United States Patent 11,078,247 (RNA ENCODING A THERAPEUTIC PROTEIN) - sequence listing, part 18

SEQ ID NO: 32581 - RNA, 1191 nt, Artificial Sequence
  derived and/or modified sequence opt1 from MAEA__Homo_sapiens__NP_001017405
auggccgugcaggagagcgccgcgcagcuguccaugacccucaagguccaggaguaccccacccugaaggugccguacgagacgcugaacaagcgcuuccgggccgcccagaagaacaucgaccgcgagaccagccacgugaccauggucguggccgagcucgagaagacccuguccggcugccccgccguggacagcgucgugucccugcucgacgggguggucgagaagcugagcgugcugaagcggaaggcgguggaguccauccaggccgaggacgagagcgccaagcucugcaagcgccggaucgagcaccugaaggagcacuccagcgaccagcccgccgcggccuccgucuggaagcgcaagcggauggaccgcaugaugguggagcaccuccugcggugcggcuacuacaacacggccgugaagcuggcccgccagagcgggaucgaggaccuggucaacaucgagauguuccucaccgccaaggagguggaggagucccuggagcggcgcgagaccgcgaccugccuggccuggugccacgacaacaagagccggcuccgcaagaugaaguccugccuggaguucagccugcggauccaggaguucaucgagcucauccgccagaacaagcggcuggacgccgugcgccacgcccggaagcacuucucccaggccgagggcagccagcuggacgagguccgccaggcgauggggaugcucgccuucccgcccgacacgcacaucucccccuacaaggaccugcuggaccccgcccgguggcgcaugcucauccagcaguuccgcuacgacaacuaccggcugcaccagcugggcaacaacagcguguucacccucacccugcaggccggccugagcgccaucaagacgccccagugcuacaaggaggacggguccagcaaguccccggacugccccgugugcagccgcucccucaacaagcuggcgcagccccugcccauggcccacugcgccaacagccggcucgucugcaagaucuccggcgacgugaugaacgagaacaacccgcccaugaugcugcccaacggguacguguacggcuacaacagccugcucuccauccgccaggacgacaaggucgugugcccccggaccaaggaggucuuccacuucagccaggccgagaagguguacaucauguga

SEQ ID NO: 32582 - RNA, 1212 nt, Artificial Sequence
  derived and/or modified sequence opt1 from MAEL__Homo_sapiens__NP_001273306
augcccaaccgcaaggccagccggaacgccuacuacuucuucgugcaggagaagaucccggagcugcgccggcgcggccuccccgucgcgcggguggccgacgccauccccuacugcuccagcgacugggccaagcccguguucaccccgcugcgccggcccgggaugcugguccccaagcagaacguguccccgcccgacaugagcgcccucucccugaagggcgaccaggcgcugcucgggggcaucuucuacuuccugaacaucuucagccacggggagcugccgccccacugcgagcagcgcuuccuccccugcgagaucggcugcgugaaguacucccugcaggagggcaucauggccgacuuccacagcuucaucaaccccggggagaucccccggggcuuccgcuuccacugccaggccgccuccgacagcucccacaagauccccaucagcaacuucgagcgggggcacaaccaggcgaccguccugcagaaccucuaccgcuucauccaccccaacccgggcaacuggccgcccaucuacugcaaguccgacgaccggacgcgcgugaacuggugccugaagcacauggccaaggccagcgagauccggcaggaccugcagcuccugaccguggaggaccuggucguggggaucuaccagcagaaguuccucaaggagcccuccaagaccuggauccgcagccugcuggacguggccaugugggacuacuccagcaacacccggugcaaguggcacgaggagaacgacauccucuucugcgcccuggcggucugcaagaagaucgccuacugcaucuccaacagccuggccacccucuucggcauccagcugacggaggcccacgugccccugcaggacuacgaggccagcaacuccgugacccccaagauggucgugcucgacgcgggccgcuaccagaagcugcggguggggagcuccggcuucagccacuucaacuccagcaacgaggagcagcgcuccaacacccccaucggggacuaccccagccgggccaagaucuccggccagaacagcuccguccgcggccgcgggaucacgcggcugcucgagagcaucuccaacagcuccagcaacauccacaaguucuccaacugcgacaccagccuguccccguacaugagccagaaggacggcuacaagagcuucuccagccuguccuga

SEQ ID NO: 32583 - RNA, 771 nt, Artificial Sequence
  derived and/or modified sequence opt1 from MAF1__Homo_sapiens__NP_115648
augaagcugcucgagaacagcuccuucgaggccaucaacagccagcugaccguggagaccggcgacgcccacaucaucgggcgcaucgaguccuacagcugcaagauggcgggcgacgacaagcacauguucaagcaguucugccaggaggggcagccccacguccuggaggcccucuccccgccccagacgagcggccugucccccagccggcuguccaagagccagggcggggaggaggagggcccccucuccgacaagugcagccgcaagacccuguucuaccugaucgccacccucaacgaguccuuccggccggacuacgacuucagcaccgcccgcucccacgaguucagccgggagcccucccugagcuggguggugaacgccgucaacugcucccuguucagcgcggugcgcgaggacuucaaggaccucaagccccagcuguggaacgccguggacgaggagaucugccuggccgagugcgacaucuacagcuacaaccccgaccucgacuccgacccguucggggaggacggcagccugugguccuucaacuacuucuucuacaacaagcggcugaagcgcaucgucuucuucagcugccgguccaucagcggguccacguacacccccagcgaggccggcaacgagcucgacauggagcugggggaggaggagguggaggaggagucccgcagcggcggcuccggggcggaggagaccagcaccauggaggaggaccgggugcccgucaucugcaucuga

SEQ ID NO: 32584 - RNA, 1062 nt, Artificial Sequence
  derived and/or modified sequence opt1 from MAFA__Homo_sapiens__NP_963883
auggccgccgagcuggcgaugggcgccgagcuccccagcuccccgcuggccaucgaguacgugaacgacuucgaccugaugaaguucgaggucaagaaggagccgcccgaggccgagcgcuucugccaccggcucccgcccgggagccuguccagcacgccccuguccacccccugcagcuccgugcccagcucccccagcuucugcgcccccucccccggcaccgggggcgggggcggcgccgggggcgggggcgggagcucccaggcgggcggcgcccccgggccgcccagcggcgggcccggcgccgugggcgggaccuccggcaagcccgcgcucgaggaccuguacuggaugagcggguaccagcaccaccugaacccggaggcccucaaccugacccccgaggacgccgucgaggcccugaucggcuccgggcaccacggcgcccaccacggcgcgcaccaccccgccgccgccgccgcguacgaggccuuccgcgggcccggcuucgccgggggcgggggcgccgacgacaugggcgccgggcaccaccacggcgcgcaccacgccgcccaccaccaccacgccgcccaccaccaccaccaccaccaccaccaccacgggggcgcggggcacggcggcggggccggccaccacgugcggcucgaggagcgcuucagcgacgaccagcugguguccaugagcguccgggagcugaaccgccagcuccggggguucagcaaggaggaggugauccgccugaagcagaagcggcgcacccugaagaaccggggcuacgcccaguccugccgcuucaagcgggugcagcagcgccacauccucgagagcgagaagugccagcugcagucccaggucgagcagcugaagcucgaggugggccggcuggccaaggagcgcgaccuguacaaggagaaguacgagaagcucgcggggcggggcgggccgggcagcgccgggggcgccggcuucccccgcgagcccuccccgccccaggccgggcccggcggggccaagggcacggcggacuucuuccuguga

SEQ ID NO: 32585 - RNA, 972 nt, Artificial Sequence
  derived and/or modified sequence opt1 from MAFB__Homo_sapiens__NP_005452
auggccgccgagcugagcaugggccccgagcucccgaccagcccccuggcgauggaguacgugaacgacuucgaccugcucaaguucgacgucaagaaggagccccuggggcgcgccgagcggcccggccgcccgugcacccggcugcagcccgccggguccguguccagcacgccccucuccacccccugcagcuccgugccgagcucccccagcuucucccccaccgagcagaagacccaccuggaggaccuguacuggauggccagcaacuaccagcagaugaaccccgaggcccucaaccugacgccggaggacgcggucgaggcccugaucggcucccaccccgugccccagccccuccagagcuucgacuccuuccgcggggcccaccaccaccaccaccaccaccacccgcacccccaccacgccuaccccggcgcgggcguggcccacgacgagcuggggccccacgcccacccgcaccaccaccaccaccaccaggccagcccgccgcccuccagcgccgcgucccccgcccagcagcugcccaccagccaccccggccccgggccccacgccaccgccagcgccaccgcggccggcgggaacggcuccgucgaggaccgguucagcgacgaccagcucguguccaugagcgugcgcgagcugaaccggcaccuccgcggcuucacgaaggacgaggucauccggcugaagcagaagcgccggacccugaagaaccgcggguacgcccaguccugccgguacaagcgcgugcagcagaagcaccaccuggagaacgagaagacccagcucauccagcaggucgagcagcugaagcaggaggugagccggcuggcccgcgagcgggacgccuacaaggugaagugcgagaagcucgcgaacuccggcuuccgcgaggccgggagcaccuccgacagccccuccagccccgaguucuuccuguga

SEQ ID NO: 32586 - RNA, 495 nt, Artificial Sequence
  derived and/or modified sequence opt1 from MAFF__Homo_sapiens__NP_001155045
augagcguggacccccuguccagcaaggcccucaagaucaagcgcgagcuguccgagaacaccccgcaccugagcgacgaggcccucaugggccuguccguccgggagcugaaccgccaccuccgggggcugagcgcggaggaggugacccgccugaagcagcggcgccggacgcucaagaaccgcggcuacgccgccuccugccgggugaagcgcgucugccagaaggaggagcugcagaagcagaaguccgagcuggagcgggagguggacaagcucgcccgcgagaacgccgcgaugcggcuggagcuggacgcccuccgcgggaagugcgaggcccugcagggcuucgcccggagcguggcggccgcccgcgggcccgccacccuggucgcccccgcgagcgugaucaccaucgugaaguccacccccggcagcggcuccgggccggcccacggccccgaccccgcccacgggcccgccagcugcuccuga

SEQ ID NO: 32587 - RNA, 489 nt, Artificial Sequence
  derived and/or modified sequence opt1 from MAFG__Homo_sapiens__XP_011521881
augaccacccccaacaagggcaacaaggcccugaaggugaagcgcgagccgggggagaacggcacgagccucaccgacgaggagcuggucaccauguccgugcgggagcugaaccagcaccuccgcgggcugagcaaggaggagaucgugcagcugaagcagcggcgccggacccucaagaaccgcggcuacgccgcguccugccgggucaagcgcgugacgcagaaggaggagcuggagaagcagaaggccgagcugcagcaggagguggagaagcucgccagcgagaacgccuccaugaagcuggagcuggacgcccuccggagcaaguacgaggcgcugcagaccuucgcccgcaccgucgcccggucccccguggcccccgcgcgcgggccccuggccgccggccucggcccgcuggugcccgggaaggucgccgccaccagcgugaucacgaucgugaaguccaagaccgacgcgcggagcuga

SEQ ID NO: 32588 - RNA, 1122 nt, Artificial Sequence
  derived and/or modified sequence opt1 from MAF__Homo_sapiens__NP_001026974
auggccagcgagcuggccauguccaacagcgaccuccccaccuccccgcuggcgauggaguacgugaacgacuucgaccugaugaaguucgaggucaagaaggagcccguggagaccgaccgcaucaucagccagugcggccggcucaucgccgggggcucccugagcuccacgcccaugagcacccccugcuccagcgugccgcccucccccagcuucuccgcccccagcccgggguccggcagcgagcagaaggcccaccuggaggacuacuacuggaugaccggguacccccagcagcucaaccccgaggcccugggcuucucccccgaggacgcggucgaggcccugaucagcaacucccaccagcuccagggcggguucgacggcuacgcccgcggggcccagcagcuggcggccgccgccggcgccggggcgggcgccagccugggcgggagcggcgaggagauggggccggccgccgccgugguguccgcggucaucgccgccgccgccgcgcagagcggcgccggcccccacuaccaccaccaccaccaccacgccgccgggcaccaccaccaccccaccgccggcgcgcccggggccgccggcuccgccgcggccagcgccgggggcgccggcggggccggcgggggcgggccggcguccgccggcggcgggggcgggggcgggggcggcgggggcgggggcggcgccgccggggccggcggggcgcuccacccccaccacgccgccggcgggcugcacuucgacgaccgguucagcgacgagcagcuggugacgauguccgugcgcgagcucaaccggcagcugcgcggcgucagcaaggaggaggugauccggcugaagcagaagcgccggacccucaagaaccgcggcuacgcccaguccugccgguucaagcgcgugcagcagcggcacguccuggagagcgagaagaaccagcugcuccagcaggucgaccaccugaagcaggagaucucccgccuggugcgggagcgcgacgccuacaaggagaaguacgagaagcucgugagcuccggguuccgggagaacggcagcuccagcgacaaccccuccagccccgaguucuucauguga

SEQ ID NO: 32589 - RNA, 471 nt, Artificial Sequence
  derived and/or modified sequence opt1 from MAFK__Homo_sapiens__XP_006715836
augaccaccaaccccaagccgaacaaggcccugaaggugaagaaggaggccggcgagaacgcgcccguccucagcgacgacgagcugguguccaugagcgugcgcgagcugaaccagcaccuccgggggcugacgaaggaggaggucacccgccugaagcagcggcgccggacccucaagaaccgcggcuacgccgccuccugccggaucaagcgcgugacccagaaggaggagcuggagcggcagcgcguggagcugcagcaggaggucgagaagcucgcccgggagaacagcuccaugcgccuggagcuggacgcccuccggagcaaguacgaggcgcugcagacguucgcccgcaccguggcccgggggcccguggcccccuccaaggucgcgaccaccagcgugaucacgaucgugaaguccaccgagcugagcuccaccagcgucccguucuccgccgccagcuga

SEQ ID NO: 32590 - RNA, 1110 nt, Artificial Sequence
  derived and/or modified sequence opt1 from MAGEA10__Homo_sapiens__NP_001011543
augccccgcgccccgaagcggcagcgcugcaugcccgaggaggaccugcagagccaguccgagacccagggccucgagggggcccaggcgccccuggccguggaggaggacgccagcuccagcaccuccacgagcuccagcuuccccuccagcuucccguccagcuccagcuccagcuccagcuccugcuacccccugauccccagcacccccgaggaggucagcgccgacgacgagaccccgaacccgccccaguccgcccagaucgcgugcagcucccccagcgugguggccucccucccccuggaccagagcgacgagggcuccagcucccagaaggaggagagccccuccacccugcagguccuccccgacagcgagucccugccccggagcgagaucgacgagaaggugacggaccuggugcaguuccuccuguucaaguaccagaugaaggagccgaucaccaaggccgagauccuggaguccgucauccgcaacuacgaggaccacuucccccuccuguucagcgaggccuccgagugcaugcugcucguguucgggaucgacgugaaggaggucgaccccaccggccacagcuucgugcuggugaccucccuggggcucacguacgacggcaugcugagcgacguccagagcaugcccaagaccggcauccugauccucauccuguccaucaucuucaucgagggguacugcaccccggaggaggugaucugggaggcgcugaacaugaugggccucuacgacgggauggagcaccugaucuacggcgagccccggaagcugcucacccaggacugggugcaggagaacuaccuggaguaccgccagguccccgggagcgaccccgcccgguacgaguuccuguggggcccgcgcgcccacgccgagauccggaagaugucccuccugaaguuccuggccaaggugaacggcagcgacccccgcuccuucccccucugguacgaggaggcgcugaaggacgaggaggagcgggcccaggaccgcaucgccacgaccgacgacaccaccgccauggccagcgcguccagcuccgccacggggagcuucuccuaccccgaguga

SEQ ID NO: 32591 - RNA, 1203 nt, Artificial Sequence
  derived and/or modified sequence opt1 from MAGEA11__Homo_sapiens__NP_001011544
augagcaagguguccaccauguucagcgaggacgacuuccaguccaccgagcgcgcccccuacggcccgcagcugcaguggagccaggaccucccccggguccagguguuccgcgagcaggccaaccuggaggaccgguccccgcgccggacgcagcgcaucaccgggggcgagcagguccugugggggcccaucacccagaucuuccccaccgugcggcccgcggaccucacgcgcgugaucaugccccuggagcagcggagccagcacugcaagcccgaggagggccugcaggcccaggaggaggaccucgggcuggugggcgcccaggcccugcaggccgaggagcaggaggcggccuucuucuccagcacccucaacgucggcacccuggaggagcugccggccgccgagucccccuccccgccccagagcccccaggaggagagcuucucccccaccgcgauggacgccaucuucgggagccucuccgacgagggcagcgggucccaggagaaggagggccccagcacgucccccgaccugaucgacccggagagcuucagccaggacauccugcacgacaagaucaucgaccucgugcaccuccugcugcgcaaguaccgggugaaggggcugaucaccaaggccgagaugcugggcuccgucaucaagaacuacgaggacuacuuccccgagaucuuccgcgaggccagcgugugcaugcagcuccuguucggcaucgacgugaaggaggucgaccccaccucccacagcuacgugcuggugaccucccucaaccugagcuacgacgggauccagugcaacgagcaguccaugcccaagagcggccugcucaucaucguccugggggugaucuucauggagggcaacugcaucccggaggaggugaugugggagguccuguccaucaugggcguguacgccgggcgggagcacuuccucuucggcgagcccaagcgccugcugacgcagaacugggugcaggagaaguaccucgucuaccgccaggugcccgggaccgaccccgcgugcuacgaguuccuguggggcccgcgggcccacgccgagaccagcaagaugaaggugcuggaguacaucgccaacgccaacgggcgggaccccaccuccuaccccagccucuacgaggacgcgcugcgcgaggagggcgagggcgucuga

SEQ ID NO: 32592 - RNA, 945 nt, Artificial Sequence
  derived and/or modified sequence opt1 from MAGEA12__Homo_sapiens__NP_001159858
augccccuggagcagcgcagccagcacugcaagccggaggagggccucgaggcccagggggaggcccugggccuggugggggcgcaggcccccgccaccgaggagcaggagaccgccuccagcuccagcacgcucgucgaggugacccugcgggaggugcccgccgcggagucccccagcccgccccacagcccccagggcgccuccacccugcccaccacgaucaacuacacccucuggucccagagcgacgagggguccagcaacgaggagcaggagggcccguccaccuuccccgaccuggagaccagcuuccaggucgcccugucccgcaagauggccgagcucgugcacuuccugcugcucaaguaccgggcgcgcgagcccuucacgaaggccgagaugcugggcagcgugauccggaacuuccaggacuucuuccccgucaucuucuccaaggccagcgaguaccugcagcucguguucgggaucgagguggucgagguggugcgcaucggccaccuguacauccuggugaccugccucgggcuguccuacgacggccugcucggggacaaccagaucgucccgaagaccggccugcugaucaucgugcucgccaucaucgccaaggagggcgacugcgcgcccgaggagaagaucugggaggagcugagcguccuggaggccagcgacgggcgggaggacuccguguucgcccacccccgcaagcuccugacccaggaccuggugcaggagaacuaccucgaguaccggcagguccccggcagcgacccggccugcuacgaguuccugugggggccccgcgcccugguggagacguccuacgugaagguccuccaccaccuccugaagaucagcggcggcccccacaucuccuacccgccccugcacgagugggcguuccgggagggggaggaguga

SEQ ID NO: 32593 - RNA, 930 nt, Artificial Sequence
  derived and/or modified sequence opt1 from MAGEA1__Homo_sapiens__NP_004979
augagccuggagcagcgcucccuccacugcaagcccgaggaggcccuggaggcccagcaggaggcgcugggccucgugugcguccaggccgccaccagcuccagcuccccgcuggugcuggggacccucgaggaggugcccacggccggcagcaccgacccgccccaguccccgcagggggccagcgcguuccccaccaccaucaacuucacgcggcagcgccagcccuccgagggcagcuccagccgggaggaggaggggcccuccaccagcugcauccuggagucccuguuccgcgccgucaucaccaagaagguggccgaccucgugggcuuccugcugcucaaguaccgggcccgcgagcccgucaccaaggcggagaugcuggagagcgugaucaagaacuacaagcacugcuuccccgagaucuucggcaaggccuccgagagccugcagcucguguucgggaucgacgucaaggaggccgaccccacgggccacuccuacgugcuggugaccugccuggggcucagcuacgacggccugcugggggacaaccagaucaugcccaagaccggcuuccucaucaucguccuggugaugaucgccauggagggcgggcacgccccggaggaggagaucugggaggagcugagcgugauggaggucuacgacggccgggagcacuccgcguacggggagccccgcaagcuccugacccaggaccuggugcaggagaaguaccucgaguaccgccaggugcccgacagcgaccccgcccgguacgaguuccuguggggcccgcgggcccuggccgagacguccuacgucaaggugcucgaguacgugaucaaggucagcgcccgcgugcgguucuucuuccccucccugcgcgaggcggcccugcgggaggaggaggagggcguguga

SEQ ID NO: 32594 - RNA, 945 nt, Artificial Sequence
  derived and/or modified sequence opt1 from MAGEA2B__Homo_sapiens__NP_705692
augccccuggagcagcgcagccagcacugcaagccggaggagggccucgaggcccgcggggaggcccugggccuggugggggcgcaggcccccgccaccgaggagcagcagaccgccuccagcuccagcacgcucgucgaggugacccugggcgaggugcccgccgcggacucccccagcccgccccacagcccccagggggccuccuccuucagcaccaccaucaacuacacgcuguggcggcaguccgacgagggcagcuccaaccaggaggaggagggcccccggauguucccggaccucgagagcgaguuccaggccgccaucucccgcaagauggucgagcuggugcacuuccugcuccugaaguaccgggcgcgcgagcccgugaccaaggccgagaugcuggagagcguccuccggaacugccaggacuucuuccccgugaucuucuccaaggccagcgaguaccugcagcugguguucgggaucgaggucguggaggugguccccaucucccaccucuacauccuggugaccugccugggccucagcuacgacgggcugcugggcgacaaccaggugaugccgaagaccgggcuccugaucaucguccuggccaucaucgccaucgagggcgacugcgcgcccgaggagaagaucugggaggagcucagcaugcuggagguguucgagggccgcgaggacuccguguucgcccacccccggaagcugcucaugcaggaccugguccaggagaacuaccuggaguaccgccaggugcccgggagcgacccggccugcuacgaguuccucuggggcccccgggcccugaucgagacguccuacgugaagguccugcaccacacccucaagaucgggggcgagccccacaucagcuacccgccccugcacgagcgcgcccugcgggagggcgaggaguga

SEQ ID NO: 32595 - RNA, 945 nt, Artificial Sequence
  derived and/or modified sequence opt1 from MAGEA3__Homo_sapiens__NP_005353
augccccuggagcagcgcagccagcacugcaagcccgaggagggccucgaggcccgcggggaggcccugggccuggugggggcgcaggcccccgccaccgaggagcaggaggccgccuccagcuccagcacccucgucgaggugacgcugggcgaggugcccgcggccgagucccccgacccgccccagagcccccagggggccuccagccugcccaccaccaugaacuacccgcucuggucccagagcuacgaggacuccagcaaccaggaggaggagggccccuccaccuuccccgaccuggagagcgaguuccaggccgcgcugucccggaaggucgccgagcucgugcacuuccugcugcucaaguaccgggcccgcgagcccgugacgaaggccgagaugcugggcagcgucguggggaacuggcaguacuucuucccggugaucuucuccaaggccagcuccagccugcagcucgucuucggcaucgagcugauggagguggaccccaucgggcaccuguacaucuucgcgaccugccucggccugagcuacgacgggcugcucggcgacaaccagaucaugcccaaggccggccugcugaucaucgugcucgccaucaucgcccgggagggggacugcgcccccgaggagaagaucugggaggagcuguccguccuggagguguucgagggccgcgaggacagcauccucggggacccgaagaagcugcugacccagcacuucgugcaggagaacuaccucgaguaccggcagguccccggcuccgaccccgcgugcuacgaguuccuguggggcccccgcgcccugguggagaccagcuacgugaagguccuccaccacauggugaagaucuccgggggcccgcacaucagcuacccgccccugcacgagugggugcugcgggagggggaggaguga

SEQ ID NO: 32596 - RNA, 954 nt, Artificial Sequence
  derived and/or modified sequence opt1 from MAGEA4__Homo_sapiens__NP_001011549
augagcuccgagcagaagucccagcacugcaagcccgaggagggcguggaggcccaggaggaggcccuggggcucgucggcgcgcaggccccgaccaccgaggagcaggaggccgccgugagcagcuccagcccccuggugcccgggacgcuggaggagguccccgccgcggaguccgccggcccgccccagagcccccagggggccuccgcccuccccaccaccaucagcuucacgugcuggcgccagccgaacgagggcuccagcucccaggaggaggagggccccagcaccucccccgacgcggagagccuguuccgggaggcccuguccaacaagguggacgagcucgcccacuuccugcugcgcaaguaccgggccaaggagcucgugaccaaggccgagaugcuggagcgcgucaucaagaacuacaagcggugcuuccccgugaucuucgggaaggcgagcgagucccugaagaugaucuucggcaucgacgugaaggaggucgacccggccagcaacaccuacacccucgugacgugccuggggcugagcuacgacggccuccuggggaacaaccagaucuuccccaagaccggccugcucaucaucgugcugggcaccaucgccauggagggggacuccgccagcgaggaggagaucugggaggagcugggcgucauggggguguacgacggccgcgagcacaccguguacggcgagccccggaagcuccugacgcaggacuggguccaggagaacuaccuggaguaccgccaggugcccggguccaacccggcccgguacgaguuccucuggggcccccgcgcgcuggccgagaccagcuacgugaagguccuggagcacguggugcgggucaacgcccgcgugcggaucgccuaccccucccuccgcgaggccgcgcugcuggaggaggaggaggggguguga

SEQ ID NO: 32597 - RNA, 945 nt, Artificial Sequence
  derived and/or modified sequence opt1 from MAGEA6__Homo_sapiens__NP_005354
augccccuggagcagcgcagccagcacugcaagccggaggagggccucgaggcccgcggggaggcccugggccuggugggggcgcaggcccccgccaccgaggagcaggaggccgccuccagcuccagcacccucgucgaggugacgcugggcgaggugcccgcggccgagucccccgacccgccccagagcccccagggggccuccagccugcccaccaccaugaacuacccgcucuggucccagagcuacgaggacuccagcaaccaggaggaggagggccccuccaccuuccccgaccuggagagcgaguuccaggccgcgcugucccggaaggucgccaagcucgugcacuuccugcugcucaaguaccgggcccgcgagcccgugacgaaggccgagaugcugggcagcgucguggggaacuggcaguacuucuucccggugaucuucuccaaggccagcgacucccugcagcucgucuucggcaucgagcugauggagguggaccccaucgggcacguguacaucuucgcgaccugccugggccucagcuacgacgggcugcugggcgacaaccagaucaugcccaagaccggcuuccucaucaucauccuggccaucaucgccaaggagggggacugcgcccccgaggagaagaucugggaggagcugagcguccucgagguguucgagggccgggaggacuccaucuucggggacccgaagaagcugcugacccaguacuucgugcaggagaacuaccucgaguaccgccagguccccggcagcgaccccgccugcuacgaguuccuguggggcccccgggcgcugaucgagacguccuacgugaaggugcuccaccacauggucaagaucagcgggggcccgcgcaucuccuacccccugcugcacgagugggcccuccgggagggggaggaguga

SEQ ID NO: 32598 - RNA, 948 nt, Artificial Sequence
  derived and/or modified sequence opt1 from MAGEA9__Homo_sapiens__NP_005356
augagccuggagcagcgcagcccccacugcaagccggacgaggaccucgaggcccagggcgaggaccuggggcugaugggcgcccaggagcccaccggggaggaggaggagaccacguccuccagcgacuccaaggaggaggaggugagcgcggccggcuccagcuccccgccccagagcccccagggcggggccuccagcuccaucagcgucuacuacacccucuggucccaguucgacgagggcagcuccagccaggaggaggaggagcccuccagcagcguggaccccgcccagcuggaguucauguuccaggaggcccugaagcucaagguggcggagcugguccacuuccugcuccacaaguaccgggugaaggagcccgugaccaaggccgagaugcuggaguccgucaucaagaacuacaagcgcuacuucccggugaucuucgggaaggccagcgaguucaugcaggucaucuucggcaccgacgugaaggagguggaccccgccgggcacuccuacauccuggugacggcgcucggccugagcugcgacuccaugcugggggacggccacagcaugcccaaggccgcccuccugaucaucguccugggcgugauccucaccaaggacaacugcgcccccgaggaggugaucugggaggcccuguccgucauggggguguacgugggcaaggagcacauguucuacggggagccgcggaagcugcucacccaggacuggguccaggagaacuaccuggaguaccgccaggugcccggcagcgaccccgcgcacuacgaguuccuguggggcuccaaggcccacgccgagaccagcuacgagaaggugaucaacuaccucgucaugcugaacgcccgggagcccaucugcuacccgucccuguacgaggaggugcucggggaggagcaggagggcguguga

SEQ ID NO: 32599 - RNA, 1011 nt, Artificial Sequence
  derived and/or modified sequence opt1 from MAGEB17__Homo_sapiens__NP_001264236
augccccgcggccaggccagcaagcggcgcgcccgggagaagcgccggcaggcgcgcggggaggaccagugccugggcggggcccaggccaccgccgccgagaaggagaagcucccguccagcuccagccccgcgugccaguccccgccccagagcuuccccaacgccggcaucccccaggagucccagcgggccagcuaccccuccagccccgccuccgcggugagccugaccuccagcgacgagggggccaagggccagaagggcgaguccccgaacagcuuccacgggcccuccagcuccgagagcacgggccgcgaccugcucaacaccaagaccggggagcugguccaguuccugcucaacaaguacauccggaaggagcccaucacccgcgaggccaugcugaaggugaucaaccggaaguacaagcagcacuuccccgagauccugcgccggagcacggagaacguggaggucguguucggccucuaccugaaggagauggacccgucccgccagagcuacgugcuggucgggaagcucgacuuccccaaccagggcucccugagcgacggcgggggcuucccccuguccgggcuccugauggugcugcucagcaccaucuucaugcacggcaaccgggccaccgaggaggagaugugggagugccugaacgcccugggcauguacaaggggcgcaagcacuucaucuacggcgagccccaggagcucgugaccaaggaccugguccgggagggguaccuggaguaccagcaggucccguccagcgacccgccccgcuacgaguuccucuggggcccccgggcgcgcgccgagacguccaagaugaaggugcuggaguucguggccaagcugaacgacaccguggccagcaccuacaagucccgguacgaggaggcccuccgcgaggaggaggagcaggcgcgcgcccgggccguggcccgcgacagcgcccgggcgcgcgccucccggagcuuccagcccuga

SEQ ID NO: 32600 - RNA, 1044 nt, Artificial Sequence
  derived and/or modified sequence opt1 from MAGEB1__Homo_sapiens__NP_803134
augccccgcggccagaaguccaagcugcgggcccgcgagaagcggcgcaaggcccgggaggagacccaggggcucaagguggcgcacgccaccgccgccgagaaggaggagugcccgagcagcucccccguccugggcgacacgcccaccagcucccccgccgcggggaucccgcagaagccccagggcgccccgcccaccaccacggccgccgcggccgugagcugcaccgaguccgacgagggggccaagugccagggcgaggagaacgccagcuucucccaggccaccaccagcacggaguccagcgugaaggaccccgucgcgugggaggccggcaugcugaugcacuucauccuccgcaaguacaagaugcgggagcccaucaugaaggccgacaugcugaaggugguggacgagaaguacaaggaccacuucaccgagauccugaacggggccucccgccggcucgagcuggucuucggccuggaccucaaggaggacaaccccagcgggcacaccuacacccugguguccaagcugaaccucacgaacgacggcaaccugagcaacgacugggacuucccccgcaacgggcugcucaugccgcugcugggcgugaucuuccucaagggcaacuccgccaccgaggaggagaucuggaaguucaugaacguccugggggcguacgacggcgaggagcaccugaucuacggggagccccggaaguucaucacccaggaccucgugcaggagaaguaccugaaguacgagcagguccccaacagcgacccgccccgcuaccaguuccuguggggcccccgggccuacgccgagaccacgaagaugaaggugcucgaguuccuggccaagaugaacggcgccacgccccgcgacuuccccucccacuacgaggaggcgcugcgggacgaggaggagcgcgcccaggugcggagcagcgugcgcgcccggcgccggaccaccgccaccaccuuccgcgcccgcucccgggcgccguucagccgcuccagccaccccauguga

SEQ ID NO: 32601 - RNA, 960 nt, Artificial Sequence
  derived and/or modified sequence opt1 from MAGEB2__Homo_sapiens__NP_002355
augccccgcggccagaaguccaagcugcgggcccgcgagaagcggcgcaaggcccgggacgagacccgcgggcucaacgugccgcaggucaccgaggcggaggaggaggaggcccccugcugcagcagcuccgugagcggcggggccgccuccagcucccccgccgcgggcaucccccaggagccgcagcgggcccccacgaccgccgccgcggccgccgccggggugagcuccaccaagagcaagaagggcgccaagucccaccagggcgagaagaacgcgagcuccagccaggccuccaccagcacgaagucccccagcgaggacccccugacccgcaaguccgggagccugguccaguuccuccuguacaaguacaagaucaagaaguccgugaccaagggcgagaugcugaagaucguggggaagcgguuccgcgagcacuucccggagauccucaagaaggccagcgagggccugagcgucguguucgggcuggagcucaacaaggugaaccccaacggccacaccuacacguucaucgacaaggucgaccugaccgacgaggagucccugcucagcuccugggacuucccccggcgcaagcugcugaugccccuccugggcgugaucuuccugaacgggaacagcgccaccgaggaggagaucugggaguuccucaacaugcugggcguguacgacggggaggagcacuccgucuucggcgagccguggaagcugaucaccaaggaccucgugcaggagaaguaccuggaguacaagcagguccccagcuccgacccgccccgguuccaguuccuguggggcccccgcgccuacgcggagacgagcaagaugaaggugcucgaguuccuggccaaggugaacgggaccacccccugcgccuuccccacccacuacgaggaggcccugaaggacgaggagaaggccggcguguga

SEQ ID NO: 32602 - RNA, 1224 nt, Artificial Sequence
  derived and/or modified sequence opt1 from MAGEB6__Homo_sapiens__NP_775794
augccccgcggccacaagagcaagcugcggaccugcgagaagcgccaggagaccaacgggcagccgcagggccucacggggccccaggccaccgccgagaagcaggaggagucccacagcuccagcuccagcucccgggcgugccugggcgacugccgccggagcuccgacgccagcaucccccaggagucccagggggugagccccaccggcuccccggacgccgucgugagcuacuccaagagcgacguggccgccaacggccaggacgagaagucccccagcaccucccgcgacgcgagcgucccccaggagagccagggggccucccccacgggcagcccggacgccgggguguccggcagcaaguacgacguggccgcgaacgggcaggacgagaagucccccagcaccucccacgacgucagcgugccccaggagucccagggcgccagccccaccggcuccccggacgccggggugagcggcuccaaguacgacgucgccgccgagggggaggacgaggagagcguguccgcgagccagaaggccaucaucuucaagcggcuguccaaggacgccgugaagaagaaggccugcacccucgcccaguuccugcagaagaaguucgagaagaaggagagcauccugaaggcggacaugcucaagugcguccgccgggaguacaagcccuacuucccccagauccugaaccgcacgucccagcaccuggugguggccuucggcgucgagcucaaggagauggacagcagcggcgaguccuacacccuggugagcaagcuggggcuccccuccgagggcauccugagcggggacaacgcccugccgaaguccggccuccugaugagccugcucguggucaucuucaugaacgggaacugcgccaccgaggaggaggugugggaguuccugggccugcucggcaucuacgacgggauccugcacuccaucuacggcgacgcccggaagaucaucaccgaggaccuggugcaggacaaguacgucguguaccgccaggugugcaacagcgacccgcccugcuacgaguuccucugggggccccgggcguacgccgagacgaccaagaugcgcguccugcgggugcuggccgacuccagcaacaccucccccggccucuacccccaccuguacgaggacgcccugaucgacgaggucgagcgcgcccuccggcugcgcgcguga

SEQ ID NO: 32603 - RNA, 3429 nt, Artificial Sequence
  derived and/or modified sequence opt1 from MAGEC1__Homo_sapiens__NP_005453
augggcgacaaggacaugcccaccgccgggaugccgagccugcuccaguccagcuccgagagcccccaguccugccccgagggcgaggacagccagagcccccugcagaucccgcagagcucccccgagagcgacgacacccuguacccccuccagagcccccagucccgcuccgagggggaggacagcuccgacccgcugcagcggccgcccgagggcaaggacagccagagcccccugcagaucccccaguccucccccgagggggacgacacgcagagcccccuccagaacagccaguccagccccgagggcaaggacucccugagcccgcuggagaucucccagagcccgcccgagggcgaggacgugcagagcccccuccagaaccccgccuccuccuucuucagcuccgcgcugcugagcaucuuccaguccagccccgaguccacccagagccccuucgagggguucccccaguccguccuccagaucccggugagcgccgccuccagcagcacccugguguccaucuuccagagcucccccgagagcacccagucccccuucgagggcuucccccagagcccgcugcagauccccgucucccgcagcuucuccagcacgcuccuguccaucuuccagagcucccccgagcggacccagagcaccuucgagggguucgcccaguccccgcugcagauccccgugagccccuccagcagcuccacccuccugagccuguuccaguccuucagcgagcgcacgcaguccaccuucgagggcuucgcccagagcucccuccagauccccgugagcccguccuucagcuccacccuggucagccuguuccaguccagccccgagcggacccaguccacguucgagggguucccccagagcccccuccagaucccgguguccagcuccagcagcuccacccugcugagccucuuccaguccagccccgagcgcacccacuccaccuucgagggcuucccccagagccugcugcagauccccaugacguccagcuucuccagcacccuccuguccaucuuccagagcuccccggagagcgcgcaguccaccuucgagggcuucccccagagcccccugcagauccccggguccccgagcuucuccagcacccuccugagccuguuccaguccagccccgagcggacgcacuccaccuucgagggcuucccccagagcccccuccagaucccgaugaccuccagcuucuccagcacccugcuguccauccuccagagcucccccgagagcgcccaguccgccuucgagggguucccccagagcccccugcagaucccgguguccagcuccuucagcuacacgcugcucucccuguuccagagcagccccgagcgcacccacuccaccuucgagggcuucccccagagcccgcugcagauccccgucuccagcuccagcuccagcuccacccuccugagccuguuccaguccagccccgagugcacgcaguccaccuucgagggcuucccccagagcccgcuccagaucccccaguccccgcccgagggggagaacacccacagcccccugcagaucgugcccucccugcccgagugggaggacagccugagcccccacuacuucccgcaguccccgccccagggcgaggacagccucagcccccacuacuucccccaguccccgccccagggggaggacucccugagcccccacuacuucccccagagcccccagggcgaggacucccugagcccccacuacuucccccaguccccgccccagggggaggacuccaugagcccccucuacuucccccaguccccgcugcagggcgaggaguuccagagcucccugcagagccccguguccaucugcagcuccagcacccccuccagccucccgcagagcuuccccgaguccagccaguccccgcccgagggccccguccagagcccccugcacagcccccaguccccgcccgaggggaugcacucccagagcccccugcagucccccgaguccgcccccgagggcgaggacucccucagcccgcugcagaucccccagagcccccuggagggggaggacucccucuccagccugcacuucccccaguccccgcccgagugggaggacagccugagcccccuccacuucccccaguucccgccccagggcgaggacuuccaguccagccugcagucccccgugagcaucugcuccagcuccacgagccugucccucccccagagcuucccggagagcccccaguccccgcccgaggggcccgcgcagagcccccugcagcggcccguguccuccuucuucagcuacacccuggccucccuccugcagagcucccacgagagcccgcagagcccgcccgagggccccgcccagagcccccugcagucccccgucuccagcuuccccuccagcaccuccagcucccucagccaguccagccccguguccagcuucccguccagcaccuccagcucccugagcaagagcucccccgagagcccccugcagucccccgugaucagcuucuccagcuccacgagccucuccccguucagcgaggaguccagcucccccgucgacgaguacaccagcuccagcgacacccugcuggaguccgacagccucaccgacuccgagagccugaucgagagcgagccccuguucaccuacacgcucgacgagaagguggacgagcuggcccgcuuccugcuccugaaguaccaggugaagcagcccaucaccaaggccgagaugcugaccaacgucaucucccgguacaccggcuacuucccggugaucuuccgcaaggcgcgggaguucaucgagauccucuucgggaucagccugcgcgagguggaccccgacgacuccuacgucuucgugaacacgcuggaccucaccagcgagggcugccuguccgacgagcaggggaugagccagaaccggcugcucauccugauccuguccaucaucuucaucaagggcaccuacgccagcgaggaggucaucugggacgugcucuccgggaucggcgugcgcgccggccgggagcacuucgccuucggggagccccgcgagcugcugaccaaggucugggugcaggagcacuaccucgaguaccgggaggugcccaacagcuccccgccccgcuacgaguuccuguggggcccccgggcccacagcgaggucaucaagcgcaaggugguggaguuccuggcgaugcucaagaacacgguccccaucaccuucccguccagcuacaaggacgcccugaaggacguggaggagcgcgcccaggccaucaucgacaccaccgacgacuccacggccaccgagagcgcguccagcuccgugaugagccccagcuucuccagcgaguga

SEQ ID NO: 32604 - RNA, 1122 nt, Artificial Sequence
  derived and/or modified sequence opt1 from MAGEC2__Homo_sapiens__NP_057333
augccgcccgugcccggcguccccuuccgcaacguggacaacgacagccccaccuccguggagcuggaggacugggucgacgcccagcaccccaccgacgaggaggaggaggaggccagcuccgcgagcuccacgcucuaccugguguucagccccuccagcuucuccaccagcuccagccugauccucgggggccccgaggaggaggaggugcccuccggggucaucccgaaccugaccgagagcauccccuccagcccgccccagggcccgccccaggggcccucccagagcccccuguccagcugcugcagcuccuucagcugguccagcuucuccgaggagagcuccagccagaagggcgaggacaccggcacgugccaggggcucccggacuccgagagcuccuucaccuacacccuggacgagaagguggccgagcugguggaguuccuccugcugaaguacgaggccgaggagcccgucaccgaggccgagaugcucaugaucgugaucaaguacaaggacuacuuccccgugauccugaagcgggcccgcgaguucauggagcuccuguucggccuggcgcugaucgaggucgggcccgaccacuucugcguguucgccaacacggugggccucaccgacgaggggagcgacgacgagggcaugccggagaacucccugcugaucaucauccucagcgucaucuucaucaagggcaacugcgccuccgaggaggugaucugggaggugcugaacgccgucgggguguacgcgggccgggagcacuucguguacggggagccccgcgagcugcucaccaaggucugggugcagggccacuaccuggaguaccgggaggugccccacagcuccccgcccuacuacgaguuccuguggggcccccgcgcccacagcgaguccaucaagaagaagguccucgaguuccuggccaagcugaacaacaccgugcccagcagcuuccccuccugguacaaggacgcccucaaggacgucgaggagcgggugcaggccacgaucgacaccgcggacgacgccaccgugauggccagcgagucccugagcgucauguccagcaacguguccuucagcgaguga

SEQ ID NO: 32605 - RNA, 1932 nt, Artificial Sequence
  derived and/or modified sequence opt1 from MAGEC3__Homo_sapiens__NP_619647
augcugcuccccugccacugggugcuggacgccaccuucagcgacggcucccuggggcagugggucaagaacaccugcgccacguacgcgcucagcccgguggugcugcccccccagccccagccgcgcaagaaggccaccgacaaggacuacuccgccuuccaccugggccaccuccgggagguccgccuguuccugcgggggggcaccagcgaccagcgcauggacucccucgugcugugccccaccuacuucaagcuguggcggacgcucagcgggucccccggccugcagcugagcgaccuccacuucggcucccagcccgaggggaaguucagccugcgccgggccguguccgucaagcagcgcgaggagccgcaggacuggccccugaacgagaagcggacccucuggaaggacagcgaccugcccaccuggcgccggggcaccggguacacgcugucccuccccgccgugagcccgggcaagcgccuguggggggagaaggcgggcucccugcccgagagcgagccccucuucaccuacacccuggacgagaagguggacaagcugguccaguuccuccugcugaaguaccaggccaaggagccccucacccgggccgagaugcagaugaacgugaucaacacguacaccggcuacuucccgaugaucuuccgcaaggcccgggaguucaucgagauccuguucgggaucucccugaccgagguggaccccgaccacuucuacgucuucgugaacacccucgaccugacgugcgagggcagccuguccgacgagcaggggaugccccagaaccgccuccugauccugauccucagcgugaucuucaucaagggcaacugcgcgagcgaggaggucaucugggaggugcugaacgccaucggccccugguccgcccuggccggguucgccgacgugcucagccggcuggcgcugugggaguccgagggcccggaggccuucugcgaggagagcgggcuccgcuccgccgagggcagcguccuggaccuggccaacccccaggggcucgccggccaccggcaggaggacggccgccgggggcugaccgaggcguccccccagcagaagaagggcggggaggacgaggacaugcccgccgccggcaugccgccccugccccagagccccccggagauccccccccaggggccgcccaagaucuccccccagggccccccgcagagccccccccaguccccccuggacagcugcuccagcccgcuccuguggacccgccuggacgaggaguccagcuccgaggaggaggacaccgccacguggcacgcccuccccgagagcgagucccugccccgcuacgcgcuggacgagaagguggccgagcucgugcaguuccugcugcucaaguaccagaccaaggagcccgucaccaaggccgagaugcugaccacggugaucaagaaguacaaggacuacuucccgaugaucuucggcaaggcccacgaguucaucgagcugaucuucgggaucgcccucaccgacauggaccccgacaaccacagcuacuucuucgaggacacccuggaccugaccuacgagggcagccucaucgacgaccaggggaugcccaagaacugccugcugauccucauccuguccaugaucuucaucaagggcagcugcgugcccgaggaggucaucugggaggugcuguccgcgaucgggccgauccagcggcccgcccgcgagguccucgaguuccugagcaagcuguccagcaucauccccuccgccuuccccagcugguacauggacgcccucaaggacauggaggaccgggcgcaggccaucaucgacacgaccgacgacgccaccgccauggccuccgcgagcccguccgugaugagcaccaacuucugccccgaguga

SEQ ID NO: 32606 - RNA, 2337 nt, Artificial Sequence
  derived and/or modified sequence opt1 from MAGED1__Homo_sapiens__NP_001005332
auggcccagaagauggacugcggcgccgggcugcucggcuuccaggcggaggccagcguggaggacuccgcccugcugaugcagacccucauggaggccauccagaucagcgaggcccccccgaccaaccaggcgacggccgccgccuccccccagagcucccagccccccaccgcgaacgagauggccgacauccaggucagcgccgccgccgcgcgcccgaaguccgccuucaaggugcagaacgccaccaccaaggggcccaacggcguguacgacuucagccaggcccacaacgccaaggacguccccaacacgcagcccaaggcggccuucaagucccagaacgccaccccgaaggggcccaacgccgccuacgacuucagccaggcggccaccaccggcgagcuggccgccaacaaguccgagauggccuucaaggcgcagaacgccacgaccaaggugggccccaacgccaccuacaacuucagccagucccugaacgccaacgaccucgcgaacagccggcccaagaccccguucaaggccuggaacgacacgaccaaggcccccaccgccgacacccagacgcagaacgugaaccaggccaagauggcgaccucccaggccgacaucgagaccgaccccgggaucagcgagcccgacggcgccaccgcccagacguccgccgacgggagccaggcgcagaaccuggagucccgcaccaucauccggggcaagcgcacccggaagaucaacaaccugaacgucgaggagaacagcagcggggaccagcgccgggccccgcucgccgccggcaccuggcgcuccgcccccgugcccgugacgacccagaaccccccgggcgcgccccccaacguccuguggcagaccccccuggccuggcagaacccgagcggguggcagaaccagaccgcccggcagacgccccccgcccgccagucccccccggcgcggcagaccccccccgccuggcagaacccgguggccuggcagaaccccgugaucuggcccaaccccgucaucuggcagaacccggugaucuggcccaaccccaucguguggcccggcccggucguguggcccaacccccucgccuggcagaaccccccgggguggcagaccccccccggcuggcagacccccccgggcuggcaggggccccccgacuggcagggccccccggacuggccccugccccccgacuggccgcugccccccgacuggccgcuccccacggacuggccccugcccccggacuggauccccgccgacuggcccauccccccggacuggcagaaccugcgccccagccccaaccuccggcccuccccgaacagccgcgcgucccagaaccccggggccgcccagccccgggacguggcccugcugcaggagcgcgccaacaagcucgucaaguaccugaugcugaaggacuacaccaaggugcccaucaagcggagcgagaugcuccgcgacaucauccgggaguacaccgacguguacccggagaucaucgagcgcgcgugcuucguccuggagaagaaguucggcauccagcugaaggagaucgacaaggaggagcaccucuacauccugaucuccacccccgagagccuggccgggauccucggcacgaccaaggacacccccaagcugggccugcuccuggugauccugggggugaucuucaugaacggcaaccgggccuccgaggccguccucugggaggcccugcgcaagauggggcugcgccccggcgugcggcacccgcuccugggggaccugcgcaagcuccugaccuacgaguucgucaagcagaaguaccuggacuaccggcgcgugcccaacagcaacccccccgaguacgaguuccucuggggccugcgguccuaccacgagaccagcaagaugaaggugcugcgcuucaucgcggagguccagaagcgggacccgcgcgacuggacggcccaguucauggaggccgccgacgaggcgcucgacgcccuggacgccgccgccgcggaggccgaggcccgggccgaggcccgcacccggaugggcaucggggacgaggcgguguccggccccuggagcugggacgacaucgaguucgagcugcugaccugggacgaggagggggacuucggcgaccccuggucccgcauccccuucaccuucugggcccgguaccaccagaacgcccgcagccgguucccgcagacguucgccgggcccaucaucggccccggcgggaccgccuccgcgaacuucgccgccaacuucggcgccaucggguucuucuggguggaguga

SEQ ID NO: 32607 - RNA, 1821 nt, Artificial Sequence
  derived and/or modified sequence opt1 from MAGED2__Homo_sapiens__NP_055414
augagcgacaccuccgagagcggcgccgggcugacccgcuuccaggccgaggcguccgagaaggacagcuccagcaugaugcagacgcugcugaccgugacccagaacgucgaggugcccgagaccccgaaggccuccaaggcccuggaggugagcgaggacgucaagguguccaaggccagcggcguguccaaggccacggaggucagcaagacccccgaggcgcgggaggcccccgccacccaggccuccagcaccacgcagcucaccgacacccaggugcuggcggccgagaacaagucccuggccgccgacaccaagaagcagaacgccgacccccaggcggugacgaugccggccaccgagaccaagaaggucagccacguggccgacaccaaggugaacacgaaggcccaggagaccgaggccgcgcccucccaggcccccgccgacgagcccgagccggagagcgccgccgcgcagucccaggagaaccaggacacccgccccaaggucaaggccaagaaggcccggaaggugaagcaccucgacggggaggaggacggcagcagcgaccagucccaggccagcgggaccacgggcggccgccggguguccaaggcccugauggcgagcauggcccgccgggccucccgcgggcccaucgccuucugggcgcggcgcgccagccggacccgccuggccgccugggcccggcgcgcgcuccugucccugcggagccccaaggcccgccggggcaaggcccgccggcgcgccgccaagcuccaguccagccaggagccggaggcgcccccgccccgggacgucgcccugcugcaggggcgcgccaacgaccucgugaaguaccugcuggccaaggaccagaccaagauccccaucaagcgcuccgacaugcucaaggacaucaucaaggaguacaccgacguguaccccgagaucaucgagcgggccggcuacagccuggagaaggucuucgggauccagcugaaggagaucgacaagaacgaccaccucuacauccugcuguccacgcucgagcccaccgacgcgggcauccugggcaccaccaaggacagccccaagcuggggcuccugauggugcugcucuccaucaucuucaugaacggcaaccgcagcuccgaggccgugaucugggagguccugcggaagcuggggcuccgcccgggcauccaccacagccuguucggcgacgugaagaagcugaucacggacgaguucgugaagcagaaguaccucgacuacgcccggguccccaacuccaacccgcccgaguacgaguucuucugggggcugcgcagcuacuacgagaccagcaagaugaaggugcugaaguucgccugcaagguccagaagaaggaccccaaggagugggcggcccaguaccgggaggccauggaggccgaccucaaggccgcggccgaggccgccgccgaggcgaaggcccgcgccgagauccgggcccgcaugggcaucgggcugggcuccgagaacgccgcggggcccugcaacugggacgaggccgacaucggccccugggccaaggcccggauccaggcgggcgccgaggccaaggccaaggcccaggagagcggguccgcgagcaccggcgccuccaccagcacgaacaacuccgccagcgccuccgccagcaccuccgggggcuucagcgcgggggccucccugaccgccacccucacguucggccuguucgccggccucgggggcgccggggcgagcaccuccggcagcuccggggccugcggcuucagcuacaaguga

SEQ ID NO: 32608 - RNA, 2226 nt, Artificial Sequence
  derived and/or modified sequence opt1 from MAGED4B__Homo_sapiens__NP_110428
auggccgagggcagcuucuccgugcagagcgaguccuacagcgucgaggacauggacgagggguccgacgaggugggcgaggaggagaugguggaggggaacgacuacgaggaguucggcgccuucgggggcuacggcacccugaccagcuucgacauccacauccuccgcgcguucgggucccugggccccgggcugcggauccucagcaacgagccgugggagcuggagaaccccguccuggcccagacgcucguggaggcccugcagcuggaccccgagacccucgccaacgagaccgccgcgcgcgccgccaacguggcccgggcggccgccuccaaccgcgccgcccgggcggccgccgccgccgcgcgcaccgccuucagccaggucguggccucccaccggguggccacgccccaggucagcggcgaggacacccagccgaccaccuacgccgcggaggcccaggggcccacgcccgagcccccgcuggccagcccccagaccagccagaugcuggugaccuccaagauggccgcccccgaggcgcccgccaccagcgcccagucccagacgggcagcccggcccaggaggcggccaccgagggccccuccagcgccugcgccuucagccaggcccccugcgcgcgcgagguggacgccaaccggcccuccaccgccuuccucgggcagaacgacgucuucgacuucacccagccggccggcgugagcgggauggccuucccccgccccaagcggcccgcgccggcccaggaggccgccacggagggccccuccgccgcgagcggcgugccccagaccgggcccggccgcgaggucgccgccacccggccgaagaccacgaaguccgggaaggcccuggcgaagacccgcuggguggagccccagaacguggucgccgccgccgccgcgaaggccaagauggccaccagcauccccgagcccgagggcgccgccgcggccaccgcccagcacuccgccgagccgugggcccggaugggcgggaagcgcacgaagaaguccaagcaccuggacgacgaguacgaguccagcgaggaggagcgggagacccccgcggugcccccgaccuggcgcgccucccagcccagccucaccgugcgggcccagcuggccccgcgcccgcccauggcgccccggucccagauccccagccgccacguccugugccucccgccccgcaacgugacgcugcugcaggagcgggccaacaagcucgugaaguaccugaugaucaaggacuacaagaagauccccaucaagcgcgccgacaugcugaaggacgucauccgggaguacgacgagcacuuccccgagaucaucgagcgcgccaccuacacccucgagaagaaguucggcauccaccugaaggagaucgacaaggaggagcaccuguacauccucgugugcacccgggacuccagcgcccgccugcuggggaagacgaaggacacgccccggcucucccugcugcucgucauccugggcgugaucuucaugaacgggaaccgcgcgagcgaggccgugcugugggaggcccuccggaagaugggccugcgccccgggguccggcaccccuuccugggcgaccuccgcaagcugaucaccgacgacuucgugaagcagaaguaccuggaguacaagaagauccccaacuccaacccgcccgaguacgaguuccucuggggccugcgggcccgccacgagaccagcaagaugcgggugcugcgcuucaucgcccagaaccagaaccgggacccccgcgaguggaaggcgcacuuccucgaggccgucgacgacgccuucaagaccauggacguggacauggccgaggagcacgcccgggcgcagaugcgcgcccagaugaacaucggggacgaggcccugaucggccgcuggagcugggacgacauccagguggagcugcucaccugggacgaggacggggacuucggcgacgccugggcccggauccccuucgcguucugggcccgcuaccaccaguacauccugaacuccaaccgggccaaccgccgggccaccuggcgcgcgggggucagcuccggcaccaacggcggggccagcaccuccgugcuggacggccccagcacguccagcaccauccggacccgcaacgccgcccgggccggggcguccuucuucagcuggauccagcaccgcuga

SEQ ID NO: 32609 - RNA, 2220 nt, Artificial Sequence
  derived and/or modified sequence opt1 from MAGED4__Homo_sapiens__NP_001092270
auggccgagggcagcuucuccgugcagagcgaguccuacagcgucgaggacauggacgagggguccgacgaggugggcgaggaggagaugguggaggggaacgacuacgaggaguucggcgccuucgggggcuacggcacccugaccagcuucgacauccacauccuccgcgcguucgggucccugggccccgggcugcggauccucagcaacgagccgugggagcuggagaaccccguccuggcccagacgcucguggaggcccugcagcuggaccccgagacccucgccaacgagaccgccgcgcgcgccgccaacguggcccgggcggccgccuccaaccgcgccgcccgggcggccgccgccgccgcgcgcaccgccuucagccaggucguggccucccaccggguggccacgccccaggucagcggcgaggacacccagccgaccaccuacgccgcggaggcccaggggcccacgcccgagcccccgcuggccagcccccagaccagccagaugcuggugaccuccaagauggccgcccccgaggcgcccgccaccagcgcccagucccagacgggcagcccggcccaggaggcggccaccgagggccccuccagcgccugcgccuucagccaggcccccugcgcgcgcgagguggacgccaaccggcccuccaccgccuuccucgggcagaacgacgucuucgacuucacccagccggccggcgugagcgggauggccuucccccgccccaagcggcccgcgccggcccaggaggccgccacggagggccccuccgccgcgagcggcgugccccagaccgggcccggccgcgaggucgccgccacccggccgaagaccacgaaguccgggaaggcccuggcgaagacccgcuggguggagccccagaacguggucgccgccgccgccgcgaaggccaagauggccaccagcauccccgagcccgagggcgccgccgcggccaccgcccagcacuccgccgagccgugggcccggaugggcgggaagcgcacgaagaaguccaagcaccuggacgacgaguacgaguccagcgaggaggagcgggagacccccgcggugcccccgaccuggcgcgccucccagcccagccucaccgugcgggcccagcuggccccgcgcccgcccauggcgccccggucccagauccccagccgccacguccugugccucccgccccgcaacgugacgcugcugcaggagcgggccaacaagcucgugaaguaccugaugaucaaggacuacaagaagauccccaucaagcgcgccgacaugcugaaggacgucauccgggaguacgacgagcacuuccccgagaucaucgagcgcgccaccuacacccucgagaagaaguucggcauccaccugaaggagaucgacaaggaggagcaccuguacauccucgugugcacccgggacuccagcgcccgccugcuggggaagacgaaggacacgccccggcucucccugcugcucgucauccugggcgugaucuucaugaacgggaaccgcgcgagcgaggccgugcugugggaggcccuccggaagaugggccugcgccccgggguccggcaccccuuccugggcgaccuccgcaagcugaucaccgacgacuucgugaagcagaaguaccuggaguacaagaagauccccaacuccaacccgcccgaguacgaguuccucuggggccugcgggcccgccacgagaccagcaagaugcgggugcugcgcuucaucgcccagaaccagaaccgggacccccgcgaguggaaggcgcacuuccucgaggccgucgacgacgccuucaagaccauggacguggacauggccgaggagcacgcccgggcgcagaugcgcgcccagaugaacaucggggacgaggcccugaucggccgcuggagcugggacgacauccagguggagcugcucaccugggacgaggacggggacuucggcgacgccugggcccggauccccuucgcguucugggcccgcuaccaccaguacauccugaacuccaaccgggccaaccgccgggccaccuggcgcgcgggggucagcuccggcaccaacggcggggccagcaccuccgugcuggacggccccagcacguccagcaccauccggacccgcaacgccgcccgggccggggcguccuucuucagcuggauccaguga

SEQ ID NO: 32610 - RNA, 2874 nt, Artificial Sequence
  derived and/or modified sequence opt1 from MAGEE1__Homo_sapiens__NP_065983
augagccuggugucccagaacagccgccggcgccggcgccgggucgccaaggccaccgcgcacaacuccagcuggggcgagaugcaggcccccaacgccccggggcuccccgccgacgugcccggcuccgacgugccccaggggccgagcgacucccagauccugcagggccugugcgccagcgaggggcccuccaccagcguccuccccacguccgcggagggccccagcaccuucgugccgcccaccaucuccgaggccagcuccgccagcggccagcccaccaucuccgaggggcccggcacgagcgugcugccgacccccuccgaggggcugagcaccagcggcccgcccaccaucuccaaggggcucugcacgagcgucacccuggccgcguccgagggccgcaacaccagccggccgcccaccuccagcgaggagcccuccacgagcgugccgcccaccgccuccgaggugcccagcaccucccugccgcccacccccggcgaggggacgagcaccuccgucccgcccaccgccuacgagggccccagcaccuccguggugcccacgcccgacgaggggcccagcaccuccguccuccccacccccggcgagggccccgggaccagcgugccccuggccgccacggagggccuguccaccagcgugcaggcgaccccggacgaggggcccagcaccuccgucccgcccacggccaccgagggccucagcacccccgugccgcccacccgcgacgaggggcccuccacgagcgugcccgccacccccggcgagggccccuccaccagcguccugcccgccgccuccgacgggcagagcaucucccuggugccgacccggggcaaggggagcuccacgagcgugccgcccaccgcgaccgagggccucuccaccagcguccagcccaccgccggggagggcuccagcacguccgugccgcccacccccggcgggggccugagcaccagcgugccgcccaccgccacggaggagcuguccaccagcgucccgcccacccccggggagggccccuccaccagcgugcuccccauccccggggagggccuguccacgagcgucccgcccaccgccuccgacggcagcgacaccuccgugccgcccacccccggggagggcgccagcacgcuggugcagcccaccgcgcccgacgggcccggcuccagcguccuccccaaccccggcgaggggcccuccacccuguucagcuccagcgccuccguggaccgcaaccccagcaagugcucccuggugcucccgagcccccgggucaccaaggccagcguggacuccgacagcgagggccccaagggggccgagggccccaucgaguucgaggugcugcgcgacugcgaguccccgaacagcaucuccaucauggggcugaacacgagccgggucgccaucacccucaagccccaggaccccauggagcagaacguggcggagcugcugcaguuccuccuggugaaggaccaguccaaguaccccauccgcgagagcgagaugcgggaguacaucgucaaggaguaccgcaaccaguucccggagauccugcggcgcgccgccgcccaccucgagugcaucuuccgguucgagcugcgcgagcuggaccccgaggcgcacaccuacauccuccugaacaagcugggccccgugcccuucgagggccucgaggaguccccgaacgggcccaagaugggccugcugaugaugauccucgggcagaucuuccugaacggcaaccaggccaaggaggccgagaucugggagaugcuguggcggaugggggugcagcgcgagcgccggcucagcaucuucggcaaccccaagcgccugcuguccgucgaguucguguggcagcgguaccucgacuaccgcccggugaccgacugcaagcccgucgaguacgaguucuucuggggcccccggagccaccuggagacgaccaagaugaagauccugaaguucauggccaagaucuacaacaaggaccccauggacuggccggagaaguacaacgaggcccuggaggaggacgcggcccgcgccuucgccgagggguggcaggcccucccccacuuccggcgccccuucuucgaggaggcggccgccgaggugcccuccccggacagcgagguguccagcuacuccagcaaguacgcgccccacuccuggcccgagagccggcuggagagcaaggcccgcaagcugguccagcuguuccuccugauggacuccaccaagcuccccaucccgaagaagggcauccuguacuacaucgggcgggagugcagcaagguguuccccgaccugcucaaccgcgccgcccggacccugaaccacguguacggcacggagcuggucgugcucgacccccgcaaccacuccuacacccuguacaaccggcgcgagauggaggagaccgaggagaucguggacagccccaaccggccggggaacaacuuccugaugcagguccucuccuucaucuucaucaugggcaaccacgcccgcgagagcgccgugugggcguuccugcggggccugggggugcaggccggccgcaagcacgucaucacgugccgcuaccucucccagcgguacaucgacagccugcgcgugcccgacuccgaccccgugcaguacgaguucgucugggggccccgggcccgccuggagaccagcaagaugaaggcccuccgguacguggcccgcauccaccggaaggagccgcaggacuggccccagcaguaccgcgaggcgauggaggacgaggccaaccgggccgacgugggccaccgccagaucuucguccacaacuuccgguga

SEQ ID NO: 32611 - RNA, 660 nt, Artificial Sequence
  derived and/or modified sequence opt1 from MAGEH1__Homo_sapiens__NP_054780
augccccgcggccgcaagagccggcggcgccggaacgcccgcgccgcggaggagaaccggaacaaccgcaagauccaggccuccgaggccagcgagaccccgauggccgccuccguggucgcgagcacccccgaggacgaccuguccgggcccgaggaggaccccagcacgccggaggaggccuccaccacccccgaggaggccagcuccaccgcccaggcgcagaagcccagcgugccccgguccaacuuccagggcacgaagaagucccuccugaugagcauccuggcccucaucuucaucauggggaacagcgccaaggaggcccugguguggaagguccugggcaagcucgggaugcagccgggccgccagcacuccaucuucggcgaccccaagaagaucgugaccgaggaguucgugcggcgcggguaccugaucuacaagcccgucccccggagcuccccgguggaguacgaguucuucuggggcccccgcgcccacguggagagcuccaagcugaaggucaugcacuucguggcgcgggugcgcaaccggugcagcaaggacuggcccugcaacuacgacugggacagcgacgacgacgccgaggucgaggccauccucaacuccggggcccgcggcuacagcgcccccuga

SEQ ID NO: 32612 - RNA, 3750 nt, Artificial Sequence
  derived and/or modified sequence opt1 from MAGEL2__Homo_sapiens__NP_061939
augagccagcuguccaagaaccucggcgacagcucccccccggccgaggcccccaagccccccguguacagccgcccgaccguccugaugcgggcgccccccgccuccagccgcgcccccccggugcccugggacccccccccgaucgaccugcaggccucccucgccgcguggcaggccccccagcccgccugggaggccccccaggggcagcugccggcgcccgugguccccaugacccagcccccggcccugggcgggcccaucgugcccgcccccccgcucggcgggcccaugggcaagccccccacgccgggcgugcugaugguccacccccccccgcccggggcccccauggcccagcccccgacccccggcgugcugauggugcaccccagcgcgcccggggccccgauggcccaccccccccccccgggcacccccaugucccacccccccccgcccgggacccccauggcccaccccccgccccccggcacgcccauggcccacccgccccccccgggcacccccaugguccacccccccccgcccgggacccccauggcgcaccccccgccccccggcacccccauggcccacccgcccccccccgggacgccgauggcccaccccccccccccgggcacccccauggcccacccccccccgcccggcacccccauggcccagcccccggcgcccggggugcucauggcccagccccugaccccgggcgugcugaugguccagcccgccgcccccggggcccccauggugcagccgccccccgcggccaugaugacgcagccccagccgagcggcgcccccauggccaagccccccgggccgggcgugcucaugauccacccccccggcgcgcgggcccccaugacccagccgcccgccuccggggcccccauggcccagcccgcggccccgcccgcccagcccauggcccccccggcccagcccauggcgagcugggccccccaggcccagccccugauccugcagauccagucccaggucauccgcgccccgccccaggugccccagggcccgcaggccccccccgcgcagcucgccacccccccgggguggcaggccaccagccccggcuggcaggccacgcagcagggguggcaggcgaccccccugaccuggcagaccacgcaggugaccuggcaggcccccgccgucaccuggcaggugccgccccccaugcggcagggccccccgcccauccgccccggccccccgcccauccggcccgggcccccgcccgugcgccaggcccccccccugauccggcaggccccgcccgucauccgccaggcgcccccggugauccggcaggccccccccgugauccgccaggcccccgccgucauccggcaggccccgcccgugauccgccaggcgccccccgucauccggcaggccccgcccgugauccgccaggcccccccccucauccggcaggccccgccccccauccgccccgccccgcaggugcuggcgacccagcccccccuguggcaggcccuccccccgccccccccccugcggcaggccccgcaggcccgccugcccgcgccccagguccaggccgccccccaggugccgacggccccccccgccacccaggugccggcggccccccccgccggcccccaggucccgcagcccgugcuccccgccccccuguccgccccgcugagcgcgccccaggccgugcacugccccuccaucaucuggcaggcccccaaggggcagccgcccgucccccacgagauccccaccagcauggaguuccaggaggugcagcagacccaggcccucgccuggcaggcgcagaaggccccgacgcacaucuggcagccccugcccgcccaggaggcccagcggcaggcccccccgcuggugcagcucgagcagcccuuccagggcgcgccccccucccagaaggccguccagauccagcugccgccccagcaggcccaggccagcgggccccaggcggaggugcccacccugccgcuccagcccagcuggcaggcccccccggccgugcugcaggcccagcccggcccccccgucgccgcggccaacuucccgcugggcuccgccaagagccucaugacccccuccggggagugccgcgccagcuccaucgaccgccggggcagcuccaaggagcgccggaccagcuccaaggagcgccgggcccccagcaaggaccgcaugaucuucgcggccacguucugcgcccccaaggccguguccgccgcgcgggcccaccugccggccgccuggaagaaccugcccgcgacccccgagaccuucgcccccagcuccagcguguucccggccaccucccaguuccagcccgccagccucaacgccuucaaggggcccuccgcggccagcgagacgcccaagucccugccguacgcccugcaggaccccuucgccugcgucgaggcccuccccgcggugcccugggugccgcagcccaacaugaacgccagcaaggccagccaggccguccccaccuuccugauggccaccgcggccgccccccaggccaccgcgaccacgcaggaggccuccaagaccagcguggagccgccccgccgguccggcaaggccacccgcaagaagaagcaccuggaggcccaggaggacagccggggccacacccucgccuuccacgacuggcaggggccccgccccugggagaaccugaaccuguccgacugggaggugcagagcccgauccaggucuccggcgacugggagcaccccaacacgccccgggggcucagcggcugggaggggccguccaccagccgcauccuguccggcugggagggccccagcgcguccugggcccugagcgccugggaggggcccuccaccagccgggcccugggccucuccgagagccccgggagcucccugccggugguggucagcgagguggccuccgugagccccggcuccagcgcgacccaggacaacuccaaggucgaggcccagccccugagcccccucgacgagcgcgccaacgcccuggugcaguuccugcucgugaaggaccaggccaaggucccggugcagcgguccgagauggugaaggucauccugcgcgaguacaaggacgagugccuggacaucaucaaccgggcgaacaacaagcucgagugcgccuucggguaccagcugaaggagaucgacacgaagaaccacgccuacaucaucaucaacaagcugggcuaccacaccggcaaccucguggccagcuaccuggaccgccccaaguucgggcugcucauggugguccugucccugaucuucaugaagggcaacugcgugcgcgaggaccucaucuucaacuuccuguucaagcuggggcucgacgugcgggagaccaacggccuguucgggaacaccaagaagcugaucacggaggucuucgugcgccagaaguaccucgaguaccggcgcauccccuacaccgagcccgccgaguacgaguuccuguggggcccgcgggcguuccuggagaccagcaagaugcucgugcugcgcuuccuggccaagcuccacaagaaggacccccaguccuggcccuuccacuaccuggaggcccuggccgagugcgagugggaggacaccgacgaggacgagcccgacacgggcgacagcgcgcacgggccgaccucccggccccccccccgcuga

SEQ ID NO: 32613 - RNA, 1806 nt, Artificial Sequence
  derived and/or modified sequence opt1 from MAG__Homo_sapiens__NP_001186145
augcccagcuccaucagcgccuucgaggggaccugcguguccaucccgugccgcuucgacuuccccgacgagcugcggcccgccgucgugcacggcgugugguacuucaacagccccuacccgaagaacuacccgcccgucguguucaagucccgcacccaggugguccacgagagcuuccagggccggucccgccuccugggggaccugggccuccggaacugcacgcugcugcucagcaacgugucccccgagcucgggggcaaguacuacuuccgcggcgaccucgggggcuacaaccaguacaccuucagcgagcacuccgugcuggacaucgucaacacccccaacaucguggugccgcccgaggucguggcggggaccgagguggaggucagcugcauggugcccgacaacugccccgagcugcggcccgagcuguccuggcugggccacgaggggcugggcgagcccgccgugcugggccgccuccgggaggacgaggggacguggguccaggugagccugcugcacuucgugcccacccgcgaggccaacggccaccggcucgggugccaggccuccuucccgaacaccacccugcaguucgagggcuacgccagcauggacgucaaguacccgcccgugaucguggagaugaacuccagcgucgaggcgaucgagggcucccacgugagccugcucugcggggccgacagcaacccgccgccccugcugacguggaugcgcgacggcaccguccuccgggaggccguggccgagucccugcugcucgagcuggaggaggugacccccgcggaggacggggucuacgccugccuggccgagaacgccuacggccaggacaaccgcaccguggggcucagcgugauguacgcccccuggaagcccacggucaacggcaccaugguggcgguggagggcgagaccgucuccauccugugcagcacccaguccaaccccgaccccauccugacgaucuucaaggagaagcagauccucagcaccgugaucuacgaguccgagcugcagcuggagcuccccgccgugagccccgaggacgacggggaguacuggugcgucgccgagaaccaguacggccagcgggccaccgccuucaaccuguccguggaguucgcgcccgugcugcuccuggagagccacugcgccgccgcccgcgacaccguccagugccugugcguggugaaguccaaccccgagccgagcgucgccuucgagcuccccucccggaacgugacggugaacgagagcgagcgcgaguucgucuacuccgagcggagcgggcuggugcugaccuccauccucacccugcgcggccaggcgcaggccccgccccgggugaucugcaccgcccgcaaccuguacggggccaagagccucgagcugcccuuccagggcgcccaccgccugaugugggcgaagaucggccccgucggggccgugguggccuucgccauccugaucgcgaucgucugcuacaucacgcagacccggcgcaagaagaacgugaccgagucccccagcuucagcgccggcgacaacccgcccguccucuucuccagcgacuuccggaucuccggggcccccgagaaguacgagagcgagcgccggcugggcuccgagcgccggcugcucgggcugcgcggcgagccgcccgagcuggaccucagcuacucccacagcgaccugggcaagcggcccaccaaggacuccuacacgcugaccgaggagcucgccgaguacgccgagauccgcgugaaguga

SEQ ID NO: 32614 - RNA, 4389 nt, Artificial Sequence
  derived and/or modified sequence opt1 from MAGI1__Homo_sapiens__NP_001028229
augagcaaggugauccagaagaagaaccacuggaccucccgcguccacgagugcaccgugaagcggggcccccagggggagcugggcgugacgguccucgggggcgccgagcacggggaguucccguacgugggcgccguggcggccgucgaggccgccggccugcccgggggcggggagggcccccgccugggggagggcgagcuccugcuggaggugcagggcgugcgggucagcgggcucccccgcuacgacgugcugggcgugaucgacuccugcaaggaggccgucaccuucaaggcggugcggcagggcgggcgccugaacaaggaccuccggcacuuccugaaccagcgcuuccagaagggcagcccggaccacgagcugcagcagaccauccgggacaaccucuaccgccacgccgugcccugcaccacgcggagcccccgcgagggggagguccccggcguggacuacaacuuccugaccgugaaggaguuccuggaccucgagcaguccgggacccugcuggaggucggcaccuacgaggggaacuacuacggcacgccgaagccgcccucccagcccgugagcggcaaggugaucaccaccgacgcccuccacucccugcagagcggguccaagcagagcacccccaagcggacgaaguccuacaacgacaugcagaacgccggcaucguccacgcggagaacgaggaggaggacgacgugcccgagaugaacagcuccuucaccgccgacagcggggagcaggaggagcacacccugcaggagaccgcccucccgcccgugaacuccagcaucaucgccgcccccaucacggaccccucccagaaguucccccaguaccugccccugagcgcggaggacaaccucggcccgcugcccgagaacugggagauggccuacaccgagaacggggaggucuacuucaucgaccacaacaccaagaccacgagcuggcuggacccccgcugccucaacaagcagcagaagccccuggaggagugcgaggacgacgagggcgugcacaccgaggagcuggacuccgagcucgagcugccggccggcugggagaagaucgaggaccccgucuacgggaucuacuacguggaccacaucaaccggaagacccaguacgagaaccccgugcuggaggccaagcgcaagaagcagcucgagcagcagcagcagcagcagcagcagcagcagcagcagcagcagcagcagcagcagcagcagaccgaggaguggacggaggaccacagcgcccuggugcccccggucauccccaaccacccgcccuccaaccccgagcccgcgcgggaggugccccugcagggcaagccguucuucacccgcaaccccagcgagcucaaggggaaguucauccacaccaagcugcggaaguccagccgcggcuucggguucaccgucgugggcggcgacgagcccgacgaguuccugcagaucaagucccucgugcuggacgggcccgccgcccuggacggcaagauggagacgggggacgucaucgugagcgugaacgacacgugcguccucggccacacccacgcccagguggugaagaucuuccaguccaucccgaucggcgccagcgucgaccuggagcugugccggggguacccccuccccuucgaccccgacgacccgaacaccucccuggugaccagcguggcgauccuggacaaggagcccaucaucgucaacggccaggagaccuacgacucccccgccagccacuccagcaagaccgggaaggugaacggcaugaaggacgcccgccccuccagcccggccgacguggccuccaacagcagccacggguaccccaacgacaccgucucccucgcgagcuccaucgccacgcagcccgagcugaucaccgugcacaucgugaagggccccaugggcuucggguucaccaucgccgacagcccgggcgggggcgggcagcgcgucaagcagaucguggacagcccccggugccgcggccugaaggagggcgaccugaucguggaggucaacaagaagaacgugcaggcccucacccacaaccagguggucgacaugcugguggagugccccaagggguccgaggugacccugcucguccagcggggcgggcugcccgugccgaagaagucccccaagagccagccccuggagcgcaaggacucccagaacagcucccagcacagcguguccagccaccggucccuccacacggcgagcccgucccacagcacccagguccugcccgaguucccgcccgccgaggcccaggcccccgaccagaccgacagcuccggccagaagaagcccgaccccuucaagaucugggcccagagccgcuccauguacgagaaccggcugcccgacuaccaggagcaggacaucuuccucuggcgcaaggagaccggguucggcuuccggauccugggcgggaacgagccgggcgagcccaucuacaucgggcacaucgugccccugggcgcggccgacacggacgggcgccuccggagcggcgacgagcugaucugcguggacggcacccccgucaucgggaagucccaccagcugguggugcagcucaugcagcaggccgccaagcagggccacgucaaccugaccgugcgccggaagguggucuucgccgugccgaagaccgagaacgaggugcccagccccgcguccagccaccacuccagcaaccagcccgccucccugacggaggagaagcgcaccccgcaggggagccagaacucccucaacaccgucagcuccggcagcggcuccaccagcgggaucggcuccgggggcgggggcggcagcgggguggugagcacggucgugcagcccuacgacgucgagauccggcgcggcgagaacgagggguucggcuucgugaucguguccagcgucucccggcccgaggccgggaccaccuucggcaacgccugcguggccaugccccacaagaucggccgcaucaucgaggggagcccggcggaccggugcggcaagcugaaggugggggaccgcauccuggccgucaacggcugcuccaucaccaacaagagccacuccgacaucgugaaccucaucaaggaggccgggaacacggugacccugcgcaucauccccggcgacgagagcuccaacgccacccugcucaccaacgcggagaagaucgccacgaucaccaccacccacacgcccagccagcagggcacccaggagacccggaacaccacgaagcccaagcaggagucccaguucgaguucaaggccccgcaggccacccaggagcaggacuucuacaccgucgagcuggagcgcggggccaagggcuucggguucagccugcggggcggccgcgaguacaacauggaccucuacgugcugcggcuggcggaggacgggcccgccgagcgcugcggcaagaugcggaucggggacgagauccucgagaucaacggcgagaccacgaagaacaugaagcacucccgcgccaucgagcugaucaagaacgggggccggcgcgugcggcuguuccucaagcgcggcgacgggagcguccccgaguacgaccccuccagcgaccggcacggcccggccaccgggccccagggcgugcccgaggugcgcgccgggccggaccggcgccagcaccccucccuggagagcuccuacccgcccgaccugcacaagagcagcccccacggcgagaagcgggcgcacgcccgcgaccccaagggcucccgggaguacagccgccagcccaacgagcaccacaccuggaacgggaccucccggaagcccgacagcggcgccugccgcccgaaggaccgcgcccccgaggggcggcgcgacgcccaggcggagcgggccgccgccgcgaacggccccaagcgccggucccccgagaagcgccgggaggggacgcgcagcgccgacaacacccucgagcggcgcgagaagcacgagaagcggcgcgacgucuccccggagcggcgccgggagcgcagccccacccggcgccgggacggcucccccagccgccgccggcgcucccuggagcggcugcucgagcagcgccggagccccgagcgccggcgcggcggguccccggagcggcgcgccaagagcaccgaccggcgccgggcccgcucccccgagcggcgccgggagcgcagccuggacaagcggaaccgcgaggaccgggccucccaccgcgagcgcgaggaggcgaaccugaagcaggacgccggccggagcucccgccacccgcccgagcagcggcgccggcccuacaaggagugcagcaccgaccucagcaucuga

SEQ ID NO: 32615 - RNA, 4326 nt, Artificial Sequence
  derived and/or modified sequence opt1 from MAGI2__Homo_sapiens__NP_001288057
augagcaagucccugaagaagaagagccacuggaccuccaaggugcacgagagcgucaucggccgcaaccccgaggggcagcucggcuucgagcugaaggggggcgccgagaacgggcaguucccguaccugggcgaggugaagcccggcaagguggccuacgaguccgggagcaagcucgucuccgaggagcugcugcucgaggugaacgagacccccguggcgggccugacgauccgggacguccuggccgugaucaagcacugcaaggacccccuccgccugaagugcgugaagcaggggggcaucgucgacaaggaccugcggcacuaccucaaccugcgcuuccagaaggggagcguggaccacgagcugcagcagaucauccgggacaaccucuaccugcgcaccgugccgugcaccacccggccccacaaggagggcgagguccccggcguggacuacaucuucaucacgguggaggacuucauggagcuggagaaguccggggcccuccuggagagcggcaccuacgaggacaacuacuacgggacccccaagccgcccgccgagcccgccccccugcuccugaacgucaccgaccagauccugccgggcgcgacgcccuccgccgagggcaagcgcaagcggaacaagagcguguccaacauggagaaggccagcaucgagccccccgaggaggaggaggaggagcgcccgguggucaacgggaacggcgugguggucacccccgaguccagcgagcacgaggacaaguccgccggggcgagcggcgagaugcccucccagcccuacccggcccccguguacagccagcccgaggagcucaaggagcagauggacgacaccaagcccaccaagccggaggacaacgaggagcccgacccccugcccgacaacugggagauggccuacacggagaagggggagguguacuucaucgaccacaacaccaagaccaccagcuggcuggacccgcggcucgccaagaaggccaagccccccgaggagugcaaggagaacgagcugccguacggcugggagaagaucgacgaccccaucuacggcacguacuacgucgaccacaucaaccgccggacccaguucgagaaccccgugcuggaggcgaagcgcaagcuccagcagcacaacaugccccacaccgagcuggggaccaagccgcugcaggcccccggcuuccgggagaagccccucuucacgcgcgacgccucccagcugaaggggaccuuccugagcaccacccucaagaaguccaacaugggcuucggguucacgaucaucggcggcgacgagcccgacgaguuccugcaggucaagagcgugaucccggacgggcccgccgcccaggacggcaagauggagaccggggacgugaucgucuacaucaacgaggugugcgugcugggccacacccacgcggacgucgugaagcucuuccaguccgugcccaucgggcagagcgucaaccuggugcugugccggggcuacccccucccguucgaccccgaggaccccgccaacuccauggugcccccgcuggccaucauggagcgccccccccccgucauggugaacggccggcacaacuacgagaccuaccuggaguacaucagccgcacgucccagagcgugccggacaucaccgaccggcccccccacucccuccacagcaugcccaccgacgggcagcuggacggcaccuacccgccccccguccacgacgacaacguguccauggccagcuccggggccacgcaggcggagcugaugacccucaccaucgugaagggcgcccagggcuucggguucaccaucgccgacagcccgacgggccagcgcgucaagcagauccuggacauccaggggugccccggccugugcgagggggaccugaucguggagaucaaccagcagaacgugcagaaccucucccacaccgaggucguggacauccugaaggacugccccaucggcagcgagaccucccugaucauccaccgcggcggguucuucagccccuggaagaccccgaagcccaucauggaccggugggagaaccagggcagcccccagaccucccucagcgcccccgccaucccgcagaaccugcccuucccccccgcgcugcaccgcuccagcuucccggacuccacggaggccuucgacccccggaagcccgaccccuacgagcucuacgagaagagccgcgccaucuacgagucccggcgcccggacuacaaggagcuggacgugcaccugcggcgcauggagagcggguucggcuuccggauccucgggggcgacgagcccggccagcccauccugaucggggccgucaucgcgaugggcuccgccgaccgcgacgggcggcugcaccccggcgacgagcucguguacguggacgggaucccggucgccggcaagacccaccgcuacgugaucgaccugaugcaccacgccgcccggaacggccaggugaaccugaccguccgccggaaggugcucugcgggggcgagcccugccccgagaacgggcgcagccccggcuccgugagcacccaccacuccagcccgcgguccgacuacgcgacguacaccaacagcaaccacgccgcccccuccagcaacgccagcccccccgagggguucgccucccacagccugcagaccuccgacgucgugauccaccgcaaggagaacgagggcuucggcuucgugaucaucagcucccugaaccggccggagagcggguccaccaucacggucccccacaagaucggccgcaucaucgacgggagccccgcggaccgcugcgccaagcucaaggugggcgaccggauccuggccgugaacggccaguccaucaucaacaugccgcacgccgacaucgucaagcugaucaaggacgccgggcucagcgugacccugcgcaucaucccccaggaggagcugaacucccccaccagcgcgcccuccagcgagaagcaguccccgauggcccagcagagcccccucgcccagcaguccccccuggcccagcccagcccggcgacccccaacucccccaucgcccagcccgccccgccccagccccugcagcuccagggccacgagaacagcuaccggagcgaggugaaggcccgccaggacgucaagcccgacauccggcagccgcccuucacggacuaccgccagcccccccuggacuaccggcagccgcccgggggcgacuaccagcagccccccccgcuggacuaccgccagcccccccuccuggacuaccggcagcacucccccgacacccgccaguacccgcugagcgacuaccggcagccccaggacuucgacuacuucaccguggacauggagaagggggccaagggcuucggcuucuccauccgcgggggccgggaguacaagauggaccucuacgugcugcgccuggcggaggacgggcccgccauccggaacggccgcaugcgggucggggaccagaucaucgagaucaacggcgagagcacccgcgacaugacgcacgcccgggccaucgagcucaucaaguccggcgggcgccgggugcgccugcugcucaagcgcggcaccgggcaggugccggaguacgacgagcccgcccccuggagcucccccgcggccgccgccccgggccugcccgaggucggggugagccuggacgacggccucgcccccuucucccccagccacccggcgccccccuccgaccccagccaccagaucuccccgggccccaccugggacaucaagcgggagcacgacgugcgcaagcccaaggagcugagcgccugcgggcagaagaagcagcggcugggcgagcagcgcgagcgguccgccagcccccagcgcgccgcgcggccgcgccucgaggaggcccccgggggccagggccggcccgaggccgggcgccccgccuccgaggcccgggcgccgggccuggccgccgccgacgccgcggacgccgcccgcgccgggggcaaggaggccccccgggcggccgccgggagcgagcugugccgccgggagggccccggcgccgcccccgcguucgccgggccgggcgggggcggguccggcgcccucgaggccgagggccgcgcgggggcccgggccggcccccgccccgggccgcggccccccggcggggcccccgcccgcaaggcggccgucgccccgggccccuggaaggugcccggcagcgacaagcugcccagcguccugaagccgggggccuccgccgcgagccgcuga

SEQ ID NO: 32616 - RNA, 3762 nt, Artificial Sequence
  derived and/or modified sequence opt1 from MAGI3__Homo_sapiens__XP_011539510
auggagcgcauggacagcucccugcccgaggaggaggaggacgaggacaaggaggccaucaacggcagcgggaacgccgagaaccgggagcgccacuccgagagcuccgacuggaugaagaccgugccgagcuacaaccagaccaacuccagcauggacuuccggaacuacaugaugcgcgacgagacgcucgagccccugcccaagaacugggagauggcguacaccgacaccggcaugaucuacuucaucgaccacaacaccaagacgaccaccuggcuggacccccggcucugcaagaaggccaaggccccggaggacugcgaggacggggagcugcccuacggcugggagaagaucgaggacccccaguacgggaccuacuacgucgaccaccugaaccagaagacgcaguucgagaaccccguggaggaggccaagcgcaagaagcagcucggccagguggagaucggcuccagcaagccggacauggagaagucccacuucacccgggaccccagccagcugaaggggguccuggugcgcgccucccucaagaaguccaccaugggcuucggguucaccaucaucggcggggaccggcccgacgaguuccugcaggucaagaacguccugaaggacggccccgcggcccaggacggcaagaucgccccgggggacgugaucguggacaucaacggcaacugcguccucgggcacacgcacgccgacguggugcagauguuccagcugguccccgugaaccaguacgugaaccugacccucugccgcggcuacccccugcccgacgacuccgaggacccggucguggacaucguggcggccacccccgucaucaacggccagagccugaccaagggggagacgugcaugaacccccaggacuucaagcccggcgccauggugcucgagcagaacgggaaguccggccacacccugaccggggacggccugaacggcccgagcgacgccuccgagcagcgggugagcauggccagcuccgggagcucccagcccgagcucgucaccaucccccugaucaagggccccaagggguucggcuucgcgaucgccgacagcccgacggggcagaaggugaagaugauccuggacucccaguggugccagggccuccagaagggcgacaucaucaaggagaucuaccaccagaacgugcagaaccugacccaccuccaggucguggagguccucaagcaguuccccgugggggccgacgugccccugcugauccugcgcggcgggcccccgagccccaccaagaccgccaagaugaagacggacaagaaggagaacgccggcagccuggaggcgaucaacgagcccaucccgcagcccaugcccuucccgcccagcaucauccgguccgggagccccaagcuggaccccuccgagguguaccucaagagcaagacccuguacgaggacaagcccccgaacaccaaggaccuggacguguuccuccgcaagcaggaguccggcuucggcuuccgggugcugggcggcgacgggcccgaccagagcaucuacaucggcgccaucaucccccugggcgccgccgagaaggacgggcgccuccgggccgcggacgagcugaugugcaucgacggcauccccgucaaggggaagucccacaagcagguccuggaccucaugaccacggccgcccgcaacggccacgugcugcugaccgugcggcgcaagaucuucuacggggagaagcagccggaggacgacagcucccaggccuucaucagcacccagaacggcagcccccggcucaaccgcgccgaggugcccgcgcgccccgccccgcaggagcccuacgacgugguccugcagcggaaggagaacgagggcuucggguucgugauccugaccuccaagaacaagcccccgcccggcgugaucccccacaagaucgggcgcgucaucgagggcagccccgccgaccggugcgggaagcucaaggugggcgaccacaucuccgccgugaacggccagagcaucgucgagcugucccacgacaacaucgugcagcugaucaaggacgcgggggugacggucacccugaccgugaucgccgaggaggagcaccacgggcccccgagcgggaccaacuccgcccgccagagccccgcccuccagcaccggcccaugggccagucccaggccaaccacaucccgggggaccgcagcgcgcuggagggcgagaucggcaaggacguguccacgagcuaccggcacuccuggagcgaccacaagcaccuggcccagcccgacaccgccgucaucuccgugguggggagccgccacaaccagaaccucggcugcuaccccgucgagcuggagcgggggccccgcggcuucggguucucccugcggggcggcaaggaguacaacaugggccucuucauccugcgccuggccgaggacgggccggccaucaaggacgggcggauccacgugggcgaccagaucguggagaucaacggcgagcccacccaggggaucacccacacccgcgcgaucgagcucauccaggccggcgggaacaagguccugcugcuccugcggcccggcacggggcugauccccgaccacggcgacugggacaucaacaacccgagcuccagcaacgugaucuacgacgagcagagcccccucccgcccuccagccacuucgccuccaucuucgaggagagccacgugcccgucaucgaggagucccugcgcgugcagaucugcgagaaggccgaggagcugaaggacaucgugcccgagaagaaguccacccucaacgagaaccagcccgagaucaagcaccagagccugcugcagaagaacgucagcaagcgggacccgcccuccagccacggccacuccaacaagaagaaccuccugaagguggagaacggggugacccgccggggccgcagcgucucccccaagaagcccgccagccagcacuccgaggagcaccuggacaagauccccagcccgcucaagaacaaccccaagcgccggccccgcgaccagucccugagccccuccaagggggagaacaagagcugccaggugagcacccgggcgggcuccgggcaggaccagugccgcaagagccggggccgcuccgccagcccgaagaagcagcagaagaucgagggcuccaaggcccccagcaacgccgaggcgaagcugcucgaggggaagucccggcgcaucgccggcuacacggggagcaacgccgagcagauccccgacggcaaggagaaguccgacgugauccggaaggacgccaagcagaaccagcuggagaagucccgcacccggagccccgagaagaagaucaagcgcauggucgagaagucccugccgagcaagaugaccaacaagaccacgagcaaggagguguccgagaacgagaaggggaagaaggugaccaccggcgagaccagcuccagcaacgacaagaucggcgagaacguccagcucuccgagaagcggcugaagcaggagcccgaggagaagguggugagcaacaagacggaggaccacaaggggaaggagcuggaggccgcggacaagaacaaggagaccggccgcuucaagcccgagagcuccagcccggucaagaagacccucaucacccccgggcccuggaaggugcccuccggcaacaaggugacgggcaccaucgggauggccgagaagcggcaguga

SEQ ID NO: 32617 - RNA, 1104 nt, Artificial Sequence
  derived and/or modified sequence opt1 from MAGT1__Homo_sapiens__NP_115497
augcgcaagggcaaggggcccaucugccuguucagccggcccacccuccgccccucccggagcaaggugucccugaucgagggccgcggggccaacauggccgcgcgguggcgcuucuggugcgucagcgugaccaugguggucgcccugcucaucgugugcgacgugcccuccgccagcgcccagcggaagaaggagaugguccuguccgagaaggugagccagcugauggaguggacgaacaagcgccccgugauccggaugaacggcgacaaguuccgccggcucgucaaggccccgccccgcaacuacuccgugaucgugauguucaccgcgcugcagcugcaccggcagugcgucgugugcaagcaggccgacgaggaguuccagauccucgccaacagcuggcgcuacuccagcgccuucaccaaccggaucuucuucgcgaugguggacuucgacgagggguccgacgucuuccagaugcugaacaugaacagcgcccccaccuucaucaacuuccccgccaagggcaagccgaagcgcggcgacacguacgagcuccaggugcggggguucuccgccgagcagaucgcccgcuggaucgcggaccggaccgacgugaacauccgcgucauccggccgcccaacuacgccggcccccugaugcuggggcugcuccuggccgugaucggcgggcugguguaccuccgccgcagcaacauggaguuccuguucaacaagaccggcugggccuucgccgcgcugugcuucguccucgccaugaccuccggccagauguggaaccacauccgggggccgcccuacgcccacaagaacccccacacgggccacgugaacuacauccacgggagcucccaggcccaguucguggccgagacccacaucguccugcuguucaacggcggcgugacccucgggaugguccugcugugcgaggcggccaccagcgacauggacaucggcaagcgcaagaucaugugcguggccgggaucggccucgugguccuguucuucagcuggaugcuguccaucuuccggagcaaguaccacggguaccccuacuccuuccucaugagcuga

SEQ ID NO: 32618 - RNA, 903 nt, Artificial Sequence
  derived and/or modified sequence opt1 from MAK16__Homo_sapiens__NP_115898
augcagagcgacgacgugaucugggacacccugggcaacaagcaguucugcuccuucaagauccgcaccaagacgcagagcuucugccggaacgaguacucccucaccgggcugugcaaccgcagcuccugcccccuggccaacagccaguacgccaccaucaaggaggagaagggccagugcuaccucuacaugaaggucaucgagcgggcggccuucccgcgccggcugugggagcgcgugcggcuguccaagaacuacgagaaggcccucgagcagaucgacgagaaccugaucuacuggccccgcuucauccggcacaagugcaagcagcgcuucaccaagaucacgcaguaccugauccggauccgcaagcucacccugaagcggcagcgcaagcuggugccccucagcaagaaggucgagcggcgcgagaagcggcgcgaggagaaggcccugaucgccgcgcagcuggacaacgccaucgagaaggagcuccuggagcggcugaagcaggacaccuacggggacaucuacaacuuccccauccacgccuucgacaaggcccucgagcagcaggaggcggaguccgacagcuccgacaccgaggagaaggacgacgacgacgacgacgaggaggacgugggcaagcgcgaguucguggaggacggggaggucgacgagagcgacaucuccgacuucgaggacauggacaagcuggacgccagcuccgacgaggaccaggacggcaagagcuccagcgaggaggaggaggagaaggcccuguccgccaagcacaagggcaagaugccgcuccgggggccccugcagcgcaagcgcgccuacguggagaucgaguacgagcaggagacggagcccguggcgaaggccaagaccaccuga

SEQ ID NO: 32619 - RNA, 1872 nt, Artificial Sequence
  derived and/or modified sequence opt1 from MAK__Homo_sapiens__NP_005897
augaaccgcuacaccaccaugcggcagcugggcgacgggacguacggcagcgugcucauggggaaguccaacgagagcggcgagcuggucgccaucaagcgcaugaagcggaaguucuacuccugggacgagugcaugaaccugcgcgaggucaagagccucaagaagcugaaccacgccaacgugaucaagcugaaggaggugauccgggagaacgaccaccucuacuucaucuucgaguacaugaaggagaaccuguaccagcugaugaaggaccgcaacaagcuguuccccgaguccgugauccggaacaucauguaccagauccugcaggggcuggcguucauccacaagcacggcuucuuccaccgcgacaugaagccggagaaccuccugugcaugggccccgagcuggugaagaucgccgacuucgggcucgcccgggagcugcgcagccagccgcccuacaccgacuacgucuccacccggugguaccgcgcccccgaggugcugcuccggagcuccguguacagcucccccaucgacgucugggccgugggcagcaucauggcggagcuguacaugcugcgcccccucuuccccgggaccuccgagguggacgagaucuucaagaucugccagguccugggcacgccgaagaaguccgacuggcccgagggguaccagcuggccagcagcaugaacuuccgguucccccagugcgugcccaucaaccucaagacccugaucccgaacgccuccaacgaggccauccagcugaugaccgagaugcucaacugggaccccaagaagcgccccaccgcgagccaggcccugaagcaccccuacuuccaggugggccagguccugggcccguccagcaaccaccucgagagcaagcagucccugaacaagcagcugcagccccucgagagcaagcccucccugguggagguggagcccaagccgcugcccgacaucaucgaccaggucguggggcagccccagcccaagacgagccagcagccgcuccagcccauccagccgccccagaaccuguccgugcagcagccgcccaagcagcagagccaggagaagccgccccagacccuguuccccuccaucgucaagaacaugcccaccaagcccaacggcacccucagccacaaguccgggcggcgccgguggggccagacgaucuucaagagcggcgacuccugggaggagcuggaggacuacgacuucggggccagccacuccaagaagcccagcaugggcguguucaaggagaagcgcaagaaggacucccccuuccggcugcccgagcccgugccgagcggguccaaccacagcaccggcgagaacaagucccuccccgccgucaccagccucaagagcgacuccgagcugagcaccgcccccacguccaagcaguacuaccucaagcagagccgcuaccugcccggggugaacccgaagaaggucucccugaucgcgagcggcaaggagaucaacccccacaccugguccaaccagcuguuccccaagagccucggccccgugggggccgagcuggccuucaagcgcuccaacgccggcaaccuggggagcuacgccaccuacaaccaguccggcuacaucccgagcuuccucaagaaggaggugcaguccgcggggcagcggauccaccuggcgccccugaacgccaccgccagcgaguacacguggaacaccaagaccggccgcggccaguucuccgggcggaccuacaaccccacggccaagaaccucaacaucgucaaccgcgcccagcccaucccgagcgugcacggccggaccgacuggguggccaaguacgggggccaccgcuga

SEQ ID NO: 32620 - RNA, 462 nt, Artificial Sequence
  derived and/or modified sequence opt1 from MAL__Homo_sapiens__NP_002362
auggcccccgccgcggccaccggcgggagcacccugccguccggcuucagcguguucacgacccuccccgaccugcuguucaucuucgaguucaucuucgggggccucgucuggauccugguggccuccagccuggugcccuggccccucguccaggggugggugauguucguguccgucuucugcuucguggccaccaccacgcugaucauccuguacaucaucggcgcccacggcggggagaccagcugggugacccucgacgcggccuaccacugcaccgccgcccuguucuaccuguccgcgagcguccucgaggcccuggccacgaucaccaugcaggacggcuucaccuaccgccacuaccacgagaacaucgccgccgugguguucuccuacaucgcgacccugcucuacgucgugcacgccguguucagccugauccgguggaaguccagcuga

SEQ ID NO: 32621 - RNA, 462 nt, Artificial Sequence
  derived and/or modified sequence opt1 from MALL__Homo_sapiens__NP_005425
auggccagccccgacccgcccgccaccuccuacgcgcccagcgacgugcccuccggcgucgcccuguuccucaccaucccguucgccuucuuccugcccgagcugaucuucggguuccucguguggacgaugguggccgccacccacaucgucuacccccugcugcagggcugggugauguacgugagccucaccuccuuccugaucagccugauguuccuccuguccuaccuguucggguucuacaagcgcuucgagagcuggcggguccucgacucccuguaccacggcaccacggggauccuguacaugagcgcggccgugcuccaggugcacgccaccaucgucuccgagaagcugcuggacccccgcaucuacuacaucaacagcgccgcguccuucuucgccuucaucgccacccuccuguacauccugcacgccuucagcaucuacuaccacuga

SEQ ID NO: 32622 - RNA, 6471 nt, Artificial Sequence
  derived and/or modified sequence opt1 from MALRD1__Homo_sapiens__NP_001135780
augcuguucuuccuggaccgcaugcuggccuuccccaugaacgagaccuucugcugccuguggaucgccugcguguucaacuccacccucgcgcagcagggcaccgaguccuuccagugcgacaacggggugagccugccgcccgacuccaucugcgacuucaccgaccagugcggcgacagcuccgacgagcggcacugccugaacuacgagcgcugcgacuucgaggacgggcucugccacaugacccaggaccagagccugcagcccuccuggaccaagcggagcggcaugaucgggcugagcccgcccuucuacgaccacaacggcgacgugagcgcccacuuccucucccuggugagccgcgucgacuccaucagcuccagccugcggucccgcguguuccuccccacgaacgaccagcacgacugccagaucaccuucuacuacuucagcugccagguguccggcaagcugauggucgggcugcagaccgccugcggcgggcccauccagcaccucuggcagaacaccgccgcccugcccaaccagugggagcggaacgugaucaagauccagagcagccagcgcuuccagguggucuucgagggccagauggccuccacguacgagcaggacgaggugaucgccaucgacgacaucagcuucuccagcgggugccugcccgccaacgacggcauccuccugugccaggaggcccugaacgcggagcgggagcucugccaccccgacaccgaccugugccgcuucgacgccaccgacgaggagcugcggcucugccaggccugcggcuucgaguucgacaugugcgaguggaccuccgaggccagcgccgggcagaucuccuggaugcgcacgaaggcgcgggagauccccgccuucgagagcacgccccagcaggaccagggcggggacgacgagggcuacuacgugugggucggcgccaagcacggguucacccugaaccaccuggacucccgcgccuaccucaacagcuccgugugccacugccugggcaagagcugccaccuccaguucuacuacgccauggaguccagcgugcuccggguccgccuguacaacaacaaggaggaggagaucuucuggaccuacaacaucuccacgcacagccagugggugaaggcggacgugcugauccccgaggaccucaagaccuucaagaucaucuucgaggggacccugcugucccagcggagcuucaucgcccucgaccaccugugggucuacgccugcggccagacccagucccgcaagcugugcagcgccgacgaguuccccugcacgagcgggcagugcaucgccaaggaguccgugugcgacagccggcaggacugcuccgacgagagcgacgaggaccccgcgaccugcuccaagcaccugaccugcgacuucgagagcggcuucugcggcugggagcccuuccugaccgaggacucccacuggaagcugaugaaggggcucaacaacggcgagcaccacuuccccgccgccgaccacacggccaacaucaaccacgggagcuucaucuaccuggaggcccagcgcucccccggcguggcgaagcuggggagccccguccucaccaagcugcugaccgccuccacccccugccaggugcaguucugguaccaccucagccagcacuccaaccugagcguguucacgcggaccucccuggacggcaaccugcagaagcagggcaagaucauccgcuucagcgagucccaguggagccacgccaagaucgaccucaucgccgaggcgggggagagcacccugccguuccagcugauccucgaggccaccguccuguccagcaacgccacgguggcccuggacgacaucuccgucagccaggagugcgagaucuccuacaagagccucccccgcaccuccacccagagcaaguucuccaagugcgacuucgaggccaacagcugcgacugguucgaggcgaucuccggcgaccacuucgacuggauccggagcucccagagcgagcuguccgccgacuucgagcaccaggcgccgccccgcgaccacagccugaacgccucccaggggcacuucauguucauccucaagaaguccagcagccuguggcaggucgccaagcugcagagcccgaccuucucccagacgggccccgggugcauccucagcuucugguucuacaacuacggccuguccgugggcgcggccgagcugcagcuccacauggagaacagccacgacuccaccgucaucuggcgggugcuguacaaccaggggaagcaguggcuggaggccaccauccagcucggccgccugagccagcccuuccaccugucccucgacaaggugagccuggggaucuacgacggcgucuccgccaucgacgacauccgguucgagaacugcacccugccccucccggccgagagcugcgagggccuggaccacuucuggugccgccacacccgggcgugcaucgagaagcugcgccucugcgaccugguggacgacugcggggaccggacggacgaggugaacugcgcccccgagcugcagugcaacuucgagaccggcaucugcaacugggagcaggacgccaaggacgacuucgacuggacccgcucccaggggcccaccccgacgcucaacaccggccccaugaaggacaacacccuggggaccgccaagggccacuaccuguacaucgagagcuccgagccccaggcguuccaggacagcgccgcccuccugucccccauccugaacgccacggacaccaagggcugcaccuuccgguucuacuaccacauguucgggaagcgcaucuaccggcucgccaucuaccagcgcaucuggagcgacucccggggccagcugcuguggcagaucuucgggaaccagggcaaccgcuggauccggaagcaccucaacaucagcucccgccagccguuccagauccuggucgaggcgagcgugggggacggcuucaccggcgacaucgccaucgacgaccugagcuucauggacugcacgcucuaccccgggaaccugcccgccgaccugcccaccccgcccgagaccuccgugcccgucacccugcccccgcacaacugcacggacaacgaguucaucugccggagcgacggccacugcaucgagaagaugcagaagugcgacuucaaguacgacugccccgacaaguccgacgaggccagcugcgugauggaggugugcuccuucgagaagcgcagccucugcaagugguaccagcccauccccguccaccuccugcaggacuccaacaccuuccgcugggggcugggcaacgggaucagcauccaccacggcgaggagaaccaccggccguccguggaccacacccagaacaccacggacggcugguaccuguacgccgacagcuccaacgggaaguucggcgacaccgcggacauccucacccccaucaucagccugaccgggcccaagugcacgcugguguucuggacccacaugaacggcgccaccgucgggucccuccaggugcugaucaagaaggacaacgugaccagcaagcugugggcccagacgggccagcagggcgcccaguggaagcgcgccgaggucuuccucgggauccggucccacacccagaucguguuccgcgcgaagcggggcaucagcuacaucggggacguggccgucgacgacaucuccuuccaggacugcagcccccugcuguccccggagcgcaagugcaccgaccacgaguucaugugcgccaacaagcacugcaucgccaaggacaagcucugcgacuucgugaacgacugcgcggacaacagcgacgagaccacguucaucugccggaccagcuccggccgcugcgacuucgaguucgaccugugcagcuggaagcaggagaaggacgaggacuucgacuggaaccugaaggccuccagcauccccgccgccggcaccgagcccgccgcggaccacacccucgggaacuccagcggccacuacaucuucaucaagucccuguucccccagcagccgaugcgggccgcccgcaucagcucccccgugaucagcaagcgguccaagaacugcaagaucaucuuccacuaccacauguacgggaacggcaucggggcccugacgcucaugcaggucagcgugaccaaccagaccaaggugcugcugaaccucaccgucgagcagggcaacuucuggcgccgggaggagcugucccuguucggcgacgaggacuuccagcucaaguucgaggggcgcgugggcaaggggcagcggggcgacaucgcccuggacgacaucgugcugaccgagaacugccucagccugcacgacuccguccaggaggagcuggcggugccccucccgacgggguucugcccccugggcuaccgcgagugccacaacggcaagugcuaccggcuggagcagagcugcaacuucguggacaacugcggggacaacaccgacgagaacgagugcggcuccagcugcaccuucgagaagggguggugcggcuggcagaacucccaggccgacaacuucgacuggguccucggggugggcagccaccagagccugcggccgcccaaggaccacacccugggcaacgagaacgggcacuucauguaccucgaggccacggccgugggccugcgcggggacaaggcccacuuccgcuccaccauguggcgggagagcuccgcggccugcaccaugagcuucugguacuucgucuccgccaaggccaccggcagcauccagauccugaucaagacggagaagggccucuccaagguguggcaggagagcaagcagaacccggggaaccacuggcagaaggccgacauccugcugggcaagcuccgcaacuucgaggugaucuuccaggggauccgcacccgggaccugggcgggggcgcggccaucgacgacaucgaguucaagaacugcaccaccgucggcgagaucuccgagcugugccccgagaucacggacuuccucugccgcgacaagaagugcaucgccagccaccuccugugcgacuacaagcccgacugcuccgaccggagcgacgaggcccacugcgcgcacuacaccuccaccaccgggagcugcaacuucgagacguccagcggcaacuggaccaccgccugcucccugacccaggacagcgaggacgaccucgacugggccaucgggucccgcauccccgccaaggcccugaucccggacagcgaccacacgcccggcagcgggcagcacuuccuguacgugaacuccagcggcuccaaggagggcagcguggcgcggaucaccaccuccaagagcuuccccgccucccucgggaugugcaccguccgcuucugguucuacaugaucgacccccggagcaugggcauccugaagguguacacgaucgaggaguccgggcugaacauccucguguggagcgucaucggcaacaagcgcaccggguggaccuacggcuccgugccgcugagcuccaacagccccuucaagguggccuucgaggccgaccuggacggcaacgaggacaucuucaucgcccucgacgacaucuccuucacccccgagugcgucaccgggggccccgugccgguccagcccagccccugcgaggcggaccaguucuccugcaucuacacccugcagugcgugccccugagcgggaagugcgacggccacgaggacugcaucgacgggagcgacgagauggacugcccgcucucccccacgccgccccugugcagcaacauggaguucccgugcuccaccgacgagugcauccccagccugcuccugugcgacggcgugcccgacugccacuucaacgaggacgagcugaucugcuccaacaagagcugcuccaacggcgcccucgucugcgccagcuccaacagcugcauccccgcccaccagcggugcgacggguucgccgacugcauggacuuccagcuggacgaguccagcugcuccgagugcccgcugaacuacugccgcaacggcgggacgugcgugguggagaagaacggccccaugugccggugccgccagggcuggaaggggaaccggugccacaucaaguucaacccgcccgcgaccgacuucaccuacgcccagaacaacaccuggacgcuccugggcaucgggcuggccuuccucaugacccacaucaccgucgccgugcugugcuuccuggcgaaccgcaaggugcccauccggaagaccgagggcagcgggaacugcgccuucgucaaccccguguacggcaacugguccaaccccgagaagaccgagagcuccguguacagcuucuccaacccgcucuacggcacgaccagcgggagccuggagacccugucccaccaccucaaguga

SEQ ID NO: 32623 - RNA, 2475 nt, Artificial Sequence
  derived and/or modified sequence opt1 from MALT1__Homo_sapiens__NP_006776
augagccugcucggcgacccccugcaggcccugccgcccuccgccgcgcccaccgggccccuccuggccccgcccgccggcgccacccugaaccgccuccgggagccccugcugcgccggcucagcgagcugcuggaccaggcccccgaggggcgcggcuggcggcgccucgcggagcuggccgggucccggggccgccugcggcucagcugccuggaccuggagcagugcucccucaaggugcuggagccggagggcagccccucccugugccuccugaagcugaugggggagaagggcugcacggucaccgagcucagcgacuuccugcaggccauggagcacaccgaggugcugcagcuccuguccccgcccgggaucaagaucaccgugaaccccgagagcaaggccguccuggcgggccaguucgugaagcucugcugccgcgccacggggcaccccuucgugcaguaccagugguucaagaugaacaaggagauccccaacggcaacaccuccgagcugaucuucaacgccguccacgugaaggacgccggcuucuacgugugccgggucaacaacaacuucaccuucgaguucagccaguggucccagcuggacgugugcgacauccccgagagcuuccagcgcuccguggacggggucagcgaguccaagcuccagaucugcguggagccgaccagccagaagcugaugcccggcuccacgcuggugcuccagugcgucgccguggggagccccaucccccacuaccagugguucaagaacgagcugccgcugacccacgagaccaagaagcucuacauggugcccuacgucgaccuggagcaccagggcaccuacuggugccacguguacaacgaccgggacagccaggacuccaagaagguggagaucaucaucggccgcacggacgaggcggucgagugcaccgaggacgagcugaacaaccucgggcaccccgacaacaaggagcagaccaccgaccagccccuggccaaggacaagguggcccugcucaucggcaacaugaacuaccgggagcacccgaagcugaaggcgccccugguggacgucuacgagcucacgaaccugcugcgccagcuggacuucaagguggucagccuccuggaccugaccgaguacgagaugcggaacgccguggacgaguuccuccugcugcucgacaaggggguguacggccugcuguacuacgccgggcacggcuacgagaacuucggcaacuccuucaugguccccguggacgcccccaacccguaccgcagcgagaacugccucugcgugcagaacauccugaagcugaugcaggagaaggagaccgggcucaacgucuuccugcuggacaugugccggaagcgcaacgacuacgacgacaccauccccauccucgacgcccugaaggugacggccaacaucguguucggcuacgcgaccugccagggggccgaggccuucgagauccagcacuccggccuggccaacgggaucuucaugaaguuccucaaggaccggcugcuggaggacaagaagaucaccguccuccuggacgagguggccgaggacaugggcaagugccaccugaccaagggcaagcaggcccucgagauccgcagcucccugagcgagaagcgcgcgcugacggaccccauccaggggaccgaguacuccgccgagagccucgugcggaaccugcagugggccaaggcccacgagcugccggaguccaugugccucaaguucgacugcggcguccagauccagcugggguucgcggccgaguucagcaacgugaugaucaucuacaccuccaucguguacaagccgcccgagaucaucaugugcgacgccuacgucaccgacuucccccuggaccucgacaucgaccccaaggacgccaacaagggcacgcccgaggagaccgggagcuaccugguguccaaggaccugcccaagcacugccucuacacccgccugagcucccugcagaagcucaaggagcaccugguguucaccgucugccugagcuaccaguacuccggccucgaggacacgguggaggacaagcaggaggugaacgucggcaagccccugaucgccaagcuggacaugcaccgggggcucggccgcaagaccugcuuccagaccugccugaugagcaacgggccguaccagagcuccgcggccaccagcggcggcgccgggcacuaccacucccugcaggaccccuuccacggcguguaccacagccaccccgggaaccccuccaacgugacgccggccgacagcugccacugcucccggacccccgacgccuucaucagcuccuucgcgcaccacgccagcugccacuucucccgcagcaacguccccguggagaccaccgacgagauccccuucuccuucagcgaccggcuccgcaucuccgagaaguga

SEQ ID NO: 32624 - RNA, 3051 nt, Artificial Sequence
  derived and/or modified sequence opt1 from MAML1__Homo_sapiens__NP_055572
auggugcugccgaccugcccgauggccgaguucgcccucccccgccacagcgcggucauggagcggcugcgccggcgcaucgagcugugccggcgccaccacuccacgugcgaggcccgguacgaggccgugagccccgagcgccucgagcuggagcggcagcacaccuucgcccugcaccagcgcugcauccaggccaaggcgaagcgggccggcaagcaccgccagcccccggccgccaccgcgcccgcccccgccgcccccgccccgcggcucgacgcggccgacgggcccgagcacggccgccccgccacccaccuccacgacaccgugaagcggaaccuggacuccgccacgagcccccagaacggggaccagcagaacggcuacggggaccucuucccgggccacaagaagacccgccgggaggcgccccugggcgucgccaucuccagcaacgggcugccgcccgccagcccccucggccaguccgacaagcccuccggggccgacgcccugcagagcuccggcaagcacagccuggggcucgacucccugaacaagaagcgccuggccgacagcucccuccaccugaacggcggcagcaaccccuccgagagcuucccccugucccucaacaaggagcugaagcaggagccgguggaggaccugcccugcaugaucaccgggaccgugggcagcaucagccaguccaaccucaugcccgaccugaaccugaacgagcaggaguggaaggagcucaucgaggagcugaaccggagcguccccgacgaggacaugaaggaccuguucaacgaggacuucgaggagaagaaggacccggaguccagcggguccgcgacgcagacgccccucgcccaggacaucaacaucaagaccgaguucagccccgccgccuucgagcaggagcagcugggcagcccccaggugcgcgccggcagcgcggggcagaccuuccugggcccguccagcgcccccguguccaccgacagccccucccucgggggcucccagacccuguuccacaccuccgggcagccccgggccgacaaccccagccccaaccugaugcccgccuccgcgcaggcccagaacgcccagcgcgcccuggccggcgucgugcugccgagccagggccccgggggcgcguccgagcugagcagcgcccaccagcuccagcagaucgccgccaagcagaagcgcgagcagaugcugcagaacccccagcaggccacccccgcgccggcccccgggcagauguccacguggcagcagaccggccccagccacuccagccuggacgugcccuacccgauggagaagcccgccucccccagcuccuacaagcaggacuucaccaacagcaagcuccugaugaugcccuccgucaacaagagcuccccgcggcccgggggccccuaccugcagcccagccacgugaaccuccugucccaccagccgcccagcaaccugaaccagaacuccgccaacaaccagggcagcgugcucgacuacgggaacaccaagccccugucccacuacaaggccgacugcggccaggggagccccggcagcgggcaguccaagccggcgcugauggccuaccugccccagcagcucagccacaucucccacgagcagaacagccuguuccugaugaagcccaagccgggcaacaugcccuuccgcucccucgucccgcccggccaggagcagaaccccagcuccgugcccgugcaggcccaggccacgagcgucgggacccagccgcccgcgguguccguggccagcucccacaacagcucccccuaccugagcucccagcagcaggccgccgucaugaagcagcaccagcugcuccuggaccagcagaagcagcgggagcagcagcagaagcaccuccagcagcagcaguuccugcagcgccagcagcaccuccuggccgagcaggagaagcagcaguuccagcggcaccugacccgcccgccgccccaguaccaggaccccacccagggcagcuucccccagcaggucgggcaguucacgggcuccagcgcggccgugcccggcaugaacacccuggggcccuccaacagcagcugcccccggguguucccccaggccggcaaccugaugcccauggggcccggccacgccuccgugagcucccucccgaccaacagcgggcagcaggaccgcggcgucgcccaguuccccggcucccagaacaugccccagagcucccuguacgggauggcgagcggcaucacccagaucguggcccagcccccgccccaggccacgaacgggcacgcccacaucccccggcagaccaacgugggccagaacaccuccgucagcgccgcguacgggcagaacucccugggcagcuccggccucagccagcagcacaacaaggggacccugaaccccggccugacgaagccgcccgugccccgcguguccccggccaugggcgggcagaacagcuccuggcagcaccaggggaugcccaaccucagcggccagacccccggcaacuccaacgucagccccuucaccgccgccagcuccuuccacaugcagcagcaggcgcaccugaagaugagcuccccgcaguucagccaggccgugcccaaccggcccauggcccccauguccagcgccgccgcgguggggucccugcucccgcccgucagcgcccagcagcgcaccuccgcccccgcccccgccccgccgcccacggcgccccagcagggccugcccgggcugagccccgccggccccgagcucggggccuucucccagagccccgccucccagaugggcggccgggccgggcugcacugcacccaggcguacccggugcgcaccgccggccaggagcugcccuucgccuacagcgggcagcccggcggcuccgggcucagcuccguggccggccacaccgaccugaucgacagccugcucaagaaccggaccuccgaggaguggaugagcgaccuggacgaccugcucgggagccaguga

SEQ ID NO: 32625 - RNA, 3471 nt, Artificial Sequence
  derived and/or modified sequence opt1 from MAML2__Homo_sapiens__NP_115803
augggcgacaccgcgcccccgcaggcccccgccgggggccucgggggcgccagcggggccggccugcugggcgggggcuccgugacgccccgcguccacagcgccaucguggagcggcugcgcgcccggaucgcggugugccgccagcaccaccucuccugcgaggggcgguacgagcgcggccgggccgagagcuccgaccgcgagcgggagagcacccugcagcugcucucccugguccagcacgggcagggcgcccgcaaggccggcaagcacaccaaggcgaccgccaccgccgccacgaccaccgcgcccccgcccccgcccgcggccccgcccgccgccagccaggccgcggccaccgccgccccgccgcccccgcccgacuaccaccaccaccaccagcagcaccuccucaacuccagcaacaacgggggcuccgggggcaucaacggcgagcagcagccgcccgccagcacgcccggggaccagcggaacuccgcgcugaucgcccugcagggcagccucaagcgcaagcaggucgugaaccugucccccgccaacagcaagcggcccaacggguucgucgacaacuccuuccuggacaucaagcgcauccgggugggcgagaaccucagcgccgggcagggcggccugcagaucaacaacgggcagucccagaucaugagcggcacccugcccaugagccaggcgccccuccgcaagaccaacacccugcccucccacacgcacagccccgggaacggccuguucaacauggggcucaaggaggugaagaaggagcccggcgagacccuguccugcagcaagcacauggacggccagaugacccaggagaacaucuuccccaaccgguacggggacgaccccggcgagcagcugauggaccccgagcuccaggagcuguucaacgagcugaccaacaucuccgucccgcccaugagcgaccucgagcuggagaacaugaucaacgccacgaucaagcaggacgaccccuucaacaucgaccuggggcagcagucccagcgcagcaccccgcggcccucccuccccauggagaagaucgugaucaagagcgaguacucccccggccugacccaggggccgagcggcagcccccagcugcgcccgcccuccgccggccccgccuucuccauggccaacagcgcgcuguccaccagcucccccauccccagcgugccccagagccaggcccagccccagacgggguccggcgccagccgggcccugcccuccuggcaggaggugagccacgcccagcagcugaagcagaucgcggccaaccgccagcagcacgcccgcaugcagcagcaccagcagcagcaccagcccaccaacugguccgcccuccccagcuccgccgggccgagccccggccccuucggccaggagaagauccccuccccgagcuucgggcagcagaccuucagcccccaguccucccccaugcccggcguggccgggggcagcgggcaguccaaggugauggccaacuacauguacaaggccggcccgagcgcccagggcgggcaccuggacguccugaugcagcagaagccccaggaccucucccggagcuucaucaacaacccccacccggccauggagccccgccagggcaacaccaagccccuguuccacuucaacagcgaccaggcgaaccagcagaugcccuccgugcugccgagccagaacaagcccucccuccugcacuacacgcagcagcagcagcagcagcagcagcagcagcagcagcagcagcagcagcagcagcagcagcagcagcagcagcagcagcagcagcagcagcagcagcagcagagcuccaucagcgcccagcagcagcagcagcagcaguccagcaucuccgcccagcagcagcagcagcagcagcagcagcagcagcagcagcagcagcagcagcagcagcagcagcagcagcagcagcagcagcccagcucccagcccgcccagagccugccgucccagccccuccugcggagcccccugccccuccagcagaagcugcugcugcagcagaugcagaaccagccgaucgcggggaugggcuaccaggugucccagcagcagcgccaggaccagcacagcgucguggggcagaacaccggccccucccccagccccaacccgugcuccaaccccaacaccggcagcggguacaugaacagccagcagucccuccugaaccagcagcugaugggcaagaagcagacccuccagcggcagaucauggagcagaagcagcagcugcugcuccagcagcagaugcuggccgacgccgagaagaucgcgccccaggaccagaucaaccgccaccugagccggcccccgcccgacuacaaggaccagcgccggaacguggggaacaugcagcccacggcccaguacuccggcgggagcuccaccaucagccucaacuccaaccaggcccuggccaaccccgucagcacccacaccauccugacgccgaacuccagccuccuguccaccagccacggcacccgcaugcccucccugagcaccgccgugcagaacaugggcauguacgggaaccuccccugcaaccagcccaacacguacuccgugaccagcggcaugaaccagcugacccagcagcggaacccgaagcagcugcucgccaaccagaacaaccccaugaugccccgcccgcccacccuggggcccuccaacaacaacaacgucgccaccuucggcgcggggagcgugggcaacucccagcagcugcggcccaaccucacgcacagcauggccagcaugccgccccagcgcaccuccaacgucaugaucaccagcaacaccacggcccccaacugggccucccaggagggcaccagcaagcagcaggaggcccugaccuccgcgggggugcgguuccccaccggcacgccggccgccuacacccccaaccagagccugcagcaggccguggggucccagcaguucagccagcgcgcggucgccccgcccaaccagcucacccccgccgugcagaugcggcccaugaaccagaugucccagacccugaacggccagacgaugggcccccugcgcgggcucaaccugcggcccaaccagcugagcacccagauccucccgaaccugaaccaguccggcaccgggcugaaccagagccgcaccggcaucaaccagccgcccucccucacgcccagcaacuuccccucccccaaccagagcucccgcgccuuccaggggaccgaccacagcuccgaccuggccuucgacuuccugagccagcagaacgacaacaugggccccgcgcucaacagcgacgccgacuucaucgacucccugcugaagaccgagcccggcaacgacgacuggaugaaggacaucaaccucgacgagauccuggggaacaacagcuga

SEQ ID NO: 32626 - RNA, 3402 nt, Artificial Sequence
  derived and/or modified sequence opt1 from MAML3__Homo_sapiens__NP_061187
augggcgacuucgccgcccccgcggccgccgccaacgggagcuccaucugcaucaacagcucccugaacagcucccucggcggggccggcaucggggugaacaacaccccgaacagcacccccgcggcccccuccagcaaccaccccgccgccggcggcugcgggggcuccgggggccccgggggcggcagcgcggccguccccaagcacuccacggugguggagcgccugcggcagcgcaucgaggggugccggcgccaccacgucaacugcgagaaccgguaccagcaggcccagguggagcagcuggagcucgagcgccgggacaccgugagccuguaccagcgcacccuggagcagcgggccaagaaguccggcgccgggaccggcaagcagcagcaccccagcaagccccagcaggacgcggaggccgccuccgccgagcagcgcaaccacacgcucaucaugcugcaggagaccgucaagcggaagcuggagggcgcccgcagcccgcucaacggggaccagcagaacggcgcgugcgacgggaacuucucccccaccagcaagcggauccgcaaggacaucuccgccggcauggaggccaucaacaaccugcccagcaacaugccccugccgagcgccagcccccuccaccagcuggaccugaagcccucccucccccugcagaacuccgggacccacacgccgggccugcucgaggaccugagcaagaacggccggcugcccgagaucaagcuccccgugaacgggugcuccgaccuggaggacagcuucaccauccugcaguccaaggaccucaagcaggagccccuggacgacccgaccugcaucgacaccagcgagacgucccugagcaaccagaacaagcuguucuccgacaucaaccugaacgaccaggaguggcaggagcugaucgacgagcucgccaacaccgugcccgaggacgacauccaggaccuguucaacgaggacuucgaggagaagaaggagcccgaguucagccagcccgcgaccgagaccccgcugucccaggagagcgccuccgucaagagcgaccccucccacagccccuucgcccacguguccaugggcagcccccaggcccgcccgagcuccagcgggccgcccuucuccacggugagcaccgccaccucccucccgagcgucgcguccacccccgccgcccccaaccccgccagcuccccggcgaacugcgccgugcagagcccccagacgcccaaccaggcccacacccccggccaggccccgccccggcccgggaacggcuaccuccugaaccccgccgcggugaccgucgccggcuccgccagcgggccgguggccgugcccuccagcgacaugucccccgccgagcagcucaagcagauggcggcccagcagcagcagcgcgccaagcugaugcagcagaagcagcagcagcagcagcagcagcagcagcagcagcagcagcagcagcagcagcagcagcagcagcacagcaaccagaccuccaacuggagcccccugggcccgcccagcucccccuacggggccgccuucacggcggagaagcccaacagcccgaugauguacccccaggccuucaacaaccagaaccccaucgugcccccgauggccaacaaccuccagaagaccaccaugaacaacuaccugccccagaaccacaugaacaugaucaaccagcagcccaacaaccugggcaccaacucccucaacaagcagcacaacauccugacguacgggaacaccaagccgcugacccacuucaacgccgaccucagccagcggaugaccccgcccgucgcgaaccccaacaagaacccccugaugcccuacauccagcagcagcagcagcagcagcagcagcagcagcagcagcagcagcagcagcagccgccgccgccccagcugcaggcgccccgcgcccaccucuccgaggaccagaagcggcugcugcugaugaagcagaagggcgugaugaaccagcccauggccuacgccgcccuccccagccacggccaggagcagcaccccgucgggcugccccgcacgaccggccccaugcaguccagcgugccgcccggguccggcggcauggugagcggggccucccccgccggccccggguuccugggcagccagccccaggccgccaucaugaagcagaugcucaucgaccagcgcgcgcagcugaucgagcagcagaagcagcaguuccugcgggagcagcgccagcagcagcagcagcagcagcagauccucgccgagcagcagcugcagcagucccaccucccgcggcagcaccuccagccccagcgcaaccccuaccccguccagcaggucaaccaguuccaggggagcccccaggacaucgccgccgugcggucccaggccgcgcugcagagcaugcgcaccucccggcugauggcccagaacgccggcaugaugggcaucgggcccagccagaaccccggcaccauggccacggcggccgcccaguccgagauggggcuggccccguacagcaccacccccaccagccagcccggcauguacaacauguccaccgggaugacgcagaugcugcagcacccgaaccagagcggcauguccaucacccacaaccaggcccagggcccccgccagcccgcgagcgggcagggcguggggaugguguccggcuucgggcagagcaugcuggucaacuccgccaucacccagcagcacccccagaugaagggcccggugggccaggcccucccccggccccaggcgcccccgcgccugcagagccugauggggaccgugcagcagggcgcccaguccuggcagcagcggagccuccaggggaugcccggccgcacguccggggagcugggccccuucaacaacggcgccagcuacccccugcaggccgggcagccgcggcucaccaagcagcacuucccccagggccugucccagagcgucguggacgccaacaccgggaccgugcgcacgcugaaccccgccgccaugggccggcagaugaugcccucccucccgggccagcaggggaccagccaggcgcgccccauggucauguccggccugagccagggggugcccggcaugcccgccuucucccagccgcccgcccagcagcagauccccagcgggagcuucgcccccuccagccagucccaggccuacgagcggaacgcgccgcaggacgugagcuacaacuacuccggcgacggcgccgggggcagcuuccccgggcugcccgacggcgccgaccucgucgacuccaucaucaagggcgggcccggcgacgaguggaugcaggagcuggacgagcuguucgggaacccguga

SEQ ID NO: 32627 - RNA, 2997 nt, Artificial Sequence
  derived and/or modified sequence opt1 from MAMLD1__Homo_sapiens__NP_001170936
auggacgacuggaagagccgccuggugaucaaguccaugcucccccacuucgccauggucggcaaccggcaggagccgcgcaagcugcaggagagcgggaccgugaagcggcgccaggaggaggaccacuuccaguuccccgacauggccgacggcggguaccccaacaagaucaagcggcccugccuggaggacgugacccucgcgaugggcccgggggcccaccccuccacggccugcgccgagcugcagguccccccccugaccaucaacccgagccccgccgcgaugggcguggccggccagucccuccugcuggagaacaaccccaugaacgggaacaucaugggcagccccuucguggucccgcagaccaccgagguggggcucaagggccccacggugcccuacuacgagaagaucaacuccguccccgccguggaccaggagcugcaggagcugcucgaggagcugaccaagauccaggacccgagccccaacgagcuggaccucgagaagauccuggggaccaagcccgaggagccccuggugcucgaccacccgcaggccacccuguccacgacccccaagcccagcguccagaugucccaccuggagagccucgcguccagcaaggaguucgccuccagcugcucccaggugaccggcaugagccugcagauccccuccagcagcaccggcaucuccuacagcaucccguccacgagcaagcagaucgugucccccagcuccagcauggcccaguccaagagccagguccaggccaugcugcccguggcccuccccccgcugcccgugccccaguggcaccacgcgcaccagcugaaggcccucgccgccuccaagcaggggagcgccaccaagcagcagggcccgacccccuccuggagcgggcugccccccccgggccuguccccccccuaccgccccgucccgagcccccacccccccccgcucccccugccccccccgcccccccccuucuccccgcagagccugaugguguccugcaugagcagcaacacccucuccggcagcacgcugcgggggucccccaacgcgcugcucagcuccaugaccagcuccagcaacgccgcccugggccccgccaugcccuacgccccggagaagcugcccucccccgcgcucacccagcagccgcaguucgggccccagagcuccauccuggccaaccugaugagcuccaccaucaagacgccccagggccaccucaugagcgcccugcccgccuccaacccggggcccagcccccccuaccgcccggagaagcuguccagccccggccucccccagcagagcuucaccccccagugcucccugauccggagccugaccccgaccuccaaccuccugagccagcagcagcagcagcagcagcagcagcagcaggccaacgugaucuucaagcccaucuccagcaacuccagcaagacgcuguccaugaucaugcagcagggcauggcgagcuccagccccggggccaccgagcccuucaccuucggcaacaccaagccgcugucccacuucgucagcgagcccgggccccagaagaugcccuccaugccgacgaccagccgccagcccucccuccugcacuaccugcagcagcccacccccacccaggccagcuccgccacggcgagcagcaccgccaccgccacccuccagcugcagcagcagcagcagcagcagcagcagcagccggaccacuccagcuuccugcuccagcagaugaugcagcagccccagcgguuccagcgcuccguggccagcgacuccaugcccgcccugccccggcagcaggaggagcagcgcagcggccugauggcgaugacgccggagcggcagaacgccuacaucucccagcagaugagccccuucgaggccgugcaggagcaggucaccuccaagugcagccgcaucaaggccucccccccgagcuccaagcaccucaugcccccccggaccgggcugcugcagaacaaccucagccccggcaugaucccgcugacccgccaccaguccugcgagggcaugggggugaucagccccacccugggcaagcggcaggggaucuucacguccagcccccagugccccauccucucccacagcggccagaccccgcuggggcgccuggacagcgucugccagcacaugcagucccccaaggccaccccccccgaggugccgcuccccggcuucugccccagcucccugggcacccagagccuguccccccaccagcuccggcgcccgagcgugccccgcaugcccacggcguucaacaacgccgccugggucaccgccgccgcggccgugaccaccgccguguccgggaagacgccccugagccaggucgacaacuccgugcagcagcacagcccguccggccaggccugccugcagcggcccagcgacugggaggcgcaggugcccgccgccauggggacccaggucccccucgccaacaacccguccuucagccugcugggcucccagagccuccgccagucccccgugcagggccccgugcccgucgccaacaccaccaaguuccugcagcaggggauggcgagcuucuccccgcugagccccauccagggcaucgagcccccgagcuacguggccgccgccgccacggcggccgccgccuccgccguggcggccagccaguuccccgggcccuucgaccggaccgacauccccccggagcucccccccgccgacuuccugcgccagccccagccgccccugaacgaccucaucuccagccccgacugcaacgaggucgacuucaucgaggcccugcugaagggcuccugcgugagccccgacgaggacugggugugcaaccuccggcugaucgacgacauccuggagcagcacgcggccgcccagaacgccaccgcccagaacuccgggcaggucacccaggacgcgggcgcccucuga

SEQ ID NO: 32628 - RNA, 1962 nt, Artificial Sequence
  derived and/or modified sequence opt1 from MAN1A1__Homo_sapiens__NP_005898
augcccgugggcgggcugcucccgcuguucagcucccccgccggcgggguccugggcgggggccucggcgggggcgggggccgcaaggggagcggccccgccgcgcugcggcugaccgagaaguucgugcuccugcugguguucuccgccuucaucacccucugcuucggcgccaucuucuuccugcccgacagcuccaagcugcucagcgggguccuguuccacuccagcccggcccugcagcccgccgcggaccacaagcccggccccggggcccgcgccgaggacgccgcggagggccgggcccgccggcgcgaggagggcgccccgggggaccccgaggccgcccucgaggacaaccuggcgcggauccgcgagaaccacgagcgggcccugcgcgaggccaaggagacgcuccagaagcugcccgaggagauccagcgggacauccugcucgagaagaagaagguggcccaggaccagcugcgcgacaaggcccccuuccggggccugccgcccguggacuucgucccgcccaucgggguggagucccgcgagcccgcggacgccgccauccgggagaagcgcgccaagaucaaggagaugaugaagcacgccuggaacaacuacaagggcuacgcgugggggcucaacgagcugaagcccaucagcaagggcggccacuccagcucccuguucgggaacaucaagggcgccaccaucguggacgcccucgacacccuguucaucauggagaugaagcacgaguucgaggaggccaagagcugggucgaggagaaccuggacuucaacgugaacgccgagaucuccguguucgaggucaacauccgguucgucgggggccuccugagcgcguacuaccuguccggggaggagaucuuccgcaagaaggccguggagcucggcgugaagcugcugcccgccuuccacacccccagcggcaucccgugggcccuccugaacaugaaguccgggaucggccggaacuggcccugggcgagcgggggcagcuccauccuggccgaguucgggacgcuccaccuggaguucaugcaccugagccaccucuccggcaaccccaucuucgccgagaaggugaugaacauccgcaccgugcugaacaagcuggagaagccccagggccucuacccgaacuaccugaaccccagcuccgggcaguggggccagcaccacgucagcgucgggggccugggcgacuccuucuacgaguaccuccugaaggccuggcugaugagcgacaagaccgaccuggaggccaagaagauguacuucgacgcggugcaggccaucgagacccaccucauccggaaguccagcuccgggcugacguacaucgccgaguggaagggcgggcugcucgagcacaagaugggccaccugaccugcuucgccgggggcauguucgcccugggcgcggacgccgcccccgaggggauggcccagcacuaccucgagcugggcgccgagaucgcgcggaccugccacgagagcuacaaccgcaccuucaugaagcuggggcccgaggccuuccgcuucgacggcgggguggaggccaucgccacgcgccagaacgagaaguacuacauccuccggccggaggugauggagaccuacauguacauguggcgccugacccacgaccccaaguaccggaagugggcgugggaggccguggaggcccuggagaaccacugccgcgucaacggcggcuacuccgggcuccgggacguguaccugcugcacgagagcuacgacgacguccagcaguccuucuuccucgccgagacccugaaguaccuguaccucaucuucagcgacgacgaccugcugccccucgagcacuggaucuucaacuccgaggcccaccuccugccgauccugcccaaggacaagaaggagguggagauccgcgaggaguga

SEQ ID NO: 32629 - RNA, 2100 nt, Artificial Sequence
  derived and/or modified sequence opt1 from MAN1B1__Homo_sapiens__NP_057303
auggccgccugcgagggccgccggagcggggcgcugggcuccagccaguccgacuuccucacgcccccggucgggggcgcccccugggccguggccaccaccguggugauguacccgcccccgcccccgccgccccaccgcgacuucaucagcgucacccuguccuucggggagaacuacgacaacagcaaguccuggcggcgccggagcugcuggcgcaaguggaagcagcugucccggcuccagcgcaacaugauccuguuccugcucgccuuccugcuguucugcggccuccuguucuacaucaaccuggcggaccacuggaaggcccucgccuuccggcuggaggaggagcagaagaugcgccccgagaucgccggccugaagcccgcgaacccgcccgugcuccccgcgccccagaaggccgacaccgaccccgagaaccugcccgagaucagcucccagaagacccagcggcacauccagcgcgggccgccccaccuccagauccggccgcccagccaggaccucaaggacggcacgcaggaggaggccaccaagcgccaggaggcccccguggacccccggcccgagggggacccccagcgcaccgucaucuccuggcggggcgccgugaucgagcccgagcaggggaccgagcugcccagccgccgggccgaggugcccacgaagccgccccugccgcccgcccgcacccagggcacccccguccaccugaacuaccggcagaagggcgugaucgacguguuccugcacgccuggaagggguaccgcaaguucgccuggggccacgacgagcugaagcccgucucccgcagcuucuccgagugguucgggcucggccugacccugaucgacgcgcucgacacgauguggauccugggccugcggaaggaguucgaggaggcccgcaagugggugagcaagaagcuccacuucgagaaggacguggacgucaaccuguucgaguccaccauccggauccucgggggccugcugagcgccuaccaccugagcggggacucccucuuccugcgcaaggccgaggacuucggcaaccggcugaugcccgccuuccgcacccccagcaagauccccuacuccgacgugaacaucgggaccggcguggcgcacccgccccgguggacgagcgacuccaccgucgccgaggugaccagcauccagcucgaguuccgcgagcugucccggcugaccggcgacaagaaguuccaggaggccguggagaaggucacgcagcacauccacgggcucagcggcaagaaggacgggcuggugcccauguucaucaacacccacuccggccuguucacccaccucgggguguucacccugggcgcccgcgccgacagcuacuacgaguaccugcucaagcaguggauccagggcgggaagcaggagacgcagcugcuggaggacuacgucgaggcgaucgagggcgugcggacccaccuccugcgccacuccgagcccagcaagcugaccuucgucggggagcuggcccacggccgguucuccgccaagauggaccaccucgugugcuuccugcccgggacccuggcccucggcguguaccacggccugcccgcgagccacauggagcuggcccaggagcucauggagacgugcuaccagaugaaccgccagauggagaccgggcuguccccggagaucguccacuucaaccuguacccccagcccggccggcgcgacguggaggugaagcccgccgaccggcacaaccuccugcgcccggagaccgucgagagccuguucuaccucuaccgggugaccggggaccgcaaguaccaggacuggggcugggagauccugcaguccuucagccgcuucacgcgggugcccuccggcggguacagcagcaucaacaacguccaggacccccagaagcccgagccgcgcgacaagauggaguccuucuuccugggcgagacccucaaguaccuguuccuccuguucagcgacgaccccaaccugcugucccucgacgccuacguguucaacaccgaggcccacccccugcccaucuggaccccggcguga

SEQ ID NO: 32630 - RNA, 3435 nt, Artificial Sequence
  derived and/or modified sequence opt1 from MAN2A1__Homo_sapiens__NP_002363
augaagcugagccgccaguucaccguguucggcuccgccaucuucugcgucgugaucuucagccucuaccugaugcuggaccgggggcaccucgacuacccccgcaacccgcggcgcgagggcuccuucccccaggggcagcugagcaugcugcaggagaagaucgaccaccucgagcggcugcuggccgagaacaacgagaucaucuccaacauccgcgacagcgugaucaaccucuccgagagcgucgaggacggccccaaguccagccaguccaacuucagccagggggcgggcucccaccuccugcccagccagcucucccugagcguggacaccgccgacugccuguucgccucccagagcggcucccacaacagcgacgugcagaugcucgacgucuacagccugaucuccuucgacaacccggacgggggcguguggaagcagggguucgacaucacguacgagagcaacgagugggacaccgagccccuccagguguucgucgugccccacucccacaacgaccccggcuggcugaagaccuucaacgacuacuuccgggacaagacccaguacaucuucaacaacauggugcugaagcugaaggaggacagccgccggaaguucaucugguccgagaucagcuaccucuccaaguggugggacaucaucgacauccagaagaaggacgccgucaagagccugaucgagaacgggcagcuggagaucgugacgggcggcugggugaugccggacgaggccacgccccacuacuucgcgcucaucgaccagcugaucgaggggcaccaguggcuggagaacaacaucggcgucaagccccgcuccgggugggccaucgaccccuucggccacagcccgaccauggccuaccuccugaaccgggccggccugucccacaugcucauccagcgcgugcacuacgcggugaagaagcacuucgcccugcacaagacccuggaguucuucuggcggcagaacugggaccucgggagcgucaccgacauccugugccacaugaugcccuucuacuccuacgacaucccccacacgugcggccccgacccgaagaucugcugccaguucgacuucaagcgccugcccgggggccgguucgggugccccuggggcgugcccccggagaccauccaccccggcaacgugcagagccgcgcccggaugcuccuggaccaguaccgcaagaaguccaagcuguuccggaccaagguccuccuggcgccccugggggacgacuuccgcuacugcgaguacaccgagugggaccuccaguucaagaacuaccagcagcuguucgacuacaugaacagccaguccaaguucaaggugaagauccaguucggcacccugagcgacuucuucgacgcccucgacaaggccgacgagacccagcgggacaaggggcaguccauguuccccgugcugagcggcgacuucuucaccuacgccgaccgcgacgaccacuacuggagcggguacuucacgucccgcccguucuacaagcggauggaccgcaucauggagagccaccuccgggccgccgagauccuguacuacuucgcccugcgccaggcgcacaaguacaagaucaacaaguuccuguccagcucccuguacaccgcccucaccgaggcccggcgcaaccugggccuguuccagcaccacgacgccaucaccggcacggccaaggacugggucguggucgacuacgggacccggcuguuccacagccugauggugcuggagaagaucaucggcaacuccgcguuccuccugauccugaaggacaagcucaccuacgacagcuacucccccgacaccuuccuggagauggaccugaagcagaagucccaggacucccucccccagaagaacaucauccgccugagcgccgagccccgguaccugguggucuacaacccgcucgagcaggaccgcaucucccuggugagcguguacgucuccagccccacgguccagguguucuccgccagcgggaagcccguggagguccaggugagcgccgugugggacaccgccaacaccaucuccgagaccgcguacgagaucagcuuccgggcccacaucccgccccugggccucaagguguacaagauccuggaguccgccagcuccaacagccaccuggccgacuacgugcucuacaagaacaaggucgaggacuccgggaucuucacgaucaagaacaugaucaacaccgaggagggcaucacccuggagaacagcuucgugcugcuccgcuucgaccagaccggccugaugaagcagaugaugacgaaggaggacgggaagcaccacgaggugaacguccaguucuccugguacggcaccaccaucaagcgggacaagagcggggcguaccuguuccuccccgacggcaacgccaagcccuacguguacaccacgccgcccuucgugcgcgucacccacggccggaucuacuccgaggugaccugcuucuucgaccacgugacccaccgcguccggcuguaccacauccaggggaucgagggccagagcguggagguguccaacaucgucgacauccgcaagguguacaaccgggagaucgccaugaagaucagcuccgacaucaagagccagaaccgcuucuacaccgaccugaacggguaccagauccagccccgcaugacgcucuccaagcugccccugcaggccaacguguacccgaugaccaccauggccuacauccaggacgcgaagcaccggcucacccugcugagcgcccagucccucggcgucagcagccugaacuccgggcagaucgaggugaucauggaccgccggcugaugcaggacgacaaccgcggccucgagcagggcauccaggacaacaagaucacggccaaccuguuccggauccugcucgagaagcgcagcgccgugaacaccgaggaggagaagaaguccgucagcuaccccucccugcugagccacaucaccuccagccucaugaaccaccccgugauccccauggccaacaaguucuccagcccgacccuggagcugcagggggaguucagcccccuccagagcucccugcccugcgacauccaccuggugaaccuccggacgauccagagcaaggucggcaacgggcacuccaacgaggcggcccugauccugcaccgcaagggcuucgacugccgguucagcuccaaggggaccggccucuucugcagcaccacccagggcaagauccuggugcagaagcugcucaacaaguucaucguggagucccugacgcccagcagccugucccucaugcacagcccgcccgggacccagaacaucuccgagaucaaccugagccccauggagaucuccaccuuccgcauccagcugcgguga

SEQ ID NO: 32631 - RNA, 3453 nt, Artificial Sequence
  derived and/or modified sequence opt1 from MAN2A2__Homo_sapiens__NP_006113
augaagcugaagaagcaggugaccgucugcggcgccgccaucuucugcguggcgguguucagccucuaccugaugcuggaccgcguccagcacgaccccacccggcaccagaacgggggcaacuucccgcgcucccagaucagcgugcuccagaaccggaucgagcagcuggagcagcugcucgaggagaaccacgagaucaucucccacaucaaggacagcgugcuggagcugacggccaacgccgaggggccccccgccaugcuccccuacuacaccgucaacggcuccuggguggugccgcccgagccccgccccagcuucuucuccaucagcccgcaggacugccaguucgcccuggggggccggggccagaagcccgagcugcagaugcucaccgucuccgaggagcugcccuucgacaacguggacgggggcguguggcgccagggguucgacaucagcuacgacccccacgacugggacgcggaggaccugcaggucuucguggugccgcacucccacaacgaccccggcuggaucaagaccuucgacaaguacuacacggagcagacccagcacauccucaacagcauggucuccaagcugcaggaggacccccggcgccgguuccugugggccgaggugagcuucuucgccaaguggugggacaacaucaacgugcagaagcgcgccgcgguccggcgccucguggggaacggccagcuggagaucgccaccggcgggugggugaugcccgacgaggccaacucccacuacuucgcccugaucgaccagcucaucgagggccaccaguggcuggagcggaaccugggggccaccccgcgcagcggcugggcggucgaccccuucggcuacuccagcacgaugcccuaccuccugcggcgcgccaaccugaccuccaugcucauccagcgggugcacuacgccaucaagaagcacuucgccgccacccacagccuggaguucauguggcgccagaccugggacagcgacuccagcacggacaucuucugccacaugaugcccuucuacuccuacgacgugccgcacaccugcgggcccgaccccaagaucugcugccaguucgacuucaagcggcugcccggcgggcgcaucaacugcccguggaagguccccccccgggcgaucaccgaggccaacguggccgagcgcgccgcccuccugcuggaccaguaccgcaagaagagccagcucuuccgguccaacguccugcuggugccccucggcgacgacuuccgcuacgacaagccgcaggagugggacgcgcaguucuucaacuaccagcggcuguucgacuucuucaacagccgccccaaccugcacgugcaggcccaguucgggacccucuccgacuacuucgacgcccuguacaagcggacgggcgucgagcccggcgcccgcccgcccggguuccccgugcugagcggcgacuucuucuccuacgccgaccgggaggaccacuacuggaccggguacuacaccagccgccccuucuacaagucccucgaccgggugcuggaggcgcaccugcgcggcgccgagguccucuacagccuggccgccgcgcacgcccggcgcuccgggcuggccggccgguacccgcucagcgacuucacccugcugacggaggcccgccggacccugggccucuuccagcaccacgacgccaucaccgggaccgcgaaggaggccgugguggucgacuacggcgugcgccugcugcggucccucgugaaccugaagcaggucaucauccacgccgcccacuaccuggugcucggggacaaggagacguaccacuucgaccccgaggcccccuuccugcagguggacgacacccgccugagccacgacgcgcuccccgagcggaccgucauccagcuggacuccagcccgcgcuucguggugcuguucaacccccucgagcaggagcgcuucuccauggucagccugcuggugaacagcccccgggugcgcguccucuccgaggagggccagccccuggccgugcagaucagcgcccacugguccagcgccaccgaggccgugccggacgucuaccagguguccgugcccguccggcugcccgcgcucgggcugggcgugcugcagcuccagcugggccuggacgggcaccgcacgcuccccagcuccgugcggaucuaccugcacggccgccagcugagcgucucccggcacgaggccuucccgcuccgcgugaucgacagcgggaccuccgacuucgcccugagcaaccgguacaugcaggugugguucuccggccugaccggccuccugaagagcauccgccgggucgacgaggagcacgagcagcagguggacaugcaggugcuggucuacgggacccgcacguccaaggacaagagcggcgccuaccucuuccugcccgacggggaggcgaagcccuacgugcccaaggagccgcccgugcugcgggucaccgagggccccuucuucuccgaggugguggccuacuacgagcacauccaccaggccguccgccucuacaaccugcccgggguggagggccugagccucgacaucagcucccugguggacauccgggacuacgucaacaaggagcuggcccuccacauccacaccgacaucgacagccagggcaucuucuucaccgaccugaacggguuccaggugcagccgcgccgguaccugaagaagcucccccugcaggccaacuucuaccccaugccggugauggcguacauccaggacgcccagaagcgccugacgcuccacaccgcccaggcccugggcgucuccagccugaaggacgggcagcucgaggugauccuggaccggcgccugaugcaggacgacaaccggggccucgggcagggccugaaggacaacaagcgcaccugcaaccgcuuccggcugcuccuggagcgccggaccgugggcuccgagguccaggacagccacuccaccagcuaccccucccugcucagccaccugacguccauguaccugaacgcccccgcgcucgcccugcccguggcccgcaugcagcugccggggcccggccuccggagcuuccacccccuggccuccagccugcccugcgacuuccaccuccugaaccugcgcacccuccaggccgaggaggacacccugccguccgcggagaccgcccugauccuccaccggaagggguucgacugcggccuggaggccaagaaccugggguucaacugcacgaccagccagggcaaggucgcccucggcucccuguuccacgggcuggacgugguguuccuccagcccaccagccugacccugcucuacccccuggcgucccccagcaacagcacggacgucuaccuggagccgauggagaucgccaccuuccgccuccggcugggcuga

SEQ ID NO: 32632 - RNA, 3036 nt, Artificial Sequence
  derived and/or modified sequence opt1 from MAN2B1__Homo_sapiens__NP_000519
augggcgccuacgcccgcgcgagcggggugugcgcccggggcugccuggacuccgccgggcccuggaccaugagccgcgcccuccggccgccccugccgccccugugcuucuuccuccugcugcucgccgcggccggcgcccgcgccgggggcuacgagaccugcccgacgguccagcccaacaugcugaacgugcaccuccucccccacacccacgacgacgugggcuggcugaagaccgucgaccaguacuucuacgggaucaagaacgacauccagcacgcgggcgugcaguacauccuggacuccgugaucagcgcccuccuggccgaccccacccggcgcuucaucuacgucgagaucgccuucuucucccggugguggcaccagcagacgaacgccacccaggagguggugcgcgaccugguccggcaggggcgccucgaguucgcgaacggcgggugggugaugaacgacgaggccgccacccacuacggcgccaucguggaccagaugacccugggccugcgguuccucgaggacacguucgggaacgacggccgcccgcgggucgccuggcacaucgaccccuucgggcacagccgcgagcaggcgucccuguucgcccagaugggcuucgacggcuucuucuucgggcggcuggacuaccaggacaagugggugcgcaugcagaagcucgagauggagcaggucuggcgggccagcaccucccugaagccgcccaccgccgaccuguucaccggcguccuccccaacggguacaacccgccccgcaaccugugcugggacgugcugugcguggaccagccccucgucgaggacccccggagccccgaguacaacgccaaggagcugguggacuacuuccugaacguggcgacggcccagggccgcuacuaccggaccaaccacaccgucaugaccaugggguccgacuuccaguacgagaacgccaacaugugguucaagaaccucgacaagcugauccgccuggugaacgcccagcaggccaagggcagcuccgugcacgugcuguacagcacgcccgcgugcuaccugugggagcugaacaaggccaaccucaccugguccgugaagcacgacgacuucuuccccuacgccgacggcccgcaccaguucuggaccggguacuucagcucccgccccgcccugaagcgguacgagcgccugagcuacaacuuccuccaggucugcaaccagcuggaggcgcuggugggccucgccgccaacguggggcccuacggcuccggggacagcgcgccccugaacgaggccauggccguccugcagcaccacgacgccgugagcggcaccucccggcagcacguggccaacgacuacgcccgccagcucgccgcgggcugggggccgugcgagguccugcugagcaacgcccucgcccggcugcgcggcuucaaggaccacuucacguucugccagcagcugaacaucuccaucugcccccugagccagaccgccgcccgguuccaggugaucguguacaacccccucgggcgcaaggucaacuggauggugcggcugcccguguccgagggcgucuucguggugaaggacccgaacgggcgcaccguccccagcgacguggugaucuuccccuccagcgacucccaggcgcacccgcccgagcuccuguucagcgccucccugcccgcccugggcuucagcaccuacuccgucgcccaggugccccgguggaagccgcaggcgcgcgcgccccagcccaucccccggcgcagcugguccccggcccucacgaucgagaacgagcacauccgggccaccuucgaccccgacaccggccugcugauggagaucaugaacaugaaccagcagcuccugcugcccgugcgccagaccuucuucugguacaacgccagcaucggggacaacgaguccgaccaggccagcggcgccuacaucuuccggcccaaccagcagaagccgcuccccgucucccgcugggcccagauccaccuggugaagacgccccuggugcaggagguccaccagaacuucagcgccuggugcagccagguggugcggcucuaccccgggcagcgccaccuggagcuggagugguccgucggcccgauccccgugggcgacaccugggggaaggaggugaucagccgcuucgacacgccccucgagaccaagggccgguucuacaccgacuccaacgggcgcgagauccuggagcggcgccgggacuaccgccccaccuggaagcugaaccagaccgagccggucgccggcaacuacuaccccgugaacacccggaucuacaucacggacgggaacaugcagcucaccgugcugaccgaccgcagccagggcggcuccagccugcgggacgggucccucgagcugaugguccaccgccggcugcucaaggacgacggccgcggggugagcgagccccugauggagaacggcuccggggcgugggugcggggccgccaccugguccuccuggacaccgcccaggccgccgccgcgggccaccggcugcucgccgagcaggaggugcuggcgccccaggugguccuggcccccgggggcggggccgccuacaaccucggcgccccgccccgcacccaguucagcgggcugcggcgcgaccugccgcccuccgugcaccuccugacgcuggccagcuggggccccgagauggugcuccugcggcuggagcaccaguucgccgucggcgaggacuccgggcgcaaccucagcgcgcccgugacccugaaccugcgggaccucuucuccaccuucaccaucacgcgccugcaggagaccacccugguggccaaccagcuccgcgaggccgccagccggcugaaguggaccacgaacaccggccccacgccccaccagacccccuaccagcuggaccccgccaacaucacccucgagccgauggagauccgcaccuuccuggcguccguccaguggaaggagguggacggguga

SEQ ID NO: 32633 - RNA, 3174 nt, Artificial Sequence
  derived and/or modified sequence opt1 from MAN2C1__Homo_sapiens__NP_001243423
auggccgccgcgcccgcccugaagcacuggcgcaccacccucgagcggguggagaaguucgucagcccccuguacuucacggacugcaaccugcgcggccggcuguucggggccuccugccccguggccgugcugagcuccuuccugacccccgagcgccuccccuaccaggaggccguccagcgggacuuccgcccggcccaggugggcgacagcuucgggcccaccugguggaccugcugguuccggguggagcugacgauccccgaggcgugggucggccaggaggugcaccugugcugggaguccgacggggagggccucguguggcgcgacggcgagcccguccaggggcugaccaaggagggcgagaagaccagcuacgugcugaccgaccggcucggggagcgcgacccgcggucccugacgcuguacguggaggucgccugcaacggccuccugggggccggcaagggcagcaugaucgcggcccccgaccccgagaagauguuccagcugucccgcgccgagcucgccguguuccaccgggacgugcacaugcugcuggucgaccucgagcugcugcucgggaucgccaagggccuggggaaggacaaccagcgcagcuuccaggcgcuguacaccgccaaccagauggugaacgugugcgaccccgcccagccggagaccuuccccgucgcccaggcccucgcgucccgguucuucggccagcacggcggggagagccagcacaccauccacgccacgggccacugccacaucgacaccgccuggcuguggcccuucaaggagaccgugcgcaagugcgcccgguccugggugaccgcccugcagcucauggagcgcaaccccgaguucaucuucgcgugcagccaggcccagcagcuggagugggucaagucccgguacccggggcuguacagccgcauccaggaguucgccugccggggccaguucgugcccgucgggggcacguggguggagauggacggcaaccuccccuccggggaggccauggugcgccaguuccugcagggccagaacuucuuccugcaggaguucgggaagaugugcagcgaguucuggcuccccgacaccuucggcuacuccgcccagcugccgcagaucaugcacgggugcggcauccgccgguuccugacccagaagcucagcuggaaccuggucaacagcuucccccaccacaccuucuucugggagggccuggacgggucccgcgugcucgugcacuucccgcccggcgacagcuacgggaugcagggcuccgucgaggaggugcugaagacgguggcgaacaaccgggacaaggggcgcgccaaccacagcgccuuccuguucggcuucggcgacgggggcgggggccccacccagaccaugcucgaccggcugaagcgccuguccaacaccgacggccucccccggguccagcugagcagcccccgccagcuguucuccgcccuggaguccgacagcgagcagcucugcacgugggugggggagcuguuccuggagcuccacaacggcaccuacaccacccacgcgcagaucaagaaggggaaccgggagugcgagcgcauccugcacgacguggagcugcucuccagccuggcccuggcccgguccgcccaguuccucuaccccgccgcgcagcugcagcaccuguggcgccuccugcugcucaaccaguuccacgacgucgugacgggcagcugcauccagaugguggccgaggaggccaugugccacuacgaggacauccggucccacgggaacacccugcugagcgccgccgcggccgcccucugcgccggcgagccgggccccgaggggcugcugaucgucaacacccuccccuggaagcgcaucgaggugauggcccugccgaagcccggcggggcgcacucccugggccucacccccagccccggggacuccgcccagcacggccugugcagcugcagcuccccgcaccugacggccgcccccgcggcccccgccgccugcgugcggagcgcccgcgcgcccaccgacuccgccagccggccgccgcccaccaagaccgacggcuccgucacgcucgacaacgggaucauccgcgugaagcuggaccccaccggccggcugaccagccucgugcuggucgccuccgggcgcgaggccaucgccgagggcgcgguggggaaccaguucgugcuguucgacgacgucccccucuacugggacgccugggacgugauggacuaccaccuggagacccgcaagcccgugcugggccaggccggcacccucgccgucgggacggagggcgggcugcggggcagcgccugguuccugcuccagaucucccccaacagccgccugucccaggagguggugcuggacgucgggugccccuacgugcgguuccacaccgaggugcacuggcacgaggcgcacaaguuccucaaggucgaguucccggcccgcgugcggagcucccaggccaccuacgagauccaguucggccaccuccagcgccccacccacuacaacacgagcugggacugggcccgguucgaggugugggcgcaccgcuggauggaccuguccgagcacggcuucgggcucgcccugcugaacgacugcaaguacggcgccagcguccggggguccauccucagccugagccugcuccgcgcccccaaggcccccgacgcgaccgccgacaccggccggcacgaguucaccuacgcccugaugccgcacaagggcuccuuccaggacgccggggugauccaggccgcguacagccugaacuucccccuccuggcccugcccgcccccuccccggcccccgccacgagcugguccgcguucagcguguccagccccgccgucgugcucgagaccgugaagcaggccgaguccagcccgcagcgccggucccugguccugcgccucuacgaggcccacggcagccacguggacugcuggcugcaccugucccuccccgugcaggaggccauccugugcgaccugcucgagcggcccgaccccgcggggcaccugacccugcgcgacaaccggcucaagcugaccuucagcccguuccagguccugucccuccugcuggugcuccagcccccgccccacuga

SEQ ID NO: 32634 - RNA, 2640 nt, Artificial Sequence
  derived and/or modified sequence opt1 from MANBA__Homo_sapiens__NP_005899
augcgccugcaccuccugcugcuccuggcccugugcggcgccgggaccaccgcggccgagcucagcuacucccugcggggcaacuggagcaucugcaacgggaacggcucccuggagcuccccggggccgugccgggcugcguccacagcgcccuguuccagcagggccugauccaggacuccuacuaccgcuucaacgaccucaacuaccggugggugagccuggacaacuggacguacuccaaggaguucaagauccccuucgagaucagcaaguggcagaaggugaaccugauccucgagggggucgacaccguguccaagauccuguucaacgaggugaccaucggcgagaccgacaacauguucaaccgcuacagcuucgacaucacgaacgucgugcgggacgugaacuccaucgagcugcgcuuccagagcgccguccucuacgcggcccagcaguccaaggcccacacccgguaccaggugccgcccgacugcccgccccuggugcagaagggggagugccacgucaacuucgugcgcaaggagcagugcagcuucuccugggacuggggccccagcuuccccacccaggggaucuggaaggacgugcggaucgaggccuacaacaucugccaccugaacuacuucaccuucucccccaucuacgacaagagcgcgcaggaguggaaccucgagaucgaguccacguucgacgucgugagcagcaagcccgugggcggccaggucaucguggccauccccaagcugcagacccagcagaccuacuccaucgagcugcagcccgggaagcgcaucguggagcuguucgucaacaucagcaagaacaucaccguggagacgugguggccgcacggccacgggaaccagaccggcuacaacaugaccguccucuucgagcuggacggcgggcucaacaucgagaaguccgccaagguguacuuccggaccguggagcugaucgaggagcccaucaagggcagccccgggcuguccuucuacuucaagaucaacggcuuccccaucuuccucaaggggagcaacuggaucccggccgacuccuuccaggaccgcgucacgagcgagcugcugcggcuccugcugcaguccgugguggacgccaacaugaacacccuccgcgucuggggcggcgggaucuacgagcaggacgaguucuacgagcugugcgacgagcugggcaucaugguguggcaggacuucauguucgcgugcgcccucuaccccaccgaccagggguuccuggacagcgugaccgccgaggucgccuaccagaucaagcggcugaagucccaccccagcaucaucaucugguccggcaacaacgagaacgaggaggcccucaugaugaacugguaccacaucagcuucacggaccgccccaucuacaucaaggacuacgugacccuguacgugaagaacauccgggagcugguccucgcgggggacaagucccgcccguucaucaccagcucccccaccaacggcgccgagacgguggccgaggccugggugagccagaaccccaacuccaacuacuucggcgacguccacuucuacgacuacaucagcgacugcuggaacuggaagguguuccccaaggcccgguucgcgagcgaguacggguaccaguccuggccgagcuucuccacccuggagaaggugagcuccaccgaggacuggagcuucaacuccaaguucagccugcaccgccagcaccacgagggcgggaacaagcagaugcucuaccaggccggccugcacuucaagcugccccaguccaccgacccccugcggacguucaaggacaccaucuaccucacccaggucaugcaggcccagugcgugaagaccgagacggaguucuaccgccgcagccgguccgagaucguggaccagcaggggcacaccaugggcgcccuguacuggcagcugaacgacaucuggcaggcccccagcugggcgucccucgaguacggcgggaaguggaagaugcugcacuacuucgcccagaacuucuucgccccgcugcuccccgucggcuucgagaacgagaacaccuucuacaucuacggggugagcgaccugcacuccgacuacagcaugacccuguccgugcgcguccacacguggagcagccucgagcccgugugcucccgggugaccgagcgcuucgucaugaagggcggcgaggccgugugccuguacgaggagccggugagcgagcugcuccggcgcugcgggaacugcacccgggaguccugcgucgugagcuucuaccuguccgcggaccacgagcugcucagccccaccaacuaccacuuccuguccagccccaaggaggccgugggccugugcaaggcccagaucaccgccaucaucucccagcagggggacaucuucgucuucgaccucgagacgagcgccguggcgcccuucguguggcuggacgucggcuccaucccggggcgcuucagcgacaacggcuuccugaugaccgagaagacccggaccauccucuucuaccccugggagcccacguccaagaacgagcuggagcagagcuuccacgugaccucccugaccgacaucuacuga

SEQ ID NO: 32635 - RNA, 1389 nt, Artificial Sequence
  derived and/or modified sequence opt1 from MANEA__Homo_sapiens__NP_078917
auggccaaguuccgccggcggaccugcaucauccuggcccucuucauccuguucaucuucagccugaugaugggccucaagaugcugcgccccaacaccgcgacguucggggccccguucggccuggaccuccugcccgagcugcaccagcgcaccauccaccucgggaagaacuucgacuuccagaaguccgaccggaucaacagcgagaccaacaccaagaaccugaaguccguggagaucacgaugaagcccagcaaggccuccgagcugaaccucgacgagcugcccccgcugaacaacuaccuccacgucuucuacuacagcugguacggcaacccccaguucgacgggaaguacauccacuggaaccaccccgugcuggagcacugggacccccgcaucgccaagaacuacccgcagggccggcacaacccgcccgacgacaucggcuccagcuucuaccccgagcugggguccuacagcucccgcgaccccagcgugaucgagacccacaugcggcagaugcgcuccgccagcaucggcguccucgcgcuguccugguacccgcccgacgugaacgacgagaacggggagcccaccgacaaccuggugcccaccauccucgacaaggcccacaaguacaaccugaaggucacguuccacaucgagcccuacagcaaccgggacgaccagaacauguacaagaacgugaaguacaucaucgacaaguacggcaaccaccccgccuucuaccgcuacaagaccaagaccgggaacgcccugcccauguucuacguguacgacuccuacaucaccaagccggagaagugggcgaaccuccugacgaccagcggcucccggagcauccgcaacagccccuacgacggccuguucaucgcccuccuggucgaggagaagcacaaguacgacauccugcaguccggguucgacggcaucuacaccuacuucgccaccaacggguucacguacggcagcucccaccagaacugggccagccucaagcuguucugcgacaaguacaaccugaucuucauccccuccgugggccccggguacaucgacaccagcauccggccguggaacacccagaacacccgcaaccggaucaacggcaaguacuacgagaucgggcucuccgccgcgcugcagacgcgccccagccugaucuccaucaccagcuucaacgaguggcacgagggcacccagaucgagaaggccgugcccaagcggaccuccaacacggucuaccucgacuaccgcccccacaagccggggcuguaccuggagcucacccggaaguggagcgagaaguacuccaaggagcgcgccaccuacgcccuggaccgccagcugcccgugagcuga

SEQ ID NO: 32636 - RNA, 558 nt, Artificial Sequence
  derived and/or modified sequence opt1 from MANF__Homo_sapiens__NP_006001
augcgccggaugcgccggaugugggccacccagggccuggccguggcgcucgcccugagcguccugcccgggucccgcgcccuccggccgggcgacugcgaggugugcaucagcuaccuggggcgcuucuaccaggaccugaaggaccgggacgugaccuucucccccgccacgaucgagaacgagcucaucaaguucugccgcgaggcccggggcaaggagaaccgccugugcuacuacaucggggcgaccgacgacgccgccaccaagaucaucaacgaggucagcaagccccuggcccaccacauccccguggagaagaucugcgagaagcucaagaagaaggacucccagaucugcgagcugaaguacgacaagcagaucgaccugagcaccguggaccucaagaagcugcgggucaaggagcugaagaagauccucgacgacuggggcgagacgugcaagggcugcgcggagaaguccgacuacauccgcaagaucaacgagcugaugccgaaguacgcccccaaggccgccagcgcccggaccgaccuguga

SEQ ID NO: 32637 - RNA, 1296 nt, Artificial Sequence
  derived and/or modified sequence opt1 from MANSC1__Homo_sapiens__NP_060520
auguucuucggcggggagggcagccugaccuacacccucgugaucaucugcuuccugacgcugcgccucuccgccagccagaacugccugaagaagucccuggaggacgucgugaucgacauccagagcucccucagcaaggggauccggggcaacgagcccguguacaccuccacccaggaggacugcaucaacagcugcugcuccaccaagaacaucagcggggacaaggccugcaaccugaugaucuucgacacgcgcaagaccgcgcggcagccgaacugcuaccuguucuucugccccaacgaggaggccugcccccucaagcccgccaagggccugauguccuaccgcaucaucaccgacuucccgagccugacccggaaccuccccucccaggagcugccccaggaggacagccugcuccacggccaguucucccaggccgucacgccccuggcccaccaccacaccgacuacagcaagccgaccgacaucuccuggcgcgacacccugagccagaaguucggguccagcgaccaccucgagaagcuguucaagauggacgaggcgagcgcccagcugcucgccuacaaggagaagggccacucccagagcucccaguucagcuccgaccaggagaucgcccaccuccugcccgagaacgugagcgcgcugcccgccacgguggccgucgccagcccccacaccaccuccgccaccccgaagcccgcgacgcugcugcccaccaacgccuccgugacccccagcgggaccucccagccgcagcucgccacgaccgccccgcccgugaccaccgucacgagccagccgcccaccacccugaucuccaccguguucacgcgggccgcggccacccugcaggccauggccaccaccgccgugcucacgaccaccuuccaggcgcccaccgacagcaagggcucccuggagacgauccccuucaccgagaucagcaaccugacccucaacaccgggaacgucuacaaccccaccgcccuguccaugagcaacguggaguccagcacgaugaacaagaccgccagcugggagggccgcgaggccucccccggcagcuccagccagggguccgugcccgagaaccaguacggccugcccuucgagaaguggcuccugaucgggagccuccuguucggcguccuguuccuggugaucggccucgugcugcuggggcggauccucuccgagagccugcgccggaagcgcuacucccggcuggacuaccucaucaacggcaucuacgucgacaucuga

SEQ ID NO: 32638 - RNA, 1584 nt, Artificial Sequence
  derived and/or modified sequence opt1 from MAOA__Homo_sapiens__NP_000231
auggagaaccaggagaaggccagcaucgccggccacauguucgacguggucgugaucgggggcgggaucuccggccugagcgcggccaagcuccugaccgaguacgggguguccguccuggugcucgaggcccgcgaccgggugggcggccgcaccuacacgauccggaacgagcacgucgacuacguggacgucgggggcgccuacguggggcccacccagaaccgcauccugcggcugagcaaggagcucggcaucgagaccuacaaggugaacguguccgagcgccugguccaguacgugaaggggaagaccuacccguuccggggcgccuucccgcccguguggaaccccaucgcguaccuggacuacaacaaccucuggcgcacgaucgacaacaugggcaaggagauccccaccgacgcccccugggaggcccagcacgccgacaagugggacaagaugaccaugaaggagcugaucgacaagaucugcuggaccaagacggcgcggcgcuucgccuaccuguucgucaacaucaacgugaccagcgagccccacgagguguccgcccucugguuccugugguacgucaagcagugcgggggcaccacccggaucuucagcgugacgaacgggggccaggagcgcaaguucgugggcggguccggccaggucagcgagcggaucauggaccugcucggggaccaggugaagcugaaccaccccgugacccacgucgaccaguccagcgacaacaucaucaucgagacccugaaccacgagcacuacgagugcaaguacgugaucaacgccaucccgcccacccucacggccaagauccacuuccgccccgagcugcccgcggagcggaaccagcugauccagcgccucccgaugggcgccgucaucaagugcaugauguacuacaaggaggccuucuggaagaagaaggacuacugcgggugcaugaucaucgaggacgaggacgcccccaucuccaucacccuggacgacaccaagcccgacggcagccugcccgccaucaugggcuucauccucgcgcggaaggccgaccgccuggccaagcugcacaaggagauccggaagaagaagaucugcgagcucuacgccaaggugcuggggucccaggaggcccugcacccggugcacuacgaggagaagaacuggugcgaggagcaguacagcggcgggugcuacaccgcguacuucccgcccggcaucaugacgcaguacgggcgcgucauccggcagcccgugggccgcaucuucuucgccggcaccgagaccgccaccaagugguccggguacauggagggcgccguggaggccggggagcgcgcggcccgggagguccucaacggccuggggaaggugacggagaaggacaucugggugcaggagcccgagagcaaggacguccccgccguggagaucacccacaccuucugggagcgcaaccugcccuccgugagcggccuccugaagaucaucggcuucagcaccuccgucacggcccugggguucgugcucuacaaguacaagcugcugccccggagcuga

SEQ ID NO: 32639 - RNA, 1563 nt, Artificial Sequence
  derived and/or modified sequence opt1 from MAOB__Homo_sapiens__NP_000889
augagcaacaagugcgacguggucguggugggcgggggcaucuccgggauggccgccgcgaagcugcuccacgacagcggccugaacgucguggugcuggaggcccgcgaccgggucgggggccgcaccuacacccuccggaaccagaaggugaaguacguggaccugggcggguccuacgucggccccacgcagaaccgcauccugcggcucgccaaggagcuggggcuggagaccuacaaggugaacgagguggagcgccucauccaccacgucaagggcaagagcuacccguuccgggggcccuucccgcccguguggaaccccaucaccuaccuggaccacaacaacuucuggcgcaccauggacgacaugggccgggagauccccuccgacgcccccuggaaggcgccccuggccgaggagugggacaacaugacgaugaaggagcuccuggacaagcugugcuggaccgagagcgccaagcagcucgccacccuguucgugaaccugugcgucaccgccgagacgcacgagguguccgcgcucugguuccugugguacgugaagcagugcggcgggaccacccgcaucaucagcaccacgaacggcgggcaggagcggaaguucgucggcggcuccggccaggugagcgagcgcaucauggaccugcucggggaccgggugaagcuggagcgcccggucaucuacaucgaccagacccgggagaacgugcugguggagacccucaaccacgagauguacgaggccaaguacgucaucuccgccaucccgcccacccuggggaugaagauccacuucaacccgccccugcccaugaugcgcaaccagaugaucacgcgggugccccucggcagcgucaucaagugcaucguguacuacaaggagcccuucuggcgcaagaaggacuacugcgggaccaugaucaucgacggcgaggaggcccccguggccuacacccuggacgacaccaagcccgagggcaacuacgcggccaucaugggguucauccuggcccacaaggcccggaagcucgcccgccugacgaaggaggagcggcugaagaagcucugcgagcuguacgcgaagguccugggcucccucgaggcccuggagcccgugcacuacgaggagaagaacuggugcgaggagcaguacagcgggggcugcuacaccaccuacuucccgcccgggauccugacccaguacggccgcgugcuccgccagcccgucgaccggaucuacuucgccggcacggagaccgccacccacugguccggguacauggagggcgccguggaggcgggggagcgcgccgcccgggagauccugcacgccaugggcaagauccccgaggacgagaucuggcagagcgagcccgaguccguggacgucccggcccagcccaucaccacgaccuuccuggagcgccaccuccccagcgugcccgggcugcugcggcucaucggccugaccaccaucuucuccgcgacggcccugggcuuccucgcccacaagcgcgggcugcuggugcgggucuga

SEQ ID NO: 32640 - RNA, 3144 nt, Artificial Sequence
  derived and/or modified sequence opt1 from MAP10__Homo_sapiens__NP_061963
auggcccacugcggccagcugaccaacuggcucugccuggccugggagcgcaaggagagccccgacuuccuguccaucuuccuccgguacaucgaccugaccccgaagcugcacaagaucugcagcgacaagacgaucacccagaagacccacugccuccugccccugaucuccagcgcgcucuccagcaucgugcugauccaggggugguggcagaagaccgcccacaaguacgccuacaagggcgccaagcacaucgagcagcagaacccccagucccgccaccggccccgcccggccggggcgcugccccagaucagccgggacucccgccagcggugccuccugcugcgcuuccucguccggccccgcggcuucagcuucuccuucgccgagcccgccgccgcguucccgggggccacggccauggccgccagccuguccgagcggcuguucagccucgagcugcugguggacugggugcgccucgaggcgcggcugcugcccucccccgccgccgccgucgagcaggaggaggaggaggaggagaaggagcagggcgaggccagcuccccccgcggccucugcccggcgguggccuuccggcugcuggacuuccccacccuccugguguacccccccgacgggccgggcgcccccgccgccgagcccuggcccggggucauccgcuucggccgggggaagagcugccuguuccgccuccagccggcgacccugcacugccggcugcuccgcaccccccuggccacgcugcuccugcagcugccccccggccggccgacccccaccccccagcuccugggcgccugcgacaucucccuggccaccgccgcgcaccgcgugguggggcccgccgccagcggcugcagccaccgccaccgggggcgcuucccgcuccacaaccgggucggcgagcgcacgggcgacaucgcccuggcguaccggcugaccgaccucgggucccgccugcugagccagcucgagcggccccugaccuucacccgcacgggcgggggcgccgagguguccccccagacccagcaggagcggcagcagcugcagcagccggccagccagcccucccccaaggaggccgacaagccccugggggagcucgagaucccggaggcccagaaggaccugaaggagauggugaagagcaaggcggagugcgacaacgucggcuccguggagaacggcaagaccaacagcguggucaccugcuccggggccggcaacgggcgcaacgugagcucccugaacgaggaggugacggagcucgacauggagaccaacaucuucugcccccccccccuguacuacaccaaccugacccaggagaagccgccccccgcccaggccaagaucacgaucgagccccagaugaacgccccggaggagauggacgacgcgagccccgagaagaagcgggucaacccccccgcccaccgcuccugccucaagcacccgagcuccgccgcccacgagcacccccccaugcuggugaaccccccgcacauccagaacaucggcgccaccaaccagaccugccagaccgagcagaaccggaucaacacgauccgccagcugccccuccugaacgcgcugcucguggagcugagccugcucuacgaccagcccgucaccucccccgcccacauccacccgcaccuggccuggcuguaccggaccgaggacaagaagagccccgaguccagcgccaagagcaccugccgcuccgaggcgaagaaggacaagcggagcguggggggcugcgagaaguccgugagccuccaguacaagaagaaccagaucgagaacuacaaggaggacaaguacuccgagaagagcuccggcgcccugcacaagcgcguccccaaggggcggcugcucuacggccugacgaacacccugcgccuccgccugaagcugaccaacccggacaugcucgugguccacgagaagcgggagcuguaccgcaagcggcagagccagaugcuggggaccaaguuccgcauccccuccagcaaggugaagcuccuguccagcgccgagcagucccagaagccccagcugcccgaggacaaguaccucgacagcgacgccuccuucacggagaacagcgacaccucccggcagaucagcggcguguucgacgagccgagcaccuccaaggagaccaagcugaaguacgccaccgagaagaagacggucgacugcagcaagaaccgcaucaacaacgugucccuggaggagguggucagccccgcgaacuccaucauccccgagcggcucacccccaccaacauccuggggggcaacguggagaugaagauccagagcccgugcguguuccagcaggacgccgucguggaccgcaucguggacaaggagaucgacauccggcaggucaagaccacggacaacgacauccugauggccgacaucuccgacaagcgcaccggcaagaacagcugcuacgagaacaucuccgagcucaaguacagcgacgaccuguccagccccugcuacuccgaggacuucugcaccagcgaggacaccucccggagcuucaaggcccacgacuccagcucccgcacggagaaccccaagcacagccaguacaccagcaaguccagcgacaccgggguguccaagaagaagaacagcuccgaccggagcuccauccugagccccccguucuccgccggcagccccgugcacuccuaccgcaaguuccacaucagcaagacccaggacaagucccucgaggaggcgagcuccaucagcgccuccgaccugagcuccacgcacuggaccgagcagaaggagaaccagaucgaccagaacagcaugcacaacagcgagaucaccaagcgggcccaggacaucuccgucaagacccgcagcuccuggaagagccuggagaagucccagagcccccagacgucccaggugagcuccuaccuccccagcaacguguccgagcugaacguccuggacagcuccaccagcgaccacuucgaggaggggaacgacgacgugggcucccucaacaucagcaagcagugcaaggacaucugcgagcuggugaucaacaagcugccgggcuacaccauguga

SEQ ID NO: 32641 - RNA, 8412 nt, Artificial Sequence
  derived and/or modified sequence opt1 from MAP1A__Homo_sapiens__NP_002364
auggacggcguggccgaguucagcgaguacgucuccgagaccguggacgugcccagcccguucgaccugcucgagccccccaccuccgggggcuuccugaagcugagcaagcccugcugcuacaucuucccggggggccgcggggacuccgcccucuucgcggucaacggcuucaacauccugguggacggcgggagcgaccggaaguccugcuucuggaagcuggugcgccaccucgaccggaucgacagcguccugcugacgcacaucggcgccgacaaccuccccgggaucaacggccugcugcagcgcaagguggccgagcucgaggaggagcagucccaggggagcuccagcuacuccgacugggugaagaaccugaucagccccgagcugggcgucguguucuucaacgugcccgagaagcuccggcugccggacgccucccgcaaggccaagcggagcaucgaggaggcgugccugacccuccagcaccugaaccgccugggcauccaggccgagccccucuaccgggucguguccaacaccaucgagccccugacccuguuccacaagaugggggugggccgccucgacauguacguccugaaccccgugaaggacagcaaggagaugcaguuccugaugcagaagugggccgggaacuccaaggccaagacgggcaucgugcucccgaacggcaaggaggcggagaucagcguccccuaccugaccagcaucaccgcccuggugguguggcuccccgccaaccccaccgagaagaucguccgggugcuguucccggggaacgccccccagaacaagauccuggagggccucgagaagcugcgccaccuggacuuccuccgguaccccguggccacgcagaaggaccuggcguccggggccguccccaccaaccugaagccgagcaagaucaagcagcgcgccgacuccaaggagagccucaaggccaccaccaagacggccguguccaagcuggcgaagcgggaggaggucguggaggagggcgccaaggaggcccgcagcgagcuggccaaggagcucgccaagaccgagaagaaggcgaaggaguccagcgagaagccccccgagaagcccgccaagccggagcgggugaagaccgaguccagcgaggcccugaaggccgagaagcgcaagcugaucaaggacaaggucgggaagaagcaccucaaggagaagaucuccaagcuggaggagaagaaggacaaggagaagaaggagaucaagaaggagcggaaggagcugaagaaggacgagggccgcaaggaggagaagaaggacgccaagaaggaggagaagcggaaggacaccaagcccgagcucaagaagaucagcaagcccgaccugaagcccuucacgccggaggugcgcaagacccuguacaaggcgaaggugcccggccgcgucaagaucgaccggucccgcgccauccggggggagaaggagcugagcuccgagccccagaccccgcccgcccagaagggcaccgugccccuccccacgaucagcgggcaccgcgagcuggugcuguccagcccggaggaccucacccaggacuucgaggagaugaagcgggaggagcgcgcccugcuggcggagcagcgggacaccggccucggggacaagcccuucccccuggacaccgccgaggagggccccccguccacggccauccagggcaccccccccagcguccccgggcugggccaggaggagcacgugaugaaggagaaggagcucgugccggagguccccgaggagcaggggagcaaggaccgcggccuggacuccggggccgagaccgaggaggagaaggacaccugggaggagaagaagcagcgggaggccgagcgccugcccgaccggacggaggcgcgcgaggagagcgagcccgaggugaaggaggacgugaucgagaaggccgagcucgaggagauggaggagguccacccguccgacgaggaggaggaggacgccaccaaggccgagggcuucuaccagaagcacaugcaggagccccugaaggugaccccccggagccgcgaggccuucggcgggcgggagcugggccuccaggggaaggcgcccgagaaggagaccucccuguuccugagcucccucacgaccccggccggcgccaccgagcacgugagcuacauccaggacgagaccauccccggcuacuccgagacggagcagaccaucagcgacgaggagauccacgacgagcccgaggagcgccccgccccgccccgguuccacaccuccaccuacgaccugcccgggccggagggcgccgggcccuucgaggcgagccagcccgccgacuccgccguccccgccaccagcggcaagguguacgggacgccggagaccgagcugaccuaccccaccaacaucguggcggccccccucgccgaggaggagcacgucuccagcgccacguccaucaccgagugcgacaagcugagcagcuucgccaccuccguggcggaggaccagagcguggccucccugaccgccccccagacggaggagaccggcaagagcucccuccugcuggacaccgucaccagcaucccguccagccgcacggaggccacccagggccucgacuacgugcccuccgccgggaccaucagccccaccuccagccuggaggaggacaagggcuucaagucccccccgugcgaggacuucagcgugacgggggaguccgagaagcggggcgagaucaucgggaagggccugagcggcgagcgcgcggucgaggaggaggaggaggagaccgccaacguggagauguccgagaagcucugcagccaguacgggacccccguguucuccgcccccggccacgcccugcaccccggggagccggcccugggcgaggcggaggagcgcugccucagccccgacgacagcaccgucaagauggccuccccccccccgagcgggccccccuccgccacgcacacccccuuccaccagagcccgguggaggagaaguccgagccccaggacuuccaggaggccgacagcuggggcgacaccaagcggacccccggcguggggaaggaggacgcggccgaggagacggucaagcccggcccggaggaggggacccuggagaaggaggagaaggugccccccccgcgcuccccccaggcccaggaggcccccgugaacaucgacgagggccugaccgggugcaccauccagcuccugcccgcccaggacaaggcgaucgucuucgagaucauggaggccggcgagccgacgggccccauccugggggccgaggcccuccccggcgggcugcggacccugccccaggagccgggcaagccccagaaggacgaggugcuccgcuaccccgaccggagccugucccccgaggacgccgagagccuguccgugcucagcgucccgucccccgacaccgcgaaccaggagcccacccccaagagcccgugcggccugacggagcaguaccugcacaaggaccgcuggcccgaggugucccccgaggacacccagagccucucccugagcgaggagucccccagcaaggagaccagccuggacguguccagcaagcagcucuccccggagagccuggggacccugcaguucggcgagcucaaccuggggaaggaggagaugggccaccugaugcaggccgaggacacgucccaccacaccgcccccaugagcguccccgagccccacgccgccaccgcguccccgcccaccgacgggaccacgcgguacagcgcccagaccgacaucaccgacgacucccucgaccgcaagagccccgccuccagcuucucccacagcacccccuccggcaacggcaaguaccugccgggggccaucacgagccccgacgagcacauccugacccccgacuccagcuucuccaagagcccggagagccuccccggccccgcccuggaggacaucgcgaucaagugggaggacaaggugcccgggcugaaggaccggaccuccgagcagaagaaggagccggagcccaaggacgaggugcuccagcagaaggacaagacccuggagcacaaggaggucguggagcccaaggacacggccaucuaccagaaggacgaggcccugcacgugaagaacgaggccgucaagcagcaggacaaggcgcucgagcagaagggccgcgaccuggagcagaaggacaccgcccuggagcagaaggacaaggcccucgagcccaaggacaaggaccuggaggagaaggacaaggcccuggagcagaaggacaagaucccggaggagaaggacaaggcccucgagcagaaggacaccgcgcuggagcagaaggacaaggcccuggagcccaaggacaaggaccucgagcagaaggaccgggugcuggagcagaaggagaagauccccgaggagaaggacaaggcccuggaccagaaggugcgcagcgucgagcacaaggcccccgaggacaccguggccgagaugaaggaccgggaccucgagcagacggacaaggcgccggagcagaagcaccaggcccaggagcagaaggacaaggucuccgagaagaaggaccaggcccuggagcagaaguacugggcccuggggcagaaggacgaggcccucgagcagaacauccaggcgcuggaggagaaccaccagacccaggagcaggagagccuggugcaggaggacaagacccgcaagcccaagaugcucgaggagaagucccccgagaaggugaaggccauggaggagaagcuggaggcccugcucgagaagaccaaggcccugggccuggaggagagccucguccaggagggccgggcgcgcgagcaggaggagaaguacuggcgggggcaggacguggugcaggaguggcaggagacgucccccacccgcgaggagccggccggcgagcagaaggagcuggcccccgccugggaggacaccagccccgagcaggacaaccgguacuggcgcgggcgggaggacgucgcccuggagcaggacaccuacuggcgcgagcucuccugcgagcgcaaggugugguucccccacgagcuggacggccagggggcgcggccgcacuacacggaggagcgcgagagcaccuuccuggacgagggccccgacgacgagcaggaggugccccugcgggagcacgccacccgcucccccugggccagcgacuucaaggacuuccaggaguccagcccgcagaagggccucgaggucgagcgguggcuggccgagucccccguggggcugcccccggaggaggaggacaagcucacccgcagccccuucgagaucaucuccccccccgccagcccgcccgagauggugggccagcggguccccuccgcgcccgggcaggagagcccgauccccgaccccaagcugaugccccacaugaagaacgagccgacgacccccagcuggcuggccgacaucccccccugggugccgaaggaccgcccccucccccccgccccgcugucccccgcccccggccccccgacccccgcccccgagagccacacccccgcgccguucuccuggggcacggccgaguacgacagcguggucgccgccgugcaggagggggcggccgagcuggagggcgggcccuacuccccccucggcaaggacuaccggaaggccgagggggagcgcgaggaggagggccgggccgaggccccggacaagagcucccacagcuccaaggugcccgaggcgagcaagucccacgccaccaccgagcccgagcagaccgagcccgagcagcgcgagccgacgcccuaccccgacgagcggagcuuccaguacgccgacaucuacgagcagaugaugcugaccggccuggggcccgccugcccgacccgcgagcccccccucggcgccgcgggggacuggcccccgugccuguccaccaaggaggccgccgccggccggaacacgagcgccgagaaggagcuguccagccccaucucccccaagagccuccaguccgacacccccaccuucagcuacgcggcccuggccgggccgaccguccccccccgccccgagccgggccccagcauggagcccucccugacccccccggccgugcccccccgggcccccauccucagcaagggcccgucccccccccugaacgggaacauccugagcugcuccccggaccgccggagccccucccccaaggagagcggccgcucccacugggacgacagcacguccgacagcgagcucgagaagggggcgcgcgagcagcccgagaaggaggcccaguccccgagccccccccaccccaucccgaugggcucccccacccuguggcccgagaccgaggcccacgugagccccccgcuggacucccaccucgggcccgcccggcccagccuggacuuccccgcgagcgccuucggcuucuccagccugcagccggcccccccccagcuccccuccccggccgagccccgcagcgcccccugcggcucccuggcguucagcggggaccgggcccuggcccucgcccccggcccgcccacccgcacgcggcacgacgaguaccuggaggucaccaaggcccccucccuggacagcucccucccccagcugccgagccccuccagccccggggcgccgcugcucuccaaccugccccgccccgccagccccgcccuguccgagggcagcuccagcgaggccaccaccccggugaucuccagcguggccgagcgguucagccccucccucgaggcggccgagcaggagagcggggagcuggaccccggcauggagcccgccgcccacucccugugggaccucacgccgcugagccccgcgccccccgccucccuggaccucgcccuggccccggcccccagccugcccggcgacaugggggacggcauccuccccugccaccuggagugcuccgaggcggccaccgagaagccgagccccuuccagguccccuccgaggacugcgccgccaacgggcccaccgagaccagcccgaacccccccggccccgccccggcgaaggccgagaacgaggaggccgccgccugccccgcgugggagcgcggcgccuggcccgagggggccgagcgguccagccgcccggacacgcugcucucccccgagcagcccgugugccccgccggcgggagcggcgggccgcccuccagcgcgucccccgagguggaggccggcccccagggcugcgccaccgagccgcggccccaccgcggggagcugagccccuccuuccugaaccccccgcucccccccagcaucgacgaccgggaccugagcaccgaggagguccgccuggugggccgggggggccgccggcgcguggggggccccggcaccacggggggcccgugccccgucaccgacgagaccccccccaccuccgccagcgacuccgggagcucccagagcgacuccgacgugccgcccgagacggaggagugccccagcaucaccgccgaggcggcccucgacuccgacgaggacggcgacuuccugcccguggacaaggccgggggcgucagcggcacccaccacccgcggcccgggcacgacccccccccgcugccccagcccgacccgcgccccucccccccccggccggacgugugcauggccgaccccgagggccucagcuccgagagcgggcgcguggagcgccugcgggagaaggagaagguccagggccgcguggggcggcgcgcccccggcaaggcgaagcccgccuccccggcccggcgccuggaccuccggggcaagcgcagccccacccccgggaagggccccgccgaccgggccucccgcgcgccgccccggccccgcagcacgaccucccaggugacccccgccgaggagaaggacgggcacagcccgaugagcaagggccuggucaacggccugaaggccgggcccauggcccucuccagcaagggcuccagcggggcccccguguacguggaccuggcguacauccccaaccacugcuccggcaagaccgccgaccuggacuucuuccggcgcguccgggccagcuacuacgugguguccgggaacgacccggccaacggcgagcccagccgcgcgguccucgacgcccugcuggagggcaaggcccaguggggggagaaccuccaggugacgcugauccccacccacgacaccgaggugacccgggagugguaccagcagacgcacgagcagcagcagcagcugaacguccucgugcuggccuccagcuccaccguggucaugcaggacgagagcuuccccgccugcaagaucgaguucuga

SEQ ID NO: 32642 - RNA, 7407 nt, Artificial Sequence
  derived and/or modified sequence opt1 from MAP1B__Homo_sapiens__NP_005900
auggccaccguggugguggaggccaccgagcccgagcccagcggcagcaucgccaaccccgccgccagcaccagccccagccugucccaccgcuuccucgacagcaaguucuaccugcugguggucgugggggagaucgugaccgaggagcaccuccggcgcgccaucggcaacaucgagcuggggauccgguccugggacaccaaccugaucgagugcaaccucgaccaggagcugaagcuguucgucagccgccacuccgcccgguucagccccgaggugcccggccagaagauccuccaccaccgcuccgacgugcuggagaccgucgugcugaucaaccccagcgacgaggccguguccaccgagguccggcucaugaucaccgacgccgcccgccacaagcugcuggugcucaccgggcagugcuucgagaacaccggcgagcugauccugcagagcggcuccuucagcuuccagaacuucaucgagaucuucaccgaccaggagaucggggagcuccuguccaccacccaccccgccaacaaggcgagccugacccucuucugccccgaggagggcgacuggaagaacuccaaccuggaccggcacaaccugcaggacuucaucaacaucaagcucaacagcgccagcauccugcccgagauggaggggcuguccgaguucaccgaguaccucagcgaguccguggagguccccagccccuucgacauccuggagccgcccaccuccggcggguuccugaagcucagcaagcccugcugcuacaucuuccccggcggccgcggggacuccgcccuguucgccgugaacggcuucaacaugcugaucaacgggggcagcgagcggaaguccugcuucuggaagcucauccgccaccuggaccggguggacagcauccugcucacccacaucggcgacgacaaccugcccgggaucaacuccaugcugcagcgcaagaucgccgagcucgaggaggagcagagccagggcuccaccaccaacagcgacuggaugaagaaccugaucucccccgaccugggggucguguuccucaacgugcccgagaaccugaagaaccccgagcccaacaucaagaugaagcggagcaucgaggaggcgugcuucacccugcaguaccucaacaagcuguccaugaagcccgagccccuguuccgcagcgucggcaacaccaucgaccccgugauccucuuccagaagaugggggugggcaagcuggagauguacguccugaaccccgugaaguccagcaaggagaugcaguacuucaugcagcaguggaccggcacgaacaaggacaaggccgaguucauccugcccaacgggcaggaggucgaccuccccaucagcuaccugaccuccgugagcucccugaucguguggcaccccgccaaccccgccgagaagaucauccggguccucuucccgggcaacagcacccaguacaacauccuggaggggcuggagaagcucaagcaccuggacuuccugaagcagccccucgccacccagaaggaccugacgggccaggugcccaccccgguggucaagcagaccaagcugaagcagcgcgcggacucccgggagagccucaagcccgccgccaagccccugcccuccaagagcgugcgcaaggaguccaaggaggagaccccggaggugacgaaggucaaccacguggagaagccgcccaagguggagagcaaggagaaggucauggugaagaaggacaagcccaucaagaccgagaccaagccguccgugaccgagaaggagguccccagcaaggaggagcccucccccgugaaggccgagguggccgagaagcaggcgacggacgucaagccgaaggccgccaaggagaagaccgugaagaaggagaccaaggugaagcccgaggacaagaaggaggagaaggagaagcccaagaaggaggucgccaagaaggaggacaagacccccaucaagaaggaggagaagccgaagaaggaggaggugaagaaggaggugaagaaggagaucaagaaggaggagaagaaggagcccaagaaggaggucaagaaggagacgccgcccaaggaggugaagaaggaggugaagaaggaggagaagaaggaggucaagaaggaggagaaggagccgaagaaggagaucaagaagcugcccaaggacgccaagaaguccuccacgccccugagcgaggcgaagaagcccgccgcccugaagccgaaggugcccaagaaggaggaguccgugaagaaggacagcgucgccgcggggaagcccaaggagaagggcaagaucaaggugaucaagaaggagggcaaggccgccgaggccguggccgcggccgucgggaccggcgccaccaccgccgccgugauggcggccgccgggaucgccgccaucggcccggcgaaggagcuggaggccgagcggagccucauguccagccccgaggaccugacgaaggacuucgaggagcugaaggccgaggagguggacgucaccaaggacaucaagccccagcucgagcugaucgaggacgaggagaagcugaaggagaccgagcccguggaggccuacgugauccagaaggagcgcgaggucaccaaggggccggcggagucccccgacgagggcaucacgaccaccgagggcgagggggagugcgagcagacccccgaggagcucgagcccguggagaagcagggcguggacgacaucgagaaguucgaggacgagggggccggcuucgaggagagcuccgagacgggcgacuacgaggagaaggccgagaccgaggaggccgaggagccggaggaggacggggaggagcacgucugcgugagcgccuccaagcacagccccaccgaggacgaggaguccgcgaaggccgaggccgacgccuacauccgcgagaagcgggagagcguggccuccggcgacgaccgcgcggaggaggacauggacgaggccaucgagaagggggaggccgagcagagcgaggaggaggccgacgaggaggacaaggccgaggacgcgcgggaggaggaguacgagcccgagaagauggaggccgaggacuacgucauggccgugguggacaaggccgcggaggccggcggggccgaggagcaguacggcuuccugaccacgcccaccaagcagcugggcgcccaguccccggggcgcgagcccgccagcuccauccacgacgagacccuccccggcgggagcgaguccgaggcgaccgccagcgacgaggagaaccgggaggaccagcccgaggaguucacggccaccuccggcuacacccagagcaccaucgagaucagcuccgagccgacgcccauggacgagaugagcacgccccgcgacgucauguccgacgagaccaacaacgaggagaccgagagccccucccaggaguucgugaacaucacgaaguacgagagcucccuguacagccaggaguacuccaagccggccgacgugacgccccugaacggguucagcgagggcuccaagaccgacgccaccgacggcaaggacuacaacgcgagcgccuccacgaucuccccgcccuccagcauggaggaggacaaguucucccggagcgcccuccgcgacgccuacugcuccgaggucaaggccagcaccacccuggacaucaaggacagcaucuccgcggugagcuccgagaaggucagcccguccaagagccccucccugagccccagcccgcccagcccccucgagaagacgccccugggggagcgguccgugaacuucagccugacgcccaacgagaucaagguguccgccgaggccgaggucgcccccgugagccccgaggugacccaggaggucguggaggagcacugcgccucccccgaggacaagacccucgagguggucagcccgucccagagcgugaccggcuccgcggggcacacgcccuacuaccagagccccaccgacgagaaguccucccaccuccccaccgaggugaucgagaagccgcccgccguccccgugagcuucgaguucuccgacgccaaggacgagaacgagcgcgccagcgugucccccauggacgagccgguccccgacagcgagucccccaucgagaaggugcugagcccccuccgguccccgccccugaucggcagcgaguccgcguacgagagcuuccuguccgccgacgacaaggccagcgggcgcggcgccgagucccccuucgaggagaaguccggcaagcaggggucccccgaccaggugagcccggucuccgagaugaccagcaccagccucuaccaggacaagcaggagggcaaguccacggacuucgcccccaucaaggaggacuucgggcaggagaagaagaccgacgacguggaggcgaugagcucccagcccgcccuggcccuggacgagcggaagcucggcgacgugagccccacccagaucgacgucucccaguucgggagcuucaaggaggacaccaagauguccaucagcgagggcacgguguccgacaagagcgccaccccgguggacgagggcgucgccgaggacaccuacucccacauggaggggguggcgagcguguccaccgccagcgucgccacguccagcuuccccgagcccaccaccgacgacgugucccccagccugcacgccgaggugggcuccccgcacagcaccgaggucgacgacagccuguccgugagcgugguccagacgcccaccaccuuccaggagaccgagaugucccccagcaaggaggagugcccgcgccccauguccaucuccccgcccgacuucuccccgaagacggccaagagccggacccccgugcaggaccaccgcuccgagcagagcuccaugagcaucgaguucgggcaggagucccccgagcagagccucgcgauggacuucucccggcagagccccgaccacccgaccgugggcgccggcguccugcacaucaccgagaacgggcccacggagguggacuacucccccagcgacaugcaggacagcucccugagccacaagaucccgcccauggaggagcccuccuacacccaggacaacgaccucagcgagcugaucuccgugagccaggucgaggccucccccagcaccuccagcgcccacacccccucccagaucgcgagcccccugcaggaggacacgcucuccgacguggcgccgccccgcgacaugagccuguacgccucccugaccagcgagaaggugcagucccucgagggcgagaagcugagccccaaguccgacaucagcccgcugacgccccgggagagcagcccccucuacagccccaccuucuccgacagcacguccgccgucaaggagaagaccgcgaccugccacagcuccagcuccccgcccaucgacgcggccagcgccgagcccuacggguuccgcgccuccgugcuguucgacaccaugcagcaccaccuggcccucaaccgcgaccugagcacgccgggccuggagaaggacuccgggggcaagacccccggcgacuucagcuacgcguaccagaagcccgaggagaccacccggucccccgacgaggaggacuacgacuacgagagcuacgagaagacgacccgcaccuccgacgucgggggcuacuacuacgagaagaucgagcggaccaccaagagcccguccgacagcggguacagcuacgagacgaucggcaagaccaccaagacccccgaggacggggacuacuccuacgagaucaucgagaagacgacccgcacccccgaggagggcggcuacagcuacgacaucuccgagaagaccacgagcccgcccgaggucuccggguacagcuacgagaagaccgagcggucccgccggcuccuggacgacaucagcaacggcuacgacgacuccgaggacgggggccacacccugggggaccccagcuacuccuacgagaccacggagaagaucaccagcuuccccgaguccgagggcuacagcuacgagaccuccaccaagacgacccgcacccccgacaccagcacguacugcuacgagaccgccgagaagaucacccggacgccccaggccuccaccuacagcuacgagaccuccgaccucugcuacaccgccgagaagaagucccccagcgaggcccgccaggacguggaccugugccugguguccagcugcgaguacaagcaccccaagaccgagcucucccccagcuucaucaacccgaacccccuggagugguucgcguccgaggagcccacggaggagagcgagaagccccugacccaguccggcggggccccgccgccgcccggcgggaagcagcagggccggcagugcgacgagaccccgcccaccagcgucuccgagagcgcccccucccagacggacagcgacgugcccccggagaccgaggagugccccuccaucaccgccgacgcgaacaucgacagcgaggacgaguccgagaccauccccacggacaagaccgugaccuacaagcacauggacccgccgcccgcccccguccaggaccgcagcccgagcccccggcaccccgacgugagcauggucgaccccgaggcccucgccaucgagcagaaccugggcaaggcccugaagaaggaccucaaggagaagaccaagacgaagaagccggggaccaagaccaaguccagcagccccgugaagaaguccgacggcaagagcaagccccuggcggccucccccaagccggccgggcugaaggagagcuccgacaaggugagccgcgucgccucccccaagaagaaggagagcguggagaaggccgcgaagcccaccaccacgcccgaggugaaggccgcccggggcgaggagaaggacaaggagaccaagaacgccgccaacgcguccgccagcaaguccgccaagaccgccaccgccgggccgggcacgaccaagaccaccaagagcuccgcggugccgcccggccuccccguguaccuggaccugugcuacaucccgaaccacagcaacuccaagaacguggacgucgaguucuucaagcgcgugcggagcuccuacuacguggucagcgggaacgaccccgccgccgaggagcccucccgcgccgugcucgacgcgcugcuggagggcaaggcccagugggggagcaacaugcaggucacgcucauccccacccacgacagcgaggucaugcgggagugguaccaggagacccacgagaagcagcaggaccugaacaucauggugcuggccuccagcuccaccguggucaugcaggacgagagcuucccggccugcaagaucgagcucuga

SEQ ID NO: 32643 - RNA, 366 nt, Artificial Sequence
  derived and/or modified sequence opt1 from MAP1LC3A__Homo_sapiens__NP_115903
augcccagcgaccgcccguucaagcagcggcgcuccuucgccgaccggugcaaggaggugcagcagauccgcgaccagcaccccagcaagauccccgucaucaucgagcgguacaagggcgagaagcagcugcccgugcucgacaagaccaaguuccuggugccggaccacgucaacauguccgagcuggugaagaucauccgccggcgccuccagcugaaccccacccaggccuucuuccugcucgugaaccagcacagcauggucuccgugagcacgcccaucgcggacaucuacgagcaggagaaggacgaggacggguuccuguacaugguguacgccucccaggagaccuucggcuucuga

SEQ ID NO: 32644 - RNA, 378 nt, Artificial Sequence
  derived and/or modified sequence opt1 from MAP1LC3B2__Homo_sapiens__NP_001078950
augcccagcgagaagaccuucaagcagcgccggaccuucgagcagcgcguggaggacguccggcugauccgcgagcagcacccgacgaagauccccgugaucaucgagcgguacaagggcgagaagcagcuccccgugcuggacaagaccaaguuccugguccccgaccacgugaacauguccgagcucaucaagaucauccgccggcgccugcagcugaacgccaaccaggccuucuuccuccuggugaacgggcacagcauggucuccgugagcaccccgaucuccgagguguacgagagcgagaaggacgaggacggcuuccuguacauggucugcgcgucccaggagaccuucgggaugaagcucagcguguga

SEQ ID NO: 32645 - RNA, 378 nt, Artificial Sequence
  derived and/or modified sequence opt1 from MAP1LC3B__Homo_sapiens__NP_073729
augcccagcgagaagaccuucaagcagcgccggaccuucgagcagcgcguggaggacguccggcugauccgcgagcagcacccgacgaagauccccgugaucaucgagcgguacaagggcgagaagcagcuccccgugcuggacaagaccaaguuccugguccccgaccacgugaacauguccgagcucaucaagaucauccgccggcgccugcagcugaacgccaaccaggccuucuuccuccuggugaacgggcacagcauggucuccgugagcaccccgaucuccgagguguacgagagcgagaaggacgaggacggcuuccuguacauggucuacgcgucccaggagaccuucgggaugaagcucagcguguga

SEQ ID NO: 32646 - RNA, 3180 nt, Artificial Sequence
  derived and/or modified sequence opt1 from MAP1S__Homo_sapiens__NP_060644
auggccgccguggcgggcagcggggccgccgccgcccccuccagccugcuccuggucgugggcuccgaguucgggagcccgggccugcucaccuacgugcuggaggagcuggagcgcgggauccgguccugggacgucgaccccggcgugugcaaccucgacgagcagcugaagguguucgucagccgccacuccgcgaccuucagcuccaucgugaagggccagcggagccugcaccaccgcggggacaaccucgagacgcuggugcugcucaaccccuccgacaagagccuguacgacgagcugcggaaccuccugcuggaccccgccucccacaagcuccugguccuggccggcccgugccucgaggagaccggggagcugcugcuccagaccggcggguucagcccccaccacuuccugcaggugcugaaggaccgcgagauccgggacauccucgccaccacgccccccccggugcagccccccauccugaccaucaccugccccaccuucggcgacugggcgcagcuggccccggccguccccggccuccagggggcccugcgccugcagcuccggcugaacccccccgcccagcugccgaacuccgagggccucugcgaguuccuggaguacguggcggagagccuggagccccccucccccuucgagcuccuggagccgcccacgagcgggggcuuccugcgccucggccggcccugcugcuacaucuuccccgggggccugggggacgccgccuucuucgccgugaacggcuucaccguccuggugaacgggggcuccaacccgaagagcagcuucuggaagcucgugcgccaccuggaccgggucgacgccgugcuggugacccaccccggcgcggacucccuccccgggcugaacagccugcugcgccggaagcucgccgagcgcuccgaggucgccgccggcgggggcagcugggacgaccggcugcgccggcugaucucccccaaccucggggugguguucuucaacgccugcgaggcggccagccgccuggcccggggcgaggacgaggccgagcuggcccucucccugcuggcgcagcucggcaucaccccgcugccccugagccgcgggcccgucccggccaagcccacggugcucuucgagaagaugggcgucgggcgccuggacauguacgugcugcacccccccuccgccggcgccgagcggacccucgcgagcgugugcgcccugcuggucuggcacccggccgggcccggcgagaagguggugcgcguccucuuccccggcugcacccccccggccugccugcuggacgggcucgugcggcugcagcaccugcgcuuccuccgggagcccguggucaccccccaggaccuggagggccccgggcgcgccgaguccaaggagagcgugggcucccgggacagcuccaagcgcgagggccugcucgcgacgcacccgcggcccgggcaggagcgccccggcguggcccggaaggagcccgcccgcgccgaggccccgcggaagaccgagaaggaggcgaagaccccccgcgagcugaagaaggaccccaagcccagcgucucccggacccagccgcgcgaggugcggcgcgccgccagcuccgugcccaaccugaagaagacgaacgcccaggccgcgcccaagccccggaaggccccgagcaccagccacuccggguucccccccgucgccaacggcccgcgcagcccccccucccuccgcugcggggaggccagccccccguccgcggccugcggcagccccgccucccagcugguggccacccccagccuggagcucggccccaucccggccggggaggagaaggcgcuggagcugccccucgccgccuccagcaucccccggccccgcaccccgucccccgagagccaccggucccccgccgagggcagcgagcgccugucccugagcccccuccgggggggcgaggccgggccggacgcgucccccacggugaccacccccaccgucacgacccccagccugccggccgaggugggcagcccccacuccaccgagguggacgagagccuguccgucagcuucgagcaggugcucccccccuccgccccgaccagcgaggccggccugucccugccccuccgcgggccccgggcccgccggagcgcguccccccacgacguggaccugugccuggucagcccgugcgaguucgagcaccgcaaggccgugcccauggcccccgccccggcgucccccggcagcuccaacgacagcuccgcccggagccaggagcgcgccgggggccucggggccgaggagacgccccccaccuccgugagcgagucccugccgacccugagcgacagcgaccccgucccccucgcccccggcgcggccgacuccgacgaggacaccgagggcuucggggugccgcggcacgacccccugcccgacccccugaaggugccgcccccccuccccgacccgagcuccaucugcauggucgaccccgagaugcugccccccaagacggcccgccagaccgagaacgugagccggacccgcaagccgcuggcccggcccaacucccgcgccgcggcccccaaggccacccccguggccgccgcgaagaccaagggccucgccgggggcgaccgggccagccgcccgcuguccgcccggagcgagcccuccgagaaggggggccgcgccccccugagccgcaaguccagcacgcccaagaccgcgacccggggcccguccgggagcgccuccagccgccccggcgucuccgccacccccccgaagagccccguguaccucgaccuggccuaccugcccuccgggagcagcgcgcaccucguggacgaggaguucuuccagcggguccgcgcccugugcuacgugaucuccggccaggaccagcggaaggaggagggcaugcgcgccgugcuggacgcccuccuggccagcaagcagcacugggaccgggaccugcaggucacgcucauccccaccuucgacuccguggcgaugcacaccugguacgccgagacccacgcccgccaccaggcccuggggaucacggugcugggcagcaacuccauggucagcaugcaggacgacgccuucccggcgugcaagguggaguucuga

SEQ ID NO: 32647 - RNA, 1680 nt, Artificial Sequence
  derived and/or modified sequence opt1 from MAP2__Homo_sapiens__NP_001034627
auggccgacgagcgcaaggacgaggccaaggcgccccacuggaccagcgccccgcugaccgaggccuccgcccacagccacccgcccgagaucaaggaccagggcggggccggcgaggggcucgugcgguccgcgaacggcuuccccuaccgcgaggacgaggagggggccuucggcgagcacggcagccaggggacguacuccaacaccaaggagaacggcaucaacggggagcugaccagcgccgaccgggagaccgccgaggaggucuccgcgcgcaucguccagguggugacggccgaggccguggccgugcugaagggcgagcaggagaaggaggcccagcacaaggaccagaccgcggcccucccccuggccgccgaggagaccgccaaccugccgcccagcccgccgcccucccccgcgagcgagcagaccgucacgguggaggaggccgccgggggcgaguccgcccucgcccccagcguguucaagcaggcgaaggacaaggucuccaacagcacccuguccaagauccccgcccugcagggcagcaccaagagcccccgguacuccuccgccugccccagcaccacgaagcgcgccaccuucagcgacucccuccugauccagcccaccagcgccggguccaccgaccggcugcccuacagcaaguccggcaacaaggacggggugaccaagagccccgagaagcgcuccagccucccccggcccuccagcauccugccgccccgccggggcguguccggcgaccgcgacgagaacagcuucucccugaacagcuccaucagcuccagcgcgcggcgcaccacccgguccgagcccauccgccgggccggcaagagcgggaccagcacgcccaccaccccgggguccaccgccaucacgcccggcaccccgcccagcuacuccagccgcacccccgggacccccggcacgcccuccuacccgcggacgccccacacccccggcacccccaagagcgccauccucgucccguccgagaagaagguggcgaucauccgcacgccgcccaagagccccgccacccccaagcagcugcggcugaucaaccagccccuccccgaccugaagaacgugaaguccaagaucgggagcaccgacaacaucaaguaccagcccaagggcgggcagguccgcauccugaacaagaagaucgacuucuccaaggugcagagccgcugcggcuccaaggacaacaucaagcacagcgccgggggcggcaacgugcagaucgucaccaagaagaucgaccucucccacgugacgagcaagugcgggucccugaagaacauccggcaccgcccgggcgggggccgggugaagaucgagagcgucaagcuggacuucaaggagaaggcccaggccaagguggggagccucgacaacgcgcaccacgugcccggcggcgggaacgucaagaucgacucccagaagcugaacuuccgcgagcacgccaaggcccggguggaccacggcgccgagaucaucacccagagccccgggcgcuccagcgucgccagcccccggcgccuguccaacguguccagcuccggcagcaucaaccuccuggaguccccgcagcuggcgacccucgccgaggacgugaccgccgcccuggccaagcagggccuguga

SEQ ID NO: 32648 - RNA, 1182 nt, Artificial Sequence
  derived and/or modified sequence opt1 from MAP2K1__Homo_sapiens__NP_002746
augcccaagaagaagcccacccccauccagcugaaccccgcccccgacggcagcgccgugaacgggaccuccagcgcggagacgaaccucgaggcccugcagaagaagcuggaggagcucgagcuggacgagcagcagcgcaagcggcuggaggccuuccucacccagaagcagaaggucggcgagcugaaggacgacgacuucgagaagaucuccgagcugggggccggcaacgggggcgugguguucaaggucagccacaagccguccggccucgugauggcccgcaagcugauccaccuggagaucaagcccgcgauccggaaccagaucauccgcgagcuccaggugcugcacgagugcaacagccccuacaucgucggguucuacggcgccuucuacuccgacggggagaucagcaucugcauggagcacauggacggcgggucccuggaccaggugcucaagaaggccggccggauccccgagcagauccugggcaaggugagcaucgccgucaucaaggggcugaccuaccuccgcgagaagcacaagaucaugcaccgggacgugaagccguccaacauccuggugaacagccgcggcgagaucaagcugugcgacuucggggucuccggccagcucaucgacagcauggcgaacuccuucgugggcacccggagcuacaugucccccgagcgccugcaggggacgcacuacagcgugcaguccgacaucuggagcaugggccugagccucgucgagauggccguggggcgguaccccaucccgccgcccgacgccaaggagcuggagcugauguucggcugccagguggagggggacgccgccgagaccccgccccgcccccggacccccggccgcccccucuccagcuacggcauggacucccggccgcccauggcgaucuucgagcugcuggacuacaucgucaacgagcccccgcccaagcuccccagcgggguguucucccuggaguuccaggacuucgugaacaagugccugaucaagaaccccgccgagcgcgccgaccucaagcagcugaugguccacgccuucaucaagcggagcgacgccgaggagguggacuucgcgggcuggcugugcuccaccaucgggcucaaccagcccagcacgcccacccacgccgccggcguguga

SEQ ID NO: 32649 - RNA, 1203 nt, Artificial Sequence
  derived and/or modified sequence opt1 from MAP2K2__Homo_sapiens__NP_109587
augcuggcccgccggaagcccgugcucccggcccugaccaucaaccccaccaucgcggagggccccagccccacguccgagggggccagcgaggccaaccuggucgaccuccagaagaagcuggaggagcuggagcucgacgagcagcagaagaagcgccuggaggccuuccugacccagaaggccaaggugggcgagcucaaggacgacgacuucgagcggaucuccgagcugggggcgggcaacgggggcguggucaccaaggugcagcaccgcccgagcggccugaucauggcccggaagcucauccaccuggagaucaagcccgccauccgcaaccagaucauccgggagcuccaggugcugcacgagugcaacucccccuacaucgucggguucuacggcgccuucuacagcgacggggagaucuccaucugcauggagcacauggacggcgggagccuggaccaggugcugaaggaggcgaagcgcauccccgaggagauccucggcaagguguccaucgccguccugcggggccuggccuaccuccgcgagaagcaccagaucaugcaccgggacgugaagccgagcaacauccuggugaacucccgcggggagaucaagcugugcgacuucggcgucagcgggcagcucaucgacuccauggccaacagcuucgugggcacccgguccuacauggcccccgagcgccugcagggcacgcacuacagcgugcaguccgacaucuggagcauggggcugucccucgucgagcuggcggugggccgguaccccaucccgccgcccgacgccaaggagcuggaggccaucuucgggcgccccguggucgacggcgaggagggggagccccacagcaucagcccgcggccccgcccgcccggccggcccguguccggccacgggauggacagccgccccgccauggccaucuucgagcuccuggacuacaucgugaacgagcccccgcccaagcugcccaacggcgucuucacccccgacuuccaggaguucgugaacaagugccucaucaagaaccccgcggagcgggccgaccugaagaugcugaccaaccacaccuucaucaagcgcuccgagguggaggaggucgacuucgccggguggcucugcaagacgcugcgccugaaccagcccggcacccccacccggaccgccguguga

SEQ ID NO: 32650 - RNA, 957 nt, Artificial Sequence
  derived and/or modified sequence opt1 from MAP2K3__Homo_sapiens__NP_002747
augagcaagcccccggcccccaaccccacgcccccgcgcaaccuggacucccggaccuucaucaccaucggcgaccgcaacuucgagguggaggccgacgaccucgucaccaucagcgagcuggggcggggcgcguacggggugguggagaagguccgccacgcccaguccggcaccaucauggccgugaagcggauccgcgccaccgugaacagccaggagcagaagcggcugcucauggaccuggacaucaacaugcgcacggucgacugcuucuacaccgugaccuucuacggggcccuguuccgggagggcgacguguggaucugcauggagcucauggacaccucccuggacaaguucuaccgcaagguccuggacaagaacaugacgauccccgaggacauccucggcgagaucgcggugagcaucgugcgggcccuggagcaccuccacuccaagcugagcgucauccaccgcgacgugaagcccuccaacgugcugaucaacaaggaggggcacgucaagaugugcgacuucggcaucagcggguaccugguggacuccguggccaagaccauggacgccggcugcaagcccuacauggcgccggagcggaucaaccccgagcucaaccagaagggguacaacgucaagagcgacguguggucccugggcaucaccaugaucgagauggccauccugcgcuuccccuacgagagcuggggcacccccuuccagcagcucaagcaggucguggaggagccgagcccccagcugcccgccgaccgguucucccccgaguucguggacuucacggcccagugccugcgcaagaacccggccgagcggauguccuaccucgagcugauggagcaccccuucuucacccugcacaagaccaagaagaccgacaucgcggccuucgugaaggagauccucggggaggacagcuga

SEQ ID NO: 32651 - RNA, 1233 nt, Artificial Sequence
  derived and/or modified sequence opt1 from MAP2K4__Homo_sapiens__NP_001268364
auggccgcccccagcccguccggcgggggcgggagcggcgggggcuccggcagcgggacccccggccccguggggucccccgcgccgggccaccccgccgucagcuccaugcagggguuccagaucaacuucugcgagaaggcccagagcaagcgcaaggcccugaagcucaacuucgccaacccgcccuucaaguccaccgcgcgguucacgcugaaccccaaccccaccggcgugcagaacccccacaucgagcgccugcggacccacagcaucgaguccagcggcaagcucaagaucucccccgagcagcacugggacuucaccgccgaggaccugaaggaccugggggagaucggccgcggggccuacggcagcgugaacaagaugguccacaagccguccggccagaucauggccgugaagcggauccgcagcacgguggacgagaaggagcagaagcagcuccugauggaccuggacgucgugaugcgguccagcgacugccccuacaucgugcaguucuacggggcccucuuccgcgagggcgacugcuggaucugcauggagcugauguccaccagcuucgacaaguucuacaaguacgucuacagcgugcuggacgacgugauccccgaggagauccucgggaagaucacccuggcgaccgucaaggcccugaaccaccucaaggagaaccugaagaucauccaccgggacaucaagcccuccaacauccugcucgaccgcagcggcaacaucaagcugugcgacuucgggaucuccggccagcugguggacagcaucgccaagacgcgggacgccggcugccgcccguacauggcgcccgagcggaucgaccccuccgccagccgccagggguacgacgugcgguccgacgucuggagccucggcaucacccuguacgagcuggccaccgggcgcuuccccuacccgaaguggaacuccguguucgaccagcucacccagguggucaagggcgacccgccccagcugagcaacuccgaggagcgggaguucagccccuccuucaucaacuucgugaaccugugccucacgaaggacgagagcaagcgccccaaguacaaggagcugcugaagcaccccuucauccucauguacgaggagcgggccguggaggucgccugcuacgugugcaagauccuggaccagaugcccgcgacccccuccagcccgauguacguggacuga

SEQ ID NO: 32652 - RNA, 1239 nt, Artificial Sequence
  derived and/or modified sequence opt1 from MAP2K5__Homo_sapiens__NP_001193733
augauggagggccacuucccccagagcgacgugaucgggcagguccugcccgaggccaccaccacggccuucgaguacgaggacgaggacggcgaccgcaucaccgugcgguccgacgaggagaugaaggcgaugcucagcuacuacuacuccaccgugauggagcagcaggucaacgggcagcugaucgagccccugcagaucuucccccgcgccugcaagcccccgggcgagcggaacauccacgggcucaaggugaacacccgcgccggccccagccagcacuccagccccgccguguccgacagccugcccuccaacagccugaagaaguccagcgccgagcucaagaagauccuggcgaacggccagaugaacgagcaggacauccgguaccgcgacacgcuggggcacggcaacgggggcaccgucuacaaggccuaccacgugccguccgggaagauccucgccgugaaggucauccugcuggacaucacccucgagcugcagaagcagaucaugagcgagcuggagauccucuacaagugcgacuccagcuacaucaucggcuucuacggcgccuucuucguggagaaccggaucuccaucugcaccgaguucauggacgggggcagccuggacguguaccgcaagaugcccgagcacguccuggggcggaucgcgguggccguggucaagggccucacguaccuguggucccugaagauccuccaccgcgacgugaagcccagcaacaugcuggugaacacccggggccaggucaagcugugcgacuucggggugagcacccagcucgugaacuccaucgccaagaccuacgucggcacgaacgccuacauggcccccgagcgcaucagcggggagcaguacggcauccacuccgacguguggagccuggggaucuccuucauggagcuggcgcucggccgguucccguacccccagauccagaagaaccagggcagccugaugccccugcagcuccugcagugcaucguggacgaggacucccccguccugccggugggggaguucagcgagcccuucguccacuucaucacccagugcaugcgcaagcagcccaaggagcggcccgccccggaggagcucaugggccaccccuucaucgugcaguucaacgacgggaacgccgccguggucuccaugugggugugccgcgcccuggaggagcggcgcagccagcagggcccgcccuga

SEQ ID NO: 32653 - RNA, 1005 nt, Artificial Sequence
  derived and/or modified sequence opt1 from MAP2K6__Homo_sapiens__NP_002749
augagccaguccaagggcaagaagcgcaaccccgggcugaagaucccgaaggaggccuucgagcagccccagaccagcuccaccccgccccgggaccucgacagcaaggccugcaucuccaucggcaaccagaacuucgaggugaaggcggacgaccuggagcccaucauggagcuggggcgcggcgccuacggggucguggagaagaugcggcacgugcccagcggccagaucauggccgucaagcgcauccgggccacggugaacucccaggagcagaagcgccuccugauggaccuggacaucagcaugcggaccguggacugccccuucaccgucaccuucuacggcgcccucuuccgcgagggggacguguggaucugcauggagcugauggacacgucccuggacaaguucuacaagcaggucaucgacaagggccagaccauccccgaggacauccucgggaagaucgcggugagcaucgugaaggcccuggagcaccuccacuccaagcugagcgugauccaccgggacgucaagccguccaacgugcugaucaacgcccugggccaggugaagaugugcgacuucgggaucagcggcuaccucgucgacuccguggccaagaccaucgacgcgggcugcaagcccuacauggcccccgagcgcaucaaccccgagcugaaccagaagggguacagcgugaaguccgacaucuggagccugggcaucaccaugaucgagcucgccauccugcgguucccguacgacuccugggggacgcccuuccagcagcugaagcaggucguggaggagcccagcccccagcucccggccgacaaguucagcgccgaguucguggacuucaccucccagugccugaagaagaacagcaaggagcgccccaccuaccccgagcugaugcagcaccccuucuucacccuccacgaguccaagggcacggacgucgcgagcuucgugaagcugauccugggcgacuga

SEQ ID NO: 32654 - RNA, 1308 nt, Artificial Sequence
  derived and/or modified sequence opt1 from MAP2K7__Homo_sapiens__NP_001284484
auggccgccagcucccuggagcagaagcugagccgccuggaggcgaagcugaagcaggagaaccgggaggcccgccggcgcaucgaccucaaccuggacaucagcccccagcggccgcgccccaucaucgugaucacccugucccccgcccccgccccgucccagcgggccgcgcuccagcugccccuggccaacgacggcgggagccgcucccccagcuccgagagcagcccccagcacccgaccccgcccgcccggccccgccacaugcucggccugcccuccacgcuguucacgccccgguccauggagagcaucgagaucgaccagaagcuccaggagaucaugaagcagaccggguaccugaccaucggcgggcagcgcuaccaggccgagaucaacgaccuggagaaccucggcgagaugggcuccgggaccugcggccaggucuggaagaugcgguuccgcaagaccgggcacgugaucgcggugaagcagaugcggcgcagcggcaacaaggaggagaacaagcggauccugauggaccuggacgucgugcucaagucccacgacugccccuacaucgugcagugcuucgggaccuucaucaccaacacggacgucuucaucgccauggagcugauggggaccugcgccgagaagcugaagaagcgcaugcagggccccaucccggagcggauccucggcaagaugaccguggccaucgugaaggcccuguacuaccugaaggagaagcacggcgucauccaccgcgacgugaagcccagcaacauccuccuggacgagcgggggcagaucaagcugugcgacuucggcaucuccggccgccucguggacagcaaggcgaagacccgcagcgccgggugcgccgccuacauggcccccgagcggaucgacccgcccgaccccacgaagcccgacuacgacauccgcgcggacgucuggucccugggcaucagccugguggagcucgccaccgggcaguuccccuacaagaacugcaagaccgacuucgaggugcugaccaagguccugcaggaggagccgccccuccugcccggccacaugggguucuccggcgacuuccagagcuucgugaaggacugccugacgaaggaccaccggaagcgccccaaguacaacaagcuccuggagcacuccuucaucaagcgguacgagacccuggagguggacgucgccagcugguucaaggacgugauggccaagaccgaguccccgcgcaccagcggcgugcucucccagccccaccuccccuucuuccgguga

SEQ ID NO: 32655 - RNA, 2865 nt, Artificial Sequence
  derived and/or modified sequence opt1 from MAP3K10__Homo_sapiens__NP_002437
auggaggaggaggagggcgccguggccaaggagugggggaccacccccgcgggcccggucuggacggccguguucgacuacgaggccgccggggacgaggagcugacccuccgccggggcgaccgcgugcagguccugagccaggacugcgccguguccggggacgagggcugguggaccggccagcugcccagcgggcgggugggcgucuuccccuccaacuacguggcgcccggggccccggccgcccccgcgggccuccagcugccccaggagauccccuuccacgagcugcagcucgaggagaucaucggggugggcggcuucgggaaggucuaccgcgcccuguggcggggcgaggagguggccgugaaggccgcccgccuggacccggagaaggaccccgcggucaccgccgagcaggugugccaggaggcccggcucuucggggcccugcagcaccccaacaucaucgcccugcgcggcgcgugccucaaccccccgcaccugugccuggugauggaguacgcccggggcggggcccucagccgcguccuggccggccggcgcgugcccccccacgugcuggucaacugggccgugcagguggcgcgggggaugaacuaccuccacaacgacgcccccgucccgaucauccaccgcgaccugaaguccaucaacauccugauccucgaggccaucgagaaccacaaccuggccgacacggugcugaagaucaccgacuucggccucgcccgggaguggcacaagaccaccaagaugagcgcggccgggacguacgccuggauggcccccgaggugauccgccugucccuguucagcaaguccagcgacgucugguccuucggcgugcuccugugggagcugcucaccggcgagguccccuaccgggagaucgacgcgcuggccguggccuacgggguggccaugaacaagcugacccuccccaucccgagcaccugccccgagcccuucgcccgccugcuggaggagugcugggaccccgacccgcacggccggcccgacuucggguccauccucaagcgccuggaggucaucgagcagagcgcgcuguuccagaugccccucgaguccuuccacagccugcaggaggacuggaagcuggagauccagcacauguucgacgaccuccggacgaaggagaaggagcugcgcucccgcgaggaggagcugcuccgggccgcccaggagcagcgcuuccaggaggagcagcugcggcgccgggagcaggagcuggccgagcgcgagauggacaucguggagcgggagcuccaccugcugaugugccagcugagccaggagaagccccgcgugcggaagcgcaagggcaacuucaagcggucccgccuccugaagcugcgggaggggggcagccacaucagccucccguccggcuucgagcacaagaucaccguccaggccagccccacccuggacaagcgcaagggguccgacggcgcgagccccccggccucccccagcaucaucccccggcugcgcgccauccggcucacccccguggacugcgggggcuccagcuccgggagcuccagcggcggcuccgggacguggagccgcggcgggccgcccaagaaggaggagcuggugggcggcaagaagaaggggcggaccuggggccccuccagcacccugcagaaggagcgcgucgggggcgaggagcgccucaaggggcugggcgagggcuccaagcaguggagcuccagcgcccccaaccuggggaagagcccgaagcacacccccaucgcccccggcuucgcgucccucaacgagauggaggaguucgccgaggccgaggacgggggcagcuccgugcccccgagccccuacuccacgcccagcuaccuguccgugccccugccggccgagcccagccccggggcgcgggcccccugggagccgacccccuccgccccccccgcccgcuggggccacggcgcccggcgccggugcgaccucgcgcugcuggggugcgccacccuccugggcgccgucgggcugggcgccgacguggccgaggcgcgcgccgccgacggggaggagcagcggcgcuggcucgacggccuguucuucccgcgggccggccgcuucccccgggggcugagccccccggcccgcccccacggccggcgcgaggacguggggcccggccucgggcuggcgcccuccgccacccuggucagccucuccagcguguccgacugcaacagcacgcggucccugcugcgcagcgacagcgacgaggccgccccggcggcccccuccccccccccgagcccccccgcccccaccccgacccccucccccagcaccaacccccucguggaccuggagcuggaguccuucaagaaggacccgcggcagagccucacgcccacccacgucaccgccgccugcgcggugucccgcggccaccggcgcacccccagcgacggcgcccuggggcagcggggccccccggagcccgccgggcacggccccggcccccgcgaccugcucgacuucccgcgccugcccgacccccaggcccuguuccccgcccggcgccggccgcccgaguuccccgggcgcccgacgacccucaccuucgcgccccggccccgccccgccgccucccggccgcgccuggaccccuggaagcuggugagcuucggccggacccucacgaucuccccccccagccgcccggacacccccgagucccccgggcccccgagcguccagcccacccugcuggacauggacauggagggccagaaccaggacuccaccgugccccucugcggggcccacggcagccacuga

SEQ ID NO: 32656 - RNA, 2544 nt, Artificial Sequence
  derived and/or modified sequence opt1 from MAP3K11__Homo_sapiens__NP_002410
auggagccccugaagagccucuuccugaaguccccgcugggcagcuggaacggguccggcagcgggggcgggggcggcgggggcgggggccgccccgaggggucccccaaggccgccggcuacgcgaaccccguguggaccgcccucuucgacuacgagccgagcggccaggacgagcuggcccugcggaagggggaccgcgucgaggugcucucccgggacgccgccaucagcggcgacgagggguggugggcgggccaggugggcgggcaggucggcaucuuccccuccaacuacgugagccgcgggggcgggccccccccgugcgagguggccuccuuccaggagcugcggcuggaggaggucaucggcaucggcggguucggcaagguguaccgcgggagcuggcggggcgagcucguggccgucaaggccgcgcgccaggaccccgacgaggacaucuccgugaccgccgagagcgugcggcaggaggcccgccuguucgccaugcuggcccaccccaacaucaucgcgcucaaggccgucugccuggaggagcccaaccugugccucgugauggaguacgccgccgggggcccgcugucccgggcccuggcgggccgccgggugcccccccacguccucgugaacugggccgugcagaucgcccgcgggaugcacuaccugcacugcgaggcccugguccccgugauccaccgggaccucaagagcaacaacauccugcugcuccagccgaucgaguccgacgacauggagcacaagacgcugaagaucaccgacuucggccuggcccgcgaguggcacaagaccacccagaugagcgcggccgggacguacgccuggauggcccccgaggugaucaaggccuccaccuucagcaagggcagcgacgucugguccuucggggugcuccugugggagcugcucaccggcgaggugcccuaccggggcaucgacugccuggcggucgccuacgggguggccgucaacaagcugacccuccccaucccgagcacgugccccgagcccuucgcccagcugauggcggacugcugggcccaggacccccaccgccggccggacuucgccuccauccugcagcagcucgaggcccuggaggcccaggugcugcgcgagaugccccgggacagcuuccacuccaugcaggagggcuggaagcgcgagauccaggggcucuucgacgagcugcgcgcgaaggagaaggagcugcucagccgggaggaggagcugacccgcgccgcccgggagcagcgcucccaggccgagcagcugcggcgccgggagcaccuccuggcccagugggagcuggagguguucgagcgcgagcucacccugcugcugcagcaggucgaccgggagcgcccccacgugcggcgccggcgcggcaccuucaagcggagcaagcuccgcgcgcgggacggcggggagcgcaucuccaugccccuggacuucaagcaccggaucacggugcaggccagcccgggccuggaccgccgccggaacgucuucgagguggggcccggcgacucccccaccuucccgcgcuuccgggccauccagcucgagcccgccgagcccgggcaggccuggggccgccagagcccccggcgccuggaggacuccagcaacggcgagcggcgcgcgugcugggccugggggccguccagccccaagcccggcgaggcccagaacgggcggcgccggucccgcauggacgaggccaccugguaccuggacagcgacgacuccagcccccucggcagcccguccaccccccccgcgcugaacgggaaccccccgcggcccagccuggagcccgaggagcccaagcgcccggugcccgccgagcggggcuccagcuccggcacgcccaagcucauccagcgcgcccugcugcgggggaccgcccuccuggccagccugggccucgggcgcgaccugcagcccccgggcgggcccggccgggagcgcggcgagucccccaccacccccccgacgcccacccccgcgccgugccccaccgagccccccccgagcccccugaucugcuucucccucaagacccccgacagccccccgacgcccgccccccugcugcucgaccuggggauccccgucggccagcgguccgccaagagcccgcgccgcgaggaggagccccgggggggcaccguguccccccccccggggaccagccgcuccgcccccggcacccccggcacgccccggagcccgccccuggggcucaucucccgcccccggcccagcccgcugcgcagccggaucgaccccugguccuucgugagcgccggcccccgccccuccccgcugcccagcccccagccggcgccccggcgcgcccccuggacccucuuccccgacuccgacccguucugggacagcccccccgccaaccccuuccaggggggcccgcaggacugccgggcccagaccaaggacaugggcgcccaggcgcccuggguccccgaggccgggcccuga

SEQ ID NO: 32657 - RNA, 2580 nt, Artificial Sequence
  derived and/or modified sequence opt1 from MAP3K12__Homo_sapiens__NP_006292
auggccugccugcacgagacccgcacccccagcccguccuucggcggguucgugagcacgcucuccgaggccagcaugcggaagcuggaccccgacaccuccgacugcacccccgagaaggaccugacccccacgcacguccuccagcugcacgagcaggacgcgggcgggccgggcggggccgccggcagccccgagucccgcgccagccgggugcgcgccgacgaggugcggcugcagugccaguccggcagcggguuccucgagggccuguucgggugccugcgccccgucuggaccaugaucggcaaggcguacuccaccgagcacaagcagcagcaggaggaccucugggaggugcccuucgaggagauccuggaccugcaguggguggggagcggcgcccagggcgccgucuuccucgggcgguuccacggcgaggagguggccgugaagaagguccgcgaccugaaggagaccgacaucaagcaccugcggaagcucaagcacccgaacaucaucacguucaagggggugugcacccaggcgcccugcuacugcauccugauggaguucugcgcccagggccagcuguacgaggugcuccgcgccggccggcccgucacccccucccugcugguggacuggagcauggggaucgccggcgggaugaacuaccuccaccugcacaagaucauccaccgcgaccugaaguccccgaacaugcucaucaccuacgacgacguggucaagaucagcgacuucggcacguccaaggagcugagcgacaaguccaccaagaugagcuucgccgggaccguggcguggauggcccccgaggugauccggaacgagcccgucagcgagaagguggacaucugguccuucggcgugguccugugggagcuccugaccggcgagauccccuacaaggacguggacagcuccgccaucaucuggggggugggcagcaacucccugcaccucccgguccccagcuccugccccgacggguucaagauccugcugcgccagugcuggaacagcaagccccggaaccgcccguccuuccggcagauccuccugcaccuggacaucgccagcgccgacgugcucuccacgccccaggagaccuacuucaagagccaggcggaguggcgcgaggaggucaagcugcacuucgagaagaucaaguccgagggcaccugccugcaccggcucgaggaggagcuggugaugcgccggcgcgaggagcugcgccacgcccucgacauccgggagcacuacgagcgcaagcuggagcgggccaacaaccuguacauggagcucaacgcccugaugcugcagcucgagcugaaggagcgcgagcugcugcggcgcgagcaggcccucgagcggcgcugccccgggcugcugaagccccacccgagccggggccuccugcacggcaacaccauggagaagcugaucaagaagcgcaacgugccccagaagcucuccccccacagcaagcggcccgacauccugaagacggagucccugcucccgaagcuggacgcggcccugagcggggucggccuccccgggugccccaagggcccgcccucccccgggcgcagccggcgcggcaagacccggcaccgcaaggccagcgccaagggcuccugcggggaccugcccggccugcggaccgccgugccgccccacgagcccgggggccccggcagcccggggggccucgggggcgggcccuccgcgugggaggccugcccccccgcccugcgcggccugcaccacgaccuccugcugcggaagaugagcuccagcuccccggaccuccugagcgccgcgcugggcucccgcgggcgcggcgccaccgggggcgccggggaccccggcagcccccccccggcccggggcgacacgccccccuccgaggggagcgcccccggcuccaccagcccggacucccccgggggcgcgaagggggagccccccccgcccgugggccccggcgagggggucggccuccuggggaccggccgcgaggggaccagcggccggggcgggucccgcgccggcagccagcaccugacgccggccgcccuccuguaccgggccgcggugacccgcagccagaagcgggggaucuccagcgaggaggaggagggcgagguggacuccgaggucgagcugaccagcucccagcgcuggccccagagccucaacaugcggcagucccugagcaccuucuccagcgagaaccccuccgacggcgaggaggggacggccagcgagcccuccccgagcggcacccccgaggugggguccaccaacaccgacgagcgccccgacgagcggagcgacgacaugugcucccagggcagcgagaucccccuggacccgccccccuccgaggugauccccgggccggagcccagcagccuccccaucccccaccaggagcugcugcgcgagcggggcccgcccaacuccgaggacagcgacugcgacuccacggagcucgacaacagcaacuccgucgacgcccugcgcccccccgccagccugccgcccuga

SEQ ID NO: 32658 - RNA, 2280 nt, Artificial Sequence
  derived and/or modified sequence opt1 from MAP3K13__Homo_sapiens__NP_001229246
auguacugcggcauccagauccuggcccucugggagcgcggggugugcacccaggcccccugcuacugcaucaucauggaguacugcgcgcacggccagcuguacgagguccugcgggccgggcgcaagaucaccccgcggcuccugguggacuggagcacgggcaucgccuccgggaugaacuaccugcaccuccacaagaucauccaccgcgaccucaagagccccaacgugcuggucacccacaccgacgccgugaagaucuccgacuucggcaccagcaaggagcuguccgacaagagcacgaagauguccuucgccggcaccguggcguggauggcccccgaggucauccggaacgagcccgugagcgagaagguggacaucugguccuucggggucgugcugugggagcugcucaccggcgagaucccguacaaggacguggacagcuccgccaucaucuggggcgucgggagcaacucccugcaccuccccgugcccagcacgugccccgacggguucaagauccugaugaagcagaccuggcaguccaagccgcgcaaccggcccagcuuccgccagacccugaugcaccuggacaucgccuccgcggacgugcucgccaccccgcaggagaccuacuucaagagccaggccgaguggcgggaggaggucaagaagcacuucgagaagaucaaguccgagggcacgugcauccaccgccuggacgaggagcugauccggcgccggcgcgaggagcuccggcacgcccuggacauccgcgagcacuacgagcggaagcuggagcgcgccaacaaccucuacauggagcugagcgcgaucaugcugcagcucgagaugcgggagaaggagcugaucaagcgcgagcaggccguggagaagaaguaccccggcaccuacaagcggcaccccgugcgccccaucauccaccccaacgccauggagaagcugaugaagcgcaagggggucccccacaagagcggcaugcagaccaagcggccggaccuccugcgcuccgaggggauccccaccacggagguggcccccaccgccagcccccuguccggcagcccgaagauguccaccagcuccagcaagucccgguaccgcagcaagccccggcaccgccggggcaacucccgcgggagccacuccgacuucgcggccauccucaagaaccagcccgcccaggagaacagcccccacccgaccuaccugcaccaggcccagucccaguaccccagccugcaccaccacaacucccuccagcagcaguaccagcagcccccgcccgccaugagccagucccaccacccccggcugaacaugcacggccaggacaucgcgacgugcgccaacaaccugcgcuacuucgggcccgccgccgcccuccggagcccgcugagcaaccacgcgcagcgccagcugcccggcuccagccccgaccucaucuccaccgccauggccgccgacugcuggcggagcuccgagcccgacaaggggcaggcgggcccguggggcugcugccaggccgacgccuacgaccccugccugcagugccgccccgagcaguacgggagccuggacauccccuccgccgagccggugggccggagccccgaccucuccaagagccccgcccacaacccccugcuggagaacgcgcaguccagcgagaagaccgaggagaacgaguucuccgggugccgcagcgaguccagccucggcaccucccaccuggggacgccgcccgcccugccccggaagacccgcccccugcagaaguccggcgacgacagcagcgaggaggaggagggcgaggucgacagcgagguggaguucccgcggcgccagcgcccccaccggugcaucuccagcugccaguccuacagcaccuucuccagcgagaacuucuccgugagcgacggggaggagggcaacaccuccgaccacagcaacucccccgacgagcucgccgacaagcuggaggaccgccuggccgagaagcucgacgaccugcugagccagacgcccgagaucccgaucgacaucuccagccacuccgacgggcucagcgacaaggagugcgccguccggcgcgugaagacccagaugucccugggcaagcugugcgucgaggagcggggguacgagaaccccaugcaguucgaggagagcgacugcgacagcuccgacggcgagugcagcgacgcgaccgugcgcaccaacaagcacuacuccagcgccacgugguga

SEQ ID NO: 32659 - RNA, 2844 nt, Artificial Sequence
  derived and/or modified sequence opt1 from MAP3K14__Homo_sapiens__XP_011523743
auggccgugauggagauggccugccccggcgcgccggggagcgccgucggccagcagaaggagcugcccaaggccaaggagaagaccccgccccucgggaagaagcaguccagcguguacaagcuggaggccguggagaagucccccgucuucugcggcaagugggagauccugaacgacgugaucaccaaggggacggccaaggagggcagcgaggcgggccccgccgccaucuccaucaucgcccaggcggagugcgagaacagccaggaguucucccccaccuucagcgagcgcaucuucaucgccggguccaagcaguacagccaguccgagagccucgaccagauccccaacaacguggcccacgccaccgagggcaagauggcccgggucugcuggaaggggaagcgccgguccaaggcgcgcaagaagcggaagaagaaguccuccaagagccuggcccacgccggcguggcccuggccaagccgcucccccgcacccccgagcaggaguccugcacgauccccgugcaggaggacgagagcccgcugggggcgcccuacguccggaacacgccccaguucaccaagccccugaaggagccgggccucggccagcugugcuucaagcagcugggggagggccuccgccccgcccugccccgguccgagcugcacaagcucaucagcccccugcagugccugaaccacguguggaagcuccaccacccgcaggacgggggcccccugccccugcccacccacccguuccccuacagccgccucccccaccccuucccguuccacccccugcagcccuggaagccgcacccccuggaguccuuccucggcaagcuggccugcguggacagccagaagccccugcccgacccgcaccucuccaagcuggccugcgucgacagccccaagccccugcccgggccgcaccucgagcccagcugccugagccggggcgcccacgagaaguucuccguggaggaguaccuggugcacgcgcuccaggggagcgucuccagcggccaggcccacucccugaccagccuggccaagaccugggccgcccgcgggucccggagccgcgagcccucccccaagaccgaggacaacgagggcgugcuccugaccgagaagcugaagccgguggacuacgaguaccgggaggagguccacugggcgacgcaccagcuccgccugggccgggggagcuucggcgaggugcaccgcauggaggacaagcagaccggguuccagugcgccgugaagaagguccggcuggagguguuccgcgccgaggagcucauggccugcgcgggccugaccagcccccggaucgugccccuguacggggccguccgcgagggccccugggugaacaucuucauggagcuccuggagggcgggucccugggccagcucgucaaggagcaggggugccugccggaggaccgcgcccuguacuaccugggccaggcccucgaggggcuggaguaccugcacucccggcgcauccuccacggcgacgugaaggccgacaacgugcugcugagcagcgacggcucccacgcggcccucugcgacuucgggcacgccgucugccugcagcccgacggccugggcaagagccuccugaccggggacuacauccccggcacggagacccacauggcccccgagguggugcuggggcgguccugcgacgccaaggucgacguguggagcuccugcugcaugaugcuccacaugcugaacggcugccacccguggacccaguucuuccgcgggccccugugccucaagaucgcgagcgagcccccgcccgugcgggagaucccgcccuccugcgcgccccugaccgcccaggccauccaggagggccugcgcaaggagcccauccaccgggucagcgccgccgagcucgggggcaaggugaaccgcgcccugcagcaggucggcgggcugaagucccccuggcggggcgaguacaaggagccccgccacccgccgcccaaccaggccaacuaccaccagacgcuccacgcccagccccgggagcugagcccccgcgcgcccgggccccggcccgccgaggagaccaccggccgcgccccgaagcugcagccgccccucccgcccgagccgcccgagcccaacaaguccccgccccugacccugagcaaggaggaguccgggaugugggagccccucccccugagcucccuggagcccgcccccgcccggaaccccagcucccccgagcgcaaggcgacggugcccgagcaggagcuccagcagcuggagaucgagcuguuccucaacagccugagccagcccuucucccuggaggagcaggagcagauccucagcugccuguccaucgacagccugucccucagcgacgacuccgagaagaaccccagcaaggccucccagagcucccgggacacccugagcuccggcgugcacagcugguccagccaggccgaggcccgcuccagcuccuggaacauggugcuggcccggggccgcccgaccgacacccccagcuacuucaacggggucaaggugcagauccagagccucaacggcgagcaccuccacauccgcgaguuccaccgggugaaggucggggacaucgcgacgggcaucuccagccagauccccgccgccgccuucucccuggugaccaaggacgggcagcccgugcgcuacgacauggaggucccggacagcggcaucgaccugcagugcacccuggcccccgacggcuccuucgcguggagcuggcgggugaagcacgggcagcuggagaaccgccccuga

SEQ ID NO: 32660 - RNA, 3648 nt, Artificial Sequence
  derived and/or modified sequence opt1 from MAP3K19__Homo_sapiens__NP_001018054
augagcuccaugcccaagccggagcgccacgccgagagccugcucgacaucugccacgacaccaacuccagccccaccgaccugaugacggugaccaagaaccagaacaucauccugcaguccaucagccgguccgaggaguucgaccaggacggcgacugcagccacuccacccucgucaacgaggaggaggaccccagcgggggccgccaggacuggcagccccggaccgaggaguucuccacgagccacaugaaguacuccgggcgcagcaucaaguuccugcugccgccccucucccugcugcccacccggagcggcgugcucaccaucccccagaaccacaaguucccgaaggagaaggagcgcaacauccccucccugaccagcuucgugcccaagcuguccgucagcgugcggcagagcgacgagcucucccccagcaacgagccgcccggggcccuggugaagucccugauggaccccacgcuccgcagcuccgacggcuucaucuggagccggaacaugugcuccuuccccaagaccaaccaccaccgccagugccuggagaaggaggagaacuggaaguccaaggagaucgaggagugcaacaagaucgagaucacccacuucgagaagggccagagccuggucagcuucgagaaccucaaggaggggaacaucccggcggugcgggaggaggacaucgacugccacggcuccaagacccgcaagcccgaggaggagaacagccaguaccuguccagccggaagaacgaguccagcguggccaagaacuacgagcaggaccccgagaucgucugcacgauccccuccaaguuccaggagacccagcacagcgagaucaccccgucccaggacgaggagaugcgcaacaacaaggccgccagcaagcgggugagccugcacaagaacgaggccauggagcccaacaacauccucgaggagugcaccgugcugaagucccugagcuccgucguguucgacgaccccaucgacaagcuccccgaggggugcagcuccauggagacgaacaucaagaucagcaucgcggagcgcgccaagccggagaugucccggauggugccccugauccacaucaccuuccccgucgacggcagccccaaggagccggugaucgccaagcccucccugcagacccgcaaggggaccauccacaacaaccacagcgugaacauccccguccaccaggagaacgacaagcacaagaugaacucccaccggagcaagcucgacuccaagacgaagaccagcaagaagaccccgcagaacuucgugaucuccaccgagggccccaucaagcccacgaugcacaagaccagcaucaagacccagaucuuccccgcccugggccugguggacccgcgccccuggcagcucccccgguuccagaagaagaugccccagaucgcgaagaagcaguccacccaccgcacgcagaagccgaagaagcagagcuuccccugcaucugcaagaaccccgggacccagaaguccugcgucccccugagcgugcagccgaccgagccccgccugaacuaccucgaccugaaguacagcgacauguucaaggagaucaacuccaccgccaacggccccgggaucuacgagauguucggcacgcccguguacugccacguccgggagaccgagcgcgacgagaacaccuacuaccgggagaucugcagcgccccguccggccgccggaucaccaacaagugccgcagcucccacagcgagcggaaguccaacauccgcacgcggcugagccagaagaagacccacaugaagugccccaagaccuccuucgggaucaagcaggagcacaaggugcucaucagcaaggagaaguccagcaaggccguccacuccaaccugcacgacaucgagaacggcgacgggaucagcgagcccgacuggcagaucaaguccagcggcaacgaguuccuguccagcaaggacgagauccaccccaugaaccucgcccagaccccggagcagagcaugaagcagaacgaguucccgcccguguccgaccugagcaucguggaggaggucuccauggaggagagcaccggggaccgcgacaucuccaacaaccagauccugacgaccagccuccgggaccugcaggagcuggaggagcuccaccaccagauccccuucauccccuccgaggacagcugggcggugcccuccgagaagaacagcaacaaguacgugcagcaggagaagcagaacaccgccucccugagcaaggucaacgccucccgcauccugaccaacgaccucgaguucgacagcguguccgaccacagcaagacgcugaccaacuucuccuuccaggccaagcaggagagcgccuccagccagaccuaccaguacugggugcacuaccuggaccacgacagccuggcgaacaaguccaucaccuaccagauguucggcaagacgcucagcggcaccaacuccaucagccaggagaucauggacuccgucaacaacgaggagcugaccgacgagcugcucgggugccuggccgccgagcugcucgcccuggacgagaaggacaacaacagcugccagaagauggccaacgagaccgaccccgagaaccugaaccucgugcugcgguggcgcggcuccacgccgaaggagauggggcgggagaccaccaaggugaagauccagcgccacagcuccggccugcggaucuacgaccgcgaggagaaguuccucaucagcaacgagaagaagaucuucuccgagaacagccugaaguccgaggagcccauccuguggaccaagggggagauccucggcaagggcgcguacgggacggucuacugcggccugaccagccaggggcagcugaucgccgugaagcaggucgcccucgacaccuccaacaagcuggccgccgagaaggaguaccggaagcugcaggaggagguggaccuccugaaggcgcugaagcacgugaacaucguggccuaccucgggaccugccugcaggagaacacggucagcaucuucauggaguucgugcccggcggcuccaucagcuccaucaucaaccgcuucggcccccugccggagaugguguucugcaaguacaccaagcagauccuccagggggucgccuaccugcacgagaacugcguggugcaccgcgacaucaagggcaacaacgucaugcugaugcccaccgggaucaucaagcucaucgacuucggcugcgcccggcgccuggcgugggccggccugaacgggacccacagcgacaugcucaagagcaugcacggcacgcccuacuggauggcccccgaggugaucaacgaguccggguacggccgcaagagcgacaucugguccaucgggugcaccguguucgagauggccaccggcaagccgccccuggccagcauggaccggauggcggccauguucuacaucggcgcccaccgggggcugaugccgccccuccccgaccacuucuccgagaacgccgccgacuucguccgcaugugccugacccgggaccagcacgagcgccccagcgcgcugcagcuccugaagcacuccuuccuggagcggagccacuga

SEQ ID NO: 32661 - RNA, 4539 nt, Artificial Sequence
  derived and/or modified sequence opt1 from MAP3K1__Homo_sapiens__NP_005912
auggccgccgcggccggcaaccgcgccagcuccagcggguuccccggcgcccgggccaccucccccgaggccgggggcgggggcggcgcgcugaaggccagcuccgcccccgcggccgccgccgggcuccugcgcgaggccggcagcgggggccgggagcgcgcggacuggcggcgccggcagcugcgcaaggugcgguccgucgagcucgaccagcugcccgagcagccccuguuccucgccgccagcccgcccgccuccagcaccucccccagccccgagccggccgacgcggccggguccggcacgggcuuccagcccguggccgugcccccgccccacggggccgccagccgcggcggggcgcaccugaccgaguccgucgccgcccccgacagcggcgccuccagccccgccgcggccgagcccggcgagaagcgggccccggccgcggagcccucccccgccgccgcccccgccgggcgcgagauggagaacaaggagacccugaagggccuccacaagauggacgaccggccggaggagcgcaugauccgggagaagcugaaggcgaccugcaugcccgccuggaagcacgaguggcuggagcgccggaaccgccgggggcccgugguggucaagcccaucccggugaagggcgacgggagcgagaugaaccaccucgccgccgagagccccggcgaggugcaggccuccgcggccagccccgccuccaagggccgccggagccccuccccggggaacagccccuccggccgcacggucaagagcgagucccccggggugcgccggaagcgcgugagcccgguccccuuccaguccggccggaucaccccgccccgccgggcccccagccccgacggguucucccccuacagccccgaggagaccaaccgccgggugaacaaggugaugcgcgcccggcuguaccugcuccagcagaucggcccgaacuccuuccugaucggcggggacagccccgacaacaaguaccgcgucuucaucggcccccagaacugcuccugcgcgcgggggaccuucugcauccaccuccucuucgugaugcugcgcguguuccagcuggagcccagcgacccgaugcucuggcggaagacgcugaagaacuucgaggucgagucccuguuccagaaguaccacagccgccggagcucccgcaucaaggcccccagccggaacaccauccagaaguucgugucccgcaugagcaacucccacacccucagcuccagcuccaccagcacguccagcuccgagaacagcaucaaggacgaggaggagcagaugugccccaucugccugcugggcaugcucgacgaggagucccugaccgugugcgaggacgggugccggaacaagcugcaccaccacugcaugagcaucugggccgaggagugccgccgcaaccgggagccccucaucugcccgcugugccgcuccaaguggcggagccacgacuucuacagccacgagcuguccagccccgucgacucccccagcucccugcgcgccgcgcagcagcagaccgugcagcagcagccccuggccggcagccggcgcaaccaggaguccaacuucaaccugacccacuacggcacgcagcagaucccgcccgccuacaaggaccucgccgagcccuggauccagguguucgggauggagcuggucggcugccuguucagccggaacuggaacgugcgcgagauggcccuccggcgccugucccacgacgucagcggggcgcugcuccuggccaacggcgaguccaccggcaacagcgggggcuccagcggguccagccccuccggcggggccaccagcggcuccagccagaccagcaucuccggcgacgugguggaggccugcugcagcguccuguccauggugugcgccgacccgguguacaaggucuacguggcggcccucaagacgcugcgggccaugcugguguacacccccugccacagccucgccgagcgcaucaagcugcagcggcugcugcagcccgucguggacaccauccucgugaagugcgccgacgcgaacucccgcaccagccagcuguccaucagcacgcugcucgagcugugcaaggggcaggccggcgagcuggccgucgggcgggagauccucaaggccggcuccaucgggaucggcggcguggacuacgugcugaacugcauccuggggaaccagaccgagagcaacaacuggcaggagcuccugggccgccugugccucaucgaccggcugcugcucgaguucccggcggaguucuacccccacaucgucuccaccgacgugagccaggccgagcccguggagauccgcuacaagaagcugcugucccuccugaccuucgcccugcagagcaucgacaacucccacagcauggucgggaagcucucccggcgcaucuaccugagcuccgcccggauggugacgaccgugccccacgucuucagcaagcugcucgagaugcugagcguguccagcuccacccacuucacccgcaugcgccggcgccugauggccaucgcggacgagguggagaucgccgaggccauccagcucggcgucgaggacacgcuggacgggcagcaggacagcuuccugcaggccuccgugccgaacaacuaccucgagaccaccgagaacagcucccccgagugcaccgugcaccuggagaagacgggcaagggccugugcgccaccaagcucagcgcguccagcgaggacaucuccgagcggcuggccagcaucuccgucgggcccagcuccagcaccaccaccacgaccaccaccacggagcagcccaagccgauggugcagaccaagggccgcccccacucccagugccugaacagcagcccccucucccaccacagccagcugauguuccccgcccuguccaccccgagcuccagcacccccuccgugcccgccgggacggccaccgacgucagcaagcaccggcuccagggcuucauccccugccgcaucccguccgcgagcccccagacccagcggaaguucucccugcaguuccaccgcaacugccccgagaacaaggacagcgacaagcugucccccguguucacccagagccggccgcuccccuccagcaacauccaccgccccaagcccucccggccgacgcccgggaacaccagcaagcagggcgaccccuccaagaacagcaugacccuggaccugaacuccagcagcaagugcgacgacuccuucggcugcagcuccaacagcuccaacgccgugauccccagcgacgagaccgucuucacgccgguggaggagaagugccgccucgacgugaacaccgagcugaacuccagcaucgaggaccugcucgaggccuccaugcccagcuccgacaccaccgucacguucaagagcgagguggccgugcugucccccgagaaggccgagaacgacgacaccuacaaggacgacgucaaccacaaccagaagugcaaggagaagauggaggcggaggaggaggaggcccuggccaucgccauggcgaugagcgccucccaggacgcccucccgaucgugccccagcuccagguggagaacggggaggacaucaucaucauccagcaggacacccccgagacccugcccggccacacgaaggccaagcagccguaccgggaggacaccgaguggcugaaggggcagcagaucggccugggcgccuucagcuccugcuaccaggcgcaggacgucgggaccggcacccugauggccgugaagcaggucacguacgugcgcaacaccagcuccgagcaggaggaggugguggaggcccuccgggaggagauccgcaugaugagccaccugaaccaccccaacaucauccggaugcugggggcgaccugcgagaaguccaacuacaaccucuucaucgaguggauggccggcgggagcgucgcccaccuccugagcaaguacggcgccuucaaggaguccguggugaucaacuacaccgagcagcugcugcgcggccugagcuaccuccacgagaaccagaucauccaccgggacgucaagggggccaaccugcugaucgacuccacgggccagcgccuccgcaucgccgacuucggggccgcggcccggcuggccagcaagggcaccggggccggcgaguuccagggccagcugcucgggaccaucgcguucauggcccccgaggugcugcgcggccagcaguacgggcgguccugcgacgucuggagcgugggcugcgccaucaucgagauggccugcgccaagcccccguggaacgcggagaagcacuccaaccaccuggcccucaucuucaagaucgccagcgccaccacggcccccuccauccccagccaccugucccccgggcugcgcgacguggcgcuccggugccuggagcugcagccgcaggaccgcccgcccagccgggagcuccugaagcaccccgucuuccgcaccaccugguga

SEQ ID NO: 32662 - RNA, 1860 nt, Artificial Sequence
  derived and/or modified sequence opt1 from MAP3K2__Homo_sapiens__NP_006600
auggacgaccagcaggcccugaacagcaucaugcaggaccucgccgugcugcacaaggcgucccgccccgcccugagccuccaggagacccggaaggccaaguccagcucccccaagaagcagaacgacguccgcgugaaguucgagcaccggggcgagaagcgcauccugcaguucccccggcccgugaagcuggaggaccuccgcagcaaggccaagaucgccuucgggcaguccauggaccugcacuacaccaacaacgagcuggucaucccccucacgacccaggacgaccuggacaaggcgguggagcugcucgaccggagcauccacaugaagucccugaagauccugcucgugaucaacggcagcacccaggccaccaaccuggagccgcugcccucccucgaggaccuggacaacacggucuucggggccgagcgcaagaagcggcugagcaucaucggccccaccucccgcgaccggagcagcccgccgcccggguacauccccgacgagcuccaccagguggcccgcaacggcagcuucaccuccaucaacagcgagggcgaguucauccccgaguccauggaccagaugcuggacccccugagccucagcucccccgagaacagcggguccggcagcugccccucccuggacagcccccuggacggggaguccuaccccaagagccggaugccccgcgcgcaguccuaccccgacaaccaccaggaguucagcgacuacgacaaccccaucuucgagaaguucggcaagggcgggaccuacccgcggcgcuaccacguguccuaccaccaccaggaguacaacgacggccggaagacguucccccgcgcccggcgcacccaggggaccagccuccggucccccgucagcuucucccccaccgaccacagccuguccacgagcuccggcagcagcaucuucaccccggaguacgacgacucccgcauccgccggcgcgggagcgacaucgacaaccccacccugaccgugauggacaucuccccgcccagccgguccccgcgcgcccccacgaacuggcggcucggcaagcugcugggccagggggccuucggccgcguguaccucugcuacgacgucgacaccgggcgggagcuggccgugaagcagguccaguucgaccccgacagcccggagaccuccaaggaggugaacgcgcuggagugcgagauccagcuccugaagaaccugcuccacgagcgcaucgugcaguacuacggcugccugcgggacccccaggagaagacccugagcaucuucauggaguacaugcccgggggcuccaucaaggaccagcucaaggccuacggcgcccugacggagaacgugacccgcaaguacacccggcagauccuggaggggguccacuaccuccacagcaacaugaucgugcaccgcgacaucaagggcgccaacauccugcgggacuccaccgggaacgugaagcugggcgacuucggggccagcaagcgccuccagacgaucugccuguccggcaccggcaugaaguccgucaccgggacccccuacuggauguccccggaggugaucagcggcgagggguacggccggaaggcggacaucugguccguggccugcacggucguggagaugcugaccgagaagccgcccugggccgaguucgaggccauggccgcgaucuucaagaucgccacccagcccaccaaccccaagcugccgccccacgucagcgacuacacgcgcgacuuccucaagcggaucuucguggaggccaagcugcgccccagcgccgacgagcugcuccggcacauguucgugcacuaccacuga

SEQ ID NO: 32663 - RNA, 1881 nt, Artificial Sequence
  derived and/or modified sequence opt1 from MAP3K3__Homo_sapiens__NP_002392
auggacgagcaggaggcccugaacagcaucaugaacgaccucguggcccugcagaugaaccgccggcaccgcaugcccggcuacgagaccaugaagaacaaggacaccgggcacuccaaccggcagagcgacguccgcaucaaguucgagcacaacggcgagcggcgcaucaucgcguucucccggccggugaaguacgaggacguggagcacaaggucacgaccguguucgggcagccccuggaccuccacuacaugaacaacgagcugagcauccugcucaagaaccaggacgaccuggacaaggccaucgacauccuggaccgcuccagcuccaugaagucccuccggauccugcugcucucccaggaccgcaaccacaacagcuccagcccccacuccggcgugagccggcagguccgcaucaaggccucccagagcgccggggacaucaacaccaucuaccagcccccggagccccggucccgccaccugagcguguccagccagaaccccggccggagcagcccgccgcccggcuacgugcccgagcgccagcagcacaucgcccggcaggggagcuacaccuccaucaacagcgagggcgaguucauccccgagacguccgagcagugcaugcuggacccccucagcuccgcggagaacagccuguccgggagcugccagucccuggaccgcagcgccgacucccccagcuuccggaagucccgcaugagccgggcccaguccuuccccgacaaccgccaggaguacagcgaccgcgagacccagcucuacgacaagggcgucaagggcgggaccuacccccggcgcuaccacguguccgugcaccacaaggacuacagcgacggccggcgcaccuucccgcggauccgccggcaccaggggaaccuguucacgcugguccccagcucccgcagccucuccaccaacggcgagaacauggggcuggccgugcaguaccuggacccccggggccgccuccggagcgcggacuccgagaacgcccugagcgugcaggagcgcaacguccccaccaaguccccgagcgcccccaucaacuggcggcgcggcaagcugcucgggcagggcgccuucgggcggguguaccugugcuacgacguggacaccggccgcgagcuggccuccaagcagguccaguucgaccccgacagccccgagacguccaaggaggugagcgcgcucgagugcgagauccagcugcugaagaaccuccagcacgagcggaucgugcaguacuacgggugccugcgcgaccgggccgagaagacccugaccaucuucauggaguacaugccgggcggcuccgucaaggaccagcucaaggccuacggggcccugaccgagagcgugacgcgcaaguacacccgccagauccuggagggcauguccuaccuccacagcaacaugaucgugcaccgggacaucaagggggccaacauccugcgcgacuccgcgggcaacgucaagcugggggacuucggcgccagcaagcggcuccagaccaucugcaugagcggcaccgggaugcgcuccgugacgggcacccccuacuggaugagccccgaggucaucuccggggagggcuacgggcggaaggccgacguguggagccugggcugcaccguggucgagaugcugaccgagaagcccccgugggccgaguacgaggccauggcggccaucuucaagaucgccacgcagcccaccaacccccagcucccgucccacaucagcgagcacggccgcgacuuccugcggcgcaucuucguggaggcccggcagcgccccuccgccgaggagcugcucacccaccacuucgcgcagcugauguacuga

SEQ ID NO: 32664 - RNA, 4827 nt, Artificial Sequence
  derived and/or modified sequence opt1 from MAP3K4__Homo_sapiens__NP_005913
augcgcgaggccgccgcggcccuggugcccccgcccgccuucgccgucacccccgccgcggccauggaggagcccccgcccccccccccgcccccccccccgccccccgagcccgagaccgagagcgagccggagugcugccucgccgcccggcaggagggcacgcugggggacuccgcgugcaagagccccgaguccgaccuggaggacuucagcgacgagaccaacaccgagaaccucuacggcaccuccccccccagcacgccgcgccagaugaagcggauguccaccaagcaccagcgcaacaacguggggcggcccgccagccgcuccaaccugaaggagaagaugaacgcccccaaccagcccccgcacaaggacaccggcaagaccguggagaacgucgaggaguacagcuacaagcaggagaagaagauccgggccgcccugcgcacgaccgagcgggaccacaagaagaacgugcagugcuccuucaugcucgacagcguggggggcucccugcccaagaagagcauccccgacgucgaccugaacaagcccuaccucucccugggcugcagcaacgcgaagcugccgguguccgugcccaugcccaucgcccgcccggcccggcagaccagccgcaccgacugccccgccgaccggcucaaguucuucgagacgcugcgccugcuccugaagcugaccuccgucagcaagaagaaggaccgggagcagcgcgggcaggagaacaccagcggcuucuggcucaaccgguccaacgagcugaucuggcuggagcuccaggccuggcacgcggggcgcaccaucaacgaccaggacuucuuccuguacacggcccggcaggccauccccgacaucaucaacgagauccugaccuucaagguggacuacggcagcuucgccuucgugcgcgaccgggccggguucaacggcaccuccgucgagggccagugcaaggcgacccccgggacgaagaucgugggcuacagcacccaccacgagcaccuccagcgccagcgcguguccuucgagcaggucaagcggaucauggagcugcuggaguacaucgaggcccucuacccgagccugcaggcccugcagaaggacuacgagaaguacgccgccaaggacuuccaggaccgcgugcaggcgcucugccuguggcugaacaucaccaaggaccucaaccagaagcugcggaucauggggaccgugcugggcaucaagaaccucuccgacaucggcuggcccgucuucgagauccccagcccccgcccguccaaggggaacgagcccgaguacgagggcgacgacacggagggggagcugaaggagcuggagagcuccaccgacgagagcgaggaggagcagaucuccgacccccgggugcccgagauccgccagccgaucgacaacagcuucgacauccagucccgggacugcaucagcaagaagcucgagcgccuggaguccgaggacgacagccugggcuggggggcccccgacugguccaccgaggccggcuucagccggcacugccucaccagcaucuaccgccccuucguggacaaggcccugaagcagaugggccugcggaagcucauccugcgccugcacaagcucauggacgggucccugcagcgggcgcgcaucgcccuggucaagaacgaccggcccguggaguucagcgaguucccggaccccauguggggcuccgacuacgugcagcugagccgcacgccccccuccagcgaggagaagugcuccgccgucagcugggaggagcucaaggccauggaccugccguccuucgagcccgccuuccuggugcucugccggguccugcugaacgugauccacgagugccucaagcugcgccuggagcagcggcccgcgggggagcccagccuccuguccaucaagcagcuggugcgcgagugcaaggagguccucaagggcgggcugcugaugaagcaguacuaccaguucaugcuccaggaggugcuggaggaccuggagaagccggacugcaacaucgacgccuucgaggaggaccuccacaagaugcugaugguguacuucgacuacaugcgcagcuggauccagaugcugcagcagcucccccaggccucccacagccugaagaaccugcucgaggaggaguggaacuucaccaaggagaucacccacuacauccggggcggcgaggcccaggccgggaagcuguucugcgacaucgcgggcaugcugcucaaguccaccgggagcuuccuggaguucggccugcaggaguccugcgccgaguucuggacgagcgccgacgacagcuccgccagcgacgagauccgccgguccgucaucgagaucagccgcgcccucaaggagcuguuccacgaggcgcgggagcgcgccuccaaggcccugggguucgccaagaugcuccggaaggaccuggagaucgcggccgaguuccgccugagcgcccccgugcgggaccuccuggacgugcugaaguccaagcaguacgucaaggugcagaucccgggccucgagaaccugcagauguucgugcccgacacccuggccgaggagaagagcaucauccuccagcugcugaacgccgcggccggcaaggacugcuccaaggacagcgacgacguccucaucgacgccuaccugcugcucaccaagcacggggaccgcgcccgggacuccgaggacagcuggggcaccugggaggcccagcccgugaagguggucccccagguggagacgguggacacccugcgcuccaugcaggucgacaaccugcuccugguggugaugcagagcgcgcaccugaccauccagcggaaggccuuccagcaguccaucgaggggcucaugacccugugccaggagcagaccagcucccagccggucaucgccaaggcccugcagcagcucaagaacgacgcccuggagcugugcaaccgcaucagcaacgcgaucgaccggguggaccacauguucacguccgaguucgacgccgagguggacgagagcgagagcgucacccuccagcaguacuaccgcgaggccaugauccagggcuacaacuucggcuucgaguaccacaaggagguggugcggcugauguccggggaguuccgccagaagaucggcgacaaguacaucagcuucgcccggaaguggaugaacuacguccugaccaagugcgaguccgggcgcggcacccggccccgcugggcgacgcagggguucgacuuccuccaggccaucgagcccgccuucaucagcgcccugcccgaggacgacuuccugucccuccaggcccugaugaacgagugcaucggccacgugaucggcaagccgcacagccccgugaccgggcuguaccucgcgauccaccgcaacuccccccggcccaugaaggucccgcgcugccacagcgacccccccaacccccaccugaucaucccgacccccgagggcuucuccacccggagcaugcccuccgacgcccgcagccacgggucccccgccgccgccgcggccgccgccgccgcggccguggccgccagccggccgucccccagcggcggggacuccgugcugcccaagagcaucuccagcgcccacgacacgcgcggcagcuccguccccgagaacgaccggcucgcgagcaucgccgccgagcugcaguuccgcucccugagccggcacuccagcccgaccgaggagcgcgacgagcccgccuacccccggggcgacuccagcggguccacccgccggagcugggagcuccgcacccugaucucccagagcaaggacacggcguccaagcugggccccaucgaggccauccagaagagcgugcggcucuucgaggagaagcgcuaccgggagaugcgccggaagaacaucaucgggcaggugugcgacaccccgaaguccuacgacaacgucaugcacgugggccugcgcaaggugaccuucaaguggcagcgcgggaacaagaucggcgagggccaguacgggaaggucuacaccugcaucagcguggacacgggcgagcugauggccaugaaggagauccgguuccagcccaacgaccacaagaccaucaaggagaccgccgacgagcucaagaucuucgaggggaucaagcaccccaaccuggugcgcuacuucggcgucgagcugcaccgggaggagauguacaucuucauggaguacugcgacgaggggacccucgaggaggugucccgccugggccugcaggagcacgugauccggcucuacagcaagcagaucacgaucgccaucaacguccugcacgagcacggcaucgugcaccgcgacaucaagggggcgaacaucuuccugaccuccagcggccucaucaagcugggggacuucggcugcagcgugaagcugaagaacaacgcccagaccaugccgggcgaggucaacuccacccucgggacggccgccuacauggcccccgaggugaucacccgggcgaagggcgaggggcacggccgcgccgccgacaucuggagccuggggugcguggucaucgagauggugaccggcaagcggcccuggcacgaguacgagcacaacuuccagaucauguacaaggucggcauggggcacaagcccccgauccccgagcgccugucccccgagggcaaggacuuccugagccacugccucgaguccgaccccaagaugcgguggaccgccagccagcugcuggaccacuccuucgugaaggugugcacggacgaggaguga

SEQ ID NO: 32665 - RNA, 4125 nt, Artificial Sequence
  derived and/or modified sequence opt1 from MAP3K5__Homo_sapiens__NP_005914
augagcaccgaggccgacgagggcaucaccuucuccgugcccccguucgcccccagcggguucugcacgauccccgagggcgggaucugccgccggggcggggcggccgccgucggcgagggcgaggagcaccagcugcccccgcccccgcccggguccuucuggaacguggagagcgccgccgcgcccggcaucgggugccccgccgccaccuccagcuccagcgccacccgcggccggggguccagcgugggcggcgggucccgccggaccacggucgcguacgugaucaacgaggccagccagggccagcucguggucgccgaguccgaggcccugcagagccugcgcgaggccugcgagaccgugggggcgacccucgagacccugcacuucggcaagcuggacuucggcgagacgaccgugcucgaccgguucuacaacgccgacaucgccgucguggagauguccgacgccuuccgccagcccagccuguucuaccaccugggggugcgggaguccuucagcauggccaacaacaucauccucuacugcgacaccaacuccgacagccugcagagccugaaggagaucaucugccagaagaacaccaugugcacgggcaacuacaccuucguccccuacaugaucaccccgcacaacaagguguacugcugcgacuccagcuucaugaaggggcucaccgagcugaugcagcccaacuucgagcugcuccugggccccaucugccugccccucguggaccgcuucauccagcugcugaaggucgcgcaggccuccagcucccaguacuuccgggagagcauccucaacgacauccgcaaggcccggaaccuguacacggggaaggagcuggccgccgagcucgcgcgcauccggcagcgcguggacaacaucgaggugcugaccgccgacaucgucaucaaccugcuccuguccuaccgggacauccaggacuacgacagcaucgugaagcugguggagacccucgagaagcugccgaccuucgaccuggccucccaccaccacgucaaguuccacuacgccuucgcccucaaccgccggaaccugcccggcgaccgcgcgaaggcccuggacaucaugauccccauggugcagagcgagggccagguggccuccgacauguacugccucgucgggcggaucuacaaggacauguuccuggacagcaacuucacggacaccgagucccgcgaccacggcgccagcugguucaagaaggcguucgaguccgagcccacccugcagagcgggaucaacuacgccgugcuccugcuggccgccggccaccaguucgaguccagcuucgagcuccgcaaggucggggugaagcuguccagccugcucggcaagaagggcaaccuggagaagcugcagagcuacugggaggugggguucuuccucggcgccuccguccuggcgaacgaccacaugcgggugauccaggccagcgagaagcuguucaagcugaagaccccggccugguaccucaaguccaucguggagacgauccugaucuacaagcacuucgucaagcugaccaccgagcagcccguggccaagcaggagcucguggacuucuggauggacuuccuggucgaggccaccaagacggacgugaccgugguccgcuuccccgugcugauccucgagcccaccaagaucuaccagccgagcuaccuguccaucaacaacgagguggaggagaagaccaucagcaucuggcacguccugcccgacgacaagaaggggauccacgaguggaacuucuccgcgagcuccgugcggggcgugagcaucuccaaguucgaggagcgcugcugcuuccucuacguccugcacaacagcgacgacuuccagaucuacuucugcacggagcugcacugcaagaaguucuucgagauggugaacaccaucaccgaggagaaggggcgguccaccgaggagggcgacugcgagagcgaccuccuggaguacgacuacgaguacgacgagaacggcgaccgcgugguccuggggaagggcacguacgggaucguguacgccggccgggaccucuccaaccaggugcgcaucgccaucaaggagauccccgagcgggacagccgcuacucccagccccugcacgaggagaucgcccugcacaagcaccucaagcacaagaacaucguccaguaccugggcagcuucagcgagaacggguucaucaagaucuucauggagcaggucccgggcgggucccugagcgcccuccugcgguccaaguggggcccccugaaggacaacgagcagaccaucggguucuacaccaagcagauccucgagggccugaaguaccugcacgacaaccagaucgugcaccgcgacaucaagggcgacaacgugcucaucaacaccuacagcggggugcugaagaucuccgacuucggcaccagcaagcggcuggcggggaucaaccccugcacggagaccuucaccggcacccuccaguacauggccccggagaucaucgacaaggggccccgcggcuacggcaaggccgccgacaucuggucccuggggugcacgaucaucgagauggcgaccggcaagccgcccuucuacgagcugggggagccccaggccgccauguucaaggugggcauguucaagguccaccccgagauccccgagagcauguccgccgaggccaaggcguucauccucaagugcuucgagcccgacccggacaagcgggccugcgccaacgaccugcugguggacgaguuccucaaggugagcuccaagaagaagaagacccagcccaagcugagcgcccuguccgccgggagcaacgaguaccuccgcuccaucagccugcccguccccgugcugguggaggacaccuccagcuccagcgaguacggcagcgucuccccggacacggagcucaagguggaccccuucagcuucaagacccgggcgaaguccugcggcgagcgcgacgugaaggggauccggacccuguuccugggcauccccgacgagaacuucgaggaccacagcgcgcccccgucccccgaggagaaggacagcggguucuucaugcuccgcaaggacuccgagcgccgggccacccugcaccgcauccugacggaggaccaggacaagaucguccggaaccucauggagagccuggcccagggcgccgaggagcccaagcugaagugggagcacaucaccacccucaucgccucccugcgcgaguucgugcggagcaccgaccgcaagaucaucgccacgacccuguccaagcucaagcuggagcuggacuucgacagccacgggaucucccaggugcaggucgugcuguucggcuuccaggacgccgugaacaagguccugcggaaccacaacaucaagccccacuggauguucgcccuggacagcaucauccgcaaggcggugcagaccgccaucaccauccucgugccggagcugcggccccacuucucccuggccagcgaguccgacacggccgaccaggaggaccucgacgucgaggacgaccacgaggagcagcccagcaaccagaccgugcgccggccccaggccgugaucgaggacgcggucgccaccuccggcgugagcacccugagcuccacggucagccacgacucccagagcgcccaccgcucccugaacgugcagcucgggcggaugaagaucgagaccaaccgccugcuggaggagcucgugcggaaggagaaggagcugcaggcccugcuccaccgcgccaucgaggagaaggaccaggagaucaagcaccugaagcucaagagccagccgaucgagauccccgagcuccccgucuuccaccugaacuccagcggcaccaacaccgaggacuccgagcugacggacuggcuccgggugaacggggcggacgaggacaccaucagccgcuuccuggccgaggacuacacccugcucgacgugcuguacuacgucacccgggacgaccugaagugccuccgccugcggggcggcaugcugugcacgcucuggaaggccaucaucgacuuccgcaacaagcagaccuga

SEQ ID NO: 32666 - RNA, 3843 nt, Artificial Sequence
  derived and/or modified sequence opt1 from MAP3K6__Homo_sapiens__NP_001284538
auggccggccccugcccgcgcagcggggccgagcgggcgggcuccugcuggcaggacccccuggccguggcccucagccgcgggcggcagcuggccgccccgcccggccgcgggugcgcgcggucccgcccccugagcgucguguacgugcucacccgggagccccagcccggccuggagccccgcgagggcaccgaggccgagccgcugccccuccggugccugcgcgaggccugcgcccaggucccccggccccgcccgccgccccagcugcggucccuccccuucgggacgcuggagcugggcgacaccgcggcccucgacgccuucuacaacgccgacguggugguccuggaggugagcuccagccuggugcagcccucccucuucuaccaccuggggguccgcgagagcuucuccaugaccaacaacgugcugcucugcagccaggccgaccugcccgaccugcaggcgcuccgggacugcgugggcuccuacacccugauccccuacgucgugacggccaccgggcgcgugcugugcggcgacgccggccuccugcgggggcuggccgacggccucguccaggccggggugggcaccgaggcgcugcugacgccccucgugggccgccuggcccggcugcucgaggccaccccgaccgacagcugcggguacuuccgcgagaccauccggcgcgacauccgccaggcccgggagcgcuucuccggcccccagcugcggcaggagcuggcccgccuccagcggcgccuggacagcgucgagcugcucucccccgacaucaucaugaaccugcugcucagcuaccgggacgugcaggacuacuccgcgaucaucgagcugguggagacccugcaggcccuccccacgugcgacgucgccgagcagcacaacgugugcuuccacuacaccuucgcccugaaccgccggaaccgcccgggggaccgggccaaggcgcugagcgugcuccugccccugguccagcuggagggcagcguggcccccgaccucuacugcaugugcgggcgcaucuacaaggacauguucuucuccagcggcuuccaggacgccggccaccgggagcaggccuaccacugguaccgcaaggcguucgacgucgagcccucccugcacagcgggaucaacgccgccgugcugcucaucgccgccggccagcacuucgaggacuccaaggagcugcggcugaucgggaugaagcucggcugccugcuggcgcgcaaggggugcguggagaagaugcaguacuacugggacgucggcuucuaccucggcgcccagauccuggccaacgacccgacccagguggugcuggccgccgagcagcucuacaagcugaacgcgcccaucugguaccuggucagcgugauggagaccuuccuccuguaccagcacuuccggcccacgccggagccgcccgggggcccgccccgccgggcccacuucuggcugcacuuccuccugcaguccugccagcccuucaagaccgccugcgcccagggggaccagugccuggugcucguccuggagaugaacaaggugcugcuccccgccaagcuggaggugcgcggcaccgaccccgucagcaccgugacgcugucccuccuggagcccgagacccaggacauccccagcuccuggaccuuccccguggcgagcaucugcggggucuccgccagcaagcgcgacgagcggugcugcuuccuguacgcccugcccccggcccaggacgugcagcucugcuuccccuccgugggccacugccagugguucugcggccugauccaggcgugggucaccaaccccgacagcacggcccccgccgaggaggccgagggggccggcgagaugcucgaguucgacuacgaguacaccgagaccggggagcgccuggugcugggcaagggcaccuacgggguggucuacgcgggccgggaccgccacacgcgggugcgcaucgccaucaaggagaucccggagcgggacucccgcuucagccagccccuccacgaggagaucgcccugcaccggcgccugcggcacaagaacaucgugcgcuaccucggguccgccagccagggcggguaccugaagaucuucauggaggagguccccggcggcagccuguccagccuccugcgguccgugugggggccccugaaggacaacgagagcaccaucuccuucuacacccgccagauccuccagggccugggguaccugcacgacaaccacaucgugcaccgggacaucaagggcgacaacguccucaucaacaccuucagcgggcugcugaagaucuccgacuucggcacgagcaagcgccucgccggcaucaccccgugcaccgagaccuucacggggacccugcaguacauggcgcccgagaucaucgaccagggcccccggggguacggcaaggccgccgacaucuggucccuggggugcaccgugaucgagauggccaccggccggcccccguuccacgagcucggcagcccccaggccgcgauguuccagguggggauguacaagguccacccgcccaugcccuccagccuguccgccgaggcccaggccuuccugcuccgcaccuucgagcccgacccccgccugcgggcgagcgcccagacgcugcucggcgacccguuccugcagcccgggaagcgcucccgcagccccuccagcccccggcacgccccgcgccccagcgacgcccccuccgccagccccaccccguccgcgaacagcaccacccagucccagacguuccccugcccccaggcccccagccagcacccgcccuccccgcccaagcggugccugagcuacggcgggaccucccagcuccgcgugcccgaggagcccgccgccgaggagcccgccagccccgaggaguccagcggccugucccugcuccaccaggagagcaagcggcgcgcgaugcuggccgccgugcuggagcaggagcucccggcccuggccgagaaccugcaccaggagcagaagcaggagcagggcgcgcggcucgggcgcaaccacgucgaggagcugcugcggugccucggcgcccacauccacacccccaaccgccggcagcuggcccaggagcugcgcgcccuccaggggcggcugcgcgcccagggccugggccccgcgcuccugcaccggccccuguucgccuucccggacgccgugaagcagauccuccgcaagcggcagauccgcccccacuggauguucgugcuggacucccugcucagccgggccguccgcgcggcccugggggugcugggccccgagguggagaaggaggccgucuccccgcgcagcgaggagcucuccaacgagggggacagccagcagagccccggccagcagagcccccugcccguggagccggagcaggggcccgcgccccugauggugcagcucucccugcugcgggccgagaccgaccgccugcgggagauccucgccggcaaggagcgcgaguaccaggcccugguccagcgggcccugcagcgccucaacgaggaggcccggacguacgugcuggcccccgagccgcccaccgcgcuguccaccgaccagggccucgugcaguggcugcaggagcugaacgucgacagcgggaccauccagaugcuccugaaccacuccuucacgcugcacacccuccugaccuacgccacccgcgacgaccugaucuacacgcggauccgcggcgggauggugugccggaucuggcgcgccauccucgcccagcgggccggcagcacccccgugaccuccgggcccuga

SEQ ID NO: 32667 - RNA, 429 nt, Artificial Sequence
  derived and/or modified sequence opt1 from MAP3K7CL__Homo_sapiens__NP_001273546
augaucagcaccgcccgcgugcccgccgacaagcccguccggaucgcguucucccugaacgacgccagcgacgacaccccgcccgaggacuccaucccccucguguuccccgagcuggaccagcagcugcagccccucccgcccugccacgacagcgaggaguccauggagguguucaagcagcacugccagaucgccgaggaguaccacgaggucaagaaggagaucacgcugcuggagcagcgcaagaaggagcucaucgccaagcuggaccaggccgagaaggagaagguggacgcggccgagcuggugcgggaguucgaggcccucaccgaggagaaccgcacccugcggcuggcccagagccagugcgucgagcagcucgagaagcugcgcauccaguaccagaagcggcagggcuccagcuga

SEQ ID NO: 32668 - RNA, 1740 nt, Artificial Sequence
  derived and/or modified sequence opt1 from MAP3K7__Homo_sapiens__NP_003179
augagcaccgccuccgccgcgagcuccagcuccagcuccagcgccggcgagaugaucgaggcccccucccaggugcugaacuucgaggagaucgacuacaaggagaucgaggucgaggaggugguggggcgcggcgccuucggggucgugugcaaggccaaguggcgggcgaaggacguggccaucaagcagaucgagagcgaguccgagcgcaaggccuucaucgucgagcuccggcagcugagccgcgugaaccacccgaacaucgugaagcuguacggcgccugccucaaccccgucugccuggugauggaguacgcggagggcgggucccuguacaacgugcuccacggcgccgagccccugcccuacuacaccgccgcccacgccaugagcuggugccugcagugcucccagggggucgcguaccuccacagcaugcagccgaaggcccugauccaccgggaccugaagccgcccaaccuccugcugguggccggcgggacggugcucaagaucugcgacuucggcaccgccugcgacauccagacccacaugaccaacaacaagggguccgccgcguggauggcccccgaggucuucgagggcagcaacuacuccgagaagugcgacguguucagcuggggcaucauccugugggaggugaucacgcgccggaagcccuucgacgagaucgggggccccgccuuccgcaucaugugggccguccacaacgggacccggccgccccugaucaagaaccuccccaagcccaucgagagccugaugacccgcugcugguccaaggaccccagccagcggcccuccauggaggagaucgugaagaucaugacccaccugaugcgcuacuucccgggcgccgacgagccccuccaguaccccugccaguacagcgacgagggccaguccaacagcgcgacguccaccgggagcuucauggacaucgccuccaccaacaccagcaacaaguccgacacgaacauggagcagguccccgccaccaacgacaccaucaagcggcuggagagcaagcugcucaagaaccaggccaagcagcaguccgagagcggccgccugucccugggggccagccggggcuccagcguggagucccucccgcccaccagcgaggggaagcgcaugagcgcggacauguccgagaucgaggcccggaucgccgccacgaccggcaacggccagccccgccggcgcagcauccaggaccugaccgugaccgggacggagcccggccagguguccagccgguccagcuccccgagcguccgcaugaucaccaccuccgggcccaccagcgagaagcccacgcgcucccaccccuggaccccggacgacagcaccgacaccaacggcuccgacaacagcauccccauggcguaccugacgcucgaccaccagcugcagccccuggccccgugccccaacuccaaggagagcauggccguguucgagcagcacugcaagauggcccaggaguacaugaagguccagaccgagaucgcccuccugcugcagcggaagcaggagcucguggcggagcuggaccaggacgagaaggaccagcagaacaccucccgccuggugcaggagcacaagaagcuccuggacgagaacaagagccugagcaccuacuaccagcagugcaagaagcagcucgaggucauccggucccagcagcagaagcgccaggggacgagcuga

SEQ ID NO: 32669 - RNA, 1404 nt, Artificial Sequence
  derived and/or modified sequence opt1 from MAP3K8__Homo_sapiens__XP_005252421
auggaguacaugagcaccggcuccgacaacaaggaggagaucgaccugcucaucaagcaccugaacgugagcgacgucaucgacaucauggagaaccuguacgccuccgaggagcccgccguguacgagcccagccucaugaccaugugccaggacuccaaccagaacgacgagcgcagcaagucccugcugcucagcgggcaggaggugcccuggcuguccagcguccgguacggcacgguggaggaccugcucgcguucgccaaccacaucuccaacaccgccaagcacuucuacgggcagcgcccccaggagagcggcauccugcugaacauggugaucacgccccagaacgggcgguaccagaucgacuccgacguccuccugaucccguggaagcugaccuaccgcaacaucggcagcgacuucaucccccggggcgccuucgggaagguguaccucgcccaggacaucaagaccaagaagcgcauggcgugcaagcugauccccguggaccaguucaagcccuccgacgucgagauccaggccugcuuccggcacgagaacaucgccgagcuguacggcgccgugcucuggggcgagaccgugcaccuguucauggaggcgggggagggcgggagcguccuggagaagcucgaguccugcggcccgaugcgcgaguucgagaucaucugggugaccaagcacgugcugaaggggcuggacuuccuccacagcaagaaggucauccaccacgacaucaagcccuccaacaucguguucaugagcaccaaggccgugcuggucgacuucggccugagcgugcagaugacggaggacguguacuuccccaaggaccuccgggggaccgagaucuacaugucccccgaggucauccugugccgcggccacagcaccaaggccgacaucuacucccugggcgccacccucauccacaugcagacggggaccccgcccugggugaagcgguacccccgcagcgccuaccccuccuaccuguacaucauccacaagcaggcgccgccccuggaggacaucgccgacgacugcagccccggcaugcgggagcucaucgaggccucccuggagcgcaaccccaaccaccggccgcgcgccgccgaccugcucaagcacgaggcgcugaacccgccccgggaggaccagccccgcugccagagccuggacuccgcccuccuggagcggaagcgccugcucagccggaaggagcuggagcugcccgagaacaucgccgacuccagcugcaccggguccaccgaggagagcgagaugcucaagcgccagcgcucccuguacaucgaccugggcgcccucgccggguacuucaaccuggugcggggcccgcccacgcuggaguacggcuga

SEQ ID NO: 32670 - RNA, 3315 nt, Artificial Sequence
  derived and/or modified sequence opt1 from MAP3K9__Homo_sapiens__NP_001271159
auggagcccagccgcgcccugcucggcugccuggccuccgcggccgccgccgccccgcccggggaggacggcgcgggggccggcgccgaggaggaggaggaggaggaggaggaggccgcggccgccguggggcccggcgagcugggcugcgacgcgccccucccguacuggaccgccgucuucgaguacgaggccgccggggaggacgagcugacccugcggcucggcgacgugguggagguccugagcaaggacucccaggugagcggggacgagggcugguggacggggcagcugaaccagcgcgugggcaucuuccccuccaacuacgucacgccccggagcgccuucuccagccgcugccagcccggcggggaggacccguccugcuacccgcccauccagcuccuggagaucgacuucgccgagcugacccucgaggagaucaucggcaucgggggcuucggcaagguguaccgggccuucuggaucggggacgagguggcggucaaggccgcccgccacgaccccgacgaggacaucagccagaccaucgagaacgugcggcaggaggccaagcuguucgccaugcugaagcaccccaacaucaucgcgcuccgcggcgugugccugaaggagcccaaccugugccucgucauggaguucgcccgcgggggcccccugaaccgggugcuguccgggaagcggaucccgcccgacauccucgugaacugggccguccagaucgcccgcggcaugaacuaccugcacgacgaggccaucgugcccaucauccaccgggaccucaagagcuccaacauccucauccugcagaagguggagaacggcgaccugagcaacaagauccucaagaucaccgacuucgggcuggcgcgcgaguggcaccggaccaccaagauguccgccgccggcaccuacgccuggauggcgcccgaggucauccgcgccagcauguucuccaaggggagcgacgugugguccuacggcgugcugcucugggagcugcugacgggggagguccccuuccggggcaucgacggccucgccguggccuacgggguggccaugaacaagcuggcgcugccgauccccuccacgugccccgagcccuucgccaagcucauggaggacugcuggaacccggacccccacagccgccccagcuucaccaacauccuggaccagcugaccaccaucgaggagagcggcuucuucgagaugcccaaggacuccuuccacugccuccaggacaacuggaagcacgagauccaggagauguucgaccagcugcgggccaaggagaaggagcugcgcaccugggaggaggagcucacccgggccgcccugcagcagaagaaccaggaggagcugcuccgccgccgggagcaggagcuggcggagcgcgagaucgacauccuggagcgggagcucaacaucaucauccaccagcugugccaggagaagccgcgcgucaagaagcggaaggggaaguuccgcaagagccggcugaagcugaaggacggcaaccgcaucucccuccccagcgacuuccagcacaaguucaccgugcaggccucccccacgauggacaagcgcaagagccugaucaacucccggagcuccccgcccgccagccccaccaucaucccccggcugcgcgccauccagcucaccccgggggaguccagcaagaccuggggccgguccagcgucgugcccaaggaggagggcgaggaggaggagaagcgcgcccccaagaagaaggggcggacguggggccccgggacccugggccagaaggagcuggcguccggcgacgaggggagcccgcagcgccgggagaaggccaacggccucuccacccccagcgagagcccccacuuccaccuggggcugaagucccucguggacggcuacaagcaguggagcuccagcgcccccaaccuggucaaggggccgcgcuccagccccgcccugcccggcuucaccucccucauggagauggaggacgaggacagcgagggccccggguccggcgagagccggcugcagcacuccccgagccaguccuaccugugcauccccuucccccgcggggaggacggcgacgggcccagcuccgacggcauccacgaggagccgacgcccgugaacagcgcgaccuccacgccccagcucacccccaccaacagccugaagcgcggcggggcccaccaccggcgcugcgagguggcccugcucggcugcggggccguccuggccgcgaccggccugggguucgaccuccuggaggccggcaagugccagcugcucccgcuggaggagcccgagcccccggcccgggaggagaagaagcgccgggagggccuguuccagcgcagcucccggccccgccggagcaccuccccgcccagccgcaagcuguucaagaaggaggagcccaugcugcugcucggggaccccuccgccagccugacccugcucucccugagcuccaucagcgagugcaacuccacgcggagccugcuccgcuccgacagcgacgagaucgugguguacgagaugcccgucucccccguggaggccccgccccugagccccugcacccacaacccccuggugaacguccggguggagcgcuucaagcgggacccgaaccagucccucacccccacccacgugacgcugaccacccccagccagcccuccagccaccgccggaccccgagcgacggcgcgcugaagcccgagacccuccuggccucccgcagccccuccagcaacgggcugucccccagcccgggcgccgggaugcucaagacgcccucccccagccgggaccccggcgaguucccgcgccugcccgaccccaacgucguguucccgcccacgccccggcgcuggaacacccagcaggacuccacccuggagcgccccaagacccucgaguuccugccgcggccccgccccagcgccaaccggcagcgccuggaccccuggugguucguguccccgagccacgcccgguccaccagccccgcgaacuccagcuccaccgagacccccagcaaccucgacuccugcuucgccagcagcuccagcacggucgaggagcgccccggccugccggcccugcuccccuuccaggccgggccccugcccccgaccgagcggacccugcucgaccuggacgcggagggccagucccaggacagcaccgugccccugugccgcgccgagcucaacacgcaccggcccgcccccuacgagauccagcaggaguucugguccuga

SEQ ID NO: 32671 - RNA, 3408 nt, Artificial Sequence
  derived and/or modified sequence opt1 from MAP4__Homo_sapiens__NP_001127836
auggccgaccugagccucgccgacgcgcugaccgagcccuccccggacaucgagggcgagaucaagcgcgacuucaucgccacccuggaggccgaggccuucgacgacguggucggggagacggugggcaagaccgacuacaucccccuccuggacguggacgagaagaccgggaacagcgaguccaagaagaagcccugcagcgagaccucccagaucgaggacacgcccagcuccaagccgacccugcucgccaacggcgggcacggcgucgagggcagcgacaccaccgggucccccacggaguuccuggaggagaagauggcguaccaggaguaccccaacagccagaacuggcccgaggacaccaacuucugcuuccagccggagcaggucguggaccccauccagaccgaccccuucaagauguaccacgacgacgaccuggccgaccucgucuuccccuccagcgccaccgccgacacguccaucuucgcgggccagaacgacccgcugaaggacagcuacgggaugucccccugcaacaccgccguggugccccagggcuggagcgucgaggcccugaacagcccccacuccgaguccuucgugagcccggaggccguggccgagccgccccagcccaccgcggucccccucgagcuggccaaggagaucgagauggccagcgaggagcggccgcccgcccaggcccuggagaucaugauggggcucaagaccacggacauggcgcccuccaaggagaccgagauggcccuggccaaggacauggcccuggccaccaagaccgagguggcgcucgccaaggacauggagagccccacgaagcuggacgugacccuggccaaggacaugcagcccuccauggagagcgacauggcccucgucaaggacauggagcugcccaccgagaaggagguggcccuggugaaggacguccgcuggcccaccgagacggacguguccagcgcgaagaacgugguccucccgaccgagaccgagguggcccccgccaaggacgugacccugcugaaggagacggagcgggccucccccaucaagauggaccucgcgccgagcaaggacaugggcccgcccaaggagaacaagaaggagaccgagcgcgccucccccaucaagauggaccuggcccccagcaaggacaugggcccgcccaaggagaacaagaucgugcccgccaaggaccuggugcuccuguccgagaucgaggucgcccaggcgaacgacaucaucagcuccaccgagaucagcuccgccgagaagguggcccugagcuccgagaccgagguggcccucgcccgggacaugacgcugccgcccgagaccaacgucauccugaccaaggacaaggcgcucccccuggaggccgagguggcccccgugaaggacauggcccagcugcccgagaccgagaucgcccccgcgaaggacgucgcccccagcacggugaaggagguggggcuccugaaggacaugagcccccuguccgagaccgagauggcccucggcaaggacgucaccccgccgcccgagaccgagguggugcugaucaagaacgucugccugccgcccgagauggagguggcccucaccgaggaccaggugcccgcgcugaagacggaggcgccccuggccaaggacgggguccucacccuggccaacaacgugacccccgccaaggacgugccgccccugagcgagaccgaggccacgcccguccccaucaaggacauggagaucgcccagacccagaagggcaucuccgaggacagccaccuggagucccuccaggacgugggccagagcgccgcccccaccuucaugaucucccccgagaccgugacggggaccggcaagaagugcagccugcccgccgaggaggacuccguccuggagaagcucggggagcgcaagccgugcaacagccagcccuccgagcugagcuccgagaccagcggcaucgcgcggcccgaggaggggcgccccgugguguccggcaccggcaacgacaucacgaccccgcccaacaaggagcugccgcccagccccgagaagaagaccaagccccucgccaccacgcagcccgccaagaccuccaccagcaaggccaagacccagcccacgucccugccgaagcagcccgcccccaccaccaucgggggccugaacaagaagcccaugagccucgcgagcgggcuggucccggccgccccgcccaagcggcccgccguggcguccgcccgccccagcauccugcccuccaaggacgugaagcccaagcccaucgccgacgccaaggccccggagaagcgggcgagccccuccaagcccgccagcgccccggccucccgcagcggcuccaagagcacccagacggucgccaagaccaccaccgcggccgccguggccuccacggggcccagcucccggagccccuccacccuccugcccaagaagccgaccgccaucaagaccgagggcaagcccgcggaggugaagaagaugacggccaagagcguccccgccgaccugucccgccccaagagcaccuccaccagcagcaugaagaagaccacgacccucuccggcaccgccccggccgcggggguggugcccagccgggucaaggccacccccaugcccucccgcccgagcaccacgcccuucaucgacaagaagcccaccuccgccaagcccagcuccaccaccccgcggcugagccgccuggccacgaacaccuccgcgcccgaccucaagaacgugcggagcaaggugggcuccaccgagaacaucaagcaccagcccgggggcgggcgcgccaaggucgagaagaagaccgaggccgccgccacgacccggaagcccgagagcaacgcggugaccaagaccgccggcccgaucgccuccgcccagaagcagcccgccggcaaggugcagaucgucagcaagaagguguccuacagccacauccaguccaagugcgggagcaaggacaacaucaagcacgugcccggcgggggcaacguccagauccagaacaagaagguggacaucuccaaggugagcagcaagugcggcuccaaggcgaacaucaagcacaagcccgggggcggggacgucaagaucgagagccagaagcugaacuucaaggagaaggcccaggccaaggugggcucccuggacaacguggggcaccucccggccggcggcgccgucaagaucgagacguaccgccugaccuuccgcgcgaacgcccgggcccgcaccgaccacggggccgacaucgugagccggccgccccacuuccccggcgggcccaacuccggcagccgcgugcuggggccccucucccgggcgguccacuga

SEQ ID NO: 32672 - RNA, 2466 nt, Artificial Sequence
  derived and/or modified sequence opt1 from MAP4K1__Homo_sapiens__NP_001036065
auggacguggucgaccccgacaucuucaaccgcgacccgcgggaccacuacgaccugcuccagcgccugggcgggggcaccuacggggagguguucaaggcccgggacaaggugagcggcgaccuggucgcccucaagauggugaagauggagcccgacgacgacguguccacccugcagaaggagauccugauccucaagacgugccgccacgcgaacaucgucgccuaccacgggagcuaccuguggcugcagaagcucuggaucugcauggaguucugcggcgccggcucccugcaggacaucuaccaggugaccgggagccuguccgagcuccagaucagcuacgugugccgggagguccugcagggccuggccuaccuccacucccagaagaagauccaccgcgacaucaagggggccaacauccugaucaacgacgcgggcgaggugcggcuggccgacuucgggaucagcgcccagaucggcgccacccucgcgcgccggcuguccuucaucggcacccccuacuggauggcccccgagguggccgccgucgcccugaaggggggcuacaacgagcucugcgacaucuggagccuggggaucacggcgaucgagcuggccgagcuccagccgccccuguucgacgugcacccccugcgcgugcucuuccugaugaccaaguccggcuaccagcccccgcggcugaaggagaagggcaaguggagcgccgccuuccacaacuucaucaaggucacccucaccaagucccccaagaagcgccccagcgccacgaagaugcugucccaccagcuggugagccagcccgggcucaaccggggccugauccuggaccuccuggacaagcugaagaacccggggaagggccccuccaucggggacaucgaggacgaggagcccgagcuccccccggcgaucccccgccggauccgcagcacccaccgguccagcagccugggcauccccgacgccgacugcugccgccggcacauggaguuccgcaagcugcggggcauggagacccgccccccggccaacaccgcccgccuccagcccccccgggaccugcgcuccagcuccccccggaagcagcugagcgaguccagcgacgacgacuacgacgacguggacaucccgacgcccgccgaggacaccccccccccgcucccccccaagccgaaguuccgcucccccagcgacgaggggcccggcuccaugggggacgacggccagcugagccccgggguccuggugcggugcgcguccggcccgccccccaacagcccccgcccgggccccccccccuccaccagcuccccgcaccucaccgcccacagcgagcccucccuguggaacccccccagccgggagcuggacaagccgccccugcucccccccaagaaggagaagaugaagcgcaaggggugcgcccugcuggugaagcucuucaacggcugcccgcugcggauccacuccacggccgccuggacccaccccagcaccaaggaccagcaccugcuccugggggcggaggagggcaucuucauccugaaccgcaacgaccaggaggccacccucgagaugcuguuccccagccggacgaccugggucuacuccaucaacaacgugcugaugagccucuccgggaagaccccccaccuguacagccacuccauccugggccuccuggagcgcaaggagacccgggccggcaacccgaucgcccacaucagcccccaccgccugcucgcgcggaagaacaugguguccacgaagauccaggacaccaaggggugccgcgccugcugcgucgccgagggcgccagcuccgggggccccuuccugugcggcgcccuggagaccagcgugguccuccugcagugguaccagccgaugaacaaguuccugcucgugcggcaggugcuguucccccugcccaccccccucuccgucuucgcgcugcugacggggccgggcagcgagcuccccgccgugugcaucggggugucccccggccgccccgggaagagcguccuguuccacaccgugcgguucggcgcccuguccugcuggcucggcgagaugagcaccgagcaccgcgggccggugcaggucacccagguggaggaggacauggugaugguccugauggacggcuccgugaagcuggugacgcccgaggggagccccguccgcggccuccggacccccgagaucccgaugaccgaggccguggaggccguggcgauggucgggggccagcugcaggccuucuggaagcacggcgugcaggugugggcccuggggagcgaccagcuccugcaggagcugcgcgaccccacccucacguuccggcugcugggcuccccccgccccgucgugguggagacccggccggucgacgaccccaccgcccccagcaaccucuacauccaggaguga

SEQ ID NO: 32673 - RNA, 2463 nt, Artificial Sequence
  derived and/or modified sequence opt1 from MAP4K2__Homo_sapiens__NP_004570
auggcccugcuccgcgacgugagccugcaggacccccgggaccgcuucgagcugcuccagcgggucggcgccgggaccuacggcgacguguacaaggcgcgcgacaccgugacguccgagcuggccgccgucaagaucgugaagcuggacccgggggacgacaucagcucccuccagcaggagaucaccauccugcgggagugccgccaccccaacguggucgccuacaucggcagcuaccugcggaacgaccgccucuggaucugcauggaguucugcgggggcggcucccugcaggagaucuaccacgccaccgggccccuggaggagcggcagaucgcguacgugugccgcgaggcccucaagggccugcaccaccuccacagccaggggaagauccaccgggacaucaagggcgccaaccuccugcugacccuccagggggacgugaagcuggccgacuucggcgucuccggcgagcugacggcgagcguggccaagcgccgguccuucaucgggacccccuacuggauggccccggagguggccgccgucgagcgcaagggcggguacaacgagcucugcgacgugugggcgcugggcaucaccgccaucgagcugggcgagcuccagccgccccuguuccaccuccaccccaugcgggcccugaugcugaugagcaaguccagcuuccagccgcccaagcugcgcgacaagacccgguggacgcagaacuuccaccacuuccucaagcuggcccugaccaagaaccccaagaagcgccccaccgccgagaagcuccugcagcacccguucaccacgcagcagcugccccgggcgcuccugacccagcugcucgacaaggccuccgacccccaccuggggacccccagcccggaggacugcgagcuggagaccuacgacauguuccccgacacgauccacucccgcggccagcacgggcccgccgagcggacccccagcgagauccaguuccaccaggugaaguucggcgccccgcgccgcaaggagaccgacccccucaacgagcccugggaggaggaguggacccugcuggggaaggaggagcucuccggcagccugcugcaguccguccaggaggcccucgaggagcggagccugacgauccgcagcgcguccgaguuccaggagcuggacagccccgacgacaccaugggcaccaucaagcgggccccguuccuggggccccuccccaccgacccgcccgccgaggagccccuguccagcccgcccggcacgcugcccccgccgcccuccgggcccaacagcagcccccuccugcccaccgccugggccaccaugaagcagcgcgaggaccccgagcgguccuccugccacggccugccgcccacccccaaggugcacaugggggcgugcuucagcaagguguucaacggcugcccccuccgcauccacgccgccgucacguggauccaccccgugacccgggaccaguuccugguggucggcgccgaggaggggaucuacacccugaaccuccacgagcugcacgaggacacccuggagaagcucaucucccaccgcugcagcuggcuguacugcgugaacaacgugcugcucucccugagcggcaaguccacgcacaucugggcgcacgaccugcccgggcuguucgagcagcggcgccugcagcagcaggucccccugagcauccccaccaaccggcucacccagcgcaucaucccccggcgcuucgcccuguccaccaagauccccgacacgaagggcugccugcagugccgggugguccgcaaccccuacaccggggccaccuuccuccuggccgcccugccgaccagccuccugcugcuccagugguacgagccccugcagaaguuccugcuccugaagaacuucuccagcccccugcccagcccggcgggcaugcucgagccccuggugcuggacggcaaggagcucccccaggugugcgucggggccgagggcccggaggggcccggcugccgggugcuguuccacgugcugccccucgaggccggccugacccccgacauccugaucccgcccgaggggauccccggcuccgcccagcaggucauccagguggaccgcgacacgauccucgugagcuucgagcggugcguccgcaucgugaacaugcagggggagcccaccgccacccuggcgccggagcugaccuucgacuuccccaucgagacgguggucugccuccaggacuccgugcuggccuucuggagccacggcaugcaggggcgcucccuggacaccaacgaggugacccaggagaucaccgacgagacgcggaucuuccgcguccucggcgcccaccgggacaucauccuggagagcauccccaccgacaaccccgaggcccacuccaaccuguacauccucaccggccaccagagcaccuacuga

SEQ ID NO: 32674 - RNA, 2622 nt, Artificial Sequence
  derived and/or modified sequence opt1 from MAP4K3__Homo_sapiens__NP_001257354
augaaccccggcuucgaccugagccgccggaacccgcaggaggacuucgagcucauccagcgcaucggguccggcaccuacggggacguguacaaggcccggaacgucaacaccggcgagcuggccgcgaucaaggugaucaagcuggagcccggggaggacuucgccgugguccagcaggagaucaucaugaugaaggacugcaagcaccccaacaucguggccuacuucggcagcuaccuccgccgggacaagcuguggaucugcauggaguucugcggcgggggcucccugcaggacaucuaccacgugacggggccccucagcgagcugcagaucgccuacgucucccgcgagacccugcagggccucuacuaccugcacagcaaggggaagaugcaccgggacaucaagggcgccaacauccugcucaccgacaacggccacgugaagcuggcggacuucgggguguccgcccagaucaccgccacgaucgccaagcgcaagagcuucaucggcaccccguacuggauggcgcccgaggucgccgccguggagcggaaggggggcuacaaccagcugugcgaccucugggccgugggcaucaccgccaucgagcuggcggagcugcagccccccauguucgaccuccacccgaugcgcgcccuguuccugaugaccaaguccaacuuccagccccccaagcucaaggacaagaugaaguggagcaacuccuuccaccacuucgucaagauggcccugacgaagaaccccaagaagcggccgaccgccgagaagcugcuccagcaccccuucgugacccagcaccugacccgcagccuggccaucgagcuccuggacaaggugaacaaccccgaccacuccacguaccacgacuucgacgacgacgaccccgagccgcuggucgcggugccccaccggauccacagcaccucccgcaacgugcgggaggagaagacccgcagcgagaucaccuucgggcaggucaaguucgaccccccccuccggaaggagacggagccgcaccacgagcuggaccugcagcucgaguacggccaggggcaccagggcggguacuuccugggcgccaacaagucccugcucaagagcguggaggaggagcugcaccagcgcggccacguggcccaccuggaggacgacgagggggacgacgacgaguccaagcacagcacccucaaggccaagaucccccccccccugccgcccaagcccaagagcaucuucaucccccaggagaugcacuccaccgaggacgagaaccagggcaccaucaagcggugcccgaugagcgggucccccgccaagcccagccaggucccgccccgcccccccccgccccggcugcccccccacaagccgguggcgcucggcaacgggauguccagcuuccagcugaacggcgagcgcgacggcucccugugccagcagcagaacgagcaccgcgggacgaaccucagccggaaggagaagaaggacgugcccaagcccaucuccaacggccugcccccgacccccaagguccacaugggggccugcuucagcaagguguucaacggcugcccccugaagauccacugcgccuccagcuggaucaaccccgacacccgcgaccaguaccucaucuucggggccgaggagggcaucuacacccugaaccugaacgagcugcacgagacguccauggagcagcucuucccgcggcgcugcaccuggcuguacgucaugaacaacugccugcucagcaucuccggcaaggccagccagcuguacucccacaaccugcccgggcucuucgacuacgcgcggcagaugcagaagcugcccguggccauccccgcccacaagcugccggaccgcauccucccccggaaguucagcguguccgccaagauccccgagaccaaguggugccagaagugcugcgucgugcgcaaccccuacaccggccacaaguaccugugcggggcgcugcagacgagcaucgugcuccuggagugggucgagccgaugcagaaguucaugcugaucaagcacaucgacuuccccauccccugcccgcuccggauguucgagaugcugguggugcccgagcaggaguacccccuggucugcgugggcgugagccgcggccgggacuucaaccaggucgugcgcuucgagaccgugaaccccaacuccaccagcuccugguucaccgagagcgacacgccgcagaccaacgucacccacgugacccagcucgagcgggacacgauccuggugugccuggacugcugcaucaagaucgucaaccuccaggggcgccugaaguccagccggaagcuguccagcgagcucaccuucgacuuccagaucgaguccaucgugugccugcaggacagcgugcuggccuucuggaagcacggcaugcaggggcgcuccuuccggagcaacgaggucacccaggagaucuccgacagcacccgcaucuuccggcuccugggcuccgaccgcguggugguccuggagagccgccccaccgacaaccccacggccaacuccaaccucuacauccuggccgggcacgagaacagcuacuga

SEQ ID NO: 32675 - RNA, 3720 nt, Artificial Sequence
  derived and/or modified sequence opt1 from MAP4K4__Homo_sapiens__NP_001229488
auggccaacgacagccccgccaagucccugguggacaucgaccucagcucccugcgcgacccggcgggcaucuucgagcuggucgaggugguggggaacggcaccuacgggcaggucuacaagggccggcacgugaagaccgggcagcucgccgccaucaaggugauggacgucacggaggacgaggaggaggagaucaagcuggagaucaacaugcugaagaaguacagccaccaccgcaacaucgccaccuacuacggcgccuucaucaagaaguccccccccggccacgacgaccagcucuggcuggugauggaguucugcggggcgggcagcaucaccgaccuggugaagaacaccaaggggaacacgcucaaggaggacuggaucgccuacaucucccgggagauccugcgcggccuggcccaccuccacauccaccacgucauccaccgggacaucaaggggcagaacgugcugcugaccgagaacgccgaggugaagcucgucgacuucggcgugagcgcgcagcuggaccgcaccgugggccggcgcaacaccuucaucgggacgcccuacuggauggccccggaggucaucgccugcgacgagaaccccgacgccaccuacgacuaccgguccgaccuguggagcugcggcaucaccgccaucgagauggcggagggggcccccccccucugcgacaugcacccgaugcgcgcccuguuccugaucccccggaacccccccccgcgccucaaguccaagaaguggagcaagaaguucuucuccuucaucgagggcugccuggugaagaacuacaugcagcggcccagcaccgagcagcugcucaagcaccccuucauccgcgaccagcccaacgagcggcaggugcgcauccagcugaaggaccacaucgaccggacgcgcaagaagcggggcgagaaggacgagaccgaguacgaguacuccgggagcgaggaggaggaggaggaggucccggagcaggagggcgagcccuccagcaucgugaacgugcccggggaguccacccugcgccgggacuuccuccgccugcagcaggagaacaaggagcgcagcgaggcccugcggcgccagcagcuccugcaggagcagcagcugcgggagcaggaggaguacaagcgccagcuccuggccgagcggcagaagcgcaucgagcagcagaaggagcagcggcgccggcuggaggagcagcagcgccgggagcgcgaggcgcggcgccagcaggagcgggagcagcgccggcgcgagcaggaggagaagcggcgccucgaggagcuggagcgccggcgcaaggaggaggaggagcggcgccgggccgaggaggagaagcgccgggucgagcgcgagcaggaguacauccggcgccagcuggaggaggagcagcggcaccucgaggugcugcagcagcagcugcuccaggagcaggccaugcugcuggagugccgcuggcgggagauggaggagcaccgccaggccgagcggcuccagcgccagcugcagcaggagcaggccuaccugcucagccugcagcacgaccaccggcgcccccacccgcagcacucccagcagcccccccccccgcagcaggagcggagcaagcccuccuuccacgcgcccgagcccaaggcccacuacgagccggccgaccgcgcccgggagguggaggaccgcuuccgcaagaccaaccacagcucccccgaggcccagagcaagcagacgggccggguccuggagcccccggugcccucccgcagcgaguccuucagcaacgggaacuccgagagcguccaccccgcgcugcagcggcccgccgagccgcaggugcccgugcgcaccaccucccggagccccguccucucccgccgggacagcccccugcagggcuccggccagcagaacagccaggccgggcagcgcaacuccaccagcaucgagccgcggcugcucugggagcgcguggagaagcuggugccccggcccggcagcggguccagcuccggcagcuccaacagcgggucccagcccggcagccacccgggcucccagagcggguccggcgagcgcuuccggguccgcagcuccagcaaguccgaggggagccccucccagcggcuggagaacgccgugaagaagcccgaggacaagaaggagguguuccgcccccucaagccggcggaccugacggcccuggccaaggagcuccgggccgucgaggacgugcgccccccccacaaggugaccgacuacagcagcuccagcgaggaguccggcaccaccgacgaggaggacgacgacgucgagcaggagggggccgacgagagcacguccggccccgaggacacccgggcggccagcucccugaaccugagcaacggcgagaccgaguccgugaagaccaugaucgugcacgacgacgucgagagcgagccggccaugacgcccuccaaggaggggacccucaucgugcgccagacccagagcgccuccagcacccugcagaagcacaaguccagcuccagcuucacgcccuucaucgacccccgccugcuccagaucuccccgagcagcggcaccaccgugaccuccgucgugggguucagcugcgacggcaugcggcccgaggccauccgccaggaccccacgcggaagggcuccguggucaacgugaacccgaccaacacccgcccccagagcgacacccccgagauccggaaguacaagaagcgcuucaacuccgagauccugugcgcggcccuguggggggugaaccuccuggucggcaccgagagcgggcugaugcuccuggaccgguccggccaggggaagguguacccccugaucaaccgccggcgcuuccagcagauggacgugcucgagggccugaacguccuggugacgaucagcggcaagaaggacaagcuccggguguacuaccuguccuggcugcgcaacaagauccuccacaacgacccggaggucgagaagaagcagggguggaccaccgugggcgaccuggaggggugcgugcacuacaaggucgugaaguacgagcggaucaaguuccuggugaucgcccucaagagcuccgucgagguguacgccugggcccccaagcccuaccacaaguucauggcguucaagagcuucggcgagcuggugcacaagccccugcucgucgaccugaccguggaggaggggcagcgccugaaggugaucuacggcuccugcgccggcuuccacgccgucgacguggacagcggguccguguacgacaucuaccucccgacgcacauccagugcagcaucaagccccacgccaucaucauccugcccaacaccgacggcauggagcugcucgucugcuacgaggacgaggggguguacgugaacaccuacggccggaucaccaaggacgucgugcugcaguggggggagaugcccacguccguggcguacauccgcagcaaccagaccaugggcuggggcgagaaggccaucgagauccgguccgucgagaccgggcaccuggacggcguguucaugcacaagcgcgcccagcggcucaaguuccugugcgagcgcaacgacaaggucuucuucgccagcgugcggagcgggggcuccagccagguguacuucaugacccuggggcgcacgucccuccugagcugguga

SEQ ID NO: 32676 - RNA, 2541 nt, Artificial Sequence
  derived and/or modified sequence opt1 from MAP4K5__Homo_sapiens__XP_006720076
auggaggcgccccugcgcccggccgccgacauccuccggcgcaacccccagcaggacuacgagcuggugcagcgggucggcagcgggaccuacggcgacguguacaaggcccgcaacgugcacaccggggagcuggccgccgucaagaucaucaagcucgagcccggcgacgacuucucccugauccagcaggagaucuucauggugaaggagugcaagcacugcaacaucguggccuacuucgggagcuaccugucccgggagaagcucuggaucugcauggaguacugcggcggcgggagccugcaggacaucuaccacgucacgggcccccuguccgagcuccagaucgcguacgugugccgcgagacccugcaggggcuggccuaccuccacaccaagggcaagaugcaccgggacaucaagggggccaacauccugcugaccgaccacggcgacgugaagcucgccgacuucggcgucgcggccaagaucacggccaccaucgccaagcgcaagagcuucaucgggaccccguacuggauggcccccgagguggcggccguggagaagaacggcggguacaaccagcugugcgacaucugggccgucggcaucaccgccaucgagcugggcgagcuccagccgcccauguucgaccugcaccccaugcgggcccuguuccucauguccaagagcaacuuccagccgcccaagcugaaggacaagacgaagugguccagcaccuuccacaacuucgugaagaucgcgcugaccaagaaccccaagaagcgccccaccgccgagcggcuccugacgcacaccuucguggcccagcccgggcugucccgcgcccucgccgucgagcugcuggacaaggugaacaaccccgacaaccacgcgcacuacaccgaggccgacgacgacgacuucgagccccacgccaucauccggcacaccauccgcagcacgaaccggaacgcccgcgccgagcggaccgcguccgagaucaacuucgacaagcuccaguucgagccgccccugcgcaaggagaccgaggcccgggacgagaugggccugagcuccgaccccaacuucaugcuccaguggaaccccuucguggacggggccaacaccggcaagagcacguccaagcgcgccaucccgccgccccugccgcccaagccccggaucagcuccuaccccgaggacaacuuccccgacgaggagaaggcgagcaccaucaagcacugccccgacagcgagucccgcgcgccccagauccugcgccggcagagcucccccagcugcgggccggucgccgagaccuccagcaucggcaacggcgacgggaucuccaagcucaugagcgagaacaccgagggcuccgcccaggcgccccagcugccccgcaagaaggacaagcgggacuuccccaagccggccaucaacgggcugccgcccacgcccaaggugcucaugggcgccugcuucagcaagguguucgacgggugcccccugaagaucaacugcgccaccuccuggauccaccccgacaccaaggaccaguacaucaucuucggcaccgaggacggcaucuacacgcugaaccucaacgagcugcacgaggccaccauggagcagcuguucccccgcaagugcaccuggcucuacgucaucaacaacacccugaugagccuguccgaggggaagacguuccagcucuacagccacaaccugaucgcccuguucgagcacgccaagaagcccggccuggccgcccacauccagacccaccgguucccggaccgcauccucccccggaaguucgcccugaccaccaagauccccgacacgaaggggugccacaagugcugcaucgugcgcaaccccuacaccggccacaaguaccugugcggggcccuccaguccggcaucgugcugcugcagugguacgagccgaugcagaaguucaugcucaucaagcacuucgacuucccccugcccagcccccugaacgucuucgagaugcucgugaucccggagcaggaguaccccauggucugcguggcgaucuccaagggcaccgagagcaaccaggugguccaguucgagaccaucaaccugaacuccgccagcagcugguucaccgagaucggggccggcucccagcagcuggacagcauccacgugacgcagcucgagcgggacaccgugcuggucugccuggacaaguucgugaagaucgugaaccuccaggggaagcugaaguccagcaagaagcuggccuccgagcucagcuucgacuuccgcaucgaguccgucgugugccugcaggacagcgugcuggcguucuggaagcacggcaugcagggcaaguccuucaagagcgacgaggucacccaggagaucuccgacgagacccggguguuccgccuccuggggagcgaccggguggucgugcuggagucccgccccacggagaaccccaccgcccacagcaaccucuacauccuggccggccacgagaacuccuacuga

SEQ ID NO: 32677 - RNA, 2442 nt, Artificial Sequence
  derived and/or modified sequence opt1 from MAP6__Homo_sapiens__NP_149052
auggccuggcccugcaucacccgcgccugcugcaucgcgcgguucuggaaccagcuggacaaggccgacaucgccgugccgcucgucuucaccaaguacagcgaggccacggagcaccccggcgccccgccccagcccccgccgccccagcagcaggcgcagcccgcccuggccccgcccuccgcccgcgcgguggccaucgagacccagcccgcccagggggagcuggacgccguggcccgggcgaccggccccgcccccgggcccaccggcgagcgcgagcccgccgccgggcccggccggagcggccccgggcccggccucggguccggcagcacguccgggcccgccgacagcgucaugcgccaggacuaccgggcguggaaggugcagcgcccggagcccuccugccggccccgcagcgaguaccagcccuccgacgccccguucgagcgggagacccaguaccagaaggacuuccgcgccuggccccugccccggcgcggcgaccaccccuggaucccgaagcccgugcagaucagcgccgccucccaggcgagcgcccccauccugggcgccccgaagcggcgcccccagucccaggagcgguggcccguccaggccgccgcggaggcccgcgagcaggaggccgcccccgggggcgccgggggccucgccgccggcaaggccagcggggccgacgagcgggacacccgccggaaggcgggcccggccuggaucgugcgccgcgccgaggggcugggccacgagcagacgccccugcccgccgcccaggcccaggugcaggcgaccgggcccgaggccggccggggccgcgccgccgcggacgcccucaaccggcagauccgcgaggaggucgccuccgccgugagcuccagcuaccggaacgaguuccgcgcguggaccgacaucaagccggugaagcccaucaaggccaagccccaguacaagcccccggacgacaagaugguccacgagaccuccuacagcgcccaguucaagggggaggccagcaagcccaccacggccgacaacaaggugaucgaccggcgccggauccgcucccuguacagcgagcccuucaaggagcccccgaagguggagaagcccuccguccagagcuccaagcccaagaagaccagcgcgucccacaagcccacccggaaggccaaggacaagcaggccgugagcggccaggccgccaagaagaaguccgcggaggggccgagcaccacgaagcccgacgacaaggagcaguccaaggagaugaacaacaagcuggccgaggccaaggagagccucgcccagcccguguccgacagcuccaagacccagggccccgucgccaccgagccggacaaggaccaggggagcguggugcccggccugcugaagggccaggggcccaugguccaggagccgcucaagaagcagggcuccguggugcccgggccgcccaaggaccugggccccaugaucccccugcccgucaaggaccaggaccacaccgugcccgagccgcucaagaacgagagccccgucaucuccgcgcccgugaaggaccaggggcccagcgugccggucccgcccaagaaccagagccccauggugcccgccaaggugaaggaccagggcuccgucgugcccgagagccugaaggaccagggcccccgcauccccgagccggugaagaaccaggcccccaugguccccgcccccgugaaggacgaggggccgaugguguccgcgagcgucaaggaccagggccccaugguguccgcccccgugaaggaccaggggcccaucgucccggcccccgugaagggcgagggccccaucgugccggcccccgucaaggacgaggggcccauggugagcgcccccaucaaggaccaggacccgauggugcccgagcaccccaaggacgaguccgcgauggccacggcccccaucaagaaccagggcagcauggucuccgagccggugaagaaccaggggcugguggucagcggccccgugaaggaccaggacguggucgugcccgagcacgccaaggugcacgacuccgccgucguggcgcccgugaagaaccaggggccggucgugcccgagagcgugaagaaccaggaccccauccuccccguccuggugaaggaccagggcccgaccgugcugcagccgcccaagaaccagggccggaucguccccgagccccucaagaaccaggugcccaucgugcccgucccccugaaggaccaggacccgcuggugcccgugcccgccaaggaccaggggcccgccgucccggagccccucaagacccagggcccccgcgacccgcagcugcccaccgugagcccccugccccgggugaugaucccgacggcgccccacaccgaguacaucgaguccucccccuga

SEQ ID NO: 32678 - RNA, 2205 nt, Artificial Sequence
  derived and/or modified sequence opt1 from MAP7__Homo_sapiens__NP_001185540
augcccggcagcgccaccgcccugcgccacgagcggcucaagaagaccaacgcgcgcccgaucccccuggggcuguucacgaucaacgaggaggacgagcagcagaagaacggcaacucccggcgccccaaggcccccgacagcuacaaggugcaggacaagaagaacgccuccagccggccggccuccgccaucagcgggcagaacaacaaccacuccggcaacaagcccgacccgccgcccguccuccgcguggacgaccggcagcgccuggcgcgggagcgccgggaggagcgcgagaagcagcuggccgcccgggagaucguguggcucgagcgcgaggagcgggcccgccagcacuacgagaagcaccuggaggagcggaagaagcgccuggaggagcagcggcagaaggaggagcgccggcgcgcggccgucgaggagaagcgccggcagcgccucgaggaggacaaggagcggcacgaggccguggugcgccggaccauggagcgcagccagaagcccaagcagaagcacaaccggugguccuggggcgggagccugcacggcucccccagcauccacuccgccgcccgccggcugcagcucagccccugggaguccagcgucgugaaccgccugcugacccccacccacuccuuccucgcgcggagcaaguccacggccgcccugagcggggaggccgccagcugcucccccaucaucaugcccuacaaggcggcccacagccgcaacuccauggaccggcccaagcuguucgugaccccgcccgagggcagcucccgccggcgcaucauccacgggaccgccagcuacaagaaggagcgggagcgcgagaacguccucuuccugaccuccggcacgcggcgcgccgugagccccuccaaccccaaggcccgccagccggcgcggagccgccuguggcuccccuccaagagccugccccaccuccccgggaccccgcggcccaccuccagccugccgcccggcuccgugaaggccgcccccgcccagguccgcccgcccagccccggcaacauccggcccgugaagcgcgaggugaaggucgagcccgagaagaaggaccccgagaaggagccgcagaagguggccaacgagcccucccugaaggggcgggcgccccuggugaaggucgaggaggccaccguggaggagcgcacgcccgccgagccggaggugggccccgccgcgcccgccauggcccccgccccggccagcgcgcccgcccccgccuccgcccccgccccggcgcccguccccacccccgccauggugagcgccccgagcuccaccgugaacgccagcgccuccgucaagaccagcgcggggacgaccgaccccgaggaggccacccggcuccuggccgagaagcgccggcuggcccgcgagcagcgggagaaggaggagcgcgagcggcgcgagcaggaggagcucgagcggcagaagcgcgaggagcuggcgcagcggguggccgaggagcgcaccacgcggcgcgaggaggagucccgccggcuggaggccgagcaggcccgcgagaaggaggagcagcuccagcggcaggccgaggagcgcgcgcugcgggagcgcgaggaggccgagcgggcccagcgccagaaggaggaggaggcccggguccgcgaggaggccgagcgggugcgccaggagcgggagaagcacuuccagcgcgaggagcaggagcggcuggagcgcaagaagcggcucgaggagaucaugaagcgcacccggcgcaccgaggcgaccgacaagaagacgagcgaccagcgcaacggcgacaucgccaagggcgcccugaccgggggcaccgagguguccgcccugcccugcaccacgaacgcccccgggaacggcaagccggucgggagcccccacguggugaccucccaccagagcaaggucaccguggaguccacccccgaccucgagaagcagccgaacgagaacggcgugagcguccagaacgagaacuucgaggagaucaucaaccugcccaucggcuccaagcccagccggcuggacgugacgaacuccgagagccccgagaucccgcucaaccccauccuggcguucgacgacgaggggacccugggcccccucccccagguggacgggguccagacccagcagaccgccgaggugaucuga

SEQ ID NO: 32679 - RNA, 1944 nt, Artificial Sequence
  derived and/or modified sequence opt1 from MAP9__Homo_sapiens__NP_001034669
augagcgacgagguguucuccaccacccuggccuacaccaagagccccaaggucacgaagcgcaccaccuuccaggacgagcucauccgggccaucacggcgcgcuccgcccggcagcgcagcuccgaguacagcgacgacuucgacuccgacgagaucgugagccugggcgacuucuccgacaccagcgccgacgagaacuccgugaacaagaagaugaacgacuuccacaucagcgacgacgaggagaagaaccccuccaagcuccuguuccugaagaccaacaagagcaacgggaacaucaccaaggacgagcccgucugcgccaucaagaacgaggaggagauggcccccgacggcugcgaggacaucguggugaaguccuucagcgagucccagaacaaggacgaggaguucgagaaggacaagaucaagaugaagcccaagccgcggauccugagcaucaaguccacgagcagcgcggagaacaacucccucgacaccgacgaccacuucaagcccagcccccgcccccgguccaugcugaagaagaagucccacauggaggagaaggacgggcuggaggacaaggagaccgcccucagcgaggagcuggagcugcacagcgccccguccagccuccccacccccaacggcauccagcuggaggccgagaagaaggcguucuccgagaaccuggaccccgaggacagcugccucacgucccuggccagcuccagccugaagcagauccucggggacuccuucagcccgggcuccgagggcaacgccagcgggaaggaccccaacgaggagaucaccgagaaccacaacucccucaagagcgacgagaacaaggagaacagcuucuccgccgaccacgucaccaccgccguggagaaguccaaggagagccaggugacggcggacgaccuggaggaggagaaggccaaggccgagcugaucauggacgacgaccgcaccgucgacccccugcugagcaagucccagagcauccucaucuccaccagcgccaccgccuccagcaagaagacgaucgaggaccggaacaucaagaacaagaaguccaccaacaaccgcgcgagcuccgccagcgcccggcugaugaccuccgaguuccugaagaaguccagcagcaagcgccggacccccagcacgaccaccuccagccacuaccucggcacccugaaggugcuggaccagaagccgucccagaagcagagcaucgagcccgaccgcgccgacaacauccgggccgcgguguaccaggaguggcucgagaagaagaacgucuaccugcacgagaugcaccgcaucaagcggaucgaguccgagaaccugcgcauccagaacgagcagaagaaggccgccaagcgggaggaggcccucgccagcuucgaggcguggaaggccaugaaggagaaggaggccaagaagaucgccgcgaagaagcgccuggaggagaagaacaagaagaagacggaggaggagaacgccgcccggaagggggaggcccugcaggccuucgagaaguggaaggagaagaagauggaguaccucaaggagaagaaccgcaaggagcgcgaguacgagcgggcgaagaagcagaaggaggaggagaccguggccgagaagaagaaggacaaccugaccgccguggagaaguggaacgagaagaaggaggccuucuucaagcagaaggagaaggagaagaucaacgagaagcgcaaggaggagcugaagcgggccgagaagaaggacaaggacaagcaggcgaucaacgaguacgagaaguggcucgagaacaaggagaagcaggagcgcaucgagcggaagcagaagaagcgccacuccuuccuggagagcgaggcccugccgcccugguccccgcccagccggaccgucuucgccaagguguucuga

SEQ ID NO: 32680 - RNA, 1269 nt, Artificial Sequence
  derived and/or modified sequence opt1 from MAPK10__Homo_sapiens__NP_002744
augagccugcacuuccucuacuacugcuccgagcccacccuggacgugaagaucgccuucugccagggcuucgacaagcaggucgacgugagcuacaucgccaagcacuacaacauguccaagagcaagguggacaaccaguucuacuccgucgaggugggggacagcaccuucacggugcugaagcgcuaccagaaccucaagccgaucggcuccggggcgcagggcaucgucugcgccgccuacgacgccgugcuggaccggaacguggccaucaagaagcugagccgccccuuccagaaccagacccacgcgaagcgggccuaccgcgagcucguccugaugaagugcgugaaccacaagaacaucaucucccugcucaacguguucacgccccagaagacccuggaggaguuccaggacgucuaccuggugauggagcucauggacgccaaccugugccaggugauccagauggagcuggaccacgagcggaugagcuaccuccuguaccagaugcugugcgggaucaagcaccuccacuccgccggcaucauccaccgcgaccugaagcccagcaacaucgucgugaaguccgacugcacccugaagauccucgacuucggccuggcgcggaccgccgggaccagcuucaugaugaccccguacguggucacgcgcuacuaccgggcccccgaggugauccugggcaugggguacaaggagaacguggacaucugguccgucggcugcaucaugggggagauggugcgccacaagauccucuuccccggccgggacuacaucgaccaguggaacaaggugaucgagcagcugggcacccccugcccggaguucaugaagaagcugcagcccaccguccgcaacuacguggagaaccggcccaaguacgccgggcucaccuuccccaagcuguucccggacagccuguuccccgccgacuccgagcacaacaagcucaaggcgagccaggcccgcgaccugcuguccaagaugcucgucaucgaccccgccaagcggaucagcguggacgacgcccugcagcaccccuacaucaacgugugguacgacccggccgaggucgaggcgcccccgccccagaucuacgacaagcagcuggacgagcgcgagcacacgaucgaggaguggaaggagcucaucuacaaggaggugaugaacagcgaggagaagaccaagaacggcguggucaaggggcagcccucccccagcgcccaggugcagcaguga

SEQ ID NO: 32681 - RNA, 1095 nt, Artificial Sequence
  derived and/or modified sequence opt1 from MAPK11__Homo_sapiens__NP_002742
augagcggcccccgcgccggguucuaccggcaggagcugaacaagaccgugugggaggucccccagcgccuccagggccugcggcccgugggguccggcgccuacgggagcgugugcuccgcguacgacgcccgccugcggcagaaggucgccgugaagaagcucagccgccccuuccagucccugauccacgcccggcgcaccuaccgggagcugcgccuccugaagcaccugaagcacgagaacgugaucggccuccuggacgucuucacgcccgccaccagcaucgaggacuucuccgagguguaccuggugaccacccucaugggcgcggaccugaacaacaucgucaagugccaggcccugagcgacgagcacgugcaguuccucguguaccagcugcugcgggggcucaaguacauccacuccgccggcaucauccaccgcgaccugaagccgagcaacgucgccgugaacgaggacugcgagcugcggauccucgacuucgggcuggcgcgccaggccgacgaggagaugacgggcuacguggccacccggugguaccgcgcccccgagaucaugcugaacuggaugcacuacaaccagaccgucgacaucugguccguggggugcaucauggccgagcuccugcagggcaaggcgcuguuccccggcagcgacuacaucgaccagcucaagcggaucauggagguggucgggacccccuccccggaggugcuggccaagaucagcuccgagcacgcccgcacguacauccagagccugccgcccaugccccagaaggaccucuccagcaucuuccggggcgccaacccccuggccaucgaccugcucgggcgcaugcuggugcuggacuccgaccagcgggucagcgcggccgaggcccucgcccacgccuacuucagccaguaccacgaccccgaggacgagcccgaggcggagcccuacgacgaguccguggaggccaaggagcgcacccuggaggaguggaaggagcugaccuaccaggaggugcucagcuucaagccgcccgagccgcccaagccgcccggcucccuggagaucgagcaguga

SEQ ID NO: 32682 - RNA, 1074 nt, Artificial Sequence
  derived and/or modified sequence opt1 from MAPK12__Homo_sapiens__NP_001290181
augagcagcccgccgcccgcccgcuccggcuucuaccggcaggaggugaccaagaccgccugggagguccgcgcgguguaccgggaccugcagcccgugggguccggcgccuacggggccgucugcagcgccguggacggccgcaccggggccaagguggcgaucaagaagcucuaccggcccuuccaguccgagcuguucgccaagcgcgccuaccgggagcugcgccuccugaagcacaugcggcacgagaacgucaucggccugcucgacguguucacccccgacgagacccuggacgacuucaccgacuucuaccuggugaugcccuucaugggcacggaccucgggaagcugaugaagcacgagaagcugggcgaggaccgcauccaguuccucgucuaccagaugcugaaggggcugcgggaccucaagcccggcaaccuggccgugaacgaggacugcgagcugaagauccucgacuucgggcuggcgcgccaggccgacagcgagaugaccggcuacguggucacccggugguaccgcgcccccgaggugauccugaacuggaugcgguacacccagacgguggacaucugguccgucggcugcaucauggccgagaugaucaccgggaagacccucuucaagggcagcgaccaccuggaccagcugaaggagaucaugaaggugaccgggacgccgcccgccgaguucgugcagcgccuccaguccgacgaggcgaagaacuacaugaagggccugcccgagcuggagaagaaggacuucgccagcauccucaccaacgccagcccccuggccgucaaccugcucgagaagaugcuggugcuggacgccgagcagcgggugaccgcgggcgaggcccucgcccacccguacuucgagucccugcacgacaccgaggacgagccccagguccagaaguacgacgacuccuucgacgacguggaccgcacgcuggacgaguggaagcgggugaccuacaaggagguccucagcuucaagccgccccgccagcugggggcccggguguccaaggagacgccccuguga

SEQ ID NO: 32683 - RNA, 1098 nt, Artificial Sequence
  derived and/or modified sequence opt1 from MAPK13__Homo_sapiens__NP_002745
augagccugauccgcaagaagggcuucuacaagcaggacgugaacaagaccgccugggagcuccccaagaccuacgucuccccgacgcacguggggagcggcgccuacggguccgugugcagcgcgaucgacaagcgguccggcgagaaggucgccaucaagaagcugagccgccccuuccaguccgagaucuucgccaagcgggccuaccgcgagcugcuccugcugaagcacaugcagcacgagaacgugaucgggcuccuggacguguucacccccgccagcucccugcggaacuucuacgacuucuaccucgucaugcccuucaugcagaccgaccugcagaagaucaugggcauggaguucagcgaggagaagauccaguaccugguguaccagaugcucaagggccugaaguacauccacuccgcgggggugguccaccgcgaccugaagccgggcaaccucgccgugaacgaggacugcgagcugaagauccuggacuucgggcucgcccggcacgccgacgcggagaugaccggcuacguggucacgcgcugguaccgggcccccgaggugauccugagcuggaugcacuacaaccagaccguggacaucugguccgucgggugcaucauggccgagaugcugaccggcaagacccucuucaagggcaaggacuaccuggaccagcugacgcagauccucaaggugaccggggugcccggcaccgaguucguccagaagcugaacgacaaggccgccaagagcuacauccagucccugccccagaccccgcgcaaggacuucacgcagcuguucccccgggcgagcccccaggccgccgaccuccuggagaagaugcucgagcuggacguggacaagcgccugaccgccgcccaggcgcucacccaccccuucuucgagccguuccgggaccccgaggaggagaccgaggcccagcagcccuucgacgacucccuggagcacgagaagcugacgguggacgaguggaagcagcacaucuacaaggagaucgucaacuucagccccaucgcccgcaaggacucccggcgccggagcgggaugaagcucuga

SEQ ID NO: 32684 - RNA, 1083 nt, Artificial Sequence
  derived and/or modified sequence opt1 from MAPK14__Homo_sapiens__NP_001306
augagccaggagcgccccaccuucuaccggcaggagcugaacaagaccaucugggaggugccggagcgcuaccagaaccucucccccgucggcagcggggccuacggcuccgugugcgccgcguucgacacgaagaccgggcugcggguggccgucaagaagcugagccgccccuuccaguccaucauccacgccaagcggaccuaccgcgagcuccggcugcugaagcacaugaagcacgagaacgugaucggccuccuggacguguucacccccgcccgcagccuggaggaguucaacgacgucuaccucgugacgcaccugaugggggccgaccugaacaacaucgugaagugccagaagcucaccgacgaccacguccaguuccugaucuaccagauccugcggggccucaaguacauccacuccgcggacaucauccaccgcgaccugaagccgagcaaccuggccgugaacgaggacugcgagcucaagauccuggacuucggccuggcccggcacaccgacgacgagaugaccggguacguggccacgcgcugguaccgggcgcccgagaucaugcucaacuggaugcacuacaaccagaccgucgacaucugguccgugggcugcaucauggccgagcugcugaccgggcgcacccucuuccccggcacggaccacaucaaccagcugcagcagaucaugcggcugaccgggacgcccccggccuaccucaucaaccgcaugcccagccacgaggcccggaacuacauccagucccugacccagaugcccaagaugaacuucgccaacguguucaucggcgcgaacccccuggccgucgaccuccuggagaagaugcuggugcucgacagcgacaagcgcaucaccgccgcccaggcccuggcgcacgccuacuucgcccaguaccacgacccggacgacgagcccguggccgaccccuacgaccaguccuucgagagccgggaccugcucaucgacgaguggaagucccugaccuacgacgaggucaucagcuucgugcccccgccccuggaccaggaggagauggaguccuga

SEQ ID NO: 32685 - RNA, 1635 nt, Artificial Sequence
  derived and/or modified sequence opt1 from MAPK15__Homo_sapiens__NP_620590
augugcaccguggucgacccccgcaucgugcggcgcuaccugcuccggcgccagcugggccagggggccuacggcaucguguggaaggccgucgaccggcgcaccggggaggugguggcgaucaagaagaucuucgacgccuuccgggacaagacggacgcccagcgcaccuuccgggagaucacccugcuccaggaguucggcgaccaccccaacaucaucagccugcuggacgucauccgcgccgagaacgaccgggacaucuaccucguguucgaguucauggacaccgaccugaacgccgugauccgcaagggcgggcugcuccaggacguccacgugcgguccaucuucuaccagcugcugcgcgcgacgcgguuccuccacagcggccacgugguccaccgcgaccagaagcccuccaacgugcugcuggacgccaacugcaccgugaagcucugcgacuucgggcuggcccggagccugggcgaccuccccgaggggcccgaggaccaggccgucaccgaguacguggcgacccgcugguaccgggccccggaggugcugcuguccagccaccgcuacacgcucggcgucgacauguggucccuggggugcauccugggcgagaugcuccggggccgcccccuguuccccgggaccagcacccugcaccagcucgagcugauccuggagaccaucccgccgcccuccgaggaggaccuccuggcccugggcagcgggugccgcgccuccgugcuccaccagcugggcagccggccccgccagacgcuggacgcccuccugccgcccgacaccucccccgaggcgcuggaccuccugcggcgccugcucguguucgcccccgacaagcggcugagcgccacccaggcccugcagcaccccuacguccagcgcuuccacugccccuccgacgagugggcccgggaggcggacgugcgcccccgggcccacgagggcgugcagcucagcguccccgaguaccgcucccggguguaccagaugauccuggagugcgggggcagcuccgggaccagccgcgagaagggccccgagggggucagcccgucccaggcccaccuccacaagccccgggccgacccccagcugcccagccgcacgccggugcagggcccccggccccgcccccaguccagcccgggccacgaccccgccgagcacgagagcccccgggcggccaagaacgugccgcgccagaacuccgcgccccuccugcagaccgcccugcuggggaacggcgagcggccgcccggggccaaggaggccccgccccugacccugucccucgucaagcccagcggccgcggggccgcccccucccugaccagccaggccgcggcccagguggccaaccaggcccugauccgcggcgacuggaaccggggcgggggcgugcgcgucgccuccgugcagcaggucccgccccggcucccgcccgaggcgcgccccgggcggcgcauguucagcacguccgcccugcagggcgcccagggcggggcccgggcccugcucggcggguacagccaggcguacggcaccgugugccacuccgcccuggggcaccucccccugcuggagggccaccacguguga

SEQ ID NO: 32686 - RNA, 1083 nt, Artificial Sequence
  derived and/or modified sequence opt1 from MAPK1__Homo_sapiens__NP_620407
auggccgccgcggccgccgccggcgccgggcccgagauggugcgcggccaggucuucgacguggggccgcgguacaccaaccugagcuacaucggcgagggggcguacggcauggugugcuccgccuacgacaacgucaacaaggugcgcguggccaucaagaagaucagccccuucgagcaccagaccuacugccagcggacgcuccgcgagaucaagauccugcugcgguuccgccacgagaacaucaucggcaucaacgacaucauccgggcccccaccaucgagcagaugaaggacgucuacaucgugcaggaccucauggagaccgaccuguacaagcugcucaagacccagcaccuguccaacgaccacaucugcuacuuccuguaccagauccuccgcgggcugaaguacauccacagcgcgaacgugcugcaccgggaccucaagcccuccaaccugcugcucaacacgaccugcgaccugaagaucugcgacuucggccuggcccgcgucgccgacccggaccacgaccacaccggguuccucaccgaguacguggccacgcggugguaccgcgcccccgagaucaugcugaacagcaagggcuacaccaaguccaucgacaucuggagcguggggugcauccuggcggagaugcucuccaaccggcccaucuuccccggcaagcacuaccuggaccagcugaaccacauccucggcauccuggggagcccgucccaggaggaccugaacugcaucaucaaccucaaggcccgcaacuaccugcugagccucccccacaagaacaagguccccuggaaccggcuguuccccaacgccgacuccaaggcccuggaccuccuggacaagaugcugaccuucaacccgcacaagcgcaucgagguggagcaggcccucgcgcaccccuaccuggagcaguacuacgaccccagcgacgagcccaucgccgaggccccguucaaguucgacauggagcuggacgaccuccccaaggagaagcugaaggagcugaucuucgaggagaccgcccgguuccagcccggcuaccgcuccuga

SEQ ID NO: 32687 - RNA, 1074 nt, Artificial Sequence
  derived and/or modified sequence opt1 from MAPK3__Homo_sapiens__NP_001035145
auggccgccgcggccgcccagggcgggggcgggggcgagccccgccggaccgagggggugggcccgggcguccccggggagguggagauggugaagggccagcccuucgacgucgggccccgcuacacccagcugcaguacaucggcgagggggccuacggcauggugagcuccgccuacgaccacgugcggaagacgcgcgucgcgaucaagaagaucagcccguucgagcaccagaccuacugccagcggacccuccgcgagauccagauccugcugcgguuccgccacgagaacgugaucggcauccgggacauccuccgcgccuccacccuggaggccaugcgggacguguacaucguccaggaccugauggagacggaccucuacaagcugcucaagagccagcagcucuccaacgaccacaucugcuacuuccuguaccagauccugcgcgggcucaaguacauccacagcgccaacgugcugcaccgggaccugaagcccuccaaccuccugaucaacacgaccugcgaccugaagaucugcgacuucggccucgcgcgcaucgccgaccccgagcacgaccacaccggguuccugaccgaguacguggccacccggugguaccgcgcccccgagaucaugcugaacagcaagggcuacaccaaguccaucgacaucuggagcgucggcugcauccucgccgagaugcuguccaaccggccgaucuuccccgggaagcacuaccuggaccagcucaaccacauccugggcauccuggggagccccucccaggaggaccucaacugcaucaucaacaugaaggcgcgcaacuaccugcagagccugcccuccaagaccaagguggccugggccaagcuguuccccaagagcgacuccaaggcccuggaccugcucgaccggaugcugacguucaacccgaacaagcgcaucaccguggaggaggcccuggcgcaccccuaccucgagcaguacuacgaccccaccgacgaggucggccagagcccggccgccguggggcugggcgccggcgagcagggcgggaccuga

SEQ ID NO: 32688 - RNA, 2166 nt, Artificial Sequence
  derived and/or modified sequence opt1 from MAPK6__Homo_sapiens__XP_005254596
auggccgagaaguucgagagccugaugaacauccacggcuucgaccucgggucccgcuacauggaccugaagccccugggcugcgggggcaacgggcucguguucagcgccgucgacaacgacugcgacaagcggguggcgaucaagaagaucgugcugaccgacccgcaguccgucaagcacgcccugcgcgagaucaagaucauccggcgccucgaccacgacaacaucgugaagguguucgagauccugggccccagcggcucccagcugaccgacgacgucgggagccucacggagcugaacuccguguacaucgugcaggaguacauggagaccgaccuggccaacguccucgagcagggcccccugcuggaggagcacgcccgccucuucauguaccagcugcugcgggggcucaaguacauccacagcgccaacgugcugcaccgggaccugaagcccgcgaaccucuucaucaacaccgaggaccuggugcugaagaucggcgacuucgggcucgcccgcaucauggacccgcacuacucccacaagggccaccugagcgagggccuggucaccaagugguaccggagcccccgccuccugcugagccccaacaacuacacgaaggccaucgacaugugggccgcggggugcaucuucgccgagaugcucaccggcaagacccuguucgccggggcccacgagcuggagcagaugcagcucauccuggaguccauccccguggugcacgaggaggaccggcaggagcugcucagcgucaucccgguguacauccgcaacgacaugaccgagccccacaagccccugacgcagcugcuccccggcaucucccgggaggcccuggacuuccuggagcagauccucaccuucagcccgauggaccgccugaccgcggaggaggcccugucccaccccuacaugagcaucuacuccuuccccauggacgagcccaucagcagccacccguuccacaucgaggacgagguggacgacauccuccugauggacgagacccacucccacaucuacaacugggagcgguaccacgacugccaguucagcgagcacgacuggcccguccacaacaacuucgacaucgacgaggugcagcuggacccccgcgcccucuccgacgugacggacgaggaggagguccagguggacccccggaaguaccuggacggcgaccgcgagaaguaccuggaggacccggccuucgacaccaacuacagcaccgagcccugcuggcaguacuccgaccaccacgagaacaaguacugcgaccuggagugcagccacacgugcaacuacaagacccgguccagcuccuaccucgacaaccugguguggcgcgagagcgaggucaaccacuacuacgagcccaagcugaucaucgaccucuccaacuggaaggagcagagcaaggagaaguccgacaagaaggggaaguccaagugcgagcggaacggccuggugaaggcccagaucgcgcuggaggaggccucccagcagcucgccgggaaggagcgcgagaagaaccagggcuucgacuucgacagcuucaucgccgggaccauccagcuguccagccagcacgagcccaccgacgucguggacaagcugaacgaccucaacuccagcgugagccagcuggagcugaagucccucaucagcaaguccgucagccaggagaagcaggagaagggcauggccaaccuggcgcagcuggaggcccucuaccaguccagcugggacucccaguucgugagcggcggggaggacugcuucuucaucaaccaguucugcgaggugcgcaaggacgagcaggucgagaaggagaacaccuacacguccuaccuggacaaguucuucagccggaaggaggacaccgagaugcuggagaccgagccgguggaggacggcaagcucggggagcgcggccacgaggagggguuccugaacaacuccggcgaguuccuguucaacaagcagcucgagagcaucggcaucccccaguuccacucccccguggggagcccccugaaguccauccaggccacccugacgccgagcgccaugaaguccagcccccagaucccccaccagaccuacagcuccauccucaagcaccugaacuga

SEQ ID NO: 32689 - RNA, 2451 nt, Artificial Sequence
  derived and/or modified sequence opt1 from MAPK7__Homo_sapiens__NP_002740
auggccgagccccugaaggaggaggacggcgaggacgggagcgccgagccgcccggccccgugaaggcggagcccgcccacaccgccgccuccgucgccgcgaagaaccucgcccugcugaaggcccgcagcuucgacgugaccuucgacgugggggacgaguacgagaucaucgagacgaucggcaacggggccuacggcgucguguccagcgcgcggcgccggcucaccggccagcaggucgccaucaagaagaucccgaacgccuucgacgucgugaccaacgccaagcgcacccugcgggagcugaagauccucaagcacuucaagcacgacaacaucaucgccaucaaggacauccugcgccccacggugcccuacggggaguucaaguccgucuacguggugcuggaccucauggagagcgaccugcaccagaucauccacuccagccagccccugacccucgagcacguccgguacuuccuguaccagcugcuccgcggccugaaguacaugcacuccgcccaggugauccaccgggaccugaagccgagcaaccuccuggugaacgagaacugcgagcugaagaucggggacuucggcauggcccgcgggcucugcaccucccccgccgagcaccaguacuucaugaccgaguacgucgccacgcggugguaccgcgcccccgagcugaugcugagccuccacgaguacacccaggcgaucgaccugugguccgugggcugcaucuucggcgagaugcuggcccggcgccagcuguuccccgggaagaacuacgugcaccagcugcagcugaucaugauggugcucggcaccccgagccccgcggugauccaggccgugggggccgagcggguccgcgcguacauccagucccucccgccccggcagccggugcccugggagaccguguaccccggcgccgaccgccaggcccugagccuccugggccggaugcugcgcuucgagcccuccgcccggaucagcgccgcggccgcccuccgccacccguuccuggccaaguaccacgaccccgacgacgagcccgacugcgcgcccccguucgacuucgccuucgaccgcgaggcccugacgcgggagcgcaucaaggaggccaucgucgccgagaucgaggacuuccacgcgcggcgcgaggggauccggcagcagauccgcuuccagcccucccuccagcccguggccagcgagcccggcugcccggacgucgagaugcccagccccugggccccguccggggacugcgccauggagagcccgccgcccgcgcccccgcccugccccggccccgcccccgacaccaucgaccugacccugcagccgccgccgcccguguccgagcccgccccgcccaagaaggacggggccaucagcgacaacaccaaggccgcccucaaggcggcccugcugaagucccuccggagccgccugcgggacggccccuccgcgccccuggaggcccccgagccccgcaagcccgugacggcccaggagcggcagcgcgagcgggaggagaagcgccggcgccggcaggagcgcgccaaggagcgggagaagcgccgccaggagcgggagcgcaaggagcggggcgccggggccagcggcgggcccuccaccgacccccucgccggccugguccugagcgacaacgaccgcucccugcucgagcgguggacccgcauggcgcggcccgccgcccccgcccugaccagcgugcccgcccccgcgcccgcccccacgcccacccccacccccgugcagcccaccagcccgccgcccgggcccgucgcccagcccacgggcccccagccccaguccgccggcuccaccagcgggcccgugccccagccggccugcccgccgcccggccccgcgccccaccccaccgggccgcccggccccauccccgugcccgccccgccccagaucgccaccuccacgagccugcucgccgcgcagucccuggugcccccgcccgggcugcccggcagcagcacccccggcguccuccccuacuucccgcccgggcugcccccgcccgacgccggcggggcgccccaguccagcauguccgagagccccgacgugaaccuggucacccagcagcucuccaagagccagguggaggacccccugccgcccguguucuccggcacccccaagggcagcggggccggcuacggggucggcuucgaccuggaggaguuccucaaccaguccuucgacauggggguggccgacggcccccaggacggccaggccgacagcgccucccugagcgccucccugcucgccgacuggcuggaggggcacggcaugaaccccgccgacaucgagagccugcagcgcgagauccagauggacucccccaugcuccuggcggaccugcccgaccuccaggacccguga

SEQ ID NO: 32690 - RNA, 927 nt, Artificial Sequence
  derived and/or modified sequence opt1 from MAPK8__Homo_sapiens__NP_001265477
augagccgcuccaagcgggacaacaacuucuacagcguggagaucggcgacuccaccuucaccguccugaagcgcuaccagaaccucaagcccaucgggagcggcgcccaggggaucgugugcgccgccuacgacgccauccuggagcggaacguggccaucaagaagcugucccgcccguuccagaaccagacgcacgccaagcgggccuaccgcgagcucguccugaugaagugcgugaaccacaagaacaucaucggccugcucaacguguucacgccccagaagucccuggaggaguuccaggacgucuacaucgugauggagcugauggacgcgaaccucugccaggugauccagauggagcuggaccacgagcggaugagcuaccugcucuaccagaugcugugcgggaucaagcaccuccacagcgccggcaucauccaccgcgaccugaagcccuccaacaucgucgucaagagcgacugcacccugaagauccuggacuucggccucgcccggaccgccgggaccuccuucaugaugacccccuacguggugacccgcuacuaccgggcgccggaggugauccugggcaugggguacaaggagaacgccgacagcgagcacaacaagcugaaggccucccaggcccgcgaccuccugagcaagaugcuggugaucgacgccuccaagcggaucagcgucgacgaggcgcuccagcaccccuacaucaacgugugguacgaccccuccgaggccgaggcgcccccgcccaagauccccgacaagcagcuggacgagcgcgagcacaccaucgaggaguggaaggagcugaucuacaaggaggugauggaccucgaggagcggacgaagaacggcgucauccgcgggcagcccagcccgcuggcccaggugcagcaguga

SEQ ID NO: 32691 - RNA, 2136 nt, Artificial Sequence
  derived and/or modified sequence opt1 from MAPK8IP1__Homo_sapiens__NP_005447
auggccgagcgcgagagcggcgggcugggcgggggcgccgcgagcccgcccgccgccucccccuuccucgggcugcacaucgccuccccgcccaacuuccggcugacccacgacaucagccucgaggaguucgaggacgaggaccuguccgagaucaccgacgagugcggcaucagccugcagugcaaggacacgcucucccugcgcccgccccgggccggccugcucagcgccgggggcgggggcgcggggucccgccugcaggccgagaugcugcagauggaccucaucgacgccaccggcgacacccccggcgcggaggacgacgaggaggacgacgacgaggagcgggccgcccgccggcccggggccggcccgcccaaggccgagagcgggcaggagcccgcgucccgcggccagggccagagccaggggcagucccagggccccgggagcggcgacaccuaccggcccaagcgccccacgacccugaaccuguucccccaggugccccggucccaggacacccucaacaacaacagccuggggaagaagcacuccuggcaggaccgcgucagccgguccagcagcccgcugaagaccggcgagcagacgccgccccacgagcacaucugccucuccgacgagcugcccccgcagagcggccccgcccccaccaccgaccgcgggaccuccacggacagccccugccggcgcuccaccgccacccagauggccccgcccggcgggccgcccgccgcgccgcccggcgggcggggccacagccaccgcgaccggauccacuaccaggccgacgugcgccuggaggccaccgaggagaucuaccucacgcccgugcagcggccgcccgacgccgccgagcccaccuccgcguuccugccgcccaccgagagccgcauguccgucagcuccgaccccgaccccgccgccuaccccagcaccgccggccgcccccaccccuccaucagcgaggaggaggagggguucgacugccuguccagccccgagcgggccgagcccccgggcgggggcuggcgcgggucccucggcgagcccccgccgccgccccgggcgagccuguccagcgacacgagcgcccuguccuacgacagcgugaaguacacccucguggucgacgagcacgcccagcuggagcuggugucccuccgccccugcuucggcgacuacagcgacgaguccgacagcgccaccguguacgacaacugcgcguccgucagcucccccuacgagagcgccaucggggaggaguacgaggaggcgccccggccccagccgcccgccugccuguccgaggacagcacccccgacgagcccgacgugcacuucuccaagaaguuccugaacguguucaugagcggccgcucccggagcuccagcgccgagagcuucggccucuucuccugcaucaucaacggggaggagcaggagcagacgcaccgcgccaucuuccgguucgucccccgccacgaggacgagcuggagcuggagguggacgacccccuccugguggagcugcaggccgaggacuacugguacgaggccuacaacaugcggaccggcgcccgcggggucuuccccgccuacuacgcgaucgaggugaccaaggagcccgagcacauggccgcccucgccaagaacagcgacuggguggaccaguuccgggucaaguuccugggcuccguccaggugcccuaccacaaggggaacgacgugcugugcgccgcgaugcagaagaucgccaccacgcgccggcucaccgugcacuucaacccgcccagcuccugcgugcuggagaucagcguccgcggcgugaagaucggggucaaggccgacgacucccaggaggccaagggcaacaagugcagccacuucuuccagcugaagaacaucuccuucugcggcuaccaccccaagaacaacaaguacuucggguucaucaccaagcaccccgcggaccaccgguucgccugccacguguucgugagcgaggacuccaccaaggcccucgccgagagcgucggccgcgccuuccagcaguucuacaagcaguucguggaguacacgugccccaccgaggacaucuaccuggaguga

SEQ ID NO: 32692 - RNA, 2475 nt, Artificial Sequence
  derived and/or modified sequence opt1 from MAPK8IP2__Homo_sapiens__NP_036456
auggccgaccgcgccgagauguucagccuguccaccuuccacagccucagcccgcccggcugccggccgccccaggacaucucccuggaggaguucgacgacgaggaccuguccgagaucaccgacgacugcgggcucggccugagcuacgacuccgaccacugcgagaaggacagccugucccucgggcgcagcgagcagccccaccccaucugcuccuuccaggacgacuuccaggaguucgagaugaucgacgacaacgaggaggaggacgacgaggacgaggaggaggaggaggaggaggaggagggcgacggggagggccaggagggcggggaccccggcagcgaggcgcccgcccccgggccgcugauccccucccccagcguggaggagccccacaagcaccggccgacgacccugcgccucaccacccugggcgcccaggacucccugaacaacaacgggggcuucgaccucguccggcccgccagcuggcaggagacggcccugugcucccccgcgcccgaggcccugcgcgagcucccgggcccccugcccgccaccgacaccgggcccggcggggcccagagcccggugcggcccggcugcgacugcgagggcaaccgccccgcggagcccccggcccccgggggcaccucccccagcagcgaccccgggaucgaggccgaccugcggucccgcagcuccggcgggcggggcggccgccggagcucccaggagcucagcuccccggggagcgacuccgaggacgccggcggggcccgccugggccggaugaucagcuccaucagcgagacggagcuggagcucuccagcgacgggggcuccagcuccagcggccgcuccagccaccugaccaacagcaucgaggaggcguccagccccgccuccgagcccgagccgccccgggagccgccccgccggcccgccuuccugcccguggggcccgacgacaccaacagcgaguacgaguccggcagcgaguccgagcccgaccucagcgaggacgccgacuccccguggcugcugagcaaccucgucucccgcaugaucagcgagggguccagccccauccggugccccggccagugccugucccccgccccgcgcccgcccggggagcccgugagccccgcgggcggcgccgcccaggacucccaggaccccgaggccgccgcggggcccggcgggguggagcuggucgacauggagacccucugcgcgcccccgccgcccgcccccgccgcgccccgccccggccccgcccagccgggccccugccuguuccugagcaaccccacgcgggacaccaucacgccccucugggccgccccggggcgcgccgcccggcccggccgcgccugcagcgccgccugcuccgaggaggaggacgaggaggacgacgaggaggaggaggacgccgaggacagcgcggggucccccggcgggcggggcaccggccccagcgccccgcgcgacgccucccugguguacgacgccgugaaguacacccuggucguggacgagcacacccagcucgagcuggugagccugcggcgcugcgccgggcucggccacgacuccgaggaggacagcgggggcgaggcguccgaggaggaggccggggccgcccugcugggcggcgggcaggucagcggcgacaccucccccgacagccccgaccucaccuucuccaagaaguuccugaacguguucgugaacagcacgucccggagcuccagcaccgaguccuucgggcuguucagcugccucgucaacggcgaggagcgcgagcagacccaccgggccguguuccgcuucaucccccggcacccggacgagcuggagcuggacguggacgaccccguccucguggaggcggaggaggacgacuucugguuccgcggguucaacaugcggaccggcgagcgcggcguguuccccgccuucuacgcccacgccguccccgggccggcgaaggaccugcugggcagcaagcggucccccugcuggguggagcgcuucgacgugcaguuccuggggagcgucgaggugcccugccaccagggcaacgggauccucugcgccgccaugcagaagaucgccacggcccggaagcugaccguccaccuccggcccccggcguccugcgaccuggagaucagccugcgcggcgugaagcugucccucagcggcgggggccccgaguuccagcgcugcucccacuucuuccagaugaagaacaucagcuucugcgggugccacccccgcaacuccugcuacuucggcuucaucaccaagcacccccugcugagccgguucgccugccacguguucgucucccaggagagcaugcgcccgguggcccaguccgugggccgggccuuccucgaguacuaccaggagcaccuggccuacgcgugccccaccgaggacaucuaccuggaguga

SEQ ID NO: 32693 - RNA, 3993 nt, Artificial Sequence
  derived and/or modified sequence opt1 from MAPK8IP3__Homo_sapiens__NP_001035529
augauggagauccagauggacgagggcgggggcguggucguguaccaggacgacuacugcagcggguccgugaugagcgagcgcgucuccggccuggccgggagcaucuaccgggaguucgagcgccucauccacugcuacgacgaggagguggugaaggagcugaugccccuggucgugaacgugcucgagaaccuggacuccguccugagcgagaaccaggagcacgagguggagcucgagcugcugcgggaggacaacgagcagcuccugacccaguacgagcgcgagaaggcccugcggcgccaggcggaggagaaguucaucgaguucgaggacgcccucgagcaggagaagaaggagcugcagauccagguggagcacuacgaguuccagacccggcagcuggagcucaaggccaagaacuacgccgaccagaucucccgccuggaggagcgggagagcgagaugaagaaggaguacaacgcccugcaccagcgccacacggagaugauccagaccuacgucgagcacaucgagcgguccaagaugcagcaggucggcggcaacagccagaccgaguccagccucccggggcgccggaaggagcgccccaccucccugaacguguucccccuggcggacggcacggugcgggcccagaucgggggcaagcucgugcccgccggggaccacuggcaccugagcgaccugggccagcuccaguccagcuccagcuaccagugcccgcaggacgagauguccgagagcggccagagcuccgccgcggccacccccagcaccaccgggacgaaguccaacacccccaccagcuccgugcccagcgccgccgucaccccgcugaacgagucccugcagccccucggcgacuacggggugggcagcaagaacuccaagcgcgcccgggagaagcgcgacagccggaacauggaggugcaggucacgcaggagaugcgcaacguguccaucggcauggggagcuccgacgaguggagcgacgugcaggacaucaucgacuccacccccgagcuggacaugugccccgagacccggcuggaccgcaccggcagcuccccgacgcaggggaucgucaacaaggcguucggcaucaacaccgacagccucuaccacgagcuguccaccgccgggagcgaggugaucggcgacgucgacgagggcgccgaccugcucggggaguucagcggcauggggaaggaggugggcaaccugcugcucgagaacucccagcugcuggagaccaagaacgcccucaacguggucaagaacgaccugaucgccaagguggaccagcugagcggggagcaggaggugcuccgcggcgagcuggaggcggccaagcaggccaaggucaagcuggagaaccggaucaaggagcucgaggaggagcugaagcgcgugaaguccgaggccaucaucgcccggcgcgagcccaaggaggaggcggaggacgugagcuccuaccugugcacggagagcgacaagauccccauggcccagcggcgccgguucacccgcgucgagauggcccgggugcucauggagcgcaaccaguacaaggagcggcugauggagcugcaggaggccgugcgcuggaccgagaugauccgggccucccgcgagcaccccagcguccaggagaagaagaaguccaccaucuggcaguucuucagccggcuguucuccagcuccagcuccccgccgcccgcgaagcgccccuaccccagcgugaacauccacuacaagucccccacgaccgccggcuucagccagcggcgcaaccacgccaugugccccaucagcgccgggucccggccccucgaguucuucccggacgacgacugcaccagcuccgcgcgccgcgagcagaagcgggagcaguaccgccaggugcgggagcacguccgcaacgacgacggccggcugcaggccugcggguggagccugcccgccaaguacaagcagcucucccccaacggcgggcaggaggacacccgcaugaagaacgugcccgugccggucuacugccggccccugguggagaaggaccccacgaugaagcuguggugcgccgccggcgugaaccucagcggcuggcgcccgaacgaggacgacgcggggaacggcgucaagcccgcccccgggcgggacccccugaccugcgaccgcgagggcgacggcgagccgaaguccgcccacaccagccccgagaagaagaaggccaaggagcugcccgagauggacgccaccuccagccggguguggauccucacguccacccugaccaccagcaagguggucaucaucgacgcgaaccagcccgggacggugguggaccaguucaccgucugcaacgcccacgugcugugcaucuccagcaucccggccgccuccgacagcgacuacccgcccggcgagauguuccucgacuccgacgugaaccccgaggaccccggggccgacggcguccuggcggggaucacccuggugggcugcgccacccgcugcaacgugccccggagcaacugcuccagccgcggcgacacccccguccucgacaaggggcagggcgagguggccacgaucgccaacgggaaggugaaccccagccaguccaccgaggaggcgaccgaggccaccgaggucccggaccccggccccagcgagcccgagacggccacccugcggccggggccccugaccgagcacguguucaccgaccccgcccccacgccguccagcggcccccagcccggcuccgagaacgggccggagcccgacagcuccagcacccgccccgagcccgagccguccggcgaccccaccggggccggcagcuccgcggcccccaccauguggcucggggcccagaacggcuggcuguacgugcacagcgccgucgccaacuggaagaagugccugcacuccaucaagcucaaggacagcgugcugucccuggugcacgucaagggccgggugcucguggcgcuggccgacgggacgcuggccaucuuccaccgcggcgaggacgggcagugggaccucagcaacuaccaccugauggaccugggccacccccaccacuccauccggugcauggccgucguguacgaccgcguguggugcggguacaagaacaagguccacgugauccagccgaagaccaugcagaucgagaaguccuucgacgcccacccccggcgcgagagccaggugcgccagcucgcguggaucggcgacggcgucugggugagcauccggcuggacagcacccugcgccucuaccacgcccacacccaccagcaccuccaggacgucgacaucgagcccuacguguccaagaugcuggggacgggcaagcugggguucagcuucgugcggaucaccgcccugcuggucgccggcucccgccucugggugggcaccgggaacggcguggucaucagcaucccccugaccgagacgguggugcugcaccgggggcagcuccugggccugcgcgcgaacaagaccuccccgaccagcggggagggcgcccggcccggcgggaucauccacgucuacggcgacgacuccagcgaccgcgccgccuccagcuucauccccuacugcuccauggcccaggcgcagcucugcuuccacgggcaccgggacgccgugaaguucuucgugagcguccccggcaacgugcuggccacccugaacggguccgugcucgacagcccggccgagggccccggccccgccgcgcccgccuccgaggucgaggggcagaagcugcgcaacgugcuggugcucagcggcggggagggcuacaucgacuuccggaucggggacggcgaggacgacgagacggaggagggcgccggggacaugucccaggucaagccggugcugagcaaggccgagcgcucccacaucaucguguggcaggucagcuacacccccgaguga

SEQ ID NO: 32694 - RNA, 729 nt, Artificial Sequence
  derived and/or modified sequence opt1 from MAPK9__Homo_sapiens__NP_001128516
augagcgacuccaagugcgacagccaguucuacuccgugcaggucgccgacagcaccuucaccgugcugaagcgcuaccagcagcucaagcccaucggcuccggggcccagggcaucgugugcgcggccuucgacacgguccuggggaucaacguggccgugaagaagcugagccggccguuccagaaccagacccacgccaagcgcgccuaccgggagcucguccugcugaagugcgugaaccacaagaacaucaucucccuccugaacguguucacgccccagaagacccuggaggaguuccaggacgucuaccucgugauggagcugauggacgcgaaccugugccaggugauccacauggagcucgaccacgagcgcaugagcuaccugcuguaccagaugcucugcggcaucaagcaccuccacuccgccgggaucauccaccgggaccugaagcccagcaacaucgucgugaaguccgacugcacccugaagauccuggacuucggccuggcccgcaccgccugcaccaacuucaugaugacccccuacguggucacgcgguacuaccgcgcgccggaggugauccucggcaugggguacaaggagaacguggacaucuggagcgucggcugcaucaugggggagcuggugaagggcugcgugaucuuccaggggaccgaccggauccugccccgcgaccucggccccgccaugcuguccuga

SEQ ID NO: 32695 - RNA, 1569 nt, Artificial Sequence
  derived and/or modified sequence opt1 from MAPKAP1__Homo_sapiens__NP_001006618
auggccuuccuggacaaccccaccaucauccucgcccacauccgccagagccacgugaccuccgacgacacgggcaugugcgagaugguccugaucgaccacgacguggaccuggagaagauccacccgcccagcaugcccggggacuccggcagcgagauccagggguccaacggcgagacccagggguacguguacgcgcagagcgucgacaucaccuccagcugggacuucggcauccggcgccgguccaacaccgcccagcgccucgagcggcugcgcaaggagcggcagaaccagaucaagugcaagaacauccaguggaaggagcgcaacagcaagcaguccgcccaggagcucaagagccuguucgagaagaagucccugaaggagaagcccccgaucagcggcaagcaguccauccugagcgugcggcucgagcagugcccccugcagcugaacaaccccuucaacgaguacuccaaguucgacgggaagggccacguggggacgaccgccaccaagaagaucgacgucuaccucccccugcacagcucccaggaccgccugcucccgaugaccguggugacgauggccagcgcgcggguccaggaccugaucggccugaucugcuggcaguacaccagcgaggggcgcgagcccaagcucaacgacaacguguccgccuacugccugcacaucgccgaggacgacggcgagguggacaccgacuucccgccccuggacagcaacgagcccauccacaaguucggcuucuccacccucgcccuggucgagaaguacagcucccccgggcugacgagcaaggagucccucuucgugcggaucaacgcggcccacggcuucagccugauccagguggacaacaccaaggucaccaugaaggagauccugcucaaggccgugaagcgccggaaggggucccagaaggugagcggcccccaguaccgccuggagaagcaguccgagcccaacgucgccguggaccuggacagcacccucgagucccagagcgccugggaguucugccuggugcgggagaacuccagccgcgcggacggcgucuucgaggaggacucccagaucgacaucgccacggugcaggacaugcugagcucccaccacuacaagagcuucaaggugagcaugauccaccggcuccgcuucaccaccgacguccagcuggggaucuccggcgacaagguggagaucgacccggucaccaaccagaaggccagcacgaaguucuggaucaagcagaagcccaucuccaucgacagcgaccugcucugcgccugcgaccuggccgaggagaagucccccagccacgcgaucuucaagcugaccuaccucuccaaccacgacuacaagcaccuguacuucgagagcgacgccgccaccgugaacgagaucgugcugaaggucaacuacauccucgagucccgggccagcaccgcccgcgcggacuacuucgcccagaagcagcgcaagcugaaccggcgcacguccuucagcuuccagaaggagaagaaguccgggcagcaguga

SEQ ID NO: 32696 - RNA, 1113 nt, Artificial Sequence
  derived and/or modified sequence opt1 from MAPKAPK2__Homo_sapiens__NP_004750
augcugagcaacucccagggccagagcccgcccgugcccuuccccgcccccgccccgccgccccagccgcccacccccgcgcucccccacccgcccgcccagcccccgcccccgccgccccagcaguucccccaguuccacgucaaguccgggcugcagaucaagaagaacgccaucaucgacgacuacaaggugaccagccaggugcugggccucgggaucaacggcaagguccugcagaucuucaacaagcgcacgcaggagaaguucgcccugaagaugcuccaggacugccccaaggcccggcgcgagguggagcugcacuggcgggcgucccagugcccccacaucgugcgcaucgucgacguguacgagaaccuguacgccgggcggaagugccuccugaucgugauggagugccuggacggcggcgagcuguucagccgcauccaggaccgcggggaccaggccuucaccgagcgggaggccuccgagaucaugaaguccaucggcgaggcgauccaguaccuccacagcaucaacaucgcccaccgggacgucaagcccgagaaccugcucuacaccagcaagcgccccaacgccauccugaagcugaccgacuucggguucgccaaggagacgaccucccacaacagccucaccacccccugcuacacgcccuacuacguggcccccgaggugcugggccccgagaaguacgacaaguccugcgacauguggagccugggggucaucauguacauccuccugugcggcuacccgcccuucuacuccaaccacggccuggcgaucagccccgggaugaagacccggauccgcaugggccaguacgaguuccccaaccccgagugguccgaggugagcgaggaggugaagaugcucauccggaaccugcugaagaccgagcccacccagcgcaugacgaucaccgaguucaugaaccaccccuggaucaugcaguccaccaaggucccgcagacgccccuccacaccagccgggugcugaaggaggacaaggagcgcugggaggacgugaaggggugccugcacgacaagaacagcgaccaggccaccuggcucacccggcuguga

SEQ ID NO: 32697 - RNA, 1149 nt, Artificial Sequence
  derived and/or modified sequence opt1 from MAPKAPK3__Homo_sapiens__NP_001230855
auggacggcgagaccgccgaggagcagggcgggcccgugccgccgcccgucgcccccgggggccccgggcugggcggcgcgcccgggggccgccgggagcccaagaaguacgccgugaccgacgacuaccagcucagcaagcagguccuggggcugggcgugaacgggaaggugcucgagugcuuccaccgccggacgggccagaagugcgcccugaagcugcucuacgacucccccaaggcccgccaggagguggaccaccacuggcaggccagcggcgggccgcacaucgucugcauccuggacguguacgagaacaugcaccacggcaagcggugccugcucaucaucauggagugcauggagggcggggagcuguucucccgcauccaggagcggggcgaccaggcguucaccgagcgcgaggccgccgagaucaugcgggacaucgggaccgccauccaguuccugcacagccacaacaucgcgcaccgcgacgugaagcccgagaaccuccuguacaccuccaaggagaaggacgccguccugaagcucacggacuucggcuucgccaaggagaccacccagaacgcccugcagacccccugcuacacgcccuacuacguggccccggaggugcuggggcccgagaaguacgacaagagcugcgacauguggucccucggcgucaucauguacauccugcugugcggguucccgcccuucuacagcaacaccggccaggcgaucucccccggcaugaagcggcgcauccggcucgggcaguacggcuuccccaaccccgaguggagcgagguguccgaggacgccaagcagcugauccgccugcuccugaagaccgaccccaccgagcggcugacgaucacccaguucaugaaccacccguggaucaaccagagcaugguggucccccagacgccccuccacaccgcccgcgugcugcaggaggacaaggaccacugggacgaggugaaggaggagaugaccuccgcccuggccaccaugcgggucgacuacgaccaggugaagaucaaggaccucaagaccagcaacaaccgccugcugaacaagcggcgcaagaagcaggcgggguccagcuccgccagccagggcugcaacaaccaguga

SEQ ID NO: 32698 - RNA, 4545 nt, Artificial Sequence
  derived and/or modified sequence opt1 from MAPKBP1__Homo_sapiens__NP_001122080
auggccguggagggcagcaccaucaccucccgcaucaagaaccugcuccggagccccuccaucaagcugcgccggagcaaggccgggaaccgccgggaggaccuguccagcaaggucacgcucgagaaggugcugggcaucaccguguccgggggccgcgggcuggcgugcgacccgcggagcggccucgucgccuaccccgccggcugcguggugguccuguucaacccccgcaagcacaagcagcaccacauccugaacuccagccggaagaccaucaccgcccucgccuucucccccgacgggaaguaccuggugacgggcgagagcgggcacaugccggcggugcgcgucugggacguggccgagcacucccagguggccgagcugcaggagcacaaguacggcgucgccugcguggcguucagccccuccgccaaguacaucgugagcgucggguaccagcacgacaugaucgugaacgugugggccuggaagaagaacaucgucguggccuccaacaaggugagcucccgggucaccgccgugagcuucagcgaggacugcuccuacuucgugaccgcgggcaaccgccacaucaaguucugguaccucgacgacagcaagaccuccaaggucaacgccacggugccccugcugggccggagcgggcuccugggcgagcugcgcaacaaccucuucaccgacgucgccugcgggcggggcaagaaggccgacuccaccuucugcaucaccagcuccggccugcugugcgaguucagcgaccgccggcuccuggacaaguggguggagcugcgcaacaucgacuccuucacgaccaccguggcccacugcaucagcgucucccaggacuacaucuucugcgggugcgcggacggcaccgugcgccucuucaaccccagcaaccugcacuuccuguccacgcucccgcgcccccacgcccuggggaccgacaucgccagcgugaccgaggccucccggcuguucagcggcgucgccaacgcgcgcuaccccgacaccaucgcccucacguucgaccccaccaaccaguggcuguccugcguguacaacgaccacagcaucuacgugugggacguccgcgacccgaagaagguggggaagguguacuccgcccuguaccacagcagcugcgucugguccguggagguguaccccgaggucaaggacagcaaccaggccugccucccgcccuccagcuucaucacgugcuccagcgacaacaccauccggcuguggaacacggaguccagcggcgugcacggcuccacccugcaccgcaacauccucagcuccgaccugaucaagaucaucuacguggacgggaacacccaggcccugcucgacaccgagcugcccggcggggacaaggcggacgccagccugcucgacccccgggucggcauccgcuccgugugcgugagccccaacgggcagcaccuggccuccggcgaccggaugggcacgcugcgcguccacgagcuccagagccuguccgagaugcugaagguggaggcccacgacagcgagauccucugccuggaguacagcaagcccgacaccgggcugaagcugcucgcguccgccagccgggaccggcugauccacgugcuggacgccggccgggaguacucccuccagcagacccuggacgagcacagcuccagcaucaccgccgucaaguucgccgcguccgacggccaggugcgcaugaucagcugcggggccgacaaguccaucuacuuccggaccgcccagaaguccggggacggcgugcaguucacccgcacccaccacgucgugcggaagaccacgcuguacgacauggacguggagccgagcuggaaguacaccgccaucggcugccaggaccgcaacauccggaucuucaacaucagcuccgggaagcagaagaagcuguucaagggcagccagggggaggacggcacccucaucaagguccagaccgaccccuccggcaucuacaucgccaccagcugcuccgacaagaaccugagcaucuucgacuucuccagcggggagugcguggcgacgauguucggccacagcgagaucgugaccgggaugaaguucuccaacgacugcaagcaccucaucagcgucuccggcgacagcugcaucuucguguggcgccuguccagcgagaugaccaucuccaugcggcagcgccuggccgagcuccggcagcgccagcgcgggggcaagcagcagggccccagcagcccccagcgggccuccgggccgaaccgccaccaggcccccuccaugcugagccccggccccgcccuguccagcgacuccgacaaggagggggaggacgagggcaccgaggaggagcucccggcgcugcccgugcuggccaagagcacgaagaaggcccucgccuccguccccagcccggcgcugccccggucccugagccacugggagaugagccgcgcccaggaguccgugggguuccucgaccccgcccccgccgccaacccgggcccccggcgccggggccgcugggugcagcccggggucgagcugagcgugcgguccaugcuggaccuccgccagcuggagacccuggcgcccagccuccaggacccgucccaggacagccuggccaucauccccuccggcccccggaagcacgggcaggaggcccuggagaccagccucaccucccagaacgagaagcccccgcgcccccaggccagccagcccugcuccuacccccacaucauccggcugcugagccaggaggagggcguguucgcccaggaccucgagccggcgcccaucgaggacgggaucgucuaccccgagcccuccgacaacccgacgauggacaccagcgaguuccaggugcaggcccccgcccgcggcacccugggccggguguaccccgggucccgcagcuccgagaagcacagccccgacuccgccugcagcgucgacuacagcuccagcugccuguccagcccggagcaccccaccgaggacuccgagagcacggagccccucuccguggacggcaucagcuccgaccuggaggagccggccgagggggacgaggaggaggaggaggaggagggcgggaugggccccuacggccugcaggaggggagcccccagacccccgaccaggagcaguuccucaagcagcacuucgagacccuggcguccggcgccgccccgggggcccccgugcagguccccgagcggagcgagucccgcagcaucuccagccgguuccugcuccaggugcagacccgcccccugcgggagccgucccccagcuccagcagccuggcgcucaugucccgccccgcccaggugccccaggccagcggcgagcagccgcgcggcaacggggccaacccgcccggcgccccgcccgaggucgagcccuccagcgggaaccccagcccccagcaggcggccuccgugcugcugccccggugccgccucaaccccgacuccagcugggcccccaagcgggucgccacggccucccccuucagcggccugcagaaggcgcaguccgugcacagccuggugccgcaggagcgccacgaggccucccuccaggcccccagccccggggcccugcugucccgggagaucgaggcccaggacggccucggcagccugcccccggcggacgggcgccccucccggccccacagcuaccagaacccgaccaccuccagcauggccaagaucagccgcuccaucagcgucggcgagaaccuggggcucguggccgagccccaggcccacgcccccauccgggugagcccccuguccaagcuggcgcucccgucccgcgcccaccugguccuggacauccccaagccccuccccgaccggccgacccuggccgccuucagccccgugacgaagggccgcgcgcccggggaggccgagaagcccggcuucccggugggccuggggaaggcccacuccaccaccgagcggugggccugccucggcgaggggaccacgcccaagccccgcaccgagugccaggcccaccccggcccgagcucccccugcgcgcagcagcugcccgucagcucccuguuccaggggcccgagaaccuccagccgcccccgcccgagaagacccccaaccccauggagugcaccaagcccggcgccgcccugagccaggacuccgagcccgccgugagccuggagcagugcgagcagcucguggccgagcugcggggcuccguccgccaggcggugcggcuguaccacagcguggccgggugcaagaugccguccgccgagcagagccgcaucgcccagcuccugcgggacacguucagcuccguccgccaggagcuggaggccguggcgggcgccgugcucagcucccccgggagcucccccggcgccgucggcgccgagcagacccaggcgcugcuggagcaguacagcgagcuccugcugcgcgccguggagcggcgcauggagcggaagcucuga

SEQ ID NO: 32699 - RNA, 807 nt, Artificial Sequence
  derived and/or modified sequence opt1 from MAPRE1__Homo_sapiens__NP_036457
auggccgugaacgucuacagcaccuccgugaccagcgacaaccugucccgccacgacaugcucgccuggaucaacgagagccugcagcugaaccucacgaagaucgagcagcugugcuccggcgcggccuacugccaguucauggacaugcuguuccccgggagcaucgcccucaagaaggugaaguuccaggccaagcuggagcacgaguacauccagaacuucaagauccugcaggccggcuucaagcggaugggggucgacaagaucaucccgguggacaagcucgugaagggcaaguuccaggacaacuucgaguucguccagugguucaagaaguucuucgacgcgaacuacgacgggaaggacuacgaccccguggccgcccgccagggccaggagaccgccguggcgcccucccuggucgcccccgcccugaacaagccgaagaagccccucaccagcuccagcgccgcgccccagcggcccaucuccacccagcgcacggccgccgccccgaaggccggccccgggguggugcggaagaaccccggcgucgggaacggcgacgacgaggccgcggagcugaugcagcaggucaacgugcugaagcucaccguggaggaccuggagaaggagcgcgacuucuacuucgggaagcugcggaacaucgagcucaucugccaggagaacgagggcgagaacgaccccgugcugcagcgcaucguggacauccuguacgccaccgacgagggcuucgucaucccggacgagggcgggccccaggaggagcaggaggaguacuga

SEQ ID NO: 32700 - RNA, 855 nt, Artificial Sequence
  derived and/or modified sequence opt1 from MAPRE2__Homo_sapiens__NP_001137298
auggccgugaacgucuacagcaccuccaucacccaggagacgaugagccgccacgacaucaucgccugggugaacgacaucgugucccugaacuacaccaaggucgagcagcucugcagcggcgcggccuacugccaguucauggacaugcuguuccccgggugcaucucccugaagaaggugaaguuccaggccaagcucgagcacgaguacauccacaacuucaagcugcugcaggccagcuucaagcggaugaacguggacaaggucauccccguggagaagcucgugaagggccgcuuccaggacaaccuggacuucauccagugguucaagaaguucuacgacgccaacuacgacgggaaggaguacgaccccgucgaggcgcggcagggccaggacgccaucccgccgcccgaccccggggagcagaucuucaaccugcccaagaagucccaccacgccaacagccccaccgccggcgcggccaaguccagccccgccgccaagcccggcuccacccccagccgccccuccagcgccaagcgggcguccagcuccgggagcgccuccaagagcgacaaggaccucgagacccaggugauccagcugaacgagcagguccacagccugaagcucgcccuggagggcguggagaaggagcgcgacuucuacuucgggaagcugcgggagaucgagcuccugugccaggagcacggccaggagaacgacgaccuggugcagcgccucauggacauccuguacgccuccgaggagcacgaggggcacacggaggagccggaggccgaggagcaggcgcacgagcagcagccgccccagcaggaggaguacuga

SEQ ID NO: 32701 - RNA, 846 nt, Artificial Sequence
  derived and/or modified sequence opt1 from MAPRE3__Homo_sapiens__NP_001289979
auggccgugaacgucuacagcaccuccgugaccagcgagaaccugucccgccacgacaugcucgccugggugaacgacagccugcaccugaacuacacgaagaucgagcagcucugcuccggcgcggccuacugccaguucauggacaugcuguuccccgggugcguccaccuccggaaggugaaguuccaggccaagcuggagcacgaguacauccacaacuucaaggugcugcaggccgccuucaagaagaugggcgucgacaagaucauccccguggagaagcuggugaaggggaaguuccaggacaacuucgaguucauccagugguucaagaaguucuucgacgcgaacuacgacggcaaggacuacaacccccuccuggcccgccaggggcaggacgucgcgcccccgcccaaccccggcgaccagaucuucaacaagagcaagaagcugaucggcaccgccgugccccagcggaccucccccaccgggcccaagaacaugcagacgagcggccgccucuccaacguggccccgcccugcauccugcggaagaacccgcccagcgcccgcaacgggggccacgagaccgacgcccagauccuggagcucaaccagcagcuggucgaccugaagcucaccguggacgggcuggagaaggagcgggacuucuacuucuccaagcugcgcgacaucgagcucaucugccaggagcacgagagcgagaacucccccgugaucagcggcaucaucggcauccuguacgccaccgaggagggguucgccccgcccgaggacgacgagaucgaggagcaccagcaggaggaccaggacgaguacuga

SEQ ID NO: 32702 - RNA, 2331 nt, Artificial Sequence
  derived and/or modified sequence opt1 from MAPT__Homo_sapiens__NP_001116538
auggccgagccccgccaggaguucgaggugauggaggaccacgccggcaccuacgggcugggcgaccggaaggaccaggggggcuacaccaugcaccaggaccaggagggggacacggacgcgggccucaaggagagcccgcugcagacccccaccgaggacggcuccgaggagcccgggagcgagaccuccgacgccaagagcacgcccaccgccgaggacgucaccgccccgcugguggacgagggcgcccccgggaagcaggcggccgcccagccccacaccgagauccccgagggcacgaccgccgaggaggcggggaucggcgacaccccgucccucgaggacgaggccgccggccacgugacccaggagcccgagagcgggaaggucgugcaggagggcuuccugcgcgagcccgggcccccgggccugucccaccagcucaugagcggcaugcccggggccccccugcugcccgagggcccgcgggaggccacgcgccagcccuccgggaccggccccgaggacaccgaggggggccggcacgcgcccgagcuccugaagcaccagcugcucggcgaccugcaccaggaggggccgccccugaagggcgccgggggcaaggagcgccccgggagcaaggaggagguggacgaggaccgggacgucgacgaguccagcccccaggacuccccgcccagcaaggccucccccgcccaggacggccgccccccgcagaccgccgcgcgggaggccacgagcauccccggcuuccccgccgagggggccaucccgcuccccguggacuuccuguccaaggugagcaccgagauccccgccuccgagcccgacggcccgagcgucgggcgcgcgaagggccaggacgccccccuggaguucaccuuccacguggagaucacccccaacgugcagaaggagcaggcccacagcgaggagcaccucgggcgggccgccuuccccggcgcgccgggcgaggggcccgaggcccgcggccccucccugggggaggacacgaaggaggccgaccugcccgagccgagcgagaagcagcccgccgcggccccccggggcaagcccgucucccgcgugccgcagcucaaggcccggauggugagcaaguccaaggacggcaccgggagcgacgacaagaaggccaagaccuccacccgcagcuccgccaagacgcugaagaaccggcccugccugagccccaagcaccccaccccgggcuccagcgacccccucauccagcccuccagccccgcggucugcccggagccccccuccagcccgaaguacguguccagcgugaccucccgcaccgggagcagcggcgccaaggagaugaagcugaagggggccgacggcaagacgaagaucgccaccccccggggcgccgcgccccccgggcagaagggccaggccaacgccacccgcaucccggccaagaccccccccgcccccaagacgccgcccuccagcgcgaccaagcagguccagcggcgcccccccccggccgggccccgcuccgagcggggcgagccccccaagagcggggaccgcuccggcuacagcuccccgggcagccccgggacccccggcucccggagccgcacccccucccugccgacgccccccacccgggagcccaagaagguggccgugguccgcaccccgcccaagagccccuccagcgccaagucccggcuccagaccgcgcccgugccgaugcccgaccugaagaacgugaagagcaagaucggguccaccgagaaccugaagcaccagcccggcgggggcaagguccagaucaucaacaagaagcucgaccugagcaacgugcagagcaagugcggcuccaaggacaacaucaagcacgucccggggggcgggagcgugcagaucguguacaagcccgucgaccuguccaaggugacgagcaagugcggcucccucgggaacauccaccacaagcccggcggcgggcagguggaggucaagagcgagaagcuggacuucaaggaccgcgugcaguccaagaucggcagccuggacaacaucacccacgugcccgggggcggcaacaagaagaucgagacccacaagcucaccuuccgggagaacgccaaggccaagacggaccacggggccgagaucgucuacaaguccccgguggugagcggcgacaccuccccccgccaccugagcaacgucuccagcaccggguccaucgacaugguggacagcccccagcuggccacccucgcggacgagguguccgccagccuggccaagcagggccuguga

SEQ ID NO: 32703 - RNA, 1014 nt, Artificial Sequence
  derived and/or modified sequence opt1 from MARC1__Homo_sapiens__NP_073583
augggcgccgccgggagcuccgcgcuggcccgcuucgugcuccuggcccagagccggcccggcuggcugggggucgccgcccucggccugaccgcgguggcccugggggccguggccuggcgccgggcguggccgacccgccggcgccggcuccugcagcaggucggcacgguggcccagcuguggaucuaccccgugaaguccugcaagggcguccccgugagcgaggccgagugcaccgccauggggcuccgcuccggcaaccugcgggaccgcuucuggcuggugaucaaccaggaggggaacauggucaccgcccggcaggagccccgccucgugcugaucagccugaccugcgacggcgacacgcucacccuguccgcggccuacaccaaggaccugcuccugccgaucaagacccccacgaccaacgccgugcacaagugccggguccacgggcuggagaucgagggccgcgacugcggcgaggccaccgcccaguggaucaccagcuuccucaagucccagcccuaccggcuggugcacuucgagccccacaugcgcccgcggcgcccccaccagaucgcggaccuguuccggcccaaggaccagaucgccuacagcgacacgucccccuuccucauccugagcgaggccucccuggccgaccucaacagccgccuggagaagaaggugaaggccaccaacuuccggccgaacaucgucaucuccgggugcgacguguacgcggaggacagcugggacgagcugcucaucggcgacguggagcugaagcgcgucauggccugcucccgcugcauccugaccaccguggaccccgacacgggggugaugagccggaaggagccccucgagacccugaaguccuaccgccagugcgaccccagcgagcggaagcuguacggcaagagcccccucuucggccaguacuucguccuggagaacccggggaccaucaaggugggcgaccccguguaccugcucgggcaguga

SEQ ID NO: 32704 - RNA, 738 nt, Artificial Sequence
  derived and/or modified sequence opt1 from MARC2__Homo_sapiens__XP_011507986
auguucuggcuggugaucaaggaggacggccacauggucaccgcccgccaggagccccggcucgugcugaucagcaucaucuacgagaacaacugccugaucuuccgcgccccggacauggaccagcucgugcugcccuccaagcagcccagcuccaacaagcugcacaacugccggaucuucgggcucgacaucaagggccgcgacugcgggaacgaggcggccaagugguucaccaacuuccugaagacggaggccuaccggcugguccaguucgagaccaacaugaagggccgcaccagccggaagcuccugcccacccuggaccagaacuuccagguggccuacccggacuacugcccccuccugaucaugacggacgccucccugguggaccucaacacccgcauggagaagaagaugaagauggagaacuuccggcccaacaucgucgugaccgggugcgacgcguucgaggaggacaccugggacgagcugcugaucggcagcguggaggucaagaaggugauggccugcccccgcugcauccucacgaccguggacccggacaccggcgucaucgaccggaagcagccccuggacacccugaaguccuaccgccucugcgaccccagcgagcgggagcuguacaagcugagcccccucuucgggaucuacuacuccguggagaagaucggcucccugcgcgugggggacccggucuaccggaugguguga

SEQ ID NO: 32705 - RNA, 870 nt, Artificial Sequence
  derived and/or modified sequence opt1 from MARCH1__Homo_sapiens__NP_001159845
augcugggcuggugcgaggccaucgcccgcaacccccaccggauccccaacaacacccgcacccccgagaucagcggggaccucgcggacgccucccagacgagcacccugaacgagaagucccccggccggagcgccucccgcagcuccaacaucagcaaggccuccagccccaccaccgggacggccccgcggucccagagccgccuguccgugugccccagcacccaggacaucugccggaucugccacugcgagggcgacgaggagagcccccucaucacccccugccgcugcaccgggacgcugcgguucguccaccaguccugccugcaccaguggaucaaguccagcgacacccgcugcugcgagcucugcaaguacgacuucaucauggagaccaagcugaagccgcugcggaagugggagaagcuccagaugaccacguccgagcgccggaagaucuucugcagcgugaccuuccacgugaucgcgaucacgugcgucguguggagccuguacgugcugaucgaccgcaccgccgaggagaucaagcagggcaacgacaacggcguccucgaguggcccuucuggaccaagcuggugguggucgccaucggguucaccggcgggcugguguucauguacgugcagugcaaggucuacgugcagcucuggcggcgccugaaggccuacaaccgggugaucuucguccagaacugccccgacaccgcgaagaagcuggagaagaacuucuccugcaacgugaacaccgacaucaaggacgccguggucgugcccgugccgcagacgggcgccaacagccuccccuccgccgagggcgggccgcccgaggucgugagcguguga

SEQ ID NO: 32706 - RNA, 741 nt, Artificial Sequence
  derived and/or modified sequence opt1 from MARCH2__Homo_sapiens__NP_001005415
augaccaccggcgacugcugccaccuccccgggagccugugcgacugcuccggcagcccggccuucuccaagguggucgaggccacggggcugggcccgccccaguacguggcccaggugaccagccgcgacgggcggcugcucuccaccgucauccgcgcgcuggacacccccagcgacggccccuucugccggaucugccacgagggcgccaacggggagugccugcucucccccugcggcugcacggggacccugggcgccgugcacaagagcugccuggagaaguggcucuccagcuccaacaccagcuacugcgagcugugccacaccgaguucgccguggagaagcgcccccggccccugacggaguggcucaaggacccggggccccgcaccgagaagcggacccugugcugcgacauggucugcuuccuguucaucacgccccucgcggccaucuccggcuggcugugccugcgcggcgcccaggaccaccuccggcugcacagccagcuggaggccguggggcucaucgcgcugaccaucgcccuguucaccaucuacgugcucuggacccuggucuccuuccgcuaccacugccagcuguacagcgaguggcggaagaccaaccagaaggugcgccucaagauccgggaggccgacucccccgagggcccgcagcacagcccccuggccgccgggcugcucaagaagguggcggaggagacgcccgucuga

SEQ ID NO: 32707 - RNA, 837 nt, Artificial Sequence
  derived and/or modified sequence opt1 from MARCH5__Homo_sapiens__NP_060294
augcccgaccaggcccugcagcagaugcucgaccgcagcugcugggugugcuucgccaccgacgaggacgaccggaccgcggaguggguccgcccgugccggugccgcggcuccacgaagugggugcaccaggccugccugcagcgguggguggacgagaagcagcgcgggaacagcaccgcccgggucgccugcccccagugcaacgccgaguaccugaucguguuccccaagcucggccccguggucuacgugcuggaccuggcggaccgccucaucuccaaggccugcccguucgccgccgcggggaucauggugggcagcaucuacuggaccgccgucaccuacggggccgugacggugaugcaggucgugggccacaaggagggccuggacgugauggagcgggccgacccccuguuccuccugaucgggcugcccaccauccccgucaugcucauccugggcaagaugauccgcugggaggacuacgugcugcggcucuggcgcaaguacuccaacaagcugcagauccugaacagcaucuucccggggaucggcugccccgugccccggauccccgccgaggcgaacccgcucgccgaccacgucuccgccacccgcauccugugcggggcccugguguuccccaccaucgccacgaucgugggcaagcucauguucagcuccgucaacagcaaccugcagcggaccauccugggcgggaucgcguucguggccaucaagggcgccuucaagguguacuucaagcagcagcaguaccuccgccaggcccaccggaagauccugaacuaccccgagcaggaggaggccuga

SEQ ID NO: 32708 - RNA, 2733 nt, Artificial Sequence
  derived and/or modified sequence opt1 from MARCH6__Homo_sapiens__NP_005876
auggacaccgccgaggaggacaucugccgcgugugccggagcgagggcacccccgagaagccccuguaccaccccugcgucugcacgggguccaucaaguucauccaccaggagugccucgugcaguggcugaagcacagccgcaaggaguacugcgagcugugcaagcaccgguucgccuucacccccaucuacucccccgacaugcccagccgccuccccauccaggacaucuucgcgggccuggugaccuccaucgggaccgccauccgguacugguuccacuacacgcuggucgccuucgccuggcucggcguggugccccugaccgccugccgcaucuacaagugccuguucaccgggagcgucuccagccuccugacccugccccucgacaugcuguccacggagaaccugcucgcggacugccugcagggcugcuucguggugaccugcacccugugcgccuucaucagccucgucuggcugcgggagcagaucgugcacggcggggccccgaucuggcuggagcacgccgcgccgcccuucaacgccgccggccaccaccagaacgaggcccccgccgggggcaacggggcggagaacguggccgccgaccagcccgccaacccgcccgccgagaacgcggucgugggcgagaaccccgacgcccaggacgaccaggccgaggaggaggaggaggacaacgaggaggaggacgacgccggcguggaggacgccgcggacgccaacaacggggcccaggacgacaugaacuggaacgcccucgagugggaccgcgccgcggaggagcugaccugggagcggaugcugggccucgacgggucccuggucuuccuggagcacguguucuggguggucagccucaacacgcuguucauccugguguucgccuucugccccuaccacaucggccacuucucccucgugggccugggguucgaggagcacguccaggccagccacuucgagggccugaucaccaccaucgugggguacauccuccuggccaucacccugaucaucugccacggccucgcgacgcuggugaaguuccaccgcucccggcgccugcucggggucugcuacaucguggucaaggugagccugcugguggucguggagaucggcguguucccccucaucugcggcugguggcuggacaucugcucccuggagauguucgacgccacccucaaggaccgggagcugagcuuccaguccgcccccgggaccaccauguuccugcacuggcucgucggcaugguguacguguucuacuucgccagcuucauccugcugcugcgcgagguccuccggcccggggugcugugguuccugcgcaaccucaacgacccggacuucaaccccgugcaggagaugauccaccuccccaucuaccggcaccuccgccgguucauccugagcgucaucguguucggcuccaucgugcugcugaugcuguggcugcccauccgcaucaucaagagcguccugccgaacuuccuccccuacaacgugaugcuguacuccgacgcccccgugagcgagcugucccucgagcugcugcuccugcaggucgugcugcccgcgcuccuggagcaggggcacacgcggcaguggcugaagggccucgugcgcgccuggaccgucaccgccggcuaccugcuggaccuccacagcuaccugcugggggaccaggaggagaacgagaacuccgccaaccagcaggucaacaacaaccagcacgcccgcaacaacaacgcgaucccgguggugggcgaggggcuccacgccgcccaccaggccauccugcagcagggcgggcccgugggcuuccagcccuaccggcgcccgcugaacuucccccuccggaucuuccugcugaucguguucaugugcaucacccuccugaucgccagccugaucugccucacgcugcccgucuucgcgggccgcuggcugauguccuucuggaccgggaccgccaagauccacgagcucuacaccgccgccugcggccuguacgugugcuggcugacgauccgggcggugaccgucaugguggccuggaugccccaggggcgccgggugaucuuccagaaggucaaggaguggagccucaugaucaugaagacccugaucguggccgugcugcucgccggcgucgugccgcugcugcucggccugcuguucgagcucgugaucgucgcgccccugcgcgugccccuggaccagacgccccucuucuacccguggcaggacugggcccugggggugcugcacgccaagaucaucgccgccaucacccucaugggcccccagugguggcugaagaccgucaucgagcaggucuacgccaacgggauccggaacaucgaccugcacuacaucgugcgcaagcucgcggcccccgugaucuccgugcugcugcucagccugugcgugcccuacgucaucgccuccggcguggugccgcugcucggggucaccgccgagaugcagaaccuggugcaccggcgcaucuaccccuuccugcucauggucguggugcugauggccauccugagcuuccagguccggcaguucaagcgccucuacgagcacaucaagaacgacaaguaccuggugggccagcggcuggugaacuacgagcgcaaguccggcaagcaggggagcuccccgccgccgccccagagcucccaggaguga

SEQ ID NO: 32709 - RNA, 1908 nt, Artificial Sequence
  derived and/or modified sequence opt1 from MARCH7__Homo_sapiens__NP_001269735
auggagagcaagcccucccgcaucccgcggcgcaucagcgugcagcccuccagcucccugagcgcccggaugauguccggcagccgcggguccagccucaacgacaccuaccacucccgggacagcuccuuccgccuggacagcgaguaccaguccaccagcgccuccgcgagcgccucccccuuccagagcgccugguacagcgaguccgagaucacgcagggcgcccggagccgcucccagaaccagcagcgggaccacgacagcaagcgccccaagcuguccugcaccaacugcaccaccagcgccgggcggaacgucggcaacgggcucaacacgcuguccgacgugcaggaccgcgugccgagcuacucccagggcgcgcggcccaaggagaacagcauguccacccugcagcucaacaccagcuccaccaaccaccagcugcccagcgagcaccagacgauccuguccagccgcgacucccggaacagccuccgcuccaacuucagcagccgggaguccgagagcucccgcagcaacacccagcccggcuucuccuacagcuccagccgggacgaggccccgaucaucuccaacagcgagcgcgucguguccagccagcggcccuuccaggaguccagcgacaacgaggggcgccgcaccacccggcgccugcugucccggaucgccagcuccaugagcagcacguucuucucccgccggagcucccaggacagccucaacacccgcucccugaacagcgagaacuccuacgugagcccccggauccugaccgccucccagagccgcuccaacguccccagcgcguccgaggugccggacaaccgggccagcgaggccucccagggcuuccgcuuccuccggcgccggugggggcugagcucccugagccacaaccacuccagcgagagcgacuccgagaacuucaaccaggagagcgagggccgcaacaccgggcccuggcucuccagcucccugcggaaccgcugcacgccccuguucagccggcgccggcgcgagggccgcgacgaguccagccggauccccaccuccgacaccagcucccgcagccacaucuuccggcgcgaguccaacgaggugguccaccucgaggcccagaacgacccgcugggcgccgcggccaaccggccccaggccagcgccgccuccagcuccgcgaccaccgggggcagcacguccgacagcgcccagggcgggcgcaacaccggcaucagcgggauccugcccggcucccucuuccgguucgccgugcccccggcccuggggagcaaccugaccgacaacgugaugaucacggucgacaucauccccuccggcuggaacagcgccgacgggaaguccgacaagaccaagagcgcgcccucccgcgaccccgagcggcuccagaagaucaaggagagccugcugcucgaggacuccgaggaggaggagggcgaccugugccgcaucugccagauggccgccgccagcuccagcaaccugcucaucgagccgugcaagugcaccggcucccugcaguacgugcaccaggacugcaugaagaaguggcugcaggccaagaucaacagcggguccagccucgaggcggugaccacgugcgagcugugcaaggagaagcuggagcucaaccuggaggacuucgacauccacgagcugcaccgggcccacgccaacgagcaggccgaguacgaguucaucuccagcggccucuaccuggucgugcugcuccaccugugcgagcaguccuucagcgacaugauggggaacaccaacgagcccagcacccgcgugcggcugcagcgcaugauccccaagaagaccgagacgaucaccggccaccucauccugcccaacuucaucuga

SEQ ID NO: 32710 - RNA, 876 nt, Artificial Sequence
  derived and/or modified sequence opt1 from MARCH8__Homo_sapiens__NP_001002266
augagcaugccccugcaccagaucuccgccaucccgagccaggacgccaucuccgcgcgcguguaccggagcaagaccaaggagaaggagcgcgaggagcagaacgagaagacccucggccacuucaugucccacagcuccaacaucagcaaggccggguccccgcccagcgccuccgcccccgcccccgucagcuccuucagccggacguccaucacccccagcucccaggacaucugccgcaucugccacugcgagggcgacgacgagagcccccugaucacccccugccacugcaccgggucccugcacuucgugcaccaggcgugccuccagcaguggaucaagagcagcgacacgcggugcugcgagcugugcaaguacgaguucaucauggagaccaagcugaagccgcuccgcaagugggagaagcugcagaugaccuccagcgagcggcgcaagaucaugugcuccgugaccuuccacgucaucgccaucacgugcgugguguggagccuguacguccucaucgaccggaccgccgaggagaucaagcagggccaggccaccgggauccuggaguggcccuucuggaccaagcuggugguggucgcgaucggcuucacgggcgggcuccuguucauguacgugcagugcaagguguacguccagcuguggaagcgccucaaggccuacaaccgggugaucuacgugcagaacugccccgagaccuccaagaagaacaucuucgagaaguccccgcugaccgagcccaacuucgagaacaagcacggcuacgggaucugccacagcgacaccaacagcuccugcugcacggagcccgaggacaccggcgccgagaucauccacgucuga

SEQ ID NO: 32711 - RNA, 999 nt, Artificial Sequence
  derived and/or modified sequence opt1 from MARCKS__Homo_sapiens__NP_002347
augggcgcccaguucagcaagaccgccgcgaagggggaggccgccgccgagcgccccggcgaggccgcgguggccuccagccccuccaaggccaacgggcaggagaacggccacgucaaggugaacggggacgccagccccgcggccgccgaguccggcgccaaggaggagcugcaggccaacggcagcgcgcccgccgccgacaaggaggagcccgccgccgcgggguccggcgccgccagcccguccgccgccgagaagggggagcccgcggccgccgccgcccccgaggcgggcgccagccccguggagaaggaggccccggccgagggggaggcggccgagcccggcucccccaccgccgccgagggcgaggccgcgagcgccgccuccagcacguccagccccaaggccgaggacggggccaccccgucccccagcaacgagacccccaagaagaagaagaagcgguucuccuucaagaaguccuucaagcucagcggcuucagcuucaagaagaacaagaaggaggcgggggagggcggcgaggccgaggcccccgccgccgagggcgggaaggacgaggcggccgggggcgccgccgcggccgccgccgaggccggggcggccagcggcgagcaggccgccgccccgggcgaggaggcggccgccggggaggagggcgccgccgggggcgacccccaggaggcgaagccccaggaggccgccgucgcccccgagaagccgcccgcguccgacgagaccaaggccgccgaggagcccagcaagguggaggagaagaaggccgaggaggccggggcguccgccgccgccugcgaggcccccagcgcggccggcccgggcgccccgcccgagcaggaggccgcccccgcggaggagcccgccgccgccgccgcguccagcgccugcgccgcccccucccaggaggcgcagcccgagugcagcccggaggccccgcccgccgaggccgccgaguga

SEQ ID NO: 32712 - RNA, 1563 nt, Artificial Sequence
  derived and/or modified sequence opt1 from MARCO__Homo_sapiens__NP_006761
augcgcaacaagaagauccugaaggaggacgagcuccugagcgagacccagcaggccgccuuccaccagaucgcgauggagcccuucgagaucaacgugccgaagcccaagcggcgcaacggcgucaacuucucccuggccgugguggucaucuaccucauccugcugaccgccggggccggccuccugguggugcagguccugaaccuccaggcccggcugcgcgugcuggagauguacuuccucaacgacacgcuggcggccgaggacagccccuccuucagccugcuccaguccgcccaccccggggagcaccuggcccagggcgcgagccggcuccaggugcugcaggcccagcugaccuggguccgcgugucccacgagcaccuccugcagcggguggacaacuucacccagaacccggggauguuccgcaucaagggcgagcagggcgcccccgggcugcagggccacaagggggccaugggcaugcccggggcccccggcccgcccggcccgcccgcggagaagggggccaagggcgccauggggcgggacggcgccaccggccccagcgggccccagggcccgcccggggucaagggcgaggccgggcugcagggcccccagggcgcgcccgggaagcagggcgccacggggacccccggcccccagggggagaagggcuccaagggcgacgggggccucaucgggccgaagggcgagaccgggaccaagggcgagaagggcgaccuggggcugcccggcagcaagggggaccgcggcaugaagggcgacgccggggugaugggcccgcccggggcccagggcuccaagggggacuucggccggcccggcccgcccgggcucgccggcuuccccggggcgaagggcgaccaggggcagcccggccugcagggcgugcccgggcccccgggcgccgucgggcaccccggcgccaagggggagcccggcagcgccggcucccccgggcgcgccggccugccggggagccccggcucccccggggcgacgggccucaagggcagcaagggggacaccggccugcaggggcagcagggccggaagggcgaguccggggugcccggcccggccggggugaagggcgagcaggggagccccggccuggccggccccaagggggcccccggccaggcggggcagaagggcgaccagggggucaagggcuccagcggcgagcagggggugaagggcgagaagggggagcgcggcgagaacagcguguccguccggaucguggggagcuccaaccgcggccgggccgagguguacuacagcggcaccugggggaccaucugcgacgacgaguggcagaacuccgacgccaucgucuucugccgcaugcucggcuacagcaaggggcgggcccuguacaaggugggcgccggcacggggcagaucuggcuggacaacguccagugccgcggcaccgaguccacccucuggagcugcaccaagaacuccugggggcaccacgacugcagccacgaggaggacgcgggcguggagugcuccguguga

SEQ ID NO: 32713 - RNA, 2343 nt, Artificial Sequence
  derived and/or modified sequence opt1 from MARK1__Homo_sapiens__NP_001273055
augagcgcccgcacgccccugccgaccgugaacgagcgggacaccgagaaccacaccuccgucgacggcuacaccgagccccacauccagcccaccaagagcuccagccgccagaacaucccccggugccgcaacuccaucacgagcgccaccgacgagcagccgcacaucgggaacuaccggcuccagaagaccaucggcaaggggaacuucgcgaaggugaagcuggcccgccacgugcugaccggccgggaggucgccgugaagaucaucgacaagacgcagcucaaccccaccucccugcagaagcuguuccgcgaggugcggaucaugaagauccucaaccaccccaacaucgucaagcuguucgaggugaucgagaccgagaagacccuguaccucgugauggaguacgccagcgggggcgaggucuucgacuaccugguggcccacggccgcaugaaggagaaggaggcgcgggccaaguuccgccagaucguguccgccguccaguacugccaccagaaguacaucgugcaccgggaccugaaggccgagaaccuccugcuggacggggacaugaacaucaagaucgcggacuucggcuucagcaacgaguucacgguggggaacaagcucgacaccuucugcggcagcccgcccuacgccgcccccgagcuguuccaggggaagaaguacgacggccccgaggucgacguguggagccugggcgugauccucuacacccuggucuccgggagccugcccuucgacggccagaaccucaaggagcugcgcgagcgggugcugcgcgggaaguaccggaucccguucuacauguccaccgacugcgagaaccuccugaagaagcugcucgugcugaaccccaucaagcgcggcagccuggagcagaucaugaaggaccgguggaugaacgucggccacgaggaggaggagcucaagcccuacacggagcccgacccggacuucaacgacaccaagcgcaucgacaucauggugaccaugggguucgcccgggacgagaucaacgacgcccugaucaaccagaaguacgacgaggugauggcgaccuacauccugcucggccgcaagccgcccgaguucgagggcggggagucccugagcuccgggaaccugugccagcgcagccggcccagcuccgaccucaacaacagcacgcugcagucccccgcccaccugaagguccagcgcagcaucuccgccaaccagaagcagcggcgcuucagcgaccacgccggccccuccaucccgcccgccgugagcuacaccaagcggccccaggcgaacuccgucgagagcgagcagaaggaggagugggacaaggacguggcccgcaagcucggcuccaccaccguggggagcaaguccgagaugacggccagcccccuggucggccccgagcggaagaaguccagcaccauccccuccaacaacguguacagcgggggcuccauggcccgccggaacaccuacgugugcgagcgcaccacggaccgguacgucgcccugcagaacgggaaggacagcagccucaccgagauguccgugagcuccaucagcuccgcgggcagcuccguggccagcgccgucccguccgcccgcccccggcaccagaaguccauguccaccagcggccaccccaucaaggugacccugccgacgaucaaggacggguccgaggccuaccgccccggcaccacccagcgggugcccgcggccagccccuccgcccacagcaucuccaccgccacgccggaccgcacccgguucccccgcgggagcagcucccggagcaccuuccacggcgagcagcugcgcgagcgccgguccgucgcguacaacgggccgcccgccagccccucccacgagaccggcgccuucgcccacgcccgccggggcaccagcacggggaucaucuccaagaucaccagcaaguucgugcgccgguccaccagcggcgagcccaaggagcgcgacaaggaggaggggaaggacuccaagccccggagccuccgcuucaccugguccaugaagacgaccagcuccauggaccccaacgacaugaugcgggagauccgcaaggugcuggacgcgaacaacugcgacuacgagcagaaggagcgguuccuccuguucugcguccacggcgacgcccgccaggacagccuggugcagugggagauggaggugugcaagcugccgcggcugucccucaacggcguccgcuucaagcggaucagcgggaccuccaucgccuucaagaacaucgccagcaagaucgccaacgagcugaagcuguga

SEQ ID NO: 32714 - RNA, 2367 nt, Artificial Sequence
  derived and/or modified sequence opt1 from MARK2__Homo_sapiens__NP_001034558
augagcuccgcccgcacgccccugccgacccucaacgagcgggacaccgagcagcccacccugggccaccuggacagcaagcccuccagcaaguccaacaugauccgcgggcggaacagcgccaccuccgcggacgagcagccccacaucggcaacuaccgccuccugaagaccaucgggaagggcaacuucgccaaggugaagcuggcccggcacauccucacggggaaggaggucgccgugaagaucaucgacaagacccagcugaacagcuccagccugcagaagcuguuccgcgaggugcggaucaugaagguccucaaccacccgaacaucgugaagcuguucgaggugaucgagaccgagaagacccucuaccuggucauggaguacgccuccggcggcgagguguucgacuaccugguggcgcacgggcgcaugaaggagaaggaggcccgggccaaguuccgccagaucgucagcgccgugcaguacugccaccagaaguucaucgugcaccgggaccucaaggcggagaaccugcugcucgacgccgacaugaacaucaagaucgccgacuucggcuucuccaacgaguucacguucgggaacaagcuggacaccuucugcggcagcccgcccuacgccgcccccgagcuguuccaggggaagaaguacgacggccccgaggucgacguguggucccucggcgugauccuguacacccuggucagcgggucccuccccuucgacggccagaaccugaaggagcugcgcgagcgggugcuccgcgggaaguaccggauccccuucuacaugagcaccgacugcgagaaccugcugaagaaguuccucauccugaaccccuccaagcgcggcacgcuggagcagaucaugaaggaccgguggaugaacgugggccacgaggacgacgagcucaagccguacgucgagccccugcccgacuacaaggacccccgccggaccgagcugauggugagcaugggguacacccgcgaggagauccaggacagccucgugggccagcgguacaacgaggucauggcgaccuaccugcugcucggguacaaguccagcgagcuggagggcgacacgaucacccugaagccgcgccccuccgccgaccucaccaacagcuccgcccccagccccucccacaaggugcagcgcagcguguccgccaacccgaagcagcggcgcuucagcgaccaggccgcggggcccgccauccccaccuccaacagcuacuccaagaagacgcagagcaacaacgccgagaacaagcggcccgaggaggaccgcgaguccggccggaaggccagcuccaccgccaaggucccggcgagcccccugcccggccuggagcgcaagaagaccacccccacgccguccaccaacagcgugcucagcaccuccaccaaccggagccgcaacagcccccugcuggagcgggccagccucgggcaggccuccauccagaacggcaaggacagccugacgaugcccgggucccgcgccagcaccgccuccgcgagcgccgccgucuccgccgcgcggccgcgccagcaccagaaguccauguccgccagcgugcaccccaacaaggccuccggccugccgcccaccgagagcaacugcgaggugccccggcccuccaccgcgccccagcgcguccccguggccagcccgagcgcccacaacaucuccagcuccgggggcgcccccgaccggacgaacuucccccgcggcgugagcucccggagcaccuuccacgccgggcagcugcgccagguccgggaccagcagaaccuccccuacggcgugaccccggccucccccagcgggcacucccagggccgccgcggggccagcggcuccaucuucagcaaguucaccuccaaguucgugcggcgcaaccugagcuuccgguucgcgcgccggaaccugaacgagcccgaguccaaggaccgcgucgagacgcuccggccccacguggugggcagcgggggcaacgacaaggagaaggaggaguuccgcgaggccaagccgcggucccugcgcuucaccuggagcaugaagaccaccuccagcauggagcccaacgagaugaugcgggagauccgcaagguccuggacgccaacagcugccaguccgagcuccacgagaaguacaugcugcugugcaugcacgggacccccggccacgaggacuucgugcagugggagauggaggugugcaagcucccccggcugagccugaacggcguccgcuucaagcggaucuccgggacgagcauggccuucaagaacaucgccuccaagaucgcgaacgagcucaagcuguga

SEQ ID NO: 32715 - RNA, 2262 nt, Artificial Sequence
  derived and/or modified sequence opt1 from MARK3__Homo_sapiens__NP_001122390
augagcacccgcacgccccugccgaccgugaacgagcgggacaccgagaaccacaccucccacggcgacgggcgccaggaggucaccagccggacgucccgcagcggcgcccggugccgcaacuccaucgccagcugcgcggacgagcagccccacaucgggaacuaccggcuccugaagaccaucggcaaggggaacuucgccaaggugaagcuggcccgccacauccucaccggccgggagguggccaucaagaucaucgacaagacccagcugaaccccacgucccugcagaagcuguuccgcgagguccggaucaugaagauccucaaccaccccaacaucgugaagcuguucgaggugaucgagaccgagaagacccucuaccugaucauggaguacgccagcggcggggaggucuucgacuaccugguggcgcacggccgcaugaaggagaaggaggcccgguccaaguuccgccagaucgugagcgccguccaguacugccaccagaagcggaucgugcaccgcgaccucaaggccgagaaccugcugcucgacgcggacaugaacaucaagaucgccgacuucggguucuccaacgaguucaccgugggcgggaagcuggacacguucugcggcagcccgcccuacgccgcccccgagcuguuccagggcaagaaguacgacgggcccgaggucgacguguggucccucggcgugauccuguacacccuggucagcgggucccucccguucgacggccagaaccugaaggagcugcgggagcgcgugcuccggggcaaguaccgcauccccuucuacaugagcaccgacugcgagaaccugcugaagcgguuccucgugcugaaccccaucaagcgcgggacccuggagcagaucaugaaggaccgcuggaucaacgccggccacgaggaggacgagcucaagcccuucgucgagccggagcuggacaucuccgaccagaagcggaucgacaucaugguggggaugggcuacagccaggaggagauccaggagucccugagcaagaugaaguacgacgagaucacggcgaccuaccuccugcuggggcgcaagagcuccgagcucgacgccagcgacuccagcuccagcuccaaccugagccuggccaaggugcggcccuccagcgaccucaacaacuccaccggccagagcccccaccacaagguccagcgcuccgugagcuccagccagaagcagcggcgcuacuccgaccacgccggccccgccaucccgagcguggucgcguaccccaagcggucccagaccagcacggccgacagcgaccugaaggaggacgggaucuccagccgcaaguccagcggcuccgccgucgggggcaaggggaucgcccccgccagccccaugcugggcaacgcguccaacccgaacaaggccgacauccccgagcggaagaaguccagcaccgugcccagcuccaacaccgccagcggcgggaugacccgccggaacacguacgugugcuccgagcgcaccaccgccgaccggcacagcgugauccagaacggcaaggagaacuccaccauccccgaccagcgcacgccggucgccagcacccacuccaucagcagcgcggccacccccgaccggauccgcuucccccgggggaccgccucccgcagcacguuccacggccagccccgggagcgccgcaccgccaccuacaacgggccgcccgcgucccccagccucucccacgaggccaccccgcugagccagacgcggucccgcggcagcaccaaccuguucuccaagcucaccagcaagcugacccggcgcaacauguccuuccgguucaucaagcgccugcccaccgaguacgagcggaacggccgcuacgaggggagcucccggaacgugagcgccgagcagaaggacgagaacaaggaggccaagccccgcucccuccgguucacguggagcaugaagaccaccuccagcauggaccccggcgacaugaugcgcgagauccggaaggugcuggacgccaacaacugcgacuacgagcagcgcgagcgguuccugcuguucugcguccacggggacggccacgcggagaaccucgugcagugggagauggaggugugcaagcugccgcgccugucccucaacggcguccgguucaagcgcaucagcgggaccagcaucgccuucaagaacaucgccuccaagaucgccaacgagcugaagcuguga

SEQ ID NO: 32716 - RNA, 2259 nt, Artificial Sequence
  derived and/or modified sequence opt1 from MARK4__Homo_sapiens__NP_001186796
augagcucccgcaccgugcuggcccccggcaacgaccggaacagcgacacccacgggacgcucggcuccgggcgcagcuccgacaagggcccgagcugguccagccggucccugggggcccgcugccggaacagcaucgcguccugccccgaggagcagccccacgucggcaacuaccgccugcuccggaccaucggcaaggggaacuucgccaaggugaagcuggcccgccacauccugaccggccgggagguggccaucaagaucaucgacaagacccagcucaaccccagcucccugcagaagcuguuccgcgagguccggaucaugaaggggcucaaccacccgaacaucgugaagcuguucgaggugaucgagacggagaagacccuguaccucgucauggaguacgccagcgcgggcgagguguucgacuaccuggugucccacgggcgcaugaaggagaaggaggcccgggccaaguuccgccagaucgucagcgccgugcacuacugccaccagaagaacaucgugcaccgggaccugaaggcggagaaccuccugcuggacgccgaggccaacaucaagaucgccgacuucggcuucuccaacgaguucacccucggcagcaagcuggacaccuucugcggguccccgcccuacgccgcgcccgagcuguuccagggcaagaaguacgacgggcccgaggucgacaucuggagccucggcgugauccuguacacgcuggugagcggcucccuccccuucgacgggcacaaccugaaggagcugcgcgagcggguccuccgcggcaaguaccgggugcccuucuacaugagcaccgacugcgaguccauccugcgccgguuccuggugcucaaccccgccaagcgcugcacccuggagcagaucaugaaggacaaguggaucaacaucggguacgagggcgaggagcugaagccguacaccgagcccgaggaggacuucggggacacgaagcgcaucgaggucauggugggcaugggcuacacccgggaggagaucaaggagagccucaccucccagaaguacaacgaggugaccgccacguaccugcugcucgggcgcaagaccgaggagggcggggaccggggcgcccccgggcuggcccuggcgcgcguccgggcccccagcgacaccaccaacggcacguccagcuccaagggcaccagccacuccaaggggcagcgcagcuccagcuccaccuaccaccggcagcgccggcacagcgacuucugcggcccgucccccgcgccccuccaccccaagcgcagcccgaccuccacgggggaggccgagcugaaggaggagcggcugcccggccgcaaggccagcugcagcaccgccggguccggcagccggggccucccgcccuccagccccaugguguccagcgcccacaaccccaacaaggccgagauccccgagcgccggaaggacuccaccagcacccccaacaaccugccgcccuccaugaugacgcgccggaacaccuacgugugcaccgagcgccccggggccgagcggccgagccugcuccccaacggcaaggagaacuccagcgggacgccccgcgugcccccggccucccccagcucccacagccuggcgccgcccuccggcgagcgcagccggcuggcccgcggcagcaccauccgguccaccuuccacgggggccagguccgcgaccggcgcgccgggggcgggggcggcgggggcguccagaacgggccgcccgccagccccacccucgcgcacgaggccgccccgcugcccgccggccggccccgccccaccacgaaccuguucaccaagcugaccuccaagcucacccggcgcguggccgacgagcccgagcggaucgggggccccgaggugaccagcugccaccuccccugggaccagacggagaccgcgccccgccugcugcgguuccccugguccgucaagcugaccagcucccgcccgcccgaggcccugauggccgcccuccggcaggccaccgcggccgcccgcugccggugccgccagccccagcccuuccugcuggccugccuccacggcggggccggcgggccggagccccugagccacuucgagguggaggugugccagcugccccggccgggccuccgcgggguccuguuccggcgcguggcgggcacggcccuggccuuccgcacccucgugacccggaucuccaacgaccuggagcuguga

SEQ ID NO: 32717 - RNA, 1782 nt, Artificial Sequence
  derived and/or modified sequence opt1 from MARS2__Homo_sapiens__NP_612404
augcugcgcaccagcgugcuccggcugcugggccgcaccggggccucccggcucagccugcuggaggacuucggcccccgcuacuacuccagcgggucccucagcgccggcgacgacgcgugcgacguccgggccuacuucacgaccccgaucuucuacgugaacgccgcgccccacaucgggcaccuguacuccgcccugcucgccgacgcccugugccgccaccggcgccugcggggccccagcaccgccgccacccgcuucuccacgggcaccgacgagcacgggcucaagauccagcaggcggccgccaccgccggccuggcccccaccgagcugugcgaccgggugagcgagcaguuccagcagcuguuccaggaggcggggaucuccugcacggacuucauccgcaccaccgaggcccggcaccgcgucgccgugcagcacuucuggggcgugcucaagagccgggggcugcucuacaagggcgucuacgagggcugguacugcgccuccgacgagugcuuccugccggaggccaaggugacccagcagcccgggcccagcggcgacuccuuccccgugagccuggaguccgggcacccggucagcuggacgaaggaggagaacuacaucuuccgccucucccaguuccggaagccccugcagcgcuggcugcggggcaacccccaggcgaucacccccgagccguuccaccacguggugcuccaguggcuggacgaggagcugcccgaccucagcgucagccgccgguccagccaccuccacuggggcauccccgugcccggggacgacucccagaccaucuacguguggcuggacgcccuggucaacuaccugaccgugaucggcuacccgaacgccgaguucaagagcugguggcccgccacgucccacaucaucgggaaggacauccugaaguuccacgccaucuacuggcccgcguuccuccugggcgccgggaugagcccgccccagcgcaucugcgugcacucccacuggaccgucugcggccagaagaugagcaagucccugggcaacgugguggacccccggaccugccucaaccgcuacaccgucgacggguuccgcuacuuccugcugcggcagggcgugcccaacugggacugcgacuacuacgacgagaagguggucaagcuccugaacagcgagcuggccgacgcccucgggggccugcugaaccgcugcacggccaagcggaucaaccccuccgagaccuacccggcguucugcacgaccugcuuccccagcgagcccgggcucgugggccccuccguccgcgcccaggccgaggacuacgcccuggugagcgcgguggccacccugccgaagcaggucgccgaccacuacgacaacuuccggaucuacaaggcccucgaggccguguccagcugcgugcgccagaccaacggcuucguccagcggcacgcgcccuggaagcugaacugggagucccccguggacgccccguggcuggggaccgugcugcacgucgcccucgagugccugcgcguguucggcacccugcuccagcccgugacgcccagccuggccgacaagcugcucucccggcugggggucagcgccagcgagcgcucccugggcgagcucuacuuccugccccgguucuacgggcacccgugccccuucgagggccgccggcugggccccgagaccgggcuccuguucccccgccuggaccagagccggaccuggcucgugaaggcgcaccgcaccuga

SEQ ID NO: 32718 - RNA, 2703 nt, Artificial Sequence
  derived and/or modified sequence opt1 from MARS__Homo_sapiens__NP_004981
augcgccuguucgugagcgacggcguccccgggugccuccccgugcuggccgccgcgggccgggcccgcgggcgggccgaggugcugaucuccaccgucggccccgaggacugcguggugcccuuccucacccgccccaaggucccggugcugcagcuggacagcgggaacuaccucuucuccacgagcgccaucugccgguacuucuuccugcuguccggcugggagcaggacgaccucaccaaccaguggcuggagugggaggccaccgagcugcagcccgcgcucagcgccgcccuguacuaccuggugguccagggcaagaagggggaggacgugcucggcuccgugcgccgggcccugacccacaucgaccacagccugucccgccagaacugccccuuccucgcgggggagacggagagccuggccgacaucguccuguggggcgcccucuacccccugcugcaggacccggccuaccuccccgaggagcuguccgcccugcacagcugguuccagacccucuccacccaggagcccugccagcgggcggccgagaccgugcugaagcagcagggggugcuggcccuccgccccuaccugcagaagcagccgcagcccagccccgccgagggccgggccgucacgaacgagcccgaggaggaggagcuggcgacccucuccgaggaggagaucgccauggccgugaccgccugggagaagggccuggagagccugccgccccuccgcccccagcagaaccccgugcugccggucgccggggagcggaacgugcugaucaccuccgcgcuccccuacgugaacaacgucccccaccugggcaacaucaucgggugcgugcugagcgccgacguguucgcccgcuacucccggcuccgccaguggaacacgcuguaccugugcggcaccgacgaguacggcaccgccaccgagacgaaggcccucgaggaggggcugacgccccaggagaucugcgacaaguaccacaucauccacgcggacaucuaccggugguucaacaucagcuucgacaucuucggccgcaccaccaccccgcagcagaccaagaucacccaggacaucuuccagcagcugcucaagcggggguucguccugcaggacaccguggagcagcugcgcugcgagcacugcgcccgguuccuggccgaccgcuucgucgagggcgugugccccuucugcggguacgaggaggcccgcggcgaccagugcgacaagugcggcaagcucaucaacgcgguggagcugaagaagccccagugcaaggucugccggagcugccccguggugcaguccagccagcaccuguuccucgaccugccgaagcuggagaagcgccucgaggaguggcuggggcggacgcugcccggcuccgacuggacccccaacgcccaguucaucacccgcagcuggcuccgggacgggcugaagccgcgcugcaucacccgggaccugaaguggggcacgcccgucccccucgagggguucgaggacaagguguucuacgugugguucgacgccaccaucggcuaccuguccaucaccgccaacuacaccgaccagugggagcgcugguggaagaaccccgagcaggucgaccuguaccaguucauggccaaggacaacgugccguuccacagccucguguuccccugcuccgcgcugggcgccgaggacaacuacacgcuggucagccaccucaucgccaccgaguaccugaacuacgaggacgggaaguucuccaagagccggggcguggggguguucggcgacauggcccaggacaccgggauccccgccgacaucuggcgcuucuaccugcucuacauccggcccgagggccaggacuccgcguucagcuggaccgaccugcugcucaagaacaacuccgagcugcugaacaaccucggcaacuucaucaaccgcgccgggauguucgucagcaaguucuucggcggguacgugccggagauggugcugacgcccgacgaccagcggcugcucgcccacgucacccuggagcugcagcacuaccaccagcuccuggagaaggugcgcauccgggacgcccugcgcuccauccucaccaucagccggcacggcaaccaguacauccaggugaacgagcccuggaagcgcaucaagggcuccgaggccgaccggcagcgcgcggggaccgucaccggccuggccgugaacaucgccgcccugcucagcgugaugcugcagcccuacaugccgacggucuccgcgaccauccaggcccagcugcagcucccgccgcccgccugcagcauccugcugaccaacuuccucugcacccugcccgccgggcaccagaucggcacggugagcccccuguuccagaagcucgagaacgaccagaucgagucccugcgccagcgguucgggggcggccaggccaagaccagccccaagcccgcgguggucgagaccgugaccacggccaagccccagcagauccaggcccugauggacgaggugaccaagcaggggaacaucguccgcgagcucaaggcccagaaggccgacaagaacgagguggcggccgagguggccaagcugcuggaccucaagaagcagcuggccgucgccgagggcaagccgcccgaggcgcccaaggggaagaagaagaaguga

SEQ ID NO: 32719 - RNA, 522 nt, Artificial Sequence
  derived and/or modified sequence opt1 from MARVELD1__Homo_sapiens__NP_113672
augcugcccccgccgccccgccagcccccgccccaggcccgggccgcgcgcggcgccgugcggcuccagcgccccuuccugcggagcccccuggggguccuccgccugcugcagcuccuggccggcgccgccuucuggaucaccaucgcgaccuccaaguaccaggggcccgugcacuucgcccuguucgugagcguccucuucuggcugcugacgcucggccuguacuuccugacccuccuggggaagcacgagcuggugcccgugcucggcucccgguggcugauggucaacguggcccacgacgugcuggccgcggcccucuacggcgccgccaccgggaucaugagcgaccagaugcagcgccacuccuacugcaaccugaaggacuacccccugcccugcgccuaccacgcguuccucgccgccgccgucugcggcggggugugccacggccuguaccugcucagcgcccuguacgggugcggccggcgcugccagggcaagcaggagguggcguga

SEQ ID NO: 32720 - RNA, 1641 nt, Artificial Sequence
  derived and/or modified sequence opt1 from MARVELD2__Homo_sapiens__NP_001231663
augagcaacgacggccgcucccggaaccgcgaccggcgcuacgacgaggugcccagcgaccugccguaccaggacaccaccauccggacgcaccccacccuccacgacuccgagcgcgccgucagcgccgacccccugcccccgccgccccugccccuccagccgcccuucgggcccgacuucuacuccagcgacaccgaggagcccgcgaucgcccccgaccugaagcccgugcggcgcuucgugcccgacuccuggaagaacuucuuccggggcaagaagaaggaccccgagugggacaagccggucagcgacauccgcuacaucuccgacgggguggagugcagcccgcccgccucccccgcccggcccaaccaccgcagcccccugaacuccugcaaggaccccuacggcgggagcgagggcaccuucuccagccggaaggaggccgacgcgguguucccccgcgacccguacggcucccucgaccggcacacgcagaccguccgcaccuacagcgagaagguggaggaguacaaccugcgguacuccuacaugaaguccugggccgggcugcuccgcauccugggcguggucgagcugcuccugggggccggcguguucgccugcgugaccgcguacauccacaaggacagcgagugguacaaccuguucggguacagccagcccuacggcaugggcggggucggcgggcucggcagcauguacggcggguacuacuacacgggccccaagacccccuucgugcugguggucgccgggcuggccuggaucaccaccaucaucauccucgugcugggcauguccauguacuaccggacgauccugcucgacagcaacugguggccgcugaccgaguucgggaucaacguggcccuguucauccucuacauggccgcggccaucgucuacgugaacgacaccaaccgcggcggccugugcuacuacccccuguucaacacccccgugaacgccgucuucugccggguggagggcgggcagaucgccgccaugaucuuccucuucgugacgaugaucgucuaccugaucuccgcgcuggugugccucaagcuguggcgccacgaggccgcccgccggcaccgcgaguacauggagcagcaggagugcgagauggccaccagcggggaccggcagcgcgacuccgaggucaacuucaaggagcugcggaccgccaagaugaagccggagcuccugagcggccacaucccgcccgggcacauccccaagcccaucgugaugcccgacuacguggcgaaguaccccgucauccagaccgacgacgagcgcgagcgguacaaggccguguuccaggaccaguucuccgaguacaaggagcugagcgccgaggugcaggccguccuccgcaaguucgacgagcuggacgccgugaugucccggcugccccaccacagcgagucccgccaggagcacgagcggaucagccgcauccacgaggaguucaagaagaagaagaacgacccgacguuccucgagaagaaggagcggugcgacuaccugaagaacaagcugucccacaucaagcagcgcauccaggaguacgacaaggugaugaacugggacguccagggcuacagcuga

SEQ ID NO: 32721 - RNA, 1233 nt, Artificial Sequence
  derived and/or modified sequence opt1 from MARVELD3__Homo_sapiens__NP_001017967
auggaggaccccagcggcgcccgcgagccgcgggcccgcccccgggagcgcgaccccgggcggcgcccccacccggaccagggccggacccacgaccgcccccgggaccgccccggggacccccggcgcaagcgguccagcgacggcaaccgccggcgcgacggggaccgggacccggagcgcgaccaggagcgggacggcaaccgcgaccggaaccgcgaccgcgagcgggagcgcgagcgggagcgcgaccccgaccggggcccccgccgggacacccaccgcgacgcggggccccgggccggcgagcacggggugugggagaagccgcgccagucccggacgcgcgacggcgcccgggggcugaccugggacgccgccgcgccgcccggccccgcccccugggaggcccccgagccgccccagccccagcgcaagggcgaccccgggcggcgccggcccgagagcgagcccccguccgagcgcuaccuccccagcacgccccggcccggccgcgaggaggucgaguacuaccaguccgaggccgaggggcugcuggagugccacaagugcaaguaccucugcaccggccgcggcguggugcagaucgucgagguggugcugaacgggaugguccugaucugcaucguggcgagcuacuucgugcucgccggcuucuccgccagcuucuccagcgggggcggguucggcaacaacuacuacuccccguucgagggcaccgagcuggagcagguccggcagcuggaccagcaguacaccauccuccgcagcccccugaucuacgggggcguggccgugucccuggggcucggcguccugaccaugggggugcugcuccagggcgccaagagccggaccaugcuguccggcaaguggcugcucacggaggcggccuucagccugcuggccgccgugggguacugcaccggcaucggggucuaccuccacguggcccugcagaucaacuccaccgacacgugcaagacccgcgagcggcuguacgcgcgcaagggccucaccuggauggacugccagcuggccgggaccgacggcgccgccgccaccuucgcgugccugcucgugaucauguacggcgccagcgucgugcuggcccugcggagcuaccgcgagcagaagcgguacaaggggucccgcgagcagcccggcagcuacuccgacgccccggaguaccucuggagcgggacgcuguga

SEQ ID NO: 32722 - RNA, 978 nt, Artificial Sequence
  derived and/or modified sequence opt1 from MAS1__Homo_sapiens__NP_002368
auggacggcagcaacgugaccuccuucgucguggaggagcccaccaacaucagcacggggcgcaacgccuccgugggcaacgcccaccggcagaucccgaucguccacugggugaucaugagcaucucccccgugggguucgucgagaacggcauccugcucugguuccugugcuuccgcaugcggcgcaaccccuucaccguguacaucacccaccugagcaucgcggacaucucccuccuguucugcaucuucauccugagcaucgacuacgcccucgacuacgagcuguccagcgggcacuacuacaccaucgugacgcuguccgucaccuuccucuucggcuacaacaccggccuguaccugcucaccgccaucagcguggagcggugccuguccgugcuguaccccaucugguaccgcugccaccggccgaaguaccagagcgcccucgucugcgcccugcugugggcgcucuccugccuggugacgaccauggaguacgugaugugcaucgaccgcgaggaggagagccacucccggaacgacugccgcgccgucaucaucuucaucgccauccugagcuuccucguguucacgccccugaugcugguguccagcaccauccucgucgugaagauccggaagaacaccugggccagccacuccagcaagcuguacaucgugaucauggucaccaucaucaucuuccugaucuucgcgaugcccaugcgccuccuguaccugcucuacuacgaguacugguccaccuucgggaaccugcaccacaucagccuccuguucuccaccaucaacagcuccgccaaccccuucaucuacuucuucgugggcagcuccaagaagaagcgguucaaggagagccugaaggugguccugacgcgcgccuucaaggacgagaugcagccgcggcgccagaaggacaacugcaacaccgugaccgucgagaccgugguguga

SEQ ID NO: 32723 - RNA, 1137 nt, Artificial Sequence
  derived and/or modified sequence opt1 from MAS1L__Homo_sapiens__NP_443199
augguguggggcaagaucugcugguucagccagcgcgccggguggaccgucuucgccgagucccagaucagccuguccugcagccucugccugcacuccggcgaccaggaggcgcagaaccccaaccuggugagccagcucugcgggguguuccugcagaacgagaccaacgagacgauccacaugcagauguccauggccgucggccagcaggcccugccgcucaacaucaucgcccccaaggccgugcuggugagccugugcgggguccuccugaacggcaccguguucuggcugcucugcugcggcgcgaccaaccccuacaugguguacauccugcaccuggucgccgccgacgugaucuaccucugcugcuccgccgugggguuccugcaggucacccugcucacguaccacggcgugguguucuucauccccgacuuccuggcgauccugagcccguucuccuucgaggucugccucugccugcugguggccaucagcaccgagcggugcgugugcguccucuuccccaucugguaccgcugccaccggcccaaguacaccuccaacguggugugcacccugaucugggggcugcccuucugcaucaacaucgucaagagccucuuccugacguacuggaagcacgugaaggccugcgugaucuuccugaagcucuccggccuguuccacgccauccugagccucgucaugugcguguccagccugacccugcucauccgcuuccugugcugcucccagcagcagaaggccacccgggucuacgcgguggugcagaucagcgccccgauguuccugcucugggcccugccccugagcgucgcgccccucaucaccgacuucaagauguucgugacgaccuccuaccugaucagccuguuccucaucaucaacuccagcgccaaccccaucaucuacuucuucguggggucccugcgcaagaagcggcugaaggagagccuccgcgucauccugcagcgggcccuggccgacaagccggaggugggccgcaacaagaaggccgccggcaucgaccccauggagcagccccacuccacccagcacguggagaaccugcucccccgggagcaccgcgucgacguggagaccuga

SEQ ID NO: 32724 - RNA, 1143 nt, Artificial Sequence
  derived and/or modified sequence opt1 from MASP1__Homo_sapiens__NP_001027019
augcgcuggcugcuccuguacuacgcccugugcuucagccucuccaaggccagcgcgcacaccguggagcugaacaacauguucggccagauccagucccccggguacccggacagcuaccccuccgacagcgaggucaccuggaacaucacggugcccgacggcuuccggaucaagcuguacuucaugcacuucaaccucgaguccagcuaccugugcgaguacgacuacgugaaggucgagaccgaggaccaggugcuggccaccuucugcgggcgcgagaccacggacaccgagcagacccccggccaggaggugguccucuccccggggagcuucauguccaucaccuuccggagcgacuucuccaacgaggagcgcuucacgggcuucgacgcccacuacauggccguggacguggacgagugcaaggagcgggaggacgaggagcugagcugcgaccacuacugccacaacuacaucggcggguacuacugcuccugccgcuucggcuacauccugcacaccgacaaccggaccugccgcgucgagugcagcgacaaccucuucacccagcggacgggggugaucaccucccccgacuuccccaaccccuaccccaagagcuccgagugccuguacaccaucgagcuggaggagggcuucauggugaaccuccaguucgaggacaucuucgacaucgaggaccaccccgagguccccugccccuacgacuacaucaagaucaagguggggccgaaggugcugggccccuucugcggcgagaaggcccccgagcccaucagcacccagagccacuccguccugauccucuuccacagcgacaacuccggggagaaccgcggcuggcggcugagcuaccgcgcggccgggaacgagugcccggagcugcagccgcccgugcacggcaagaucgagcccucccaggccaaguacuucuucaaggaccaggugcucgucagcugcgacacgggcuacaaggugcugaaggacaacguggagauggacaccuuccagaucgagugccugaaggacgggaccugguccaacaagaucccgaccugcaagaagaacgagaucgaccucgagagcgagcugaaguccgagcaggucacggaguga

SEQ ID NO: 32725 - RNA, 5592 nt, Artificial Sequence
  derived and/or modified sequence opt1 from MAST2__Homo_sapiens__XP_011539364
augaagcgcucccggugccgcgaccggccccagcccccgccgcccgaccgccgggaggacggcgugcagcgcgccgccgagcugucccagagccucccgccccggcgccgggcgccgcccgggcgccagcggcuggaggagcgcaccggccccgccgggcccgagggcaaggagcaggacguggugaccggggugagcccccuccuguuccggaagcuguccaaccccgacaucuucuccuccaccggcaaggucaagcugcagcgccagcugucccaggacgacugcaagcuguggcggggcaaccuggccuccucccucagcgggaagcagcugcugccccucuccagcuccgugcacagcuccgugggccaggucaccuggcagagcuccggggaggccuccaaccuggugcgcaugcggaaccagucccugggccagagcgcccccagccucaccgccgggcugaaggagcugucccucccccgccggggcagccugaucuccacccugugccgcggcgccgaggugaaccagcacauguucagccccaccuccgcccccgcccucuuccugaccaagguccccuucagcgcggacugcgcccuggccaccagcccccucgccaucuuccugaacccccgggcccacuccucccccgggacccccugcagcucccgcccccugcccuggagcugccgcacguccaaccgcaagucccucaucgugaccuccagcaccucccccacccugccccgcccccacagcccccugcacggccacacggggaacuccccgcucgacagcccccggaacuucagccccaacgcgcccgcccacuucuccuucgugcccgcccgccggaccgacggccgccgguggagccuggccucccugcccagcuccggcuacgggaccaacacccccagcuccacggucagcuccagcugcuccagccaggagaagcuccaccagcugcccuuccagcccaccgccgacgagcugcacuuccucaccaagcacuucuccaccgagagcgugcccgacgaggagggccgccagucccccgcgaugcggccgcgcagccggucccugagccccgggcgcagccccguguccuucgacagcgagaucaucaugaugaaccacgucuacaaggagcgguuccccaaggccacggcccagauggaggagcgccuggccgaguucaucuccagcaacaccccggacuccgugcucccccuggccgacggcgcgcugagcuucauccaccaccaggugaucgagauggcccgggacugccucgacaagucccgcagcgggcugaucaccucccaguacuucuacgagcugcaggacaaccucgagaagcugcugcaggacgcccacgagcggagcgaguccagcgaggucgccuucgugaugcagcucgugaagaagcugaugaucaucaucgcccgccccgcgcggcugcuggagugccucgaguucgaccccgaggaguucuaccaccuccuggaggccgccgagggccacgccaaggagggccaggggaucaagugcgacaucccgcgcuacaucgucucccagcucggccugacccgcgacccccuggaggagauggcgcagcucagcuccugcgacagccccgacacgcccgagaccgacgacuccaucgaggggcacggcgccagccugccguccaagaagacccccagcgaggaggacuucgagaccaucaagcugaucagcaacggggccuacggcgccguguuccucgugcggcacaaguccacgcgccagcgguucgccaugaagaagaucaacaagcagaaccugauccugcgcaaccagauccagcaggcguucgucgagcgggacauccucaccuucgccgagaaccccuucguggucagcauguucugcuccuucgacaccaagcgccaccugugcauggugauggaguacguggagggcggggacugcgccacccugcucaagaacaucggcgcccugcccgucgacauggugcggcuguacuucgccgagacggugcucgcgcuggaguaccugcacaacuacgggaucguccaccgcgaccucaagccggacaaccugcugaucaccagcaugggccacaucaagcucaccgacuucgggcuguccaagaucggccugaugagccucaccacgaaccuguacgagggccacaucgagaaggacgcccgggaguuccuggacaagcaggucugcgggacccccgaguacaucgcccccgaggugauccuccgccagggcuacgggaagccggucgacuggugggccaugggcaucauccuguacgaguuccuggugggcugcgugcccuucuucggggacacccccgaggagcuguucggccaggucaucuccgacgagaucguguggcccgagggggacgaggcccugccgcccgacgcgcaggaccugaccagcaagcuccugcaccagaacccccuggagcggcucggcaccggguccgccuacgaggugaagcagcaccccuucuucacgggccuggacuggaccggccugcuccgccagaaggccgaguucaucccgcagcuggagagcgaggacgacaccuccuacuucgacacccggagcgagcgcuaccaccacauggacuccgaggacgaggaggaggucagcgaggacgggugccuggagauccggcaguucuccagcugcagcccccgcuucaacaagguguacagcuccauggagcggcucagccugcuggaggagcgccggacgccgccgcccaccaagcgcagccucuccgaggagaaggaggaccacagcgacggccuggccgggcugaagggccgggaccgcuccugggugaucgggagccccgagauccuccgcaagcggcuguccgucagcgaguccagccacaccgaguccgacagcagcccgcccaugaccgugcgccggcgcugcagcggccugcucgacgcgccccgguuccccgagggccccgaggaggccuccagcacgcugcgccggcagccccaggaggggaucugggugcugaccccgcccuccggcgagggggucagcggccccgugaccgagcacuccggggagcagcgccccaagcucgacgaggaggccgugggccggagcuccggcagcagcccggccauggagacccgcgggcggggcacgucccagcuggccgagggggcgaccgccaaggccaucagcgaccuggccguccgccgggcccgccaccggcuccuguccggcgacagcaccgagaagcgcaccgcgcggcccgugaacaaggugaucaaguccgccagcgccacggcccugucccuccugauccccagcgagcaccacacgugcagcccccuggccagcccgaugagcccccacagccaguccagcaaccccuccagccgcgacuccagcccgucccgggacuuccuccccgcgcuggggagcaugcggccgcccaucaucauccaccgcgccggcaagaaguacggcuucacccugcgggccauccgcgucuacaugggggacagcgacguguacaccgugcaccacauggucuggcacguggaggacggcgggccggccuccgaggcgggccuccggcagggcgaccugaucacgcacgugaacggggagcccguccacggccuggugcacaccgagguggucgagcucauccugaaguccgggaacaagguggccaucuccaccacgccccuggagaacacgagcaucaaggugggccccgcccgcaagggguccuacaaggccaagauggcccggcgcagcaagcggucccgcggcaaggacggccaggagagccggaagcgcuccagccucuuccggaagaucaccaagcaggcgucccugcugcacaccagccgcucccucagcucccugaaccggagccuguccagcggggaguccggcccggggagccccacccacagccacucccucagcccccgcucccccacgcagggcuaccgggucaccccggacgccgugcacagcgugggcggcaacuccagccaguccagcucccccagcuccagcguccccuccagccccgccggcuccgggcacacccgcccgagcucccugcacggccuggcccccaagcuccagcggcaguaccgcagcccccggcgcaagagcgccggguccaucccccugagcccgcuggcgcacacccccagcccgcccccgcccacggccagcccccagcggucccccagcccccucuccggccacguggcccaggccuuccccaccaagcugcaccuguccccgccccucgggcgccagcugucccgccccaagagcgccgagccgccccggagcccccugcucaagcgcgugcaguccgcggagaagcuggccgccgcccuggccgcguccgagaagaagcuggccaccagccggaagcacucccucgaccugccccacagcgagcugaagaaggagcucccgccccgcgaggucagcccccuggagguggugggcgcccgguccguccuguccggcaagggggcccuccccggcaagggggugcugcagcccgcgcccagccgcgcccugggcacccuccggcaggaccgcgccgagcggcgcgagagccugcagaagcaggaggccauccgggagguggacuccagcgaggacgacacggaggagggcccggagaacucccagggggcccaggagcugagccucgcgccccaccccgaggucucccagagcguggcccccaagggcgccggggaguccggcgaggaggacccguuccccagccgcgacccccggucccuggggcccauggucccgagccugcucaccggcaucacccuggggccgccccgcauggagucccccagcgggccgcaccggcgccugggcagcccccaggccaucgaggaggccgcgagcuccagcuccgccgggcccaaccucggccagagcggggccaccgacccgaucccgcccgagggcugcuggaaggcccagcaccuccacacccaggcccugacggcgcucucccccagcaccagcggccugaccccgaccuccagcugcagcccgcccagcuccacgagcgggaagcuguccauguggagcuggaagucccucaucgagggccccgaccgggccagcccgucccgcaaggccaccauggccgggggccuggcgaaccugcaggaccucgagaacaccacccccgcccagcccaagaaccugagcccccgggagcaggggaagacgcagccgcccuccgcgccccgccuggcccaccccagcuacgaggacccgucccagggcuggcucugggagagcgagugcgcccaggcggugaaggaggaccccgcccuguccaucacccaggugcccgacgccagcggcgaccgccggcaggacguccccugccgcgggugcccgcugacccagaaguccgagcccagccuccggcgcggccaggagcccgggggccaccagaagcaccgggaccuggcccuggugcccgacgagcuccugaagcagaccuga

SEQ ID NO: 32726 - RNA, 7872 nt, Artificial Sequence
  derived and/or modified sequence opt1 from MAST4__Homo_sapiens__NP_001158136
augggcgagaagguguccgaggcccccgagcccgucccccgcgggugcuccggccacgggucccggacccccgccuccgcccugguggccgccagcucccccggcgccagcuccgccgagagcuccagcggguccgagacccucagcgaggagggcgagcccggcggguucucccgcgagcaccagccgccgccgccgccgccccucggcgggacccugggcgcccgggcccccgccgccugggcccccgccagcgugcuccuggagcgcgggguccuggcccugcccccgccccugcccggcggcgccgugccgcccgcgccccgcggguccagcgccucccaggaggagcaggacgaggagcuggaccacauccucagcccgccgcccaugcccuuccgcaagugcuccaaccccgacguggccagcggccccgggaagucccugaaguacaagcggcagcuguccgaggacggccgccagcuccggcgcggcagccucggcggggcccugaccgggcgguaccuccugcccaaccccgucgccgggcaggccuggcccgcguccgccgagaccagcaaccuggugcgcaugcggucccaggcccucgggcagagcgcccccucccugaccgccagccugaaggagcucucccugccccgccggggcagcuucugccgcacguccaaccggaagucccugaucggcaacgggcaguccccggcgcucccccgcccccacagcccccuguccgcccacgccggcaacagcccccaggacagcccccggaacuucagccccuccgccagcgcccacuucagcuucgcgcgccggaccgacgggcgccgcuggucccuggccagccuccccuccagcggcuacgggaccaacaccccguccagcacgguguccagcuccugcagcucccaggagaagcugcaccagcugcccuaccagcccacccccgacgagcuccacuuccugagcaagcacuucugcaccaccgaguccaucgccacggagaaccggugccgcaacaccccgaugcggccccgcagccggucccugagccccggccgcucccccgccugcugcgaccacgagaucaucaugaugaaccacgucuacaaggagcgguucccgaaggcgaccgcccagauggaggagcgccucaaggagaucaucaccagcuacagccccgacaacgugcugccccuggccgacggcgugcucuccuucacgcaccaccagaucaucgagcuggcccgggacugccuggacaagagccaccaggggcucaucaccucccgcuacuuccuggagcugcagcacaagcucgacaagcugcugcaggaggcccacgaccggagcgaguccggcgagcucgcguucaucaagcagcugguccgcaagauccugaucgugaucgcccggcccgcccgccuccuggagugccuggaguucgacccggaggaguucuacuaccugcucgaggccgccgaggggcacgcgaaggagggccaggggaucaagaccgacaucccccgguacaucaucagccagcugggccugaacaaggacccccucgaggagauggcccaccugggcaacuacgacuccgggaccgccgagacgcccgagaccgacgagagcguguccagcuccaacgccagccugaagcuccgccggaagccgcgcgaguccgacuucgagaccaucaagcugaucagcaacggcgccuacggggcggucuacuucgugcggcacaaggagucccgccagcgcuucgccaugaagaagaucaacaagcagaaccugauccuccggaaccagauccagcaggccuucguggagcgcgacauccugaccuucgccgagaaccccuucgucgugagcauguacugcuccuucgagacgcggcgccaccugugcauggugauggaguacgucgagggcggcgacugcgcgacccucaugaagaacauggggccccugccgguggacauggcccggauguacuucgccgagaccgugcuggcccucgaguaccugcacaacuacggcaucguccaccgcgaccugaagcccgacaaccuccuggugaccagcauggggcacaucaagcugacggacuucggccucuccaaggucgggcugaugagcaugaccaccaaccuguacgagggccacaucgagaaggacgcccgggaguuccucgacaagcaggucugcggcacccccgaguacaucgcgcccgaggugauccugcgccagggguacggcaagccggucgacuggugggccauggggaucauccuguacgaguuccucgugggcugcgugcccuucuucggggacacgcccgaggagcuguucggccaggucaucagcgacgagaucaacuggcccgagaaggacgaggccccgccgcccgacgcccaggaccugaucacccuccugcugcggcagaacccccucgagcgccugggcaccgggggcgccuacgaggugaagcagcaccgguucuuccgcucccuggacuggaacagccuccugcggcagaaggcggaguucaucccgcagcuggaguccgaggacgacaccagcuacuucgacacgcgcuccgagaaguaccaccacauggagaccgaggaggaggacgacaccaacgacgaggacuucaacguggagauccggcaguucagcuccugcagccaccgcuucuccaaggucuucagcuccaucgaccggaucacccagaacagcgccgaggagaaggaggacuccguggacaagaccaagagcacgacccuccccuccaccgagacccugagcugguccagcgaguacuccgagaugcagcagcugagcacgagcaacuccagcgacaccgaguccaaccgccacaagcucagcuccgggcugcugcccaagcucgccaucagcaccgagggcgagcaggacgaggccgccuccugccccggggacccccacgaggagcccggcaagcccgcgcugcccccggaggagugcgcccaggaggagcccgaggugaccacgcccgccagcaccaucuccagcuccacccugagcgucggcuccuucagcgagcaccucgaccagaucaacgggcgguccgagugcguggacagcaccgacaacuccagcaagcccuccagcgagccggccagccacauggcgcgccagcggcuggaguccacggagaagaagaagaucagcggcaaggugaccaagucccugagcgccuccgcccucagccugaugauccccggggacauguucgccgucagcccccugggcagccccauguccccgcacagccucuccagcgaccccuccagcucccgcgacagcucccccagccgcgacuccagcgccgcgagcgccuccccgcaccagcccaucgugauccacagcuccgggaagaacuacggcuucaccauccgggccauccgcguguacgucggcgacagcgacaucuacaccgugcaccacaucguguggaacgucgaggaggggucccccgccugccaggccggccugaaggcgggggaccugaucacgcacaucaacggcgagcccgugcacggccucgugcacaccgaggucaucgagcugcugcucaagagcgggaacaagguguccaucaccaccacgccguucgagaacaccagcaucaagaccggccccgcccggcgcaacuccuacaagagccggauggugcgccgguccaagaaguccaagaagaaggagucccuggagcgccggcgcagccuguucaagaagcucgccaagcagcccagcccccugcugcacaccagccgguccuucagcugccucaaccgcucccugagcagcggggagucccugccgggcagccccacgcacucccucagcccccggucccccaccccgagcuaccgcuccacccccgacuuccccagcgggaccaacuccagccaguccagcucccccagcuccagcgccccgaacucccccgccggcagcggccacauccggcccagcacgcugcacgggcuggcgcccaagcucggcgggcagcgcuaccgguccggccgccggaaguccgccgggaacaucccgcugagcccccuggcccgcacccccagccccaccccgcagcccaccagcccccagcgcagccccuccccgcuccugggccacagccugggcaacuccaagaucgcccaggccuuccccagcaagaugcacagcccgcccacgaucguccggcacaucgugcgccccaagagcgcggagccgccccggagcccccuccugaagcgcgugcaguccgaggagaagcugucccccagcuacggguccgacaagaagcaccucugcagccggaagcacucccuggaggucacccaggaggaggugcagcgcgagcagagccagcgggaggcgccccugcagagccucgacgagaacgugugcgacgugccgccccugucccgcgcccggcccguggagcagggcugccugaagcgccccgugagccggaaggucgggcgccaggaguccguggacgaccucgaccgggacaagcugaaggccaagguggucgugaagaaggcggacggcuuccccgagaagcaggagagccaccagaagucccacgggcccggcagcgaccuggagaacuucgcccucuucaagcuggaggagcgcgagaagaagguguaccccaaggccgucgagcgguccagcaccuucgagaacaaggccuccaugcaggaggcgccgccccugggcagccuccugaaggacgcgcugcacaagcaggccuccgugcgcgccagcgagggggccauguccgacggccgggugccggccgagcaccgccagggcggcggcgacuuccggcgcgcgcccgcccccgggacccugcaggacggccucugccacagccuggaccgggggaucuccggcaagggggagggcacggagaaguccucccaggccaaggagcugcuccgcugcgagaagcuggacagcaagcuggccaacaucgacuaccuccgcaagaagaugucccuggaggacaaggaggacaaccugugccccguccucaagccgaagaugaccgccggcagccacgagugccugcccgggaaccccgugcggcccaccggcgggcagcaggagccgccgcccgcgagcgagucccgcgccuucgugagcuccacccacgccgcccagaugagcgcggucuccuucgugccgcugaaggcccucaccggccggguggacagcgggacggagaagcccggccuggucgcccccgagucccccgugcgcaagagcccguccgaguacaagcuggagggccggagcgucuccugccucaagcccaucgaggggacccuggacaucgcccugcucagcggcccccaggccuccaagaccgagcugcccagcccggaguccgcgcagagccccucccccagcggggacgugcgcgccuccgugcccccgguccugcccagcagcuccggcaagaagaacgacaccacgagcgcccgggagcucucccccagcucccugaagaugaacaagagcuaccugcucgagcccugguuccugccgcccucccgcgggcugcagaacagccccgccgugucccuccccgacccggaguucaagcgggaccgcaagggcccccaccccaccgcccggagccccggcaccgugauggaguccaacccgcagcagcgcgaggggagcucccccaagcaccaggaccacaccacggaccccaagcugcugaccugccucggccagaaccugcacagccccgaccuggcgcggccgcgcugcccccugccgcccgaggccucccccagccgggagaagcccgggcugcgcgaguccagcgagcggggcccgcccaccgcccgcuccgagcggagcgccgcccgcgcggacacgugccgcgagcccagcauggagcugugcuuccccgagacggccaagaccuccgacaacagcaagaaccuccuguccgucgggcggacccaccccgacuucuacacccagacgcaggccauggagaaggccugggcgcccggcggcaagaccaaccacaaggacgggcccggcgaggcccggcccccgccccgggacaacagcucccugcacagcgccgggauccccugcgagaaggagcucggcaaggugcgccggggcguggagcccaagcccgaggcccugcuggcccgccggucccuccagccgcccgggaucgagagcgagaaguccgagaagcugagcuccuuccccagccugcagaaggacggcgcgaaggagcccgagcgcaaggagcagccccuccagcggcaccccuccagcaucccgcccccgccccugaccgccaaggaccuguccagccccgccgcccgccagcacugcuccagccccucccacgccagcgggcgggagcccggcgcgaagcccagcaccgccgagcccuccagcuccccgcaggacccgcccaagcccgucgccgcccacagcgaguccagcucccacaagccgcgccccgggcccgaccccggcccgcccaagacgaagcaccccgaccggagccucuccagccagaagcccuccgugggcgccaccaaggggaaggagccggcgacccagagccugggcggguccagccgcgagggcaaggggcacuccaagagcggccccgacguguuccccgccacccccggcucccagaacaaggccagcgacgggaucggccagggggagggcgggccgagcgucccccugcacacggaccgggcgccccucgacgccaagccccagccgaccuccggcggccgcccccuggaggugcuggagaagcccgugcaccucccccggccggggcaccccggccccagcgagcccgcggaccagaagcuguccgccgucggggagaagcagacccugagcccgaagcaccccaagcccuccaccgugaaggacugcccgacgcucugcaagcagaccgacaaccgccagaccgacaagagccccucccagcccgccgccaacaccgaccggcgcgcggagggcaagaagugcacggaggcccuguacgcccccgccgagggggacaagcuggaggccggccucagcuucgugcacuccgagaaccggcugaagggcgcggagcgcccggccgccggggucggcaagggguuccccgaggcccgcggcaagggccccgggccccagaagccgcccaccgaggccgacaagcccaacggcaugaagcggagccccuccgcgaccgggcagagcuccuuccgcagcaccgcccugccggagaagucccucagcugcuccagcuccuuccccgagacgcgggccggcgugcgcgaggccagcgccgcgagcuccgacaccagcuccgccaaggccgccgggggcaugcuggagcugcccgcgcccagcaaccgggaccaccgcaaggcccagccggccggcgaggggcggacccacaugaccaaguccgacagccuccccuccuuccgcgugagcacccugccccuggagucccaccaccccgacccgaacacgaugggcggggccagccaccgggaccgcgcccucuccgucaccgcgaccgugggcgagaccaaggggaaggaccccgcccccgcccagcccccgcccgcccggaagcagaacgugggccgcgacgucacgaagcccagcccggcccccaacaccgaccggcccaucucccugagcaacgagaaggacuucguggugcgccagcggcgcggcaaggagucccugcggagcagcccccacaagaaggcgcucuga

SEQ ID NO: 32727 - RNA, 2640 nt, Artificial Sequence
  derived and/or modified sequence opt1 from MASTL__Homo_sapiens__NP_001165774
auggaccccaccgccggcagcaagaaggagcccgggggcggggccgcgaccgaggagggcgugaaccgcaucgccguccccaagccgcccuccaucgaggaguucagcaucgugaagccgaucucccgcggggccuucggcaagguguaccugggccagaagggcgggaagcucuacgccgucaagguggugaagaaggccgacaugaucaacaagaacaugacgcaccagguccaggcggagcgggacgcccuggcccugagcaagucccccuucaucgugcaccucuacuacagccugcaguccgccaacaacguguaccuggucauggaguaccucaucgggggcgacgugaagucccugcugcacaucuacggguacuucgacgaggagauggcggugaaguacaucuccgaggucgcccucgcccuggacuaccugcaccggcacggcaucauccaccgcgaccucaagcccgacaacaugcugaucagcaacgagggccacaucaagcugaccgacuucgggcucuccaaggugacccugaaccgggacaucaacaugauggacauccugaccacgcccagcauggccaagccgcgccaggacuacucccggacccccggccaggugcucagccugaucuccagccugggguucaacacccccaucgccgagaagaaccaggaccccgcgaacauccucuccgccugccugagcgagaccucccagcugagccagggccucgucugcccgaugagcguggaccagaaggacacgacccccuacuccagcaagcugcugaaguccugccucgagaccguggccagcaaccccggcaugcccgucaagugccugaccuccaaccugcuccagagccgcaagcggcuggccacguccagcgccuccagccagucccacaccuucaucagcuccguggagagcgagugccacuccagcccgaagugggagaaggacugccaggaguccgacgaggcgcuggggcccaccaugaugagcuggaacgccguggagaagcucugcgccaaguccgccaacgccaucgagaccaagggcuucaacaagaaggaccuggagcuggcgcucagccccauccacaacagcuccgcccugcccacgaccgggcgcagcugcgucaaccuggccaagaagugcuucuccggcgaggugagcugggaggccguggagcucgacgucaacaacaucaacauggacaccgacaccucccagcugggguuccaccagagcaaccagugggccguggacuccggcggcaucagcgaggagcaccuggggaagcggucccucaagcgcaacuucgagcuggucgacagcuccccgugcaagaagaucauccagaacaagaagacgugcguggaguacaagcacaacgagaugaccaacugcuacaccaaccagaacaccggccugacgguggagguccaggaccucaagcugagcgugcacaagucccagcagaacgacugcgcgaacaaggagaacaucgugaacagcuucaccgacaagcagcagacccccgagaagcugcccauccccaugaucgccaagaaccucaugugcgagcuggacgaggacugcgagaagaacuccaagcgggacuaccugagcuccagcuuccugugcagcgacgacgaccgcgccuccaagaacaucagcaugaacuccgacagcuccuucccggggaucagcaucauggagagcccccucgagagccagccccuggacuccgaccggagcaucaaggaguccagcuucgaggaguccaacaucgaggacccccugaucgucaccccggacugccaggagaagacgagccccaagggcguggagaaccccgccgugcaggaguccaaccagaagaugcucgggccgccccuggagguccugaagacccucgcgagcaagcgcaacgccguggccuuccgguccuucaacagccacaucaacgccuccaacaacagcgagcccagccgcaugaacaugaccucccuggacgccauggacaucagcugcgcguacuccggcagcuaccccauggccaucaccccgacgcagaagcggcgcuccugcaugccccaccagcagacccccaaccagaucaagagcggcacccccuaccggaccccgaaguccgugcgccgcggggucgcccccguggacgacggccggauccuggggacgcccgacuaccucgcccccgagcugcugcucggccgcgcccacgggccggcgguggacuggugggcccugggcgucugccuguucgaguuccucaccggcaucccgcccuucaacgacgagacgccccagcaggucuuccagaacauccugaagcgggacauccccuggcccgagggggaggagaagcugagcgacaacgcccaguccgccguggagauccuccugaccaucgacgacaccaagcgcgccggcaugaaggagcugaagcggcacccccucuucagcgacguggacugggagaaccugcagcaccagaccaugcccuucaucccgcagcccgacgacgagaccgacaccuccuacuucgaggcgcgcaacaccgcccagcaccugacggugagcggguucucccucuga

SEQ ID NO: 32728 - RNA, 1188 nt, Artificial Sequence
  derived and/or modified sequence opt1 from MAT1A__Homo_sapiens__XP_005269899
augaacggccccguggacgggcugugcgaccacagccucuccgagggcgucuucauguucaccagcgaguccgugggggagggccacccggacaagaucugcgaccagaucagcgacgccgugcuggacgcccaccugaagcaggaccccaacgcgaaggucgccugcgagaccgugugcaagacggggauggugcuccugugcggcgagaucaccuccauggccauggucgacuaccagcgcguggugcgggacaccaucaagcacaucggcuacgacgacagcgccaagggguucgacuucaagaccugcaacguccugguggcccucgagcagcagucccccgacaucgcgcagugcgugcaccuggaccgcaacgaggaggacgucggcgccggggaccagggccugauguucggguacgccacggacgagaccgaggagugcaugccccucaccaucauccuggcccacaagcugaacgcgcggauggccgaccuccgccggagcggccugcugccguggcuccgccccgacuccaagacccaggugacggugcaguacaugcaggacaacggcgccgucauccccgugcggauccacaccaucgugaucagcguccagcacaacgaggacaucacccuggaggagaugcgccgggcccugaaggagcaggucauccgcgccguggugcccgcgaaguaccucgacgaggacaccguguaccaccuccagccguccgggcgguucgugaucggcgggccccagggcgacgccggcgucacggggcgcaagaucaucguggacaccuacggcggguggggcgcccacgggggcggcgccuucagcgggaaggacuacaccaaggucgaccgguccgccgcguacgccgcccgcuggguggccaagagccuggugaaggccggccugugccggcgcguccugguccagguguccuacgcgaucgggguggccgagccccugagcaucuccaucuucaccuacggcacgagccagaagaccgagcgggagcuccuggacguggugcacaagaacuucgaccugcgccccggggucaucgugcgggaccucgaccugaagaagccgaucuaccagaagaccgccugcuacggccacuucggccgcuccgaguuccccugggaggugccccggaagcuggucuucuga

SEQ ID NO: 32729 - RNA, 1188 nt, Artificial Sequence
  derived and/or modified sequence opt1 from MAT2A__Homo_sapiens__NP_005902
augaacggccagcugaacggguuccacgaggccuucaucgaggagggcaccuuccucuucaccagcgaguccgugggggagggccaccccgacaagaucugcgaccagaucagcgacgccguccuggacgcgcaccuccagcaggacccggacgccaagguggccugcgagacgguggccaagaccgggaugauccugcuggccggcgagaucaccucccgcgcggccgucgacuaccagaagguggugcgggaggccgucaagcacaucggcuacgacgacagcuccaagggguucgacuacaagaccugcaacgugcugguggcccucgagcagcagagccccgacaucgcgcagggcguccaccuggaccgcaacgaggaggacaucggggccggcgaccaggggcugauguucggcuacgccacggacgagaccgaggagugcaugccccucaccaucgugcuggcccacaagcugaacgccaagcucgcggagcugcggcgcaacggcacccugcccuggcuccggccggacuccaagacccaggugacgguccaguacaugcaggaccgcggggccgugcugcccauccgggugcacaccaucgucaucagcgugcagcacgacgaggaggugugccuggacgagaugcgcgacgcccucaaggagaaggucaucaaggccguggugcccgccaaguaccuggacgaggacaccaucuaccaccuccagcccuccggccgguucgucaucgggggcccgcagggcgacgcggggcugacgggccgcaagaucaucguggacaccuacgggggcuggggcgcccacgggggcggggccuucagcggcaaggacuacaccaagguggaccgguccgccgccuacgcggcccgcugggucgccaagagccuggugaagggcgggcugugccggcgcguccucguccagguguccuacgccaucggggugagccacccccuguccaucagcaucuuccacuacggcaccucccagaaguccgagcgggagcugcucgagaucgugaagaagaacuucgaccugcgccccggcgugaucguccgggaccuggaccucaagaagcccaucuaccagcgcacggccgcguacgggcacuucggccgggacagcuucccgugggaggugcccaagaagcugaaguacuga

SEQ ID NO: 32730 - RNA, 1005 nt, Artificial Sequence
  derived and/or modified sequence opt1 from MAT2B__Homo_sapiens__NP_037415
auggugggccgcgagaaggagcugagcauccacuucguccccggguccugccggcucguggaggaggaggugaacaucccgaaccgccggguccuggugaccggcgccaccgggcugcucggccgcgccgugcacaaggaguuccagcagaacaacuggcacgcggucgggugcggcuuccggcgcgcccggcccaaguucgagcaggucaaccugcuggacagcaacgccgugcaccacaucauccacgacuuccagccccacgugaucgugcacugcgccgccgagcgccggcccgacguggucgagaaccagccggacgcggccucccagcucaacguggacgccagcggcaaccuggccaaggaggcggccgccgugggggccuuccugaucuacaucuccagcgacuacgucuucgacggcacgaacccgcccuaccgcgaggaggacauccccgcgccccucaaccuguacgggaagaccaagcuggacggcgagaaggccgugcucgagaacaaccugggggccgccgugcugcggauccccauccucuacggcgaggucgagaagcuggaggaguccgccgugaccgugauguucgacaagguccaguucagcaacaaguccgccaacauggaccacuggcagcagcgcuuccccacccacgugaaggacguggcgacggucugccggcagcuggccgagaagcgcaugcucgaccccagcaucaagggcaccuuccacugguccgggaacgagcagaugaccaaguacgagauggccugcgccaucgccgacgcguucaaccugccgagcucccaccuccggcccaucaccgacagccccgugcugggcgcccagcgcccccggaacgcccagcuggacugcuccaagcuggagacgcucgggaucggccagcgcaccccguuccggaucggcaucaaggagagccuguggcccuuccugaucgacaagcgcuggcggcagaccgucuuccacuga

SEQ ID NO: 32731 - RNA, 1527 nt, Artificial Sequence
  derived and/or modified sequence opt1 from MATK__Homo_sapiens__NP_002369
augcagggccacuuccccgccgagcgccgggaggggcgcccgcggcgcggcacccgggggcagcagcagcugcucgugagcccccgcuuccugcgggccuggcacccgccgcccgucuccgcgcgcaugcccacccggcgcugggcccccggcacgcagugcaucaccaagugcgagcacacccggcccaagcccggggagcuggccuuccgcaagggcgacguggugaccauccucgaggccugcgagaacaagagcugguaccgggucaagcaccacacguccggccaggaggggcugcuggccgcgggcgcccuccgcgagcgggaggcccugagcgccgaccccaagcugucccucaugcccugguuccacgggaagaucagcggccaggaggcggugcagcagcugcagcccccggaggacgggcuguuccucgugcgcgaguccgcccggcaccccggcgacuacguccugugcgugagcuucggccgcgacgugauccacuaccggguccugcaccgcgacgggcaccucaccaucgacgaggccguguucuucugcaaccugauggacaugguggagcacuacuccaaggacaagggcgccaucugcaccaagcugguccggcccaagcgcaagcacgggaccaagagcgccgaggaggagcucgcgcgcgccggcuggcugcugaaccuccagcaccugacgcugggcgcccagaucggggagggcgaguucggggccgugcuccagggcgaguaccuggggcagaagguggccgucaagaacaucaagugcgacgugaccgcgcaggccuuccuggacgagaccgccgugaugaccaagaugcagcacgagaaccucguccggcugcugggcgugauccuccaccagggccuguacaucgugauggagcacgucuccaaggggaaccuggugaacuuccuccgcacgcggggccgcgcccuggugaacaccgcccagcugcuccaguucagccugcacgucgcggaggggauggaguaccuggaguccaagaagcucgugcaccgggaccuggccgcccgcaacauccuggucagcgaggaccucguggccaagguguccgacuucggccuggccaaggcggagcggaaggggcuggacagcucccgccuccccgucaaguggaccgccccggaggcccugaagcacggcaaguucaccagcaaguccgacguguggagcuucggcgugcugcucugggaggucuucagcuacgggcgggcccccuaccccaagaugucccugaaggaggugagcgaggcgguggagaagggcuaccgcauggagcccccggaggggugccccggccccguccacgugcugauguccagcugcugggaggccgagcccgcccggcgcccgcccuuccggaagcuggccgagaagcucgcccgcgagcugcgguccgcgggggcccccgccagcguguccggccaggacgccgacggcagcacgagcccccgcucccaggagccguga

SEQ ID NO: 32732 - RNA, 2871 nt, Artificial Sequence
  derived and/or modified sequence opt1 from MATN2__Homo_sapiens__NP_002371
auggagaagaugcuggccggcugcuuccuccugauccuggggcagaucgugcuccugcccgccgaggcgcgcgagcggagccgcggccgguccaucagccgcgggcggcacgcccgcacccacccgcagaccgcccugcucgaguccagcugcgagaacaagcgggccgaccuggucuucaucaucgacuccagccgcuccgugaacacgcacgacuacgccaaggugaaggaguucaucgucgacauccugcaguuccucgacaucggccccgacgugacccggguggggcugcugcaguacggcagcaccgucaagaacgaguucucccucaagaccuucaagcgcaagagcgagguggagcgggcggugaagcgcaugcggcaccuguccacgggcaccaugaccgggcuggccauccaguacgcccucaacaucgccuucagcgaggcggagggcgcccgcccccugcgggagaacgucccccgcgugaucaugaucgugaccgacgggcggccgcaggacuccgucgccgagguggccgccaaggcgcgcgacacgggcauccugaucuucgccaucggggugggccaggucgacuucaacacccucaagagcaucggcuccgagccccacgaggaccacguguuccugguggccaacuucagccagaucgagacccugaccuccgucuuccagaagaagcucugcacggcccacaugugcagcacccuggagcacaacugcgcccacuucugcaucaacauccccggguccuacgugugccggugcaagcagggcuacauccugaacagcgaccagacgaccugccgcauccaggaccucugcgcgauggaggaccacaacugcgagcagcugugcgugaacguccccgggagcuucgugugccagugcuacuccggcuacgcccuggccgaggacggcaagcggugcguggccgucgacuacugcgccagcgagaaccacgggugcgagcacgagugcgugaacgcggacggcuccuaccucugccagugccacgagggguucgcccugaacccggacaagaagacgugcaccaagaucgacuacugcgccagcuccaaccacggcugccagcacgagugcgucaacaccgacgacagcuacuccugccacugccugaagggguucacccucaaccccgacaagaagacgugccgccgcaucaacuacugcgcccugaacaagcccggcugcgagcacgagugcgugaacauggaggagagcuacuacugccggugccaccgcggcuacacccuggaccccaacgggaagaccugcucccggguggaccacugcgcccagcaggaccacggcugcgagcagcucugccugaacaccgaggacagcuucgucugccagugcuccgagggguuccugaucaacgaggaccucaagacgugcagccgcguggacuacugccugcuguccgaccacggcugcgaguacagcugcgugaacauggaccgguccuucgcgugccagugcccggaggggcacguccuccgcagcgacggcaagaccugcgccaagcuggacuccugcgcccugggcgaccacgggugcgagcacagcugcguguccagcgaggacagcuucgugugccagugcuucgagggcuacauccuccgggaggacgggaagaccugccgccggaaggacgucugccaggccaucgaccacggcugcgagcacaucugcgugaacuccgacgacagcuacacgugcgagugccuggagggguuccgccuggcggaggacggcaagcggugccgccggaaggacgugugcaaguccacccaccacggcugcgagcacaucugcgucaacaacgggaacagcuacaucugcaagugcuccgagggcuucgugcucgccgaggacgggcgccggugcaagaagugcaccgagggccccaucgaccugguguucgucaucgacggcagcaagucccugggggaggagaacuucgagguggugaagcaguucgucaccggcaucaucgacagccucaccaucucccccaaggccgcccgcguggggcugcugcaguacagcacccaggugcacaccgaguucacccugcggaacuucaacuccgccaaggacaugaagaaggcggucgcccacaugaaguacaugggcaaggggagcaugaccggccucgcccugaagcacauguucgagcgcuccuucacgcagggcgagggggcccggccccugagcacccgcgugccgcgcgccgcgaucguguucaccgacggccgggcccaggacgacgucuccgagugggccagcaaggccaaggccaacgggaucaccauguacgcggugggcguggggaaggccaucgaggaggagcuccaggagaucgccuccgagcccaccaacaagcaccuguucuacgccgaggacuucagcacgauggacgagaucagcgagaagcugaagaagggcaucugcgaggcgcucgaggacuccgacggccgccaggacagccccgccggggagcugcccaagaccguccagcagccgaccgaguccgagcccgugaccaucaacauccaggaccugcucagcugcuccaacuucgccgugcagcaccgguaccuguucgaggaggacaaccugcuccgcagcacgcagaagcugucccacagcaccaagcccuccggcagcccccuggaggagaagcacgaccagugcaagugcgagaaccucaucauguuccagaaccuggccaacgaggagguccggaagcugacccagcgccucgaggagaugacccagcggauggaggcccuggagaaccgccugcgguaccgcuga

SEQ ID NO: 32733 - RNA, 1461 nt, Artificial Sequence
  derived and/or modified sequence opt1 from MATN3__Homo_sapiens__NP_002372
augccccgcccggcccccgcccggcgccugcccggccuccugcugcuccuguggccccugcuccugcugccgagcgcggcccccgaccccguggcccggcccggguuccgccggcucgagacccgcggccccgggggcucccccgggcggcgccccagccccgccgccccggacggcgcgcccgccuccggcaccagcgagcccgggcgggcccgcggcgccggggucugcaagucccggccccuggaccugguguucaucaucgacagcucccgcagcgugcggccgcucgaguucacgaaggucaagaccuucgugucccgcaucaucgacacccuggacaucggccccgcggacacccggguggccgucgugaacuacgccagcacggugaagaucgaguuccagcugcaggccuacaccgacaagcagucccucaagcaggccgucgggcgcaucaccccgcugagcaccggcacgauguccggccuggcgauccagaccgccauggacgaggccuucaccguggaggccggggcccgggagcccagcuccaacaucccgaagguggcgaucaucgucaccgacggccgcccccaggaccaggugaacgagguggccgcccgggcccaggccagcgggaucgagcucuacgcggucggcguggaccgcgccgacauggccucccugaagaugauggccagcgagccccuggaggagcacguguucuacgucgagacguacggcgugaucgagaagcucuccagccgguuccaggagaccuucugcgcccuggaccccugcgugcuggggacccaccagugccagcacgucugcaucagcgacggcgaggggaagcaccacugcgagugcucccagggcuacacccucaacgcggacaagaagacgugcagcgcccuggaccgcugcgcccugaacacccacgggugcgagcacaucugcgugaacgaccgcuccggcagcuaccacugcgagugcuacgagggcuacacccucaacgaggaccggaagaccugcuccgcccaggacaagugcgcgcuggggacgcacggcugccagcacaucugcgugaacgaccgcaccgggagccaccacugcgagugcuacgagggcuacacccugaacgccgacaagaagaccugcuccguccgggacaagugcgcccucgggagccacggcugccagcacaucugcguguccgacggcgccgccagcuaccacugcgacugcuacccgggguacacgcugaacgaggacaagaagaccugcuccgcgaccgaggaggcccgccggcuggucagcaccgaggacgccugcggcugcgaggccacgcucgccuuccaggacaagguguccagcuaccugcagcgccugaacaccaagcucgacgacauccuggagaagcugaagaucaacgaguacgggcagauccaccgguga

SEQ ID NO: 32734 - RNA, 2544 nt, Artificial Sequence
  derived and/or modified sequence opt1 from MATR3__Homo_sapiens__NP_001181883
augagcaaguccuuccagcagagcucccugagccgcgacucccagggccacgggcgggaccucagcgccgccggcaucgggcugcuggcggccgccacccagucccucagcaugcccgccucccugggccgcaugaaccaggggaccgcccggcuggcgagccucaugaaccugggcauguccagcucccugaaccagcagggcgcccacagcgcccucuccagcgccuccacgagcucccacaaccugcagagcaucuucaacaucgggagccgcggcccgcugccccucuccagccagcaccggggcgacgcggaccaggccuccaacauccuggccagcuucggccuguccgcccgcgaccucgacgagcugagccgguaccccgaggacaagaucacccccgagaaccugccgcagauccuccugcagcugaagcgccggcgcaccgaggaggggcccacccucuccuacggccgggacggccgcagcgccacgcgggagccgcccuaccgcgugccccgggacgacugggaggagaagcgccacuuccggcgcgacuccuucgacgaccgggggcccagccugaaccccguccuggacuacgaccacggcucccgcagccaggaguccggguacuacgaccggauggacuacgaggacgaccgccuccgcgacggcgagcggugccgcgacgacagcuucuucggcgagaccucccacaacuaccacaaguucgacagcgaguacgagcggauggggcgcggccccgggccgcugcaggagcggucccuguucgagaagaagcgcggcgcgccgcccagcuccaacaucgaggacuuccacgggcuccugcccaagggcuacccccaccugugcagcaucugcgaccuccccgugcacagcaacaaggaguggucccagcacaucaacggcgccagccacucccggcgcugccagcugcugcucgagaucuaccccgaguggaaccccgacaacgacaccgggcacaccaugggcgacccguucaugcugcagcagagcacgaaccccgcccccgggauccuggggcccccgccgcccuccuuccaccucgggggccccgccgugggcccccgggggaaccugggcgccgggaacggcaaccugcaggggccccgccacaugcagaagggccgggucgagaccagccgcguggugcacaucauggacuuccagcggggcaagaaccuccgcuaccagcugcugcagcucgucgagcccuucggggugaucuccaaccaccugauccugaacaagaucaacgaggcguucaucgagauggccaccaccgaggacgcccaggccgccguggacuacuacacgaccaccccggcgcucgucuucggcaagcccgugcgggugcaccugagccagaaguacaagcgcaucaagaagcccgaggggaagcccgaccagaaguucgaccagaagcaggagcugggccgggucauccaccucuccaaccugccgcacagcggcuacuccgacagcgccgugcugaagcuggccgagcccuacgggaagaucaagaacuacauccucaugcgcaugaagucccaggccuucaucgagauggagacccgggaggacgccauggcgaugguggaccacugccugaagaaggcccugugguuccagggccgcugcgucaagguggaccucagcgagaaguacaagaagcuggugcugcgcauccccaaccgggggaucgaccuccugaagaaggacaagucccgcaagcggagcuacucccccgacggcaaggagagcccgagcgacaagaaguccaagacggacgggagccagaagaccgaguccagcaccgagggcaaggagcaggaggagaaguccggcgaggacggggagaaggacaccaaggacgaccagacggagcaggagcccaacaugcugcucgagagcgaggacgagcugcuggucgacgaggaggaggccgccgcgcuccuggaguccggcagcuccgugggggacgagaccgaccuggccaaccucggcgacguggccagcgacgggaagaaggagcccuccgacaaggccgucaagaaggacggcagcgccuccgcggccgccaagaagaagcugaagaagguggacaagaucgaggagcuggaccaggagaacgaggccgcccucgagaacggcaucaagaacgaggagaacaccgagcccggggcggagagcuccgagaacgccgacgacccgaacaaggacaccagcgagaacgccgacggccaguccgacgagaacaaggacgacuacacgauccccgacgaguaccgcaucgggcccuaccagcccaacgugccggucggcaucgacuacgugauccccaagaccggguucuacugcaagcugugcagccuguucuacaccaacgaggaggucgccaagaacacccacugcuccagccucccccacuaccagaagcugaagaaguuccugaacaagcucgccgaggagcggcgccagaagaaggagacguga

SEQ ID NO: 32735 - RNA, 1842 nt, Artificial Sequence
  derived and/or modified sequence opt1 from MAU2__Homo_sapiens__NP_056144
auggccgcccaggcggccgccgccgcccaggcggccgccgcccaggcggcccaggccgaggccgccgacagcugguaccuggcgcuccugggcuucgccgagcacuuccgcaccuccagcccgcccaagauccggcugugcgugcacugccuccaggccgucuuccccuucaagccgccccagcgcaucgaggcccggacccaccuccagcugggguccgugcucuaccaccacacgaagaacagcgagcaggcccgcucccaccuggagaaggcguggcugaucagccagcagaucccccaguucgaggacgugaaguucgaggccgccucccuccugagcgagcuguacugccaggagaacuccgucgacgccgccaagccccuccugcggaaggcgauccagaucagccagcagacccccuacuggcacugccgccugcuguuccagcuggcccagcugcacacccucgagaaggaccugguguccgccugcgaccugcucggcgugggggccgaguacgcccgggucgugggcagcgaguacacccgcgcgcuguuccugcucuccaaggggaugcugcugcucauggagcggaagcugcaggaggugcacccccugcucacgcugugcggccagaucgucgagaacuggcagggcaaccccauccagaaggagagccugcgcguguucuuccucgugcugcaggucacccacuaccuggacgccggccaggugaaguccgugaagcccugccucaagcagcugcagcagugcauccagaccaucagcacccugcacgacgacgagauccuccccuccaaccccgccgaccuguuccacuggcugccgaaggagcacaugugcguccucguguaccuggugacggucaugcacagcaugcaggccggguaccuggagaaggcgcagaaguacaccgacaaggcccucaugcagcuggagaagcugaagaugcucgacugcucccccauccugagcagcuuccaggugauccugcuggagcacaucaucaugugccggcucgugaccgggcacaaggccaccgcccugcaggagaucucccaggucugccagcugugccagcagagcccccgccucuucuccaaccacgccgcgcagcugcacacgcugcucggccuguacugcgugagcgugaacugcauggacaacgccgaggcccaguucaccaccgcccugcggcucaccaaccaccaggagcugugggccuucaucgucacgaaccuggcguccguguacauccgcgaggggaaccggcaccaggagguccucuacagccugcuggagcgcaucaaccccgaccacuccuucccggugagcucccacugccuccgggccgccgccuucuacgugcgcggccuguucagcuucuuccagggccgguacaacgaggccaagcgcuuccugcgggagacccucaagauguccaacgcggaggaccugaaccgccugaccgccugcagccucguccugcuggggcacaucuucuacgugcucggcaaccaccgcgaguccaacaacauggugguccccgccaugcagcuggccagcaagauccccgacauguccgugcagcuguggagcuccgcgcuccugcgggaccugaacaaggccugcgggaacgccauggacgcccacgaggccgcgcagaugcaccagaacuucagccagcagcuccugcaggaccacaucgaggccugcucccugcccgagcacaaccucaucaccuggacggacggcccgccgcccgugcaguuccaggcccagaacggccccaacaccagccuggccagccugcucuga

SEQ ID NO: 32736 - RNA, 1200 nt, Artificial Sequence
  derived and/or modified sequence opt1 from MAVS__Homo_sapiens__NP_001193420
augcccgugcaggagacccaggccccggagagccccggcgagaacuccgagcaggcccugcagacccucagcccccgcgcgaucccccggaacccggacgggggcccccuggaguccagcuccgaccuggccgcccucagcccccugacguccagcgggcaccaggagcaggacaccgagcugggcuccacccacaccgccggggccacgagcucccucacccccagccgcggcccggucucccccagcguguccuuccagccccuggcgcggagcacgccccgcgccucccggcugccgggccccaccgggagcguggucuccaccggcaccagcuucagcuccagcucccccgggcucgccagcgccggcgcggccgaggggaagcagggcgccgaguccgaccaggccgagcccaucaucugcagcuccggcgccgaggcgccggccaacagccugcccuccaaggugcccaccacccugaugcccgugaacacggucgcccucaaggugccggccaaccccgccagcguguccaccguccccagcaagcugcccaccuccagcaagccgcccggggcggugcccuccaacgcccugaccaaccccgccccgagcaagcuccccaucaacuccacgcgcgccggcauggugcccagcaaggucccgaccuccauggugcugaccaaggugagcgccagcaccguccccacggacggguccagccggaacgaggagacccccgcggcccccaccccggccggcgccaccggcggguccagcgccuggcuggacuccagcuccgagaaccgcggccucgggagcgagcuguccaagcccggcgugcuggcgagccagguggacucccccuucagcgggugcuucgaggaccucgccaucuccgccagcacgucccugggcaugggccccugccacgggccggaggagaacgaguacaagagcgagggcaccuucgggauccacgucgccgagaaccccuccauccagcugcucgagggcaaccccgggcccccggcggaccccgacggcggcccccggccccaggccgaccgcaaguuccaggagcgggaggugccgugccaccgccccagccccggggcccuguggcuccagguggccgucaccggcgugcugguggucacccugcuggugguccucuaccggcgccggcugcacuga

SEQ ID NO: 32737 - RNA, 483 nt, Artificial Sequence
  derived and/or modified sequence opt1 from MAX__Homo_sapiens__NP_002373
augagcgacaacgacgacaucgagguggaguccgacgaggagcagccccgcuuccagagcgccgccgacaagcgggcgcaccacaacgcccuggagcgcaagcggcgcgaccacaucaaggacuccuuccacagccuccgggacuccgugccgagccugcagggcgagaaggccucccgcgcccagauccuggacaaggccaccgaguacauccaguacaugcggcgcaagaaccacacccaccagcaggacaucgacgaccucaagcggcagaacgcgcugcuggagcagcagguccgcgcccucgagaaggcccggagcuccgcccagcugcagacgaacuaccccagcuccgacaacagccuguacaccaacgcgaagggguccaccaucagcgccuucgacggcggguccgacagcuccagcgaguccgagcccgaggagccccagagccgcaagaagcuccggauggaggccagcuga

SEQ ID NO: 32738 - RNA, 1482 nt, Artificial Sequence
  derived and/or modified sequence opt1 from MAZ__Homo_sapiens__NP_001036004
auguuccccguguuccccugcacccugcucgccccgcccuuccccguccugggccuggacagccgcggggugggcgggcucaugaacuccuucccgccgccccagggccacgcccagaacccccuccaggugggggcggagcugcagagccgguucuucgccucccagggcugcgcccagagccccuuccaggccgcccccgcgccgccgcccacgccccaggcccccgccgccgagccccugcaggucgaccugcugcccgugcucgcggccgcccaggaguccgccgccgcggccgccgccgccgcggccgccgccgccgcgguggccgccgccccgcccgcccccgcggccgccagcaccgucgacaccgccgcgcugaagcagccgcccgccccgccgcccccgcccccgcccguguccgcccccgccgccgaggcggcgccgcccgccagcgccgccaccaucgcggccgccgccgccaccgcgguggucgcccccacguccaccguggccguggcccccgucgcgagcgcccuggagaagaagaccaaguccaagggccccuacaucugcgcccucugcgccaaggaguucaagaacggguacaaccugcgccggcacgaggccauccacaccggcgcgaaggccgggcgcgugcccagcggcgccaugaagaugcccacgauggugccccugucccuccugagcgucccccagcuguccggggccggcggcgggggcggggaggccggcgcgggcgggggcgccgccgccguggccgccgggggcguggucaccaccaccgccagcgggaagcggauccgcaagaaccacgccugcgagaugugcggcaaggccuuccgggacguguaccaccucaaccgccacaagcugucccacagcgacgagaagcccuaccagugccccgugugccagcagcgguucaagcgcaaggaccggauguccuaccacguccgcagccacgacggcgcggugcacaagcccuacaacugcagccacugcgggaaguccuucagccggcccgaccaccugaacucccacgugcgccagguccacagcacggagcggcccuucaagugcgagaagugcgaggccgccuucgccaccaaggaccgccuccgggcccacaccgugcgccacgaggagaagguccccugccacgugugcggcaagaugcuguccagcgcguacaucuccgaccacaugaaggugcacagccaggggccccaccacgucugcgagcugugcaacaagggcuucaccacggccgccuaccuccggauccacgccgugaaggaccacgggcugcaggcgccccgcgccgaccggauccugugcaagcucugcuccgugcacugcaagacccccgcccagcuggccggccacaugcagacccaccugggcggggccgccccgcccguccccggcgacgcgccccagccccagccgaccugcuga

SEQ ID NO: 32739 - RNA, 1569 nt, Artificial Sequence
  derived and/or modified sequence opt1 from MB21D1__Homo_sapiens__NP_612450
augcagcccuggcacggcaaggccaugcagcgcgccagcgaggcgggggccaccgccccgaaggccuccgcccggaacgcgcgcggcgcccccauggaccccaccgagagccccgccgccccggaggcggcccugcccaaggccgggaaguucggccccgcccggaaguccgggagccgccagaagaaguccgcccccgacacgcaggagcggccgcccgugcgcgcgaccggcgcccgggccaagaaggcgccccagcgcgcccaggacacccagcccagcgacgccaccuccgccccgggcgccgaggggcucgagccgcccgccgcccgggagcccgcgcugagccgcgccggcuccugccggcagcgcggggcccggugcagcacgaagccccggcccccgcccggccccugggacguccccucccccgggcugcccgugagcgccccgauccucgugcggcgcgacgccgcgcccggcgccuccaagcugcgggccguccuggagaagcucaagcugagccgcgacgacaucuccaccgccgcgggcauggugaaggggguggucgaccaccuccugcugcggcugaagugcgacagcgccuuccgcggcguggggcuccugaacaccggcuccuacuacgagcacgugaagaucagcgcccccaacgaguucgacgucauguucaagcuggaggugccccggauccagcucgaggaguacuccaacacccgcgccuacuacuucgugaaguucaagcgcaacccgaaggagaacccccugagccaguuccuggagggcgagauccucagcgccuccaagaugcugagcaaguuccggaagaucaucaaggaggagaucaacgacaucaaggacacggacgucaucaugaagcgcaagcgcgggggcucccccgcggugacccugcucaucagcgagaagaucuccguggacaucacccuggcccuggagagcaaguccagcuggccggccuccacccaggaggggcuccgcauccagaacuggcugagcgccaagguccggaagcagcugcgccucaagcccuucuaccuggugcccaagcacgccaaggagggcaacggguuccaggaggagacguggcggcuguccuucagccacaucgagaaggagauccucaacaaccacggcaaguccaagaccugcugcgagaacaaggaggagaagugcugccgcaaggacugccugaagcugaugaaguaccuccuggagcagcugaaggagcgguucaaggacaagaagcaccucgacaaguucagcuccuaccacgugaagaccgcguucuuccacgucugcacccagaacccccaggacagccagugggaccgcaaggaccugggccugugcuucgacaacugcgugacguacuuccuccagugccugcggaccgagaagcuggagaacuacuucaucccggaguucaaccucuucuccagcaaccugaucgacaagcgcuccaaggaguuccugaccaagcagaucgaguacgagcggaacaacgaguuccccguguucgacgaguucuga

SEQ ID NO: 32740 - RNA, 1476 nt, Artificial Sequence
  derived and/or modified sequence opt1 from MB21D2__Homo_sapiens__NP_848591
augaagauggccgcccccaccgcgaacaaggccgccagccugggcugcaacaacaagccggccuuccccgagcucgacuuccgcuccggggcccggguggaggagcugaacaagcugauccaggaguucaccaagcacgaccagcgcgaguacgacgaccagcgggcgcucgagauccacacggccaaggacuucaucuucagcaugcugggcaugguccagaagcuggaccagaagcuccccguggccaacgaguaccugcugcucuccgggggcgugcgcgagggggucguggaccuggaccuggacgagcucaacguguacgcccggggcaccgacuacgacauggacuucacccugcugguccccgcgcucaagcugcacgaccgcaaccagccggugacccuggacaugcggcacagcgcccucugccacuccuggcugagccugcgccucuucgacgagggcacgaucuccaaguggaaggacugcugcaccaucguggaccacaucaacggggccaccaacuacuucuucagccccaccaaggucgccgacugguucuacgacuccaucagcaucgugcuguccgagauccagaagaagccccagcggggcaugcccaagguggagaaggucgagaagaacgggacgaucaucagcaucauccugggcgugggguccagccgcaugcucuacgacaucgugccggucguguccuucaagggcuggcccgccguggcgcagagcuggcugauggagaaccacuucugggacggcaagaucaccgaggaggaggucaucuccggguucuaccuggugcccgccugcagcuacaagggcaagaaggacaacgaguggcggcucuccuucgcccgcagcgaggugcagcugaagaagugcaucagcuccagccugaugcaggccuaccaggccugcaaggcgaucaucaucaagcuccugucccggcccaaggccaucagcccguaccaccuccgcuccaugaugcugugggccugcgaccggcugcccgccaacuaccuggcccaggaggacuacgcggcccacuuccuccuggggcugaucgacgaccuccagcacugccuggucaacaagaugugccccaacuacuucaucccccagugcaacaugcuggagcaccucagcgaggagaccgugaugcugcacgcccgcaagcuguccagcgugcgguccgacccggccgagcaccuccgcaccgccaucgagcacgucaaggcggccaaccggcugacgcuggagcuccagcgccggggcagcaccaccuccauccccagcccccaguccgacggcggggaccccaaccagccggacgaccgccuggccaagaagcugcagcagcuggugaccgagaaccccggcaagagcaucuccgucuucaucaaccccgacgacgugacgcgcccccacuuccggaucgacgacaaguucuucuga

SEQ ID NO: 32741 - RNA, 1968 nt, Artificial Sequence
  derived and/or modified sequence opt1 from MBD1__Homo_sapiens__NP_001191065
auggccgaggacuggcuggacugccccgcccucggccccggguggaagcgccgggagguguuccgcaagagcggcgcgaccugcgggcgguccgacaccuacuaccagagccccacgggcgaccgcauccgguccaaggucgagcugacccgcuaccuggggcccgccugcgaccucacccuguucgacuucaagcagggcauccugugcuaccccgccccgaaggcccaccccguggccguggcgagcaagaagcggaagaagcccucccgccccgccaagacccggaagcgccaggucggcccgcagagcggggaggugcggaaggaggcgccccgcgacgagacgaaggccgacaccgacaccgcccccgccuccuuccccgccccgggcugcugcgagaacugcgggaucagcuucuccggcgacgggacccagcggcagcgccucaagacgcugugcaaggacugccgggcccagcgcaucgccuucaaccgggagcagcgcauguucaagcgggugggcugcggcgagugcgcggccugccaggucaccgaggacugcggggccugcagcacgugccugcuccagcugccccacgacguggccuccggccuguucugcaagugcgagcgccggcgcugccuccgcaucguggagcggagccgcgggugcggcgucugccggggcugccagacccaggaggacugcgggcacugccccaucugccugcggcccccgcgccccggccugcgccggcaguggaagugcgugcagcgccggugccuccgcgggaagcacgcccggcgcaagggcgggugcgacuccaagauggcggcccggcgccggcccggcgcccagccccugccgcccccgccgcccagccagucccccgagcccaccgagccccacccccgcgcccuggcccccagcccgcccgcggaguucaucuacuacugcguggacgaggacgagcuccagcccuacaccaaccggcgccagaaccggaagugcggcgccugcgccgccugccugcgccgcauggacugcgggcggugcgacuucugcugcgacaagcccaaguucggcggguccaaccagaagcgccagaagugccgguggcgccagugccugcaguucgccaugaagcggcuccugcccagcgucugguccgagagcgaggacggcgcggggagcccgccgcccuaccgccggcgcaagcggcccuccagcgcccgccggcaccaccugggccccacccucaagcccacccuggccacgcgcaccgcccagcccgaccacacccaggcgcccaccaagcaggaggccggcgggggcuucgugcugccgccgcccgggacggaccucguguuccugcgggagggcgccuccagccccguccaggugcccgggcccguggccgccuccaccgaggcgcugcuccaggaggcccagugcagcggccuguccugggucguggcccugccccaggugaagcaggagaaggccgacacccaggacgaguggacccccggcacggccguccucaccagcccggugcuggugcccgggugccccuccaaggcggucgaccccggccugccgagcgugaagcaggagccgcccgaccccgaggaggacaaggaggagaacaaggacgacuccgccagcaagcucgcccccgaggaggaggccgggggcgccggcacccccgucaucaccgagaucuucucccucgggggcacgcgcuuccgggacaccgcgguguggcugcccagccugcaggggcgccacuccggccgggaggacgggugcaaggugugggagaccgaggacaccgucgagccgacgagcaccuccuggaacccccgcggcuggcccggcacccacgugagccugagcccgccgcccgccuccaugaugugggugagcugccggcgcuccuggugccccagcucccagagcuga

SEQ ID NO: 32742 - RNA, 1236 nt, Artificial Sequence
  derived and/or modified sequence opt1 from MBD2__Homo_sapiens__NP_003918
augcgcgcccaccccggcgggggccggugcugcccggagcaggaggagggggagagcgccgcgggcggguccggcgccggcggggacagcgccaucgagcagggcgggcagggcuccgcccuggcccccagccccguguccggggugcgccgggagggcgcgcgcggcgggggccgggggcgcggccgguggaagcaggccggccgcgggggcggggugugcggccgggggcgcggccggggccgcgggcggggccgcgggcggggccgcgggcggggccgcggccggcccccgagcgggggcuccgggcucggcggggacggcggcgggugcggcgggggcggcagcgggggcgggggcgcgccccgccgggagcccgugcccuucccguccgggagcgccggccccggcccccgcgggccccgcgccaccgaguccggcaagcggauggacugcccggcccugccgcccggguggaagaaggaggaggucauccgcaagagcggccuguccgccggcaagagcgacguguacuacuucucccccagcgggaagaaguuccgguccaagccccagcucgcccgcuaccugggcaacaccguggaccugagcuccuucgacuuccggacggggaagaugaugcccagcaagcuccagaagaacaagcagcgccugcggaacgacccccugaaccagaacaagggcaagcccgaccucaacaccacccugccgauccgccagaccgccagcaucuucaagcagcccgucacgaaggugaccaaccaccccuccaacaaggucaagagcgacccccagcggaugaacgagcagccgcgccagcuguucugggagaagcggcuccaggggcuguccgcgagcgacgugaccgagcagaucaucaagaccauggagcugcccaagggccuccagggggugggccccggcuccaacgacgagacgcugcugagcgccguggccuccgcccuccacaccagcuccgcccccaucaccgggcaggucagcgcggccguggagaagaacccggccguguggcugaacaccucccagccccugugcaaggccuucaucgucacggacgaggacauccgcaagcaggaggagcgggugcagcagguccgcaagaagcucgaggaggcccugauggcggacauccugagccgggccgccgacaccgaggagauggacaucgagauggacuccggcgacgaggccuga

SEQ ID NO: 32743 - RNA, 876 nt, Artificial Sequence
  derived and/or modified sequence opt1 from MBD3__Homo_sapiens__NP_001268382
auggagcgcaagcggugggagugccccgcccugccgcagggcugggagcgcgaggaggugccccggcgcagcgggcucuccgccggccaccgggacgucuucuacuacagccccuccgggaagaaguuccgcagcaagccccagcuggcccgguaccugggcggguccauggaccucagcaccuucgacuuccgcaccggcaagaugcugauguccaagaugaacaagagccggcagcgcgugcgguacgacuccagcaaccaggugaagggcaagccggaccugaacacggcccuccccguccgccagaccgccuccaucuucaagcagcccgugaccaagaucaccaaccaccccagcaacaaggugaaguccgacccgcagaaggccgucgaccagccccggcagcuguucugggagaagaagcugagcgggcucaacgccuucgacaucgcggaggagcuggugaagacgauggaccugcccaagggccuccagggggugggccccgggugcaccgacgagacccugcuguccgccaucgccagcgcccuccacaccuccacgaugccgaucaccggccagcugagcgcggccgucgagaagaaccccggcguguggcugaacaccacccagccccucugcaaggccuucauggugacggacgaggacauccgcaagcaggaggagcugguccagcagguccggaagcgccuggaggaggcccucauggccgacaugcuggcgcacguggaggagcuggcccgggacggggaggcgccccucgacaaggccugcgccgaggacgacgacgaggaggacgaggaggaggaggaggaggagccggaccccgaccccgagauggagcacguguga

SEQ ID NO: 32744 - RNA, 627 nt, Artificial Sequence
  derived and/or modified sequence opt1 from MBD3L2__Homo_sapiens__NP_653215
augggcgagcccgccuucaccagcuuccccucccugcccgugcucgggaagcugaagcgcaacaugaugcccugggcccugcagaagaagcgggagauccacauggcgaaggcccaccgccggcgcgccgcccggagcgcccuccccaugcgccugaccuccugcaucuuccggcgcccggucacgcggauccgcagccaccccgacaaccaggugcggcgccggaagggcgacgagcaccuggagaagccccagcagcucugcgcguaccgccggcugcaggcccugcagcccugcuccagccagggggagggcuccagcccgcuccaccuggaguccgugcugagcauccucgcccccgggaccgccggcgagucccuggaccgcgcgggcgccgagcggguccgcagcccccuggagcccaccccggggcgguuccccgccguggccggcgggcccacccccggcauggggugccagcucccgccgccccuguccggccagcuggugacgcccgccgacauccgccggcaggcgcgccgcgucaagaaggcccgggagcgccucgccaaggcccugcaggccgaccggcuggcgcgccgggccgagaugcucaccggcggguga

SEQ ID NO: 32745 - RNA, 1725 nt, Artificial Sequence
  derived and/or modified sequence opt1 from MBD4__Homo_sapiens__NP_001263199
augggcaccaccgggcuggagagccucucccugggcgaccgcggggccgcccccacggugaccagcuccgagcggcuggugccggacccgcccaacgaccuccgcaaggaggacguggcgauggagcuggagcgggugggcgaggacgaggagcagaugaugaucaagcgcagcuccgagugcaacccccugcuccaggagcccaucgccagcgcccaguucggggccaccgccggcaccgagugccggaaguccguccccugcggcugggagcgcguggugaagcagcggcuguucgggaagacggcgggccgcuucgacgucuacuucaucagcccccaggggcugaaguuccgguccaagagcucccucgccaacuaccugcacaagaacggcgagaccagccugaagcccgaggacuucgacuucaccgugcucuccaagcgcgggaucaagagccgguacaaggacugcuccauggccgcccugaccagccaccuccagaaccaguccaacaacagcaacuggaaccugcgcacgcgguccaagugcaagaaggacguguucaugccgcccagcagcuccagcgagcugcaggagucccgcggccugagcaacuucaccuccacccaccuccugcugaaggaggacgagggcgucgacgacgugaacuuccggaaggugcgcaagcccaaggggaaggucaccauccucaagggcauccccaucaagaagacgaagaaggggugccgcaagagcugcuccggcuucgugcagagcgacuccaagcgggagagcgugugcaacaaggcggacgccgaguccgagccggucgcccagaagucccagcuggaccggaccgugugcaucagcgacgccggcgccugcggggagacccugagcgugaccuccgaggagaacagccucgucaagaagaaggagcgcucccugagcuccggcagcaacuucugcagcgagcagaagacguccgggaucaucaacaaguucugcagcgcgaaggacuccgagcacaacgagaaguacgaggacaccuuccuggagagcgaggagaucggcaccaagguggagguggucgagcggaaggagcaccuccacaccgacauccugaagcgcggguccgagauggacaacaacugcagccccacgcgcaaggacuucaccgaggacaccaucccccggacccagaucgagcgccggaagacgucccuguacuucagcuccaaguacaacaaggaggcccucagcccgccccgccggaaggccuucaagaaguggaccccgccccgcucccccuucaaccuggugcaggagacccuguuccacgaccccuggaagcuccugaucgccaccaucuuccugaaccggacgagcggcaagauggccauccccgugcucuggaaguuccuggagaaguaccccuccgcggaggucgcccgcaccgccgacuggcgggacgugagcgagcugcucaagccccugggccuguacgaccuccgcgccaagaccaucgucaaguucuccgacgaguaccugaccaagcaguggaaguacccgaucgagcugcacgggaucggcaaguacgggaacgacagcuaccggaucuucugcgugaacgaguggaagcagguccaccccgaggaccacaagcucaacaaguaccacgacuggcugugggagaaccacgagaagcugucccucagcuga

SEQ ID NO: 32746 - RNA, 4485 nt, Artificial Sequence
  derived and/or modified sequence opt1 from MBD5__Homo_sapiens__NP_060798
augaacggcgggaaggagugcgacggcggggacaaggagggcgggcugcccgccauccaggugccggucggcuggcagcgccggguggaccagaacggcgugcucuacgucagccccuccgggagccugcuguccugccucgagcaggugaagaccuaccugcugaccgacggcacgugcaagugcgggcucgagugcccccugauccugcccaagguguucaacuucgacccgggcgccgcggucaagcagcgcaccgccgaggacgugaaggccgacgaggacgugaccaagcucugcauccacaagcggaagaucaucgccgucgccacccugcacaagagcauggaggcgccccaccccucccuggugcucacgagccccgggggcggcaccaacgccaccccggugguccccucccgcgccgccaccccccggagcgugcgcaacaagucccacgaggggaucacgaacagcgugaugcccgagugcaagaacccguucaagcugaugaucggcuccagcaacgcgauggggcggcuguacguccaggagcuccccggcucccagcagcaggagcugcaccccguguacccccgccagcggcugggcagcuccgagcacgggcagaagagcccguuccgcggcucccacgggggccuccccagccccgccuccagcgggagccagaucuacggcgacggcuccaucagcccccggaccgacccgcuggggucccccgacguguucacccgcagcaaccccggcuuccacggggcccccaacuccagcccgauccaccugaaccggaccccccucuccccccccagcgucaugcugcacggcuccccggugcagagcuccugcgccauggccgggcgcacgaacaucccccugagccccacccucaccaccaaguccccggugaugaagaagcccaugugcaacuucagcacgaacauggagaucccccgggcgauguuccaccacaagcccccgcagggccccccccccccgcccccccccuccugcgcccugcagaagaagccgcugaccagcgagaaggacccccucggcauccuggaccccauccccuccaagccggucaaccagaaccccgugaucaucaaccccaccagcuuccacuccaacgugcacagccagguccccaugaugaacgugagcaugccgcccgccgucgugccccugcccuccaaccucccgcugcccaccgugaagcccgggcacaugaaccacggcagccacguccagcgcgugcagcacuccgccagcacgucccugagcccgucccccgugaccagccccguccacaugauggggaccggcaucgggcggaucgaggccuccccccagcgcagccgguccagcuccaccagcuccgaccacggcaacuucaugaugccgcccgugggcccccaggcgacgagcuccgggaucaaggugcccccgcgcagcccccggagcaccaucggcuccccccgccccagcaugccguccagccccuccaccaagagcgacgggcaccaccaguacaaggacauccccaacccccucaucgccggcaucuccaacguccugaacaccccgagcuccgccgccuuccccacggccagcgcgggcuccagcuccgugaagagccagcccgggcugcucggcaugccccugaaccagauccugaaccagcacaacgccgccuccuucccggccagcucccuccugagcgccgcggccaaggcccagcuggccaaccagaacaagcucgcggggaacaacuccagcagcuccagcaacuccggcgccguggccgggagcggcaacaccgagggccacuccacccugaacaccauguucccccccacggccaacaugcugcuccccaccggggagggccagagcgggcgcgccgcgcugcgggacaagcugaugucccagcagaaggacgcccuccgcaagcggaagcagccgcccaccaccguccugagccugcugcgccagucccagauggacagcuccgccgugcccaagcccggcccggaccuccugcggaagcaggggcagggcagcuuccccaucuccagcaugucccagcugcuccagagcauguccugccagagcucccaccugagcagcaacuccacgcccggcugcggggccagcaacaccgcccugccgugcuccgcgaaccagcuccacuucaccgaccccagcaugaacuccagcgugcugcagaacaucccccugcgcggcgaggccguccacugccacaacgccaacaccaacuucgugcacuccaacagccccgugccgaaccaccaccucgccgggcugaucaaccagauccaggccuccggcaacugcgggaugcugagccaguccggcauggcgcucggcaacagccugcaccccaaccccccccagucccggaucagcaccuccagcacgccggucauccccaacuccaucgugagcuccuacaaccagaccagcagcgaggccgggggcuccgggcccagcuccagcaucgccaucgccggcaccaaccaccccgcgaucaccaagacgaccuccgugcugcaggacggggucaucgugaccaccgccgccggcaacccgcuccagagccagcugcccaucggcuccgacuuccccuucguggggcaggagcacgcccugcacuuccccagcaacuccacgagcaacaaccaccucccgcacccccugaaccccucccugcucagcucccugcccaucagccugccggucaaccagcagcaccuccugaaccagaaccugcucaacauccugcagcccuccgccggcgagggggacaugagcuccaucaacaacacccugagcaaccaccagcucacccaccugcagucccugcucaacaacaaccagauguucccccccaaccagcagcagcagcagcugcugcagggcuaccagaaccuccaggcguuccagggccagagcaccaucccgugccccgccaacaacaaccccauggccugccuguuccagaacuuccaggugcgcaugcaggaggacgccgcccugcucaacaagcggaucagcacgcagcccgggcugaccgcgcugccggagaaccccaacaccacccuccccccguuccaggacacgcccugcgagcugcagccccgcaucgaccccucccugggccagcaggugaaggacgggcucgucgugggcgggccgggcgacgccagcguggacgccaucuacaaggccgucguggacgccgcguccaagggcaugcagguggucaucaccaccgccgugaacagcaccacgcagaucucccccauccccgcccugagcgccauguccgcguucaccgccagcaucggggacccccugaaccucuccagcgccguguccgccgucauccacggccggaacauggggggcguggaccacgacgggcgccugcggaacagccgcggcgcccggcugccgaagaaccucgaccacggcaagaacgugaacgagggggacggcuucgaguacuucaaguccgcgagcugccacaccuccaagaagcagugggacggggagcagagcccccgcggcgagcggaaccgcuggaaguacgaggaguuccuggaccaccccgggcacauccacuccagccccugccacgagcggccgaacaacgucuccacccugcccuuccuccccggcgagcagcaccccauccugcugccgccccgcaacugccccggcgacaagauccucgaggagaacuuccgcuacaacaacuacaagcggacgaugaugagcuucaaggagcgccuggagaacaccguggagcggugcgcccacaucaacgggaaccgcccccggcagagccgcggcuucggggagcugcucuccaccgccaagcaggaccuggugcuggaggagcagagcccguccagcuccaacagccucgagaacucccuggucaaggacuacauccacuacaacggcgacuucaacgccaagagcgugaacggcugcgugcccucccccagcgacgccaaguccaucagcuccgaggacgaccugcggaaccccgacagcccguccagcaacgagcucauccacuaccgcccccggaccuucaacgucggggaccugguguggggccagaucaaggggcugacguccuggcccggcaagcucgugcgcgaggacgacguccacaacagcugccagcagagcccggaggaggggaagguggagcccgagaagcugaagacccugaccgagggccucgaggcguacucccgggugcgcaagcggaaccgcaagagcggcaagcugaacaaccaccuggaggccgccauccacgaggccauguccgagcucgacaagaugagcgggaccguccaccagaucccccagggcgaccggcagaugcgccccccgaagcccaagcggcgcaagaucucccgguga

SEQ ID NO: 32747 - RNA, 3012 nt, Artificial Sequence
  derived and/or modified sequence opt1 from MBD6__Homo_sapiens__NP_443129
augaacggcgggaacgagagcuccggcgccgaccgcgccgggggccccguggcgaccagcgucccgaucggguggcagcggugcgugcgcgagggcgccgugcuguacaucucccccagcggcaccgagcucuccagccuggagcagacgcgguccuaccugcucagcgacgggaccugcaagugcggccuggagugcccccugaacguccccaagguguucaacuucgacccgcucgcccccgugacccccgggggcgccggggucggccccgccuccgaggaggacaugaccaagcugugcaaccaccgccggaaggcgguggccauggccacgcuguaccgcagcauggagaccaccugcucccacagcuccccgggcgagggggccagcccccagauguuccacaccgugucccccggccccccgagcgcgcggccccccugccgcguccccccgacgaccccccucaacgggggccccggcucccugcccccggagccccccagcgugucccaggccuuccccacccuggccgggccgggcgggcucuuccccccccggcuggccgaccccgugccgagcggcgggagcuccagcccccgcuuccugccccggggcaacgccccgucccccgcgccccccccgccccccgccaucagccucaacgcccccuccuacaacuggggcgccgcccugcgcagcucccuggucccgagcgaccucggguccccccccgcgccccacgccagcuccagcccgcccuccgaccccccccuguuccacugcagcgacgcccugaccccgcccccccuccccccguccaacaaccugcccgcccaccccggccccgccagccagccgcccguguccagcgcgacgaugcaccugccccucgugcuggggccgcugggcggggcccccaccgucgagggccccggcgcccccccguuccucgccuccagccugcugagcgccgcggccaaggcccagcaccccccccuccccccgcccuccacccugcaggggcggcgcccccgggcccaggcgcccagcgccucccacagcuccagccugcgcccgucccagcggcgcccccggcgcccccccaccguguuccggcuccuggagggccgcgggccgcagacgccccgccggagccgcccccgggcccccgccccggugccccagcccuucucccugcccgagccgagccagcccauccuccccuccguccugagccugcucggccugcccaccccggggcccucccacagcgacggcuccuucaaccugcucggcagcgacgcccaccugcccccgccccccacccuguccagcgggagccccccgcagccccgccaccccauccagcccucccucccgggcaccacgagcgggucccugagcuccgugcccggcgcgcccgcccccccggccgccagcaaggcccccgugguccccucccccgugcugcagagcccguccgagggccucgggaugggcgcggggcccgccugcccccugcccccgcuggccggcggggaggccuuccccuuccccagccccgagcagggccuggcccucuccggcgcgggguucccgggcaugcugggggcccugccccucccccugagccugggccagcccccgcccuccccccuccugaaccacagccuguucggggugcucaccggcggcgggggccagccgccccccgagccccugcugccgccccccgggggccccgggccgccccucgcccccggcgagcccgagggcccgucccugcuggucgccagccuccugcccccccccccguccgaccugcuccccccccccagcgcgccgcccuccaaccugcuggccagcuuccucccccugcuggcccucgggcccaccgccggcgacggggagggcagcgccgagggggcgggcggcccguccggggagcccuucagcggccugggggaccuguccccccuccuguucccgccccugagcgccccccccacccucaucgcccugaacuccgcccugcucgccgcgacgcuggacccgcccagcggcacccccccccagccgugcgugcuguccgccccccagcccggccccccgaccagcuccgucaccacggccaccaccgaccccggggccagcucccucggcaaggcccccagcaacuccgggcggcccccgcagcugcugagcccccuccugggcgcgucccugcucggggaccugagcucccugaccagcucccccggcgcccuccccagccugcugcagccgcccggcccccuccugagcgggcagcugggccuccagcugcugcccgggggcggggccccgcccccccucuccgaggccagcuccccccuggcgugccugcuccagagccugcagaucccgcccgagcagcccgaggccccgugccugccccccgagucccccgccagcgcccucgagccggagcccgcccgccccccccuguccgcgcuggccccgccccacggcagccccgaccccccggugcccgagcuccugacgggccggggguccggcaagcgcgggcggcgcggcgggggcggccugcgggggaucaacggcgaggcccgccccgcccgggggcgcaagcccggcagccggcgcgagccgggccggcucgcccugaagugggggacccgcggcggguucaacggccagauggagcgguccccccgccgcacccaccacuggcagcacaacggggagcuggcggagggcggcgccgagcccaaggaccccccgccccccgggccccacagcgaggaccucaaggugccgcccggcgucgugcggaagucccgccgggggcgccggcgcaaguacaaccccacccggaacagcaacuccagccgccaggacaucacgcuggagcccuccccgaccgcccgggccgccgugccccugcccccgcgcgcgcggcccggccgccccgccaagaacaagcggcgcaagcucgcccccuga

SEQ ID NO: 32748 - RNA, 465 nt, Artificial Sequence
  derived and/or modified sequence opt1 from MB__Homo_sapiens__XP_005261662
augggccugagcgacggggaguggcagcucgugcugaacgucuggggcaagguggaggccgacauccccgggcacggccaggaggugcugauccgccucuucaaggggcacccggagacccuggagaaguucgacaaguucaagcaccugaaguccgaggacgagaugaaggccagcgaggaccucaagaagcacggcgcgaccguccugacggcccugggcgggauccucaagaagaagggccaccacgaggccgagaucaagccccuggcccagucccacgccaccaagcacaagauccccgugaaguaccuggaguucaucagcgagugcaucauccaggugcuccaguccaagcaccccggggacuucggcgcggacgcccagggggccaugaacaaggcccuggagcuguuccggaaggacauggcgagcaacuacaaggagcucggcuuccagggcuga

SEQ ID NO: 32749 - RNA, 1032 nt, Artificial Sequence
  derived and/or modified sequence opt1 from MBIP__Homo_sapiens__NP_001138363
auggccgccgcgaccgagcugaaccgccccagcuccggcgaccggaaccucgagcgccggugccgcccgaaccugagccgggaggugcuguacgagaucuuccgcucccuccacacccuggucgggcagcuggaccuccgggacgacguggugaagaucacgaucgacuggaacaagcugcagagccuguccgccuuccagcccgcccuccuguucagcgcccuggagcagcacauccucuaccugcagcccuuccuggccaagcuccagucccccaucaaggaggagaacaccaccgcggucgaggagaucggccgcaccgagauggggaacaagaacgaggugaacgacaaguucagcaucggcgaccugcaggaggaggagaagcacaaggaguccgaccugcgggacgugaagaagacgcagauccacuucgacccggaggucgugcagaucaaggccgggaaggccgagaucgaccgccggaucagcgccuucaucgagcgcaagcaggcggagaucaacgagaacaacgugcgggaguucugcaacgucaucgacugcaaccaggagaacuccugcgcccgcaccgacgccaucuucacccccuaccccggcuucaagagccacgugaaggugucccgggucgugaacaccuacggcccccagacgcgcccggaggggauccccggcagcgggcacaagcccaacuccaugcuccgggacugcggcaaccaggccguggaggagcgccugcagaacaucgaggcccaccuccggcugcagaccgggggccccgucccgcgcgacaucuaccagcggaucaagaagcuggaggacaagauccuggagcucgagggcaucagccccgaguacuuccaguccgugagcuucuccgggaagcgccgcaaggugcagccgccccagaacuacagccuggcggagcuggacgagaagaucagcgcccucaagcaggcccugcugcggaagucccgcgaggccgagagcauggccacccaccaccuccccuga

SEQ ID NO: 32750 - RNA, 747 nt, Artificial Sequence
  derived and/or modified sequence opt1 from MBL2__Homo_sapiens__XP_011538118
augagccuguuccccucccucccgcugcugcuccugagcaugguggccgccuccuacagcgagaccgugaccugcgaggacgcgcagaagacgugccccgccgugaucgccugcuccagccccggcaucaacggguuccccggcaaggacgggcgcgacggcaccaagggggagaagggcgagccgggccaggggcugcggggccuccaggggccgcccggcaagcuggggccgcccggcaaccccggccccuccgggagccccggccccaaggggcagaagggcgaccccggcaagucccccgacggggacagcucccuggccgccagcgagcgcaaggcgcuccagaccgagauggcccggaucaagaaguggcugaccuucucccugggcaagcaggucgggaacaaguucuuccucacgaacggcgagaucaugaccuucgagaaggucaaggcccugugcgugaaguuccaggccagcguggcgacgccccgcaacgccgccgagaacggggccauccagaaccugaucaaggaggaggccuuccucggcaucaccgacgagaagaccgagggccaguucgucgaccugaccgggaaccggcugaccuacaccaacuggaacgagggcgagccgaacaacgcgggguccgacgaggacugcgugcuccugcugaagaacggccaguggaacgacgugcccugcagcacgucccaccucgccgucugcgaguuccccaucuga

SEQ ID NO: 32751 - RNA, 1149 nt, Artificial Sequence
  derived and/or modified sequence opt1 from MBNL1__Homo_sapiens__NP_066368
auggccgugagcgucacccccauccgcgacaccaaguggcugacgcucgaggugugccgggaguuccagcgcgggaccugcucccggccggacaccgagugcaaguucgcccaccccagcaaguccugccagguggagaacggccgcgucaucgcgugcuucgacagccugaagggccggugcucccgcgagaacugcaaguaccugcacccgccgccccaccucaagacccagcuggagaucaacgggcggaacaaccugauccagcagaagaacauggccaugcucgcccagcagaugcagcuggccaacgccaugaugcccggcgcgccccugcagcccgugcccauguucagcguggcccccucccucgccacgaacgccagcgcggccgccuucaaccccuaccuggggcccgucuccccgagccuggugcccgccgagauccuccccaccgcccccaugcuggugaccggcaacccgggcguccccgugcccgcggccgccgccgccgcggcccagaagcugaugcgcaccgaccggcucgaggugugccgcgaguaccagcgggggaacugcaaccgcggcgagaacgacugccgguucgcccaccccgccgacuccacgaugaucgacaccaacgacaacaccgucaccgugugcauggacuacaucaaggggcgcugcagccgggagaagugcaaguacuuccacccgcccgcccaccuccaggcgaagaucaaggccgcccaguaccaggugaaccaggccgccgcggcccaggccgccgcgacggccgccgccaugggcaucccccaggccguccugcccccgcugcccaagcgccccgcgcuggagaagaccaacggggccaccgccguguucaacaccggcaucuuccaguaccagcaggcccuggccaacaugcagcuccagcagcacacggcguuccugcccccgggcuccauccugugcaugacccccgccaccagcgugguccccauggugcacggggccaccccggccacgguguccgccgcgaccaccagcgccaccuccguccccuucgccgccacggcgaccgccaaccagauccccaucaucagcgccgagcaccucaccucccacaaguacgugacccagauguga

SEQ ID NO: 32752 - RNA, 1104 nt, Artificial Sequence
  derived and/or modified sequence opt1 from MBNL2__Homo_sapiens__NP_659002
auggcccugaacguggcccccguccgcgacaccaaguggcucacccuggaggugugccggcaguuccagcgcggcacgugcagccgguccgacgaggagugcaaguucgcgcacccgcccaagagcugccagguggagaacgggcgcgucaucgccugcuucgacucccugaagggccggugcagccgcgagaacugcaaguaccuccacccgcccacccaccugaagacccagcuggagaucaacgggcggaacaaccucauccagcagaagaccgccgccgccaugcuggcgcagcagaugcaguucauguuccccggcacgccccugcaccccgugcccaccuucccgguggggcccgccaucggcaccaacaccgccaucuccuucgcccccuaccucgcgcccgucacgccgggcguggggcuggugcccaccgagauccugcccaccacccccgucaucgugccgggcagcccgcccgugacgguccccggguccaccgccacccagaagcuccugcgcaccgacaagcuggaggugugccgggaguuccagcgcggcaacugcgcccgcggggagacggacugccgguucgcccaccccgccgacagcaccaugaucgacaccuccgacaacaccgugacggucugcauggacuacaucaagggccggugcaugcgcgagaagugcaaguacuuccacccgcccgcgcaccuccaggccaagaucaaggccgcccagcaccaggccaaccaggcggccguggccgcccaggccgcggccgccgccgccaccgugauggcguucccgcccggcgcccugcacccccugcccaagcggcaggcccucgagaaguccaacgggaccagcgccgucuucaaccccagcgugcugcacuaccagcaggcgcugaccuccgcccagcuccagcagcacgccgccuucauccccacgggcagcgugcugugcaugacccccgccaccuccaucguccccaugaugcacagcgcgaccuccgccacggugagcgccgccaccaccccggccaccuccgugcccuucgcggccacggccaccgccaaccagaucauccugaaguga

SEQ ID NO: 32753 - RNA, 1488 nt, Artificial Sequence
  derived and/or modified sequence opt1 from MBOAT1__Homo_sapiens__NP_001073949
auggccgccgagccccagccgagcucccugagcuaccgcaccaccggcuccacguaccuccacccccugagcgagcugcucgggaucccccuggaccaggugaacuucgucgugugccagcugguggcccucuucgcggccuucugguuccggaucuaccugcgccccggcaccaccuccagcgacguccggcacgccguggccaccaucuucgggaucuacuucgugaucuucugcuucggcugguacuccguccaccuguucgugcucgugcugaugugcuacgcgaucauggucacggccagcguguccaacauccaccgcuacagcuucuucguggccaugggguaccugaccaucugccacaucucccggaucuacaucuuccacuacggcauccucaccaccgacuucagcggcccgcugaugaucgucacgcagaagaucaccacccuggccuuccaggugcacgacgggcucggccgccgggcggaggaccuguccgccgagcagcaccgccuggccaucaaggugaagcccagcuuccucgaguaccuguccuaccugcucaacuucaugagcgucaucgccgggcccugcaacaacuucaaggacuacaucgccuucaucgagggcaagcacauccacaugaagcugcuggaggugaacuggaagcggaagggguuccacucccuccccgagccgagccccaccggcgcggugauccacaagcugggcaucacgcuggucucccuccugcuguuccucacccugaccaagaccuuccccgugacgugccugguggacgacugguucguccacaaggccagcuuccccgcccgccucugcuaccuguacguggugaugcaggccagcaagccgaaguacuacuucgccuggacccuggcggacgccgucaacaacgccgccggguucggcuucuccgggguggacaagaacggcaacuucugcugggaccuccugagcaaccugaacaucuggaagaucgagaccgccaccuccuucaagauguaccucgagaacuggaacauccagacggcgaccuggcugaagugcgucugcuaccagcgggugcccugguaccccaccgugcugaccuucauccucagcgcccuguggcacggcgucuaccccggguacuacuucacguuccugaccggcauccucgugacccuggccgcccgcgccgugcggaacaacuaccgccacuacuuccuguccagccgggcgcucaaggccgucuacgacgccgggaccugggccgugacgcagcuggcgguguccuacaccgucgccccguucgugaugcuggccguggagcccaccaucagccuguacaaguccauguacuucuaccuccacaucaucagccugcugaucauccucuuccugcccaugaagccccaggcccacacccagcgccggccgcagacgcugaacuccaucaacaagcgcaagaccgacuga

SEQ ID NO: 32754 - RNA, 1563 nt, Artificial Sequence
  derived and/or modified sequence opt1 from MBOAT2__Homo_sapiens__NP_620154
auggccaccaccagcacgaccggcuccacccugcuccagccccugagcaacgccgugcagcugccgaucgaccaggucaacuucguggugugccagcuguucgcgcuccuggccgccaucugguuccgcaccuaccuccacuccagcaagacguccagcuucauccggcacgucguggccacccugcuggggcucuaccuggcccuguucugcuucggcugguacgcgcuccacuuccuggugcaguccgggaucagcuacugcaucaugaucaucaucggcgucgagaacaugcacaacuacugcuucguguucgcccugggguaccucaccgugugccaggucacccgcguguacaucuucgacuacggccaguacuccgccgacuucagcggccccaugaugaucaucacgcagaagaucaccucccuggccugcgagauccacgacgggauguuccggaaggacgaggagcugaccagcucccagcgcgaccucgcggugcggcgcaugcccagccugcuggaguaccucuccuacaacugcaacuucaugggcauccuggccgggccccugugcagcuacaaggacuacaucaccuucaucgagggccgguccuaccacaucacgcagagcggggagaacggcaaggaggagacccaguacgagcgcaccgagccgucccccaacaccgccgucgugcagaagcuccuggugugcggccugagccuccuguuccaccugacgaucugcaccacccuccccgucgaguacaacaucgacgagcacuuccaggccaccgccagcuggcccacgaagaucaucuaccuguacaucucccugcucgcggcccggccgaaguacuacuucgccuggacccuggccgacgccaucaacaacgcggccggguucggcuuccgcggguacgacgagaacggcgccgcccggugggaccugaucagcaaccuccgcauccagcagaucgagauguccaccagcuucaagauguuccuggacaacuggaacauccagaccgcccuguggcucaagcgggugugcuacgagcgcacguccuucagccccaccauccagaccuucauccuguccgcgaucuggcacggcguguaccccggguacuaccugaccuuccucacgggcguccugaugacccuggccgcccgggccaugcgcaacaacuuccggcacuacuucaucgagcccagccagcucaagcuguucuacgacgugaucaccuggaucgugacccaggucgccaucuccuacacgguggugccguucguccugcucagcaucaagcccucccugaccuucuacagcuccugguacuacugccugcacauccuggggauccucgugcugcugcuccugcccgucaagaagacccagcgccggaagaacacccacgagaacauccagcugagccaguccaagaaguucgacgagggcgagaacagccucgggcagaacuccuucagcacgaccaacaacgugugcaaccagaaccaggagaucgcgucccgccacagcagccugaagcaguga

SEQ ID NO: 32755 - RNA, 1308 nt, Artificial Sequence
  derived and/or modified sequence opt1 from MBOAT4__Homo_sapiens__XP_011542911
auggaguggcuguggcuguucuuccugcaccccaucagcuucuaccagggcgccgccuucccguucgcgcuccucuucaacuaccugugcaucauggacuccuucagcacccgcgcccgguaccuguuccuccugaccgggggcggggcccuggccguggccgcgaugggcuccuacgccguccucguguucacgcccgccgugugcgccgucgcgcugcugugcagccucgcgccccagcagguccaccgcuggaccuucugcuuccagauguccuggcagacccugugccaccuggggcuccacuacaccgaguacuaccugcacgagcccccgagcgugcgguucugcaucacgcuguccagccucaugcugcugacccagcgcgugaccucccucagccuggacaucugcgagggcaaggugaaggccgccuccggcggguuccggagccgcuccagccuguccgagcacgugugcaaggcccuccccuacuucagcuaccugcuguucuuccccgcccuccugggcgggucccugugcagcuuccagcgguuccaggcccgcguccagggcuccagcgcccuccacccccggcacagcuucugggcccuguccuggcgcgggcugcagauccucggccuggagugccugaacguggccgugagccgggucguggacgcgggcgccgggcucaccgacugccagcaguucgagugcaucuacguggucuggacgaccgccggccuguucaagcugaccuacuacucccacuggauccucgacgacagccugcugcacgccgccggguucggcccggagcucggccagucccccggggaggagggcuacgugcccgacgcggacaucuggacccuggagcgcacgcaccggaucagcguguucucccgcaaguggaaccagagcaccgcccgguggcugcgccggcucgucuuccagcacucccgcgccuggccccugcugcagaccuucgccuucagcgccugguggcacgggcuccacccgggccagguguucggguucgugugcugggcggucaugguggaggccgacuaccugauccacuccuucgccaacgaguucauccggagcuggcccaugcgccuguucuaccggacccugacgugggcccacacccagcucaucaucgcguacaucaugcuggccguggagguccgcucccugagcucccucuggcugcugugcaacagcuacaacuccguguuccccauggucuacugcauccuccugcugcuccuggccaagcgcaagcacaagugcaacuga

SEQ ID NO: 32756 - RNA, 594 nt, Artificial Sequence
  derived and/or modified sequence opt1 from MBP__Homo_sapiens__NP_001020252
auggccagccagaagcgccccucccagcggcacggcagcaaguaccuggccaccgcguccaccauggaccacgcccgccacggguuccucccgcggcaccgcgacacgggcauccuggacagcaucgggcgguucuucggcggggaccgcggcgcccccaagcggggcuccgggaaggugcccuggcugaagcccggccgcagcccgcuccccucccacgcccggagccagcccgggcugugcaacauguacaaggacucccaccaccccgcccgcaccgcgcacuacggcagccugccgcagaagucccacgggcggacccaggacgagaaccccgucgugcacuucuucaagaacaucgugaccccccgcacgcccccgcccagccagggcaagggccgggggcucucccugagccgcuucuccuggggcgccgaggggcagcggcccggcuucggcuacgggggccgcgccagcgacuacaaguccgcccacaagggguucaagggcgucgacgcgcaggggacccugagcaagaucuucaagcucggcggccgggacucccgcagcgggagccccauggcccggcgcuga

SEQ ID NO: 32757 - RNA, 1956 nt, Artificial Sequence
  derived and/or modified sequence opt1 from MBTD1__Homo_sapiens__XP_005257525
auggagaacaccaaggaccugaccgagcacagcucccgcagcgagcggaagcgccgggacuccuucggcauguucgacggguacgacagcugcuccgaggacacgagcuccagcuccagcuccgaggagagcgaggaggagguggcgccccuccccuccaaccugcccaucaucaagaacaacggccaggucuacaccuaccccgacgggaaguccggcauggcgaccugcgagaugugcgggauggugggcgugcgcgacgccuucuacuccaagaccaagcgguucugcagcgucuccugcagccgcuccuacagcagcaacuccaagaaggccagcauccuggcccggcuccagggcaagcccccgacgaagaaggccaaggugcugcagaagcagccccugguggccaagcucgccgccuacgcccaguaccaggccacccugcagaaccaggcgaagaccaaggccgccgucuccauggagggguucagcuggggcaacuacaucaacuccaacagcuucaucgccgcccccgugaccugcuucaagcacgcgcccauggggacgugcuggggcgacaucuccgagaacgugcgcgucgaggugccgaacaccgacugcagccugcccaccaagguguucuggaucgccgggaucgucaagcucgccggcuacaacgcccugcugcgguacgagggcuucgagaacgacuccgggcucgacuucuggugcaacaucugcggcagcgacauccaccccgugggguggugcgccgcguccggcaagccccuggugccgccccgcaccauccagcacaaguacacgaacuggaaggccuuccuggucaagcggcucaccggcgccaagacccugccgcccgacuucagccagaagguguccgagagcaugcaguaccccuucaagcccugcaugcgcguggaggucguggacaagcggcaccugugccgcacccggguggccgucguggaguccgugaucgggggccgccuccggcuggucuacgaggagagcgaggaccgcacggacgacuucuggugccacaugcacagcccccugauccaccacaucggguggagccgguccaucggccaccgcuucaagcggagcgacaucaccaagaagcaggacgggcacuucgacacgcccccgcaccucuucgccaaggugaaggaggucgaccagagcggcgagugguucaaggagggcaugaagcuggaggcgaucgacccccugaaccucuccaccaucugcguggccaccauccgcaaggugcuggccgacggguuccugaugaucggcaucgacgggagcgaggccgccgacggcuccgacugguucugcuaccacgcgaccagccccuccaucuuccccgucggguucugcgagaucaacaugaucgagcucaccccgccccgcggcuacaccaagcugcccuucaagugguucgacuaccugcgggagacgggcagcaucgccgcccccgugaagcuguucaacaaggacgugccgaaccacggguuccgcgucggcaugaagcucgaggccguggaccugauggagccccggcucaucugcguggcgaccgucacccgcaucauccaccggcugcugcgcauccacuucgacgggugggaggaggaguacgaccaguggguggacugcgagucccccgaccucuacccggugggcuggugccagcugaccggguaccagcugcagccgcccgccagccaguccagccgggagaaccaguccgccagcuccaagcagaagaagaaggccaagagccagcaguacaagggccacaagaagaugacgacccuccagcugaaggaggagcugcucgacggcgaggacuacaacuuccugcagggggccuccgaccaggagagcaacggcuccgcgaacuucuacaucaagcaggagcccuga

SEQ ID NO: 32758 - RNA, 3159 nt, Artificial Sequence
  derived and/or modified sequence opt1 from MBTPS1__Homo_sapiens__NP_003782
augaagcuggugaacaucuggcuccugcugcucguggugcugcugugcggcaagaagcaccucggggaccgccuggagaagaaguccuucgagaaggcccccugcccgggcugcagccaccugacccucaagguggaguucagcuccaccgucguggaguacgaguacaucguggccuucaacggguacuucacggcgaaggcccggaacagcuucaucuccagcgcccugaaguccagcgaggucgacaacuggcgcaucaucccccggaacaaccccuccagcgacuaccccuccgacuucgaggugauccagaucaaggagaagcagaaggccggccugcucacccuggaggaccacccgaacaucaagcgcgugacgccccagcggaaggucuuccgcagccugaaguacgccgaguccgaccccaccgugcccugcaacgagacccgguggagccagaaguggcaguccagccgcccgcuccggcgcgcgucccugagccugggguccggcuucuggcacgccaccggccggcacagcagccgccggcuccugcgcgccaucccccgccagguggcccagacccugcaggcggacguccucuggcagaugggguacaccggcgccaacgugcggguggccgucuucgacacggggcuguccgagaagcacccccacuucaagaacgugaaggagcggaccaacuggaccaacgagcgcacccuggacgacggccucgggcacggcacguucguggccggcgucaucgccagcaugcgggagugccagggguucgcgcccgacgccgagcugcacaucuuccgcguguucaccaacaaccagguguccuacaccagcugguuccuggacgccuucaacuacgccauccucaagaagaucgacguccugaaccuguccaucggcgggccggacuucauggaccaccccuucguggacaaggugugggagcucaccgccaacaacgucaucauggugagcgcgaucggcaacgacggcccccuguacgggacgcugaacaaccccgccgaccagauggacgucaucggcgucgggggcaucgacuucgaggacaacaucgcccgguucuccagccgcgggaugaccaccugggagcucccgggcggcuacgggcgcaugaagcccgacaucgugaccuacggcgccggggugcggggcuccggggugaagggcggcugccgcgcccugagcgggacguccguggcgagccccgucguggccggcgccgugacccugcucgucuccaccgugcagaagcgggagcuggugaaccccgccagcaugaagcaggcccugaucgcguccgcccgccggcucccgggggucaacauguucgagcagggccacgggaagcuggaccugcuccgcgccuaccagauccugaacagcuacaagccccaggccucccugagccccuccuacaucgaccucaccgagugccccuacauguggccguacugcagccagcccaucuacuacggcggcaugcccacgguggugaacgucaccauccugaacgggaugggcgugaccgggcggaucguggacaagcccgacuggcagccguaccugccccagaacggcgacaacaucgaggucgcguucagcuacuccagcgugcucuggcccugguccggcuaccuggccaucagcaucuccgugaccaagaaggccgccagcugggaggggaucgcccagggccacgucaugaucacgguggcguccccggccgagaccgagagcaagaacggggccgagcagaccuccaccgugaagcugcccaucaaggucaagaucauccccacgcccccgcgcagcaagcgggugcugugggaccaguaccacaaccuccgcuacccgcccggcuacuucccccgggacaaccugcgcaugaagaacgacccccuggacuggaacggggaccacauccacaccaacuuccgggacauguaccagcaccuccgcuccaugggcuacuucguggagguccugggcgcccccuucacgugcuucgacgccagccaguacgggacccugcucaugguggacuccgaggaggaguacuuccccgaggagaucgcgaagcugcggcgcgacguggacaacggccugagccucgucaucuucuccgacugguacaacaccagcgugaugcggaaggugaaguucuacgacgagaacacccgccagugguggaugcccgacaccgggggcgccaacaucccggcccugaacgagcugcucuccgucuggaacaugggguucagcgacggccuguacgagggcgaguucacccuggccaaccacgacauguacuacgccagcgggugcuccaucgcgaaguuccccgaggacggcguggugaucacccagacguucaaggaccaggggcucgagguccugaagcaggagaccgccgugguggagaacguccccauccugggccucuaccagauccccgccgagggcgggggccggaucgugcuguacggggacagcaacugccuggacgacucccaccgccagaaggacugcuucuggcuccuggacgcccugcuccaguacaccagcuacggcgugaccccgcccucccugagccacuccgggaaccgccagcggccgcccagcggcgcgggguccgucacgcccgagcgcauggagggcaaccaccuccaccgguacagcaaggugcuggaggcccaccugggcgaccccaagccccgcccccugccggccugcccccggcucuccugggccaagccccagccgcugaacgagaccgcccccagcaaccuguggaagcaccagaagcuccuguccaucgaccuggacaaggugguccuccccaacuuccgcagcaaccggccccaggugcgcccgcugucccccggggagagcggcgcgugggacauccccgggggcaucaugcccggccgguacaaccaggagguggggcagaccaucccggucuucgccuuccugggcgccaugguggugcucgccuucuucgucgugcagaucaacaaggccaagucccgccccaagcggcgcaagccccgggucaagcgcccccagcugaugcagcagguccacccgcccaagacccccagcguguga

SEQ ID NO: 32759 - RNA, 1560 nt, Artificial Sequence
  derived and/or modified sequence opt1 from MBTPS2__Homo_sapiens__NP_056968
augauccccgugagccuggucgugguggucgugggcggguggaccguggucuaccucaccgaccuggugcugaaguccagcguguacuucaagcacuccuacgaggacuggcucgagaacaacggccugagcaucuccccguuccacauccgcuggcagacggccgucuucaaccgggccuucuacagcugggggcgccggaaggcgcgcaugcuguaccagugguucaacuucggcaugguguucggggugaucgccauguucuccagcuucuuccuccugggcaagacccugaugcagacccucgcccagaugauggccgacucccccagcuccuacagcuccagcuccagcuccagcuccagcagcuccagcuccagcuccagcuccagcuccagcuccagcucccugcacaacgagcagguccuccagguggugguccccggcaucaaccugcccgugaaccagcugaccuacuucuucacggccgugcugaucagcggggucgugcacgagaucggccacgggaucgcggccauccgggagcagguccgcuucaacggcuucgggaucuuccucuucaucaucuacccgggcgccuucguggaccuguucaccacccaccuccagcugaucucccccgugcagcagcugcggaucuucugcgccggcaucuggcacaacuucgugcuggcgcuccuggggauccuggcccucguccugcugcccgugauccuccugcccuucuacuacaccggcgucggggugcugaucacggagguggccgaggacagcccggccaucggcccccgcggccucuucgucggggaccuggugacccaccuccaggacugccccgugaccaacguccaggacuggaacgagugccuggacaccaucgccuacgagccccagaucggcuacugcaucuccgcgagcacgcugcagcagcuguccuucccggugcgggccuacaagcgccucgacgggagcaccgagugcugcaacaaccacagccugaccgacgugugcuucuccuaccggaacaacuucaacaagcgccugcacacgugccuccccgcccggaaggccgucgaggccacccaggugugccgcaccaacaaggacugcaagaaguccagcagcuccagcuucugcaucauccccucccuggagacccacacccggcugaucaaggugaagcacccgccccagaucgacaugcucuacgucggccacccccugcaccuccacuacacggugagcaucaccuccuucaucccccgcuucaacuuccugagcaucgaccugcccguggucguggagaccuucgugaaguaccugaucucccucagcggggcgcuggccaucgucaacgccgugccgugcuucgcccuggacggccaguggauccugaacuccuuccucgacgccacccugacgagcgugaucggcgacaacgacgucaaggaccugaucggguucuucauccuccugggcggguccgugcugcucgcggccaacgugacccugggccuguggauggucaccgcccgguga

SEQ ID NO: 32760 - RNA, 954 nt, Artificial Sequence
  derived and/or modified sequence opt1 from MC1R__Homo_sapiens__NP_002377
auggccgugcagggcagccagcgccggcugcucgggucccugaacagcacccccaccgccaucccccagcugggccucgcggccaaccagacgggggcccgcugccuggaggucuccaucagcgacggccuguuccucucccuggggcuggugagccucguggagaacgcccuggucguggccaccaucgcgaagaaccggaaccugcacucccccauguacugcuucaucugcugccucgcccugagcgaccugcucguguccggcagcaacguccuggagaccgccgugauccugcuccuggaggccggcgcgcugguggcccgcgccgccguccuccagcagcuggacaacgugaucgacgugaucacgugcuccagcaugcuguccagccucugcuuccugggggccaucgcggucgaccgguacaucuccaucuucuacgcccugcgcuaccacagcaucgugacccucccccgggcccgccgggccguggccgcgaucugggucgccuccgugguguucagcacccuguucaucgccuacuacgaccacgucgccgugcugcucugccugguggucuucuuccuggccaugcucgugcugauggcggugcuguacguccacaugcucgcccgcgccugccagcacgcccagggcaucgcccggcugcacaagcgccagcggcccgugcaccagggguucggccugaagggggcggucacccucaccauccugcugggcaucuucuuccucugcuggggcccguucuuccugcaccugacgcucaucgugcugugccccgagcacccgaccugcgggugcaucuucaagaacuucaaccuguuccucgcccugaucaucugcaacgccaucaucgacccccugaucuacgccuuccacucccaggagcugcgccggacccucaaggaggugcugaccugcagcugguga

SEQ ID NO: 32761 - RNA, 894 nt, Artificial Sequence
  derived and/or modified sequence opt1 from MC2R__Homo_sapiens__NP_001278840
augaagcacaucaucaacagcuacgagaacaucaacaacaccgcccgcaacaacuccgacugcccccgggugguccugccggaggagaucuucuucaccaucagcaucgugggcgugcucgagaaccugaucguccugcucgccguguucaagaacaagaaccugcaggcgcccauguacuucuucaucugcucccuggccaucagcgacaugcucgggucccuguacaagauccuggagaacauccucaucauccugcgcaacaugggcuaccugaagccccgggggagcuucgagacgaccgccgacgacaucaucgacucccucuucgugcugagccugcucggcuccaucuucagccuguccgucaucgccgccgaccgcuacaucaccaucuuccacgcgcugcgguaccacagcaucgugaccaugcgccggacgguggucgugcucaccgugaucuggaccuucugcaccgggacgggcaucaccauggucaucuucucccaccacgugcccaccgugaucaccuucacgagccuguucccgcugaugcucgucuucauccugugccuguacgugcacauguuccuccuggcccgcucccacacccggaagaucagcacccugccccgcgccaacaugaagggcgccaucacccucacgauccugcuggggguguucaucuucugcugggcgcccuucguccuccacgugcugcugaugaccuucugccccuccaacccguacugcgccugcuacaugagccucuuccaggugaacggcaugcugaucaugugcaacgccgucaucgaccccuucaucuacgccuuccggucccccgagcugcgcgacgccuucaagaagaugaucuucugcagccgguacugguga

SEQ ID NO: 32762 - RNA, 972 nt, Artificial Sequence
  derived and/or modified sequence opt1 from MC3R__Homo_sapiens__NP_063941
augaacgccagcugcugccugcccuccgugcagccgacccuccccaacggcagcgagcaccuccaggcccccuucuucuccaaccagagcuccagcgcguucugcgagcaggucuucaucaagcccgagguguuccugucccuggggaucgugagccugcuggagaacauccucgucauccuggccguggugcgcaacggcaaccugcacuccccgauguacuucuuccucugcagccuggccgucgccgacaugcugguguccgugagcaacgcccucgagaccaucaugaucgcgaucguccacuccgacuaccugacguucgaggaccaguucauccagcacauggacaacaucuucgacagcaugaucugcaucucccugguggccagcaucugcaaccuccuggccaucgccguggaccgguacgucaccaucuucuacgcgcugcgcuaccacuccaucaugaccgugcggaaggcccucacccugaucguggccaucugggucugcugcggggugugcggcguggucuucaucguguacagcgaguccaagauggugaucgucugccugaucacgauguucuucgccaugaugcuccugauggggacccuguacgugcacauguuccucuucgcccgccugcacgugaagcggaucgcggcccugccgcccgccgacggcgucgcgccccagcagcacagcugcaugaagggcgccgugaccaucaccauccuccugggggucuucaucuucugcugggcccccuucuuccugcaccucgugcugaucaucacgugccccaccaaccccuacugcaucugcuacaccgcccacuucaacaccuaccuggugcucaucaugugcaacagcgucaucgacccccugaucuacgccuuccgcucccuggagcuccggaacacguuccgcgagauccugugcggcugcaacgggaugaaccugggcuga

SEQ ID NO: 32763 - RNA, 999 nt, Artificial Sequence
  derived and/or modified sequence opt1 from MC4R__Homo_sapiens__NP_005903
auggugaacagcacccaccgcggcaugcacaccucccugcaccucuggaaccggagcuccuaccgccugcacagcaacgccuccgagagccuggggaagggcuacuccgacgggggcugcuacgagcagcuguucgucagccccgagguguucgugacgcucggggucaucucccugcucgagaacauccuggugaucguggccaucgcgaagaacaagaaccugcacagcccgauguacuucuucaucugcucccucgccgucgccgacaugcuggugagcguguccaacggcagcgagaccaucgucaucacccugcucaacuccaccgacacggacgcccagagcuucaccgugaacaucgacaacgugaucgacuccgucaucugcagcucccugcuggccagcaucugcagccuccuguccaucgcgguggaccgguacuucaccaucuucuacgcccugcaguaccacaacaucaugaccgugaagcgcgucggcaucaucaucagcugcaucugggccgccugcacgguguccgggauccucuucaucaucuacagcgacuccagcgcggugaucaucugccugaucaccauguucuucaccaugcuggcccucauggccucccuguacguccacauguuccugauggcccggcuccacaucaagcgcaucgccgugcugcccggcaccggggcgauccggcagggcgccaacaugaagggggccaucacgcugaccauccucaucggcguguucgucgugugcugggcccccuucuuccugcaccugaucuucuacaucagcugcccccagaacccguacugcgugugcuucaugucccacuucaaccucuaccugauccugaucaugugcaacagcaucaucgacccccucaucuacgcccugcgcucccaggagcugcggaagaccuucaaggagaucaucugcugcuacccccucggcgggcugugcgaccugagcucccgcuacuga

SEQ ID NO: 32764 - RNA, 978 nt, Artificial Sequence
  derived and/or modified sequence opt1 from MC5R__Homo_sapiens__NP_005904
augaacagcuccuuccaccuccacuuccucgaccugaaccugaacgccaccgagggcaaccucagcgggcccaacgugaagaacaaguccagcccgugcgaggacaugggcaucgccgucgagguguuccugacccugggggugaucucccuccuggagaacauccuggucaucggcgcgaucgugaagaacaagaaccuccacagccccauguacuucuucgugugcucccuggccgucgccgacaugcuggugagcauguccagcgccugggagacgaucaccaucuaccuccugaacaacaagcaccuggugaucgccgacgcguucguccgccacaucgacaacguguucgacuccaugaucugcaucagcguggucgccuccaugugcagccuccuggccaucgccguggaccgguacgugaccaucuucuacgcgcugcgcuaccaccacaucaugaccgcccggcgcuccggggccaucaucgccggcaucugggccuucugcacgggcugcgggaucgucuucauccucuacagcgaguccaccuacgugauccugugccugaucagcauguucuucgcgaugcuguuccugcuggugucccucuacauccacauguuccugcuggcccggacccacgucaagcgcaucgccgcccuccccggcgccagcagcgcgcggcagcgcaccuccaugcagggggccgugacggugaccaugcugcugggcgucuucaccgugugcugggcccccuucuuccuccaccugacccugaugcucagcugcccgcagaaccuguacugcucccgguucaugagccacuucaacauguaccugauccucaucaugugcaacuccgugauggacccccugaucuacgccuuccgcagccaggagaugcggaagacguucaaggagaucaucugcugccgcggguuccggaucgccugcuccuucccccgccgggacuga

SEQ ID NO: 32765 - RNA, 1941 nt, Artificial Sequence
  derived and/or modified sequence opt1 from MCAM__Homo_sapiens__NP_006491
augggccugccccgccucgugugcgccuuccugcuggccgcgugcugcugcugcccgcgggucgccggggugcccggcgaggccgagcagcccgcccccgagcucguggaggucgagguggggagcaccgcccugcugaagugcggccucucccagagccaggggaaccugucccacguggacugguucagcguccacaaggagaagcgcacccugaucuuccgggugcgccagggccagggccaguccgagccgggggaguacgagcagcggcucagccugcaggaccgcggcgcgacgcuggcccucacccaggugacgccccaggacgagcggaucuuccugugccaggggaagcgcccccggucccaggaguaccgcauccagcugcgggucuacaaggcccccgaggagccgaacauccaggugaacccccucggcauccccgugaacagcaaggagcccgaggaggucgcgaccugcguggggcgcaacggcuacccgaucccccaggugaucugguacaagaacggccggccccugaaggaggagaagaaccgcguccacauccaguccagccagaccguggaguccagcgggcuguacacccuccaguccauccugaaggcccagcuggugaaggaggacaaggacgcccaguucuacugcgagcucaacuaccggcugcccagcggcaaccacaugaaggagucccgcgaggucaccgugccgguguucuaccccaccgagaaggucuggcuggagguggagcccguggggaugcucaaggagggcgaccgggucgagauccgcugccuggccgacggcaacccgccgccccacuucagcaucuccaagcagaaccccagcacgcgggaggccgaggaggagaccaccaacgacaacggggugcugguccucgagcccgcccgcaaggagcacuccggccgguacgagugccaggggcuggaccuggacaccaugaucagccuccugagcgagccccaggagcugcucgugaacuacguguccgacguccgcgugagccccgcggcccccgagcgccaggagggcuccagccugacgcugaccugcgaggccgaguccagccaggaccucgaguuccaguggcugcgggaggagaccggccaggugcuggagcgcggccccguccuccagcugcacgaccugaagcgggaggccggcgggggcuaccgcugcguggccuccgugccgagcauccccgggcucaaccggacccagcuggucaacguggcgaucuucgggcccccguggauggccuucaaggagcgcaaggugugggucaaggagaacauggugcugaaccucuccugcgaggccagcgggcacccccggcccacgaucuccuggaacgugaacggcaccgccagcgagcaggaccaggacccccagcgcguccuguccacccugaacgugcucgugaccccggagcugcuggagacgggcgucgagugcaccgccagcaacgaccuggggaagaacaccuccauccucuuccuggagcuggugaaccucaccacgcugacccccgacagcaacaccaccacgggccuguccaccagcaccgcgagcccccacacccgggccaacuccacgagcaccgagcgcaagcuccccgagccggagucccgcgggguggucaucguggccgugaucgucugcauccuggugcuggccgugcucggcgccguccuguacuuccuguacaagaaggggaagcuccccugccggcggagcggcaagcaggagaucacccugccgcccucccgcaagagcgagcuggugguggaggucaaguccgacaagcuccccgaggagaugggccugcugcaggggagcuccggcgacaagcgggcgcccggggaccagggcgagaaguacaucgaccuccgccacuga

SEQ ID NO: 32766 - RNA, 543 nt, Artificial Sequence
  derived and/or modified sequence opt1 from MCAT__Homo_sapiens__NP_055322
augagcgugcgcgucgcccggguggccugggugcgcggccugggggcguccuaccggcgcggcgccagcuccuuccccgucccgccgcccggggcccagggcguggccgagcuccugcgggacgccaccggggcggaggaggaggcccccugggccgccaccgagcgccggaugcccggccagugcagcgugcuccuguuccccggccaggggucccaggucgugggcauggggcgcggccugcugaacuacccccgggugcgcgagcucuacgcggccgcccggcgcguccugggguacgaccugcucgagcugagccugcacggcccccaggagacgcucgaccggaccgugcacugccagccggccaucuucguggccucccuggcggccgucgagaagcugcaccaccuccagcccagcgugaucgagaacugcguggccgccgccggcuucuccgucggggaguucgcggcccugguguucgccggcgccauggaguucgccgaggggagcaccgugucccccgaggaguuccuguga

SEQ ID NO: 32767 - RNA, 2178 nt, Artificial Sequence
  derived and/or modified sequence opt1 from MCCC1__Homo_sapiens__NP_064551
auggccgccgcgagcgccguguccguccugcucguggccgccgagcgcaaccgguggcaccgccugcccagccugcuccugccgccccggaccuggguguggcgccagcggaccaugaaguacaccaccgccaccggccgcaacaucaccaagguccugaucgcgaaccgcggggagaucgccugccgggugaugcggacggccaagaagcucggcgugcagaccgucgccguguacuccgaggcggaccgcaacagcaugcacguggacauggccgacgaggccuacuccaucgggcccgcccccagccagcaguccuaccugagcauggagaagaucauccaggucgccaagaccuccgcggcccaggccauccacccgggcugcggguuccugagcgagaacauggaguucgccgagcucugcaagcaggagggcaucaucuucaucgggcccccgcccuccgccauccgggacauggggaucaagagcaccuccaagagcaucauggcggccgccggcgugcccguggucgagggguaccacggcgaggaccaguccgaccagugccugaaggagcacgcccgccggaucggguaccccgugaugaucaaggccgugcgcggcggcgggggcaaggggaugcggaucguccgcagcgagcaggaguuccaggagcagcuggaguccgcgcggcgcgaggccaagaaguccuucaacgacgacgccaugcucaucgagaaguucguggacacgccccggcacguggagguccagguguucggcgaccaccacggcaacgccguguaccuguucgagcgcgacugcagcguccagcggcgccaccagaagaucaucgaggaggcccccgcgccggggaucaagagcgaggugcgcaagaagcugggcgaggccgccgugcgggccgcgaaggccgucaacuacgugggggccggcaccgucgaguucaucauggacagcaagcacaacuucugcuucauggagaugaacacccgccuccagguggagcaccccgugaccgagaugaucacggggaccgaccuggucgaguggcagcugcggaucgccgccggcgagaagaucccccucucccaggaggagaucacccugcagggccacgcguucgaggcccgcaucuacgccgaggaccccagcaacaacuucaugccgguggccgggccccuggugcaccucuccacgccccgggccgaccccagcacccgcaucgagaccggcguccggcagggggacgagguguccgugcacuacgacccgaugaucgcgaagcuggucgugugggccgccgaccgccaggccgcccugaccaagcuccgguacagccugcgccaguacaacaucgugggccugcacaccaacaucgacuuccuccugaaccuguccgggcaccccgaguucgaggcgggcaacguccacacggacuucaucccccagcaccacaagcagcuccugcugagccggaaggccgccgccaaggagucccucugccaggcggcccugggccugauccucaaggagaaggccaugaccgacaccuucacccugcaggcccacgaccaguucagccccuucuccagcuccagcgggcgccggcugaacaucuccuacacgcgcaacaugacccucaaggacggcaagaacaacguggccaucgcggugaccuacaaccacgacgggagcuacuccaugcagaucgaggacaagaccuuccagguccugggcaaccuguacagcgagggggacugcacguaccucaagugcuccgugaacggcguggccagcaaggccaagcugaucauccuggagaacaccaucuaccucuucagcaaggagggcuccaucgagaucgacaucccgguccccaaguaccugagcuccgugagcucccaggagacccagggcggcccccuggcccccaugaccgggacgaucgagaagguguucgucaaggccggcgacaaggugaaggcgggcgacagccucauggugaugaucgccaugaagauggagcacaccaucaaguccccgaaggacgggaccgucaagaagguguucuaccgggagggcgcccaggccaaccgccacacgccccugguggaguucgaggaggaggagagcgacaagcgggaguccgaguga

SEQ ID NO: 32768 - RNA, 1692 nt, Artificial Sequence
  derived and/or modified sequence opt1 from MCCC2__Homo_sapiens__NP_071415
augugggccgugcugcgccucgcccugcggcccugcgcgcgcgccagcccggccggcccccgggccuaccacggggacuccgucgccagccugggcacccagcccgaccucggguccgcgcuguaccaggagaacuacaagcagaugaaggcccuggugaaccagcuccacgagcgcguggagcacaucaagcugggcgggggcgagaaggcccgggcccugcacaucagccgcggcaagcuccugccccgggagcgcaucgacaaccugaucgacccggggucccccuuccucgagcugagccaguucgcgggcuaccagcuguacgacaacgaggagguccccgggggcgggaucaucaccggcaucggccggguguccgggguggagugcaugaucaucgccaacgacgccacggucaagggcggggccuacuaccccgugaccgugaagaagcagcuccgcgcccaggagaucgcgaugcagaaccggcugccgugcaucuaccuggucgacagcggcggcgccuaccucccccgccaggccgacguguuccccgaccgggaccacuucgggcgcaccuucuacaaccaggccaucauguccagcaagaacaucgcccagaucgcgguggucaugggcuccugcaccgccgggggcgccuacgugcccgccauggccgacgagaacaucaucgugcggaagcaggggacgaucuuccuggcgggcccgccccuggucaaggccgccaccggcgaggaggugagcgccgaggaccucgggggcgccgaccugcacugccgcaaguccggggugagcgaccacugggcgcuggacgaccaccacgcccuccaccugacccggaaggucgugcgcaaccugaacuaccagaagaagcucgacgugaccaucgagcccuccgaggagccccuguucccggccgacgagcuguacggcaucgucggggccaaccucaagcggagcuucgacgugcgcgaggugaucgcgcggaucgucgacggcucccgcuucacggaguucaaggccuucuacggcgacacccuggugaccggguucgcccgcaucuucggcuaccccgucgggaucgugggcaacaacggggugcuguucagcgaguccgccaagaagggcacccacuucguccagcucugcugccagcggaacaucccccugcuguuccuccagaacaucacgggcuucaugguggggcgcgaguacgaggccgagggcaucgcgaaggacggggccaagaugguggccgccgucgccugcgcccaggugcccaagaucacccugaucaucggcggcagcuacggggcgggcaacuacgggaugugcggccgggccuacagcccgcgcuuccuguacaucuggcccaacgcccggaucuccgugaugggcggggagcaggccgcgaacguccucgccaccaucaccaaggaccagcgcgcccgggagggcaagcaguucagcuccgccgacgaggcggcccugaaggagcccaucaucaagaaguucgaggaggaggggaaccccuacuacagcuccgcccgcgugugggacgacggcaucaucgacccggccgacacgcggcuggugcucgggcugagcuucuccgccgcgcugaacgcccccaucgagaagaccgacuucggcaucuuccgcauguga

SEQ ID NO: 32769 - RNA, 360 nt, Artificial Sequence
  derived and/or modified sequence opt1 from MCCD1__Homo_sapiens__NP_001011700
auggugcugccccugccguggcugagccgcuaccacuuccugcggcuccugcugcccuccuggagccucgcgccccagggcucccacgggugcugcagccagaaccccaaggccuccauggaggagcagaccagcucccgcggcaacgggaagaugaccagcccgccccggggccccgggacgcaccgcaccgccgagcuggcccgggccgaggagcugcucgagcagcagcuggagcuguaccaggcccuccuggagggccaggagggcgccugggaggcgcaggcccugguccucaagauccagaagcugaaggagcagaugcgccggcaccaggagucccucgggggcggggccuga

SEQ ID NO: 32770 - RNA, 3060 nt, Artificial Sequence
  derived and/or modified sequence opt1 from MCC__Homo_sapiens__NP_001078846
augauggccgccgcggccgccgccgccgcgggcagcuccagcuccgggggcgggggcgggggcagcggcuccagcuccagcuccagcgacaccuccagcaccggggaggaggagcgcaugcggcgccuguuccagacgugcgacggcgacggggacggcuacaucucccggaacgaccuccugauggugugccgccagcugaacauggaggagagcgucgccgagaucaugaaccagcucggggccgacgagaacggcaagaucuccuuccaggacuucacccggugccgcaugcagcuggugcgggagauccgcaaggaggagguggaccugagcgccaaguccgacaacagcugcaccaagaagcuccgggaccgcaucgcguccuggcccaccagcagcgacaacucccugggcgcccugagcgccgcccgggaguccugggaguacgacagcggggcccgcgaccuccaguccccggacguccagagccaguccgcgcugcagaagcugcucgaguacggcgggagcucccugcaccagcaggccgcccugcacaagcuccugacgcagagcccccacaucggcaacuccgugggcgggagcuaccuggagcucgccaacacccugcacuccgccgcgcuggccagccucaagggcgacaucguggagcugaacaagcggcugcagcagaccgagcgcgagcgggaccuccuggagaagaagcuggccaaggcccagugcgagcagucccaccucaugcgcgagcacgaggacguccaggagcggaccacgcugcgcuacgaggagcggaucaccgagcugcacagcgugaucgccgagcucaacaagaagaucgaccgccugcaggggaccaccauccgggaggaggacgaguacuccgagcugcgcagcgagcucucccagagccagcacgaggugaacgaggacagccgcuccauggaccaggaccagacgagcgucuccauccccgagaaccagagcaccauggugaccgcggacauggacaacugcuccgaccugaacagcgagcugcagcgggugcucaccggccuggagaacgucgugugcgggcgcaagaaguccagcugcucccugagcguggccgaggucgaccggcacaucgagcagcucacgaccgccuccgagcacugcgaccuggccaucaagaccguggaggagaucgagggcgugcugggccgcgaccucuaccccaaccuggccgaggagcggagccgcugggagaaggagcuggcggggcuccgggaggagaacgagucccugaccgccaugcugugcagcaaggaggaggagcucaaccgcacgaaggccaccaugaacgccauccgggaggagcgcgaccggcugcgccggcgcguccgggagcugcagacccgccugcaguccgugcaggcgaccggcccgagcucccccgggcggcucacgagcaccaaccgccccaucaaccccagcaccggcgagcuguccaccagcuccagcuccaacgacaucccgaucgccaagaucgccgagcgggugaagcugagcaagacgcgcuccgagagcuccagcuccgaccgccccguccucgggagcgagaucuccagcaucggcguguccagcuccguggccgagcaccuggcccacagccugcaggacugcuccaacauccaggagaucuuccagacccucuacagccacggcagcgcgaucuccgagagcaagauccgggaguucgaggucgagaccgagcgccugaacucccggaucgagcaccucaagagccagaacgaccugcugaccaucacgcuggaggagugcaaguccaacgccgagcgcaugagcaugcucguggggaaguacgaguccaacgccaccgcccugcggcuggcccuccaguacagcgagcagugcaucgaggcguacgagcugcugcucgcccuggccgaguccgagcagagccugauccucggccaguuccgcgccgccggggucggcuccagccccggggaccaguccggcgacgagaacaucacccagaugcugaagcgggcgcacgacugccgcaagaccgccgagaacgccgccaaggcgcugcucaugaagcuggacggcagcugcgggggcgccuucgccguggccgggugcuccgugcagcccugggagagccuguccagcaacucccacacgagcaccaccagcuccaccgccagcuccugcgacaccgaguucacgaaggaggacgagcagcggcucaaggacuacauccagcagcugaagaacgaccgcgcggccgucaagcugaccaugcucgagcuggagagcauccacaucgacccgcuguccuacgacgugaagccccggggcgacagccagcgccucgaccuggagaacgccgugcugaugcaggagcucauggccaugaaggaggagauggccgagcugaaggcgcagcuguaccuccuggagaaggagaagaaggcccuggagcucaagcuguccacccgggaggcccaggagcaggccuaccugguccacaucgagcaccucaagagcgagguggaggagcagaaggagcagcgcaugcggucccugagcuccaccagcuccggcagcaaggacaagcccgggaaggagugcgccgacgcggccucccccgcccugagccucgccgagcugcgcacgaccugcuccgagaacgagcuggcggccgaguucaccaacgccauccggcgcgagaagaagcucaaggcccgggugcaggagcuggucagcgcccuggagcgccucaccaaguccagcgagauccggcaccagcagagcgcggaguucgugaacgaccugaagcgcgccaacuccaaccugguggccgccuacgagaaggccaagaagaagcaccagaacaagcucaagaagcuggagagccagaugauggcgauggucgagcgccacgagacccaggugcggaugcugaagcagcgcaucgcccuccuggaggaggagaacucccggccgcacacgaacgagaccagccuguga

SEQ ID NO: 32771 - RNA, 531 nt, Artificial Sequence
  derived and/or modified sequence opt1 from MCEE__Homo_sapiens__NP_115990
auggcccgcgugcugaaggccgcggccgccaacgccgucggccucuucagccggcugcaggcccccaucccgaccgugcgcgcguccagcaccucccagccccuggaccaggugacggggagcgucuggaaccucggccggcugaaccacguggccaucgccgugcccgaccuggagaaggccgcggccuucuacaagaacauccucggggcccaggucuccgaggccgugccccugccggagcacggcgugagcgucguguucgugaaccuggggaacaccaagauggagcuccugcacccccugggccgcgacucccccaucgccggcuuccuccagaagaacaaggccgggggcaugcaccacaucugcaucgaggucgacaacaucaacgcggccgugauggaccugaagaagaagaagauccggagccuguccgaggaggugaagaucggggcccacggcaagcccgucaucuuccuccacccgaaggacugcgggggcgugcugguggagcuggagcaggccuga

SEQ ID NO: 32772 - RNA, 2958 nt, Artificial Sequence
  derived and/or modified sequence opt1 from MCF2__Homo_sapiens__NP_001093325
augcaggacaucgccuuccugagcggcgggcgcggcaaggacaacgccuggaucaucaccuuccccgagaacugcaacuuccggugcaucccggaggaggugaucgcgaagguccucaccuaccugacguccaucgcccgccagaacgggagcgacucccgguucaccaucauccuggaccgccggcucgacaccuggagcucccugaagaucagccugcagaagaucuccgccagcuuccccggcaaccuccaccuggugcuggugcuccgccccaccuccuuccugcagcggacguucaccgacaucggguucugguucagccaggaggacuucaugcugaagcuccccgucgugaugcuguccagcguguccgaccugcucaccuacaucgacgacaagcagcugaccccggagcugggcggcacgcuccaguacugccacagcgaguggaucaucuuccgcaacgccaucgagaacuucgcccugaccgucaaggagauggcgcagaugcugcaguccuucgggaccgagcucgccgagaccgagcugcccgacgacauccccagcaucgaggagauccuggccauccgggccgagcgcuaccaccuccugaagaacgacaucacggcggugaccaaggagggcaagauccugcucaccaaccuggaggugcccgacaccgagggggccgucuccagccggcuggagugccaccgccagaucuccggcgacuggcagacgaucaacaagcuccugacccaggugcacgacauggagaccgccuucgacggguucugggagaagcaccagcugaagauggagcaguaccuccagcuguggaaguucgagcaggacuuccagcagcuggugaccgaggucgaguuccuccugaaccagcaggccgagcuggccgacgugacgggcaccaucgcccaggugaagcagaagaucaagaagcucgagaaccuggacgagaacagccaggagcugcucagcaaggcgcaguucgucauccugcacggccacaagcuggccgccaaccaccacuacgcccucgaccugaucugccagcggugcaacgagcugcgcuaccucuccgacauccuggugaacgagaucaaggcgaagcggauccagcugagccgcaccuucaagaugcacaagcugcuccagcaggcccggcagugcugcgacgagggggagugccugcuggccaaccaggagaucgacaaguuccaguccaaggaggacgcccagaaggcccuccaggacaucgagaacuuccuggagauggcgcugccguucaucaacuacgagcccgagacccuccaguacgaguucgacgugauccugagccccgagcugaagguccagaugaagacgauccagcucaagcuggagaacauccgcuccaucuucgagaaccagcaggccggcuuccggaaccuggccgacaagcacgugcgccccauccaguucguggucccgacccccgagaaccucgugaccagcgggacccccuucuucuccagcaagcagggcaagaagacguggcggcagaaccaguccaaccugaagaucgaggugguccccgacugccaggagaagcgcagcuccggcccgagcuccagccuggacaacgggaacucccucgacgugcugaagaaccacguccugaacgagcucauccagaccgagcgcguguacgugcgggagcuguacaccguccugcucggcuaccgcgccgagauggacaaccccgagauguucgaccugaugccgccccugcuccggaacaagaaggacauccuguucgggaacauggccgagaucuacgaguuccacaacgacaucuuccugagcucccucgagaacugcgcgcacgcccccgagcgcgugggccccugcuuccuggagcggaaggacgacuuccagauguacgccaaguacugccagaacaagccccgcagcgagaccaucuggcggaaguacuccgagugcgccuucuuccaggagugccagcgcaagcugaagcaccggcuccgccuggacagcuaccugcucaagcccgugcagcggaucacgaaguaccagcugcugcucaaggagcugcugaaguacagcaaggacugcgagggguccgcgcuccugaagaaggcccuggacgccaugcucgaccugcucaagagcgucaacgacuccaugcaccagaucgccaucaacggcuacaucggcaaccugaacgagcuggggaagaugaucaugcagggcggguucagcguguggaucggccacaagaagggggccaccaagaugaaggaccuggcgcgcuucaagccgaugcagcggcaccucuuccuguacgagaaggccaucguguucugcaagcgccgggucgaguccggcgagggcagcgaccgcuaccccuccuacagcuucaagcacugcuggaagauggacgagguggggaucaccgaguacgugaagggcgacaaccggaaguucgagaucugguacggggagaaggaggaggucuacaucgugcaggccuccaacguggacgucaagaugaccuggcugaaggagauccgcaacauccuccugaagcagcaggagcugcucacggugaagaagcggaagcagcaggaccagcugaccgagcgcgacaaguuccagaucagccugcagcagaacgacgagaagcagcagggcgccuucaucuccaccgaggagaccgagcucgagcacaccagcacgguggucgaggugugcgaggccaucgcguccgugcaggccgaggccaacaccgucuggaccgaggccagccaguccgccgagaucagcgaggagcccgcggagugguccagcaacuacuucuaccccaccuacgacgagaacgaggaggagaaccgcccgcugaugcggcccgugagcgagauggcccugcucuacuga

SEQ ID NO: 32773 - RNA, 3345 nt, Artificial Sequence
  derived and/or modified sequence opt1 from MCF2L2__Homo_sapiens__NP_055893
augcugagcugccucaaggaggagaugcccccgcaggagcugacccgccggcuggccaccgugaucacgcacgucgacgagaucaugcagcaggaggugcgcccccucauggccguggagaucaucgagcagcugcaccggcaguucgcgauccuguccggcgggcgcggcgaggacggggcccccaucaucaccuuccccgaguucagcggcuucaagcacaucccggacgaggacuuccucaacgucaugaccuaccugaccuccauccccagcguggaggccgccuccaucggguucaucguggucaucgaccggcgccgggacaaguggagcuccgugaaggccagccugacgcgcaucgcgguggccuuccccggcaaccuccagcugaucuucauccugcggcccucccgcuucauccagcggaccuucaccgacaucggcaucaaguacuaccgcaacgaguucaagaccaaggucccgaucaucauggugaacagcguguccgaccuccacggguacaucgacaagagccagcugacgcgggagcugggcgggacccucgaguaccgccacggccagugggucaaccaccggaccgccaucgagaacuucgcccugacccugaagacgaccgcgcagaugcuccagaccuucggguccugccuggccaccgccgagcugccccgcagcaugcucuccacggaggaccugcugaugagccacacccggcagcgcgacaagcuccaggacgagcugaagcugcucggcaagcagggcaccacccugcuguccugcauccaggagcccgccacgaagugccccaacagcaagcucaaccugaaccagcuggagaacgugaccaccauggagcggcuccuggugcagcuggacgagaccgagaaggccuucucccacuucuggagcgagcaccaccucaagcugaaccagugccugcagcuccagcacuucgagcacgacuucugcaaggcgaagcuggcccuggacaaccuccuggaggagcaggccgaguucacggggaucggcgacagcgucaugcacguggagcagauccugaaggagcacaagaagcucgaggagaagucccaggagccgcuggagaaggcccagcugcucgcccuggugggggaccagcugauccagagccaccacuacgcggccgacgccauccgcccccggugcgucgagcugcgccaccucugcgacgacuucaucaacggcaacaagaagaagugggacauccugggcaagucccuggaguuccaccgccagcucgacaaggugagccaguggugcgaggccgggaucuaccugcuggccucccaggcgguggacaagugccagagccgggagggcgucgacaucgcccucaacgacaucgccaccuuccuggggaccgugaaggaguacccccugcucucccccaaggaguucuacaacgaguucgagcugcugcucacccuggacgccaaggccaaggcgcagaaggugcugcagcgccucgacgacguccaggagaucuuccacaagcgccaggugagccugaugaagcuggccgccaagcagacgcggccgguccagcccguggcgccccaccccgaguccagcccgaaguggguguccagcaagaccucccagcccagcaccuccgucccccucgcccggccccugcgcaccagcgaggagccguacacggagaccgagcugaacucccggggcaaggaggacgacgagaccaaguucgaggugaaguccgaggagaucuucgagucccaccacgagcgcgggaaccccgagcucgagcagcaggcccggcugggcgaccugagcccccgccggcgcaucauccgggaccuccuggagaccgaggagaucuacaucaaggagaucaagagcaucaucgacggcuacaucacgcccauggacuucaucuggcugaagcaccucaucccggacgugcugcagaacaacaaggacuuccuguucgggaacauccgcgagcucuacgaguuccacaaccggaccuuccugaaggagcuggagaagugcgccgagaaccccgagcuccuggcccacugcuuccugaagcgcaaggaggaccuccagaucuacuucaaguaccacaagaaccugccccgggcccgcgcgaucuggcaggagugccaggacugcgccuacuucggcgucugccagcggcagcuggaccacaaccucccgcuguucaaguaccugaaggggcccucccagcgccucaucaaguaccagaugcugcugaagggccuccuggacuucgagagccccgaggacauggagaucgaccccggggagcugggcggcuccgccaaggacgggccgaagcgcaccaaggacagcgccuucuccaccgagcuccagcaggcccuggcggugaucgaggaccugaucaagagcugcgagcucgccguggaccuggccgccgucaccgagugccccgacgacaucggcaagcuggggaagcuccugcugcacggccccuucuccguguggacgauccacaaggaccgguacaagaugaaggaccucauccgcuucaagcccagccagcggcagaucuaccuguucgagcgcgggaucguguucugcaagauccggauggagccgggcgaccagggccugagcccccacuacagcuucaagaaggccaugaagcucaugacccuguccauccgccagcuggggcggggcagccaccgcaaguucgagaucgcgucccggaacgggcucgagaaguacauccugcaggccgccagcaaggagauccgcgacugcugguucuccgagaucagcaagcugcucauggagcagcagaacaacaucaaggaccagggcaacccccaguucgagauguccaccagcaagggcagcggggccggcuccgggcccuggaucaagaacauggagcgggcgaccacgagcaaggaggacccggccuccagcaccggcgggaucaagggcugcuccagccgcgaguucuccagcauggacaccuucgaggacugcgagggcgccgaggacauggagaaggaguccagcgcccugucccuggccgggcuguuccagagcgacgacucccacgagaccugcagcuccaagagcgcguuccucgagcggggcgaguccagccagggggagaaggaggagcgcgacgaggaggagacggccacccgguccaccgaggaggagcgcgccggcgccagcaccgggcggcuggcccccgcgggcgccacggccggcuuccaggcccgcgcccuccggccccgcaccagcgcgcaggaguccuga

SEQ ID NO: 32774 - RNA, 3378 nt, Artificial Sequence
  derived and/or modified sequence opt1 from MCF2L__Homo_sapiens__NP_001106203
augcgcuucuggcugcggaccgaggagauggcccucgaggagauggugcagcgccugaacgccgucagcaagcacaccgacgagaucaugcaccaggacaucgugccccugugcgcggccgacauccaggaccagcucaagaagcgguucgccuaccuguccggcgggcgcggccaggacgggagcccggugaucacguuccccgacuaccccgccuucuccgagauccccgacaaggaguuccagaacgucaugaccuaccugaccagcaucccgucccuccaggacgccggcaucggguucauccuggugaucgaccggcgccgggacaaguggaccagcgugaaggcguccguccugcgcaucgccgccagcuuccccgccaaccuccagcuggugcuggugcuccggcccacgggcuucuuccagcgcacccuguccgacaucgcguucaaguucaaccgggacgacuucaagaugaagguccccgugaucaugcugagcuccgugccggaccuccacggcuacaucgacaagagccagcugaccgaggaccucgggggcacccuggacuacugccacucccgcuggcugugccagcggacggccaucgagagcuucgcccugauggucaagcagaccgcccagaugcuccaguccuucgggaccgagcuggccgagaccgagcugcccaacgacgugcagagcacguccagcgugcucugcgcgcacaccgagaagaaggacaaggccaaggaggaccugcgccuggcccucaaggagggccacuccguccuggagagccugcgggagcuccaggccgaggggagcgagcccuccgugaaccaggaccagcuggacaaccaggccaccgugcagcgccugcucgcgcagcugaacgagaccgaggccgccuucgacgaguucugggccaagcaccagcagaagcuggagcagugccuccagcugcggcacuucgagcagggcuuccgcgaggucaaggccauccuggacgcggccagccagaagaucgccacguucaccgacaucggcaacucccucgcccacguggagcaccuccugcgggaccuggccagcuucgaggagaaguccgggguggcggucgagcgcgcccgggcccugagccuggacggcgagcagcucaucgggaacaagcacuacgccguggacuccauccgccccaagugccaggagcugcgccaccugugcgaccaguucagcgcggagaucgcccggcgccggggccuccuguccaagagccuggagcugcaccgccggcucgagaccuccaugaaguggugcgacgagggcaucuaccugcuggccagccagccgguggacaagugccagucccaggacggggccgaggccgcgcuccaggagaucgagaaguuccuggagaccggcgccgagaacaagauccaggagcugaacgccaucuacaaggaguacgagagcauccucaaccaggaccugauggagcacguccgcaagguguuccagaagcaggccuccauggaggaggucuuccaccggcgccaggccagccugaagaagcucgcggcccggcagacgcgccccgugcagcccguggcgccccggccggaggcccuggccaagucccccugccccagccccgggauccgccggggcuccgagaacagcagcuccgagggcggggcccugcgccggggcccguaccgccgggccaagagcgagauguccgagagccgccaggggcggggcuccgccggggaggaggaggagagccucgccauccugcgccgccacgucauguccgagcugcucgacaccgagcgggcguacguggaggagcugcugugcgugcucgagggcuacgccgccgagauggacaacccccugauggcccaccuccugagcaccgggcugcacaacaagaaggacguccuguucggcaacauggaggagaucuaccacuuccacaaccgcaucuuccuccgggagcuggagaacuacaccgacugccccgagcuggugggccgcugcuuccucgagcggauggaggacuuccagaucuacgagaaguacugccagaacaagccccgcuccgagagccuguggcggcagugcuccgacugcccguucuuccaggagugccagcgcaagcuggaccacaagcucagccuggacuccuaccugcucaagcccgugcagcggaucacgaaguaccagcugcugcucaaggagaugcugaaguacagccgcaacugcgagggggccgaggaccugcaggaggcgcucuccagcauccugggcauccugaaggccgucaacgacuccaugcaccucaucgccaucaccggguacgacggcaaccugggggaccugggcaagcuccugaugcagggcagcuucagcguguggaccgaccacaagcgggggcacaccaaggugaaggagcuggcccgcuucaagcccaugcagcggcaccucuuccugcacgagaaggccguccuguucugcaagaagcgcgaggagaacggcgagggguacgagaaggcgcccuccuacagcuacaagcagucccucaacauggccgccgugggcaucacggagaacgugaagggcgacgccaagaaguucgagaucugguacaacgcccgggaggaggucuacaucgugcaggcgccgacccccgagaucaaggccgccugggugaacgagauccgcaagguccugaccagccagcugcaggccugccgggaggcgucccagcaccgcgcccucgagcagagccagucccugccccugccggcccccaccagcacgucccccagccgggggaacucccgcaacaucaagaagcucgaggagcggaagaccgacccccugagccuggagggcuacguguccagcgccccgcucaccaagccgcccgagaaggggaagggcugguccaagaccagccacucccuggaggcccccgaggacgacgggggcuggagcuccgcggaggagcagaucaacagcagcgacgccgaggaggacggcgggcugggccccaagaagcucgugcccgggaaguacacggucguggccgaccacgagaagggcgggcccgacgcccugcgcgugcgcuccggcgacgucguggagcuggugcaggagggcgacgaggggcucugguacguccgggaccccaccaccggcaaggaggggugggugccggccagcucccugagcgugcgccugggccccuccgggagcgcgcagugccucuccagcuccgagagcucccccggcagcgccguccuguccaacagcuccagcugcuccgagggcgggcaggcccccuucagcgaccugcagggcuga

SEQ ID NO: 32775 - RNA, 441 nt, Artificial Sequence
  derived and/or modified sequence opt1 from MCFD2__Homo_sapiens__NP_001164979
augaccaugcgcagccugcuccggacccccuuccugugcggccugcucugggccuucugcgccccgggggcccgcgccgaggagcccgccgccuccuucagccagcccggcuccauggggcuggacaagaacacggugcacgaccaggagcacaucauggagcaccuggagggcgucaucaacaagcccgaggccgagaugagcccgcaggagcuccagcugcacuacuucaagaugcacgacuacgacgggaacaaccugcucgacggccuggagcuguccaccgcgaucacccacgugcacaaggaggagggcagcgagcaggcgccccucauguccgaggacgagcugaucaacaucaucgacggggugcugcgggacgacgacaagaacaacgacggcuacaucgacuacgccgaguucgccaagagccuccaguga

SEQ ID NO: 32776 - RNA, 1269 nt, Artificial Sequence
  derived and/or modified sequence opt1 from MCHR1__Homo_sapiens__NP_005288
augagcgugggcgccaugaagaagggggucggccgcgccguggggcugggcgggggcuccggcugccaggcgaccgaggaggacccccucccgaacugcggggccugcgcccccggccagggcgggcggcgcuggcggcugccccagcccgccuggguggaggggagcuccgcccgccugugggagcaggcgaccggcacgggcuggauggaccucgaggccagccugcugccgaccgggcccaacgccuccaacaccagcgacggccccgacaaccucaccuccgccgggagcccgccccggacgggcuccaucagcuacaucaacaucaucaugcccuccgucuucggcaccaucugccugcuggggaucaucggcaacagcaccgugaucuucgcgguggucaagaaguccaagcuccacuggugcaacaacgugcccgacaucuucaucaucaaccugagcguggucgaccuccuguuccugcuggggaugcccuucaugauccaccagcucaugggcaacgggguguggcacuucggcgagaccaugugcacgcugaucaccgccauggacgccaacucccaguucaccagcaccuacauccugacggccauggccaucgaccgcuaccucgcgaccgugcacccgaucuccagcaccaaguuccggaagcccuccgucgccacccuggugaucugccugcucugggcccugagcuucaucagcaucacgcccguguggcuguacgcccgccucauccccuucccgggcggggccgucggcugcgggauccggcugcccaaccccgacaccgaccuguacugguucacccucuaccaguucuuccuggcguucgcccugcccuucguggugaucaccgccgccuacguccgcauccuccagcggaugacguccagcguggccccggcgucccagcgcagcauccggcugcgcaccaagcgggugacccgcaccgccaucgccaucugccuggucuucuucgugugcugggcccccuacuacgugcuccagcugacgcagcuguccaucagccggcccacccucaccuucgucuaccuguacaacgccgcgaucucccugggcuacgccaacagcugccucaaccccuucguguacaucguccugugcgagaccuuccgcaagcggcuggugcucuccgugaagccggccgcccaggggcagcugcgcgcggucagcaacgcccagacggccgacgaggagcggaccgaguccaagggcaccuga

SEQ ID NO: 32777 - RNA, 1023 nt, Artificial Sequence
  derived and/or modified sequence opt1 from MCHR2__Homo_sapiens__NP_001035269
augaaccccuuccacgccagcugcuggaacaccuccgccgagcugcucaacaagagcuggaacaaggaguucgcguaccagaccgccuccguggucgacacggugauccugccgagcaugaucggcaucaucugcuccaccgggcuggugggcaacauccucaucgucuucaccaucauccgcagccggaagaagaccgugcccgacaucuacaucugcaaccuggccguggccgaccugguccacaucguggggaugcccuuccucauccaccagugggcccgcggcggggaguggguguucggcggcccccugugcacgaucaucaccucccuggacacgugcaaccaguucgcgugcagcgccaucaugaccgucauguccguggaccgguacuucgcccucgugcagccguuccgccugacccgguggcgcacccgguacaagaccauccgcaucaaccuggggcucugggccgcgagcuucauccuggcccugcccgucuggguguacuccaaggugaucaaguucaaggacggcgucgagagcugcgccuucgaccucaccucccccgacgacgugcugugguacacgcuguaccucaccaucaccaccuucuucuucccccugccgcugauccucgugugcuacauccugauccugugcuacacgugggagauguaccagcagaacaaggacgcccggugcugcaaccccagcguccccaagcagcgcgugaugaagcucaccaagauggugcugguccuggugguggucuucauccucuccgccgcgcccuaccacgugauccagcuggucaaccugcagauggagcagccgacccucgccuucuacgugggguacuaccugagcaucugccuguccuacgccagcuccagcaucaaccccuuccucuacauccugcugagcggcaacuuccagaagcggcucccccagauccagcgccgggccaccgagaaggagaucaacaacauggggaacacgcugaagucccacuucuga

SEQ ID NO: 32778 - RNA, 1158 nt, Artificial Sequence
  derived and/or modified sequence opt1 from MCIDAS__Homo_sapiens__NP_001177716
augcaggccugcggcgggggcgccgcggggcgccgggccuucgacagcaucugccccaaccgcaugcuggcccucccgggccgggcccugcugugcaagcccgggaagcccgagcgcaaguucgcccccccgcggaaguucuuccccggcugcaccggcgggucccccgugagcgucuacgaggaccccccggacgcggagcccaccgcccuccccgcccugacgaccaucgaccugcaggaccucgccgacugcuccagccugcugggcuccgacgcgcccccggggggcgaccucgccgccagccagaaccacucccaccagaccgaggccgacuucaaccugcaggacuuccgcgacaccguggacgaccugaucagcgacuccagcuccaugaugagccccacgcucgccuccggggacuuccccuucagccccugcgacaucuccccguucggccccugccugagccccccccuggacccgcgggcgcuccagucccccccccugcgccccccggacgugcccccccccgagcaguacuggaaggaggucgccgaccagaaccagcgggcccugggcgacgcccucguggagaacaaccagcugcacgugacccugacccagaagcaggaggagaucgccagccucaaggagcgcaacguccagcugaaggagcuggcgucccggacccgccaccucgccagcgugcuggacaagcugaugaucacgcagagccgggacugcggggccgccgccgagccguuccuccugaaggcgaaggccaagcgcucccuggaggagcucgugagcgccgccggccaggacugcgccgaggucgacgcgauccugcgggagaucuccgagcgcugcgacgaggcccugcagagccgggaccccaagcgcccccggcuccugccggagcccgccaacaccgacacccgccccgggaaccugcacggcgccuuccggggccuccgcaccgacugcucccgcagcgcgcugaaccugucccacagcgagcucgaggaggggggcuccuucagcacgcggauccgcucccacagcaccauccggacccuggccuucccccaggggaacgccuucaccauccgcacggccaacggcggguacaaguuccggugggugccguccuga

SEQ ID NO: 32779 - RNA, 2625 nt, Artificial Sequence
  derived and/or modified sequence opt1 from MCM10__Homo_sapiens__NP_060988
auggacgaggaggaggacaaccugagccuccugaccgcccugcucgaggagaacgaguccgcccuggacugcaacagcgaggagaacaacuuccugacccgcgagaacggcgagcccgacgcguucgacgagcucuucgacgccgacggggacggcgaguccuacacggaggaggccgacgacggggagaccggcgagacccgggacgagaaggagaaccuggccacccuguucggggacauggaggaccucacggacgaggaggaggugccggccagccaguccaccgagaaccgcguccugcccgcgcccgccccccggcgcgagaagaccaacgaggagcugcaggaggagcuccggaaccugcaggagcagaugaaggcccugcaggagcagcucaaggugaccacgaucaagcagaccgccagcccggcgcgccugcagaagucccccgagaagagcccccggcccccgcugaaggagcgccgggugcagcgcauccaggaguccaccugcuucagcgccgagcucgacguccccgcccugccccggaccaagcgcguggcccggacgcccaaggccuccccgcccgaccccaagagcuccagcucccgcaugaccagcgcgcccucccagccgcugcagaccaucagccggaacaagcccuccggcaucacccgcggccagaucguggggacgcccggcagcagcggggagaccacccagcccaucugcgucgaggccuucuccggccuccggcugcgccggccgcgcgugagcuccaccgagaugaacaagaagaugacggggcggaagcugauccgccucagccagaucaaggagaagauggcccgcgagaagcuggaggagaucgacugggugaccuucggcgucauccugaagaaggugaccccccaguccgugaacagcggcaagaccuucuccaucuggaagcucaacgaccugcgggaccugacgcagugcgucagccucuuccuguucggggaggugcacaaggcccuguggaagaccgagcagggcaccguggucgggauccucaacgccaaccccaugaagcccaaggacggcuccgaggaggugugccugagcaucgaccacccgcagaaggugcugaucaugggcgaggcgcucgaccuggggaccugcaaggccaagaagaagaacggcgagcccugcacgcagaccgucaaccugcgcgacugcgaguacugccaguaccacgugcaggcccaguacaagaagcucuccgccaagcgggccgaccugcagagcaccuucuccgggggccgcauccccaagaaguucgcgcggcgcgggaccagccugaaggagcggcucugccaggacggcuucuacuacggcgggguguccagcgccuccuacgccgccagcaucgccgcggccgucgcccccaagaagaagauccagacgacccuguccaaccugguggugaagggcaccaaccucaucauccaggagacccgccagaagcuggggaucccgcagaagagccugagcugcuccgaggaguucaaggagcucauggaccugcccacgugcggcgcccggaaccugaagcagcaccuggcgaaggccaccgccagcgggaucaugggcucccccaagccggccaucaagagcaucuccgccagcgcgcuccugaagcagcagaagcagcgcaugcuggagaugcggcgccggaaguccgaggagauccagaagcgcuuccuccagagcuccagcgaggucgagucccccgccgugcccagcuccagccggcagcccccggcccagcccccccgcaccggcuccgaguucccccggcuggagggggccccggccaccaugacccccaagcugggccgcgggguccucgagggcgacgacgugcuguucuacgacgagagcccccccccgcggcccaagcuguccgcgcucgccgaggccaagaagcuggccgccaucacgaagcugcgcgcgaaggggcaggugcucaccaagaccaaccccaacagcaucaagaagaagcagaaggacccccaggacauccuggaggucaaggagcgcguggagaagaacaccauguucagcucccaggccgaggacgagcuggagccggcccggaagaagcgccgggagcagcucgccuaccuggagagcgaggaguuccagaagauccugaaggcgaaguccaagcacacgggcauccucaaggaggccgaggccgagaugcaggagcgcuacuucgagccccuggugaagaaggagcagauggaggagaagaugcggaacauccgcgaggucaagugccggguggugaccugcaagaccugcgccuacacccacuucaagcugcucgagacgugcgucagcgagcagcacgaguaccacuggcacgacggcgugaagcgcuucuucaagugccccugcgggaaccgguccaucagccuggaccgccugcccaacaagcacugcuccaacugcggccucuacaagugggagcgggacgggaugcugaaggagaagaccggcccgaagaucggcggggagacccugcucccccgcggcgaggagcacgccaaguuccugaacagccugaaguga

SEQ ID NO: 32780 - RNA, 2715 nt, Artificial Sequence
  derived and/or modified sequence opt1 from MCM2__Homo_sapiens__NP_004517
auggccgagagcuccgagagcuucaccauggccuccagccccgcgcagcgccggcgcggcaacgacccgcugaccuccagccccgggcgguccagccgccggacggacgcccucaccuccagccccggccgcgaccugcccccguucgaggacgaguccgaggggcugcucggcaccgaggggccccuggaggaggaggaggacggcgaggagcugaucggcgacgggauggagcgggacuaccgcgccauccccgagcucgacgccuacgaggccgagggccuggcgcuggacgacgaggacguggaggagcucaccgccagccagcgggaggccgccgagcgcgcgaugcggcagcgcgaccgggaggccgggcgcggccuggggcggaugcgccggggccugcucuacgacuccgacgaggaggacgaggagcgccccgcccggaagcgccggcaggucgagcgcgccacggaggacggcgaggaggacgaggagaugaucgagagcaucgagaaccuggaggaccugaaggggcacuccgugcgcgagugggugagcauggccggcccgcggcucgagauccaccaccgcuucaagaacuuccugcggacccacgucgacucccacgggcacaacguguucaaggagcgcaucagcgacaugugcaaggagaaccgggagucccugguggucaacuacgaggaccucgcggcccgcgagcacgugcuggccuacuuccugcccgaggcccccgccgagcuccugcagaucuucgacgaggcggcccuggaggugguccucgccauguaccccaaguacgaccggaucaccaaccacauccacgugcgcaucagccaccucccgcugguggaggagcuccggagccugcgccagcugcaccucaaccagcugauccggaccuccggcgucgugacgagcugcaccggcgugcugccccagcucuccauggucaaguacaacugcaacaagugcaacuucgugcuggggcccuucugccagagccagaaccaggaggugaagcccggcuccugcccggagugccagagcgccgggcccuucgaggucaacauggaggagaccaucuaccagaacuaccagcgcauccggauccaggagucccccggcaagguggccgcggggcgccugccccggagcaaggacgccauccuccuggccgaccugguggacuccugcaagccgggcgacgagaucgagcucaccggcaucuaccacaacaacuacgacgggagccugaacacggccaacggcuuccccgucuucgccaccgugauccuggcgaaccacguggccaagaaggacaacaaggucgccgugggggagcucaccgacgaggacgucaagaugaucaccucccugagcaaggaccagcagaucggcgagaagaucuucgccuccaucgcgcccagcaucuacgggcacgaggacaucaagcgcggccuggcccucgcccuguucggcggggagcccaagaacccgggcgggaagcacaaggugcggggcgacaucaacgugcugcucugcggggaccccggcacggccaagucccaguuccugaaguacaucgagaaggucagcucccgcgccaucuucaccaccggccagggggcgagcgccgugggccugaccgccuacgugcagcggcaccccgucucccgcgaguggacgcuggaggccggggcccucgugcuggcggaccgcggcgugugccugaucgacgaguucgacaagaugaacgaccaggaccggaccagcauccacgaggccauggagcagcagagcaucuccaucagcaaggccggcaucgucaccucccuccaggcccgcugcaccgugaucgccgcggccaaccccaucgggggccgguacgacccgagccugacguucuccgagaacguggaccugaccgagcccaucaucagccgcuucgacauccucugcgucgugcgggacaccguggaccccguccaggacgagaugcuggcccgcuucgugguggggucccacguccggcaccacccgagcaacaaggaggaggagggccuggccaacggguccgcggccgagcccgccaugcccaacaccuacggcguggagccccucccgcaggaggugcugaagaaguacaucaucuacgccaaggagcgcguccaccccaagcugaaccagauggaccaggacaagguggccaagauguacagcgaccuccggaaggaguccauggcgacgggcagcauccccaucaccgugcgccacaucgaguccaugauccggauggccgaggcccacgcccgcauccaccuccgggacuacgucaucgaggacgacgugaacauggccauccgcgugaugcuggagagcuucaucgacacccagaaguucuccgucaugcggagcaugcgcaagaccuucgcgcgguaccuguccuuccgccgggacaacaacgagcugcugcuguucauccugaagcagcugguggccgagcaggucacguaccagcgcaaccgguucggggcccagcaggacaccaucgaggugcccgagaaggaccucguggacaaggcccgccagaucaacauccacaaccugagcgccuucuacgacagcgagcuguuccgcaugaacaaguucucccacgaccucaagcggaagaugauccugcagcaguucuga

SEQ ID NO: 32781 - RNA, 5943 nt, Artificial Sequence
  derived and/or modified sequence opt1 from MCM3AP__Homo_sapiens__XP_006724127
augaaccccaccaacccguucagcggccagcagcccagcgcguucagcgccuccagcuccaacguggggacccugcccagcaagccgcccuuccgguucggccagcccucccucuucgggcagaacagcacccuguccggcaagagcuccggguucagccaggucuccagcuuccccgcguccagcggcgugucccacagcuccagcgugcagacccugggcuucacccagaccagcuccgucgggcccuucagcggccucgagcacacguccaccuucguggccaccagcgggcccuccagcuccagcgugcugggcaacaccggguucuccuucaagagccccacguccgucggcgccuuccccagcaccuccgccuucggccaggaggccggggagaucgugaacagcggcuucgggaagaccgaguucuccuucaagccccuggagaacgcgguguucaagccgauccucggcgccgagagcgagcccgagaagacccagucccagaucgccagcggcuucuucacguucucccaccccaucagcagcgcccccgggggccuggcgccguucuccuucccccaggucaccagcuccagcgccaccaccuccaacuucacguucagcaagcccguguccagcaacaacucccugagcgccuucacccccgcccucuccaaccagaacguggaggaggagaagcgggggcccaagagcaucuucggcuccagcaacaacuccuucagcuccuuccccgucagcagcgccgugcugggggagcccuuccaggcguccaaggccggcgugcgccagggcugcgaggaggccgucagccagguggagccccugccgucccucaugaaggggcugaagcggaaggaggaccaggaccgcagcccccggcgccacggccacgagcccgccgaggacuccgacccccugagccgcggcgaccacccgcccgacaagcgccccgugcggcucaaccgcccgcggggcgggacccuguucggccgcaccauccaggacgucuucaaguccaacaaggaggugggccggcuggggaacaaggaggccaagaaggagacgggcuucguggagagcgcggaguccgaccacauggccauccccgggggcaaccagagcguccucgcccccucccgcauccccggggugaacaaggaggaggagaccgagagccgggagaagaaggaggacucccugcgcggcaccccggcccggcagagcaaccgcuccgagagcaccgacucccugggcgggcucagccccuccgaggugacggccauccagugcaagaacauccccgacuaccugaacgaccggaccauccuggagaaccacuucggcaagaucgcgaagguccagcgcaucuucacccggcgcagcaagaagcucgccgugguccacuucuucgaccacgccagcgccgcccuggcgcgcaagaaggggaagucccugcacaaggacauggccaucuucuggcaccggaagaagaucagccccaacaagaagccguucucccucaaggagaagaagcccggcgacggcgaggugagccccuccaccgaggacgcccccuuccagcacagcccgcuggggaaggccgcgggccgcacgggggccuccagccugcucaacaaguccagccccgugaagaagcccucccugcugaaggcccaccaguucgagggcgacagcuucgacuccgccagcgagggguccgagggccucggccccugcguccugagccuguccacccucaucgggaccguggccgagaccagcaaggagaaguaccggcugcuggaccagcgcgaccggaucaugcgccaggcgcgggugaagcgcacggaccucgacaaggcccggaccuucgucgggaccugccuggacaugugcccggagaaggagcgcuacaugcgggagacccgcucccagcugagcguguucgaggugguccccgggacggaccagguggaccacgccgccgccgugaaggaguacagccgguccagcgcggaccaggaggagccccucccccacgagcugcgcccgcugcccguccucucccggaccauggacuaccuggugacccagaucauggaccagaaggagggcagccugcgcgacugguacgacuucguguggaaccggacccgcgggauccggaaggacaucacccagcagcaccucugcgacccccugacggucucccugaucgagaagugcacccgcuuccacauccacugcgcccacuucaugugcgaggagcccaugagcuccuucgacgccaagaucaacaacgagaacaugaccaagugccugcagagccucaaggagauguaccaggaccugcgcaacaagggcguguucugcgccuccgaggccgaguuccagggcuacaacgugcugcucagccugaacaagggggacauccugcgggagguccagcaguuccacccggcggugcgcaacuccagcgaggugaaguucgccguccaggccuucgccgcgcucaacuccaacaacuucgugcgguucuucaagcuggugcagagcgccuccuaccugaacgccugccuccugcacugcuacuucagccagauccgcaaggacgcccugcgggcccucaacuucgcguacaccgucuccacgcagcgcagcaccaucuucccccuggacggcguggugcggaugcuccuguuccgcgacugcgaggaggccaccgacuuccugaccugccacgggcugacggucuccgacggcugcguggagcucaaccggagcgccuuccuggagcccgaggggcugagcaagacccgcaaguccguguucaucacccggaagcucaccgucagcgugggcgagaucgugaacggcgggccgcugccgcccgucccccgccacacgccggugugcuccuucaacagccagaacaaguacaucggcgagucccuggccgccgagcuccccgugagcacccagcggcccggguccgacaccgucggcgggggccgcggcgaggagugcgggguggagcccgacgcgccgcugagcucccugccccagagccuccccgcccccgccccgucccccgugccccugcccccgguccuggcccucacccccagcguggcccccucccuguuccagcugagcgugcagcccgagccgccgccgcccgagccgguccccauguacuccgacgaggaccucgcccaggugguggacgagcugauccaggaggcccugcagcgggacugcgaggaggucggcagcgccggggccgcguacgccgccgccgcccucggcguguccaacgcggccauggaggaccugcugacggccgccaccaccggcauccuccgccacaucgccgcggaggaggugagcaaggagcgggagcgccgggagcaggagcgccagcgggccgaggaggagcgccugaagcaggagcgcgagcugguccucuccgagcugagccaggggcuggccguggagcucauggagcgggugaugauggaguucguccgcgagaccugcagccaggagcugaagaacgccguggagacggaccagcggguccgcguggcccggugcugcgaggacgugugcgcgcaccuggucgaccucuuccugguggaggagaucuuccagaccgccaaggagacccugcaggagcuccagugcuucugcaaguaccugcagcgcuggcgggaggccgugaccgcccgcaagaagcugcggcgccagaugcgggccuuccccgcggcccccugcugcgucgacguguccgaccgccuccgggcccuggccccgagcgcggagugccccaucgccgaggagaaccuggcccgcggccuccuggaccuggggcacgccggccggcucgggaucuccugcacgcgccugcggcgccugcggaacaagaccgcccaccagaugaaggugcagcacuucuaccagcagcuccugagcgacgucgcgugggccucccuggaccuccccagccugguggccgagcaccuccccggccgccaggagcacguguucuggaagcugguccuggugcugcccgacguggaggagcagucccccgagagcugcggccgcauccucgccaacuggcugaaggucaaguucaugggggacgagggcuccguggacgacaccagcuccgacgccgggggcauccagacccugagccucuucaacucccugagcuccaagggggaccagaugaucagcgugaacgucugcaucaagguggcgcacggcgcccuguccgacggcgccaucgacgccguggagacgcagaaggaccuccugggggccagcggccugaugcuccugcugcccccgaagaugaaguccgaggacauggcggaggaggacgucuacuggcucagcgcccugcugcagcucaagcagcugcugcaggccaagcccuuccagcccgcccucccccugguggugcuggucccgagccccgggggcgacgcgguggagaaggagguggaggacgggcucaugcugcaggaccuggucuccgccaagcugaucagcgacuacaccgugaccgagauccccgacaccaucaacgaccuccagggcuccacgaaggugcugcaggccguccaguggcuggugagccacugcccccacucccucgaccugugcugccagacccugauccaguacguggaggacggcaucgggcacgaguucagcggccgguucuuccacgaccgccgggagcgccggcucgggggccuggccucccaggagccgggcgccaucaucgagcuguucaacagcguccuccaguuccuggcguccguggugagcuccgagcagcugugcgaccucagcuggcccgucaccgaguucgccgaggccgggggcucccgccugcugccccaccuccacuggaacgcccccgagcaccuggccuggcugaagcaggcggugcucggguuccagcugccgcagauggaccugccgccccucggcgcccccuggcugccggugugcagcauggucgugcaguacgccucccagauccccagcucccggcagacccagcccgugcugcagagccaggucgagaaccuccugcaccgcacguacugccgguggaaguccaagucccccagcccggugcacggggccggccccuccgugauggagauccccugggacgaccugaucgcccucugcaucaaccacaagcugcgcgacuggacgccgccccggcugcccgucaccagcgaggcgcucuccgaggacggccagaucugcguguacuucuucaagaacgaccugaagaaguacgacgugccccugagcugggagcaggcccgccuccagacccagaaggagcugcagcugcgggaggggcgccucgccaucaagcccuuccaccccuccgccaacaacuuccccaucccccugcugcacaugcaccggaacuggaagcgcagcaccgagugcgcgcaggagggccggaucccguccacggaggaccucaugcgcggggccagcgccgaggagcugcuggcccagugccucuccagcucccugcugcucgagaaggaggagaacaagcgguucgaggaccagcugcagcaguggcugagcgaggacuccggcgccuucaccgaccucaccagccugccccuguaccucccccagacccuggucucccugagccacacgaucgagcccgugaugaagaccuccgugaccaccagcccgcagagcgacaugaugcgcgagcagcuccagcuguccgaggcgacggggaccugccugggcgagcggcucaagcaccuggagcgccugauccgcagcucccgggaggaggaggucgccagcgagcuccaccuguccgcccugcucgacaugguggacaucuga

SEQ ID NO: 32782 - RNA, 2457 nt, Artificial Sequence
  derived and/or modified sequence opt1 from MCM3__Homo_sapiens__NP_001257401
augcugaucugcagccagggcccccgccucuuccuggaggugaccuucgggggcgggaaguccagcgaggucuucgccccgggcuggucccaccccgggaaccugcacgccacccucguggaggugguccuguggcagcgggcguggcgcgugcccuggugcuggacgauguggagcugcggccggcugcgcgagaucaccuggaccuccuggaccacgcggcuccugaacaacgccuucgaggagcugguggccuuccagcgcgcccucaaggacuucgucgccagcaucgacgcgaccuacgccaagcaguacgaggaguucuacgugggccuggagggguccuucggcagcaagcacgugagcccccggacccugaccuccugcuuccucuccugcgucgugugcguggaggggaucgucacgaagugcagccuggugcgcccgaaggugguccgguccgugcacuacugccccgccaccaagaagaccaucgagcgccgguacagcgaccugaccacgcucguggccuuccccuccagcuccgucuaccccaccaaggacgaggagaacaacccgcuggagaccgaguacggccugagcguguacaaggaccaccagaccaucacgauccaggagaugcccgagaaggcgcccgccgggcagcucccccgcuccguggacgucauccuggacgacgaccugguggacaaggccaagccgggcgaccgggugcaggucgugggcaccuaccgcugccuccccgggaagaagggcggguacaccagcggcaccuuccggacgguccugaucgccugcaacgugaagcagaugagcaaggacgcccagcccuccuucagcgcggaggacaucgccaagaucaagaaguucuccaagacccgcagcaaggacaucuucgaccagcuggccaagucccucgcccccagcauccacggccacgacuacgugaagaaggccauccugugccugcuccucgggggcgucgagcgggaccuggagaacgggucccacauccgcggcgacaucaacauccugcugaucggggacccgagcguggcgaagucccagcugcuccgguacgugcugugcaccgcgccccgcgccauccccaccacgggccggggcagcuccggggucggccugaccgccgccgugaccaccgaccaggagacgggggagcgccgccucgaggccggcgccauggugcuggccgaccgcggggucgugugcaucgacgaguucgacaagaugagcgacauggaccggaccgccauccacgaggugauggagcagggccgggucaccaucgccaaggcgggcauccacgcccgccugaacgcccggugcuccgugcucgccgcggccaaccccguguacgggcgcuacgaccaguacaagaccccgauggagaacaucggccugcaggacagccugcucucccgguucgaccugcuguucaucaugcucgaccagauggaccccgagcaggaccgcgagaucagcgaccacguccugcggaugcaccgcuaccgggcccccggggagcaggacggcgacgccaugccccugggguccgccguggacauccucgcgacggacgacccgaacuucagccaggaggaccagcaggacacccagaucuacgagaagcacgacaaccugcugcacggcaccaagaagaagaaggagaagaugguguccgccgccuucaugaagaaguacauccacgucgccaagaucaucaagcccgugcugacccaggagagcgccacguacaucgcggaggaguacagccgccuccggucccaggacagcauguccagcgacaccgcccgcaccucccccgugaccgcccggacccuggagacgcugauccgccucgccaccgcccacgcgaaggcccggaugagcaagaccgucgaccugcaggacgccgaggaggccguggagcuggugcaguacgcguacuucaagaagguccucgagaaggagaagaagcgcaagaagcgguccgaggacgagagcgagaccgaggacgaggaggagaagucccaggaggaccaggagcagaagcgcaagcgccggaagacgcgccagcccgacgccaaggacggcgacagcuacgacccguacgacuucuccgacaccgaggaggagaugccccaggugcacacccccaagaccgccgacagccaggagacgaaggagucccagaagguggagcugagcgagucccggcugaaggccuucaaggucgcccuccuggacguguuccgcgaggcgcacgcccagagcaucgggaugaaccggcugaccgaguccaucaaccgcgacagcgaggagccguucagcuccguggagauccaggccgcccucagcaagaugcaggacgacaaccaggucaugguguccgagggcaucaucuuccugaucuga

SEQ ID NO: 32783 - RNA, 2592 nt, Artificial Sequence
  derived and/or modified sequence opt1 from MCM4__Homo_sapiens__NP_877423
augagcucccccgccagcaccccgucccgccggggcagccgccgggggcgcgccacccccgcgcagacgccccgguccgaggacgcccgcagcucccccagccagcggcgccggggcgaggacuccaccagcaccggggagcugcagccgaugcccaccucccccggcguggaccuccagagccccgccgcccaggacguccuguucuccagcccgccccagaugcacuccagcgccaucccccuggacuucgacguguccagcccccucacguacgggaccccguccagccgcguggagggcacgccccggagcggcguccgcgggacccccgugcggcagcgccccgaccugggcuccgcgcagaaggggcuccagguggaccuccagagcgacggcgccgccgccgaggacaucgucgcguccgagcagagccuggggcagaagcuggugaucuggggcaccgacgugaacgucgccgccugcaaggagaacuuccagcgguuccuccagcgcuucaucgacccgcuggccaaggaggaggagaacgugggcaucgacaucaccgagccccuguacaugcagcggcucggggagaucaacgugaucggcgagcccuuccugaacgucaacugcgagcacaucaaguccuucgacaagaaccuguaccgccagcucaucagcuacccccaggaggugaucccgaccuucgacauggccgugaacgagaucuucuucgaccgguaccccgacuccauccuggagcaccagauccagguccgccccuucaacgcgcugaagaccaagaacaugcggaaccucaaccccgaggacaucgaccagcugaucacgaucagcgggauggugauccgcaccucccagcugaucccggagaugcaggaggccuucuuccagugccaggugugcgcccacaccacccgcgucgagauggaccggggccgcaucgccgagcccagcgugugcggccggugccacacgacccacuccauggcccucauccacaaccgcagccuguucuccgacaagcagaugaucaagcugcaggagagccccgaggacaugcccgcggggcagaccccgcacaccgugauccucuucgcccacaacgaccuggucgacaaggugcagcccggcgaccgggugaacgucacggggaucuaccgcgccgugcccauccgggucaacccgcgcguguccaacgucaagagcguguacaagacccacaucgacgugauccacuaccggaagaccgacgccaagcgccugcacggccucgacgaggaggccgagcagaagcuguucuccgagaagcggguggagcugcucaaggagcugagccgcaagcccgacaucuacgagcggcuggcguccgcccucgcccccagcaucuacgagcacgaggacaucaagaaggggauccugcugcagcuguucggcggcacccgcaaggacuucagccacacggggcggggcaaguuccgcgccgagaucaacauccugcugugcggggaccccggcaccuccaagagccagcuccugcaguacgucuacaaccuggugccgcgggggcaguacaccuccggcaagggcagcuccgccguggggcucaccgcguacgucaugaaggaccccgagacgcgccagcuggugcugcagaccggcgcccucgugcugagcgacaacgggaucugcugcaucgacgaguucgacaagaugaacgaguccacccggagcguccugcacgaggugauggagcagcagacccucuccaucgccaaggccggcaucaucugccagcugaacgcgcgcacgagcgugcuggccgccgccaaccccaucgagucccaguggaaccccaagaagaccaccaucgagaacauccagcugccgcacacccuccugagccgcuucgaccugaucuuccuccugcuggacccccaggacgaggccuacgaccggcgccucgcgcaccaccuggucgcccuguacuaccaguccgaggagcaggccgaggaggagcuccuggacauggccgugcugaaggacuacaucgccuacgcgcacagcacgaucaugccccggcucuccgaggaggccagccaggcccugaucgaggccuacguggacaugcgcaagaucggguccagccggggcauggucagcgccuacccccgccagcuggagucccucauccggcuggcggaggcccacgccaaggugcgccugagcaacaagguggaggccaucgacgucgaggaggcgaagcggcuccaccgcgaggcccugaagcaguccgccaccgacccgcggaccggcaucguggacaucagcauccugaccaccgggauguccgccacgagccgcaagcggaaggaggagcucgccgaggcgcugaagaagcugauccucuccaagggcaagacccccgcccugaaguaccagcagcuguucgaggacauccgcgggcagagcgacaucgccaucaccaaggacauguucgaggaggcccuccgggcccuggcggacgacgacuuccugaccgugacgggcaagaccguccgccuccuguga

SEQ ID NO: 32784 - RNA, 2205 nt, Artificial Sequence
  derived and/or modified sequence opt1 from MCM5__Homo_sapiens__NP_006730
augagcggcuucgacgaccccgggaucuucuacuccgacagcuucggcggggacgcccaggccgacgagggccaggcgcgcaagucccagcugcagcggcgcuucaaggaguuccuccggcaguaccgcguggggaccgaccggaccggcuucacguucaaguaccgcgacgagcugaagcggcacuacaaccugggcgaguacuggaucgaggucgagauggaggaccucgccagcuucgacgaggaccuggccgacuaccuguacaagcagccggccgagcaccuccagcugcuggaggaggccgcgaaggagguggccgacgaggugacccgcccccggcccuccggggaggagguccuccaggacauccaggugaugcucaagagcgacgccucccccagcuccauccgcagccugaaguccgacaugaugagccaccucgugaagaucccgggcaucaucaucgccgcguccgccguccgggccaaggccacccgcaucagcauccagugccgguccugccgcaacacccugacgaacaucgccaugcggcccgggcuggagggcuacgcgcucccccgcaagugcaacaccgaccaggccgggcggcccaagugcccgcuggaccccuacuucaucaugcccgacaagugcaagugcguggacuuccagacccugaagcuccaggagcugcccgacgccgugccgcacggcgagaugccccgccacaugcagcuguacugcgaccgguaccucugcgacaaggucgugcccggcaaccgcgugaccaucauggggaucuacagcaucaagaaguucggccugacgaccucccgggggcgcgaccgcgucggcgugggcauccggagcuccuacauccgcgugcuggggauccaggucgacaccgacggcagcgggcggagcuucgccggcgccgugagcccccaggaggaggaggaguuccgccggcucgcggcccugccgaacguguacgaggucaucagcaaguccaucgcccccagcaucuucgggggcaccgacaugaagaaggccaucgccugccugcuguucggcgggucccgcaagcggcugcccgacggccugacgcgccgcggggacaucaaccuccugaugcugggcgaccccgggaccgcgaagucccagcuccugaaguucguggagaagugcuccccgaucggcguguacaccagcggcaagggguccagcgccgccggccugaccgccuccgucaugcgggaccccagcucccggaacuucaucauggagggcggggccauggugcucgcggacgggggcguggucugcaucgacgaguucgacaagaugcgcgaggacgaccggguggccauccacgaggccauggagcagcagacgaucagcaucgccaaggcgggcaucaccaccacccugaacucccgcugcagcguccuggccgccgccaacuccguguucgggcggugggacgagacgaagggcgaggacaacaucgacuucaugcccaccauccucagccgcuucgacaugaucuucaucgugaaggacgagcacaacgaggagcgggacgucaugcuggccaagcacgugaucacccugcacguguccgcgcucacccagacgcaggccgucgagggggagaucgaccuggccaagcugaagaaguucaucgccuacugccgcgugaagugcggcccccggcucagcgccgaggcggccgagaagcugaagaaccgcuacaucaucaugcgcagcggcgcccggcagcacgagcgcgacuccgaccggcgcagcuccaucccgaucaccgugcggcagcuggaggccaucguccgcaucgccgaggcgcucagcaagaugaagcugcagcccuucgccaccgaggccgacguggaggaggcccugcggcuguuccagguguccacccucgacgcggcccugagcgggacgcuguccggcgucgagggguucaccagccaggaggaccaggagaugcucucccgcaucgagaagcagcugaagcggcgcuucgccaucggcagccagguguccgagcacagcaucaucaaggacuucaccaagcagaaguaccccgagcacgccauccacaaggugcugcagcucaugcugcggcgcggggagauccagcaccggaugcagcgcaagguccuguaccggcucaaguga

SEQ ID NO: 32785 - RNA, 2466 nt, Artificial Sequence
  derived and/or modified sequence opt1 from MCM6__Homo_sapiens__NP_005906
auggaccuggccgccgcggccgagcccggcgccgggagccagcaccucgaggugcgcgacgaggucgccgagaagugccagaagcuguuccuggacuuccucgaggaguuccaguccagcgacggcgagaucaaguaccugcagcuggccgaggagcucauccggccggagcgcaacacccuggugguguccuucgucgaccuggagcaguucaaccagcagcucagcaccacgauccaggaggaguucuaccggguguaccccuaccugugccgcgcgcugaagaccuucgugaaggaccggaaggagaucccccucgccaaggacuucuacgucgccuuccaggaccugcccacccgccacaagauccgggagcugaccuccagccgcaucgggcuccugacgcggaucuccggccagguggugcgcacccacccgguccaccccgagcuggugagcgggaccuuccucugccuggacugccagaccgugauccgggacgucgagcagcaguucaaguacacgcagcccaacaucugccgcaaccccgugugcgccaaccggcgccgguuccugcucgacaccaacaagucccgcuucguggacuuccagaagguccggauccaggagacccaggcggagcugccgcgcggcagcaucccccggucccuggaggugauccuccgcgccgaggccguggagagcgcccaggccggcgacaagugcgacuucaccgggacgcugaucgucgugcccgacguguccaagcugagcacccccggcgcgcgggccgagaccaacucccgcgucagcgggguggacggcuacgagaccgaggggauccgcggccuccgggcccugggcgugcgcgaccuguccuaccggcucgucuuccuggccugcugcguggccccgacgaacccccgcuucgggggcaaggagcugcgggacgaggagcagaccgcggagagcaucaagaaccagaugaccgucaaggagugggagaagguguucgagaugucccaggacaagaaccucuaccacaaccugugcaccagccuguuccccacgauccacgggaacgacgaggugaagcgcggcguccuccugaugcuguucggcggggugcccaagaccaccggcgaggggaccagccuccggggcgacaucaacgugugcaucgucggggacccguccacggccaagagccaguuccugaagcacguggaggaguucagcccccgcgccguguacaccagcggcaaggccuccagcgccgcgggccugaccgccgccgucgugcgggacgaggagucccacgaguucgugaucgaggccggggcccucaugcuggcggacaacggcgucugcugcaucgacgaguucgacaagauggacgugcgcgaccagguggccauccacgaggccauggagcagcagaccaucagcaucacgaaggccggggucaaggcgacccugaacgcccggaccuccauccucgccgccgccaaccccaucagcggccacuacgaccgcuccaagagccugaagcagaacaucaaccuguccgcgcccaucaugagccgguucgaccucuucuucauccugguggacgagugcaacgaggugaccgacuacgccaucgcccgccggaucgucgaccugcacucccgcaucgaggagagcaucgaccggguguacucccuggacgacauccgccgguaccuccuguucgcccgccaguucaagccgaagaucagcaaggaguccgaggacuucaucguggagcaguacaagcaccuccgccagcgggacgggagcggcgucacgaaguccuccuggcgcaucaccgugcggcagcuggagagcaugauccgccuguccgaggccauggcgcggaugcacugcugcgacgaggugcagcccaagcacgucaaggaggccuuccgccugcucaacaagagcaucauccggguggagacccccgacgugaaccuggaccaggaggaggagauccagauggaggucgacgagggcgccgggggcaucaacgggcacgccgacucccccgccccggugaacggcaucaacggguacaacgaggacaucaaccaggagagcgcgcccaaggccucccugcgccucggcuucagcgaguacugccggaucuccaaccugaucgugcugcaccuccgcaaggucgaggaggaggaggacgagagcgcccugaagcgguccgagcuggugaacugguaccucaaggagaucgagagcgagaucgacuccgaggaggagcugaucaacaagaagcgcaucaucgagaaggugauccaccggcugacccacuacgaccacguccucaucgagcugacgcaggccggccugaaggggagcaccgagggcuccgagagcuacgaggaggaccccuaccucguggugaaccccaacuaccugcuggaggacuga

SEQ ID NO: 32786 - RNA, 2160 nt, Artificial Sequence
  derived and/or modified sequence opt1 from MCM7__Homo_sapiens__NP_005907
auggcccugaaggacuacgcccucgagaaggagaaggugaagaaguuccugcaggaguucuaccaggacgacgagcugggcaagaagcaguucaaguacgggaaccagcucguccgccuggcgcaccgggagcaggucgcccuguacguggaccucgacgacguggccgaggacgaccccgagcugguggacagcaucugcgagaacgcccgccgguacgccaagcuguucgcggacgccgugcaggagcuccugccgcaguacaaggagcgcgaggucgugaacaaggacgugcuggacgucuacaucgagcaccggcucaugauggagcagcgcucccgggaccccggcauggugcgcagcccccagaaccaguaccccgccgagcugaugcggcgcuucgagcuguacuuccaggggccguccagcaacaagccccgggugauccgcgagguccgggccgacuccgugggcaagcucgugaccguccgcgggaucgugacccgggugagcgaggucaagcccaagauggugguggcgacguacacgugcgaccagugcggcgccgagaccuaccagcccauccaguccccgaccuucaugccccugaucaugugccccagccaggagugccagaccaaccgcuccggcgggcggcuguaccuccagacccgcggcagccgguucaucaaguuccaggagaugaagaugcaggagcacuccgaccagguccccguggggaacaucccgcgcagcaucaccgugcuggucgagggcgagaacacccggaucgcccagcccggggaccacguguccgucacgggcaucuuccugcccauccuccgcaccggcuuccgccagguggugcaggggcugcugagcgagaccuaccucgaggcccaccggaucgucaagaugaacaaguccgaggacgacgagagcggcgccggggagcugacccgcgaggagcugcggcagaucgcggaggaggacuucuacgagaagcucgccgccuccaucgcccccgagaucuacggccacgaggacgugaagaaggcccugcugcuccugcuggugggcggggucgaccagagcccgcgcggcaugaagauccgggggaacaucaacaucugccucaugggcgaccccgggguggcgaagucccagcugcugagcuacaucgaccgccucgcgccccggagccaguacacgaccggccgcggcuccagcggggugggccugaccgccgccguccugcgggacuccgugagcggggagcucacccuggagggcggggcccuggugcucgccgaccagggcgucugcugcaucgacgaguucgacaagauggccgaggccgaccgcacggccauccacgaggugauggagcagcagaccaucuccaucgccaaggcgggcauccugaccacccugaacgcccggugcagcauccucgccgccgcgaaccccgccuacgggcgcuacaacccgcggcgcucccuggagcagaacauccagcugcccgccgcccuccugagccgguucgaccugcuguggcucauccaggaccgccccgaccgggacaacgaccugcgccuggcccagcacaucacguacgugcaccagcacucccggcagcccccgagccaguucgagccccucgacaugaagcugaugcgccgcuacaucgcgaugugccgggagaagcagcccaugguccccgagucccuggccgacuacaucaccgccgccuacguggagaugcgccgggaggccugggcgagcaaggacgccaccuacaccuccgcccgcacgcuccuggccauccugcggcucagcaccgcccuggcgcgccugcggaugguggacgucguggagaaggaggacgugaacgaggccauccgccucauggagauguccaaggacagccugcugggcgacaaggggcagaccgcccggacccagcgcccggccgacgucaucuucgcgacggugcgggagcucguguccggcgggcgcagcguccgguucuccgaggccgagcagcgcugcgugagccggggcuucacccccgcccaguuccaggccgcccuggacgaguacgaggagcugaacguguggcaggucaacgcgagccgcacccggaucaccuucguguga

SEQ ID NO: 32787 - RNA, 2523 nt, Artificial Sequence
  derived and/or modified sequence opt1 from MCM8__Homo_sapiens__NP_001268449
augaacggcgaguaccgcgggcggggcuucgggcgcggccgguuccagagcuggaagcgcgggcggggcggcgggaacuucuccggcaaguggcgcgagcgggagcaccgccccgaccugagcaagaccaccgggaagcggacguccgagcagaccccgcaguuccuccugagcaccaagacgccccaguccaugcagagcacccuggaccgcuucauccccuacaagggcuggaagcucuacuucuccgagguguacagcgacuccagcccccugaucgagaagauccaggccuucgagaaguucuucacccggcacaucgaccuguacgacaaggacgagaucgagcgcaagggguccauccucgucgacuucaaggagcugaccgagggcggcgaggugaccaaccugaucccggacaucgccacggagcuccgggacgcgcccgagaagacccuggccugcauggggcuggccauccaccaggugcucaccaaggaccuggagcgccacgccgccgagcugcaggcgcaggagggccucagcaacgacggggagaccauggucaacgugccccacauccacgcccggguguacaacuacgagccccugacgcagcugaagaacguccgcgccaacuacuacggcaaguacaucgcccuccggggcaccguggugcgcgucuccaacaucaagccgcugugcaccaagauggcguuccugugcgccgccugcggggagauccagagcuucccccuccccgacggcaaguacucccugcccaccaagugcccggugcccgugugccgggggcgcagcuucacggcccugcgguccagcccccucaccgucaccauggacuggcaguccaucaagauccaggagcugaugagcgacgaccagcgcgaggccggccgcaucccccggaccaucgagugcgagcuggugcacgaccucguggacagcugcgucccgggggacacggugaccaucaccggcaucgugaaggucuccaacgcggaggagggcagccgcaacaagaacgacaagugcauguuccugcuguacaucgaggccaacuccaucagcaacuccaaggggcagaagaccaagagcuccgaggacggcugcaagcacgggaugcucauggaguucagccugaaggaccuguacgccauccaggagauccaggccgaggagaaccucuucaagcugaucgugaacucccugugccccgugaucuucggccacgagcucgucaaggccgggcuggcgcuggcccucuucggcggcagccagaaguacgccgacgacaagaaccggauccccauccgcggggacccccacauccugguggugggcgacccggggcugggcaagucccagaugcuccaggccgccugcaacgucgcgccccgcgggguguacgucugcggcaacacgaccaccaccagcggccugacggugacccuguccaaggacagcuccagcggggacuucgcccucgaggccggcgcccuggugcugggggaccagggcaucugcggcaucgacgaguucgacaagauggggaaccagcaccaggcccuccuggaggcgauggagcagcaguccaucagccuggccaaggccggcgucgugugcucccugcccgcccggaccagcaucaucgcggccgccaaccccgucgggggccacuacaacaaggccaagaccgugagcgagaaccucaagaugggguccgcccugcugagccgguucgaccucguguucauccugcuggacacgccgaacgagcaccacgaccaccuccuguccgagcacgugaucgcgauccgcgccggcaagcagcggaccaucagcuccgccaccgucgcccgcaugaacagccaggacuccaacaccagcgugcuggagguggucuccgagaagccccucagcgagcggcugaagguggugcccggcgagacgaucgaccccaucccgcaccagcugcuccgcaaguacaucggguacgcccggcaguacgucuacccccgccuguccaccgaggcggcccgggugcugcaggacuucuaccucgagcugcgcaagcagagccagcggcugaacuccagccccaucaccacccgccagcucgagucccugauccggcugaccgaggcccgcgcccgccucgagcugcgggaggaggccacgaaggaggacgcggaggacaucguggagaucaugaaguacagcaugcugggcaccuacuccgacgaguucgggaaccucgacuucgagcgcagccagcacggcagcgggauguccaaccggagcaccgccaagcgcuucaucuccgcccugaacaacgucgccgagcggaccuacaacaacaucuuccaguuccaccagcugcgccagaucgcgaaggagcucaacauccagguggccgacuucgagaacuucaucggcagccugaacgaccagggcuaccugcucaagaaggggccgaagguguaccagcugcagacgauguga

SEQ ID NO: 32788 - RNA, 3432 nt, Artificial Sequence
  derived and/or modified sequence opt1 from MCM9__Homo_sapiens__NP_060166
augaacagcgaccaggugacccuggucggccagguguucgaguccuacgugagcgaguaccacaagaacgacauccuccugauccugaaggagcgcgacgaggacgcccacuaccccgucguggugaacgccaugacccucuucgagacgaacauggagaucggggaguacuucaacauguuccccuccgagguccugaccaucuucgacagcgcgcugcggcgcuccgcccucaccauccugcagagccugucccagcccgaggccgugagcaugaagcagaaccuccacgcccggaucuccggccugcccgugugccccgagcugguccgcgagcacaucccgaagaccaaggacguggggcacuuccucagcgugacgggcaccgucauccggaccucccuggugaaggugcuggaguucgagcgcgacuacaugugcaacaagugcaagcacgucuucgugaucaaggccgacuucgagcaguacuacaccuucugccggcccagcuccugccccagccucgaguccugcgacagcuccaaguucacgugccugagcgggcuguccagcagccccacccgcugccgggacuaccaggagaucaagauccaggagcagguccagcgccucuccgucggcagcaucccgcgguccaugaaggugauccuggaggacgaccugguggacagcugcaaguccggcgacgaccucaccaucuacgggaucgucaugcagcgcuggaagcccuuccagcaggacgugcggugcgagguggagaucguccugaaggcgaacuacauccaggugaacaacgagcagagcuccggcaucaucauggacgaggagguccagaaggaguucgaggacuucugggaguacuacaagagcgaccccuucgccgggcgcaacgugauccuggccucccucugcccccagguguucggcauguaccuggucaagcuggccguggcgauggugcucgccgggggcauccagcggaccgacgccacgggcacccgcguccgcggggagagccaccuccugcucgugggcgacccggggaccggcaagucccaguuccugaaguacgccgccaagaucacgccccggagcgugcugaccaccggcaucggguccaccagcgcgggccugaccgugacggccgugaaggacagcggggaguggaaccuggaggccggcgcccuggugcucgccgacgcggggcugugcugcaucgacgaguucaacagccugaaggagcacgaccggaccuccauccacgaggccauggagcagcagaccaucagcgucgccaaggccggccucgugugcaagcugaacacccgcacgaccauccuggccgcgaccaaccccaagggccaguacgacccccaggaguccgugagcgucaacaucgcccucgggagcccgcugcugucccgguucgaccucauccuggugcugcucgacaccaagaacgaggacugggaccgcaucaucagcuccuucauccuggagaacaagggcuaccccagcaaguccgagaagcuguggagcauggagaagaugaagacguacuucugccugauccgcaaccuccagcccacccuguccgacguggggaaccagguccugcuccgguacuaccagaugcagcgccagagcgacugccggaacgccgcccgcaccaccauccggcugcuggagucccucauccgccuggccgaggcgcacgcccggcugauguuccgcgacacggugacccucgaggacgccaucaccguggucagcgugauggaguccagcaugcagggcggggcccugcugggcggcgugaacgcgcuccacaccuccuuccccgagaacccgggggagcaguaccagcggcagugcgagcugauccuggagaagcucgagcugcagagccugcucuccgaggagcugcgccggcuggagcgccuccagaaccagagcguccaccagucccagccccgggugcuggagguggagacgacccccggcagccugcgcaacgggcccggcgaggagagcaacuuccggaccuccagccagcaggagaucaacuacuccacccacaucuucagccccgggggcucccccgagggcagccccguccucgacccgccgccccaccuggagcccaaccgcuccaccagccggaagcacuccgcccagcacaagaacaaccgcgacgacagccuggacugguucgacuucauggccacgcaccaguccgagccgaagaacaccgugguggucagcccccaccccaagaccuccggggagaacauggccagcaagaucuccaacagcaccucccagggcaaggagaaguccgagcccgggcagcggagcaagguggacaucggccuccugccgagccccggcgagacgggggugcccuggcgcgccgacaacgucgagagcaacaagaagaagcgccuggcgcucgacuccgaggccgccgugagcgccgacaagcccgacuccgugcugacccaccacgucccgcggaaccugcagaagcucugcaaggagcgcgcccagaagcugugccggaacagcacccgcgugcccgcgcagugcaccgugcccucccacccccagagcacgccgguccacucccccgaccggaugcuggacagccccaagcgcaagcggcccaagucccucgcccagguggaggagccggccaucgagaacgugaagccgcccggcagccccgucgccaagcuggccaaguucaccuucaagcagaaguccaagcugauccacagcuucgaggaccacucccacgugagccccggggcgaccaagaucgccgugcacucccccaagaucagccagcgccggacccgccgggacgccgcccuccccgucaagcgccccggcaagcugacguccaccccggggaaccagaucagcucccagccccagggcgagaccaaggaggugagccagcagcccccggagaagcacggcccccgggagaaggugaugugcgcgcccgagaagcgcaucauccagcccgagcuggagcucgggaacgagaccggcugcgcccaccugacgugcgagggggacaagaaggaggaggucagcggcuccaacaagagcgggaaggugcacgccugcacccuggcccggcucgccaacuucugcuucaccccgcccuccgagagcaaguccaagagcccgccgcccgagcgcaagaaccggggcgagcgcggccccuccagcccgcccaccacgaccgcgcccaugcggguguccaagcgcaagagcuuccagcugcggggguccaccgagaagcugaucgucagcaaggagucccucuucacccugcccgagcugggcgacgaggccuucgacugcgacugggacgaggagaugcgcaagaaguccuga

SEQ ID NO: 32789 - RNA, 1923 nt, Artificial Sequence
  derived and/or modified sequence opt1 from MCMBP__Homo_sapiens__NP_001243307
augcccugcggcgaggacuggcugagccacccgcucgggaucgugcagggcuucuucgcccagaacggggucaaccccgacugggagaagaaggugaucgaguacuucaaggagaagcugaaggagaacaacgcccccaagugggugcccucccugaacgaggucccgcuccacuaccugaagcccaacagcuucgugaaguuccgcugcaugauccaggacauguucgaccccgaguucuacaugggcguguacgagaccgucaaccagaacaccaaggcgcacgugcugcacuucgggaaguaccgggacguggccgagugcggcccccagcaggagcucgaccugaacuccccgcgcaacacgacccuggagcggcagaccuucuacugcguccccgugcccggcgagagcaccugggugaaggaggccuacgucaacgccaaccaggcccgcgugucccccagcacguccuacaccccgagccggcacaagcgcuccuacgaggacgacgacgacauggaccuccagcccaacaagcagaaggaccagcacgcgggggcccggcaggccggcagcgucgggggccugcaguggugcggggagcccaagcgccuggagaccgaggccuccaccggccagcagcucaacagccugaaccuguccagccccuucgaccucaacuucccgcugcccggcgagaaggggcccgcgugccuggugaagguguacgaggacugggacugcuucaaggugaacgacauccucgagcuguacggcauccuguccgucgaccccgugcucagcauccugaacaacgacgagcgggacgccuccgcccugcucgacccgauggagugcacggacaccgccgaggagcagcgcgugcacagcccgcccgccucccuggucccccggauccacgugauccuggcgcagaagcuccagcacaucaacccccugcugcccgccugccucaacaaggaggagagcaagaccuucgugagcuccuucaugagcgagcugucccccguccgcgccgagcugcucggguuccugacccacgcccugcucggcgacagccuggccgcggaguaccugauccuccaccugaucuccacgguguacacccggcgcgacguccugccccucggcaaguucaccgugaaccugagcgggugcccgcggaacuccaccuucacggagcaccuguaccgcaucauccagcaccucgugcccgccagcuuccggcugcagaugaccaucgagaacaugaaccaccugaaguucaucccccacaaggacuacaccgccaaccgccucgucuccggccugcugcagcugccgagcaacaccucccucgugaucgacgagacgcugcuggagcaggggcagcucgacacccccggcgugcacaacgucaccgcccugagcaaccugaucaccuggcagaagguggacuacgacuucuccuaccaccagauggaguuccccugcaacaucaacguguucaucacgagcgaggggcggucccuccugcccgccgacugccagauccaccuccagccgcagcugaucccgcccaacauggaggaguacaugaacagccugcuguccgcgguccuccccagcgugcugaacaaguuccgcaucuaccugacccuccugcgguuccuggaguacuccaucagcgacgagaucaccaaggccguggaggacgacuucgucgagaugcgcaagaacgacccccagagcaucaccgccgacgaccuccaccagcugcuggugguggcccgcugccucucccugagcgccggccagacgacccugucccgggagcgcuggcuccgggcgaagcagcuggagagccugcgccggacccgccuccagcagcagaagugcgucaacggcaacgagcuguga

SEQ ID NO: 32790 - RNA, 1743 nt, Artificial Sequence
  derived and/or modified sequence opt1 from MCOLN1__Homo_sapiens__NP_065394
augaccgcccccgccggcccccgcgggagcgagaccgagcggcugcucacgcccaaccccggcuacgggacccaggcgggccccuccccggccccgcccacgccgcccgaggaggaggaccugcgccggcgccugaaguacuucuucaugagccccugcgacaaguuccgggccaaggggcgcaagcccugcaagcucaugcuccagguggucaagauccugguggugaccguccagcugauccuguucggccuguccaaccagcucgccgugaccuuccgggaggagaacaccaucgccuuccgccaccuguuccugcucggcuacagcgacggggcggacgacaccuucgccgccuacacccgggagcagcuguaccaggccaucuuccacgcgguggaccaguaccuggcccuccccgacgucucccugggccgcuacgccuacgugcgcgggggcggggaccccuggacgaacggcagcggccuggcccucugccagcgguacuaccaccgggggcacguggaccccgccaacgacaccuucgacaucgaccccauggucgugaccgacugcauccagguggacccgcccgagcgcccgccgccgccgcccuccgacgaccugacccugcucgagagcuccagcuccuacaagaaccugacgcugaaguuccacaagcucgucaacgugaccauccacuuccggcugaagaccaucaaccugcagagccucaucaacaacgagauccccgacugcuacaccuucuccgugcugaucacguucgacaacaaggcgcacagcggccgcauccccaucucccuggagacccaggcccacauccaggagugcaagcaccccagcgucuuccagcacggggacaacuccuuccggcuccuguucgacgugguggucauccugaccugcagccucuccuuccugcugugcgcccgcagccuccugcggggcuuccugcuccagaacgaguucgugggcuucauguggcgccagcgggggcgcgugaucagccugugggagcgccuggaguucgucaacggcugguacauccuccuggugaccuccgacgugcugacgaucagcgggaccaucaugaagaucggcaucgaggccaagaaccucgccuccuacgacgucugcagcauccugcuggggaccuccacccuccuggugugggucggcgugauccgguaccugacguucuuccacaacuacaacauccugaucgcgacccuccgcguggcccugcccagcgucaugcgguucugcugcugcguggccgugaucuaccugggcuacugcuucugcggguggaucguccucggccccuaccacgugaaguuccgcucccugagcaugguguccgagugccuguucagccucaucaacggggacgacauguucgucaccuucgccgccaugcaggcgcagcagggccgguccagccugguguggcuguucucccagcucuaccuguacagcuucaucucccuguucaucuacauggugcucagccuguucaucgcccugaucaccggggccuacgacacgaucaagcaccccggcggcgccggggccgaggaguccgagcuccaggcguacaucgcccagugccaggacagccccaccuccggcaaguuccgccgggggagcggcagcgccugcucccugcugugcugcugcgggcgcgaccccagcgaggagcacucccuccuggucaacuga

SEQ ID NO: 32791 - RNA, 1734 nt, Artificial Sequence
  derived and/or modified sequence opt1 from MCOLN3__Homo_sapiens__XP_011540041
auggagggccgccgggccggggccggccgcgagaugcagcuguuccgggcggcccccaagccgcccgccgagauggccgaccccgagguggucgugagcuccugcagcucccacgaggaggagaaccgcugcaacuucaaccagcagaccagccccuccgaggagcuccugcuggaggaccagaugcggcgcaagcucaaguucuucuucaugaacccgugcgagaaguucugggcccgggggcgcaagcccuggaagcuggcgauccagauccugaagaucgccauggugaccauccagcucguccuguucggccugagcaaccagauggugguggccuucaaggaggagaacacgaucgccuucaagcaccucuuccugaagggguacauggaccggauggacgacaccuacgcggucuacacccaguccgacguguacgaccagcugaucuucgccgugaaccaguaccuccagcuguacaacgucagcgugggcaaccacgccuacgagaacaagggcaccaagcaguccgccauggccaucugccagcacuucuacaagcgcgggaacaucuaccccggcaacgacacguucgacaucgaccccgagaucgagaccgagugcuucuucguggagccggacgagcccuuccacaucgggacccccgcggagaacaagcugaaccucacccuggacuuccaccggcugcucacggucgagcugcaguucaagcugaaggccaucaaccuccagaccgugcgccaccaggagcugcccgacugcuacgacuucacccugaccaucacguucgacaacaaggcccacagcggccggaucaagaucucccucgacaacgacaucagcauccgcgagugcaaggacuggcacguguccgggagcauccagaagaacacccacuacaugaugaucuucgacgccuucgucauccugaccugccuggugucccucauccugugcauccggagcgugauccgcggccugcagcuccagcaggaguucgucaacuucuuccugcugcacuacaagaaggagguguccgugagcgaccagauggaguucgucaacggcugguacaucaugaucaucaucuccgacauccucaccaucaucgggagcauccugaagauggagauccaggccaagagccugacguccuacgacgugugcagcauccuccugggcaccuccaccaugcugguguggcucggggucauccgguaccugggcuucuucgcgaaguacaaccugcucauccugacccugcaggccgcccucccgaacgugauccgcuucugcugcugcgccgccaugaucuaccugggcuacugcuucugcggguggaucguccugggccccuaccacgacaaguuccggagccucaacaugguguccgagugccuguucagccugaucaacggggacgacauguucgcgacguucgccaagaugcagcagaaguccuaccugguguggcuguucagccgcaucuaccucuacuccuucaucagccuguucaucuacaugauccucucccuguucaucgcccugaucaccgacaccuacgagaccaucaagcaguaccagcaggacggcuuccccgagacggagcuccggaccuucaucagcgagugcaaggaccugcccaacuccgggaaguaccgccuggaggacgacccgcccgucagccucuucugcugcugcaagaaguga

SEQ ID NO: 32792 - RNA, 1833 nt, Artificial Sequence
  derived and/or modified sequence opt1 from MCPH1__Homo_sapiens__NP_001166045
auggccgcccccauccugaaggacguggucgcguacguggagguguggagcuccaacggcaccgagaacuacagcaagaccuucacgacccagcucgucgacaugggggccaagguguccaagaccuucaacaagcaggucacccacgugaucuucaaggacggcuaccagagcacgugggacaaggcccagaagcgcggggugaagcugguguccguccuguggguggagaagugccggaccgccggcgcccacaucgacgagagccucuucccggcggccaacaugaacgagcaccuguccagccugaucaagaagaagcgcaagugcaugcagcccaaggacuucaacuucaagacccccgagaacgacaagcgguuccagaagaaguucgagaagauggccaaggagcuccagcgccagaagaccaaccuggacgacgacgugcccauccugcuguucgaguccaacgggagccugaucuacacgccgaccaucgagaucaacuccagccaccacuccgccauggagaagcggcugcaggagaugaaggagaagcgcgagaaccucagccccaccuccagccagaugauccagcagucccacgacaaccccagcaacucccugugcgaggcgccccugaacaucagccgggacacccucugcagcgacgaguacuucgccggcggccugcacuccagcuucgacgaccugugcgggaacuccggcugcgggaaccaggagcgcaagcucgagggcagcaucaacgacaucaaguccgacgucugcaucagcucccuggugcugaaggccaacaacauccacagcuccccgagcuucacgcaccucgacaaguccagcccccagaaguuccuguccaaccugagcaaggaggagaucaaccuccagcggaacaucgccgggaagguggucacccccgaccagaagcaggccgcgggcaugucccaggagaccuucgaggagaaguaccgccugagccccacccuguccagcacgaagggccaccuccugauccacucccggccgcgcagcagcuccgugaagcggaagcgcgugagccacgggucccacagcccgcccaaggagaagugcaagcggaagcgcuccacccggcgcagcaucaugccccggcugcagcucugccgcuccgaggaccggcugcagcacgucgccggccccgcccuggaggcccucagcugcggggaguccagcuacgacgacuacuucucccccgacaaccugaaggagcgcuacagcgagaaccugccgcccgagucccagcuccccagcucccccgcccagcugagcugccgcucccugagcaagaaggagcggaccagcaucuucgagauguccgacuucagcugcgugggcaagaagacccgcacgguggacaucaccaacuucaccgcgaagaccaucuccagcccccggaagacgggcaacggggagggccgcgccaccuccagcugcgucaccuccgcccccgaggaggcccuccggugcugccgccaggccgggaaggaggacgcgugcccggagggcaacggguucagcuacaccaucgaggaccccgcccugcccaagggccacgacgacgaccugacgccccucgagggcucccuggaggagaugaaggaggccguggggcucaagagcacccagaacaagggcaccaccuccaagaucagcaacuccagcgagggggaggcccaguccgagcacgagccgugcuucaucguggacugcaacauggagacgagcaccgaggagaaggagaaccuccccggcggguacuccggcagcauguga

SEQ ID NO: 32793 - RNA, 1428 nt, Artificial Sequence
  derived and/or modified sequence opt1 from MCRS1__Homo_sapiens__NP_001012300
augacccgcggcaccgggggcaccgcccagcgggggcgcagcggccccgacucccaggggcugcucgacagcucccugauggccagcggcaccgcgucccggagcgaggacgaggagucccuggccggccagaagcgcgccagcucccaggcccucgggaccaucccgaagcggcgcagcuccagccgguucaucaagcgcaagaaguucgacgacgagcugguggaguccagccuggccaaguccagcacccgggcgaagggcgccuccggggucgagcccggccgcugcagcggguccgagcccagcagcuccgagaagaagaaggugagcaaggcccccuccacgccggugccgcccagccccgcccccgcgcccggccucaccaagcgggucaagaaguccaagcagccccuccaggugaccaaggaccugggccgcuggaagcccgccgacgaccugcugcugaucaacgccgugcuccagaccaacgaccugacgagcguccaccugggggugaaguucuccugccgguucacccuccgcgaggugcaggagcggugguacgcccugcuguacgacccggucaucagcaagcucgccugccaggcgaugcgccagcugcaccccgaggccaucgccgccauccaguccaaggcccuguucagcaaggcggaggagcagcuccuguccaaggugggcagcaccucccagcccacccuggagacguuccaggaccuccugcaccggcaccccgacgccuucuaccuggcccgcaccgccaaggcccuccaggcgcacuggcagcugaugaagcaguacuaccugcucgaggaccagaccgugcagccgcugcccaagggggaccagguccugaacuucagcgacgccgaggaccucaucgacgacuccaagcugaaggacaugcgggacgaggugcuggagcacgagcucaugguggccgaccgccggcagaagcgcgagauccgccagcuggagcaggagcugcacaaguggcagguccucguggacagcaucaccggcauguccagccccgacuucgacaaccagacgcuggccgugcugcggggccgcaugguccgguaccucaugcgcucccgggagaucacccuggggcgcgccaccaaggacaaccagaucgacguggaccugagccucgagggccccgcguggaagaucagccggaagcagggggugaucaagcugaagaacaacggcgacuucuucaucgccaacgaggggcgccggccgaucuacaucgacggccgccccguccugugcggcuccaaguggcggcucagcaacaacuccgugguggagaucgccagccugcgcuucgucuuccugaucaaccaggaccugaucgcccucauccgggcggaggccgccaagaucacgccccaguga

SEQ ID NO: 32794 - RNA, 2337 nt, Artificial Sequence
  derived and/or modified sequence opt1 from MCTP1__Homo_sapiens__NP_001002796
augcuggacagcugcaagcucaaguccgccugcaaccugcccuucaucugcaacaagaagaucaucaacaccgccggcaccagcaacgcggaggugccgcuggccgaccccgggauguaccagcucgacaucacgcugcgccggggccagucccuggccgcccgcgaccgcgggggcaccagcgaccccuacgucaaguucaagaucgggggcaaggagguguuccgguccaagaucauccacaagaaccucaaccccgugugggaggagaaggccugcauccuggucgaccaccuccgggagccgcuguacaucaagguguucgacuacgacuucggccugcaggacgacuucauggggagcgcguuccuggaccucacccagcuggagcugaaccgccccaccgacgugacgcucacccugaaggacccccacuaccccgaccacgaccugggcaucauccuccuguccgucauccugaccccgaaggagggggagagccgggacgugaccaugcucaugcgcaaguccuggaagcggagcuccaaggagcugagcgagaacgagguggucggcuccuacuucagcgugaagucccuguucuggcgcacgugcgggcggcccgcccuccccgugcugggcuucugccgcgccgagcugcagaaccccuacugcaagaacguccaguuccagacccagagccuccggcuguccgaccugcaccgcaagagccaccucuggcggggcaucguguccaucacccugaucgaggggcgcgaccugaaggccauggacagcaacggccucagcgacccguacgugaaguuccggcuggggcaccagaaguacaaguccaagaucaugcccaagacccugaacccccaguggcgcgagcaguucgacuuccaccucuacgaggagcggggcggcgucaucgacaucacggcgugggacaaggacgccgggaagcgcgacgacuucaucggccggugccagguggaccugagcgcccugucccgcgagcagacccacaagcucgagcugcagcuggaggagggggagggccaccucgugcugcuggucacccucaccgccagcgccacgguguccaucagcgaccuguccgugaacagccuggaggaccagaaggagcgcgaggagauccucaagcgguacagcccccugcgcaucuuccacaaccugaaggacgucggguuccuccaggugaaggugauccgggcggagggccugauggccgccgacgucaccggcaaguccgacccguucugcguggucgagcugaacaacgaccgccugcucacccacaccguguacaagaaccugaaccccgaguggaacaagguguucacguucaacaucaaggacauccacuccguccuggaggugaccguguacgacgaggaccgggaccgcagcgccgacuuccucgggaaggucgccaucccccugcuguccauccagaacggcgagcagaaggcguacgugcucaagaacaagcagcugaccgggcccaccaagggcgugaucuaccuggagaucgacgucaucuucaacgccgugaaggccagccuccggacgcugaucccgaaggagcagaaguacaucgaggaggagaaccgccuguccaagcagcuccugcugcggaacuucauccgcaugaagcggugcgugaugguccucgugaacgccgccuacuacgugaacagcugcuucgacugggacuccccgccccgcagccuggcggccuucguccuguuccucuucgugguguggaacuucgagcuguacaugaucccccugguccuccugcugcuccugaccuggaacuacuuccugaucaucuccgggaaggacaaccggcagcgcgacaccgugguggaggacaugcucgaggacgaggaggaggaggacgacaaggacgacaaggacagcgagaagaagggcuucaucaacaagaucuacgccauccaggaggucugcgugagcgugcagaacauccuggacgaggucgccuccuucggcgagcggaucaagaacaccuucaacuggacggugcccuuccugagcuggcucgccaucguggcgcugugcgucuucaccgccauccuguacugcaucccccuccgcuacaucgugcuggugugggggaucaacaaguucaccaagaagcugcggucccccuacgccaucgacaacaacgagcuccuggacuuccugagccgcguccccuccgacguccagguggugcaguaccaggagcucaagccggaccccagccacucccccuacaagcggaagaagaacaaccugggcuga

SEQ ID NO: 32795 - RNA, 2472 nt, Artificial Sequence
  derived and/or modified sequence opt1 from MCTP2__Homo_sapiens__NP_001153115
auggaccuggacaagcccagcguguggggcucccucaagcagcgcacccggccgcugcugaucaaccucagcaagaagaaggucaagaagaaccccuccaagccgcccgaccugcgcgcccggcaccaccuggaccgccggcucagccuguccgugcccgaccugcucgaggccgaggcgcuggcccccgaggggcgccccuacagcggcccccaguccagcuacaccuccgugccgagcucccugagcacggccgggaucuuccccaaguccagcuccagcucccucaagcagagcgaggaggagcuggacuggucccaggaggaggccagccaccuccacgucguggagaccgacagcgaggaggccuacgcgucccccgccgagcggcgccgggugagcuccaacggcaucuucgaccugcagaagaccagccugggcggcgacgcccccgaggagccggagaagcugugcggcuccagcgaccucaacgccuccaugaccagccagcacuucgaggagcaguccguccccggggaggcgagcgacggccuguccaaccugcccagccccuucgccuaccuccugacgauccaccugaaggaggggcgcaaccucguggugcgggaccgcugcggcaccuccgacccguacgucaaguucaagcugaacgggaagacccuguacaagagcaaggugaucuacaagaaccucaaccccgugugggacgagaucgucgugcugcccauccagucccuggaccagaagcuccgggugaaggucuacgaccgcgaccugaccacgagcgacuucaugggcuccgccuucgugauccugagcgaccucgagcugaaccggaccaccgagcacauccugaagcucgaggaccccaacucccuggaggacgacaugggcgugaucguccugaaccucaaccugguggugaagcagggggacuucaagcgccaccgguggagcaaccgcaagcggcugagcgccuccaagagcucccucauccgcaaccugcggcugagcgagucccucaagaagaaccagcuguggaacggcaucaucagcaucacccugcucgaggggaagaacgucuccggcggcagcaugacggagauguucgugcagcugaagcugggggaccagcgcuacaaguccaagacccugugcaagagcgccaacccgcaguggcaggagcaguucgacuuccacuacuucuccgaccgcaugggcauccucgacaucgaggugugggggaaggacaacaagaagcacgaggagcggcuggggaccugcaaggucgacaucagcgcgcugccccucaagcaggccaacugccuggagcugccccucgacuccugccugggggcccugcucaugcuggugacccugacgcccugcgccggcgucagcguguccgaccucugcgugugcccgcuggccgaccugagcgagcgcaagcagaucacccagcgguacugccuccagaacucccugaaggacgucaaggacgugggcauccuccaggugaagguccugaaggcggccgaccugcuggccgccgacuucagcgggaaguccgaccccuucugccuccuggagcugggcaacgaccgccuccagacccacaccguguacaagaaccugaaccccgaguggaacaagguguucacguuccccaucaaggacauccacgacguccuggaggugaccguguucgacgaggacggggacaagccgcccgacuuccucggcaaggucgccaucccccugcuguccauccgggacgggcagccgaacugcuacgugcucaagaacaaggaccuggagcaggcguucaagggcgugaucuaccuggagauggaccucaucuacaaccccgucaaggccagcauccgcaccuucacgccccgggagaagcgcuucguggaggacucccggaagcugagcaagaagauccugucccgcgacguggaccgggucaagcgcaucaccauggccaucuggaacaccaugcaguuccucaagagcugcuuccagugggaguccacccugcggagcaccaucgccuucgccgaguccgagaagaagggccugaucgagcgcaucuacauggugcaggacaucgugagcacgguccagaacgugcucgaggagaucgcguccuucggggagcggaucaagaacaccuucaacuggaccgugcccuuccugagcucccuggccugccucauccuggccgccgcgaccaucauccuguacuucaucccgcuccgcuacaucauccugaucuggggcaucaacaaguucacgaagaagcugcggaaccccuacagcaucgacaacaacgagcuccuggacuuccugucccgcguccccagcgacgugcagaaggugcaguacgccgagcucaagcugugcuccagccacagcccccugcggaagaagcgcagcgcccucuga

SEQ ID NO: 32796 - RNA, 549 nt, Artificial Sequence
  derived and/or modified sequence opt1 from MCTS1__Homo_sapiens__NP_001131026
augggcaaggggcgcuucgacgagaaggagaacgugagcaacugcauccagcugaagaccuccgucaucaagggcaucaagaaccagcucaucgagcaguuccccgggaucgagccguggcugaaccagaucaugcccaagaaggaccccgugaagaucgugcggugccacgagcacaucgagauccugaccgucaacggcgagcuccuguucuuccgccagcgggaggggcccuucuacccgacgcugcgccuccugcacaaguaccccuucauccugccccaccagcaggucgacaagggcgccaucaaguucgugcucagcggcgccaacaucaugugccccgggcugaccuccccgggcgcgaagcuguaccccgccgccguggacaccaucguggccaucauggccgaggggaagcagcacgcgcucugcgugggcgucaugaagaugagcgccgaggacaucgagaaggugaacaaggggaucggcaucgagaacauccacuaccugaacgacggccuguggcacaugaagaccuacaaguga

SEQ ID NO: 32797 - RNA, 993 nt, Artificial Sequence
  derived and/or modified sequence opt1 from MCU__Homo_sapiens__NP_001257608
auggccgccgcggccggccgcagccugcuccugcugcucagcagccgcgggggcgggggcgggggcgccggcgggugcggcgcccugaccgccgggugcuuccccggccugggggugucccggcaccggcagcagcagcaccaccgcaccguccaccagcggaucgcgagcuggcagaaccucggcgccguguacugcuccacgguggucccgagcgacgacgugaccguggucuaccagaacggccugcccgugaucuccgugcgccugcccagccggcgcgagcggugccaguucacccucaagcccaucuccgacagcgucgggguguuccugcgccagcugcaggaggaggaccggggcaucgaccgcguggccaucuacuccccggacgggguccggguggccgcgagcaccggcaucgaccuccugcugcucgacgacuucaagcuggugaucaacgaccugacguaccacguccgcccgcccaagcggguggagaugggcuucugccacguggggcagaacggcuucgagcuccugaccuccagcuaccugcccgccuccgccagccaguccgccgagaucaucgccguccgcaucgagaucagccggaaggcggagaagcgcaccacccucgugcuguggggcgggcuggccuacauggccacgcaguucgggauccucgcccggcugaccuggugggaguacuccugggacaucauggagcccgugaccuacuucaucaccuacggcagcgccauggcgauguacgccuacuucgucaugacgcgccaggaguacguguaccccgaggcccgggaccgccaguaccugcuguucuuccacaagggcgccaagaagucccgcuucgaccuggagaaguacaaccagcugaaggacgccaucgcgcaggccgagauggaccucaagcggcugcgcgacccccuccaggugcaccucccccugcggcagaucggggagaaggacuga

SEQ ID NO: 32798 - RNA, 1080 nt, Artificial Sequence
  derived and/or modified sequence opt1 from MCUR1__Homo_sapiens__NP_001026883
auggacugcggcagcgucgggggccagcgcacccagcggcugcccgggcgccagcggcuccuguuccugccggugggccucuccgggcgccccggcggcagcgagaccuccgcccggcgcugccugagcgcccuguccgacgggcucggcgcgcugcggccccgcgcccccgccgcccgcgggggcgugagccgggccuccccgcugcuccugcugcuccuggugcccagcccccggcuggcggccgccgcgccccgccggcagcucggggacugggagcgcucccggcugggcuacgccgccccgcccgccggccgcagcuccgccuggcggugcagccccggggucgccgcggccgccggcgcccugccccaguaccacgggccggcccccgcgcucguguccugccgccgggagcugagccuguccgccggcagccuccagcuggagcgcaagcggcgcgacuucacguccagcggcucccgcaagcuguacuucgacacccacgcccucgugugccugcuggaggacaacggguucgccacccagcaggccgagaucaucgucagcgcgcucgugaagauccuggaggccaacauggacaucguguacaaggacauggucaccaagaugcagcaggagaucacguuccagcaggucaugagccagaucgccaacgugaagaaggacaugaucauccuggagaaguccgaguucagcgcccuccgggccgagaacgagaagaucaagcuggagcugcaccagcucaagcagcaggucauggacgaggugaucaaggugcgcaccgacaccaagcuggacuucaaccuggagaagucccgggugaaggagcucuacagccugaacgagaagaagcugcucgagcugcgcaccgagaucguggcgcugcacgcccagcaggaccgggcccucacgcagaccgaccgcaagaucgagaccgagguggccggccugaagaccaugcuggagucccacaagcucgacaacaucaaguaccuggcggggagcaucuucacgugccugaccgucgcccucggcuucuaccggcuguggaucuga

SEQ ID NO: 32799 - RNA, 6270 nt, Artificial Sequence
  derived and/or modified sequence opt1 from MDC1__Homo_sapiens__NP_055456
auggaggacacccaggccaucgacugggacguggaggaggaggaggagaccgagcaguccuccgagucccugcggugcaacguggagcccgugggccggcuccacaucuucuccggggcccacggccccgagaaggacuucccccugcaccuggggaagaacguggugggccgcaugcccgacugcagcguggcccuccccuucccguccaucagcaagcagcacgccgagaucgagauccuggccugggacaaggcccccauccugcgggacugcgggucccucaacggcacccagauccugcggccgcccaaggugcugagcccgggcgucucccaccggcuccgcgaccaggagcugauccuguucgccgaccuccugugccaguaccaccggcuggacgugagccuccccuucgugucccgcgggccccugaccgucgaggagacgccccgcgugcagggcgagacccagccgcagcgccugcuccuggccgaggacagcgaggaggagguggacuuccuguccgagcggcgcauggucaagaagucccggaccaccuccagcuccgugaucgugcccgagagcgacgaggaggggcacucccccguccucggcgggcuggggccgcccuucgccuucaaccugaacagcgacaccgacguggaggagggccagcagcccgccaccgaggaggccagcuccgcggcccgccgcggggccaccguggaggccaagcagagcgaggccgaggucgugaccgagauccagcucgagaaggaccagccccuggugaaggagcgcgacaacgacaccaaggucaagcggggcgcggggaacggcguggugcccgccggcgucauccuggagcgcucccagccgcccggggaggacagcgacaccgacguggacgacgacucccggccgcccggccgccccgccgagguccaccucgagcgggcccagcccuucggguucaucgacagcgacacggacgccgaggaggagcgcauccccgcgacccccguggugauccccaugaagaagcgcaagaucuuccacggcgucgggacccggggccccggcgcccccgggcuggcccaccuccaggagucccaggccggcagcgacaccgacguggaggaggggaaggccccgcaggcggugccccucgagaagucccaggccagcauggucaucaacuccgacacggacgacgaggaggaggugagcgccgcccugacccuggcccaccucaaggagucccagcccgcgaucuggaaccgcgacgccgaggaggacaugccccagcgggugguccugcugcagcgcagccagaccaccacggagcgggacuccgacaccgacguggaggaggaggagcucccgguggagaaccgcgaggccguccugaaggaccacaccaagauccgggcccuggugcgcgcgcacagcgagaaggaccagccgcccuucggcgacuccgacgacagcguggaggccgacaaguccagccccgggauccaccucgagcggagccaggccuccaccacggucgacaucaacacccagguggagaaggaggugccgcccggcagcgccaucauccacaucaagaagcaccaggucuccguggagggcaccaaccagaccgacgugaaggccgucgggggccccgcgaagcugcugguggugagccucgaggaggccuggccccugcacggggacugcgagacggacgccgaggagggcaccucccugaccgccagcgucguggccgacgugcgcaagucccagcucccggcggagggggacgccggcgccgagugggccgccgcgguccugaagcaggagcgggcccacgaggugggcgcccagggcgggccgcccguggcccaggucgagcaggaccugcccaucagccgcgagaaccucaccgaccuggugguggacacggacacccugggggaguccacccagccccagcgggagggcgcgcagguccccaccggccgcgagcgggagcagcacgucgggggcacgaaggacagcgaggacaacuacggggacuccgaggaccuggaccuccaggccacccagugcuuccuggagaaccagggccuggaggccgugcagagcauggaggacgagcccacccaggccuucaugcucacgccgccccaggagcuggggcccucccacugcagcuuccagaccacgggcacccuggacgagcccugggagguccucgccacccagcccuucugccugcgcgaguccgaggacagcgagacccagcccuucgacacgcaccuggaggcguacggccccugccucagcccgccccgggccauccccggggaccagcaccccgagagccccgugcacaccgagccgaugggcauccaggggcgcggccggcagaccguggacaaggucauggggauccccaaggagaccgccgagcgcgugggccccgagcgcggcccccuggagcgggagacggagaagcugcucccggagcgccagaccgacgugaccggggaggaggagcugaccaagggcaagcaggaccgggagcagaagcagcugcucgcccgcgacacgcagcggcaggagagcgacaagaacggggaguccgccagccccgagcgcgaccgggagucccugaaggucgagaucgagaccagcgaggagauccaggagaagcagguccagaagcagacccugcccuccaaggcguucgagcgcgagguggagcggcccgucgccaaccgcgagugcgacccggccgagcucgaggagaaggugcccaaggugauccuggagcgggacacccagcgcggcgagcccgagggcggcagccaggaccagaagggccaggccuccagccccacgccggagcccggggucggcgccggggaccugcccggccccaccuccgcgccggugcccagcgggucccagagcggcggccgggggucccccgugagcccccgccggcaccagaagggccuccugaacugcaagaugccgcccgccgagaaggccucccgcauccgggccgcggagaaggucagccgcggggaccaggagucccccgacgccugccugcccccgaccgugcccgaggcccccgccccgccccagaagccccucaacagccagucccagaagcaccuggcgcccccgccccugcucagcccccugcugcccagcaucaagcccaccguccggaagacgcgccaggacggcucccaggaggcgcccgaggcgccccugagcuccgagcuggagcccuuccacccgaagcccaagauccggacccgcaagagcucccgcaugacccccuuccccgccaccagcgccgccccggagccccaccccuccacgagcaccgcgcagcccgugaccccgaagcccaccucccaggccacgcggagccgcaccaaccgguccagcgugaagacccccgagcccgucgugccgaccgcccccgagcugcagcccuccacgagcaccgaccagcccgugaccuccgagccgaccagccaggucacgcgcggccggaagucccgcagcuccgugaagacccccgagaccgugguccccaccgcccucgagcugcagccgagcaccagcacggaccggcccgugaccuccgagcccaccagccaggccacccgcgggcggaagaaccgcuccagcgugaagacgcccgagccggucgugcccaccgcgcccgagcugcagcccuccaccagcaccgaccagccggugacguccgagcccaccuaccaggccacccggggccgcaagaaccggagcuccgucaagacccccgagcccguggugccgacggcccccgagcuccgccccagcaccuccaccgaccggcccgucaccccgaagcccacgagccgcaccacccggucccgcaccaacaugagcuccgugaagacgcccgagaccgugguccccaccgccccggagcugcagaucagcaccuccacggaccagcccgugacccccaagcccaccagccggaccacgcgcucccgcaccaacaugagcagcgugaagaacccggaguccaccguccccaucgcccccgagcugccgcccagcaccuccacggagcagcccgugacccccgagccgaccagccgggcgacccgcgggcggaagaaccgcuccagcggcaagacgcccgagacccucgugcccaccgcccccaagcuggagccguccaccagcaccgaccagcccgucacgcccgagcccaccucccaggccacccgggggcgcaccaaccggagcuccgugaagacgccggagaccgugguccccaccgcccccgagcugcagcccagcaccuccacggaccagccggugacccccgagcccaccagccaggcgacccgcggccggacggaccgcuccagcgugaagacccccgagaccgucgugccgaccgcccccgagcuccaggccuccgccagcacggaccagcccgugaccuccgagcccaccagccggaccacgcgcggccggaagaaccgcagcuccgucaagaccccggagaccguggugcccgccgcgcccgagcugcagcccagcaccuccacggaccagccggucacccccgagcccaccagccgggccacccgcgggcggacgaaccgcuccagcgugaagaccccggaguccaucgugcccaucgcccccgagcugcagcccagcaccucccggaaccagcucgucaccccggagcccacgagccgcgccacccggugccgcaccaaccgcuccagcgugaagacccccgagcccguggucccgacggcccccgagccccaccccaccaccuccaccgaccagccggugacgcccaagcugaccagccgggcgacccgccggaagaccaaccgcuccagcgugaagacccccaagcccgucgagccggccgccuccgaccuggagcccuucacgcccaccgaccagagcgugacccccgaggccaucgcccagggcgggcaguccaagacccuccggagcagcacggugcgcgcgaugccgguccccaccacccccgaguuccagucccccgugaccacggaccagccgaucagccccgagcccaucacccagcccuccugcaucaagcggcagcgcgccgccggcaacccggggagccuggccgcgcccaucgaccacaagcccugcuccgccccgcuggagcccaagagccaggccucccggaaccagcgcuggggcgccguccgggccgcggagagccucaccgccauccccgagcccgccuccccgcagcugcuggagacccccauccacgccagccagauccagaagguggagcccgccggccgcucccgguucacgcccgagcuccagccgaaggcgagccagucccgcaagcggagccuggccaccauggacagcccgccccaccagaagcagccccagcgcggggaggugagccagaagaccgucaucaucaaggaggaggaggaggacaccgccgagaagccgggcaaggaggaggacguggugacgcccaagcccgggaagcggaagcgcgaccaggccgaggaggagcccaaccggaucccgucccgcagccugcgccggaccaagcucaaccaggagagcaccgcccccaagguccuguucaccggcgugguggacgcgcgcggggagcgggccguccuggcccucggcggcucccuggccgggagcgcggccgaggccucccaccuggugacggaccgcauccggcgcaccgugaaguuccucugcgcccugggccgggggauccccauccugagccucgacuggcugcaccagucccgcaaggccggcuucuuccugcccccggacgaguacgucgugaccgaccccgagcaggagaagaacuucggcuucagccuccaggacgcgcugucccgggcccgcgagcggcgccugcucgagggguacgagaucuacgugacccccggcguccagcccccgccgccccagaugggggagaucaucagcugcugcggcgggacguaccugcccuccaugccgcggagcuacaagccccagcgcguggugaucacgugcccccaggacuucccgcacugcuccaucccccugcgggucggccucccccugcugagccccgaguuccuccugaccggcgugcugaagcaggaggccaagccggaggccuucgugcucagcccccuggagaugagcuccaccuga

SEQ ID NO: 32800 - RNA, 741 nt, Artificial Sequence
  derived and/or modified sequence opt1 from MDFIC__Homo_sapiens__NP_001159817
augagcggcgccggggaggcccuggcgcccggcccgguggggccccagcgcgucgccgaggccggcgggggccagcucggcuccaccgcccaggggaagugcgacaaggacaacaccgagaaggacaucacgcaggccaccaacagccacuucacccacggcgagaugcaggaccaguccaucugggggaaccccagcgacggcgagcugauccggacccagccccagcgccugccgcagcuccagacguccgcccaggugcccagcggggaggagaucggcaagaucaagaacggccacaccgggcuguccaacggcaacgggauccaccacggcgcgaagcacggcagcgccgacaaccggaagcuguccgcccccgugagccagaagaugcaccgcaagauccaguccagccucuccgucaacagcgacaucuccaagaaguccaaggugaacgcgguguucagccagaagaccgggagcucccccgaggacugcugcguccacugcauccuggccugccuguucugcgaguuccucacccugugcaacaucgugcugggccaggccagcugcgggaucugcacgagcgaggccugcugcugcugcugcggcgacgagaugggggacgacugcaacugcccgugcgacauggacugcggcaucauggacgccugcugcgaguccagcgacugccucgagaucugcauggagugcugcggcaucugcuuccccuccuga

SEQ ID NO: 32801 - RNA, 741 nt, Artificial Sequence
  derived and/or modified sequence opt1 from MDFI__Homo_sapiens__NP_001287733
auguaccaggugagcggccagcgccccuccgggugcgacgccccguacggcgcccccagcgcggcccccgggcccgcccagacccugucccuccugccgggccuggaggucgugaccgggagcacgcaccccgccgaggccgcgcccgaggagggcucccucgaggaggccgccacccccaugccgcagggcaacgggcccggcaucccccaggggcuggacagcaccgaccuggacgugcccaccgaggccgucacgugccagccgcagggcaacccccucgggugcacgccccugcugcccaacgacuccggccacccgagcgagcucggcgggacccggcgcgcgggcaacggggcccugggcggccccaaggcccaccggaagcugcagacccaccccucccucgccagccagggguccaagaaguccaagagcagcuccaagagcaccaccucccagaucccccugcaggcccaggaggacugcugcgugcacugcauccugagcugccucuucugcgaguuccugacccugugcaacaucgugcucgacugcgcgaccugcggcuccugcagcagcgaggacuccugccugugcugcugcugcugcgggagcggcgagugcgccgacugcgaccugccgugcgaccucgacugcgggauccuggacgccugcugcgaguccgccgacugccuggagaucugcauggagugcugcggccucugcuucagcuccuga

SEQ ID NO: 32802 - RNA, 2868 nt, Artificial Sequence
  derived and/or modified sequence opt1 from MDGA1__Homo_sapiens__NP_705691
auggaggugaccugccugcuccugcuggcccucauccccuuccacugccgcggccagggggucuacgccccggcgcaggcccagaucgugcacgccggccaggccugcguggucaaggaggacaacaucagcgagcggguguacaccauccgcgagggggacacgcugaugcugcagugccucgugaccggccacccccggccccagguccgcuggaccaagaccgccggguccgcgagcgacaaguuccaggagacguccguguucaacgagacccugcggaucgagcgcaucgcccggacccagggcggccgcuacuacugcaaggccgagaacggggugggcguccccgccaucaagagcauccggguggacgugcaguaccuggacgagccgaugcucaccguccaccagacgguguccgacgugcgcgggaacuucuaccaggagaagaccgucuuccugcggugcaccgugaacagcaacccgcccgcgcgcuucaucuggaagcggggcuccgacacccugagccacucccaggacaacgggguggacaucuacgagccccucuacacgcagggcgagaccaagguccugaagcugaagaaccuccgcccccaggacuacgccagcuacacgugccagguguccgugcggaacgucugcggcauccccgacaaggccaucaccuuccgccugaccaacaccaccgccccgcccgcccugaagcucagcgugaacgagacccugguggucaaccccggggagaacgugacgguccagugccugcucaccggcggggacccccugccccagcugcaguggucccacggccccggcccgcucccccugggggcgcuggcccagggcgggacccucagcauccccuccgugcaggcccgggacagcggcuacuacaacugcaccgccacgaacaacguggggaaccccgccaagaagaccgucaaccugcuggugcgcuccaugaagaacgcgaccuuccagaucaccccggacgugaucaaggagagcgagaacauccagcucggccaggaccugaagcuguccugccacgucgacgccgugccccaggagaaggugacguaccagugguucaagaacggcaagcccgcccggaugagcaagcgccuccuggucacccggaacgaccccgagcugccggccgugaccagcucccucgagcugaucgaccugcacuucagcgacuacgggaccuaccucugcauggccuccuuccccggcgcgcccgugcccgaccugagcgucgaggugaacaucuccagcgagacggugccgcccaccaucuccguccccaaggggcgcgccguggugaccguccgcgagggcagcccggccgagcugcagugcgaggugcgggggaagccccgcccgcccgugcucuggucccgggucgacaaggaggccgcccugcugcccagcggccucccccuggaggagacccccgacggcaagcugcgccucgagcgggugucccgcgacaugagcgggacguaccggugccagaccgcgcgcuacaacggcuucaacgugcggccccgcgaggcccagguccagcugaacgugcaguucccgcccgagguggagcccuccagccaggacguccggcaggcccuggggcgccccgugcugcuccggugcucccugcugcgcggcagcccgcagcggaucgccuccgcgguguggcgcuucaaggggcagcuccugcccccgccgcccgucgugcccgccgccgccgaggcccccgaccacgcggagcugcggcucgacgccgugacccgcgacagcuccggcagcuacgagugcagcgucuccaacgacgugggcagcgccgccugccuguuccagguguccgccaaggcguacagccccgaguucuacuucgacacccccaaccccacccggucccacaagcugagcaagaacuacuccuacguccuccaguggacgcagcgcgagcccgacgccguggaccccgugcugaacuaccgccugagcauccggcagcucaaccagcacaacgccgucgugaaggccaucccggugcgccgggucgagaaggggcagcugcuggaguacauccucaccgaccugcgcgugccccacuccuacgaggugcggcugacccccuacaccacguucggcgccggggacauggcgagccgcaucauccacuacaccgagccgaucaacucccccaaccucagcgacaacacgugccacuucgaggacgagaagaucugcggcuacacccaggaccugaccgacaacuucgacuggacccggcagaacgcccugacccagaaccccaagcgcucccccaacaccggcccgcccacggacaucagcgggacccccgagggcuacuacauguucaucgagaccucccggccccgcgagcucggggaccgggcccgccuggucagcccgcuguacaacgccuccgcgaaguucuacugcgugagcuucuucuaccacauguacggcaagcacaucgggagccucaaccugcuggugcggucccgcaacaagggcgcccucgacacccacgccuggagccuguccggcaacaaggggaacgucuggcagcaggcccacgugcccaucagccccuccggccccuuccagaucaucuucgagggggugcggggcccgggguaccugggcgacaucgccaucgacgacgucacgcucaagaagggcgagugcccccgcaagcagaccgaccccaacaagguggucgugaugcccgggagcggcgcgccgugccaguccagcccccagcugugggggcccauggccaucuuccugcucgcccugcagcgguga

SEQ ID NO: 32803 - RNA, 2871 nt, Artificial Sequence
  derived and/or modified sequence opt1 from MDGA2__Homo_sapiens__NP_001106970
auggaccugcucuacggccugguguggcugcucaccguccugcuggaggggaucagcggccaggggguguacgcgcccccgaccgugcgcaucguccacuccggccucgccugcaacaucgaggaggagcgguacagcgagcgcguguacacgauccgggagggggagacccuggagcugaccugccucgugaccggccacccccgcccccagauccgguggacgaagaccgccggcuccgccagcgaccgcuuccaggacuccagcgucuucaacgagacccugcggaucaccaacauccagcgccaccagggcgggcgguacuacugcaaggccgagaacgggcugggcucccccgccaucaagagcauccgcguggacguguacuaccucgacgacccggucgugacggugcaccaguccaucggggaggccaaggagcaguucuacuacgagcggaccgucuuccugcgcugcguggcgaacagcaacccgcccgugcgguacuccuggcgccggggccaggagguccugcuccagggcagcgacaaggggguggagaucuacgagcccuucuucacccagggcgagaccaagauccugaagcugaagaaccuccgcccccaggacuacgccaacuacuccugcaucgccagcgugcggaacgucugcaacauccccgacaagaugguguccuuccgccugagcaacaagacggccucccccagcaucaagcugcucguggacgaccccaucgucgugaacccgggggaggcgaucacccuggugugcgucaccaccggcggcgagcccgcccccucccugacgugggugcggagcuucgggacccuccccgagaagaccguccugaacggcgggacccugacgaucccggccaucaccagcgacgacgccggcaccuacuccugcaucgccaacaacaacguggggaaccccgcgaagaaguccaccaacaucaucgugcgcgcccucaagaagggccgguucuggaucacgcccgaccccuaccacaaggacgacaacauccagaucggccgcgaggucaagaucuccugccagguggaggccgugccgagcgaggagcugaccuucuccugguucaagaacgggcgcccccugcggagcuccgagcgcauggucaucacccagaccgaccccgacgugagccccggcacgaccaaccucgacaucaucgaccugaaguucaccgacuucgggaccuacacgugcguggccucccugaagggcgggggcaucagcgacaucuccaucgacgucaacaucagcuccagcaccgugccgcccaaccucaccgugccccaggagaaguccccgcuggucacccgggagggcgacacgaucgagcugcagugccaggugaccgggaagcccaagcccaucauccucuggagccgcgccgacaaggagguggcgaugcccgacggcuccaugcagauggagagcuacgacgggacccugcggaucgucaacgugucccgcgagaugagcggcauguaccggugccagaccagccaguacaacggguucaacgugaagccgcgcgaggcccugguccagcucaucgugcaguacccgcccgccguggagcccgccuuccuggagauccggcagggccaggaccgcuccgucaccaugagcugccgggugcugcgcgccuaccccauccgggugcucacguacgaguggcgccugggcaacaagcugcuccggaccgggcaguucgacucccaggaguacaccgaguacgcggucaagagccuguccaacgagaacuacggcguguacaacugcagcaucaucaacgaggccggggccggccgcugcuccuuccuggugaccggcaaggccuacgcccccgaguucuacuacgacacguacaaccccgucuggcagaaccggcaccgcguguacagcuacucccuccaguggacccagaugaaccccgacgcgguggaccggaucgucgccuaccgccuggggauccgccaggccggccagcagcgguggugggagcaggagaucaagaucaacgggaacauccagaagggcgagcugaucaccuacaaccugaccgagcucaucaagccggaggccuacgaggugcgccugacgccccugaccaaguucggggagggcgacagcaccauccgggugaucaaguacuccgcgcccgucaacccccaccuccgcgaguuccacugcggcuucgaggacgggaacaucugccuguucacccaggacgacacggacaacuucgacuggaccaagcagagcaccgccacccggaacacgaaguacaccccgaacaccggccccaacgccgaccgcuccgggagcaaggagggcuucuacauguacaucgagaccucccggccccgccuggagggggagaaggcccggcuccugagccccguguucuccaucgccccgaagaaccccuacggccccacgaacaccgcguacugcuucagcuucuucuaccacauguacggccagcacaucggggugcugaacgucuaccuccgccugaagggccagaccaccaucgagaacccccuguggagcuccagcgggaacaagggccagcgguggaacgaggcccacgugaacaucuacccgaucacguccuuccagcucaucuucgaggggauccgcggccccggcaucgagggggacaucgccaucgacgacgugagcaucgccgagggcgagugcgccaagcaggaccuggcgaccaagaacuccgucgacggggccgugggcauccuggugcacaucuggcuguuccccaucaucguccucaucagcauccugagcccccggcgcuga

SEQ ID NO: 32804 - RNA, 1059 nt, Artificial Sequence
  derived and/or modified sequence opt1 from MDH1__Homo_sapiens__NP_001186040
augcgccggugcagcuacuuccccaaggacgugaccgucuucgacaaggacgacaaguccgagccgauccgcgugcuggugaccggcgccgccgggcagaucgcguacagccuccuguacuccaucggcaacgggagcgucuucggcaaggaccagcccaucauccuggugcuccuggacaucacgcccaugaugggggugcuggacggcguccucauggagcugcaggacugcgcccugccccuccugaaggacgugaucgccaccgacaaggaggacguggccuucaaggaccuggacgucgccauccucgugggcuccaugccgcggcgcgaggggauggagcggaaggaccugcugaaggcgaacgugaagaucuucaagagccagggcgccgcccucgacaaguacgccaagaaguccgucaaggugaucguggucgggaaccccgcgaacaccaacugccugaccgccagcaaguccgcccccagcauccccaaggagaacuucuccugccugacgcgccucgaccacaaccgggccaaggcccagaucgcgcugaagcugggcgugaccgccaacgacgugaagaacgucaucaucugggggaaccacagcuccacccaguacccggacgugaaccacgccaaggugaagcuccagggcaaggaggucggcguguacgaggcccugaaggacgacagcuggcugaagggggaguucgugaccacgguccagcagcgcggcgccgcggugaucaaggcccggaagcucuccagcgccauguccgccgccaaggcgaucugcgaccacguccgcgacaucugguucgggacccccgagggcgaguucgugagcaugggcgugaucuccgacgggaacagcuacggcguccccgacgaccugcuguacagcuuccccguggugaucaagaacaagaccuggaaguucgucgaggggcucccgaucaacgacuucucccgggagaagauggaccugaccgccaaggagcugacggaggagaaggagagcgccuucgaguuccucuccagcgccuga

SEQ ID NO: 32805 - RNA, 1017 nt, Artificial Sequence
  derived and/or modified sequence opt1 from MDH2__Homo_sapiens__NP_005909
augcugagcgcccucgcccgccccgcguccgccgcccugcggcgcagcuucuccaccagcgcccagaacaacgccaagguggcgguccugggcgccuccgggggcaucgggcagccgcucagccugcugcucaagaacagcccccuggugucccggcugacccucuacgacaucgcccacacgcccggcguggccgcggaccugucccacaucgagaccaaggccgccgucaagggguaccugggccccgagcagcucccggacugccugaagggcugcgacgugguggucauccccgccggggugccccgcaagcccggcaugacccgggacgaccuguucaacaccaacgccacgaucguggcgacccucaccgccgccugcgcccagcacugcccggaggccaugaucugcgucaucgcgaaccccgugaacagcaccauccccaucacggccgagguguucaagaagcacggggucuacaaccccaacaagaucuucggcgugaccacccuggacaucgugcgcgccaacaccuucgucgccgagcugaaggggcucgacccggcccgggugaacgugcccgucaucggcggccacgcggggaagacgaucaucccccugaucucccagugcacccccaagguggacuucccgcaggaccagcugaccgcccucaccggccgcauccaggaggccgggacggagguggucaaggccaaggccggcgcgggcagcgccacccuguccauggccuacgccggggcgcgguucguguucagccugguggacgccaugaacggcaaggagggggucguggagugcuccuucgucaagagccaggagaccgagugcaccuacuucuccacgccccuccugcugggcaagaaggggaucgagaagaaccucggcaucggcaaggugagcuccuucgaggagaagaugaucagcgacgccauccccgagcugaaggccagcaucaagaagggggaggacuucgugaagacccugaaguga

SEQ ID NO: 32806 - RNA, 264 nt, Artificial Sequence
  derived and/or modified sequence opt1 from MDK__Homo_sapiens__NP_001257481
augcagcaccgcggcuuccugcuccugacccugcucgcccugcuggcccucaccagcgcgguggccaagaagaaggccgacugcaaguacaaguucgagaacuggggcgccugcgacggcgggacggggaccaagguccggcaggggacccugaagaaggcccgcuacaacgcgcagugccaggagaccauccgggugacgaagcccugcaccccgaagaccaaggccaaggccaaggccaagaagggcaagggcaaggacuga

SEQ ID NO: 32807 - RNA, 2040 nt, Artificial Sequence
  derived and/or modified sequence opt1 from MDM1__Homo_sapiens__NP_001191957
augcccgugcgcuucaagggccugagcgaguaccagcggaacuuccucuggaagaaguccuaccugagcgaguccugcaacagcuccgucgggcgcaaguacccgugggccggccugcggagcgaccagcucgggaucaccaaggagcccuccuucaucagcaagcgccgggugcccuaccacgacccccagaucuccaagagccuggaguggaacggcgccaucuccgagagcaacguggucgcguccccggagcccgaggcccccgagacccccaagagccaggaggccgagcagaaggacgugacgcaggagcgcgugcacucccuggaggccagccgggucccgaagcgcacccggucccacagcgccgacucccgcgcggagggggccagcgacguggagaacaacgagggcgugaccaaccacacccccgucaacgagaacguggagcucgagcacagcacgaaggugcuguccgagaacgucgacaacggcguguuccacaacaagagccaguucgugccgcccuucaaggggaacuccgucauccacgagaccgaguacaagcggaacuucaagggccugagccccgugaaggagcccaagcuccgcaacgaccugcgggagaaccgcaaccuggagaccgugucccccgagcgcaagagcaacaagaucgacgaccggcucaagcuggaggccgagauggagcugaaggaccuccaccagcccaagcggaagcugaccccguggaagcaccagcgccuggggaaggucaacuccgaguaccgggccaaguuccucagccccgcgcaguaccuguacaaggccggcgccuggacgcacgugaaggggaacaugcccaaccagggcucccugaacgccaugugguacgccgaggugaaggagcuccgcgagaaggcggaguucuaccggaagcgcguccagggcacccacuucagccgcgaccaccugaaccagauccuguccgacagcaacugcugcugggacguguccagcaccaccuccagcgaggggacgguguccagcaacauccgggcccucgaccuggccggcgaccccaccucccacaagacccugcagaagugcccgagcaccgagcccgaggagaaggggaacaucgucgaggagcagccccagaagaacacgaccgagaagcucggcgugagcgcccccaccaucccgguccgccggcgccuggccugggacaccgagaacacguccgaggacgugcagaagcagcccggcgagaaggaggaggaggacgacaacgaggaggagggggaccggaagaccggcaagcaggcguucaugggggagcaggagaagcuggacgugcgcgagaaguccaaggccgacaagaugaaggagggcuccgacagcuccgucagcuccgagaagggcgggcggcuccccacccccaagcugcgcgagcugggcgggauccagcggacccaccacgaccucacgaccccggccgugggcggggccgugcuggucagccccuccaagaugaagcccccggcccccgagcagcgcaagcggaugaccagccaggacugccuggagaccuccaagaacgacuucacgaagaaggagagccgcgcggugucccuccugaccagccccgccgccggcaucaagaccguggacccccugccgcuccgggaggacuccgaggacaacauccacaaguucgccgaggccacccugcccgucagcaagauccccaaguaccccacgaacccgcccgggcagcugcccagcccgccccacgugcccagcuacuggcaccccagccgccggauccagggcucccuccgcgaccccgaguuccagcacaacgugggcaaggcgcggaugaacaaccugcagcugccgcagcacgaggccuucaacgacgaggacgaggaccgccucagcgagaucuccgcccggagcgccgcguccagccugcgcgccuuccagacccuggcccgcgccaagaagcggaaggagaacuucugggggaagaccuga

SEQ ID NO: 32808 - RNA, 1335 nt, Artificial Sequence
  derived and/or modified sequence opt1 from MDM2__Homo_sapiens__NP_001138809
augugcaacaccaacaugagcgugcccaccgacggcgccgucaccaccucccagaucccggccagcgagcaggagacccuggugcgccccaagccccuccugcugaagcuccugaaguccgugggggcgcagaaggacaccuacacgaugaaggagguccuguucuaccucggccaguacaucaugaccaagcggcuguacgacgagaagcagcagcacaucguguacugcagcaacgaccugcucggggaccuguucggcgugcccuccuucagcgucaaggagcaccgcaagaucuacaccaugaucuaccggaaccuggugguggucaaccagcaggaguccagcgacuccgggaccagcguguccgagaaccgcugccaccucgagggcggcagcgaccagaaggaccuggugcaggagcugcaggaggagaagccguccagcucccaccucgucagccggcccuccacgagcucccgccggcgcgccaucagcgagaccgaggagaacagcgacgagcuguccggggagcggcagcgcaagcggcacaagagcgacuccaucagccuguccuucgacgagagccucgcccugugcgugauccgcgagaucugcugcgagcgguccagcuccagcgaguccaccggcacccccagcaaccccgaccuggacgccgggguguaccaggucacgguguaccaggccggcgaguccgacaccgacagcuucgaggaggacccggagaucucccucgcggacuacuggaagugcaccagcugcaacgagaugaacccgccccugcccucccacugcaaccgcugcugggcccugcgggagaacuggcuccccgaggacaaggggaaggacaagggcgagaucagcgagaaggccaagcuggagaacuccacccaggccgaggagggcuucgacgugcccgacugcaagaagacgaucgucaacgacagccgcgagagcugcguggaggagaacgacgacaagaucacccaggcgucccagagccaggaguccgaggacuacagccagcccuccaccagcuccagcaucaucuacuccagccaggaggacgugaaggaguucgagcgggaggagacccaggacaaggaggaguccgucgagagcucccugccccucaacgccaucgagccgugcgugaucugccaggggcgccccaagaacggcugcaucgugcacgggaagacgggccaccugauggccugcuucacgugcgccaagaagcugaagaagcggaacaagcccugccccgucugccgccagccgauccagaugaucgugcucaccuacuuccccuga

SEQ ID NO: 32809 - RNA, 1323 nt, Artificial Sequence
  derived and/or modified sequence opt1 from MDM4__Homo_sapiens__NP_001191100
augaccagcuucuccaccagcgcccagugcuccacgagcgacuccgccugccgcaucagccccggccagaucaaccaggugcggccgaagcugccccuccugaagauccugcacgcggccggggcccagggcgagauguucaccgucaaggaggugaugcacuaccucgggcaguacaucauggugaagcagcuguacgaccagcaggagcagcacauggucuacugcggcggggaccugcucggcgagcugcugggccgccaguccuucagcgugaaggaccccagcccccucuacgacaugcugcggaagaaccuggugacccucgccaccgccacgaccgacgcggcccagacccuggcccuggcccaggaccacuccauggacaucccgucccaggaccagcucaagcagagcgcggaggaguccagcaccucccgcaagcggacgaccgaggacgacauccccacccugcccaccagcgagcacaagugcauccacucccgcgaggacgaggaccugaucgagaaccucgcccaggacgagacgagccggcuggaccugggguucgaggagugggacgucgccggccuccccuggugguuccuggggaaccugcgcuccaacuacaccccgcggagcaacggcagcaccgaccuccagaccaaccaggugaucgagguggggaagaacgacgaccuggaggacuccaagagccuguccgacgacacggacgucgaggugaccagcgaggacgaguggcagugcaccgagugcaagaaguucaacucccccagcaagcgcuacugcuuccggugcugggcccuccgcaaggacugguacuccgacugcagcaagcugacccacucccugagcacguccgacaucaccgccauccccgagaaggagaacgagggcaacgacgugcccgacugccggcgcaccaucagcgcgccggucgugcggcccaaggacgccuacaucaagaaggagaacuccaagcuguucgaccccugcaacagcguggaguuccucgaccuggcccacuccagcgagucccaggagaccaucagcuccaugggcgagcagcucgacaaccugagcgagcagcgcacggacaccgagaacauggaggacugccagaaccugcucaagcccugcagccugugcgagaagcggccgcgcgacgggaacaucauccacggccggaccgggcaccuggugaccugcuuccacugcgcccgccggcucaagaaggccggcgcguccugccccaucugcaagaaggagauccagcuggucaucaagguguucaucgccuga

SEQ ID NO: 32810 - RNA, 1719 nt, Artificial Sequence
  derived and/or modified sequence opt1 from ME1__Homo_sapiens__NP_002386
auggagcccgaggccccgcgccggcgccacacccaccagcggggcuaccugcucacccgcaacccccaccugaacaaggaccuggccuucacgcucgaggagcggcagcagcugaacauccacgggcugcucccgcccagcuucaacucccaggagauccaggugcugcgcgucgugaagaacuucgagcaccugaacagcgacuucgaccgguaccuccugcugauggaccuccaggaccgcaacgagaagcuguucuaccgggugcugaccuccgacaucgagaaguucaugcccaucgucuacacccccaccgugggccucgcgugccagcaguacagccugguguuccgcaagccccgggggcuguucaucacgauccacgaccgcggccacaucgccuccguccucaacgccuggcccgaggacgugaucaaggccaucguggucaccgacggggagcggauccugggccugggcgaccucgggugcaacggcauggggaucccggugggcaagcuggcccuguacaccgcgugcgggggcaugaacccccaggagugccuccccgugauccuggacgucggcaccgagaacgaggagcugcucaaggacccccuguacaucgggcugcgccagcggcgcgugcggggcagcgaguacgacgacuuccucgacgaguucauggaggccguguccagcaaguacgggaugaacugccugauccaguucgaggacuucgccaacgucaacgccuuccgccugcucaacaaguaccggaaccaguacugcacguucaacgacgacauccagggcaccgcguccguggccguggccggccugcuggccgcccuccgcaucaccaagaacaagcugagcgaccagaccauccuguuccagggggcgggcgaggccgcccucgggaucgcccaccugaucgucauggcccuggagaaggagggccucccgaaggagaaggcgaucaagaagaucuggcugguggacuccaaggggcugaucgugaagggccgggccagccucacgcaggagaaggagaaguucgcccacgagcacgaggagaugaagaaccuggaggccaucguccaggagaucaagcccaccgcccugaucggcguggcggccaucgggggcgccuucuccgagcagauccucaaggacauggccgccuucaacgagcgccccaucaucuucgcgcugagcaaccccaccuccaaggccgagugcagcgccgagcagugcuacaagaucaccaaggggcgcgccaucuucgcguccggcagcccguucgaccccgugacgcugcccaacgggcagacccuguaccccggccagggcaacaacuccuacgucuucccggggguggcccucggcgucguggccugcgggcugcggcagaucaccgacaacaucuuccugaccacggccgaggugaucgcccagcaggucagcgacaagcaccucgaggagggccgccuguacccgccccugaacaccauccgggacgugagccucaagaucgcggagaagaucgugaaggacgccuaccaggagaagaccgccaccgucuaccccgagccccagaacaaggaggccuucgugcgcucccagauguacagcacggacuacgaccagauccugcccgacugcuacuccuggcccgaggaggugcagaagauccagaccaaggucgaccaguga

SEQ ID NO: 32811 - RNA, 1440 nt, Artificial Sequence
  derived and/or modified sequence opt1 from ME2__Homo_sapiens__NP_001161807
augcugagccgccuccggguggucuccacgaccugcacccuggccugccgccaccuccacaucaaggagaagggcaagccccugaugcugaacccgcggaccaacaaggggauggccuucacccugcaggagcgccagaugcucggccugcaggggcugcucccgcccaagaucgagacccaggacauccaggcgcugcgguuccaccgcaaccugaagaagaugacgagcccccucgagaaguacaucuacaucaugggcauccaggagcggaacgagaagcuguucuaccgcauccugcaggacgacaucgagucccucaugcccaucguguacacccccaccguggggcuggccugcagccaguacggccacaucuuccggcgccccaagggccuguucaucuccaucagcgaccgggggcacguccgcuccaucguggacaacuggcccgagaaccacgugaaggccgucguggugaccgacggcgagcggauccucgggcugggcgaccugggggucuacggcaugggcaucccgguggggaagcucugccuguacacggccugcgccggcauccgccccgaccggugccugcccgugugcaucgacgucgggaccgacaacaucgcgcuccugaaggaccccuucuacaugggccuguaccagaagcgcgaccggacccagcaguacgacgaccucaucgacgaguucaugaaggccaucaccgaccgcuacggccggaacacgcugauccaguucgaggacuucgggaaccacaacgccuuccgcuuccugcggaaguaccgcgagaaguacugcaccuucaacgacgacauccagggcaccgccgcgguggcccucgccgggcugcuggccgcccagaaggugaucagcaagccgaucuccgagcacaagauccucuuccugggcgcgggggaggccgcccugggcaucgccaaccucaucgucaugagcaugguggagaacggccuguccgagcaggaggcccagaagaagaucuggauguucgacaaguacgggcugcucgugaagggccgcaaggcgaagaucgacagcuaccaggagcccuucacccacuccgcccccgagagcauccccgacacguucgaggacgccgucaacauccugaagccguccaccaucaucgggguggccggcgccgggcggcuguucacccccgacgugauccgcgcgauggccagcaucaacgagcggcccgucaucuucgcccucuccaaccccaccgcccaggccgagugcacggcggaggaggccuacacccugaccgagggccgcugccuguucgccagcggcuccccguucgggcccgugaagcucaccgacggccggguguucacgcccgggcagggcaacaacgucuacaucuuccccggguaccgcaucccgaucugcuga

SEQ ID NO: 32812 - RNA, 1815 nt, Artificial Sequence
  derived and/or modified sequence opt1 from ME3__Homo_sapiens__NP_001155058
augggcgccgcccuggggaccggcacccgccucgcgcccuggccggggcgggccugcggcgcccugccccgcuggacgcccaccgcccccgcccaggggugccacagcaagccgggccccgcgcggcccgugccccugaagaagcgcggcuacgacgucacccggaacccgcaccucaacaaggggauggccuucacccuggaggagcgccugcagcucggcauccacgggcugaucccgcccugcuuccugucccaggacgugcagcuccugcggaucaugcgcuacuacgagcggcagcagagcgaccuggacaaguacaucauccucaugacgcugcaggaccgcaacgagaagcuguucuaccgggugcucaccuccgacgucgagaaguucaugcccaucguguacacccccaccgugggccuggccugccagcacuacgggcugacguuccgccggccccgcggccucuucaucaccauccacgacaagggccaccuggccaccaugcugaacagcuggcccgaggacaacaucaaggcggucguggugaccgacggggagcggauccucggccugggggaccugggcugcuacggcauggggauccccgucggcaagcucgcccuguacacggccugcgggggcgugaacccgcagcagugccugcccgugcuccuggacgucgggaccaacaacgaggagcugcuccgcgacccccuguacaucggccugaagcaccagcgggugcacggcaaggccuacgacgaccuccuggacgaguucaugcaggccgugaccgacaaguucgggaucaacugccugauccaguucgaggacuucgcgaacgccaacgccuuccgccuccugaacaaguaccggaacaaguacugcauguucaacgacgacauccagggcaccgccuccgucgccguggcggggauccuggccgcccuccgcaucacgaagaacaagcugagcaaccacguguucgucuuccagggcgccggggaggccgcgaugggcaucgcccaccuccuggugauggcccuggagaaggagggcgugcccaaggccgaggccacccggaagaucuggauggucgacuccaaggggcugaucgugaagggccgcagccaccucaaccacgagaaggagauguucgcgcaggaccacccggaggugaacucccuggaggaggucgugcgccuggucaagcccaccgccaucaucgggguggccgccaucgcgggcgccuucaccgagcagauccuccgggacauggccagcuuccacgagcgccccaucaucuucgcccuguccaaccccacgagcaaggccgagugcaccgcggagaagugcuaccgggugaccgaggggcgcggcaucuucgccuccggcagcccguucaaguccgucacccuggaggacgggaagacguucauccccggccaggggaacaacgccuacguguuccccggcguggcccugggcgucaucgccgggggcauccggcacauccccgacgagaucuuccuccugaccgcggagcagaucgcccaggaggugagcgagcagcaccugucccaggggcgccucuacccgccccugagcaccauccgggacgugucccugcgcaucgccaucaagguccucgacuacgccuacaagcacaaccuggccagcuacuaccccgagccgaaggacaaggaggcguucgugcggagccugguguacacccccgacuacgacuccuucacgcucgacagcuacaccuggcccaaggaggccaugaacguccagaccguguga

SEQ ID NO: 32813 - RNA, 558 nt, Artificial Sequence
  derived and/or modified sequence opt1 from MEA1__Homo_sapiens__NP_055438
augggccccgagcgccaccugagcggggccccggcccggauggcgaccgugguccucggcggggacaccaugggccccgagcgcaucuuccccaaccagacggaggagcuggggcaccagggccccuccgagggcaccggggacuggagcuccgaggagccggaggaggagcaggaggagaccggcagcgggcccgccggcuacuccuaccagccccugaaccaggaccccgagcaggaggagguggagcucgccccggugggggacggcgacgucguggccgacauccaggaccggauccaggcccugggccugcaccuccccgacccgccccuggagagcgaggacgaggacgaggagggggcgaccgcccugaacaaccacuccagcauccccauggaccccgagcacguggagcucgucaagcgcacgauggccggcgugucccugcccgcccccggggugccggcgugggcccgggagaucagcgacgcccagugggaggacgucgugcagaaggcccugcaggcccgccaggcgucccccgccuggaaguga

SEQ ID NO: 32814 - RNA, 3351 nt, Artificial Sequence
  derived and/or modified sequence opt1 from MECOM__Homo_sapiens__NP_001098547
augauccuggacgaguucuacaacgugaaguucugcaucgacgccagccagcccgacgucggcuccuggcucaaguacauccgcuucgccgggugcuacgaccagcacaaccugguggcgugccagaucaacgaccagaucuucuaccggguggucgccgacaucgccccgggcgaggagcugcuccuguucaugaaguccgaggacuacccccacgagaccauggcccccgacauccacgaggagcgccaguaccggugcgaggacugcgaccagcuguucgaguccaaggccgagcucgcggaccaccagaaguuccccugcagcaccccgcacuccgccuucagcaugguggaggaggacuuccagcagaagcuggaguccgagaacgaccugcaggagauccacacgauccaggagugcaaggagugcgaccagguguuccccgaccuccagagccuggagaagcacaugcugucccacaccgaggagcgcgaguacaagugcgaccagugccccaaggccuucaacuggaaguccaaccucauccggcaccagaugucccacgacagcgggaagcacuacgagugcgagaacugcgccaagcaggucuucaccgaccccuccaaccugcagcgccacauccggagccagcacgugggcgcgcgcgcccacgccugcccggagugcgggaagaccuucgccacguccagcggccugaagcagcacaagcacauccacuccagcgugaagcccuucaucugcgaggucugccacaaguccuacacccaguucagcaaccucugccggcacaagcgcaugcacgccgacugccggacccagaucaagugcaaggacugcggccagauguucagcaccacguccagccugaacaagcaccgccgguucugcgaggggaagaaccacuucgcggccggcggguucuucggccaggggaucucccugcccggcacccccgccauggacaagaccagcauggugaacaugucccacgccaacccgggccucgccgacuacuucggggcgaaccgccaccccgccggccugaccuuccccacggcccccggguucagcuucuccuucccgggccuguuccccagcggccucuaccaccggccgccccugauccccgccuccagccccgugaaggggcuguccagcaccgagcagaccaacaagucccagagcccccucaugacccacccccagauccugccggccacgcaggacauccugaaggcgcucuccaagcaccccagcgucggcgacaacaagcccguggagcugcagcccgagcgcuccagcgaggagcggccguucgagaagaucuccgaccagagcgagagcuccgaccuggacgacgugagcacccccuccgggagcgaccucgagaccaccuccggcagcgaccuggaguccgacaucgagagcgacaaggagaaguucaaggagaacgggaagauguucaaggacaaggucagcccccugcagaaccucgccagcaucaacaacaagaaggaguacuccaaccacagcaucuucuccccgagccuggaggagcagacggccguguccggcgccgugaacgacagcaucaaggccaucgcguccaucgccgagaaguacuucggcagcaccgggcuggucggccuccaggacaagaaggugggggcccugcccuaccccagcauguucccccugccguucuuccccgccuucucccagagcauguaccccuuccccgaccgcgaccuccggucccugccgcugaagauggagccccagagccccggcgaggugaagaagcuccagaagggguccagcgagucccccuucgaccugaccaccaagcgcaaggacgagaagccgcugacgcccguccccagcaagcccccggugacccccgcgaccucccaggaccagccccucgaccugagcaugggcucccggagccgcgccuccggcaccaagcugacggagccccgcaagaaccacguguucgggggcaagaaggggagcaacgucgagucccggccggccagcgacggcucccuccagcacgcccgccccacccccuucuucauggaccccaucuaccggguggagaagcgcaagcugaccgacccgcuggaggcccugaaggagaaguaccuccggcccagccccggguuccuguuccacccgcaguuccagcugcccgaccagcgcaccuggauguccgcgaucgagaacauggccgagaagcucgagagcuucagcgcccugaagcccgaggccuccgagcugcuccagagcguccccuccauguucaacuuccgggccccgcccaacgcgcugcccgagaaccugcuccgcaagggcaaggagcgguacacgugccgcuacugcggcaagaucuucccccggagcgccaaccugacccgccaccuccggacccacaccggggagcagccguaccgcugcaaguacugcgaccgguccuucagcaucuccagcaaccugcagcgccacgugcggaacauccacaacaaggagaagcccuucaagugccaccugugcgaccgcugcuucggccagcagacgaaccuggaccggcaccucaagaagcacgagaacgggaacauguccggcaccgccaccagcagcccccacagcgagcuggaguccaccggcgccauccuggacgacaaggaggacgccuacuucaccgagauccgcaacuucaucgggaacagcaaccacggcucccagagcccccgcaacguggaggagcggaugaacgggucccacuucaaggacgagaaggcgcucgucacgagccagaacuccgaccugcuggacgacgaggagguggaggacgaggugcuccuggacgaggaggacgaggacaacgacaucaccggcaagaccgggaaggagccggucaccagcaaccugcacgagggcaaccccgaggacgacuacgaggagacgagcgcccucgagauguccugcaagaccagccccgugcgcuacaaggaggaggaguacaaguccggccugagcgcccuggaccacauccggcacuucaccgacucccucaagaugcgcaagauggaggacaaccaguacagcgaggccgagcuguccagcuucuccaccagccacgugcccgaggagcugaagcagccgcuccaccggaaguccaagagccaggcguacgccaugaugcugucccugagcgacaaggagucccuccacagcacgucccacagcuccagcaacgucuggcacagcauggcccgcgccgccgcggaguccagcgccauccaguccaucagccacguguga

SEQ ID NO: 32815 - RNA, 1497 nt, Artificial Sequence
  derived and/or modified sequence opt1 from MECP2__Homo_sapiens__NP_001104262
auggccgccgcggccgccgccgcccccagcggcgggggcgggggcggggaggaggagcgccuggaggagaaguccgaggaccaggaccuccagggccugaaggacaagccgcugaaguucaagaaggugaagaaggacaagaaggaggagaaggagggcaagcacgagcccguccagcccagcgcgcaccacuccgccgagcccgccgaggccgggaaggcggagaccagcgagggcuccgggagcgccccggccgugcccgaggccuccgccagccccaagcagcggcgcuccaucauccgggaccgcggccccauguacgacgacccgacccuccccgagggguggacgcggaagcugaagcagcgcaagagcggccgguccgcgggcaaguacgacguguaccugaucaacccccaggggaaggccuuccgcagcaaggucgagcucaucgccuacuucgagaaggugggcgacaccucccuggaccccaacgacuucgacuucaccgugaccgggcggggcagcccgucccgccgggagcagaagccgcccaagaagcccaagagccccaaggcccccggcacggggcgcggccgggggcgccccaagggcuccgggaccacccggcccaaggccgcgaccagcgagggcguccaggugaagcgcgugcuggagaaguccccgggcaagcuccuggucaagaugcccuuccagacgagccccgggggcaaggccgagggcggcggggccaccaccagcacccaggugauggugaucaagcggcccgggcgcaagcggaaggccgaggccgacccgcaggcgauccccaagaagcgcggccggaagcccggguccgucguggccgccgccgccgcggaggccaagaagaaggccgugaaggagagcuccauccgcagcguccaggagacggugcugcccaucaagaagcgcaagacccgggagaccguguccaucgaggucaaggagguggugaagccgcuccuggucagcacccugggcgagaaguccgggaagggccucaagacgugcaagagccccgggcgcaaguccaaggagagcucccccaagggccggagcuccagcgccuccagcccgcccaagaaggagcaccaccaccaccaccaccacuccgagagccccaaggcgcccgugccgcugcugccgccccucccgcccccgccgcccgagcccgaguccagcgaggaccccaccagcccgcccgagccccaggaccuguccagcuccgugugcaaggaggagaagaugccccgcggcgggagccuggaguccgacggcugccccaaggagcccgccaagacccagcccgccgucgccaccgccgcgacggccgccgagaaguacaagcaccgcggggagggcgagcggaaggacaucgugagcuccagcaugccccggcccaaccgcgaggagcccgucgacucccggacccccgugaccgagcgcgugagcuga

SEQ ID NO: 32816 - RNA, 6534 nt, Artificial Sequence
  derived and/or modified sequence opt1 from MED12__Homo_sapiens__NP_005111
auggccgccuucggcauccugagcuacgagcaccgcccccugaagcggccccgccuggggccgcccgacguguacccccaggaccccaagcagaaggaggacgagcugaccgcccugaacgugaagcagggcuucaacaaccagcccgccgugagcggggacgagcacggcagcgccaagaacguguccuucaaccccgccaagaucagcagcaacuucagcuccaucaucgccgagaagcugcggugcaacacccugcccgacaccgggcgccggaagccccaggugaaccagaaggacaacuucuggcucgugaccgcccgcagccaguccgccaucaacaccugguucaccgaccuggccggcaccaagccccugacccagcucgccaagaaggugcccaucuucagcaagaaggaggaggucuucggcuaccuggccaaguacaccgugcccgugaugcgggccgccuggcugaucaagaugaccugcgccuacuacgccgcgaucuccgagacgaaggucaagaagcgccacguggaccccuucauggaguggacccagaucaucaccaaguaccucugggagcagcugcagaagauggccgaguacuaccggcccgggcccgccggcagcgggggcugcggguccaccaucggcccccugccgcacgacguggaggucgccauccgccagugggacuacacggagaagcucgccauguucauguuccaggacggcaugcuggaccggcacgaguuccugaccugggugcucgagugcuucgagaagauccgccccggggaggacgagcugcugaagcuccugcugccccuccugcugcgguacagcggcgaguucgugcaguccgcguaccucagccgccggcuggccuacuucugcacccgccggcuggcccuccagcuggacggggucuccagccacuccagccacgugaucagcgcccaguccaccagcacgcugcccaccaccccggcgccccagccgcccaccuccagcacgccguccacccccuucagcgaccuccugaugugcccccagcaccgcccccugguguucggccucuccugcauccugcagaccauccugcucugcugcccgagcgcgcuggucuggcacuacucccugaccgacagccggaucaagacgggcagcccccuggaccaccuccccaucgccccgagcaaccugcccaugcccgaggggaacuccgccuucacccagcagguccgcgccaagcuccgggagaucgagcagcagaucaaggagcgcggccaggccguggagguccgcuggagcuucgacaagugccaggaggcgaccgccggguucaccaucggccgggugcugcacacgcuggaggugcucgacucccacagcuucgagcgcuccgacuucagcaacucccuggacagccugugcaaccggaucuucgggcugggccccagcaaggacggccacgagaucuccagcgacgacgacgccgucgugucccuccugugcgagugggccgucagcugcaagcgcuccgggcggcaccgcgcgauggugguggccaagcugcucgagaagcggcaggccgagaucgaggccgagcgcugcggcgagagcgaggccgcggacgagaagggguccaucgccagcggcucccugagcgccccguccgcccccaucuuccaggacguccugcuccaguuccuggacacccaggcccccaugcugaccgacccccggagcgaguccgagcgcguggaguucuucaaccucgugcugcuguucugcgagcucauccggcacgacgucuucagccacaacauguacacgugcacgcugaucucccgcggggaccuggcguucggcgccccgggcccccggccgcccagcccguucgacgaccccgccgacgaccccgagcacaaggaggccgagggguccagcagcuccaagcucgaggaccccggccugagcgaguccauggacaucgacccgagcuccagcgugcuguucgaggacauggagaagcccgacuucucccucuucagccccaccaugcccugcgaggggaagggcuccccgagccccgagaagcccgacguggagaaggaggucaagcccccgcccaaggagaagaucgaggggacccugggcgugcuguacgaccagccccgccacgugcaguacgccacccacuucccgaucccccaggaggaguccugcagccacgagugcaaccagcggcucgucgugcuguucggcguggggaagcagcgcgacgacgcgcggcacgccaucaagaagaucacgaaggacauccugaagguccucaaccgcaagggcaccgccgagaccgaccagcuggcccccaucgugccccugaacccgggggaccucaccuuccugggcggcgaggacgggcagaagcggcgccgcaaccggcccgaggcguuccccaccgccgaggacaucuucgccaaguuccagcaccugucccacuacgaccagcaccaggugacggcccaggucagccgcaacgugcucgagcagaucaccuccuucgcccugggcaugagcuaccaccucccccucgugcagcacguccaguucaucuucgaccugauggaguacucccugagcaucuccgggcucaucgacuucgcgauccagcugcugaacgagcucagcgugguggaggccgagcugcugcucaagagcuccgaccuggucggcagcuacaccaccucccugugccucugcaucguggccgugcugcggcacuaccacgccugccugauccucaaccaggaccagauggcccaggucuucgaggggcugugcggcguggugaagcacggcaugaaccgcagcgacggguccagcgcggagcggugcauccuggccuaccucuacgaccuguacacguccugcagccaccugaagaacaaguucggcgagcuguucuccgacuucugcagcaaggucaagaacaccaucuacugcaacguggagccguccgagagcaacaugcgcugggcccccgaguucaugaucgacacccucgagaaccccgccgcccacaccuucacguacaccgggcugggcaagucccucagcgagaaccccgcgaaccgguacuccuucgugugcaacgcccugaugcacgucugcguggggcaccacgacccggaccgcgugaacgacaucgccauccugugcgccgagcucaccggcuacugcaagagccuguccgcggaguggcugggcguccucaaggcccugugcugcagcuccaacaacgggaccugcggcuucaacgaccugcucugcaacguggacgugagcgaccugagcuuccacgacucccuggccacguucgucgccauccucaucgcccggcagugccugcugcucgaggaccugauccgcugcgcggccauccccagccugcucaacgccgccugcuccgagcaggacagcgagcccggggcccggcugaccugccgcauccugcuccaccuguucaagacgccccagcugaacccgugccaguccgacggcaacaagcccaccguggggauccggagcuccugcgaccgccaccuccuggcggccagccagaaccggaucguggacggcgccgucuucgccgugcugaaggccguguucguccucggcgacgcggagcugaagggguccggcuucaccgugaccgggggcaccgaggagcugcccgaggaggagggcgggggcgggagcggcgggcgccggcagggcggccgcaacaucuccguggagaccgccagccucgacgucuacgccaaguacgugcugcgguccaucugccagcaggagugggugggggagcgcugccugaagucccucugcgaggacuccaacgaccugcaggaccccguccugagcuccgcccaggcccagcggcucaugcagcugaucugcuacccgcaccgccugcuggacaacgaggacggcgagaacccccagcgccagcggaucaagcgcauccuccagaaccuggaccaguggacgaugcggcagagcucccuggagcuccagcugaugaucaagcagacccccaacaacgagaugaacagccugcucgagaacaucgcgaaggccaccaucgagguguuccagcagagcgccgagaccggguccagcuccggcagcacggccuccaacaugcccagcuccagcaagaccaagccgguccuguccagccuggagcgcuccgggguguggcucguggcgccccugaucgccaagcugcccaccagcguccagggccacgugcucaaggccgccggcgaggagcuggagaaggggcagcaccugggcuccagcucccggaaggagcgcgaccggcagaagcagaaguccaugucccuccugagccagcagcccuuccugucccucgugcugaccugccugaaggggcaggacgagcagcgcgagggccuccugacgagccuguacagccagguccaccagaucgugaacaacuggcgggacgaccaguaccucgacgacugcaagccgaagcagcugaugcacgaggcccugaagcuccgccugaaccuggucgggggcauguucgacaccguccagcgguccacccagcagaccacggagugggcgaugcuccugcuggagaucaucaucagcggcaccguggacaugcaguccaacaacgagcuguucaccaccgugcuggacaugcugagcguccucaucaacgggacgcuggccgccgacauguccagcaucucccagggcagcauggaggagaacaagcgcgccuacaugaaccuggccaagaagcuccagaaggagcugggggagcggcaguccgacagccuggagaaggugcgccagcuccugccccugcccaagcagacccgggacgugaucacgugcgagccgcagggcucccucaucgacaccaaggggaacaagaucgcgggcuucgacagcaucuucaagaaggagggccugcaggucuccaccaagcagaagaucagccccugggaccuguucgaggggcucaagcccuccgcgccccugagcuggggcugguucgggacggugcgcguggaccggcgcgucgcccggggcgaggagcagcagcgccugcuccuguaccacacccaccuccgcccgcggccccgcgccuacuaccucgagccccugccccugccgcccgaggacgaggagccgcccgccccgacccuccuggagcccgagaagaaggcgcccgagcccccgaagaccgacaagcccggcgccgcgccgcccuccacggaggagcggaagaagaaguccaccaaggggaagaagcgcucccagccggccaccaagaccgaggacuacggcauggggcccggccggagcgggcccuacggcgugacggugcccccggaccugcuccaccaccccaaccccggcagcaucacccaccugaacuaccgccagggguccaucggccuguacacccagaaccagccccucccggccgggggcccccgggucgaccccuaccgcccggugcggcugcccaugcagaagcugcccacccgccccacguacccgggggugcuccccaccaccaugaccggcgucaugggccuggagcccagcuccuacaagacgagcguguaccggcagcagcagcccgccgugccgcaggggcagcgccugcggcagcagcuccagcagucccagggcaugcuggggcagagcuccguccaccagaugacccccagcuccagcuacggccugcagaccucccagggguacacccccuacgugagccacgugggccuccagcagcacacgggccccgccgggaccauggucccgcccuccuacagcucccagcccuaccagagcacccaccccuccaccaacccgacgcugguggaccccacccgccaccuccagcagcggcccagcggcuacgugcaccagcaggcccccaccuacgggcacggccucaccagcacgcagcgcuucucccaccagacccugcagcagaccccgaugaucagcaccaugacgcccauguccgcccaggggguccaggcgggcgugcggagcaccgccauccugcccgagcagcagcagcagcagcagcagcagcagcagcagcagcagcagcagcagcagcagcagcagcagcagcagcagcagcaguaccacauccgccagcagcagcagcagcagauccuccggcagcagcagcagcagcagcagcagcagcagcagcagcagcagcagcagcagcagcagcagcagcagcagcagcagcagcaccagcagcagcagcagcagcaggccgcgccgccccagccccagccccagucccagccccaguuccagcgccagggccugcagcagacccagcagcagcagcagaccgccgcgcuggugcggcagcuccagcagcagcugagcaacacgcagccccagcccuccaccaacaucuucgggcgcuacuga

SEQ ID NO: 32817 - RNA, 6438 nt, Artificial Sequence
  derived and/or modified sequence opt1 from MED12L__Homo_sapiens__NP_443728
auggccgccuucggccugcugagcuacgagcagcgcccccugaagcggccccgccuggggccgcccgacguguacccccaggaccccaagcagaaggaggacgagcucaccgccgugaacgugaagcagggcuucaacaaccagcccgccuucaccggggacgagcacggcuccgcccggaacaucgugaucaaccccagcaagaucggggccuacuucagcagcauccuggccgagaagcugaagcucaacacguuccaggacaccggcaagaagaagccccaggucaacgccaaggacaacuacuggcuggugaccgcccgcucccagagcgccauccacuccugguucagcgaccuggccggcaacaagccgcucuccauccuggcgaagaaggugcccauccugagcaagaaggaggacgucuucgccuaccucgccaaguacuccgugcccauggugcgggccaccuggcugaucaagaugacgugcgccuacuacagcgcgaucuccgaggccaagaucaagaagcgccaggcccccgaccccaaccuggaguggacccagaucagcacccgguaccuccgcgagcagcuggccaagaucuccgacuucuaccacauggccagcuccaccggggacggccccguccccgugcccccggagguggagcaggcgaugaagcagugggaguacaacgagaagcuggccuuccacauguuccaggaggggaugcucgagaagcacgaguaccugacguggauccuggacguccucgagaagauccggcccauggacgacgaccugcugaagcuccugcugccccucaugcugcaguacagcgacgaguucgugcaguccgccuaccugagccgccggcucgccuacuucugcgcccgccggcugagccugcuccuguccgacagccccaaccugcucgcggcccacuccccgcacaugaugaucggccccaacaacagcuccaucggggcccccagccccggcccgcccggccccgggaugucccccgugcagcuggccuucagcgacuuccuguccugcgcccagcacggcccgcucgucuacgggcugagcugcaugcugcagaccgugacccucugcugccccuccgcgcugguguggaacuacagcaccaacgagaacaaguccgccaaccccggcagcccgcuggaccuccugcaggucgcccccuccagccugcccaugcccggcgggaacacggccuucaaccagcagguccgcgcgcggaucuacgagguggagcagcagaucaagcagcgcggccgggccgucgaggugcgcugguccuucgacaagugccaggagagcaccgccggggugaccaucucccggguccuccacacccuggaggugcuggaccgccacugcuucgaccggacggacagcagcaacuccauggagacccuguaccacaagaucuucugggccaaccagaacaaggacaaccaggaggucgccccgaacgacgaggcgguggugacccuccugugcgagugggccgucagcugcaagcgcuccggcaagcaccgcgccauggccguggccaagcugcucgagaagcggcaggcggagaucgaggccgagcgcugcggggagagcgaggugcuggacgagaaggaguccaucagcuccagcucccuggccggcagcucccuccccgucuuccagaacgugcugcugcgguuccucgacacccaggcccccagccuguccgaccccaacagcgagugcgagaagguggaguucgucaaccuggugcuccuguucugcgaguucauccgccacgacguguucucccacgacgccuacaugugcacgcugaucagccggggcgaccucuccgucaccgcgagcacccgcccgcggagccccgugggggagaacgccgacgagcacuacuccaaggaccacgacgugaagauggagaucuucagccccaugcccggcgaguccugcgagaacgccaacaccagccuggggcgccggauguccgucaacugcgagaagcuggugaagcgcgagaagccgcgggagcucaucuuccccagcaacuacgaccugcugcgccaccuccaguacgccacgcacuuccccaucccccuggacgaguccagcucccacgagugcaaccagcggaccauccugcucuacggcguggggaaggagcgcgacgaggcgcggcaccagcugaagaagaucaccaaggacauccugaagauccucaacaagaaguccaccacggagaccggcgucggcgacgaggggcagaaggcccgcaagaacaagcaggagaccuucccgacccuggagacgguguucaccaagcugcagcuccuguccuacuucgaccagcaccaggugaccagccagaucuccaacaacguccuggagcagaucaccagcuucgccuccggcacgagcuaccaccucccccuggcccaccacauccagcugaucuucgaccucauggagcccgcccugaacaucaacgggcugaucgacuucgcgauccagcuccugaacgagcuguccgugguggaggccgagcuccugcucaagagcuccagccucgccggcagcuacaccaccgggcugugcgucugcaucguggccgugcugcggcgcuaccacuccugccucauccugaaccccgaccagaccgcccaggucuucgagggccugugcggcguggugaagcacgucgugaacccgagcgagugcuccagccccgagcggugcauccucgcguaccuguacgaccuguacguguccugcagccaccuccgcuccaaguucggggaccuguucagcuccgccugcagcaaggucaagcagaccaucuacaacaacgugaugcccgccaacuccaaccugcgcugggaccccgacuucaugauggacuucaucgagaacccgagcgcccgguccaucaacuacagcaugcucggcaagauccuguccgacaacgccgcgaaccgcuacagcuucgugugcaacacgcugaugaacgucugcauggggcaccaggacgccggccggaucaacgacaucgccaacuucuccagcgagcucaccgccugcugcaccgugcuguccagcgaguggcugggcgugcucaaggcgcugugcugcagcuccaaccacgucuggggguucaacgacgugcugugcaccguggacgucagcgaccucuccuuccacgacagccuggccacguucaucgccauccugaucgcccgccagugcuucucccucgaggacguggugcagcacgucgcccugcccagccugcucgcggccgccugcggcgacgccgacgccgagcccggggcgcggaugaccugccgccugcugcuccaccuguuccgggccccgcaggccugcuuccugccccaggccaccggcaagcccuuccccgggauccgcuccagcugcgaccggcaccuccuggccgcggcccacaacuccaucgaggugggcgccguguucgccguccugaaggccaucaugaugcucggcgacgcgaagaucgggaacaacagcguguccagccugaagaacgacgacuucaccaugcgcggccugcggugcgacgggaacgccgacgacaucuggacggccucccagaaccccaagagcugcggcaaguccaucagcaucgagaccgccaaccuccgcgaguacgcgcgguacgugcugcgcaccaucugccagcaggagugggucggggagcacugccugaaggagcccgagcggcucugcaccgacaaggagcugauccuggaccccgugcucuccaacaugcaggcccagaagcugcugcagcucaucugcuacccccacggcaucaaggagugcacggagggcgacaaccugcagcgccagcacaucaagcggauccugcagaaccuggagcaguggacccuccgccagagcuggcuggagcugcagcucaugaucaagcagugccugaaggacccgggguccggcagcgucgccgagaugaacaaccugcucgacaacaucgccaaggccaccaucgagguguuccagcagagcgcggaccugaacaacuccagcaacuccgggaugagccuguucaaccccaacuccaucggcagcgccgacaccuccagcacgcggcagaacgggaucaagaccuuccucuccagcuccgagcgccggggcguguggcuggucgcgccccugaucgcccgccuccccaccagcgugcagggccgcgugcugaaggccgcgggggaggagcuggagaagggccagcaccucggguccagcuccaagaaggagcgggaccgccagaagcagaaguccaugucccugcugagccagcagccguuccucucccugguccugaccugccucaagggccaggacgagcagcgggaggggcugcugacgagccuccagaaccaggugaaccagauccugagcaacuggcgcgaggagcgguaccaggacgacaucaaggcccgccagaugaugcacgaggcccugcagcuccggcugaaccuggugggcggcauguucgacaccguccagcgcuccacccaguggaccacggacugggcccuccugcugcuccagaucaucaccagcgggaccguggacaugcacaccaacaacgagcuguucacgaccgugcuggacaugcucggcguccugaucaacgggacccuggccuccgaccucagcaacgcgucccccggcggcagcgaggagaacaagcgggccuacaugaaccuggugaagaagcugaagaaggagcucggggacaagcgcuccgagagcaucgacaaggugcggcagcugcugccccuccccaagcagaccugcgacgucaucacgugcgagccgaugggcucccugaucgacaccaaggggaacaagaucgccggcuucgacagcaucgacaagaagcaggggcuccagguguccaccaagcagaaggugagccccugggaccucuucgagggccagaagaaccccgcgccccuguccugggcgugguucggcaccguccgcguggaccggcgcgugaucaaguacgaggagcagcaccaccuccugcuguaccacacgcacccgaugcccaagccccggagcuacuaccugcagccccugccgcugccgcccgaggaggaggaggaggagcccaccuccccggucagccaggagcccgagcgcaaguccgccgagcugagcgaccaggggaagaccaccaccgacgaggagaagaagacgaagggccggaagcgcaagaccaaguccagcagccggguggacgaguacccccaguccaacaucuaccgcgugccgcccaacuacagccccaucuccagccagaugaugcaccacccccaguccacccucuggggguacaaccuggucggccagccgcagcagcccggguucuuccugcagaaccagagccucacccccggcggcucccgccuggaccccgccgggagcuucgugccgacgaacaccaagcaggcccuguccaacaugcuccagcggcgcagcggcgccaugaugcagccgcccucccugcacgcgaucaccagccagcagcagcugauccagaugaagcuccugcagcagcagcagcagcagcggcugcuccgccaggcccagacccggcccuuccagcaggggcagccgggcgaccaggccgcccuguucgccgcgcaggcccgccccagcccccagcugccccaguacccggggcuccagcaggcccagacgaugccccagggcuacaccauguacggcacccagaugccccugcagcagaccagccagcagcaggccggguccgugguccugagccccuccuacaacagccgggccuacccggcggcccacagcaaccccgugcucauggagcgccugcggcagauccagcagcagcccuccggcuacgugcagcagcaggccagccccuaccugcagccgcucacggggucccagcgccugaaccaccaggcccugcagcagagcccccucgucggcggcgggaucgacgcggugcugaccuccgcccaccccaaccugcccagcgugccgcucccccaggaccccaugcggccgcgccagccccagguccggcagcagcagcgccugcugcagaugcagcagccccagcagccccagccgcagcagccgccccagccccagcaguccagccagucccagagccagacccucggccugcaggccaugcagccgcagcagccccuguucccccggcaggggcuccagcagacccagcagcagcagcagacggccgcccuggugcgccagcugcagaagcagcucuccagcaaccagccccagcagggcgugaccccguacgggcaccccucccacuucuga

SEQ ID NO: 32818 - RNA, 6525 nt, Artificial Sequence
  derived and/or modified sequence opt1 from MED13__Homo_sapiens__NP_005112
augagcgccagcuucgugcccaacggggccagccuggaggacugccacugcaaccucuucugccuggccgaccugaccgggaucaaguggaagaaguacgucuggcagggccccaccagcgcccccauccucuuccccgugaccgaggaggaccccauccugagcuccuucagccgcugccugaaggccgacgugcucggggucuggcggcgcgaccagcggcccggccgccgggagcuguggaucuucugguggggcgaggaccccuccuucgccgaccugauccaccacgaccucagcgaggaggaggacggcgugugggagaacggccuguccuacgagugccgcacccuccuguucaaggccgugcacaaccugcuggagcggugccucaugaaccgcaacuucguccggaucgggaagugguucgugaagcccuacgagaaggacgagaagcccaucaacaagagcgagcaccuguccugcagcuucaccuucuuccugcacggcgacuccaacgugugcaccagcgucgagaucaaccagcaccagcccguguaccuccuguccgaggagcacaucacccuggcgcagcagagcaacucccccuuccaggugauccucugccccuucgggcugaacggcacccugaccgggcaggccuucaagaugagcgacuccgccaccaagaagcucaucggcgaguggaagcaguucuaccccaucagcugcugccugaaggagaugagcgaggagaagcaggaggacauggacugggaggacgacucccuggccgcggucgaggugcucguggccggcguccgcaugaucuaccccgccugcuucgugcuggugccccagagcgacauccccacccccuccccggucgggagcacccacugcuccagcuccugccugggcgugcaccaggugcccgccagcacccgggaccccgccauguccagcgucacccucaccccgcccaccucccccgaggaggugcagaccguggacccccagagcguccagaagugggugaaguucuccagcgucuccgacggguucaacagcgacuccaccagccaccacggcggcaagaucccccgcaagcuggcgaaccacgugguggaccgggucuggcaggagugcaacaugaaccgcgcccagaacaagcggaaguacuccgccagcagcgggggccugugcgaggaggccaccgccgcgaagguggccuccugggacuucguggaggccacccagcgcaccaacugcagcugccuccggcacaagaaccugaagucccgcaacgccgggcagcagggccaggcccccagccuggggcagcagcagcagauccuccccaagcacaagaccaacgagaagcaggagaaguccgagaagccccagaagcggccccugacccccuuccaccaccgcgucagcguguccgacgacgugggcauggacgcggacagcgccucccagcggcuggucaucagcgcccccgacucccaggugcgcuucagcaacauccgcaccaacgacguggccaagacgccccagaugcacggcaccgagauggccaacuccccgcagccgccgccccucagcccgcaccccugcgacgucguggacgagggggugaccaagacccccuccacgccccagagccagcacuucuaccagaugccgacccccgacccccugguccccuccaagccgauggaggaccggaucgacagccugagccaguccuucccgccccaguaccaggaggcgguggagcccaccguguacgucggcaccgccgugaaccucgaggaggacgaggccaacaucgccuggaaguacuacaaguucccgaagaagaaggacguggaguuccugccgccccagcugcccagcgacaaguucaaggacgacccggucgggcccuucggccaggaguccgugaccagcgugaccgagcucaugguccagugcaagaagccccugaagguguccgacgagcuggugcagcaguaccagaucaagaaccagugccucagcgcgaucgccuccgacgccgagcaggagcccaagaucgacccguacgccuucgucgagggggacgaggaguuccuguuccccgacaagaaggaccgccagaacagcgagcgggaggccggcaagaagcacaagguggaggacggcaccuccagcgugaccguccugucccacgaggaggacgcgaugagccuguucucccccagcaucaagcaggacgccccgcgccccaccucccacgcccggccgcccagcaccucccucaucuacgacagcgaccuggccguguccuacacggaccuggacaaccucuucaacagcgacgaggacgagcugaccccggggagcaagaaguccgccaacggcagcgacgacaaggcguccugcaaggagagcaagaccgggaaccuggacccccucuccugcaucagcaccgccgaccugcacaagauguaccccacgccgcccucccuggagcagcacaucaugggcuucagccccaugaacaugaacaacaaggaguacggguccauggacacgacccccggcggcaccgugcucgaggggaacagcuccagcaucggcgcccaguucaagaucgaggucgacgagggguucugcucccccaagcccagcgagaucaaggacuucuccuacguguacaagcccgagaacugccagauccuggugggcugcagcauguucgcgccccugaagacccuccccucccaguaccugccgcccaucaagcugcccgaggagugcaucuaccgccagagcuggacggucggcaagcucgagcugcuguccagcgggcccagcaugccguucaucaaggagggcgacggguccaacauggaccaggaguacggcaccgccuacacgccccagacccacacgagcuucgggaugccgcccuccagcgcgccgcccuccaacagcggcgccggcauccuccccucccccagcaccccgcgguuccccacgccccggaccccgcggacgccccgcacgccccgcggggccggcgggcccgccuccgcgcagggcagcgugaaguacgagaacuccgaccuguacagcccggccuccacccccuccacgugccgcccccugaacuccguggagcccgccaccgucccgagcauccccgaggcccacucccucuacgugaaccugauccugagcgaguccgugaugaaccucuucaaggacugcaacuucgacagcugcugcaucugcgucugcaacaugaacaucaagggggccgacgugggcguguacauccccgaccccacccaggaggcgcaguaccggugcacgugcggcuucagcgccgucaugaaccgcaaguucgggaacaacuccggccuguuccuggaggacgagcucgacaucaucgggcggaacaccgacugcggcaaggaggccgagaagcgcuucgaggcccugcgggccacgagcgcggagcacgugaacgggggccugaaggaguccgagaagcucagcgacgaccugauccugcuccugcaggaccagugcaccaaccuguucuccccguucggcgccgccgaccaggaccccuuccccaagagcggggugaucuccaacuggguccgcguggaggagcgggacugcugcaacgacugcuaccucgcccuggagcacggccgccaguucauggacaacaugagcgggggcaagguggacgaggcccuggucaaguccagcugccuccaccccugguccaagcgcaacgacgugagcaugcagugcucccaggacauccugcggaugcugcucagccugcagccgguccugcaggacgcgauccagaagaagcgcaccgugcggcccuggggcgugcagggcccccucaccuggcagcaguuccacaagauggccggccgcggguccuacggcacggacgagagccccgagccgcugcccauccccaccuuccugcucggguacgacuacgacuaccugguccugucccccuucgcccucccguacugggagcggcugaugcuggagcccuacggcagccagcgcgacaucgccuacguggugcucugccccgagaacgaggcgcugcugaacggcgccaaguccuucuuccgggaccucaccgccaucuacgagagcugccgccuggggcagcaccggcccgucagccgccugcucaccgacggcaucaugcgggugggguccacggccagcaagaagcuguccgagaagcugguggccgagugguucagccaggcggccgacggcaacaacgaggccuucuccaagcucaagcuguacgcccaggucugccgcuacgaccuggggccguaccucgccagccugccccuggacuccagccuccugucccagcccaaccugguggcgccgaccagccagucccucaucacgccgccccagaugaccaacacgggcaacgccaacacccccagcgccacccuggccuccgccgcgagcuccaccaugacggugaccagcggcgucgccaucuccaccagcguggccaccgccaacuccacccugacgaccgccagcaccagcuccagcuccagcuccaaccucaacagcgggguguccagcaacaagcugccguccuucccgcccuucggcagcaugaacuccaacgcggccgggagcauguccacccaggccaacacgguccagagcggccagcugggcgggcagcagaccuccgcccuccagaccgcggggaucagcggggaguccagcagccugcccacccagccccaccccgacguguccgagagcacgauggaccgggacaaggugggcauccccaccgacggggacucccacgccgucaccuacccgcccgccaucgugguguacaucaucgaccccuucaccuacgagaacacggacgagagcaccaacuccagcuccgucuggacccugggccuccugcgcugcuuccuggagauggugcagacccugccgccccacaucaagagcacgguguccguccagaucauccccugccaguaccugcugcagcccgugaagcacgaggaccgggagaucuacccccagcaccucaagagccuggccuucuccgccuucacccagugccgccggccccugccgaccagcaccaacgugaagacgcucaccggguucggccccggccuggcgauggagaccgcccugcgcucccccgaccggcccgagugcauccgccucuacgccccgcccuucauccuggcccccgucaaggacaagcagaccgagcugggggagacguucggcgaggccgggcagaaguacaacgugcuguucgugggcuacugccucagccacgaccagcgguggauccuggcguccugcaccgaccuguacggcgagcuccuggagaccugcaucaucaacaucgacgucccgaaccgcgcccgccggaagaaguccuccgcccgcaaguucgggcugcagaagcucugggaguggugccugggccuggugcagaugagcucccuccccuggcggguggucaucgggcgccugggccggaucgggcacggcgagcugaaggacuggagcugccuccugagccgccggaaccugcagucccucagcaagcgccugaaggacaugugccggaugugcggcaucuccgccgccgacagccccuccauccugagcgcgugccucguggccauggagccccagggguccuucgugaucaugccggacagcgucuccaccggcagcguguucgggcgcuccacgacccugaacaugcagaccagccagcugaacacgccccaggacacguccugcacccacauccucguguuccccaccagcgccuccguccagguggccagcgcgaccuacacgaccgagaaccuggaccuggccuucaaccccaacaacgacggcgccgacgggaugggcaucuucgaccuccuggacaccggcgacgaccuggacccggacaucaucaacauccuccccgccucccccaccgggagccccgugcacuccccgggcagccacuacccccacgggggcgacgccgggaagggccagagcaccgaccggcugcuguccacggagccccacgaggagguccccaacauccuccagcagccgcuggcgcugggcuacuucgugagcaccgccaaggccgggccccuccccgacugguucugguccgccugcccccaggcccaguaccagugcccgcuguuccugaaggcgagccuccaccuccacgugcccuccguccagagcgacgagcugcuccacuccaagcacagccacccccuggacuccaaccagaccagcgacgugcugcgcuucgugcucgagcaguacaacgcccuguccuggcugaccugcgaccccgccacgcaggaccggcgcagcugccucccgauccacuucgucgugcugaaccagcuguacaacuucaucaugaacaugcucuga

SEQ ID NO: 32819 - RNA, 6633 nt, Artificial Sequence
  derived and/or modified sequence opt1 from MED13L__Homo_sapiens__NP_056150
augaccgccgccgccaacuggguggccaacggcgccagccuggaggacugccacagcaaccucuucagccuggccgagcugaccgggaucaaguggcgccgguacaacuucggcgggcacggcgacugcgggcccaucaucuccgcccccgcgcaggacgaccccauccuccugagcuucauccgcugccugcaggccaaccuccugugcguguggcggcgcgacgugaagcccgacugcaaggagcuguggaucuucugguggggcgacgagcccaaccucgugggcgucauccaccacgagcuccaggugguggaggaggggcugugggagaacggccucuccuacgagugccggacccugcuguucaaggccauccacaaccuccuggagcgcugccugauggacaagaacuucguccggaucgggaagugguucgugcgccccuacgagaaggacgagaagcccgugaacaagagcgagcaccucuccugcgccuucaccuucuuccugcacggcgagagcaacgucugcaccuccguggagaucgcgcagcaccagcccaucuaccugaucaacgaggagcacauccacauggcccagagcucccccgcccccuuccaggugcucgucagccccuacgggcugaacggcacccugaccggccaggccuacaagauguccgaccccgccacccggaagcucaucgaggaguggcaguacuucuaccccauggugcugaagaagaaggaggagagcaaggaggaggacgagcugggguacgacgacgacuuccccguggcggucgaggugaucgugggcgggguccgcaugguguaccccuccgccuucgugcucaucagccagaacgacauccccgucccccaguccguggccagcgccggcggccacaucgccguggggcagcagggccugggguccgucaaggaccccagcaacugcggcaugccccugacgccgcccaccagccccgagcaggcgauccucggggaguccggcggcaugcagagcgccgccucccaccuggugagccaggacgggggcaugaucaccaugcacucccccaagcggagcgggaagaucccgcccaagcugcacaaccacaugguccaccgcguguggaaggagugcauccucaaccggacccaguccaagcgcagccagauguccacccccacccuggaggaggagcccgccagcaaccccgccaccugggacuucguggaccccacccagcgggucuccugcagcugcucccgccacaagcugcucaagcggugcgcggugggccccaaccggccgcccaccgugagccagcccggguucuccgccggccccagcuccagcuccagccugccgccgcccgccagcuccaagcacaagaccgccgagcggcaggagaagggcgacaagcugcagaagcgcccccucauccccuuccaccaccggcccagcgucgccgaggagcugugcauggagcaggacacgcccgggcagaagcugggccucgcggggaucgacuccagccuggagguguccagcucccgcaaguacgacaagcagauggccgugcccagccgcaacaccuccaagcagaugaaccugaaccccauggacagcccccacucccccaucagcccccugccgcccacccugagcccccagccccggggccaggagaccgagucccuggacccgcccuccguccccgugaaccccgcccucuacgggaacggccuggagcugcagcagcugagcacgcucgacgaccgcaccgugcuggucggccagcggcugccccucauggccgagguguccgagaccgcgcuguacugcgggauccgccccagcaaccccgagagcuccgagaagugguggcacagcuaccggcugccgcccuccgacgacgccgaguuccgcccgcccgagcuccagggcgagcggugcgacgccaagauggaggugaacagcgaguccaccgcccugcagcgccugcucgcccagcccaacaagcgguucaagaucuggcaggacaagcagccccagcugcagccgcugcacuuccucgacccccugccccugagccagcagcccggggacucccucggcgaggucaacgacccguacacguucgaggacggcgacaucaaguacaucuucaccgcgaacaagaagugcaagcaggggaccgagaaggacagccugaagaagaacaaguccgaggacggcuucgggaccaaggacgugacgacccccggccacagcacccccgugcccgacgggaagaacgccauguccaucuucagcuccgccaccaagacggacguccgccaggacaacgccgccggccgggcgggcagcuccagccugacccaggugaccgaccucgccccgucccugcacgaccuggacaacaucuucgacaacagcgacgacgacgagcucggggccgugucccccgcccugcgcagcagcaagaugcccgccgucggcaccgaggaccggccccuggggaaggacggccgcgcggccgugccguacccgcccacgguggccgaccuccagcggauguuccccaccccgcccucccuggagcagcaccccgccuucagccccgucaugaacuacaaggacgggaucuccagcgagaccgugaccgcgcugggcaugauggaguccccgauggugagcauggucuccacccagcucacggaguucaagauggagguggaggacggccuggggagccccaagcccgaggagaucaaggacuucuccuacgugcacaagguccccagcuuccagccguucgugggcuccagcauguucgcgccccugaagaugcuccccucccacugccugcugccgcucaagauccccgacgccugccuguuccgccccagcugggccaucccgcccaagaucgagcagcugcccaugccgcccgccgcgaccuucauccgggacggguacaacaacgugccguccgucggcagccucgccgaccccgacuaccugaacacgccccagaugaacacccccgugacgcugaacuccgccgccccggccagcaacuccggggcgggcgugcuccccagccccgccacgccccgcuucagcgucccgacgccccgcacgccccgcacgccccgcaccccgcggggcgggggcaccgccuccgggcagggcagcgugaaguacgacuccaccgaccaggggagccccgccuccacccccagcaccacccgcccccugaacuccguggagccggccaccaugcagcccauccccgaggcgcacagccuguacgucacgcucauccuguccgacagcgugaugaacaucuucaaggaccggaacuucgacuccugcugcaucugcgccugcaacaugaacaucaagggcgccgacgugggccuguacauccccgacagcuccaacgaggaccaguaccgcugcacgugcggguucagcgccaucaugaaccggaagcucggcuacaacuccgggcuguuccuggaggacgagcucgacaucuucggcaagaacagcgacaucggccaggcggccgagcgccggcugaugaugugccaguccaccuuccugccgcaggucgaggggaccaagaagccccaggagcccccgaucagccuccugcugcuccugcagaaccagcacacgcagcccuucgccucccugaacuuccucgacuacaucagcagcaacaaccgccagacccugcccugcguguccuggagcuacgaccgggugcaggccgacaacaacgacuacuggaccgagugcuucaacgcccuggagcagggccgccaguacgucgacaaccccaccgggggcaagguggacgaggcgcucgugcgguccgccacgguccacagcuggccgcacuccaacgugcuggacaucagcaugcuguccagccaggacgugguccgcaugcuccugucccugcagcccuuccuccaggacgccauccagaagaagcggaccgggcgcaccugggagaacauccagcacgugcagggcccccugaccuggcagcaguuccacaagauggccggccgggggacguacggcagcgaggagucccccgagccgcugcccauccccacccuccuggucggguacgacaaggacuuccugaccaucagccccuucucccucccguucugggagcgccugcugcucgaccccuacggcgggcaccgggacguggccuacaucguggucugccccgagaacgaggcgcugcuggagggcgccaagaccuucuuccgcgaccucagcgccguguacgagaugugccggcugggccagcacaagcccaucugcaaggugcugcgcgacgggaucaugcgggucggcaagacgguggcccagaagcucaccgacgagcugguguccgagugguucaaccagccguggagcggggaggagaacgacaaccacucccgccugaagcucuacgcccaggucugccgccaccaccuggcgcccuaccuggccacccuccagcuggacagcucccugcucaucccgcccaaguaccagaccccgcccgccgccgcccagggccaggcgacgcccgggaacgccggcccccuggccccgaacggcagcgccgcgccgcccgccgggagcgccuucaacccgaccuccaacagcuccagcaccaaccccgccgccuccagcuccgcgagcggcuccagcgugccgcccguguccagcuccgccagcgccccggggaucucccagaucagcaccaccuccagcuccggcuucagcggcagcgucgggggccagaaccccuccaccgggggcaucagcgccgaccggacccaggggaacaucggcugcggcggggacaccgaccccggccaguccagcucccagcccagccaggacgggcaggaguccgugaccgagcgcgagcggaucggcaucccgacggagcccgacagcgccgacucccacgcgcacccgcccgccguggucaucuacaugguggacccguucaccuacgccgccgaggaggacagcaccuccgggaacuucuggcugcucagccugaugcgcugcuacaccgagaugcuggacaaccugcccgagcacaugcggaacuccuucauccuccagaucgugcccugccaguacaugcugcagacgaugaaggacgagcaggucuucuacauccaguaccucaagagcauggccuucuccguguacugccagugccgccggccccucccgacccagauccacaucaagagccugaccggcuucggccccgcggccuccaucgagaugacccugaagaaccccgagcgccccagcccgauccagcucuacuccccgcccuucauccuggcccccaucaaggacaagcagacggagcugggggagaccuucggcgaggccucccagaaguacaacguccuguucgucggguacugccugagccacgaccagcgguggcugcucgcguccugcaccgaccugcacggcgagcugcucgagaccugcguggugaacaucgcccugccgaaccgcagccggcgcuccaaggucagcgcccggaagaucgggcugcagaagcucugggaguggugcaucggcaucgugcagaugacgucccugcccuggcgcguggucaucggccggcuggggcgccucggccacggggagcugaaggacuggagcauccugcucggcgagugcucccugcagaccaucagcaagaagcugaaggacgugugccggaugugcgggaucuccgccgccgacagccccuccauccucagcgcgugccugguggccauggagccccagggcuccuucgucgugaugccggacgccgugaccaugggcagcgucuucgggcgcuccaccgcccugaacaugcagagcucccagcucaacacgccccaggacgccagcugcacccacauccugguguuccccaccagcuccaccauccagguggcgccggccaacuaccccaacgaggacggcuucagccccaacaacgacgacauguucgucgaccugcccuucccggacgacauggacaacgacaucgggauccucaugacgggcaaccugcacuccagccccaacuccagccccgugcccuccccgggcagccccuccgggaucggcguggggagccacuuccagcacucccggagccagggcgagcgccugcucucccgcgaggcccccgaggagcugaagcagcagccccuggcccucggguacuucgucagcaccgccaaggcggagaaccugccgcagugguucugguccagcugcccccaggcccagaaccagugcccccuguuccucaaggccucccugcaccaccacaucagcguggcccagaccgacgagcugcuccccgcgcggaacucccagcgcgugccgcacccccuggacagcaagaccacgagcgacguccugcgguucgugcucgagcaguacaacgcccuguccuggcugaccugcaaccccgccacccaggaccgcaccagcugccuccccgugcacuucgucgugcugacgcagcuguacaacgccaucaugaacauccucuga

SEQ ID NO: 32820 - RNA, 4365 nt, Artificial Sequence
  derived and/or modified sequence opt1 from MED14__Homo_sapiens__NP_004220
auggcccccgugcagcuggagaaccaccagcucgucccgcccggcgggggcgggggcgggagcggcggcccccccuccgccccggcgcccccccccccgggggccgccguggccgccgcggccgccgccgcggccagccccggcuaccgccuguccacccugaucgaguuccuccugcaccgggccuacagcgagcugauggugcucaccgaccugcugccccgcaaguccgacgucgagcggaagaucgagaucgugcaguucgccagccgcacgcggcagcucuucgugcgccugcuggcccucgucaagugggcgaacaacgccgggaagguggagaagugcgccaugaucuccagcuuccuggaccagcaggccauccuguucguggacaccgccgaccggcucgcgucccuggcccgcgacgcccugguccacgcccggcuccccagcuucgccaucccguacgcgaucgacgugcugaccaccggcuccuacccccgccugcccacgugcauccgggacaagaucauccccccggaccccaucaccaagaucgagaagcaggccacccuccaccagcugaaccagauccugcgccaccggcucgugaccacggaccugcccccccagcuggccaaccucaccgucgccaacgggcgcgugaaguuccggguggagggcgaguucgaggccacccugaccgucaugggcgacgacccggacgugcccuggcgccugcucaagcuggagauccugguggaggacaaggagacgggggacggccgggcgcucguccacagcaugcagaucuccuucauccaccagcuggugcagagccgccuguucgccgacgagaagccccuccaggacauguacaacugccugcacuccuucugccugagccuccagcuggaggugcugcacucccagacccucaugcugauccgggagcgcuggggggaccugguccagguggagcgguaccacgccggcaagugccucagccuguccguguggaaccagcagguccugggccgcaagaccgggaccgccagcgugcacaaggucacgaucaagaucgacgagaacgacgugagcaagccccuccagaucuuccacgacccgccccugcccgcguccgacagcaagcugguggagcgcgccaugaagaucgaccaccuguccaucgagaagcuccugaucgacagcguccacgcccgggcccaccagaagcugcaggagcucaaggccauccugcgcggcuucaacgcgaacgagaacuccagcaucgagaccgcccugcccgcccucguggugccgauccuggagcccugcgggaacuccgagugccugcacaucuucgucgaccuccacagcggcauguuccagcugaugcuguacgggcucgaccaggccacccuggacgacauggagaaguccgugaacgacgacaugaagcggaucauccccuggauccagcagcugaaguucuggcucggccagcagcgcugcaagcagagcaucaagcaccugccgaccaucuccagcgagacgcugcagcucuccaacuacagcacccaccccaucggcaaccuguccaagaacaagcuguucaucaagcucacccggcugccccaguacuacaucguggucgagaugcuggaggugcccaacaagccgacccagcucagcuacaaguacuacuucauguccgugaacgccgcggaccgcgaggacagccccgccauggcccugcugcuccagcaguucaaggagaacauccaggaccuggucuuccggacgaagaccgggaagcagacccgcaccaacgccaagcggaagcuguccgacgaccccugccccguggagagcaagaagacgaagcgcgccggcgagaugugcgcguucaacaaggugcucgcccacuucgucgccaugugcgacaccaacaugccguucguggggcugcggcuggagcucagcaaccuggagaucccccaccagggcgugcaggucgagggggacggcuucucccacgccauccgccugcucaagaucccccccugcaagggcaucaccgaggagacccagaaggcgcuggaccggagccugcucgacugcacguuccgccugcaggggcggaacaaccgcaccuggguggccgagcugguguucgccaacugcccgcucaacggcaccuccacccgggagcaggggcccagccgccacgucuaccugacguacgagaaccugcucuccgagcccgugggcgggcggaagguggucgagauguuccugaacgacuggaacagcaucgcccgccuguacgagugcgugcucgaguucgcccgcucccugcccgacaucccggcgcaccugaacaucuucagcgaggugcgggucuacaacuaccgcaagcucauccugugcuacggcaccaccaagggcuccagcaucuccauccaguggaacagcauccaccagaaguuccacaucucccuggggaccgugggccccaacagcgggugcuccaacugccacaacaccauccuccaccagcugcaggagauguucaacaagacgcccaacgugguccagcugcuccaggugcuguucgacacccaggccccccugaacgccaucaacaagcucccgaccgugcccaugcugggccugacccagcggacgaacaccgccuaccagugcuucagcauccucccccaguccagcacccacauccgccuggccuuccggaacauguacugcaucgacaucuacugccgcagccggggcgucguggcgauccgcgacggggccuacucccuguucgacaacagcaagcucguggagggcuucuaccccgccccggggcugaagaccuuccugaacauguucgucgacuccaaccaggacgcccggcgccggagcgugaacgaggacgacaacccccccuccccgaucggcggggacaugauggacagccucaucucccagcugcagccccccccccagcagcagccguuccccaagcagcccggcacgagcggcgccuacccccugaccuccccgcccaccagcuaccacuccaccgugaaccagagccccuccaugaugcacacgcagagccccgggaaccuccacgcggccuccagcccguccggcgcccugcgcgcccccagccccgcguccuucguccccaccccgccccccagcagccacgggaucuccaucggccccggggccagcuucgccuccccgcacggcacccuggaccccagcucccccuacaccauggugagccccuccggccgggccgggaacuggccgggcagcccccagguguccgggcccagccccgccgcgcgcaugccgggcaugucccccgccaaccccagccuccacuccccgguccccgacgccagccacuccccccgggccgggacgagcucccagaccaugcccaccaacaugccgcccccccgcaagcugccccagcggagcugggccgcguccaucccgaccauccugacgcacagcgcccucaacauccugcugcuccccagccccacccccggccuggugccgggccuggccggguccuaccucugcagcccccuggagcgcuuccugggcuccgugaucaugcggcgccaccuccagcggaucauccagcaggagacccugcagcugaucaacagcaacgagcccggggucaucauguucaagaccgacgcccucaagugccgcguggcccugucccccaagacgaaccagacccugcagcucaaggugaccccggagaacgcgggccaguggaagcccgacgagcugcagguccuggagaaguucuucgagacccgcguggccgggccccccuucaaggccaacacgcugaucgccuucaccaagcuccugggcgccccgacccacauccugcgggacugcgugcacaucaugaagcucgagcuguuccccgaccaggcgacccagcugaaguggaacguccaguucugccucacgaucccccccagcgccccgcccaucgccccccccggcaccccggccgugguccugaaguccaagaugcuguucuuccuccagcugacccagaagaccagcgugcccccccaggagccgguguccaucaucguccccaucaucuacgacauggcgagcgggacgacccagcaggccgacaucccccgccagcagaacuccagcguggccgcccccaugaugguguccaacauccugaagcgguucgccgagaugaacccgccccgccagggcgagugcaccaucuucgcggccguccgggaccucauggccaaccugacccugccccccgggggccgcccguga

SEQ ID NO: 32821 - RNA, 2367 nt, Artificial Sequence
  derived and/or modified sequence opt1 from MED15__Homo_sapiens__NP_001003891
auggacgugagcggccaggagaccgacuggcgcuccaccgccuuccggcagaagcuggucagccagaucgaggacgccaugcgcaaggcggggguggcccacuccaagagcuccaaggacauggagagccacguguuccucaaggccaagacgcgggacgaguaccugucccuggucgcccgccucaucauccacuuccgggacauccacaacaagaagagccaggccuccgugagcgaccccaugaacgcgcugcagucccugaccggcgggccggccgccggcgccgcggggaucggcaugcccccccgcggccccgggcagagccucggcgggaugggcucccugggggccaugggccagccgaugagccuguccggccagcccccccccgggaccagcggcauggccccgcacuccauggccguggucagcaccgccacgccccagacccagcuccagcugcagcagguggcgcugcagcagcagcagcagcagcagcaguuccagcagcagcagcaggccgcccuccagcagcagcagcagcagcagcagcagcagcaguuccaggcccagcaguccgccaugcagcagcaguuccaggcggugguccagcagcagcagcagcugcagcagcagcagcagcagcagcagcaccugaucaagcuccaccaccagaaccagcagcagauccagcagcagcagcagcagcugcagcggaucgcccagcugcagcuccagcagcagcagcagcagcagcagcagcagcagcagcagcagcagcaggcccugcaggcccagccccccauccagcagccgcccaugcagcagccccagcccccgcccagccaggcccugccccagcagcuccagcagaugcaccacacccagcaccaccagcccccgccccagccccagcagcccccgguggcgcagaaccagcccagccagcugcccccccagucccagacccagccgcuggugagccaggcccaggcccuccccgggcagaugcuguacacgcagcccccgcugaaguucguccgcgcccccaugguggugcagcagccccccguccagccgcaggugcagcagcagcagaccgccgugcagaccgcgcaggccgcccagauggucgcccccggcgugcagaugaucaccgaggcgcucgcccagggcgggaugcacauccgggcccgcuucccccccacgaccgccguguccgccaucccgagcuccagcaucccccugggccggcagcccauggcgcaggucucccagagcucccugcccaugcucagcuccccgagccccgggcagcaggugcagaccccccaguccaugcccccgcccccccagcccagcccgcagcccggccagcccuccagccagcccaacuccaacgugagcuccgggccggcccccagccccagcuccuuccugccgagccccuccccccagcccagccaguccccggucaccgcccgcacgccccagaacuucagcgugcccucccccggcccgcugaacacccccgucaaccccagcuccgugaugagccccgccggcuccagccaggccgaggagcagcaguaccucgacaagcugaagcagcuguccaaguacaucgagccgcuccggcgcaugaucaacaagaucgacaagaacgaggaccggaagaaggaccugagcaagaugaagucccugcucgacauccugaccgaccccagcaagcgcugcccccugaagacccuccagaagugcgagaucgcgcuggagaagcugaagaacgacauggccgugcccacgccgcccccccccccggucccccccaccaagcagcaguaccucugccagccccugcuggacgccgugcucgccaacauccgguccccgguguucaaccacagccuguaccgcaccuucguccccgccaugaccgcgauccacgggccccccaucacggccccgguggugugcacccggaagcgccggcuggaggacgacgagcgccagagcauccccuccguccugcagggcgagguggcccgccucgaccccaaguuccuggugaaccuggacccgagccacugcuccaacaacgggaccguccaccucaucugcaagcuggacgacaaggaccugcccagcgugcccccccucgagcuguccgugccggccgacuaccccgcgcagagcccccuguggaucgaccggcaguggcaguacgacgccaaccccuuccuccaguccguccaccgcugcaugaccagccggcugcugcagcucccggacaagcacuccgugacggcccugcugaacaccugggcccagagcgugcaccaggccugccucuccgcggccuga

SEQ ID NO: 32822 - RNA, 2634 nt, Artificial Sequence
  derived and/or modified sequence opt1 from MED16__Homo_sapiens__NP_005472
augugcgaccugcgccggcccgccgccggcgggaugauggaccuggcguacgugugcgagugggagaaguggagcaaguccacccacugcccgagcgucccccuggccugcgccugguccugccgcaaccugaucgccuucaccauggaccuccggagcgacgaccaggaccugacccgcaugauccacauccuggacaccgagcaccccugggaccuccacuccauccccagcgagcaccacgaggccaucacgugccuggagugggaccaguccggcagccggcugcucuccgcggacgccgacgggcagaucaagugcuggagcauggccgaccaccuggccaacuccugggagagcuccgugggcagccugguggagggggacccgaucgucgcgcucuccuggcugcacaacggcgugaagcuggcccuccacguggagaaguccggcgccagcagcuucggggagaaguucucccgcgucaaguucagccccagccugacccuguucggcgggaagcccauggagggcuggaucgccgugacgguguccgggcucgucaccgugagccugcugaagcccuccggccaggugcucaccagcaccgagucccugugccggcugcgcggccgggucgcccucgcggacaucgccuucaccgggggcgggaacaucgugguggccaccgccgacggcagcuccgccagcccgguccaguucuacaaggugugcguguccgucgugagcgagaagugccgcaucgacaccgagauccugcccucccuguucaugcggugcaccacggaccucaaccgcaaggacaaguuccccgcgaucacccaccugaaguuccuggcccgggacaugagcgagcagguccuccugugcgccuccagccagaccuccagcaucguggagugcuggucccugcgcaaggagggccuccccgugaacaacaucuuccagcagaucagcccgguggucggggacaagcagcccaccauccugaaguggcggauccuguccgccacgaacgaccucgaccgcgugagcgccgucgcgcugcccaagcugcccaucagccucaccaacaccgaccugaagguggccuccgacacccaguucuacccgggccuggggcucgcccuggccuuccacgacggcagcgugcacaucguccaccggcugucccuccagacgauggccguguucuacagcuccgcggcgccccgccccguggacgagcccgccaugaagcggccgcgcaccgccgggcccgccguccaccugaaggccaugcagcugagcuggaccucccucgcccuggugggcaucgacagccacggcaagcuguccgugcugcggcucagccccuccauggggcacccccuggaggucggccuggcccuccgccaccuccuguuccugcuggaguacugcauggugaccggguacgacuggugggacauccugcuccacgugcagccgagcaugguccagucccugguggagaagcugcacgaggaguacacgcgccagaccgccgcgcuccagcagguccugagcacccggauccuggccaugaaggccucccucugcaagcugagccccugcaccgugacgcgcgugugcgacuaccacaccaagcuguuccucaucgccaucuccagcacccucaagagccugcugcggccccacuuccugaacacccccgacaaguccccgggcgaccgccugacggagaucugcaccaagaucaccgacguggacaucgacaaggucaugaucaaccucaagaccgaggaguucgugcuggacaugaacacgcugcaggcccuccagcagcugcugcagugggugggggacuucguccucuaccugcuggcgagccuccccaaccagggcucccugcugcggcccggccacagcuuccuccgcgacgggaccucccugggcaugcugcgggagcucaugguggugauccgcaucugggggcugcugaagccgagcugccuccccgucuacaccgccaccuccgacacccaggacagcaugucccugcuguuccggcuccugacgaagcuguggaucugcugccgcgacgagggccccgccagcgagcccgacgaggcccucguggacgagugcugccugcugccgucccagcuccugauccccagccuggacuggcuccccgccuccgacgggcuggugagccggcugcagcccaagcagccgcuccgccugcaguucggccgggcgcccacccugcccggcuccgccgccacccuccagcuggacgggcuggcccgcgcgcccggccagccgaagaucgaccaccuccggcgccugcaccugggggccugccccaccgaggagugcaaggccugcacgcggugcggcugcgucaccaugcucaagagccccaaccgcaccaccgccgugaagcagugggagcagcgguggaucaagaacugccuggccguggagggccgcgggcccgacgcgugcgucacgucccgcgccagcgaggaggccccggccuucgugcagcugggcccccaguccacccaccacagcccccggacgccccgcagccucgaccaccuccacccggaggaccggcccuga

SEQ ID NO: 32823 - RNA, 1956 nt, Artificial Sequence
  derived and/or modified sequence opt1 from MED17__Homo_sapiens__NP_004259
augagcggcgugcgcgccguccggaucuccaucgagagcgccugcgagaagcagguccacgagguggggcuggacggcaccgagaccuaccugcccccgcuguccaugagccagaaccuggcgcgccucgcccagcggaucgacuucucccaggggagcggcuccgaggaggaggaggccgccgggacggagggcgacgcccaggaguggcccggcgcggggagcuccgccgaccaggacgacgaggagggcguggugaaguuccagcccagccuguggcccugggacuccgugcgcaacaaccugcggagcgcccucaccgagaugugcguccuguacgacgugcuguccaucgugcgcgacaagaaguucaugacccucgacccggucagccaggacgcccugccgcccaagcagaacccccagacccugcagcucaucuccaagaagaagucccuggcgggggccgcccagauccugcucaagggcgccgagcggcugaccaagagcgugacggagaaccaggagaacaagcugcagcgcgacuucaacagcgagcuccugcggcugcgccagcacuggaagcuccggaaggugggggacaagauccugggcgaccuguccuaccgcagcgccggcagccucuucccccaccacgggaccuucgaggucaucaagaacaccgaccuggaccuggacaagaagauccccgaggacuacugcccccucgacgugcagauccccuccgaccuggagggcagcgcguacaucaagguguccauccagaagcaggccccggacaucggggaccugggcacggucaaccucuucaagcggccccugcccaagagcaagcccggcuccccgcacuggcagaccaagcuggaggccgcccagaacgugcuccugugcaaggagaucuucgcccagcugagccgcgaggcggugcagaucaagucccaggucccccacaucguggugaagaaccagaucaucagccagcccuuccccucccuccagcugagcaucucccugugccacagcuccaacgacaagaagucccagaaguucgccaccgagaagcagugcccggaggaccaccucuacguccuggagcacaaccugcaccuccugauccgggaguuccacaagcagacccugagcagcaucaugaugccccaccccgccuccgcccccuucgggcacaagcgcaugcggcucagcggcccgcaggccuucgacaagaacgagaucaacucccugcagagcagcgaggggcugcucgagaagaucaucaagcaggcgaagcacaucuuccugcgcucccgggccgccgccacgaucgacagccuggccucccgcaucgaggacccccagauccaggcgcacuggagcaacaucaacgacguguacgaguccagcgugaagguccugaucaccucccagggcuacgagcagaucugcaagagcauccagcuccagcugaacaucgggguggagcagauccgggucgugcaccgcgacggccgcgugaucacccuguccuaccaggagcaggagcuccaggacuuccugcugagccagaugucccagcaccagguccacgccgugcagcagcucgccaaggugaugggcuggcagguccugagcuucuccaaccacguggggcugggccccaucgagagcaucgggaacgccuccgcgaucaccguggccagccccuccggcgacuacgccaucagcguccggaacgggccggagagcggcuccaagaucauggugcaguucccccgcaaccagugcaaggaccuccccaagagcgacgugcugcaggacaacaaguggucccaccuccggggcccguucaaggagguccaguggaacaagauggaggggcgcaacuucguguacaagauggagcuccugaugagcgcccugucccccugccuccuguga

SEQ ID NO: 32824 - RNA, 636 nt, Artificial Sequence
  derived and/or modified sequence opt1 from MED19__Homo_sapiens__NP_703151
augaagaucaccaacggccgccacggggacagcgccggcgccgaggggaccauggagaacuucacggcgcuguucggcgcccaggccgaccccccgcccccccccaccgcccucggguucggcccgggcaagcccccccccccgcccccccccccggccgggggcgggcccggcaccgcgccccccccgaccgccgccacggccccccccggggcggacaaguccggcgccggcugcgggcccuucuaccugaugcgggagcugccgggcagcaccgagcucaccggguccaccaaccugaucacgcacuacaaccuggagcaggccuacaacaaguucugcggcaagaaggugaaggagaagcucagcaacuuccugcccgaccugcccggcaugaucgaccuccccgggucccacgacaacagcucccugcgcagccugaucgagaagccgcccauccucuccagcuccuucaaccccaucaccggcaccaugcuggccggguuccggcugcacaccggcccccucccggagcagugccgccugaugcacauccagccccccaagaagaagaacaagcacaagcacaagcagagccggacgcaggacccggucccccccgggaagcccuccuga

SEQ ID NO: 32825 - RNA, 4746 nt, Artificial Sequence
  derived and/or modified sequence opt1 from MED1__Homo_sapiens__NP_004765
augaaggcccagggcgagaccgaggagagcgagaagcuguccaagaugagcucccuccuggagcgccugcacgccaaguucaaccagaaccggcccuggagcgagaccaucaagcucgugcgccaggucauggagaagcggguggugauguccagcgggggccaccagcaccuggucuccugccuggagacgcuccagaaggcgcugaaggugaccagccugccggccaugaccgaccgccucgaguccaucgcccggcagaacgggcugggcagccaccuguccgccagcgggaccgagugcuacaucacguccgacauguucuacguggagguccagcucgaccccgccggccagcugugcgacgugaagguggcgcaccacggcgagaaccccgucagcugccccgagcuggugcagcagcuccgcgagaagaacuucgacgaguucuccaagcaccugaaggggcuggugaaccucuacaaccugccgggcgacaacaagcugaagaccaagauguaccucgcccugcagagccuggagcaggaccucuccaagauggccaucauguacuggaaggccaccaacgcggggccccuggacaagauccugcacggcagcgucggguaccucacgccccgguccggcggccaccugaugaaccugaaguacuacgugagccccagcgaccuccuggacgacaagaccgccuccccgaucauccugcacgagaacaacgugagccgcucccucgggaugaacgccagcgucaccaucgagggcaccuccgccguguacaagcugcccaucgcgccccugaucauggggagccaccccguggacaacaaguggaccccguccuucagcuccaucacgagcgccaacuccgucgaccuccccgccugcuucuuccugaaguucccccagcccaucccggugagccgggccuucgugcagaagcugcagaacugcaccggcaucccccucuucgagacccagcccaccuacgcgccccuguacgagcugaucacgcaguucgagcucuccaaggacccggaccccaucccccugaaccacaacaugcgcuucuacgccgcccugcccggccagcagcacugcuacuuccucaacaaggacgccccgcugcccgacgggcggagccugcagggcacccucgucuccaagaucaccuuccagcaccccgggcgcgugccccugauccugaaccugauccggcaccagguggccuacaacacccucaucggcagcugcgucaagcgcacgauccugaaggaggacuccccggggcugcuccaguucgaggugugcccccugagcgagucccgguucagcgucagcuuccagcaccccgugaacgacucccuggugugcgucgugauggacgugcaggacagcacccacgucuccugcaagcucuacaagggccugagcgacgcccugaucugcaccgacgacuucaucgccaagguggugcagcgcugcauguccaucccggucaccaugcgggcgauccgccggaaggccgagacgauccaggccgacacccccgcccucagccugaucgccgagaccguggaggacauggugaagaagaaccugccgcccgcguccagccccggcuacgggaugaccacgggcaacaaccccauguccgggaccaccacccccacgaacaccuuccccggcgggccgaucaccacccucuucaacaugagcauguccaucaaggaccgccacgagagcgucggccacggcgaggacuucuccaaggugagccagaaccccauccugacgucccugcuccagaucaccgggaacggcgggagcaccaucggcuccagccccacgcccccgcaccacacgcccccgcccgugagcuccauggccgggaacaccaagaaccaccccaugcugaugaaccugcucaaggacaaccccgcccaggacuucagcacccuguacggcuccagcccccuggagcggcagaacuccagcuccggcagcccccgcauggagaucugcuccgggagcaacaagaccaagaagaagaaguccagccgccucccgcccgagaagcccaagcaccagaccgaggacgacuuccagcgggagcuguucuccauggacgucgacagccagaaccccaucuucgacgugaacaugaccgccgacacccuggacaccccgcacaucacccccgcgcccucccagugcagcacgccgcccaccaccuacccccagcccgugccgcacccccagcccuccauccagcgcaugguccggcucagcuccagcgacagcaucggccccgacgugaccgacauccuguccgacaucgccgaggaggccagcaagcugccguccacgagcgacgacugccccgccaucgggacgccccuccgcgacuccagcuccagcggccacucccagagcacccuguucgacuccgacguguuccagaccaacaacaacgagaaccccuacaccgacccggccgaccugaucgcggacgccgccggcagccccuccagcgacucccccaccaaccacuucuuccacgacggggucgacuucaaccccgaccuccugaacagccagucccagagcggcuucggggaggaguacuucgacgaguccagccagagcggcgacaacgacgacuucaagggguucgccucccaggcccugaacacccucggcgugccgaugcugggcggggacaacggcgagaccaaguucaaggggaacaaccaggcggacacgguggacuucagcaucaucuccgucgccggcaaggcccuggcccccgccgaccucauggagcaccacagcgggucccagggcccccugcugaccaccggcgaccucgggaaggagaagacccagaagcgggugaaggagggcaacgggacgagcaacuccacccugagcggccccgggcuggacuccaagccgggcaagcgcagccggacccccuccaacgacggcaagagcaaggacaagccgcccaagcgcaagaaggcggacaccgaggggaagucccccagccacuccagcuccaaccggcccuucacgccgcccaccagcaccggcggguccaagagccccggcagcgccgggcgcucccagaccccgcccggcguggccacgccgcccauccccaagaucaccauccagauccccaagggcaccgucaugguggggaagcccagcucccacagccaguacaccuccagcggcuccgugagcuccagcggguccaagagccaccacucccacagcuccagcuccagcuccagcgccagcacguccggcaagaugaaguccagcaagagcgagggcuccagcuccagcaagcucuccagcuccauguacagcucccaggggagcuccggcagcucccagagcaagaacuccagccagagcgggggcaagcccggguccagccccaucaccaagcacggccuguccagcggcuccagcuccaccaagaugaagccccaggggaagccgagcucccugaugaaccccagccucuccaagcccaacaucagccccucccacagccggccgcccggcggguccgacaagcuggcgagccccaugaagcccgucccgggcaccccgcccuccagcaaggccaagagccccaucuccagcggguccggcggcagccacauguccgggaccagcuccagcuccggcaugaaguccagcagcgggcugggcuccagcgggucccucagccagaagacgccgcccuccagcaacuccugcaccgccagcagcuccagcuucuccagcuccggcagcuccaugagcuccagccagaaccagcacggcuccagcaaggggaagucccccagccgcaacaagaagcccucccugaccgccgugaucgacaagcugaagcacggcguggucaccagcgggcccggcggcgaggacccccucgacgggcagaugggcguguccacgaacagcuccagccaccccaugagcuccaagcacaacaugagcgggggcgaguuccaggggaagcgggagaaguccgacaaggacaagagcaagguguccaccagcggcuccagcgucgacuccagcaagaagaccuccgagagcaagaacgugggcuccaccgggguggccaagaucaucaucagcaagcacgacggcgggucccccagcaucaaggcgaaggucacgcugcagaagccgggcgaguccagcggggagggccugcgcccccagauggccuccagcaagaacuacggcagcccccucaucuccgggagcaccccgaagcacgagcggggcucccccagccacuccaagagccccgccuacacgccccagaaccuggacuccgagagcgaguccgggagcuccaucgccgagaaguccuaccagaacagcccgagcuccgacgacggcauccgcccccugcccgaguacagcaccgagaagcacaagaagcacaagaaggagaagaagaaggugaaggacaaggaccgggaccgcgaccgggacaaggaccgcgacaagaagaagucccacagcaucaagcccgaguccuggagcaagagcccgaucuccagcgaccagucccucagcaugaccuccaacaccauccugagcgccgaccgccccucccggcugagccccgacuucaugaucggggaggaggacgacgaccucauggacguggcgcugaucggcaacuga

SEQ ID NO: 32826 - RNA, 603 nt, Artificial Sequence
  derived and/or modified sequence opt1 from MED22__Homo_sapiens__NP_598395
auggcccagcagcgcgcccugccccagagcaaggagacccugcugcaguccuacaacaagcggcugaaggacgacaucaagagcaucauggacaacuucaccgagaucaucaagacggcgaagaucgaggacgagacccaggugucccgcgccacccagggcgagcaggacaacuacgagaugcacguccgggccgccaacaucgugcgcgccggggagagccucaugaagcugguguccgaccugaagcaguuccucauccugaacgacuucccgagcgucaacgaggcgaucgaccagcggaaccagcagcugcgcacccuccaggaggagugcgaccggaagcugaucacgcugcgcgacgagaucuccaucgaccucuacgagcuggaggaggaguacuacagcuccagcuccagccugugcgaggccaacgaccucccccugugcgaggccuacggccggcuggaccucgacaccgacuccgccgacgggcugagcgcgccccugcucgccucccccgagccgagcgccggcccccuccagguggccgcccccgcgcacucccacgccgggggccccggcccgaccgagcacgccuga

SEQ ID NO: 32827 - RNA, 4095 nt, Artificial Sequence
  derived and/or modified sequence opt1 from MED23__Homo_sapiens__NP_001257451
auggagacccagcugcagagcaucuucgaggagguggucaagaccgaggugaucgaggaggccuuccccggcauguucauggacacgccggaggacgagaagaccaagcucaucuccugccugggggccuuccgccaguucuggggcgggcugagccaggagucccacgagcagugcauccaguggaucgugaaguucauccacggccagcacagccccaagcggaucuccuuccucuacgacugccuggcgauggccgucgagaccgggcugcucccgccccgccuggugugcgagagccugaucaacuccgacacccucgagugggagcggacgcagcugugggcccugaccuucaagcucgugcgcaagaucaucggcggcgucgacuacaagggggugcgggaccugcugaaggugauccucgagaagauccugaccauccccaacaccgucagcuccgccguggugcagcagcugcucgccgcgcgcgaggucaucgccuacauccuggagcggaacgccugccugcuccccgccuacuucgcggugacggagauccgcaagcuguaccccgagggcaagcugccccacuggcuccuggggaaccuggugagcgacuucgucgacaccuuccggccgaccgcccgcaucaacuccaucugcggccggugcagccuccugcccguggugaacaacuccggggccaucugcaacagcuggaagcuggaccccgccacccuccgcuucccccugaagggccugcucccguacgacaaggaccuguucgagccccagacggcccugcuccgguacguccuggagcagcccuacucccgcgacauggugugcaacaugcugggccucaacaagcagcacaagcagcggugccccgugcuggaggaccagcuggucgaccucgugguguacgcgauggagcgcagcgagaccgaggagaaguucgacgacgggggcaccucccagcugcuguggcagcaccucagcucccagcugaucuucuucguccuguuccaguucgccagcuucccgcacauggugcucagccugcaccagaagcuggccgggcggggccugaucaagggccgcgaccaccucauguggguccugcugcaguucaucuccgggagcauccagaagaacgcccucgccgacuuccugcccgugaugaagcuguucgaccuccuguaccccgagaaggaguacauccccgugccggacaucaacaagccccaguccacccacgcguucgccaugacgugcaucuggauccaccugaaccggaaggcccagaacgacaacagcaagcuccagauccccaucccccacucccugcgccugcaccacgaguuccuccagcagagccugcggaacaagucccugcagaugaacgacuacaagaucgcccuccugugcaacgccuacagcaccaacuccgagugcuucacccugccgaugggcgcgcucgucgagaccaucuacgggaacggcaucaugcgcaucccccugcccgggacgaacugcauggccagcggcuccaucacgccccugccgaugaaccuccuggacagccugaccgugcacgccaagaugucccucauccacagcaucgccacccgcgugaucaagcuggcccacgcgaaguccagcgucgcccuggcccccgcccucguggagaccuacucccggcugcugguguacauggagaucgagagccucggcaucaagggguucaucucccagcugcugcccaccgucuucaagagccacgcguggggcauccuccacacccugcuggagauguucagcuaccgcaugcaccacauccagccgcacuaccgggugcagcuccugucccaccuccacacccuggccgccguggcccagacgaaccagaaccagcugcaccugugcgucgagagcaccgcccuccgccugaucaccgcgcugggguccagcgaggugcagccccaguucacccgguuccucuccgaccccaagacggugcugagcgccgaguccgaggagcugaaccgcgcccucauccugacccuggcccgggccacccacgucaccgacuucuucacgggcagcgacuccauccaggggaccuggugcaaggacauccuccagaccaucaugagcuucacgccccacaacugggcgucccacacccugagcugcuucccgggcccccugcaggccuucuucaagcagaacaacgugccccaggagucccgcuucaaccucaagaagaacguggaggaggaguaccggaaguggaaguccauguccaacgagaacgacaucaucacccacuucagcaugcagggcagcccgccccuguuccugugccuccuguggaagaugcugcucgagaccgaccacaucaaccagaucggguaccgcguccuggagcggaucggcgcccgcgcccugguggcccacgugcggaccuucgcggacuuccucgucuacgaguucagcaccagcgccgggggccagcagcugaacaagugcaucgagauccugaacgacaugguguggaaguacaacaucgugacgcucgaccgccugauccugugccucgccaugcggucccacgaggggaacgaggcccaggucugcuacuucaucauccagcugcugcuccugaagcccaacgacuuccgcaaccgggugagcgacuucgugaaggagaacucccccgagcacuggcugcagaacgacuggcacaccaagcacaugaacuaccacaagaaguaccccgagaagcucuacuucgagggccuggcggagcaggucgacccgcccgugcagauccagagccccuaccugcccaucuacuucggcaacgugugccuccgcuuccugccggucuucgacaucgugauccaccgguuccuggagcuccugcccguguccaagagccuggagacccuccuggaccaccucgggggccuguacaaguuccacgaccgccccgucaccuaccuguacaacacgcugcacuacuacgagaugcaccuccgcgaccgggccuuccugaagcgcaagcuggugcacgccaucaucgggucccucaaggacaaccggccccagggcuggugccugagcgacaccuaccugaagugcgccaugaacgcccgcgaggagaacccgugggugcccgacgacaccuacuacugccggcugaucggccgccucgucgacaccauggcggggaagucccccggccccuucccgaacugcgacuggcgguucaacgaguuccccaaccccgccgcccacgcccugcacgugacgugcguggagcugauggcccucgcggucagcgggaaggaggugggcaacgcccugcugaacgugguccucaagucccagccgcuggugccccgcgagaacaucaccgccuggaugaacgccaucgggcugaucaucaccgcccuccccgagcccuacuggaucgugcugcacgaccggaucgucagcgugaucuccagcccgucccugaccagcgagacggagugggugggcuaccccuuccgccucuucgacuucaccgcgugccaccaguccuacagcgagauguccugcagcuacacccuggcccuggcccacgccgucuggcaccacagcuccaucggccagcucagccugauccccaaguuccugaccgaggugcuccugcccaucgugaagacggaguuccagcugcucuacgucuaccaccugguggggccguuccugcagcgguuccagcaggagcgcacccggugcaugaucgagaucggcgucgcguucuacgacaugcuccugaacguggaccagugcuccacccaccugaacuacauggaccccaucugcgacuuccucuaccacaugaaguacauguucaccggggacagcgugaaggagcaggucgagaagaucaucugcaaccugaagcccgcccugaagcuccgccugcgguucaucacgcacaucuccaagauggagcccgccgccgugccgccccaggccaugaacagcggcucccccgcgccccagagcaaccagguggacacccugaccuga

SEQ ID NO: 32828 - RNA, 2931 nt, Artificial Sequence
  derived and/or modified sequence opt1 from MED24__Homo_sapiens__NP_001072986
augaagguggucaaccugaagcaggccauccuccaggccuggaaggagcgguggagcgacuaccagugggcgaucaacaugaagaaguucuuccccaagggcgccaccugggacauccugaaccuggccgacgcccuccuggagcaggccaugaucgggccgucccccaacccccugauccucagcuaccugaaguacgcgaucuccagccaguucgacgacuucucccgggaccugugcgugcaggcccuccuggacaucauggacauguucugcgaccgccugagcugccacggcaaggccgaggagugcaucgggcucugccgggcccugcuguccgcgcuccacuggcugcugcgcugcaccgccgccagcgccgagcggcuccgcgagggccuggaggccgggacgcccgcggccggcgagaagcagcuggccaugugccuccagcggcuggagaagacccuguccagcaccaagaaccgcgcccuccugcacaucgccaagcuggaggaggcguccagcuggaccgccaucgagcacucccuccugaagcugggcgagauccucgccaaccugagcaacccgcagcugcggucccaggccgagcagugcgggacgcucauccgcagcauccccaccaugcuguccgugcacgccgagcagaugcacaagaccggcuuccccaccguccacgcggugauccugcucgaggggacgaugaaccugaccggcgagacccagagccugguggagcagcucaccauggucaagcggaugcagcacauccccacgccgcuguucgugcuggagaucuggaaggccugcuucguggggcucaucgagucccccgagggcaccgaggagcugaaguggaccgccuucaccuuccugaagaucccccagguccucgugaagcugaagaaguacagccacggcgacaaggacuucacggaggacgugaacugcgccuucgaguuccugcucaagcugacgccccugcuggacaaggccgaccagcgcugcaacugcgacugcaccaacuuccuccugcaggagugcgggaagcagggccugcucagcgaggcguccgucaacaaccugauggccaagcggaaggccgaccgcgagcacgccccgcagcagaaguccggggagaacgcgaacauccagcccaacauccagcugauccuccgggccgagcccaccgugaccaacauccugaagaccauggacgccgaccacagcaagagccccgagggccugcucggcgugcuggggcacaugcuguccggcaagagccucgaccugcugcucgccgccgcggccgccaccgggaagcugaaguccuucgcccgcaaguucaucaaccugaacgaguucaccacguacggcagcgaggaguccaccaagccggccagcguccgggcgcuccuguucgacaucuccuuccugaugcucugccacguggcccagaccuacgggagcgaggugauccuguccgagagccgcaccggcgccgagguccccuucuucgagacguggaugcagaccugcaugcccgaggagggcaagauccugaaccccgaccacccgugcuuccggcccgacuccaccaagguggagagccucguggcccugcugaacaacuccagcgagaugaagcucguccagaugaaguggcacgaggccugccuguccaucagcgcggccauccuggagauccucaacgccugggagaacggggugcuggccuucgagagcauccagaagaucaccgacaacaucaagggcaaggugugcucccuggcggucugcgccguggccuggcucgucgcccacgugcgcaugcuggggcuggacgagcgggagaagucccuccagaugauccgccagcuggccggcccccuguucagcgagaacacgcuccaguucuacaacgagcgcguggucaucaugaacagcauccuggagcggaugugcgcggacgugcugcagcagaccgccacccagaucaaguuccccuccaccgggguggacacgaugccguacuggaaccuccugccgcccaagcgccccaucaaggagguccugaccgacaucuucgccaaggugcucgagaagggcuggguggacagccgguccauccacaucuucgacacccugcugcacaugggcggggucuacugguucugcaacaaccucaucaaggagcugcugaaggagacccgcaaggagcacacccuccgggccguggagcugcuguacagcaucuucugccucgacaugcagcaggucacgcuggugcugcucggccacauccugcccgggcugcucaccgacuccagcaaguggcacucccugauggacccgcccggcaccgcccuggcgaagcucgccguguggugcgcccugagcuccuacagcucccacaaggggcaggccagcacccgccagaagaagcggcaccgcgaggacaucgaggacuacaucucccuguucccccucgacgacgugcagcccagcaagcugaugcggcugcucagcuccaacgaggacgacgccaacauccugagcucccccacggaccgcagcauguccagcucccugagcgcgucccagcuccacaccgucaacaugcgggacccccugaaccgcgugcuggccaaccucuuccugcugaucagcuccauccucggcagccggaccgccggcccgcacacccaguucgugcagugguucauggaggagugcgucgacugccuggagcagggcgggcgcggguccgugcugcaguucaugcccuucacgaccgugagcgagcucgucaagguguccgccaugagcucccccaaggugguccuggcgaucaccgaccugagccucccccugggccgccagguggccgccaaggccaucgccgcgcuguga

SEQ ID NO: 32829 - RNA, 2244 nt, Artificial Sequence
  derived and/or modified sequence opt1 from MED25__Homo_sapiens__NP_112235
auggugcccggcuccgagggccccgcccgggccggcuccgucguggccgacguggucuucgugaucgagggcaccgccaaccugggccccuacuucgaggggcuccggaagcacuaccugcugcccgccaucgaguacuucaacggcgggccgcccgccgagaccgacuucgggggcgacuacgggggcacgcaguacagccucguggucuucaacaccguggacugcgcccccgaguccuacgugcagugccacgcccccaccagcuccgccuacgaguucgucaccuggcuggacgggaucaaguucaugggcggcgggggcgagagcugcucccugaucgccgaggggcucagcacggcccugcagcuguucgacgacuucaagaagaugcgcgagcagaucggccagacccaccgggugugccuccugaucugcaacagcccgcccuaccugcuccccgcgguggaguccaccaccuacuccggcugcacgaccgagaaccugguccagcagaucggggagcgcggcauccacuucagcaucgugagcccccgcaagcugcccgcccuccgccugcuguucgagaaggccgccccgcccgcccuccuggagccccugcagccgcccaccgacgugagccaggacccccggcacaugguccucgugcgcgggcuggugcugcccgucggcgggggcuccgcgcccggcccccuccagagcaagcagcccgugccccugccgcccgccgcccccuccggggccacccugagcgccgcgccccagcagccccucccgcccgugccgccccaguaccagguccccggcaaccuguccgccgcccagguggccgcccagaacgcgguggaggccgccaagaaccagaaggccgggcugggcccccgguucagccccaucacgccccuccagcaggccgcgcccggggucgggccgcccuucagccaggcccccgcgccccagcugccgcccggcccgcccggggcccccaagcccccgcccgcgucccagcccagccugguguccaccgucgcccccggcagcgggcucgcccccaccgcccagcccggcgcccccuccauggcggggaccguggcccccggcggcgugagcgggcccucccccgcccagcugggcgcccccgcccugggcggccagcagagcgucuccaacaagcuccuggcguggagcggcgugcuggaguggcaggagaagcccaagcccgccuccguggacgccaacacgaagcucacccgcagccugcccugccaggucuacgugaaccacggggagaaccugaagaccgagcaguggccccagaagcucaucaugcagcugaucccgcagcagcugcucaccacgcugggcccccuguuccggaacucccgcauggugcaguuccacuucaccaacaaggaccucgagagccugaaggggcuguaccggaucaugggcaacggguucgccggcugcguccacuucccccacaccgcccccugcgaggugcgcgugcugaugcuccuguacuccagcaagaagaagaucuucaugggccugaucccguacgaccaguccggguucgucaacggcauccgccaggugaucaccaaccacaagcagguccagcagcagaagcucgagcagcagcagcgcgggaugggcgggcagcaggcgccgcccggccugggccccauccuggaggaccaggcccggccgagccagaaccuccugcagcugcggccgccccagccccagccgcaggggacggugggcgccuccggggccaccggccagccccagccccaggggaccgcgcagcccccgcccggcgcgccccagggcccgcccggggccgccagcgggcccccgccgcccgggcccauccuccggccccagaaccccggcgccaacccccagcugcgcagccugcuccugaacccgcccccgccccagaccggggugcccccgccccaggcgucccugcaccaccuccagccgcccggcgcccccgcccugcugcccccgccccaccagggccucgggcagccccagcugggcccgccccugcuccacccgccgcccgcccagagcuggcccgcccagcugccgccccgggcgccccugcccgggcagaugcuccuguccggcggcccccgcgggcccgugccgcagcccggccugcagcccagcgucauggaggacgacauccucauggaccugaucuga

SEQ ID NO: 32830 - RNA, 537 nt, Artificial Sequence
  derived and/or modified sequence opt1 from MED28__Homo_sapiens__NP_079481
auggccgcgccccugggcgggauguucagcggccagccgcccgggccgccccaggccccgcccggccuccccgggcaggccucccugcugcaggccgcccccggcgccccgcgccccagcuccagcacccucguggacgagcuggaguccagcuucgaggccugcuucgccucccuggugagccaggacuacgugaacggcaccgaccaggaggagauccggacggggguggaccagugcauccagaaguuccucgacaucgcccgccagaccgagugcuucuuccugcagaagcggcugcagcucuccguccagaagcccgagcaggucaucaaggaggacgugagcgagcugcgcaacgagcugcagcggaaggacgcccucgugcagaagcaccugaccaagcugcgccacuggcagcagguccucgaggacaucaacgugcagcacaagaagcccgcggacaucccccagggcucccuggccuaccuggagcaggccagcgccaacauccccgcgccccucaagcccaccuga

SEQ ID NO: 32831 - RNA, 666 nt, Artificial Sequence
  derived and/or modified sequence opt1 from MED29__Homo_sapiens__NP_060062
augcucaagagcaacggcgagcgccggucccgcaacgcccugcccgccguguacgcgcggaagauggccgccagccagcagcaggccuccgccgcgagcuccgccgccggggucagcggccccuccagcgccgggggccccgggccccagcagcagccccagccgcccgcgcagcuggugggccccgcccaguccggccugcuccagcagcagcagcaggacuucgaccccgugcagcgcuacaagaugcugaucccgcagcugaaggagagccuccagacccugaugaaggucgccgcccagaaccugauccagaacaccaacaucgacaacgggcagaaguccagcgacggccccauccagcgguucgacaagugccucgaggaguucuacgcccugugcgaccagcuggagcucugccugcgccuggcgcacgagugccucucccagagcugcgacuccgccaagcacagccccacgcuggugcccaccgccaccaagccggacgccgugcagcccgacucccugcccuacccccaguaccucgccgucaucaaggcgcagaucagcugcgccaaggacauccacaccgcccugcuggacugcgccaacaaggugacggggaagaccccggccccgcccgcgggccccgggggcacccucuga

SEQ ID NO: 32832 - RNA, 537 nt, Artificial Sequence
  derived and/or modified sequence opt1 from MED30__Homo_sapiens__NP_542382
augagcacgcccccgcuggccgccuccggcauggcgcccgggcccuucgccggcccccaggcccagcaggccgcccgcgaggugaacaccgcgagccucugccggaucgggcaggagaccguccaggacaucguguaccgcaccauggagaucuuccagcugcugcggaacaugcagcucccgaacggcgugaccuaccacaccgggacguaccaggaccgccugaccaagcugcaggacaaccuccggcagcuguccguccuguuccgcaagcuccggcugguguacgacaagugcaacgagaacugcggcggcauggaccccauccccguggagcagcugauccccuacgucgaggaggacgggagcaagaacgacgaccgcgccggcccgccccgguucgccuccgaggagcgccgggagaucgccgaggugaacaagaagcucaagcagaagaaccagcagcugaagcagaucauggaccagcugcgcaaccucaucugggacaucaacgcgaugcuggccaugcggaacuga

SEQ ID NO: 32833 - RNA, 675 nt, Artificial Sequence
  derived and/or modified sequence opt1 from MED4__Homo_sapiens__NP_001257558
augcuggccaucagccgcaaccagaagcuccugcaggccggcgaggagaaccaggugcuggagcuccugauccaccgggacggggaguuccaggagcugaugaagcucgcgcugaaccagggcaagauccaccacgagaugcagguccuggagaaggagguggagaagcgcgacuccgacauccagcagcuccagaagcagcugaaggaggccgagcagauccuggccaccgccguguaccaggccaaggagaagcucaagagcaucgagaaggcgcggaagggggccaucuccagcgaggagaucaucaaguacgcccaccgcaucuccgccagcaacgcggucugcgccccgcugaccugggugcccggcgacccccggcgccccuaccccacggaccuggagaugcgguccgggcuccugggccagaugaacaaccccagcaccaacggcgugaacgggcaccuccccggcgacgcccuggccgccgggcgccugcccgacguccuggcgccccaguacccguggcaguccaacgacaugagcaugaacaugcucccgcccaaccacuccagcgacuuccugcuggagccgcccggccacaacaaggagaacgaggacgacguggagaucauguccaccgacagcuccagcuccagcuccgagagcgacuga

SEQ ID NO: 32834 - RNA, 762 nt, Artificial Sequence
  derived and/or modified sequence opt1 from MED6__Homo_sapiens__NP_001271138
auggccgccguggacauccgcgacaaccugcucggcaucagcugggucgacuccagcuggauccccauccugaacuccgggagcgugcuggacuacuucuccgagcggagcaacccguucuacgaccggaccugcaacaacgagguggucaagaugcagcgccucacccuggagcaccugaaccagauggugggcaucgaguacauccuccugcacgcgcaggagcccauccuguucaucauccgcaagcagcagcggcagucccccgcccaggugaucccccucgccgacuacuacaucaucgccggggucaucuaccaggccccggaccugggcagcgugaucaacucccgcgugagccuguucuccuucuacaagcucacggcgguccacgggauccagagcgccuucgacgaggccauguccuacugccgguaccaccccagcaagggcuacugguggcacuucaaggaccacgaggagcaggacaaggugcgccccaaggccaagcggaaggaggagcccuccagcaucuuccagcgccagcggguggacgcgcugcugcucgaccugcgccagaaguucccgcccaaguucguccagcugaagcccggcgagaagcccgugccgguggaccagaccaagaaggaggccgagcccauccccgagaccgucaagcccgaggagaaggagaccacgaagaacgugcagcagaccguguccgccaaggggccgcccgagaagcggaugcgccuccaguga

SEQ ID NO: 32835 - RNA, 441 nt, Artificial Sequence
  derived and/or modified sequence opt1 from MED9__Homo_sapiens__NP_060489
auggccagcgccggcguggccgccgggcgccaggccgaggacgugcugcccccgaccuccgaccagccccuccccgacaccaagccccugccgccgccccagcccccgcccgugcccgcgccccagccccagcagagccccgcgccccggccccaguccccggcccgcgcccgggaggaggagaacuacagcuuccugccccucgugcacaacaucaucaagugcauggacaaggacucccccgagguccaccaggaccugaacgcccucaagagcaaguuccaggagaugcgcaagcugaucuccacgaugcccggcauccaccugagcccggagcagcagcagcagcagcugcagucccuccgggagcagguccgcaccaagaacgagcugcugcagaaguacaagagccucugcauguucgagauccccaaggaguga

SEQ ID NO: 32836 - RNA, 1500 nt, Artificial Sequence
  derived and/or modified sequence opt1 from MEF2A__Homo_sapiens__NP_005578
augggccgcaagaagauccagaucacccggaucauggacgagcgcaaccgccaggugaccuucacgaagcgcaaguucgggcugaugaagaaggccuacgagcucagcguccugugcgacugcgagaucgcccugaucaucuucaacuccagcaacaagcuguuccaguacgcguccaccgacauggacaaggugcugcugaaguacaccgaguacaacgagccccacgagagccggaccaacuccgacaucguggaggcccucaacaagaaggagcaccgcggcugcgacagcccggaccccgacacguccuacguccugacgccccacaccgaggagaaguacaagaagaucaacgaggaguucgacaacaugaugcggaaccacaagaucgcccccgggcugccgccccagaacuucagcauguccgugaccgugcccgucaccagccccaacgcccucuccuacaccaacccgggcagcucccuggugagccccucccucgccgcgagcuccacccucaccgacagcuccaugcugagcccgccccagacgacccugcaccggaacgugagccccggggcgccccagcggccgcccuccaccggcaacgccggcgggaugcucagcaccacggaccugaccguccccaacggcgccggguccagccccgugggcaacggguucgugaacucccgcgccagccccaaccugaucggcgccaccggcgccaacucccucgggaaggucaugcccaccaagagcccgcccccgcccggcgggggcaaccugggcaugaacucccggaagcccgaccugcgcguggugaucccgcccagcuccaaggggaugaugccgccccucaacacgcagcggaucagcuccagccaggccacccagccccuggccacccccgucguguccgugaccacgcccagccugccgccccagggccucgucuacuccgcgaugcccaccgccuacaacaccgacuacagccugaccuccgccgaccugagcgcccuccagggguucaacagccccggcaugcugucccugggccaggugagcgccuggcagcagcaccaccucgggcaggcggcccuguccagccugguggccggcgggcagcucucccagggcagcaaccuguccaucaacacgaaccagaacaucagcaucaaguccgagcccaucagcccgccccgcgaccggaugacccccuccggguuccagcagcagcagcagcagcagcagcagcagcagcccccgcccccgccccagccccagccccagccgccccagccccagccccgccaggagaugggccggagccccgucgacucccugagcuccagcuccagcagcuacgacggguccgaccgcgaggacccccggggcgacuuccacagccccaucgugcucggccggcccccgaacaccgaggaccgcgagucccccagcgugaagcgcaugcgcauggacgccugggucaccuga

SEQ ID NO: 32837 - RNA, 1107 nt, Artificial Sequence
  derived and/or modified sequence opt1 from MEF2B__Homo_sapiens__NP_001139257
augggccgcaagaagauccagaucagccggauccuggaccagcgcaaccggcaggugaccuucaccaagcgcaaguucgggcucaugaagaaggccuacgagcuguccguccugugcgacugcgagaucgcccucaucaucuucaacagcgcgaaccggcuguuccaguacgccuccacggacauggaccgcgugcugcucaaguacaccgaguacagcgagccccacgagucccggaccaacaccgacauccuggagacgcugaagcgccggggcaucgggcucgacggcccggagcuggagcccgacgaggggcccgaggagcccggcgagaaguuccgccggcuggccggcgaggggggcgacccggcccucccccgcccccggcuguaccccgccgcgccggccaugcccagccccgacguggucuacggggcccugcccccgcccggcugcgaccccuccgggcucggcgaggcccugcccgcgcagagccgcccgucccccuuccggcccgccgcccccaaggccggcccgcccgggcuggugcacccccucuucagccccucccaccugaccagcaagaccccgcccccccuguaccuccccaccgagggccgccgguccgaccugccggggggccuggccggcccccgcgggggccucaacacgagccggucccuguacagcgggcugcagaaccccugcuccaccgcgaccccgggccccccccucgggagcuuccccuuccugccgggcggcccccccgaguacgggcugggcgaccccccgcccccccccgggcuccugcagccgcccacccuggcccccuggcagcccucccgcggcgacgggccgcccgccgugagcagccagcccuccggcggccggagccucggggaggagggccccccgacgcgcggggccuccccccccacccccccggucagcaucaaguccgagcgccugagccccgcccccggcgggccgggcgacuuccccaagaccuuccccuacccccugcuccuggcgcggucccuggccgagccgcuccgccccggccccgcccugcggcgccugccccucgccgacggguggccgcgguga

SEQ ID NO: 32838 - RNA, 1098 nt, Artificial Sequence
  derived and/or modified sequence opt1 from MEF2BNB-MEF2B__Homo_sapiens__NP_005910
augggccggaagaagauccagaucagccggauccuggaccagcgcaaccgccaggugaccuucaccaagcggaaguucgggcucaugaagaaggccuacgagcuguccguccugugcgacugcgagaucgcccucaucaucuucaacagcgcgaaccggcuguuccaguacgccuccacggacauggaccgcgugcugcucaaguacaccgaguacagcgagccccacgagucccggaccaacaccgacauccuggagacgcugaagcgccggggcaucgggcucgacggcccggagcuggagcccgacgaggggcccgaggagcccggcgagaaguuccgccggcuggccggcgagggcggggacccggcccucccccgcccccggcuguaccccgccgcgccggccaugcccagccccgacguggucuacggggcccugcccccgcccggcugcgaccccuccgggcucggcgaggcccugcccgcgcagagccgcccgucccccuuccggcccgccgcccccaaggccggcccgcccgggcuggugcacccccucuucagccccucccaccugaccagcaagaccccgccgccccuguaccuccccaccgagggccgccgguccgaccugcccgggggccuggccggcccccgcgggggccucaacacgagccggucccuguacagcgggcugcagaaccccugcuccaccgcgaccccgggcccgccccucgggagcuuccccuuccugcccggcggcccgcccgugggggccgaggccugggcccgccgggucccccagcccgccgcgccgccccgccgcccgccccaguccgccagcagccuguccgccagccuccggccgcccggcgcccccgccaccuuccugcgccccucccccauccccugcagcucccccgggcccuggcagagccugugcggccucgggccgcccugcgcgggcugccccuggcccacggccggccccgggcggcgcucccccggcgggaccagcccggagcggucccccggcaccgcccgcgcccgcggggaccccaccagccugcaggccuccagcgagaagacgcagcaguga

SEQ ID NO: 32839 - RNA, 1392 nt, Artificial Sequence
  derived and/or modified sequence opt1 from MEF2C__Homo_sapiens__NP_001124477
augggccgcaagaagauccagaucacccggaucauggacgagcgcaaccgccaggugaccuucacgaagcggaaguucgggcugaugaagaaggccuacgagcucagcguccugugcgacugcgagaucgcccugaucaucuucaacuccaccaacaagcuguuccaguacgcgagcaccgacauggacaaggugcugcugaaguacaccgaguacaacgagccccacgagucccggacgaacagcgacaucguggaggcccucaacaagaaggagaacaagggcugcgaguccccggaccccgacagcuccuacgcccugacgccccgcaccgaggagaaguacaagaagaucaacgaggaguucgacaacaugaucaagagccacaagauccccgccgucccgccgcccaacuucgagaugcccguguccauccccgugagcucccacaacagccuggucuacuccaaccccgugagcucccucgggaaccccaaccugcugccccucgcccacccgagccugcagcggaacuccaugagccccggcgugacccaccgcccgcccuccgcggggaacaccggcggccugaugggcggggaccucaccagcggggccggcaccagcgccgggaacggcuacggcaacccccggaacucccccgggcugcuggucagccccggcaaccucaacaagaacaugcaggccaagagcccgccgcccaugaaccuggggaugaacaaccgcaagcccgaccugcgggugcucaucccgcccggcuccaagaacaccaugcccuccgugaaccagcgcaucaacaacagccaguccgcgcagagccuggccacgcccgucguguccguggccacccccacccugcccggccaggggaugggcggguaccccagcgccaucuccaccacguacggcaccgaguacagccucuccagcgccgaccuguccagccuguccggguucaacaccgcgagcgcccuccaccugggcuccgucaccggcuggcagcagcagcaccuccacaacaugcccccgagcgcccucagccagcugggggccugcacguccacccaccugagccaguccagcaaccucucccugcccagcacccagucccugaacaucaagagcgagcccgugagcccgccccgggaccgcaccacgacccccucccgguacccccagcacacccgccacgaggccggccggucccccguggacagccucuccagcugcuccagcuccuacgacgggagcgaccgcgaggaccaccggaacgaguuccacagcccgaucggccugacccgccccucccccgacgagcgggagagccccuccgucaagcgcaugcgccugagcgaggggugggcgacguga

SEQ ID NO: 32840 - RNA, 1566 nt, Artificial Sequence
  derived and/or modified sequence opt1 from MEF2D__Homo_sapiens__XP_005245226
augggccgcaagaagauccagauccagcggaucaccgacgagcgcaaccgccaggugaccuucacgaagcggaaguucgggcugaugaagaaggccuacgagcucagcguccugugcgacugcgagaucgcccugaucaucuucaaccacuccaacaagcuguuccaguacgcgagcaccgacauggacaaggugcugcugaaguacaccgaguacaacgagccccacgagucccggaccaacgccgacaucaucgagacgcuccgcaagaagggcuucaacgggugcgacagcccggagcccgacggcgaggacucccuggagcagagcccccugcucgaggacaaguaccggcgcgccuccgaggagcuggacgggcuguuccggcgcuacggcagcaccgugcccgccccgaacuucgccaugcccgucaccgugcccguguccaaccagagcucccuccaguucagcaaccccuccggcagccuggucaccccgucccuggugacgagcucccucaccgacccccggcugcugagcccccagcagcccgcgcuccagcgcaacuccgugagcccggggcugccccagcggcccgccagcgccggcgccaugcucgggggcgaccucaacuccgcgaacggggccugccccagcccggucggcaacggcuacguguccgcccgcgccagccccgggcugcugcccguggccaacggcaacucccucaacaaggucauccccgccaagagcccgcccccgcccacccacuccacccagcugggggcgccgagccggaagcccgaccugcgcgugaucacgucccaggccggcaagggccucaugcaccaccugaccgaggaccaccuggaccucaacaacgcccagcggcugggggugagccaguccacccacagccugaccacgcccgucguguccguggccacccccagccuccugucccagggccugccguucagcuccaugcccaccgcguacaacaccgacuaccagcucacgagcgccgagcuguccagccugcccgccuucagcucccccgggggccucagccuggggaacgucaccgccuggcagcagccccagcagccccagcagccccagcagccgcagccgccccagcagcagcccccgcagccccagcagccccagccccagcagccgcagcagccccagcagccgccccagcagcagucccaccuggugcccgugagccucuccaaccugauccccggcagcccccugccccacgucggcgccgcgcucaccgugaccacgcacccgcacaucuccaucaagagcgagcccgugucccccagccgcgagcggucccccgccccgcccccgcccgccgucuuccccgccgcccgccccgagcccggggacggccugagcucccccgccgggggcagcuacgagaccggggaccgggacgacggccgcggcgacuucgggcccacccugggccuccugcgccccgcgcccgagccggaggccgagggguccgccgugaagcggaugcgccuggacaccuggacgcugaaguga

SEQ ID NO: 32841 - RNA, 2346 nt, Artificial Sequence
  derived and/or modified sequence opt1 from MEFV__Homo_sapiens__NP_000234
auggccaagacccccagcgaccaccuccuguccacccuggaggagcuggugccguacgacuucgagaaguucaaguucaagcuccagaacacgagcguccagaaggagcacucccgcaucccccggagccagauccagcgcgcccggcccgugaagauggcgacccugcuggugaccuacuacggcgaggaguacgccguccagcucacccuccaggugcugcgcgccaucaaccagcggcugcuggccgaggagcugcaccgcgccgcgauccaggaguacuccacgcaggagaacgggaccgacgacagcgccgccuccagcucccucggcgagaacaagccccggagccugaagaccccggaccaccccgaggggaacgagggcaacgggccccgccccuacggcggcggggccgcgucccugcggugcagccagccggaggccggccgcgggcucucccggaagccccugagcaagcgccgggagaaggccuccgagggccuggacgcccaggggaagccccgcacccggagccccgcccucccgggcggccgcucccccgggcccugccgggcgcuggagggcgggcaggccgaggugcgccugcggcgcaacgccagcuccgccggccggcuccagggccuggccgggggcgcgcccgggcagaaggagugccgcccguucgaggucuaccugcccagcggcaagaugcgcccccggagccucgaggugacgaucuccaccggggagaaggcccccgccaacccggagauccugcugacccucgaggagaagaccgccgccaaccuggacagcgcgacggagccccgcgcccggcccacccccgacggcggcgccuccgccgaccugaaggaggggccgggcaaccccgagcacagcgugaccgggcgcccgcccgacaccgccgcgagcccccggugccacgcccaggagggcgaccccgucgacgggacgugcgugcgcgacuccugcuccuuccccgaggccgugagcggccacccgcaggccuccggcagccggucccccgggugcccccgcugccaggacagccacgagcggaagucccccggcagccucuccccgcagccccugccccagugcaagcgccaccugaagcagguccagcuccuguucugcgaggaccacgacgagcccaucugccugaucugcagccucucccaggagcaccaggggcaccgggugcgcccgaucgaggagguggcgcuggagcacaagaagaagauccagaagcagcuggagcaccucaagaagcugcgcaagagcggcgaggagcagcgguccuacggggaggagaaggccgucagcuuccugaagcagaccgaggcccucaagcagcgggugcagcgcaagcuggagcaggucuacuacuuccuggagcagcaggagcacuucuucguggccagccucgaggacgugggccagauggugggccagauccggaaggccuacgacacccgcgucucccaggacaucgcgcugcuggacgcccucaucggggagcuggaggccaaggagugccagagcgagugggagcugcugcaggacaucggcgacauccuccaccgggccaagaccgugcccgugcccgagaaguggacgacgccccaggagaucaagcagaagauccagcugcugcaccagaaguccgaguucgucgagaaguccaccaaguacuucagcgagacccuccgcagcgagauggagauguucaacgugccggagcugaucggggcccaggcgcacgccgucaacgugauccuggacgccgagaccgccuaccccaaccucaucuucuccgacgaccucaagagcgugcgccugggcaacaagugggagcggcugcccgacggcccccagcgcuucgacuccugcaucaucguccuggggagcccguccuuccugagcggccggcgcuacugggagguggaggugggggacaagaccgccuggauccucggcgcgugcaagaccuccaucagccggaaggggaacaugacccugucccccgagaacggcuacugggucgugaucaugaugaaggagaacgaguaccaggccagcuccgugccgcccacgcgccugcucaucaaggagccgcccaagcgggucggcaucuucguggacuaccgcguggggagcaucagcuucuacaacgucaccgcccggucccacaucuacaccuucgccagcugcuccuucagcggcccccugcagcccaucuucucccccgggacccgcgacggcgggaagaacacggcgccccugaccaucugccccgugggcggccaggggccggacuga

SEQ ID NO: 32842 - RNA, 3423 nt, Artificial Sequence
  derived and/or modified sequence opt1 from MEGF10__Homo_sapiens__NP_115822
auggugaucagccugaacuccugccucagcuucaucugccugcugcucugccacuggaucggcaccgccuccccccugaaccuggaggacccgaacgucugcagccacugggaguccuacagcgugaccgugcaggaguccuacccccaccccuucgaccagaucuacuacacgagcugcaccgacauccucaacugguucaagugcacccgccaccgggucuccuaccgcaccgccuaccggcacggggagaagacgauguaccgccggaagagccagugcugccccggcuucuacgaguccggggagaugugcgugccgcacugcgcggacaagugcgugcacggccgcugcaucgcccccaacaccugccagugcgagcccggguggggcggcaccaacugcagcuccgccugcgacggggaccacuggggcccccacugcaccagccggugccagugcaagaacggggcccugugcaacccgaucacgggcgccugccacugcgcggccggguuccgcggcuggcggugcgaggaccgcugcgagcagggcaccuacgggaacgacugccaccagcggugccagugccagaacggcgccaccugcgaccacgucaccggggagugccgcugcccccccggcuacacgggcgccuucugcgaggaccugugccccccggggaagcacggcccccagugcgagcagcggugccccugccagaacgggggcgugugccaccacgugaccggggagugcuccugccccagcggcuggaugggcaccgucugcgggcagccgugccccgagggccgcuucgggaagaacugcucccaggagugccagugccacaacggcgggaccugcgacgcggccacgggccagugccacugcagccccggcuacaccggggagcggugccaggacgagugccccgugggcaccuacggggugcucugcgccgagaccugccagugcgucaacggcgggaagugcuaccacguguccggcgccugccugugcgaggccggcuucgcgggggagcgcugcgaggcccggcugugcccggagggccucuacgggaucaagugcgacaagcgcugccccugccaccuggagaacacgcacagcugccaccccaugagcggcgagugcgccugcaagcccggcugguccgggcuguacugcaacgagaccugcagcccgggcuucuacggggaggccugccagcagaucugcuccugccagaacggcgccgacugcgacagcgugaccgggaagugcaccugcgcgcccggcuucaagggcaucgacugcuccacgcccugcccccucgggaccuacggcaucaacugcagcucccggugcgggugcaagaacgacgccgucugcagcccgguggacggcuccugcaccugcaaggccggguggcacggcguggacugcagcauccgcugccccuccggcaccuggggguucggcugcaaccugacgugccagugccugaacgggggcgccugcaacacccucgacgggaccugcaccugcgcccccggcuggcggggcgagaagugcgagcugccgugccaggacgggacguacggccugaacugcgcggagcgcugcgacugcagccacgccgacgggugccaccccaccaccggccacugccgcugccuccccgggugguccggcguccacugcgacagcgugugcgccgagggccggugggggcccaacugcucccugccgugcuacugcaagaacggcgccagcugcucccccgacgacgggaucugcgagugcgcccccggcuuccgcggcaccacgugccagcggaucugcagccccggguucuacggccaccgcugcucccagaccugcccgcagugcgugcacagcagcgggcccugccaccacaucaccggccugugcgacugccuccccggguucaccggcgcgcugugcaacgaggucugccccuccggccgguucgggaagaacugcgccggcaucugcaccugcacgaacaacgggaccugcaacccgaucgaccgcagcugccagugcuaccccggcuggaucggguccgacugcagccagcccugccccccggcccacuggggccccaacugcauccacaccugcaacugccacaacggcgccuucugcuccgcguacgacggggagugcaagugcacccccggcuggacggggcuguacugcacccagcggugcccccucggcuucuacgggaaggacugcgcccugaucugccagugccagaacggcgccgacugcgaccacaucagcggccagugcaccugccgcaccggguucaugggccggcacugcgagcagaagugcccguccgggacguacggcuacggcugccgccagaucugcgacugccugaacaacagcaccugcgaccacaucaccgggaccugcuacugcucccccggcuggaagggggcccggugcgaccaggccggcgugaucaucguggggaaccucaacagccugucccgcacgagcaccgcgcugcccgccgacuccuaccagaucggcgccaucgccggcaucaucauccucguccuggugguccuguuccuccuggcccuguucaucaucuaccggcacaagcagaaggggaaggagagcuccaugcccgcggugaccuacaccccggccaugcgcguggucaacgccgacuacacgaucagcggcacccucccccacuccaacgggggcaacgccaacagccacuacuucaccaaccccagcuaccacacccugacgcagugcgccaccuccccgcacgugaacaaccgggaccgcaugaccgugaccaagagcaagaacaaccagcuguucgucaaccucaagaacgugaaccccgggaagcggggccccgugggcgacugcacggggacccugcccgcggacuggaagcacggcggguaccugaacgagcucggcgccuucgggcuggaccgcuccuacaugggcaagagccugaaggaccucggcaagaacuccgaguacaacagcuccaacugcagccuguccagcuccgagaacccguacgccaccaucaaggacccccccguccugauccccaagagcuccgagugcggguacguggagaugaagagcccggcccggcgcgacucccccuacgcggagaucaacaacagcaccuccgccaaccgcaacguguacgaggucgagcccacggugagcgugguccagggcguguucuccaacaacgggcggcugagccaggaccccuacgaccucccgaagaacagccacauccccugccacuacgaccugcugcccgugcgcgacuccagcuccagccccaagcaggaggacuccggcgggagcuccagcaacuccagcuccagcuccgaguga

SEQ ID NO: 32843 - RNA, 3135 nt, Artificial Sequence
  derived and/or modified sequence opt1 from MEGF11__Homo_sapiens__NP_115821
auggugcugagccucaccggccugaucgccuucuccuuccugcaggccacccucgcgcugaaccccgaggacccgaacgucugcagccacugggaguccuacgccgugacggugcaggagagcuacgcccaccccuucgaccagaucuacuacacccgcugcaccgacauccugaacugguucaagugcacccggcaccgcaucuccuacaagacggccuaccggcgcgggcuccggaccauguaccgccggcgcagccagugcugccccggcuacuacgaguccggggacuucugcaucccccugugcaccgaggagugcguccacggccggugcgugagcccggacaccugccacugcgagcccggguggggcggccccgacugcuccagcgggugcgacuccgaccacuggggcccccacugcagcaaccgcugccagugccagaacggggcccugugcaacccgaucacgggcgcgugcgugugcgccgccggguuccggggcuggcgcugcgaggagcucugcgcccccggcacccacgggaagggcugccagcugcccugccagugccggcacggggcguccugcgacccccgcgccggcgagugccugugcgccccgggcuacaccggggucuacugcgaggagcucugcccccccggcagccacggggcccacugcgagcugcggugccccugccagaacggcgggaccugccaccacaucacgggcgagugcgccugcccgcccggcuggaccggggcggugugcgcccagcccugccccccgggcaccuucgggcagaacugcucccaggacugccccugccaccacggcgggcagugcgaccacgugaccggccagugccacugcacggccggcuacaugggggaccgcugccaggaggagugccccuucggcagcuucggguuccagugcucccagcacugcgacugccacaacggcgggcagugcagccccaccaccggcgccugcgagugcgagccgggcuacaaggggccccggugccaggagcgccugugccccgagggccuccacgggcccggcugcacccugccgugccccugcgacgccgacaacacgaucuccugccaccccgucaccggcgcgugcaccugccagccgggguggagcggccaccacugcaacgagagcugccccgugggguacuacggcgacgggugccagcugcccugcaccugccagaacggcgccgacugccacuccaucacgggcgggugcaccugcgcccccggcuucaugggggaggugugcgccgucagcugcgccgcgggcaccuacgggccgaacugcuccagcaucugcuccugcaacaacggcggcaccugcagccccguggacggguccugcacgugcaaggagggcuggcaggggcucgacugcacccugcccugccccagcggcaccugggggcugaacugcaacgaguccugcaccugcgccaacggcgccgccugcagcccgaucgacggcuccugcagcugcacgcccggguggcucggcgacaccugcgagcugcccugccccgacgggaccuucggccugaacugcuccgagcacugcgacugcagccacgccgacgggugcgacccggugaccggccacugcugcugccucgcgggcuggacggggauccggugcgacuccaccugcccccccggccgcugggggcccaacugcagcgucuccugcagcugcgagaacggcggcuccugcagcccggaggacgggagcugcgagugcgcccccggcuuccgggggccccugugccagcgcaucugccccccgggcuucuacgggcacggcugcgcccagcccugcccccugugcgugcacuccagccgccccugccaccacaucuccggcaucugcgagugccucccgggguucagcggcgcccugugcaaccaggugugcgcggggggcuacuucgggcaggacugcgcccagcugugcuccugcgccaacaacggcaccugcagccccaucgacggcuccugccagugcuuccccggguggaucggcaaggacugcagccaggccugcccgcccggguucuggggccccgccugcuuccacgcgugcuccugccacaacggggccagcugcuccgccgaggacggcgccugccacugcacccccggcuggaccgggcucuucugcacgcagcggugcccggccgcguucuucggcaaggacugcgggcgcgucugccagugccagaacggcgccagcugcgaccacaucuccggcaagugcaccugccggaccggguucaccggccagcacugcgagcagcgcugcgcccccgggacguucggcuacgggugccagcagcugugcgagugcaugaacaacagcaccugcgaccacgugaccggcaccugcuacugcucccccggcuucaaggggauccggugcgaccaggccgcccugaugauggaggagcucaaccccuacacgaagaucagcccggcgcugggcgccgagcgccacuccgugggggccgucaccggcaucaugcugcuccuguuccugaucguggugcuccuggggcuguucgccuggcaccggcgccggcagaaggagaagggccgcgaccucgcgccccgggucagcuacacccccgccaugcgcaugaccagcacggacuacucccugagcggcgccugcgggauggaccggcgccagaacaccuacaucauggacaagggcuucaaggacuacaugaaggaguccgugugcagcuccagcaccugcucccugaacagcuccgagaaccccuacgccaccaucaaggacccgcccauccucacgugcaagcugcccgagagcuccuacgucgagaugaagagccccgugcacaugggguccccguacaccgacgugcccagccuguccaccagcaacaagaacaucuacgaggucgagcccaccguguccgugguccaggagggcugcgggcacaacagcuccuacauccagaacgccuacgaccucccccggaacagccacaucccgggccacuacgaccugcugcccgugcgccagagccccgcgaacggccccucccaggacaagcagagcuga

SEQ ID NO: 32844 - RNA, 8538 nt, Artificial Sequence
  derived and/or modified sequence opt1 from MEGF8__Homo_sapiens__NP_001258867
auggcccugggcaaggugcuggccauggcccuggugcuggcccucgccgugcuggggucccugucccccggcgcccgggccggggacugcaagggccagcgccaggugcuccgggaggcccccggguucgugaccgacggcgccggcaacuacuccgugaacgggaacugcgaguggcugaucgaggcccccagcccccagcaccggauccugcucgacuuccuguuccuggacaccgagugcaccuacgacuaccucuucguguacgacggcgacagcccccgcgggccgcugcuggccucccucuccggcuccacccggcccccgcccaucgaggccagcuccgggaagaugcugcugcaccucuucagcgacgccaacuacaaccugcugggcuucaacgccuccuuccgguucagccucugccccggcgggugccagucccacggccagugccagccgcccggggucugcgccugcgagcccggcuggggcgggcccgacugcggccugcaggagugcagcgccuacugcgggucccacgggaccugcgccagcccccuggggcccugccggugcgagcccggcuuccucggccgcgccugcgaccugcaccugugggagaaccagggggccggcugguggcacaacguguccgcccgggaccccgccuucagcgcccgcaucggggccgccggcgccuuccucagcccgcccgggcugcuggccguguucggcggccaggaccucaacaacgcccugggggaccugguccucuacaacuucagcgccaacaccugggagagcugggaccugucccccgcccccgccgcccggcacagccacguggcgguggccugggccggcucccugguccucaugggcggggagcuggccgacgggagccugaccaacgacgugugggcguucagcccccugggccgcggccacugggagcugcuggccccgcccgccagcuccagcuccgggccgcccggccucgccgggcacgccgcggcccugguggacgacgucuggcuguacgugagcggcggccggacgccccacgaccucuucuccagcgggcuguuccgcuuccggcuggacuccaccagcggcggguacugggagcaggucauccccgccggcgggcgcccgcccgccgccaccggccacuccauggucuuccacgcgcccagccgggcccuccuggugcacggcgggcaccgccccuccaccgcccgguucagcgugcgcgucaacuccaccgagcuguuccacguggaccggcacguguggaccacccugaagggccgcgacgggcuccagggcccccgcgagcgggccuuccacacggccagcguccuggggaacuacaugguggucuacggcggcaacgugcacacccacuaccaggaggagaagugcuacgaggacgggaucuucuucuaccaccugggcugccaccagugggugagcggggcggagcucgcgccgcccggcacccccgaggggcgcgccgcgccgcccuccggccgguacagccacgucgcggccgugcugggcggguccgugcugcucgucgccggcggguacagcggccgcccccgcggggaccugauggccuacaaggugccgcccuucguguuccaggcccccgcgcccgacuaccaccuggacuacugcuccauguacaccgaccacagcgucugcucccgcgaccccgagugcagcuggugccagggcgccugccaggccgcgccgccgcccggcacgccccucggggccugccccgcggccuccugccugggccuggggcggcuccugggcgacugccaggccugccuggccuucagcucccccaccgcgccgccccgcggccccgggacccucggcuggugcgugcacaacgagagcugccugccccggcccgagcaggcgcgcugccgcggggagcagaucuccggcaccguggggugguggggccccgcccccgucuucgugaccagccuggaggccugcgugacccaguccuuccuccccggccugcaccuccugaccuuccagcagccgcccaacaccagccagcccgacaaggucuccaucgugcgcagcacgaccaucacccugacccccagcgccgagacggacgugucccuggucuaccggggguucaucuaccccaugcuccccggcgggcccggcgggcccggcgcggaggacguggccguguggacccgcgcccagcggcugcacguccuggcccgcauggcccggggccccgacaccgagaacauggaggagguggggcgcuggguggcgcaccaggagaaggagacccggcgccuccagcgccccggcagcgcccggcuguucccccugcccgggcgcgaccacaaguacgccgucgagauccagggccagcucaacggguccgccggccccggccacagcgagcugacgcugcucugggaccggaccggggugcccggcggguccgagaucagcuucuucuuccuggagcccuaccgcuccagcuccugcaccagcuacuccagcugccugggcugccucgccgaccagggcugcggguggugccugaccuccgcgacgugccaccuccgccagggcggggcccacugcggcgacgacggggccggcggcagccuccuggugcugguccccacccucugcccgcugugcgaggagcaccgcgacugccacgccugcacccaggaccccuucugcgaguggcaccaguccaccagccggaagggggacgccgcgugcucccgccggggccgcgggcggggcgcccugaagucccccgaggagugcccgccccucugcucccagcggcugaccugcgaggacugccuggccaacagcagccagugcgccuggugccaguccacgcacacgugcuuccuguucgccgcguaccuggcccgguacccccacgggggcugccgcggcugggacgacagcgugcacuccgagccccggugccgcagcugcgacggguuccugaccugccacgagugccugcagucccacgagugcggcuggugcgggaacgaggacaaccccacccugggccggugccugcagggggacuucagcggcccccucggcgggggcaacugcucccugugggugggggagggccuggggcuccccgucgcccugcccgcccgcugggcguacgcccggugccccgacguggacgagugccgccugggccucgcccggugccacccccgcgccacgugccugaacacgccccugagcuacgagugccacugccagcgcggcuaccagggggacggcaucucccacugcaaccggaccugccucgaggacugcgggcacggcgugugcagcgggcccccggacuucacgugcgucugcgaccugggcuggaccuccgaccugccgccgcccaccccggcccccgggccgcccgcgccgcgcugcagccgggacugcgggugcuccuuccacagccacugccgcaagcggggccccggguucugcgacgagugccaggacuggaccuggggcgagcacugcgagcgcugccggcccggcuccuucgggaacgccaccggcagccgcgggugccggcccugccagugcaacggccacggggacccgcgccggggccacugcgacaaccucuccggccugugcuucugccaggaccacacggagggggcccacugccagcugugcagccccggcuacuacggggacccccgcgccggcggguccugcuuccgggagugcggcggccgcgcccuccugaccaacgugagcagcguggcgcuggggucccggcgcgucggcgggcuccugcccccgggcgggggcgccgcccgggccggccccgggcugagcuacugcguguggguggucuccgccaccgaggagcuccagcccugcgcgcccggcacccugugcccgccccugacgcucaccuucagccccgacuccagcacccccugcacccuguccuacgugcuggccuucgacggguucccgcgcuuccucgacacgggcgugguccagagcgaccggucccugaucgccgccuucugcggccagcgccgcgaccggccccugaccgugcaggcgcucagcgggcugcuggugcuccacugggaggccaacggcuccagcuccuggggguucaacgccagcgucggcuccgcccgcugcgggagcggcggccccggguccugccccgugccgcaggagugcgugccccaggacggcgccgcgggggccggccugugccggugcccccaggggugggccggcccgcacugccgcauggcccugugccccgagaacugcaacgcccacaccggcgcggggaccugcaaccagagccucggcgucugcaucugcgccgagggguucggcgggcccgacugcgccacgaagcuggacggcggccagcuggugugggagacccucauggacucccggcugagcgccgacaccgccagccgcuuccugcaccggcuggggcacaccaugguggacggccccgacgcgacgcucuggauguucgggggccugggccugccgcaggggcuccugggcaaccuguaccgcuacuccgucagcgagcggcgcuggacccagaugcucgccggggccgaggacggcgggcccggccccagcccccggagcuuccacgccgcggccuacgugccggccggccgcggggccauguaccugcugggcgggcucaccgccggcggggucacccgggacuucugggugcugaaccugacgacccuccaguggcgccaggagaaggcgccccagaccguggagcugcccgccgucgccggccacacccugacggcccggcgcggccucucccugcugcucgucgggggcuacagccccgagaacggguucaaccagcagcugcuggaguaccagcucgccaccggcaccuggguguccggggcgcagagcggcaccccgcccaccggccuguacgggcacuccgccgucuaccacgaggccacggacagccuguacguguucggcggguuccgguuccacguggagcucgccgcccccucccccgagcuguacagccugcacugcccggaccgcaccuggucccuccuggcgcccagccagggcgccaagcgggaccgcaugcggaacguccgcggguccagccgcggccugggccaggugcccggggagcagcccggcuccuggggguuccgggaggugcgcaagaagauggcccucugggccgcccuggcgggcaccggcggguuccuggaggagaucagcccgcaccucaaggagccccggccccgccuguuccacgccuccgcccugcucggcgacaccauggucgugcucgggggccggagcgaccccgacgaguucagcuccgacgugcugcucuaccaggucaacugcaacgccuggcugcugccggaccucacgcgcagcgcguccguggggccgcccauggaggagagcguggcccacgccgucgccgccgugggcucccggcuguacaucagcggcggguucggcgggguggcgcugggccgccuccuggcccugacccucccgcccgaccccugccggcugcuguccagccccgaggccugcaaccaguccggggccugcaccuggugccacggcgccugccucagcggcgaccaggcgcaccgccuggggugcggcggguccccgugcagccccaugccccggucccccgaggagugccgccggcugcggaccugcagcgagugccucgcccggcacccgcgcacgcugcagcccggcgacggggaggccuccacgccccggugcaaguggugcaccaacugccccgagggcgccugcaucggccgcaacgggagcugcaccuccgagaacgacugccggaucaaccagcgcgaggucuucugggccggcaacugcagcgaggcggccugcggggccgccgacugcgagcagugcacccgcgagggcaagugcauguggacccggcaguucaagcgcaccggcgagacccggcgcauccuguccgugcagccgacguacgacuggaccugcuucagccacagccuccugaacgugucccccaugcccgucgagagcagcccgccccugcccugccccacccccugccaccuccugccgaacugcaccuccugccuggacuccaagggggcggacggcggguggcagcacugcguguggagcuccagccuccagcagugccugucccccagcuaccugccccuccggugcauggccggcgggugcggccgccugcugcggggccccgaguccugcagccucgggugcgcccaggccacgcagugcgcccugugccugcgccggccgcacugcggcuggugcgcguggggcggccaggacgggggcggccgcugcauggagggcggccucuccgggccccgggacggccugaccugcgggcgccccggcgccagcugggccuuccuguccugcccgcccgaggacgagugcgccaacggccaccacgacugcaacgagacccagaacugccacgaccagccccacggguacgagugcagcugcaagaccggcuacacgauggacaacaugaccgggcucugccggcccgugugcgcccagggcugcgucaacggguccugcguggagcccgaccacugccgcugccacuucggcuucgugggccggaacugcagcaccgagugccgcugcaaccggcacagcgagugcgcgggggucggcgcccgcgaccacugccugcugugccggaaccacaccaaggggucccacugcgagcagugccucccccuguucgugggcagcgccgugggcgggggcacgugccgccccugccacgccuucugccgggggaacucccacaucugcaucagccgcaaggagcugcagauguccaagggcgagcccaagaaguacagccucgacccggaggagaucgagaacugggucaccgaggggcccuccgaggacgaggccgugugcgugaacugccagaacaacagcuacggcgagaagugcgaguccugccugcagggcuacuuccugcucgacgggaagugcaccaagugccagugcaacggccacgcggacacgugcaacgagcaggacgggacgggcugccccugccagaacaacaccgagaccgggaccugccagggcagcucccccagcgaccgccgggacugcuacaaguaccagugcgccaagugccgcgaguccuuccacggcagcccgcucgggggccagcagugcuaccggcugaucuccgucgagcaggagugcugccucgaccccacgagccagaccaacugcuuccacgagcccaagcgccgggcccuggggcccggccgcaccgugcuguucggggugcagccgaaguucaccaacgucgacauccggcucacccuggacgugacguucggcgccguggaccuguacgucuccaccagcuacgacaccuucguggugcgcgucgcgcccgacaccggcgugcacacggugcacauccagccgccgcccgcgcccccgccgccgccgccgcccgccgacgggggcccccgcggggccggcgaccccggcggggccggcgcguccagcgggcccggcgcccccgccgagccccgcguccgggagguguggccccgcgggcucaucaccuacgugaccgucaccgagcccagcgccgugcuggucgugcggggcgugcgcgaccggcuggucaucacguacccccacgagcaccacgcccucaaguccagccgcuucuaccugcugcuccugggcgugggggaccccuccggccccggggcgaacggcagcgccgacucccaggggcugcuguucuuccggcaggaccaggcccacaucgaccucuucguguucuucagcgucuucuucuccugcuucuuccuguuccugagccucugcgugcugcuguggaaggccaagcaggcccucgaccagcgccaggagcagcggcgccaccuccaggagaugaccaagauggcgucccgccccuucgccaaggugaccgucugcuucccgcccgaccccaccgcccccgccagcgccuggaagccggcgggccugccgccgcccgccuuccggcgcuccgagccguuccucgcgccccugcugcucacgggcgccgggggccccugggggcccaugggcgggggcugcugcccgcccgcgauccccgccaccaccgccggccugcgggccgggcccaucacccuggagccgacggaggacggcauggccgggguggcgacccuccugcugcagcuccccggcgggccccacgcccccaacggcgccugccugggcagcgcccuggugacccuccgccaccggcugcacgaguacugcgggggcgggggcggcgccgggggcuccgggcacggcaccggggcgggccgcaagggccugcucagccaggacaaccugacguccaugagccuguga

SEQ ID NO: 32845 - RNA, 1809 nt, Artificial Sequence
  derived and/or modified sequence opt1 from MEGF9__Homo_sapiens__NP_001073966
augaacggcggggccgagcgcgccaugcggagccugcccucccucggcgggcuggcgcugcucugcugcgccgccgccgccgcggccgccgccguggcgagcgccgccuccgccggcaacgucaccgggggcggcggggccgcgggccagguggacgccagcccggggcccggccugcgcggggagcccucccaccccuucccgcgggccaccgcccccacggcccaggcgccccgcaccgggcccccgcgggccaccgugcaccgcccccuggccgccaccagccccgcccagucccccgagacgaccccgcucugggcgaccgccggccccagcuccaccacguuccaggcgccccugggccccagcccgaccaccccgcccgccgccgagcggaccuccacgaccagccaggcccccacccgccccgcccccaccacgcuguccaccaccaccggccccgcccccacgaccccggucgccaccaccgugcccgcgcccacgacgccccggaccccgacccccgaccuccccagcuccagcaacuccagcgugcugccgaccccgcccgccaccgaggcccccuccagcccgccgcccgaguacgucugcaacugcagcgugguggggucccugaacgucaaccgcugcaaccagaccaccggccagugcgagugccggcccggcuaccaggggcuccacugcgagacgugcaaggagggcuucuaccugaacuacaccagcgggcugugccagcccugcgacugcagcccccacggcgcccucuccauccccugcaacuccagcgggaagugccagugcaaggugggcgugaucggcuccaucugcgaccgcugccaggacggguacuacggcuucagcaagaacgggugccugcccugccagugcaacaaccgguccgccagcugcgacgcgcugaccggcgccugccucaacugccaggagaacuccaaggggaaccacugcgaggagugcaaggagggcuucuaccagagccccgacgccaccaaggagugccugcgcugccccugcuccgccgucacgagcaccggcuccugcagcaucaaguccagcgagcuggagcccgagugcgaccagugcaaggacggguacaucggccccaacugcaacaagugcgagaacggguacuacaacuucgacuccaucugccggaagugccagugccacggccacguggacccggugaagacccccaagaucugcaagcccgagagcggggagugcaucaacugccuccacaacaccaccggcuucuggugcgagaacugccuggagggcuacguccacgaccuggaggggaacugcaucaagaaggaggugauccuccccacgccggagggcagcaccauccugguguccaacgccagccugaccaccuccguccccacgcccgugaucaacagcaccuucacccccaccacgcuccagaccaucuucuccgugagcaccuccgagaacagcaccuccgcgcuggccgacgucagcuggacgcaguucaacaucaucauccugaccgugaucaucaucguggucgugcuccugaugggguucgucggcgccguguacauguaccgcgaguaccagaaccggaagcugaacgccccguucuggaccaucgagcucaaggaggacaacaucuccuucagcuccuaccacgacagcauccccaacgccgacguguccggccugcuggaggacgacgggaacgaggucgcgcccaacggccagcucacccugacgaccccgauccacaacuacaaggccuga

SEQ ID NO: 32846 - RNA, 3825 nt, Artificial Sequence
  derived and/or modified sequence opt1 from MEI1__Homo_sapiens__NP_689726
auggccgugcgccaggccgcgaccgccggcacccccgggccgcggcgcgaggaggaggccgcccugcuguucgagcgggcccacuaccgccacgacccccgguggcugcugcccgucacgccccgccucugccuggcgugcgcccuggagcuccugccggaccccggcgugagccuggugcggaagaagcacaugcucuccugcuuccaggacgcccugguccgccacaccagccuggugacccagcucgugucccaggaccagcgggucugcauccacuucaucagcgugcuguucgggcugcucugcuccauggaggacggcagcgugaccgaccugugcaucgagguccugauccagaucacgacccagcucaagcuggagcagaccauccgcugccugcucgacgagugccacaaggagcugugcaacaugcccuccaugcgggggagccuggccacccucacgcugcugggcaagcucguggacgcgauccccgcccuggccgacgagcuggugauggagcacggcaaccucauggagcaccuccugcgcgggcucgucuacccguccgagggcauccaggccagcgugugcuaccuguacgggaagcuguacuccagccccguggccgcggagaugcucuccggccacuuccgggagaagcuguucccccuguuccucagcauccuggacggggcccagaccaaggagcugcagaucaacugccucggccugcugcgccagcuccugaaguacgaccuguucgucuccaugaucaugaaccaggacggccucggggagagcgccaagaacaucgagggcuccagcgggaacaccucccugccccuggugcugaagaagcuccugcugagccgggacgagacccuccagguggccagcgcccacugcaucacggcgguccuggugcacuccccggccaagcacgccagcgccuucauccacgccgacauccccgaguuccuguucgagcaccucuccagcuccagcgaggugcuggucugguccagcugcaacugccugacccuccugguggaggagccccuguucuucuccaagugccacaccguguacggcaucgaggcggucgugcgcagccuccagggcucccugaagaugaacaacaucgagcugcacaagcaggggcuccugcuguucgccgagauccucacccggcagcccgaggagaucaagcuguucacgagcuccgccaugugccgcgacgccggccgggcccugcaggaggcggucagcuccccggugcucgagguggccgccgaggcccugaaggcgaccagcgccuuccugcgcaaggaccaccaguccaccccgcccguccaguacggggagcuccaggcccugcuggaggccaugcucaaccggugcgccgaguucagccagacccugcugucccgccgcccccucggccacgcgagcagccgggacuccgagaaggccauccugcagcgcgggaaguuccugcucagcacgcuggagggcuuccgguccgccugccgccuggccaucgaguuccagagcgagcccuccgcccaggagaaccccuucaccgcgcccagcgccaagaaggaggacacccucgaggccuucuccgaguuccugcugagcgccugcgacucccucugcauccccauggugaugcggcaccuggagcagaccacgcacccggcccugauggagguguuccucagcauccugcacaaccuguucgucaucgugccccacaugaaggagaaguucuccaagaagcucgcgagcuccagcuucauccgccugacccuggagcucaaggcccgguucugcuccggccugagccacuccgcccugaaccaggugugcagcaacuuccucuacuacaugugccugaaccugcucagcgcccccgagaagaccgggcccccguccaaggaggagcugagcgcggucuccgagcugcuccagcacggccugccccagaucagcucccgcagccccgagucccuggccuuccucagcgaccggcaguacauggagggggccgcccgccagcggcaguacugcauccugcugcuguucuaccuggccuacauccacgaggaccgcuucguguccgaggcggagcuguucgaggccgugcagagcuuccuccugucccugcaggaccagggcgagcggccgccccucgucguguucaaggccagcaucuaccugcuggccaucugccaggacaaggacaacacccuccgcgagacgaugguguccgccauccggaaguuccuggaggggauccccgaccugcagcucgucuacacccaccacccccugcugcuccgcuucuuccugcuguacccggagcucaugagccgguacggccaccgcgugcuggagcugugguucuucugggaggaguccagcuacgaggagcucgacgacgugaccuccgcgggccagcccgcccugcccgccagccuggucgugcuguuccagcugcugcgguccauccccagcauccuccugauccugcucgaccugaucuacagcuccccgguggacaccgcccacaagguccugaucagccugcgcacguuccuccgccggaacgaggacauccaggucgggggccugauccgcgggcacuuccugcucauccugcagcggcugcucguggagcacggcgccucccccagcggggcguccggcaaccugccccugcuccugagccugcucucccugaugcagcugcgcaacgugagcgagcaggagcucgacuccguggccaugaagcugcugcaccaggugagcaagcucugcggcaagugcucccccaccgacgucgacauccugcagccgagcuucaacuuccuguacuggucccuccaccagaccacccccagcucccagaagcgggccgccgcggugcugcugagcuccacggggcucauggagcugcuggagaagaugcucgcccugacccuggccaaggccgacagcccccgcaccgcccuccugugcuccgcguggcugcucaccgccagcuucagcgcccagcagcacaagggcucccuccaggugcaccagacccugagcgucgagauggaccaggugcucaaggcccuguccuuccccaagaagaaggccgcgcugcucagcgccgccauccugugcuuccugcggacggcccuccgccaguccuucagcuccgcccugguggcgcuggucccgagcggggcccagccccuccccgccaccaaggacaccgugcuggcgccccugcggaugucccaggugcgcagccucgucaucggccugcagaaccugcucgugcagaaggacccgcugcugucccaggccugcgugggcugccucgaggcccugcuggacuaccucgacgcccggagccccgacaucgcccugcacgucgccucccagcccuggaaccgcuuccuccucuucacccugcuggacgcgggggagaacagcuuccuccggcccgagauccugcgccugaugacccucuucaugcgguaccgcuccagcuccgugcugagccacgaggaggugggcgacguccugcaggggguggcccucgccgaccuguccacgcugagcaacaccacccuccaggcccugcacggcuucuuccagcagcugcagagcauggggcaccucgccgaccacuccauggcgcagacgcugcaggccagccuggagggccucccgcccuccaccagcuccggccagcccccgcugcaggacaugcugugccucgggggcguggccgucagccugucccacauccggaacuga

SEQ ID NO: 32847 - RNA, 1173 nt, Artificial Sequence
  derived and/or modified sequence opt1 from MEIS1__Homo_sapiens__NP_002389
auggcccagcgcuacgacgaccugccccacuacggcgggauggacggcguggggaucccgagcaccauguacggcgacccccacgccgcgcgguccaugcagcccguccaccaccucaaccacgggcccccgcugcacagccaccaguacccccacaccgcccacacgaacgccauggcccccuccaugggcagcuccgugaacgacgcccugaagcgcgacaaggacgcgaucuacggccacccccucuucccgcugcuggcccucaucuucgagaagugcgagcuggcgaccugcacgccccgggagcccgggguggccggcggggacgucugcagcuccgagagcuucaacgaggacaucgccguguucgccaagcagauccgcgccgagaagccccuguucuccagcaacccggagcucgacaaccugaugauccaggccauccaggugcugcgguuccaccuccuggagcuggagaagguccacgagcucugcgacaacuucugccaccgcuacaucuccugccugaagggcaagaugcccaucgaccuggugaucgacgaccgggagggcgggagcaaguccgacagcgaggacaucacccgcuccgccaaccucaccgaccagcccagcuggaaccgggaccacgacgacaccgcguccacccgcagcggcgggacccccggcccguccagcgggggccacacgagccacuccggcgacaacagcuccgagcagggggacggccuggacaacagcguggccucccccagcaccggggacgacgacgaccccgacaaggacaagaagcggcacaagaagcgcggcaucuuccccaaggucgccaccaacaucaugcgggccuggcuguuccagcaccucacccacccguaccccuccgaggagcagaagaagcagcuggcccaggacacggggcugaccauccuccaggugaacaacugguucaucaacgcgcgccggcgcaucgugcagcccaugaucgaccagagcaaccgggccgucucccagggcacccccuacaacccggacggccagcccaugggcggguucgugauggacgggcagcagcacaugggcauccgcgcccccgggcccaugagcggcaugggcaugaacauggggauggagggccaguggcacuacauguga

SEQ ID NO: 32848 - RNA, 1146 nt, Artificial Sequence
  derived and/or modified sequence opt1 from MEIS2__Homo_sapiens__NP_002390
auggacggcguggggguccccgccagcauguacggcgacccgcacgcgccccgccccaucccgcccgugcaccaccugaaccacgggccgccccuccacgcgacccagcacuacggcgcccacgcgccccaccccaacgugaugcccgccuccauggggagcgccgucaacgacgcccugaagcgggacaaggacgccaucuacggccacccccuguucccccuccuggcccugguguucgagaagugcgagcucgcgaccugcacgccgcgcgagcccggcguggccgggggcgacgucugcuccagcgacuccuucaacgaggacaucgccguguucgccaagcagguccgggccgagaagccccuguucagcuccaaccccgagcuggacaaccucaugauccaggccauccaggugcugcgcuuccaccuccuggagcuggagaaggugcacgagcugugcgacaacuucugccaccgguacaucagcugccucaaggggaagaugccgaucgaccuggugaucgacgagcgcgacggcuccagcaaguccgaccacgaggagcugagcggguccagcaccaaccucgccgaccacaaccccuccagcuggcgggaccacgacgacgccaccuccacccacagcgccggcacgcccggccccuccagcgggggccacgccagccaguccggggacaacagcuccgagcagggcgacggccuggacaacagcgucgccuccccggggaccggcgacgacgacgaccccgacaaggacaagaagcgccagaagaagcgggggaucuuccccaagguggcgaccaacaucaugcgcgccuggcuguuccagcaccucacccaccccuacccgagcgaggagcagaagaagcagcuggcccaggacacgggccugaccauccuccaggugaacaacugguucaucaacgcccggcgccggaucguccagcccaugaucgaccaguccaaccgcgccgugagccagggggcggccuacucccccgagggccagcccaugggcagcuucgugcuggacgggcagcagcacaugggcauccggccggccgggcccauguccggcauggggaugaacaugggcauggacggccaguggcacuacauguga

SEQ ID NO: 32849 - RNA, 1833 nt, Artificial Sequence
  derived and/or modified sequence opt1 from MELK__Homo_sapiens__NP_001243614
augaaggacuacgacgagcugcucaaguacuacgagcugcacgagaccaucggcaccgggggcuucgccaaggugaagcuggccugccacauccucacgggggagauggucgcgaucaagaucauggacaagaacacccugggcagcgaccugccccgcaucaagaccgagaucgaggcccucaagaaccugcggcaccagcacaucugccagcuguaccacgugcucgagaccgccaacaagaucuucauggugcuggaguacugccccgggggcgagcuguucgacuacaucaucucccaggaccgccucagcgaggaggagacgcgggucguguuccgccagaucguguccgccgucgccuacgugcacagccagggcuacgcgcaccgggaccugaagccggagaaccugcuguucgacgaguaccacaagcugaagcugaucgacuucgggcucugcgccaagcccaagggcaacaaggacuaccaccuccagaccugcugcgggucccuggccuacgccgcgcccgagcucauccagggcaagagcuaccugggguccgaggccgacguguggagcaugggcauccugcucuacguccugaugugcggcuuccugccguucgacgacgacaacgugauggcccucuacaagaagaucaugcgcgggaaguacgacgugcccaaguggcugucccccagcuccauccugcuccugcagcagaugcugcaggucgaccccaagaagcggaucagcaugaagaaccuccugaaccacccguggaucaugcaggacuacaacuaccccguggaguggcaguccaagaaccccuucauccaccuggacgacgacugcgugaccgagcucagcguccaccaccgcaacaaccggcagaccauggaggaccugaucucccuguggcaguacgaccaccucacggccaccuaccugcugcuccuggccaagaaggcgcgcggcaagcccgugcggcugcgccucagcuccuucagcugcgggcaggccuccgccaccccguucaccgacaucaaguucacgaaguacuggaccgagagcaacggcguggagagcaagucccugacccccgcccugugccggacccccgccaacaagcucaagaacaaggagaacgucuacacgcccaagagcgcggugaagaacgaggaguacuucauguucccggagcccaagacccccgugaacaagaaccagcacaagcgcgagauccugaccacccccaaccgguacacgaccccguccaaggcccgcaaccagugccugaaggagacccccaucaagauccccgucaacagcaccggcacggacaagcugaugaccggggugaucucccccgagcggcgcugccggagcguggagcucgaccugaaccaggcccacauggaggagaccccgaagcgcaagggcgccaaggucuucgggucccuggagcggggccucgacaaggugaucaccguccugacgcgcagcaagcgcaagggguccgcccgggacggcccccgccggcugaagcuccacuacaacgugaccaccacccgccuggugaaccccgaccagcugcucaacgagaucaugagcauccugcccaagaagcacgucgacuucgugcagaagggcuacacgcugaagugccagacccaguccgacuucgggaaggugaccaugcaguucgagcucgaggucugccagcugcagaagccggacguggugggcauccggcgccagcggcugaagggggacgcgugggucuacaagcgccucguggaggacauccugagcuccugcaagguguga

SEQ ID NO: 32850 - RNA, 825 nt, Artificial Sequence
  derived and/or modified sequence opt1 from MEMO1__Homo_sapiens__NP_001131074
augagcaaccgcguggucugccgggaggccucccacgccggcagcugguacaccgcguccgggccccagcugaacgcccagcucgagggcuggcugagccaggugcaguccaccaagcgcccggcccgggccaucaucgcgccccgccggaucuucauccuggggcccagccaccacgugccccucucccgcugcgcccugagcuccgucgacaucuaccggacgccgcuguacgaccuccgcaucgaccagaagaucuacggcgagcuguggaagaccgggauguucgagcggaugagccugcagaccgacgaggacgagcacuccaucgagaugcaccuccccuacaccgccaaggccauggagagccacaaggacgaguucacgaucauccccgugcuggugggcgcccuguccgagagcaaggagcaggaguucggcaagcuguucuccaaguaccucgcggaccccagcaaccuguucgucguguccagcgacuucugccacugggggcagcgcuuccgguacuccuacuacgacgagagccagggcgagaucuaccgcagcaucgagcaccucgacaagauggggauguccaucaucgagcagcuggacccggugagcuucuccaacuaccugaagaaguaccacaacaccaucugcggccggcaccccaucgggguccuccugaacgccaucaccgagcugcagaagaacggcaugaacaugagcuucuccuuccucaacuacgcccagagcucccagugccgcaacuggcaggacagcuccgugagcuacgccgccggcgcgcugaccgugcacuga

SEQ ID NO: 32851 - RNA, 1833 nt, Artificial Sequence
  derived and/or modified sequence opt1 from MEN1__Homo_sapiens__NP_570711
augggccugaaggccgcccagaagacccucuucccccugcgcagcaucgacgacgugguccggcuguucgcggccgagcucgggcgcgaggagcccgaccuggugcugcucucccuggugcugggcuucgucgagcacuuccucgccgugaaccgggugauccccaccaacguccccgagcugacguuccagcccagccccgcccccgacccgcccgggggccugaccuacuuccccguggccgaccucuccaucaucgcggcccuguacgcccgcuucaccgcccagauccgcggggcgguggaccugagccucuacccccgggagggcggcgucuccagccgggagcuggugaagaagguguccgacgucaucuggaacagccugucccgcagcuacuucaaggaccgggcccacauccagucccucuucagcuucaucaccgggacgaagcuggacuccagcggcguggccuucgccguggucggggccugccaggcgcugggccuccgcgacgugcaccuggcccuguccgaggaccacgccuggguggucuucgggcccaacggcgagcagaccgccgaggugaccuggcacggcaaggggaacgaggaccggcgcggccagaccgugaacgccggggucgcggagcggagcuggcucuaccugaagggcuccuacaugcgcugcgaccggaagauggagguggccuucauggugugcgccaucaaccccagcaucgaccugcacacggacucccucgagcugcugcagcuccagcagaagcugcuguggcuccuguacgaccugggccaccucgagcgcuacccgauggcccuggggaaccuggccgaccucgaggagcuggagcccacccccggccggcccgacccgcugacccucuaccacaaggggaucgcgagcgccaagaccuacuaccgcgacgagcacaucuaccccuacauguaccuggccggcuaccacugccggaaccgcaacguccgggaggcccugcaggccugggcggacacggccaccgugauccaggacuacaacuacugccgcgaggacgaggagaucuacaaggaguucuucgaggucgccaacgacgugauccccaaccuccugaaggaggccgcgagccugcucgaggccggggaggagcgccccggcgagcagucccagggcacccagagccagggguccgcccugcaggacccggagugcuucgcccaccuccugcgguucuacgacggcaucugcaagugggaggaggggagccccacccccgugcugcacgucggcugggccacguuccuggugcagucccuggggcgcuucgagggccaggugcggcagaagguccgcaucgugagccgggaggcggaggccgccgaggccgaggagcccuggggcgaggaggcccgcgaggggcggcgccggggcccgcgccgggaguccaagcccgaggagcccccgccgcccaagaagcccgcgcucgacaaggggcugggcaccgggcagggcgccgugagcggcccgccccgcaagccgcccgggaccgucgccggcaccgcccgggggcccgagggcggcuccacggcccaggugcccgcgcccgccgccagcccgccgcccgaggggcccgugcugaccuuccaguccgagaagaugaagggcaugaaggagcuccuggucgccaccaagaucaacagcuccgcgaucaagcugcagcucaccgcccagagccaggugcagaugaagaagcagaagguguccacgcccagcgacuacacccuguccuuccugaagcgccagcggaaggggcucuga

SEQ ID NO: 32852 - RNA, 420 nt, Artificial Sequence
  derived and/or modified sequence opt1 from MEOX1__Homo_sapiens__NP_001035091
augggcaccagcucccuggggcucguggacaccacgggcgggcccggcgacgacuacgggguccugggcagcaccgccaacgagaccgagaagaaguccagccgccggcgcaaggaguccagcgacaaccaggagaaccggggcaagccggagggguccagcaaggcccgcaaggagcggaccgcguucacgaaggagcagcugcgcgagcucgaggccgaguucgcccaccacaacuaccugacccggcugcgccgguacgagaucgccgugaaccucgaccuguccgagcgccaggugaaggucugguuccagaaccggcgcaugaaguggaagcgggugaagggcgggcagcccaucagccccaacggccaggaccccgaggacggggacuccaccgccagcccguccagcgaguga

SEQ ID NO: 32853 - RNA, 915 nt, Artificial Sequence
  derived and/or modified sequence opt1 from MEOX2__Homo_sapiens__NP_005915
auggagcacccccuguucggcugccuccgcagcccgcacgccaccgcccaggggcugcaccccuucucccagagcucccuggcgcuccacggccggagcgaccacauguccuaccccgagcugagcaccuccagcuccagcugcaucaucgccggguaccccaacgaggagggcauguucgccucccagcaccaccgcgggcaccaccaccaccaccaccaccaccaccaccaccaccaccagcagcagcagcaccaggcccugcagacgaacuggcaccucccgcagaugagcuccccgcccagcgccgcgcggcacucccugugccugcagcccgacagcggcggcccgcccgagcucggguccagcccgcccgugcugugcuccaacagcagcucccugggcagcuccacccccaccggggccgccugcgcccccggcgacuacgggcgccaggcgcucagccccgccgaggccgagaagcgguccggcggcaagcgcaagagcgacuccagcgacucccaggaggggaacuacaagagcgaggucaacuccaagccccggaaggagcgcaccgccuucacgaaggagcagauccgggagcuggaggccgaguucgcgcaccacaacuaccugacccgccuccggcgcuacgagaucgccgugaaccuggaccugaccgagcgccaggugaaggucugguuccagaaccggcggaugaaguggaagcgcgugaagggcgggcagcagggcgccgccgcccgggagaaggagcucgugaacgucaagaagggcacccugcugcccagcgagcucuccgggaucggcgcggccacgcugcagcagaccggggacagcaucgccaacgaggacucccacgacagcgaccacuccagcgagcacgcccaccuguga

SEQ ID NO: 32854 - RNA, 2241 nt, Artificial Sequence
  derived and/or modified sequence opt1 from MEP1A__Homo_sapiens__NP_005579
auggccuggauccgcagcacgugcauccuguucuucacccuccuguucgcccacaucgcggccgugcccaucaaguaccugccggaggagaacguccacgacgccgacuucggcgagcagaaggacaucuccgagaucaaccucgccgccgggcuggaccuguuccagggcgacauccuccugcagaagucccggaacgggcugcgcgaccccaacacccgguggaccuuccccauccccuacauccucgcggacaaccugggccugaacgccaagggggccauccucuacgccuucgagauguuccgccugaaguccugcguggacuucaagccguacgagggcgagagcuccuacaucaucuuccagcaguucgacggcugcuggagcgaggugggggaccagcacgucggccagaacaucuccaucgggcagggcugcgcguacaaggccaucaucgagcacgagauccugcacgcccucggguucuaccacgagcagagccggaccgaccgcgacgacuacgugaacaucuggugggaccagauccuguccggcuaccagcacaacuucgacaccuacgacgacagccugaucacggaccucaacacccccuacgacuacgagucccugaugcacuaccagcccuucagcuucaacaagaacgccuccgugcccaccaucaccgccaagaucccggaguucaacagcaucaucggccagcggcuggacuucuccgcgaucgaccucgagcgccugaaccggauguacaacugcacgaccacccacacccugcucgaccacugcacguucgagaaggccaacaucugcgggaugauccagggcacccgcgacgacaccgacugggcccaccaggacagcgcccaggccggggaggucgaccacacccugcugggccagugcacgggcgcgggguacuucaugcaguucuccaccagcuccggcagcgccgaggaggccgcccuccuggagagccggauccuguaccccaagcgcaagcagcagugccuccaguucuucuacaagaugaccgggucccccagcgaccggcuggugguguggguccgccgggacgacuccaccggcaacgugcgcaagcuggugaagguccagacguuccagggggacgacgaccacaacuggaagaucgcccacguggugcucaaggaggagcagaaguuccgguaccuguuccagggcaccaagggcgacccccagaacagcaccgggggcaucuaccuggacgacaucacccucacggagaccccgugccccaccggggucuggaccgugcgcaacuucucccaggugcuggagaacacgagcaagggcgacaagcugcagagcccccgguucuacaacagcgagggguacggcuucggcgucacccucuaccccaacucccgcgagagcuccggguaccugcggcuggcguuccacgugugcagcggcgagaacgacgccauccucgaguggccgguggagaaccgccaggucaucaucaccauccuggaccaggagcccgacgugcgcaaccggauguccagcuccaugguguucaccacgagcaagucccacaccagccccgccaucaacgacaccgucaucugggaccgccccucccggguggggaccuaccacacggacugcaacugcuuccgcagcaucgaccugggcuggagcggguucaucucccaccagaugcucaagcggcgcagcuuccugaagaacgacgaccugaucaucuucgucgacuucgaggacaucacccaccucucccagaccgaggugccgaccaagggcaagcggcugagcccccagggccugauccugcaggggcaggagcagcaggucuccgaggagggcagcgggaaggccaugcucgaggaggcccugcccgugucccugagccagggccagcccucccgccagaagcggagcguggagaacaccggcccgcucgaggaccacaacuggccccaguacuuccgcgaccccugcgaccccaacccgugccagaacgacgggaucugcgugaacgucaagggcauggcguccugccggugcaucagcgggcacgccuucuucuacacgggcgagcgcugccaggccguccaggugcacggguccgugcugggcauggugaucggcgggaccgccggcgugaucuuccugaccuucagcaucaucgcgauccucucccagcggccccgcaaguga

SEQ ID NO: 32855 - RNA, 1578 nt, Artificial Sequence
  derived and/or modified sequence opt1 from MEPE__Homo_sapiens__NP_001171623
augcgcguguucugcgucggccugcuccuguucagcgugaccugggccgcccccaccuuccagccgcagacggagaagaccaagcaguccugcguggaggagcagcggcaggaggagaagaacaaggacaacaucggguuccaccaccugggcaagcgcaucaaccaggagcucagcuccaaggagaacaucguccaggagcggaagaaggaccugagccuguccgaggcgagcgagaacaagggguccagcaagucccagaacuacuucaccaaccgccagcggcucaacaaggaguacagcaucuccaacaaggagaacacccacaacggccugcgcaugagcaucuaccccaaguccacggggaacaagggcuucgaggacggcgacgacgccaucagcaagcugcacgaccaggaggaguacggggccgcccucauccggaacaacaugcagcacaucaugggccccgugaccgccaucaagcugcugggggaggagaacaaggagaacacgccccgcaacgugcucaacaucaucccggcguccaugaacuacgccaaggcccacagcaaggacaagaagaagccccagcgggacucccaggcccagaagucccccgucaagagcaagagcacccaccgcauccagcacaacaucgacuaccugaagcaccugagcaaggugaagaagauccccuccgacuucgagggcagcggguacaccgaccuccaggagcggggcgacaacgacaucuccccguucagcggcgacgggcagcccuucaaggacauccccggcaagggggaggcgaccggccccgaccuggagggcaaggacauccagaccggguucgccggcccguccgaggccgagagcacccaccuggacacgaagaagcccggguacaacgagauccccgagcgcgaggagaacggcgggaacaccaucggcacccgggacgagaccgccaaggaggccgacgcgguggacgucucccucguggagggcagcaacgacaucaugggguccacgaacuucaaggagcugcccggccgcgaggggaaccggguggacgccggcagccagaacgcccaccaggggaaggucgaguuccacuacccgcccgcccccuccaaggagaagcgcaaggagggcagcuccgacgccgcggagagcaccaacuacaacgagauccccaagaacggcaagggguccacccggaagggcguggaccacagcaaccgcaaccaggccacccugaacgagaagcagcgguucccguccaagggcaagagccaggggcuccccauccccucccgcgggcuggacaacgagaucaagaacgagauggacagcuucaacggccccagccacgagaacaucaucacgcacggccggaaguaccacuacgugccgcaccgccagaacaacuccacccgcaacaaggggaugccccagggcaaggggagcuggggccggcagccccacuccaaccgccgguucagcucccgccggcgcgacgacagcuccgagagcuccgacagcggcuccagcuccgagagcgacggggacuga

SEQ ID NO: 32856 - RNA, 3000 nt, Artificial Sequence
  derived and/or modified sequence opt1 from MERTK__Homo_sapiens__NP_006334
augggccccgccccgcugccccuccugcugggccucuuccugcccgcccuguggcgccgggcgaucaccgaggcccgcgaggaggccaagcccuacccccucuuccccggccccuuccccgggagccugcagaccgaccacacgccgcugcucucccugccccacgccagcggcuaccagcccgcccugauguucucccccacccagccggggcggccccacaccggcaacguggcgaucccccaggucaccagcguggaguccaagccccucccgccccuggccuucaagcacacggugggccacaucauccugagcgagcacaagggggucaaguucaacugcuccaucagcgugcccaacaucuaccaggacaccaccaucuccugguggaaggacggcaaggagcuccugggggcccaccacgccaucacccaguucuaccccgacgacgaggugacggcgaucaucgccagcuucuccaucaccagcguccagcgcuccgacaacggcagcuacaucugcaagaugaagaucaacaacgaggagaucguguccgacccgaucuacaucgaggugcaggggcugccccacuucaccaagcagcccgagagcaugaacgucacccggaacacggccuucaaccugaccugccaggccguggggcccccggagcccgugaacaucuucuggguccagaacuccagccgcgugaacgagcagcccgagaagucccccagcgugcucaccgucccgggccugaccgagauggccguguucagcugcgaggcgcacaacgacaaggggcucacgguguccaagggcguccagaucaacaucaaggccauccccagcccgccgaccgagguguccauccggaacagcaccgcccacuccauccugaucagcugggugcccggguucgacggcuacucccccuuccgcaacugcagcauccaggucaaggaggccgacccccuguccaacggcagcgugaugaucuucaacaccuccgcccucccgcaccuguaccagaucaagcagcugcaggcgcucgccaacuacagcaucgggguguccugcaugaacgagaucggcuggagcgccgucucccccuggauccuggccagcacgaccgagggggcccccuccguggcgccccugaacgucaccguguuccucaacgagagcuccgacaacguggacauccgguggaugaagccgcccaccaagcagcaggacggcgagcuggucggguaccgcaucagccacguguggcagagcgccggcaucuccaaggagcugcucgaggaggugggccagaacgggagccgggcccgcaucuccguccaggugcacaacgccacgugcaccgugcggaucgccgcggucacccgcggcggggugggccccuucagcgaccccgugaagaucuucaucccggcccacgggugggucgacuacgcccccuccagcacccccgcccccggcaacgcggacccggugcugaucaucuucggcugcuucugcggguucauccugaucggccucauccuguacaucucccuggccauccggaagcgcgugcaggagacgaaguucgggaacgccuucaccgaggaggacagcgagcucgucgugaacuacaucgccaagaaguccuucugccggcgcgccaucgagcugacccugcacagccucggcguguccgaggagcugcagaacaagcuggaggacgucgugaucgaccggaaccuccugauccuggggaagauccucggcgagggcgaguucgggagcgugauggagggcaaccugaagcaggaggacgggaccucccugaaggucgcggugaagacgaugaagcuggacaacagcucccagcgcgagaucgaggaguuccucagcgaggccgccugcaugaaggacuucucccaccccaacgugauccggcugcugggcgucugcaucgagaugagcagccagggcauccccaagcccauggugauccucccguucaugaaguacggggaccugcacaccuaccugcucuacucccgccuggagaccggccccaagcacaucccccugcagacccuccugaaguucaugguggacaucgcccuggggauggaguaccucagcaaccgcaacuuccugcaccgggaccuggccgcgcgcaacugcaugcuccgggacgacaugacggucugcguggccgacuucggccuguccaagaagaucuacagcggggacuacuaccgccagggccggaucgccaagaugcccgugaaguggaucgccaucgagucccuggccgaccgcgucuacaccagcaaguccgacgugugggcguucggcgugaccaugugggagaucgccacccgggggaugaccccguaccccggcguccagaaccacgagauguacgacuaccuccugcacgggcaccgccugaagcagcccgaggacugccucgacgagcuguacgagaucauguacagcugcuggcggacggacccgcuggaccgccccaccuucuccgugcuccggcugcagcuggagaagcuccuggagagccugcccgacgugcgcaaccaggccgacgucaucuacgugaacacccagcuccuggaguccagcgagggccuggcccagggguccacccucgcgccccuggaccugaacaucgacccggacagcaucaucgccuccugcacgccccgggccgccaucagcguggucaccgccgaggugcacgacuccaagccccacgagggccgcuacauccucaacggcgggagcgaggagugggaggaccugaccuccgcgcccagcgccgccgugaccgccgagaagaacagcguccugccgggcgagcggcucgugcgcaacgggguguccuggagccacuccagcaugcugccccugggcuccagccuccccgacgagcugcuguucgccgacgacuccagcgagggguccgagguccucauguga

SEQ ID NO: 32857 - RNA, 1089 nt, Artificial Sequence
  derived and/or modified sequence opt1 from MESDC1__Homo_sapiens__NP_072088
auggccagcggcuccgccgggaagcccaccggcgaggcggccagcccggcccccgccuccgccaucgggggcgcgagcucccagccccgcaagcggcuggugagcgucugcgaccacugcaaggggaagaugcagcucguggccgaccugcugcuccuguccagcgaggcccgccccgugcuguucgagggcccggccuccagcggcgcgggggccgaguccuucgagcagugccgggacaccaucaucgcccgcacgaagggccucagcauccugacccacgacguccagucccagcugaacauggggcgguucggcgaggccggggacagccucguggagcugggcgaccugguggucucccucaccgagugcagcgcccacgcggccuaccuggccgccguggccacccccggcgcgcagcccgcccagcccgggcugguggaccgcuaccgggucacgcgcugccggcacgagguggagcagggcugcgccgugcuccgcgccaccccgcuggccgacaugacgccccagcugcuccuggaggucucccaggggcugagccggaaccucaaguuccugaccgacgcgugcgcccuggccuccgacaagagccgcgaccgguucagccgcgagcaguucaagcucggcgugaagugcauguccaccagcgccuccgcccugcuggcgugcgugcgggaggucaagguggcccccagcgagcucgcccgcucccggugcgcccuguucagcggcccccuggugcaggcggucuccgcccucgugggguucgccaccgagccgcaguuccugggccgcgccgccgcggugagcgccgaggggaaggccguccagaccgccauccugggcggggccauguccguggugagcgcgugcguccuccugacccagugccugcgggaccucgcccagcaccccgacggcggcgccaagauguccgaccaccgcgagcggcugcgcaacagcgccugcgccguguccgaggggugcacgcugcucagccaggcgcugcgcgagcgguccagcccccgcacccugcccccggucaacuccaacagcgugaacuga

SEQ ID NO: 32858 - RNA, 705 nt, Artificial Sequence
  derived and/or modified sequence opt1 from MESDC2__Homo_sapiens__NP_055969
auggccgccagccgcugggcgcggaaggccgugguccugcugugcgccuccgaccugcugcuccugcugcuccugcugcccccgcccggcagcugcgccgccgaggggucccccggcacccccgacgagagcaccccgccgccccgcaagaagaagaaggacauccgggacuacaacgacgcggacauggcccgccuccuggagcagugggagaaggacgacgacaucgaggagggggaccugcccgagcacaagcggcccuccgcccccguggacuucagcaagaucgaccccuccaagcccgagagcauccucaagaugacgaagaagggcaagacccugaugauguucgugaccgucuccgggagcccgaccgagaaggagacggaggagaucaccucccuguggcagggcagccucuucaacgccaacuacgacgugcagcgcuucaucgugggcuccgaccgggcgaucuucaugcugcgcgacgggagcuacgccugggagaucaaggacuuccuggucggccaggaccggugcgccgacgugacccucgagggccagguguaccccgggaagggcgggggcuccaaggagaagaacaagaccaagcaggacaaggggaagaagaagaaggagggcgaccucaagagccgcuccagcaaggaggagaaccgggccgggaacaagcgcgaggaccuguga

SEQ ID NO: 32859 - RNA, 1194 nt, Artificial Sequence
  derived and/or modified sequence opt1 from MESP2__Homo_sapiens__NP_001035047
auggcccagagcccgccgccccagucccugcucggccacgaccacuggaucuucgcccagggguggggcugggcggggcacugggacagcaccucccccgccagcuccagcgacuccagcggcuccugccccugcgacggggcccgcggccugccgcagccccagccgcccagcugcuccagccgggccgccgaggcggccgccaccacgccccgccgggcccgcaccggccccgccgggggccagcggcaguccgcgagcgagcgcgagaagcugcggaugcgcacccucgcccgggcccugcacgagcugcgccgguuccucccgcccucccuggcccccgcggggcagagccugaccaagaucgagacgcuccgccuggccauccgguacaucggccaccuguccgccgugcucgggcugagcgaggagucccugcagugccgccggcgccagcggggcgacgccggcagccccugggggugcccccucugccccgaccgcggcccggccgaggcgcagacccaggccgaggggcagggccagggccaggggcagggccaggggcagggccaggggcagggccagggccaggggcagggccaggggcagggccggcgccccgggcuggucagcgccgugcuggccgaggccuccuggggcagccccuccgcgugccccggcgcccaggccgccccggagcggcucgggcgcggcgugcacgacaccgaccccugggccaccccgcccuacugccccaagauccagagcccgcccuacuccagccaggggacgaccuccgacgcgagccuguggaccccgccccagggcugccccuggacccaguccagccccgagccccgcaacccgcccguccccuggacggccgcccccgccacccuggagcucgcggccguguaccaggggcuguccgugagccccgagcccugccugucccucggcgcccccagccugcugccccaccccuccugccagcggcuccagccccagacccccggccgcugcuggagccacuccgccgaggucgugccgaacagcgaggaccaggggcccggcgccgcguuccagcuguccgaggccagcccgccccagagcuccgggcugcgguucagcggcugccccgagcucuggcaggaggaccuggagggcgcccgccuggggaucuucuacuga

SEQ ID NO: 32860 - RNA, 879 nt, Artificial Sequence
  derived and/or modified sequence opt1 from MEST__Homo_sapiens__NP_001240831
augcgcgaguggugggugcaggucggccugcucgccgugccccugcuggccgcguaccuccacaucccgccgccccagcugagccccgcccugcacuccuggaaguccagcgggaaguucuucaccuacaagggccuccggaucuucuaccaggacagcgugggggucgugggcucccccgagaucgugguccugcugcacggguuccccaccagcuccuacgacugguacaagaucugggagggccucacgcugcgcuuccaccgggugaucgcccuggacuuccucggcuucggguucagcgacaagccccgcccccaccacuacuccaucuucgagcaggccagcaucguggaggcccugcugcggcaccucggccugcagaaccgccggaucaaccugcucucccacgacuacggggacaucgucgcgcaggagcugcuguaccgcuacaagcagaaccggagcggccgccucaccaucaagucccugugccugagcaacgggggcaucuucccggagacccaccggccccuccugcugcagaagcuccugaaggacggcggggugcugucccccauccucacccgccugaugaacuucuucguguucagccggggccugcuccaguacaucaaccagcgcaagaaguuccggcgccggugggucggggcccuggccuccgugacgauccccauccacuucaucuacggcccgcuggaccccgugaaccccuaccccgaguuccucgagcuguaccgcaagacccugccgcggagcaccgucuccauccucgacgaccacaucagccacuacccccagcuggaggaccccaugggcuuccugaacgccuacaugggguucaucaacagcuucuga

SEQ ID NO: 32861 - RNA, 1008 nt, Artificial Sequence
  derived and/or modified sequence opt1 from METAP1D__Homo_sapiens__NP_954697
auggccgcccccagcggcgugcaccuccugguccgccgggggucccaccgcaucuucagcuccccgcugaaccacaucuaccugcacaagcagagcuccagccagcagcggcgcaacuucuucuuccggcgccagcgggacaucucccacagcaucgugcuccccgcggccguguccagcgcccaccccguccccaagcacaucaagaagccggacuacgugaccaccggcaucgugcccgacuggggcgacuccaucgaggucaagaacgaggaccagauccaggggcugcaccaggccugccagcuggcccgccacgugcuccugcuggcgggcaagagccucaagguggacaugacgaccgaggagaucgacgcccugguccaccgggagaucaucucccacaacgccuaccccagcccccugggguacggcggguucccgaaguccgugugcaccagcgugaacaacguccucugccacggcauccccgacucccgcccccugcaggacggggacaucaucaacaucgacgugaccguguacuacaacggcuaccacggggacacgagcgagaccuuccuggucggcaacguggacgagugcggcaagaagcucguggaggucgcccggcgcugccgggacgaggcgaucgccgccugccgcgccggggcccccuucuccgugaucggcaacaccaucagccacaucacccaccagaacggguuccaggugugcccgcacuucgucggccacggcaucgggagcuacuuccacggccaccccgagaucuggcaccacgcgaacgacuccgaccugcccauggaggaggggauggccuucacgaucgagcccaucaucaccgagggcagcccggaguucaaggugcuggaggacgccuggaccguggucucccucgacaaccagcggagcgcccaguucgagcacaccgugcugaucacgucccgcggggcccagauccugaccaagcucccccacgaggcguga

SEQ ID NO: 32862 - RNA, 1161 nt, Artificial Sequence
  derived and/or modified sequence opt1 from METAP1__Homo_sapiens__NP_055958
auggccgccguggagacccgcgucugcgagaccgacggcugcagcuccgaggcgaagcugcagugccccacgugcaucaagcucgggauccagggcagcuacuucugcucccaggagugcuucaaggggagcugggccacccacaagcugcugcacaagaaggccaaggacgagaaggccaagcgggagguguccagcuggaccguggagggcgacaucaacaccgacccgugggccggguaccgcuacacgggcaagcuccggccccacuacccccugaugcccacccgcccgguccccuccuacauccagcggcccgacuacgcggaccacccccugggcaugagcgaguccgagcaggcccucaaggggaccagccagaucaagcugcuguccagcgaggacaucgagggcaugcgccucgugugccggcuggcccgcgaggugcuggacgucgccgcggggaugaucaagccgggcgugaccacggaggagaucgaccacgccgugcaccucgccugcaucgcccggaacugcuaccccagcccccugaacuacuacaacuuccccaagagcugcugcaccuccgucaacgaggugaucugccacgggaucccggaccgccggccccugcaggagggcgacaucgugaacgucgacaucacccucuaccgcaacggcuaccacggggaccugaacgagaccuucuucgugggcgagguggacgacggggcccggaagcugguccagacgaccuacgagugccucaugcaggcgaucgacgccgugaagcccggcgugcgcuaccgggagcugggcaacaucauccagaagcacgcccaggccaacggguucagcgucgugcgcuccuacugcggccacgggauccacaagcuguuccacaccgcccccaacgugccgcacuacgcgaagaacaaggccgucggcgugaugaaguccgggcacguguucaccaucgagcccaugaucugcgagggcggcuggcaggacgagacguggcccgacggguggaccgccgucacccgggacggcaagcgcuccgcccaguucgagcacacccuccuggugacggacaccgggugcgagauccugacccggcgccucgacagcgcccggccccacuucaugagccaguucuga

SEQ ID NO: 32863 - RNA, 1437 nt, Artificial Sequence
  derived and/or modified sequence opt1 from METAP2__Homo_sapiens__NP_006829
auggccggcguggaggaggucgccgcgagcgggucccaccugaacggcgaccucgaccccgacgaccgggaggagggggccgccagcaccgccgaggaggccgcgaagaagaagcggcgcaagaagaagaaguccaagggccccagcgccgccggggagcaggagcccgacaaggaguccggcgccagcguggacgagguggcgcggcagcuggagcgcuccgcccuggaggacaaggagcgggacgaggacgacgaggacggcgacggggacggcgacggggccaccggcaagaagaagaagaagaagaagaagaagcgcgggcccaagguccagacggacccgcccagcgugcccaucugcgaccucuaccccaacggcguguuccccaagggccaggagugcgaguacccgcccacccaggacgggcggaccgccgccuggcgcaccacguccgaggagaagaaggcgcuggaccaggccagcgaggagaucuggaacgacuuccgggaggccgccgaggcccaccgccagguccggaaguacgugauguccuggaucaagcccggcaugaccaugaucgagaucugcgagaagcuggaggacugcagccgcaagcucaucaaggagaacgggcugaacgcgggccuggccuuccccaccggcugcucccucaacaacugcgccgcccacuacaccccgaacgccggggacacgaccgugcugcaguacgacgacaucugcaagaucgacuucggcacccacaucagcgggcggaucaucgacugcgcguucaccgucacguucaaccccaaguacgacacccugcucaaggccgugaaggacgccaccaacaccggcaucaagugcgccgggaucgacgugcgccugugcgacgucggcgaggccauccaggaggugauggaguccuacgagguggagaucgacggcaagacguaccaggucaagcccauccggaaccugaacgggcacagcaucggccaguaccgcauccacgcggggaagaccgugcccaucgugaagggcggggaggccacccggauggaggagggcgaggucuacgccaucgagaccuucggcuccacggggaagggcguggugcacgacgacauggagugcagccacuacaugaagaacuucgacgucgggcacgugccgauccgccucccccggaccaagcaccuccugaacgugaucaacgagaacuucggcacccuggccuucugccgccgguggcuggaccgccugggggaguccaaguaccucauggcgcugaagaaccugugcgaccucggcaucgucgaccccuacccgccccugugcgacaucaagggcagcuacaccgcccaguucgagcacacgauccugcuccgcccgaccugcaaggagguggucagccgcggggacgacuacuga

SEQ ID NO: 32864 - RNA, 4173 nt, Artificial Sequence
  derived and/or modified sequence opt1 from MET__Homo_sapiens__NP_000236
augaaggcccccgccgugcuggcgccgggcauccucguccugcuguucacccucgugcagcgcagcaacggggagugcaaggaggcccuggccaaguccgagaugaacgugaacaugaaguaccagcugcccaacuucaccgccgagacgcccauccagaacgucauccuccacgagcaccacaucuuccugggcgccaccaacuacaucuacgugcugaacgaggaggaccuccagaagguggcggaguacaagaccgggcccguccuggagcacccggacugcuuccccugccaggacugcagcuccaaggccaaccugagcggcgggguguggaaggacaacaucaacauggcccucguggucgacaccuacuacgacgaccagcugaucuccugcggcagcgugaaccggggcacgugccagcgccacguguucccccacaaccacaccgccgacauccaguccgagguccacugcaucuucagcccccagaucgaggagccgucccagugccccgacugcguggugagcgcgcugggggccaagguccucuccagcgugaaggaccgguucaucaacuucuucgugggcaacaccaucaacuccagcuacuuccccgaccacccccugcacuccaucagcguccgccggcugaaggagaccaaggacggguucauguuccucacggaccaguccuacaucgacgugcugccggaguuccgcgacagcuaccccaucaaguacgugcacgccuucgaguccaacaacuucaucuacuuccugaccguccagcgggagacccucgacgcccagaccuuccacacgcgcaucauccgguucugcagcaucaacagcggccugcacuccuacauggagaugccccuggagugcauccucaccgagaagcgcaagaagcggagcaccaagaaggagguguucaacauccugcaggccgcguacguguccaagcccggggcccagcuggcccgccagaucggcgccagccucaacgacgacauccuguucggcgucuucgcccaguccaagccggacagcgcggagcccauggaccgguccgccaugugcgccuuccccaucaaguacgugaacgacuucuucaacaagaucgucaacaagaacaacgugcgcugccugcagcacuucuacgggcccaaccacgagcacugcuucaaccggacccuccugcgcaacagcuccggcugcgaggcccggcgcgacgaguaccggacggaguucaccaccgcccugcagcgcguggaccucuucauggggcaguucagcgagguccugcugaccuccaucagcacguucaucaagggcgaccucaccaucgcgaaccugggcaccuccgaggggcgguucaugcaggucguggugagccgcuccggcccgagcacgccccacgugaacuuccugcucgacucccaccccgugagccccgaggucaucguggagcacacccugaaccagaacggguacacccuggugaucaccggcaagaagaucaccaagaucccgcucaacgggcugggcugccgccacuuccaguccugcagccagugccugagcgccccgcccuucguccagugcggcuggugccacgacaagugcgugcgguccgaggagugccucagcgggacguggacccagcagaucugccugcccgccaucuacaagguguuccccaacuccgcgccccuggagggcgggacccgccucaccaucugcggcugggacuucggguuccggcgcaacaacaaguucgaccugaagaagacgcggguccugcugggcaacgagagcugcacccucacccuguccgagagcaccaugaacacgcugaagugcaccgugggccccgccaugaacaagcacuucaacauguccaucaucaucagcaacgggcacggcaccacccaguacuccaccuucagcuacguggacccggucaucacguccaucagccccaaguacgggcccauggccggcgggacccuccugacccugaccggcaacuaccucaacuccggcaacagccgccacaucuccaucgggggcaagacgugcacccucaagagcguguccaacagcauccuggagugcuacacccccgcccagaccaucagcacggaguucgccgugaagcugaagaucgaccuggccaaccgggagaccuccaucuucagcuaccgcgaggacccgaucgucuacgagauccaccccaccaaguccuucaucagcgggggcuccaccaucacgggcguggggaagaaccugaacagcguguccgucccccggauggugaucaacgugcacgaggcgggccgcaacuucaccgucgccugccagcaccggagcaacuccgagaucaucugcugcaccacccccagccuccagcagcugaaccugcagcucccgcugaagacgaaggccuucuucaugcuggacgggauccucuccaaguacuucgaccugaucuacgugcacaaccccguguucaagcccuucgagaagcccgucaugaucagcaugggcaacgagaacgugcuggagaucaaggggaacgacaucgacccggaggccgugaagggcgagguccucaaggugggcaacaaguccugcgagaacauccaccuccacagcgaggccgugcugugcaccguccccaacgaccugcugaagcugaacuccgagcucaacaucgaguggaagcaggcgaucagcuccaccgugcuggggaaggugaucguccagcccgaccagaacuucaccggccugaucgccgggguggugagcaucuccacggcccuccugcugcuccugggcuucuuccuguggcucaagaagcgcaagcagaucaaggaccuggggagcgagcugguccgguacgacgcccgcgugcacacgccccaccucgaccggcuggugagcgcccgcuccgucagcccgaccaccgagaugguguccaacgagagcguggacuaccgggcgaccuuccccgaggaccaguuccccaacuccagccagaacggcuccugccgccagguccaguacccccugaccgacaugagcccgauccucaccuccggcgacagcgacaucuccagcccccugcugcagaacaccgugcacaucgaccucuccgcccugaaccccgagcuggugcaggccguccagcacguggucaucgggcccagcucccucaucgugcacuucaacgaggugaucggccgggggcacuucggcugcgucuaccacgggacgcugcuggacaacgacggcaagaagauccacugcgccgucaagagccucaaccgcaucaccgacaucggcgaggugucccaguuccugaccgaggggaucaucaugaaggacuucagccacccgaacgugcugucccuccugggcaucugccugcgcagcgaggggagcccccucguggugcugcccuacaugaagcacggcgaccugcggaacuucauccgcaacgagacccacaacccgacggucaaggaccucaucggguucggccuccagguggccaagggcaugaaguaccuggcguccaagaaguucgugcaccgggaccuggccgcccgcaacugcaugcuggacgagaaguucaccgucaagguggccgacuucgggcuggcgcgggacauguacgacaaggaguacuacagcgugcacaacaagaccggcgccaagcuccccgucaaguggauggcccuggagucccugcagacccagaaguucacgaccaagagcgacgugugguccuucggggugcuccugugggagcugaugacccgcggcgccccgcccuaccccgacgucaacaccuucgacaucaccguguaccuccugcagggccggcgccugcuccagcccgaguacugccccgacccccuguacgaggugaugcugaagugcuggcacccgaaggccgagaugcggcccagcuucuccgagcucgucagccgcaucuccgcgaucuucagcacguucaucggggagcacuacgugcacgugaacgccaccuacgucaacgugaagugcguggcccccuaccccucccugcugagcuccgaggacaacgccgacgacgaggucgacacccggccggccagcuucugggagaccuccuga

SEQ ID NO: 32865 - RNA, 882 nt, Artificial Sequence
  derived and/or modified sequence opt1 from METRN__Homo_sapiens__NP_076947
augggcuuccccgccgccgcgcugcugugcgcccugugcugcgggcugcucgcccccgccgcccgcgcgggcuacagcgaggagcggugcuccuggcgcgggagcggccugacccaggagcccggguccgugggccagcuggcccucgccugcgccgagggcgcggucgaguggcuguaccccgccggggcccugcggcucacccugggcgggcccgacccgcgcgcccggcccggcaucgccugccugcgccccgugcggcccuucgcgggggcccagguguucgccgagcgcgccggcggcgcccucgagcugcugcucgcggaggggccgggccccgccgggggccggugcguccgcuggggcccccgggagcgccgggcccuguuccugcaggccacgccccaccaggacaucagccgccggguggccgcguuccgcuucgagcuccgggaggacgggcgcccggagcugccgccccaggcccacggccuggggguggacggcgccugccggcccugcuccgacgccgagcuccugcuggccgcgugcaccagcgacuucgucauccacgggaucauccacggcgugacccacgacguggagcuccaggaguccgucaucaccgugguggccgcccgcguccugcggcagacgccgccccuguuccaggccggccgcagcggggaccagggccucaccuccauccgcaccccgcugcggugcggggugcaccccggccccgggaccuuccuguucaugggcuggagccgcuucggcgaggcgcggcucgggugcgcgccccgcuuccaggaguuccggcgcgccuacgaggccgcccgggccgcccaccuccaccccugcgagguggcccugcacuga

SEQ ID NO: 32866 - RNA, 1632 nt, Artificial Sequence
  derived and/or modified sequence opt1 from METTL13__Homo_sapiens__NP_001007240
augaaccugcuccccaagagcucccgcgaguucggcagcguggacuacugggagaaguucuuccagcagcgggggaagaaggccuucgagugguacggcaccuaccuggagcugugcgggguccuccacaaguacaucaagccgcgcgagaaggugcuggugaucggcugcgggaacuccgagcugagcgagcagcucuacgacgucggcuaccgggacaucgugaacaucgacaucuccgagguggucaucaagcagaugaaggagugcaacgccacccgccggccccagaugagcuuccugaagauggacaugacgcagauggaguuccccgacgcguccuuccagguggugcuggacaagggcacccucgacgccguccugaccgacgaggaggagaagacccugcagcaggucgaccgcaugcucgccgagguggggcgggugcugcagggccgcgagacggaguggcuguucgggauggacgagggccggaagcagcucgccgccagcgcgggguuccgccggcugaucaccguggcccugcaccgcggccagcaguacgaguccauggaccacauccaggccgagcucagcgcccgggugauggagcuggcgcccgccggcaugccgacccagcagcagguccccuuccuguccgucgggggcgacaucggggugcgcaccgugcagcaccaggacugcagcccccucuccggcgacuacgugaucgaggacgugcagggcgacgacaagcgguacuuccgccggcugaucuuccugagcaaccgcaacgucgugcaguccgaggcccggcuccugaaggacgugagccacaaggcccagaagaagcgcaagaaggaccggaagaagcagcgccccgccgacgcggaggaccugccggccgcccccgggcaguccaucgacaagagcuaccucugcugcgagcaccacaaggccaugaucgccggccuggcgcugcuccgcaaccccgagcugcugcucgagaucccccuggcccugcucgucguggggcugggcgggggcucccugccccucuucguccacgaccacuuccccaagagcugcaucgacgccguggagaucgaccccagcaugcuggagguggccacgcagugguucggcuucucccagagcgaccggaugaagguccacaucgccgacgggcuggacuacaucgcgucccucgccggcgggggcgaggcccgccccugcuacgacgugaucauguucgacguggacagcaaggacccgacccuggggauguccugcccgccgcccgccuucgucgagcagagcuuccugcagaaggugaaguccauccucacccccgagggcguguucauccugaaccuggucugccgggaccucggccugaaggacagcgugcuggccgggcugaaggcgguguucccccuccuguacguccgccggaucgagggcgaggugaacgagauccuguucugccagcuccaccccgagcagaagcuggccacccccgagcugcucgagacggcccaggcccuggagcgcacccugcggaagccggggcgcggcugggacgacaccuacgugcucuccgacaugcugaagaccgucaagaucguguga

SEQ ID NO: 32867 - RNA, 1689 nt, Artificial Sequence
  derived and/or modified sequence opt1 from METTL16__Homo_sapiens__NP_076991
auggcccugagcaaguccaugcacgcccgcaaccgguacaaggacaagcccccggacuucgcguaccucgccagcaaguaccccgacuucaagcagcacgugcagaucaaccugaacggccgcgucucccugaacuucaaggaccccgaggccgugcgggcccugaccugcacccugcugcgcgaggacuucgggcucagcaucgacaucccccuggagcggcugaucccgacggugccccuccgccugaacuacauccacugggucgaggaccugaucggccaccaggacuccgacaagagcacccuccggcgcgggaucgacaucggcaccggggccuccugcaucuacccccugcugggcgcgacccucaacggcugguacuuccuggccacggagguggacgacaugugcuucaacuacgccaagaagaacguggagcagaacaaccugagcgaccucaucaaggucgugaaggugccccagaagacccugcugauggacgcccucaaggaggaguccgagaucaucuacgacuucugcaugugcaacccgcccuucuucgcgaaccagcuggaggccaagggggucaacagccggaacccccgccggcccccgcccuccagcgugaacaccggcgggaucaccgagaucauggccgagggcggggagcuggaguucgugaagcgcaucauccacgacucccuccagcugaagaagcggcugcgcugguacagcugcaugcucggcaagaagugcucccuggcgccccugaaggaggagcuccggauccagggcguccccaaggugacguacaccgaguucugccaggggcgcaccaugcggugggcccuggccuggagcuucuacgacgacgugaccgucccguccccgcccagcaagcgccggaagcuggagaagccccgcaagcccaucacguucguggugcucgccuccgucaugaaggagcugagccugaaggccagcccccuccgguccgagaccgccgagggcaucgugguggucaccaccuggaucgagaagauccugacggaccugaaggugcagcacaagcgcgugcccugcgggaaggaggaggucagccucuuccugaccgccaucgagaacuccuggauccaccuccgccggaagaagcgcgagcgggugcgccagcuccgggaggucccccgcgcgccggaggacgugauccaggcccuggaggagaagaagcccacccccaaggagagcggcaacucccaggagcuggcccggggcccccaggagcgcaccccgugcgggcccgcccuccgggagggcgaggccgcggccguggaggggcccugcccgagccaggagucccugagccaggaggagaaccccgagcccacggaggacgagcgcuccgaggagaagggcggggucgaggugcuggagagcugccagggcuccagcaacggcgcccaggaccaggaggccuccgagcaguucgggagccccguggccgagcggggcaagcgccucccgggggucgcgggccaguaccuguucaagugccugaucaacgugaagaaggagguggacgacgcccuggucgagaugcacuggguggaggggcagaaccgggaccucaugaaccagcugugcaccuacauccgcaaccagaucuuccggcugguggccgucaacuga

SEQ ID NO: 32868 - RNA, 1437 nt, Artificial Sequence
  derived and/or modified sequence opt1 from METTL17__Homo_sapiens__NP_001025162
auggccgccgcgcugaagugccuccugacccugggccgcuggugccccgggcucggcguggccccgcaggcccgggcccuggccgcgcugguccccggggugacccagguggacaacaagagcggcuuccuccagaagcgcccccaccggcagcaccccgggauccugaagcugccgcacguccgccucccccaggcccuggccaacggcgcccagcugcuccugcugggcuccgcggggcccaccauggagaaccaggugcagacccucaccagcuaccuguggucccggcaccuccccguggagccggaggagcugcagcgccgggcccgccaccuggagaagaaguuccuggagaaccccgaccucagccagaccgaggagaagcugcggggcgccguccugcacgcccuccgcaagacgaccuaccacuggcaggagcuguccuacaccgaggggcugagccucguguacauggccgcgcggcuggacggcggguucgccgccgugucccgcgccuuccacgagauccgggcccgcaaccccgcguuccagccccagacccugauggacuucggcagcggcacgggguccgucaccugggccgcccacagcaucuggggccagucccuccgggaguacaugugcguggaccgcagcgccgccaugcuggugcuggcggagaagcuccugaagggcggguccgagagcggcgagccguacauccccggggucuucuuccggcaguuccugcccgugucccccaaggugcaguucgacgucguggugagcgccuucucccucagcgagcugccguccaaggccgaccgcaccgaggucgugcagacccuguggcggaagacgggccacuuccucgugcuggucgagaacgggaccaaggccggccacagccugcucauggacgcccgcgaccuggugcugaaggggaaggagaaguccccgcucgacccccggcccggcuucguguucgcgcccugcccccacgagcugcccugcccccagcugaccaaccucgccugcuccuucagccaggccuaccacccgauccccuucuccuggaacaagaagcccaaggaggagaaguucagcauggucauccuggcccgcggcucccccgaggaggcgcaccgcuggccgcggaucacccagcccgugcugaagcgcccccggcacguccacugccaccugugcugcccggacgggcacaugcagcacgccgugcucacggcccgccggcacggccgcuacgggggcugcgaccagaaccagugggacguggccgggagcugcagcccccggcagcaccuguucccccagggcuucgucagccugugccccugccagcuccugggccgcuccuucacgugcgccuacagcgugugcguguccagcaucuacggguccggcagccuguga

SEQ ID NO: 32869 - RNA, 1119 nt, Artificial Sequence
  derived and/or modified sequence opt1 from METTL18__Homo_sapiens__NP_001307130
augaccuuccaguucaacuucaccaucgaggaccaccuggagaacgagcucacgcccauccgcgacggcgcccugacccuggacagcuccaaggagcucagcguguccgagagccagaagggggaggagcgggaccgcaagugcuccgccgagcaguucgaccugccgcaggaccaccugugggagcacaagagcauggagaacgcggcccccucccaggacaccgacagcccccucuccgccgccagcuccagccggaaccuggagccccacggcaagcagccgucccugcgcgccgcgaaggagcacgccaugcccaaggaccucaagaagaugcuggagaacaaggucaucgagacccugcccggguuccagcacgugaagcucagcguggucaagacgauccugcugaaggagaacuuccccggcgagaacaucguguccaagagcuucuccagccacuccgaccucaucaccgggguguacgagggcggccugaagaucugggagugcaccuucgaccugcucgccuacuucaccaaggccaaggucaaguucgcggggaagaaggugcuggaccugggcugcgggagcggccuccuggggaucacggccuucaagggcggcagcaaggagauccacuuccaggacuacaacuccauggugaucgacgaggucacccugccgaacgugguggccaacagcacccucgaggacgaggagaacgacgucaacgagcccgacgugaagcggugccgcaagcccaaggugacccagcuguacaagugccgguucuucuccggggaguggagcgaguucugcaagcugguccucuccagcgagaagcuguucgugaaguacgaccugauccucacguccgagaccaucuacaaccccgacuacuacagcaaccugcaccagaccuuccugcgccuccuguccaagaacggccgggugcugcucgccagcaaggcccacuacuucggggucggcggcggggugcaccuguuccagaaguucguggaggagcgcgacgucuucaagacccggauccugaagaucaucgacgagggccucaagcgcuucaucaucgagaucacguucaaguucccgggguga

SEQ ID NO: 32870 - RNA, 831 nt, Artificial Sequence
  derived and/or modified sequence opt1 from METTL1__Homo_sapiens__NP_005362
auggccgccgagacccgcaacguggcgggcgccgaggcgcccccgccccagaagcgguacuaccgccagcgggcccacagcaaccccauggccgaccacacccugcgcuaccccgucaagccggaggagauggacugguccgagcucuaccccgaguucuucgcgccccugacgcagaaccagagccacgacgaccccaaggacaagaaggagaagcgggcccaggcccagguggaguucgccgacaucgggugcggcuacgggggccugcucguggagcuguccccgcuguuccccgacacccucauccuggggcuggagauccgcgucaaggugagcgacuacgugcaggaccggauccgcgcccuccgggccgcccccgccggcggcuuccagaacaucgccugccugcgcuccaacgcgaugaagcaccuccccaacuucuucuacaaggggcagcugaccaagauguucuuccuguucccggacccccacuucaagcggaccaagcacaaguggcgcaucaucagccccacgcugcucgccgaguacgccuacguccugcgggugggcgggcugguguacaccaucaccgacguccucgagcugcacgacuggaugugcacccacuucgaggagcacccccuguucgagcgcgugccgcucgaggaccuguccgaggaccccguggucggccaccuggggacgagcaccgaggagggcaagaaggugcuccggaacggcgggaagaacuuccccgccaucuuccgccggauccaggaccccgugcugcaggccgucaccucccagaccagccugccgggccacuga

SEQ ID NO: 32871 - RNA, 657 nt, Artificial Sequence
  derived and/or modified sequence opt1 from METTL21A__Homo_sapiens__NP_660323
auggcccuggugcccuacgaggagaccaccgaguucggccuccagaaguuccacaagccgcuggccacguucagcuucgcgaaccacaccauccagauccgccaggacuggcggcaccugggggucgccgccguggugugggacgccgccaucguccucuccaccuaccuggagaugggcgcgguggagcugcgcgggcggagcgccguggagcucggcgccgggaccggccuggucggcaucguggccgcgcugcucggggcccacgugacgaucaccgaccgcaaggucgcccuggaguuccugaaguccaacgugcaggccaaccucccgccccacauccagaccaagaccguggucaaggagcugacguggggccagaaccuggggagcuucucccccggcgaguucgaccucauccugggggccgacaucaucuaccuggaggagaccuucaccgaccuccugcagacccuggagcaccucugcagcaaccacuccgugauccugcuggcgugccggauccgcuacgagcgggacaacaacuuccucgccaugcuggagcgccaguucacggugcggaagguccacuacgaccccgagaaggacgugcacaucuacgaggcccagaagcgcaaccagaaggaggaccuguga

SEQ ID NO: 32872 - RNA, 681 nt, Artificial Sequence
  derived and/or modified sequence opt1 from METTL21B__Homo_sapiens__NP_056248
auggccgaccccggcccggaccccgagagcgaguccgagagcguguucccccgcgaggucgggcuguucgccgacuccuacagcgagaagucccaguucugcuucugcggccacgugcucaccaucacccagaacuucgggagccggcugggcguggcggcccgcgucugggacgccgcccugucccucugcaacuacuucgagagccagaacguggacuuccgggggaagaaggugaucgagcugggcgccggcacggggaucgucggcauccuggcggcccuccagggcggggacgugaccaucaccgaccugccccuggcccucgagcagauccaggggaacgugcaggccaacgucccggcgggcggccaggcccaggugcgcgcccuguccugggggaucgaccaccacguguuccccgccaacuacgaccugguccucggcgccgacaucguguaccuggagcccaccuucccccugcuccuggggacgcugcagcaccucugccggccgcacggcaccaucuaccuggcgagcaagaugcgcaaggagcacggcaccgaguccuucuuccagcaccuccugccccagcacuuccagcuggagcuggcccagcgggacgaggacgagaacgugaacaucuaccgcgcccggcaccgcgagccccggcccgccuga

SEQ ID NO: 32873 - RNA, 795 nt, Artificial Sequence
  derived and/or modified sequence opt1 from METTL21C__Homo_sapiens__NP_001010977
auggacgugugccugagcuccgcccagcagcccggccgccgcggggagggccucagcucccccgggggcuggcuggaggccgagaagaagggggcgccgcagaaggacagcaccggcggcgugcuggaggaguccaacaagaucgagcccagccuccacucccugcagaaguucgugcccaccgacuacgccagcuacacgcaggagcacuaccgguucgccgggaaggagaucgugauccaggaguccaucgagagcuacggcgccgucguguggccgggggccauggcgcugugccaguaccucgaggagcacgccgaggagcugaacuuccaggacgccaagauccuggagaucggcgccgggcccggccucguguccaucgucgcgagcauccugggcgcccaggugaccgccaccgaccugcccgacgugcucgggaaccugcaguacaaccugcucaagaacacccugcagugcacggcccaccuccccgaggucaaggagcucguguggggcgaggaccuggacaagaacuucccgaaguccgccuucuacuacgacuacgugcuggcgagcgacgucguguaccaccacuacuuccucgacaagcugcugaccaccaugguguaccucucccagcccgggaccguccugcugugggccaacaaguuccgguucagcacggacuacgaguuccucgacaaguucaagcaggucuucgacaccacccugcuggccgaguaccccgaguccagcgugaagcuguucaagggcauccugaagugggacuga

SEQ ID NO: 32874 - RNA, 1101 nt, Artificial Sequence
  derived and/or modified sequence opt1 from METTL24__Homo_sapiens__NP_001116836
auggcccgcgagcggcccccgggccgcgggugcggcgugcugcggcgcugccuccugggggccguccugcuguucggccugcggcugugcgcggagcuccgccgggccgggcccggcagccccacccgcuccgcgcccccgggccccgccuggcggccgcccgggccccaccucccgcccgcccccggccagccccgcggggccagccggcgccaggugaccuacgugcgguccggccgccgggccccgcccgggggcggcgggagcggcacgcccgagcccgggugcugcgcgccccgcggccggccccgccggaagggcccccgcuggcacaucgaccugcagccgugggccggguccgcccagagccucgacgaggaggccuggcgguuccugcgcuacaucuccaccacccagaucgccugcaaccacaugaacaccgacagccuggccacggacuccagccccacccacaagcccugguccgucugccucgacgaccgcuucaaccuggcccaccagauccggaacaagcagugccgccuguacagccucggccugggguccgacgacacccacuucgaggugagcauggcgaacaacggcugcgaggugcaccgguucgaccccuccgucaagagcgcccacauccuggagucccagcaccucugguaccaccgccugagcaucgacuggcgggacccgcaccccgccguggccgcccagaagccccacuccaacacccgcaagcuggggagcauccucaacgaguucggccaccacaagaucgacgugcugaaggcggaccuggagagcgccgaguggaagguccucgagaaccugauccuggaggacgugcucgagcagaucggccagcugaucuucgagauccaccuccacuggcccggguucgagguguccggcagcgacuccagcgucgugcgguucugguacucccugcugaaggagcuggagcagaaggacuuccgccucuuccacagcuacaaggaccuguccaagccgcagcuguuccucaagaaggacaucuucaacgccagcuccugcuacacgcugagcugggugaacacccgguggaaguga

SEQ ID NO: 32875 - RNA, 723 nt, Artificial Sequence
  derived and/or modified sequence opt1 from METTL6__Homo_sapiens__XP_005264927
auggccagccugcagcgcaagggccuccaggcccggauccugaccuccgaggaggaggagaagcugaagcgcgaccagacccucgugagcgacuucaagcagcagaagcuggagcaggaggcgcagaagaacugggaccuguucuacaagcggaacuccacgaacuucuucaaggaccgccacuggaccacccgggaguucgaggagcuccgcagcugccgggaguucgaggaccagaagcugaccaugcuggaggccgggugcggcgucgggaacugccucuucccccugcuggaggaggaccccaacaucuucgccuacgccugcgacuucagcccccgcgccaucgaguacgugaagcagaacccccucuacgacacggagcggugcaagguguuccagugcgaccugaccaaggacgaccugcucgaccacgugcccccggaguccgucgacguggucaugcugaucuucgugcuguccgcggugcaccccgacaagaugcaccucguccugcagaacaucuacaagugccacggcugcagcuccgagcugcgccagcccugggacaaggacgacuucgccgugaccugggaccccuggagcccggccauccgggugcuccugugccacuccggguggagcgccgucgcguggaccuggcugacggccgccuccaccagcugggcccaggccgugcucccgccccagccccugaaguga

SEQ ID NO: 32876 - RNA, 735 nt, Artificial Sequence
  derived and/or modified sequence opt1 from METTL7A__Homo_sapiens__NP_054752
auggagcugaccaucuucauccuccgccuggccaucuacauccugaccuucccccucuaccugcugaacuuccucggccuguggagcuggaucugcaagaagugguucccguacuuccuggugcgguucacggucaucuacaacgagcagauggccuccaagaagcgcgagcuguucagcaaccuccaggaguucgcggggcccuccggcaagcugagccuccuggagguggggugcggcaccggggccaacuucaaguucuacccgcccggcugccgggugaccugcaucgaccccaaccccaacuucgagaaguuccugaucaaguccaucgccgagaaccgccaccuccaguucgagcgguucgucguggccgccggcgagaacaugcaccagguggcggacgggagcgucgacgugguggucugcacccuggugcugugcuccgugaagaaccaggagcgcauccuccgggaggucugccgcgugcugcggcccggcggggccuucuacuucauggagcacguggccgccgagugcagcacguggaacuacuucuggcagcagguccuggaccccgcguggcaccuccuguucgacggcugcaaccugacccgcgaguccuggaaggcccucgagcgggccagcuucuccaagcugaagcugcagcacauccaggccccgcucagcugggagcuggugcgcccccacaucuacggguacgccgugaaguga

SEQ ID NO: 32877 - RNA, 954 nt, Artificial Sequence
  derived and/or modified sequence opt1 from METTL9__Homo_sapiens__NP_001070648
augcgccugcucgccggcuggcugugccugagccucgccuccguguggcuggcgcggcgcauguggacccugcggagcccccucacccgcucccuguacgucaacaugacgagcgggccgggcgggcccgccgccgccgccggcgggcggaaggagaaccaccagugguacgugugcaaccgcgagaagcugugcgagucccuccaggcgguguucguccagagcuaccuggaccagggcacccagaucuuccugaacaacuccaucgagaaguccggcuggcuguucauccagcucuaccacagcuucgugagcuccguguucagccuguucaugucccggaccagcaucaacgggcuccugggccgcggguccauguucgucuucagccccgaccaguuccagcggcugcucaagaucaaccccgacuggaagacccaccgccugcuggaccucggcgccggggacggcgaggugacgaagaucauguccccgcacuucgaggagaucuacgccaccgagcugagcgagaccaugaucuggcagcugcagaagaagaaguaccgggugcucggcaucaacgaguggcagaacaccggguuccaguacgacgucaucuccugccugaaccugcucgaccgcugcgaccagccccugacgcugcucaaggacauccggagcgugcuggagcccacccgcggccgggugauccuggcccucguccugcccuuccacccguacguggagaacgggggcaagugggagaagcccagcgagauccuggagaucaagggccagaacugggaggagcaggucaacucccuccccgagguguuccgcaaggcgggguucgugaucgaggccuucacccggcugcccuaccugugcgagggcgacauguacaacgacuacuacgugcucgacgacgccgucuucgugcugaagccgguguga

SEQ ID NO: 32878 - RNA, 1710 nt, Artificial Sequence
  derived and/or modified sequence opt1 from MEX3B__Homo_sapiens__NP_115622
augcccagcucccuguucgccgaccucgagcgcaacggcagcgggggcgggggcgggggcuccagcggcgggggcgagacccuggacgaccagcgggcccugcagcucgcgcuggaccagcugucccuccuggggcuggacagcgacgagggcgccucccucuacgacagcgagccgcgcaagaaguccgugaacaugaccgagugcguccccgugcccagcuccgagcacguggccgagaucgucgggcggcagggcugcaagaucaaggcccugcgcgccaagacgaacaccuacaucaagacccccgugcggggcgaggagccgguguucgucgugaccgggcgcaaggaggacguggcgauggcccggcgcgagaucaucagcgccgccgagcacuucuccaugauccgggcgagccgcaacaagaacacggcccugaacggcgccguccccgggccgcccaaccuccccggccagaccaccauccaggugcgggugcccuaccgcgucgugggccugguggucgggcccaagggcgccaccaucaagcggauccagcagcagacgcacaccuacaucgugacccccucccgcgacaaggagccgguguucgaggucaccgggaugcccgagaacguggaccgggcccgcgaggagaucgaggcgcacaucgcccugcggacgggcgggaucaucgagcucaccgacgagaacgacuuccacgccaacggcaccgacgugggcuucgaccugcaccacgggagcggcggguccggccccgggagccugugguccaagcccaccccgagcaucacgcccacccccggccgcaagcccuucagcuccuaccggaacgacagcuccagcucccucggcagcgccuccaccgacagcuacuucgggggcgggaccuccagcuccgccgcggccacgcagcgccuggccgacuacagcccgcccucccccgcccugagcuucgcccacaacggcaacaacaacaacaacgggaacggcuacaccuacaccgcgggcggggaggccuccguccccagcccggacggcugccccgagcuccagcccaccuucgaccccgccccggccccgccgcccggggcgccccugaucugggcccaguucgagcggucccccggcggcgggcccgccgcccccgugagcuccagcugcagcuccagcgccuccagcuccgcgagcuccagcuccguggucuuccccggcgggggcgccagcgcccccuccaacgccaaccuggggcuccuggugcaccgccgccugcaccccggcacgagcugcccgcggcucuccccgccccugcacauggcccccggcgcgggggagcaccaccuggcccgccggguccgcagcgaccccggcgggggcgggcucgccuacgccgccuacgcgaacggccugggcgcccagcugcccgggcuccagcccuccgacaccagcggcuccagcagcuccagcuccagcuccagcuccagcuccagcuccagcuccgggcugcggcgcaagggcagccgggacugcuccgugugcuucgagagcgaggugaucgccgcccugguccccugcgggcacaaccucuucugcauggagugcgccaaccgcaucugcgagaaguccgagccggagugccccgugugccacaccgcggugacccaggccauccggaucuucagcuga

SEQ ID NO: 32879 - RNA, 1980 nt, Artificial Sequence
  derived and/or modified sequence opt1 from MEX3C__Homo_sapiens__NP_057710
augcccagcggcuccagcgccgcccuggcgcucgccgccgccccggccccccugccccagcccccgcccccccccccgcccccccccccgccccugccccccccguccgggggccccgagcucgagggggacggccugcugcuccgcgagcggcuggcggcccuggggcucgacgaccccagccccgccgagccgggcgcccccgcgcugcgcgcccccgccgccgccgcgcagggccaggcccggcgcgccgccgagcugucccccgaggagcgggccccgcccgggcgccccggcgcgcccgaggccgccgagcucgagcuggaggaggacgaggaggagggggaggaggccgagcuggacggcgaccuccuggaggaggaggagcuggaggaggccgaggaggaggaccggagcucccuccugcugcucagcccgcccgcggccaccgccucccagacccagcagauccccgggggcagccugggcuccgugcugcucccggccgcccgcuucgacgcgcgggaggccgccgccgcggccgccgccgccgggguccuguacggcggggacgacgcgcagggcaugauggccgccaugcugagccacgccuacggccccgggggcugcggggccgcggccgccgcccucaacggcgagcaggccgcgcugcugcgccggaaguccgugaacacgaccgagugcgugcccguccccagcuccgagcacguggccgagaucguggggcgccagggcugcaagaucaaggcccuccgggccaagaccaacaccuacaucaagacgccgguccgcggcgaggagcccaucuucguggugaccgggcggaaggaggacgucgcgauggccaagcgcgagauccugagcgccgccgagcacuucuccaugauccgggccagccgcaacaagaacggccccgcgcuggggggccucuccugcagccccaaccugccggggcagaccaccgugcaggugcggguccccuaccgcguggugggccuggucgugggccccaagggggccacgaucaagcggauccagcagcagacccacaccuacaucgugacccccagccgcgacaaggagccggucuucgaggugacgggcaugcccgagaacguggaccgcgcccgggaggagaucgagaugcacaucgccaugcgcaccgggaacuacaucgagcucaacgaggagaacgacuuccacuacaacggcaccgacgucuccuucgaggggggcacccugggcagcgccuggcuguccagcaaccccgugcccccgucccgggcgcgcaugaucagcaacuaccggaacgacuccagcuccagccucggguccggcagcacggacuccuacuucgggagcaaccgccuggccgacuucucccccaccagccccuucuccaccggcaacuucugguucggcgacacccugcccagcgugggguccgaggaccucgccgucgacagcccggccuucgacagccugcccacguccgcccagaccaucuggacccccuucgagcccgugaacccgcugagcggcuucggguccgaccccagcggcaacaugaagacccagcggcgcgggucccagcccagcacgccgcggcucucccccaccuuccccgagagcaucgagcacccccuggcgcgccggguccgcuccgacccgcccagcaccggcaaccacgugggccugcccaucuacauccccgccuucuccaacgggaccaacagcuacuccagcuccaacggcgggagcacguccagcagcccgcccgagucccggcgcaagcacgacugcgugaucugcuucgagaacgaggucaucgccgcccucgugcccugcggccacaaccuguucugcauggagugcgcgaacaagaucugcgagaagcggacccccagcugcccggugugccagaccgccgucacccaggccauccagauccacuccuga

SEQ ID NO: 32880 - RNA, 2001 nt, Artificial Sequence
  derived and/or modified sequence opt1 from MEX3D__Homo_sapiens__NP_001167589
augcccagcucccugggccagccggacgggggcgggggcgggggcggcgggggcgggggcgugggggccgccggcgaggaccccggccccgggcccgcgccgccgcccgagggcgcccaggaggccgcccccgccccgcggcccccgcccgagcccgacgacgcggccgccgcccuccgccuggcgcuggaccagcucagcgcccuggggcugggcggcgccggggacaccgacgaggagggcgccgccggggacggcgcggccgccgccgggggcgccgacggcggggcggcccccgagcccgugcccccggacggccccgaggccggggccccgcccacccucgcccccgcggucgcccccggcucccugccccugcucgaccccaacgccagcccgcccccgccgcccccgccccgccccuccccgcccgacguguucgccggguucgcgccccaccccgccgcccugggcccgcccacgcugcucgccgaccagaugagcgucaucggcucccggaagaaguccgugaacaugaccgagugcgugcccguccccuccagcgagcacguggccgagaucguggggcgccagggcugcaagaucaaggcgcugcgggccaagaccaacaccuacaucaagacgcccguccgcggggaggagcccguguucaucgugaccggccggaaggaggacgucgagauggccaagcgcgagauccugagcgccgccgagcacuucagcaucauccgggcgacccgcuccaaggccgggggccuccccggcgccgcccaggggccgcccaaccugcccggccagaccacgauccaggugcgggugcccuaccgcgucguggggcugguggucggccccaagggcgccaccaucaagcggauccagcagcgcacccacaccuacaucgugacgcccgggcgggacaaggagcccguguucgcggucaccggcaugcccgagaacguggaccgcgcccgggaggagaucgaggcccacaucacccuccgcaccggggccuucacggacgccggccccgacagcgacuuccacgcgaacgggaccgacgugugccuggaccugcucggcgccgccgccucccugugggcgaagacccccaaccagggccggcgcccgcccaccgccacggccgggcugcggggcgacaccgcccucggggcccccagcgcgcccgaggccuucuacgccggcucccgcgggggccccagcgucccggaccccggccccgccucccccuacagcgggagcggcaacgggggcuucgccuucggggcggagggcccgggcgcccccguggggaccgccgcccccgacgacugcgacuucggcuucgacuucgacuuccuggcccuggaccucaccguccccgcggccgccacgaucugggccccguucgagcgcgcggcgccccugcccgccuucuccgggugcagcaccgugaacggcgcccccgggccgcccgccgccggcgcccggcgcuccagcggcgccgggacgccccggcacucccccacccugccggagcccggcgggcuccgccuggagcugccccucagccggcgcggcgcccccgacccggugggcgcccuguccuggcggccgccccaggggcccgucagcuuccccggcggggcggccuucuccaccgccaccagccugcccuccagccccgccgccgcggccugcgcgccccucgacuccggcgccagcgagaacucccgcaagccgcccagcgccuccagcgcccccgcccuggcccgggagugcguggugugcgccgagggggaggucauggcggcccuggugccgugcggccacaaccucuucugcauggacugcgccgugcgcaucugcggcaaguccgagcccgagugccccgccugccggacccccgccacccaggcgauccgcgucgagacggagaccccgcagcccgggggcgccagcgcccugcagcggcaguacuga

SEQ ID NO: 32881 - RNA, 651 nt, Artificial Sequence
  derived and/or modified sequence opt1 from MFAP3__Homo_sapiens__NP_001128509
augagcguguacuacaugaucgucugccugaucgccuucaccaucacccucauccugaacgugacgcgccugugcaugauguccagccaccuccggaagaccgagaaggccaucaacgaguucuuccgcaccgagggcgcggagaagcugcagaaggccuucgagaucgccaagcggauccccaucaucaccuccgccaagacgcuggagcucgccaaggugacccaguucaagaccauggaguucgcgcgcuacaucgaggagcuggcccggagcgucccgcugccgccccucauccugaacugccgcgccuucguggaggagauguucgaggccgugcgggucgacgaccccgacgaccugggggagcgcaucaaggagcggcccgcgcucaacgcccagggcgggaucuacgugaucaaccccgagaugggccgcuccaacagccccgggggcgacuccgacgacggcagccugaacgagcaggggcaggagaucgccgugcaggucuccgugcaccuccagagcgagaccaaguccaucgacacggagagccagggcuccagccacuucuccccgcccgacgacaucgggagcgccgaguccaacugcaacuacaaggacggcgccuacgagaacugccagcuguga

SEQ ID NO: 32882 - RNA, 840 nt, Artificial Sequence
  derived and/or modified sequence opt1 from MFAP4__Homo_sapiens__NP_001185624
augggcgagcugagcccccuccagcgcccgcuggccaccgaggggaccaugaaggcccagggcgugcugcucaagcuggcgcugcucgcccugccccugcuccugcugcucuccacgccgcccugcgcgccccaggucagcgggauccggggcgacgcccuggagcgcuucugccugcagcagccccucgacugcgacgacaucuacgcccagggguaccaguccgacggcguguaccugaucuaccccagcggccccuccgugccgguccccguguucugcgacaugaccaccgagggcgggaaguggaccguguuccagaagcgguucaacgggagcgucuccuucuuccgcggcuggaacgacuacaagcugggguucggccgggccgacggcgaguacuggcucgggcugcagaacaugcaccuccugacgcugaagcagaaguacgagcugcgcguggaccucgaggacuucgagaacaacaccgccuacgccaaguacgccgacuucagcaucucccccaacgcggugagcgccgaggaggacggcuacacccuguucgucgccggguucgaggacggcggcgccggggacucccugagcuaccacuccggccagaaguucagcaccuucgaccgggaccaggaccucuucgugcagaacugcgccgcgcuguccagcggggccuucugguuccgcuccugccacuucgccaaccugaacggcuucuaccucgggggcagccaccuguccuacgccaacggcaucaacugggcccaguggaagggguucuacuacagccugaagcggacggagaugaagauccgccgggcguga

SEQ ID NO: 32883 - RNA, 492 nt, Artificial Sequence
  derived and/or modified sequence opt1 from MFAP5__Homo_sapiens__NP_001284638
augagccugcucggccccaaggugcugcuguuccucgccgccuucaucaucaccuccgacuggaucccccugggggucaacagccagcgcggcgacgacgugacccaggcgacgcccgagaccuucaccgaggaccccaaccuggugaacgaccccgccaccgacgagacgguccucgccgugcuggccgacaucgccccguccaccgacgaccuggagugcugggacgagaaguucacgugcacccggcucuacagcgugcaccgccccgucaagcagugcauccaccagcugugcuucaccucccugcggcgcauguacaucgugaacaaggagaucugcagccggcucgugugcaaggagcacgaggcgaugaaggacgagcugugccgccagauggccgggcugccgccccggcgccuccggcgcuccaacuacuuccggcugccgcccugcgagaacgucgaccugcagcgccccaacggccucuga

SEQ ID NO: 32884 - RNA, 1008 nt, Artificial Sequence
  derived and/or modified sequence opt1 from MFGE8__Homo_sapiens__NP_001108086
augccccgcccgcggcugcucgccgcccugugcggcgcgcugcucugcgcccccagccugcugguggcccucgacaucugcuccaagaaccccugccacaacgggggccugugcgaggagaucagccaggagguccgcggggacguguuccccuccuacacgugcacgugccugaagggcuacgccgggaaccacugcgagaccaagugcguggagccgcucggccuggagaacggcaacaucgccaacagccagaucgcggccuccagcguccgggugaccuuccuggggcuccagcacugggugcccgagcuggcccgccugaaccgggccggcauggucaacgcguggacccccuccagcaacgacgacaaccccuggauccaggugaaccuccugcgccggaugugggugaccggggucgugacccagggcgccucccgccuggccagccacgaguaccucaaggccuucaagguggccuacucccugaacgggcacgaguucgacuucauccacgacgucaacaagaagcacaaggaguucgugggcaacuggaacaagaacgcggugcacgucaaccuguucgagaccccgguggaggcccaguacgugcggcucuaccccaccagcugccacaccgccugcacgcugcgcuucgagcugcucggcugcgagcugaacgggugcgccaacccccugggccucaagaacaacuccauccccgacaagcagaucaccgccagcuccagcuacaagaccugggggcugcaccuguucuccuggaacccgagcuacgcgcggcucgacaagcagggcaacuucaacgccugggucgccggcuccuacgggaacgaccaguggcugcagaucuuccccggcaacugggacaaccacagccacaagaagaaccuguucgagacccccauccucgcccgcuacgugcggauccugcccguggccuggcacaaccgcaucgcgcugcggcucgagcugcuggggugcuga

SEQ ID NO: 32885 - RNA, 3159 nt, Artificial Sequence
  derived and/or modified sequence opt1 from MFHAS1__Homo_sapiens__NP_004216
auggccggcauggacagcgggaaccugaagaccgcccgccucuggcgggacgcggcccugcgcgcccggaagcugcgcuccaaccuccggcagcugacccugacggccgccggcgcgugccccggggccggcgccgacgcccucgagagcccggcgagcccccagcuggugcugcccgccaaccucggggacaucgaggcccugaaccugggcaacaacggccucgaggagguccccgaggggcugggcuccgcccuggggucccuccgcgugcuggugcugcggcgcaaccgguucgcccgccucccgcccgcggucgccgagcugggccaccaccugaccgagcucgacgugagccacaaccggcugaccgcccugggggccgagguggucuccgcccuccgcgagcugcggaagcugaaccucagccacaaccagcugcccgcgcugcccgcccagcucggcgcccuggcccaccuggaggagcucgacguguccuucaaccgccuggcccaccucccggacagccucuccugccugagccggcugcgcacccucgacguggaccacaaccagcugacggcguucccccggcagcugcuccagcuggucgcccuggaggagcucgacguguccagcaaccgccugcggggccugcccgaggacaucuccgcccuccgcgcccugaagauccuguggcugagcggggccgagcucggcacccugcccgcgggguucugcgagcuggccucccucgagagccugaugcuggacaacaacggccuccaggcccugccggcccaguucuccugccugcagcggcucaagaugcugaaccugagcagcaaccucuucgaggaguuccccgcggcccugcugccccucgccggccuggaggagcuguaccucucccgcaaccagcugaccagcgugcccucccugaucagcgggcucggccgccugcugacccucuggcuggacaacaaccggauccgcuaccugccggacuccaucgucgagcucacggggcuggaggagcuggugcuccagggcaaccagaucgccgugcugcccgaccacuucgggcagcugagccgggucggccuguggaagaucaaggacaacccccugauccagcccccguacgaggugugcaugaagggcauccccuacaucgccgcguaccagaaggagcuggcccacucccagcccgccgugcagccccgccucaagcugcugcucauggggcacaaggccgccggcaagacccugcugcggcacugccucaccgaggagcgcgucgaggggugcccgggcgggggcgacaaggagaagugcuacccgcccagcccgccgcccguguccaagggcaucgaggugaccagcuggacggcggacgccucccgggggcugcgcuucaucgucuacgaccuggccggcgacgagagcuacgaggugauccagcccuucuuccucucccccggggcccuguacgugcuggucgugaaccucgccaccuacgagccccggcacuuccccaccaccgucggcagcuuccugcaccgcgugggggcgcgggugccccacgccgucgugugcaucgugggcacgcacgccgaccugugcggcgagcgcgagcucgaggagaagugccuggacauccaccggcagaucgcccugcaggagaagcacgacgcggaggggcucucccgccuggccaaggucguggacgaggcccuggcccgggacuucgagcuccgcagcgccagcccccacgcggccuacuacggcguguccgacaagaaccugcggcgccggaaggcccacuuccaguaccugcucaaccaccgccugcagauccugucccccguccuccccgugagcugccgcgacccccggcaccuccgccggcugcgcgacaagcugcugagcguggccgagcaccgggagaucuucccgaaccugcaccgcguccucccccgguccuggcagguccuggaggagcugcacuuccagccgccccaggcccagcgccucuggcugagcuggugggacuccgcgcggcuggggcuccaggccggccugaccgaggaccgccugcagagcgcccucuccuaccugcacgagagcggcaagcugcucuacuucgaggacucccccgcccugaaggagcacguguuccacaaccugacccggcucaucgacauccugaacguguucuuccagcgcgaccccagccugcuccugcacaagcugcuccuggggaccuccggcgaggggaaggccgagggcgagagcuccccgcccauggcgcggagcacgcccucccaggagcugcuccgcgccacccagcugcaccaguacguggagggguuccugcugcacggccuccugcccgcccacgugauccggcugcuccugaagccccacguccaggcccagcaggaccugcagcuccugcuggagcuccuggagaagaugggccugugcuacugccucaacaagcccaaggggaagccgcugaacggcagcaccgcgugguacaaguuccccugcuacgugcagaacgaggugccccacgccgaggccuggaucaacgggaccaaccuggccggccaguccuucgucgccgagcagcuccagaucgaguacagcuuccccuucacguucccgcuggggcuguucgcgcgcuacuccgugcagaucaacagccacgugguccaccggagcgacggcaaguuccagaucuucgccuaccgcggcaaggugcccguggucguguccuaccggcccgcccgcggggugcuccagccggacacccugagcaucgccucccacgccagccugcccaacaucuggaccgcguggcaggccaucacgccccucgucgaggagcugaacgugcugcuccaggaguggcccggccugcacuacaccgugcacauccugugcuccaagugccucaagcgggggagcccgaacccccacgccuuccccggcgagcugcugucccagccccgcccggagggggucgccgagaucaucugccccaagaacggcagcgagcgcgugaacguggcccucgucuacccgcccacccccaccgugaucucccccugcagcaagaagaacgugggcgagaagcaccggaaccaguga

SEQ ID NO: 32886 - RNA, 2217 nt, Artificial Sequence
  derived and/or modified sequence opt1 from MFI2__Homo_sapiens__NP_005920
augcgcggccccagcggggcccuguggcuccugcuggcccuccggaccgugcugggcgggauggagguccgcuggugcgcgaccuccgacccggagcagcacaagugcggcaacaugagcgaggccuuccgggaggccgggauccagcccucccugcucugcgugcgcggcacgagcgccgaccacugcgugcagcugaucgccgcgcaggaggccgacgccaucacccuggacggcggggccaucuacgaggcgggcaaggagcacgggcucaagcccgucgugggcgagguguacgaccaggaggucgggaccuccuacuacgccguggccgugguccggcgcagcucccacgugaccaucgacacgcugaagggcgucaagagcugccacaccggcaucaaccggaccgugggguggaacgugcccgugggcuaccuggucgaguccgggcgccucagcgugaugggcugcgacgugcugaaggccgucuccgacuacuucggcgggagcugcgugccgggcgccggggagaccuccuacagcgagucccugugccggcucugccgcggcgacagcuccggggagggcgugugcgacaagagcccccuggagcgguacuacgacuacuccggcgcguuccgcugccuggccgagggggccggcgacgucgccuucgugaagcacagcacggugcucgagaacaccgacgggaagacccugcccagcuggggccaggcccugcucucccaggacuucgagcugcugugccgggacgggagccgcgcggacgucaccgaguggcggcagugccaccucgcccgcgugcccgcccacgccgucguggugcgggccgacacggacggcggccugaucuuccgccugcucaacgaggggcagcggcuguucucccacgagggcagcuccuuccagauguucagcuccgaggcguacgggcagaaggaccuccuguucaaggacagcaccuccgagcuggucccgaucgccacccagaccuacgaggccuggcugggccacgaguaccuccacgccaugaaggggcugcugugcgaccccaaccgccucccgcccuaccugcgguggugcgugcugagcacgcccgagauccagaagugcggcgacauggccguggcguuccgccgccagcggcucaagcccgagauccagugcgucuccgccaagagcccccagcacugcauggagcgcauccaggccgagcaggucgacgccgugacccuguccggcgaggacaucuacaccgcggggaagaccuacggccuggugcccgccgccggggagcacuacgccccggaggacagcuccaacagcuacuacgugguggccgucgugcggcgcgacuccagccacgcguucacgcucgacgagcugcggggcaagcgcuccugccacgccggcuucgggagccccgccggcugggacgugcccgucggggcccugauccagcggggcuucauccgccccaaggacugcgacgugcucaccgccgugagcgaguucuucaacgcguccugcgucccggugaacaaccccaagaacuaccccagcucccugugcgcccugugcgugggggacgagcagggccggaacaagugcgucggcaacagccaggagcgcuacuacggguaccggggcgccuuccgcugccucguggagaacgccggggacguggccuucguccggcacaccaccguguucgacaacacgaacggccacaacuccgagcccugggcggccgagcugcgcagcgaggacuacgagcugcugugcccgaacggggcccgggccgaggugucccaguucgcggccugcaaccucgcccagaucccgccccacgccgucauggugcgccccgacaccaacaucuucaccguguacggccugcuggacaaggcccaggaccucuucggcgacgaccacaacaagaacggguucaagauguucgacagcuccaacuaccacggccaggaccugcuguucaaggacgcgaccguccgggccgugcccgugggggagaagacgaccuaccgcggcuggcucgggcuggacuacgucgccgcccuggagggcaugagcucccagcagugcagcggcgccgcggcccccgcccccggggccccgcuccugccccugcuccugcccgcccuggcggcccggcuccugcccccggcccuguga

SEQ ID NO: 32887 - RNA, 2226 nt, Artificial Sequence
  derived and/or modified sequence opt1 from MFN1__Homo_sapiens__XP_005247653
auggccgagcccgugagcccgcugaagcacuucgugcucgccaagaaggcgaucaccgccaucuucgaccagcugcuggaguucgugaccgagggcucccacuucguggaggccacguacaagaaccccgagcucgaccgcaucgccaccgaggacgaccuggucgagaugcagggguacaaggacaagcugagcaucaucggcgaggugcucucccggcgccacaugaagguggccuucuucgggcggaccagcuccggcaagagcuccgucaucaacgcgaugcugugggacaaggugcugcccagcgggaucggccacaucaccaacugcuuccucuccguggagggcacggacggggacaaggccuaccugaugaccgagggcagcgacgagaagaaguccgucaagaccgugaaccagcuggcccacgcccuccacauggacaaggaccugaaggcggggugccuggugcgcgucuucuggcccaaggccaagugcgcccuccugcgggacgaccuggugcucguggacagcccgggcaccgacgucacgaccgagcuggacuccuggaucgacaaguucugccuggacgccgacguguucgugcucgucgccaacagcgaguccacccugaugaacaccgagaagcacuucuuccacaaggugaacgagcgccugagcaagcccaacaucuucauccucaacaaccggugggacgcguccgccagcgagcccgaguacauggaggacgugcgccggcagcacauggagcgcugccugcacuuccuggucgaggagcucaagguggugaacgcccuggaggcccagaaccggaucuucuucgucuccgccaaggaggugcugagcgcgcgcaagcagaaggcccaggggaugcccgagagcggcgucgcccucgccgagggcuuccacgcccggcugcaggaguuccagaacuucgagcagaucuucgaggagugcaucucccagagcgcggugaagacgaaguucgagcagcacaccauccgcgccaagcagauccuggccaccgugaagaacaucauggacuccgucaaccucgccgccgaggacaagcggcacuacagcguggaggagcgcgaggaccagaucgaccggcuggacuucauccgcaaccagaugaaccugcucacccuggacgugaagaagaagaucaaggaggucacggaggagguggcgaacaagguguccugcgccaugaccgacgagaucugccggcugagcguccucguggacgaguucugcuccgaguuccacccgaaccccgacgugcugaagaucuacaagagcgagcugaacaagcacaucgaggacgggaugggccgcaaccucgccgaccggugcaccgacgaggucaacgcccuggugcugcagacccagcaggagaucaucgagaaccucaagccccugcugcccgcggggauccaggacaagcuccacacgcugaucccgugcaagaaguucgaccuguccuacaaccugaacuaccacaagcucugcagcgacuuccaggaggacaucguguuccgcuucucccugggcuggagcucccugguccaccgcuuccucggcccccggaacgcccagcgcgugcugcuggggcucagcgagcccaucuuccagcugccccggucccuggccagcaccccgaccgcccccaccacgcccgccacccccgacaacgcgucccaggaggagcucaugaucacccuggugaccggccuggccagcgucacgucccgcaccagcauggggaucaucaucgugggcggggugaucuggaagaccaucggcuggaagcuccugagcgucucccugaccauguacggcgcccucuaccuguacgagcggcugagcuggacgacccacgccaaggagcgcgccuucaagcagcaguucgugaacuacgcgaccgagaagcuccggaugaucguguccagcaccuccgccaacugcagccaccaggucaagcagcagaucgccacgaccuucgcccgccugugccagcaggucgacaucacccagaagcagcuggaggaggagaucgcccggcucccgaaggagaucgaccagcuggagaagauccagaacaacuccaagcugcuccgcaacaaggcggugcagcuggagaacgagcuggagaacuucaccaagcaguuccuccccagcuccaacgaggagagcuga

SEQ ID NO: 32888 - RNA, 1740 nt, Artificial Sequence
  derived and/or modified sequence opt1 from MFRP__Homo_sapiens__NP_113621
augaaggacuucagcgacgugauccugugcauggaggccaccgaguccagcaagaccgaguucugcaaccccgccuucgagccggaguccggcccgcccugcccgccgcccgucuuccccgaggacgcgagcuacuccgugcccgcccccuggcacgggcgccggccccgcggccuccggcccgacugccgcuucagcuggcugugcgugcugcuccuguccagccugcuccugcugcuccuggggcugcucgucgccaucauccuggcccagcugcaggccgcgccgcccuccggcgccagccacagcccccuccccgccgggggccugaccaccaccaccacgacccccaccaucaccacgagccaggccgcgggcacccccaaggggcagcaggaguccggcgugagccccagcccccaguccacgugcgggggccugcucuccgggccccggggcuucuucuccuccccgaacuaccccgaccccuacccgcccaacacccacugcguguggcacauccaggucgccaccgaccacgccauccagcugaagaucgaggcccugagcaucgagagcguggccuccugccucuucgaccgccuggagcugagccccgagcccgagggcccccuccugcgggugugcgggcgcgucccgccgcccacccugaacaccaacgcgucccaccuccuggugguguucgucagcgacuccagcguggagggcuucggguuccacgccugguaccaggccauggcccccggccggggcuccugcgcccacgacgaguuccgcugcgaccagcugaucugccuccugcccgacagcgugugcgacggguucgcgaacugcgccgacggcuccgacgagaccaacugcagcgccaaguucuccgggugcggcgggaaccugacgggccuccagggcaccuucagcacccccuccuaccugcagcaguacccccaccagcugcucugcaccuggcacaucagcgucccggccgggcacuccaucgagcugcaguuccacaacuucagccuggaggcccaggacgagugcaaguucgacuacguggagguguacgagacguccagcuccggcgcguucagccuccuggggcgguucugcggcgccgagcccccgccccaccuggucagcucccaccacgagcucgccgugcuguuccgcaccgaccacgggaucagcuccggcggcuucagcgccaccuaccuggccuucaacgcgaccgagaaccccugcgggcccuccgagcucagcugccaggccggcgggugcaagggcgugcaguggaugugcgacauguggcgggacugcacggacggguccgacgacaacugcagcggcccccuguucccgccgcccgagcuggccugcgagcccguccagguggagaugugccucggccuguccuacaacaccaccgccuuccccaacaucuggguggggaugaucacccaggaggaggucguggagguccugagcggcuacaagucccugacgagccuccccugcuaccagcacuuccgccggcugcugugcgggcuccuggugccccgcugcacgccccugggcuccgugcugcccccgugccggagcgucugccaggaggcggagcaccagugccaguccggccucgcccugcucgggacccccuggcccuucaacugcaaccgccugcccgaggccgccgaccuggaggccugcgcgcagccguga

SEQ ID NO: 32889 - RNA, 1194 nt, Artificial Sequence
  derived and/or modified sequence opt1 from MFSD11__Homo_sapiens__NP_001229466
augagccccgaguccaagaagcuguucaacaucaucauccucggcguggccuucauguucauguucaccgccuuccagaccugcgggaacgucgcgcagacggugauccgcagccugaaccggaccgacuuccacggcuccggguacaccagcauggccaucaucuacggcguguucuccgccagcaaccugaucaccccguccgucguggccaucguggggccccagcucagcauguucgccuccggccuguucuacagcauguacaucgcggucuucauccagcccuuccccugguccuucuacacggccagcguguucaucggcaucgccgccgcggaguccgaccgccggaccguguucaucgcccugaccgucaucagccucguggggaccgugcuguucuuccugauccgcaagccggacuccgagaacguccucggcgaggacgagagcuccgacgaccaggacauggaggugaacgagagcgcccagaacaaccugacgaaggccguggacgccuucaagaaguccuucaagcugugcgucaccaaggagaugcuccugcugagcaucaccaccgcguacacggggcucgagcugaccuucuucagcggcguguacgggaccugcaucggcgccaccaacaaguucggcgccgaggagaagucccugaucgggcucagcggcaucuucaucgggaucggcgagauccugggcgggucccuguucggccuccugagcaagaacaaccgguucgggcgcaaccccgugguccugcucggcauccuggugcacuucaucgccuucuaccugaucuuccucaacaugcccggggacgcccccaucgcgccggugaagggcacggacuccagcgccuacaucaaguccagcaaggaggucgccauccugugcuccuuccugcucggccugggggacagcugcuucaacacccagcugcucuccauccugggcuuccuguacagcgaggacuccgcccccgccuucgcgaucuucaaguucgugcagagcaucugcgccgccguggccuucuucuacuccaacuaccuccugcugcacuggcagcuccuggucauggugaucuucggguucuucggcaccaucagcuucuucaccgucgagugggaggccgcggccuucguggcccggggguccgacuaccgcagcaucuga

SEQ ID NO: 32890 - RNA, 1443 nt, Artificial Sequence
  derived and/or modified sequence opt1 from MFSD12__Homo_sapiens__NP_778148
augggccccgggccgcccgccgccggcgcggcccccagcccccgcccgcugucccucguggcccggcugagcuacgccgucgggcacuuccugaacgaccucugcgccuccaugugguucaccuaccugcugcucuaccugcacagcgugcgcgcguacuccagccggggcgccgggcugcuccugcugcucggccagguggccgacggccugugcacgccccuggucggguacgaggccgaccgcgcggccuccugcugcgcccgguacggcccccgcaaggccuggcaccucguggggaccgugugcguccugcugagcuuccccuucaucuucuccccgugccucggcugcggggccgcgacccccgagugggccgcccugcuguacuacggccccuucaucgugaucuuccaguucggcugggccagcacccagaucucccaccucagccugauccccgagcuggugaccaacgaccacgagaaggucgagcucacggcccugcgguacgcguucaccgugguggccaacaucaccgucuacggggccgccuggcugcuccugcaccuccagggcuccagccgcguggagccgacccaggacaucuccaucagcgaccagcucgggggccaggacgugcccgucuuccggaaccugucccugcugguggugggcgucggggccguguucagccugcuguuccaccucggcacgcgcgagcggcgccggccccacgcggaggagcccggggagcacaccccgcugcuggcccccgccaccgcccagccccuccugcuguggaagcacuggcuccgcgagcccgccuucuaccaggugggcauccuguacaugaccacgcggcugaucgucaaccucucccagaccuacauggcgauguaccugaccuacagccugcaccucccgaagaaguucaucgccaccaucccccuggugauguaccugagcggguuccuguccagcuuccucaugaagcccaucaacaagugcaucggccgcaacaugacguacuucuccggccugcuggugauccucgccuucgccgcgugggucgcccuggccgaggggcugggcguggccgucuacgccgcggccgugcuccugggggccggcugcgccaccauccuggugaccagccucgccaugaccgcggaccugaucgggccccacacgaacuccggcgccuucgucuacggcagcauguccuuccuggacaagguggccaacgggcucgccgugauggccauccagagccugcacccgugccccuccgagcugugcugccgggcgugcgucagcuucuaccacugggccaugguggccgugaccggcggggucggcguggccgcggcccucugccugugcucccugcuccuguggcccacccgccugcggcgcugggaccgggacgcccgccccuga

SEQ ID NO: 32891 - RNA, 1545 nt, Artificial Sequence
  derived and/or modified sequence opt1 from MFSD1__Homo_sapiens__NP_073573
augggcguggcccugcgcgaccuccccgggcggcacgucagcucccgcagccacgugaccgccgugcugaccgucuuccacggccggugcuuccugccgggguucggcguggugacgaccuuccccucccccagccccgcgggggccauggaggaggaggacgaggaggcccgcgcccuccuggccggcggcccggacgaggcggaccgcggggcccccgccgcccccggcgcgcugcccgcccucugcgacccgucccggcuggcccaccggcugcucguccugcugcucaugugcuuccugggguucggcagcuacuucugcuacgacaaccccgccgcccugcagacccaggugaagcgcgacaugcaggucaacaccacgaaguucaugcuccuguacgcgugguacuccuggcccaacguggugcugugcuucuucgggggcuuccucaucgaccggguguucggcauccgcugggggaccaucaucuucagcugcuucgucugcaucggccaggugguguucgcccucgggggcaucuucaacgccuucuggcugauggaguucggccgguucgucuucgggaucggcggggagucccuggccguggcccagaacaccuacgcggugagcugguucaagggcaaggagcugaaccuggucuucgggcuccagcuguccauggcccgcaucggcagcaccgugaacaugaaccugaugggcuggcucuacuccaagaucgaggcccugcuggggagcgccggccacacgacccucgggaucacccugaugaucggcgggaucacgugcauccugucccucaucugcgcccuggcgcuggccuaccucgaccagcgggccgagcgcauccugcacaaggagcagggcaagaccggcgaggugaucaagcugaccgacgucaaggacuucagccucccccuguggcugaucuucaucaucugcgugugcuacuacguggccgucuucccguucaucgggcucggcaagguguucuucaccgagaaguucggguucuccagccaggccgcguccgccaucaacagcgucguguacgugaucagcgcccccaugucccccgucuucggccugcugguggacaagaccgggaagaacaucaucugggugcucugcgccgucgcggccacgcuggugagccacaugaugcuggccuucaccauguggaaccccuggaucgccaugugccuccugggccuguccuacagccugcucgccugcgcgcuguggccgaugguggccuucgucgugcccgagcaccagcugggcaccgccuacggguucaugcaguccauccagaaccucggccuggccaucaucagcaucaucgccgggaugauccuggacucccggggcuaccucuuccuggagguguucuucaucgcgugcgucagccugucccuccugagcguggugcugcucuaccuggucaaccgcgcccagggcgggaaccugaacuacuccgcccggcagcgcgaggagaucaaguucagccacaccgaguga

SEQ ID NO: 32892 - RNA, 2376 nt, Artificial Sequence
  derived and/or modified sequence opt1 from MFSD6__Homo_sapiens__NP_060164
auggccgacgacaagguggccauccugaccgacgacgaggaggagcagaagcgcaaguacguccucgcggaccccuucaacggcaucagccgggagccggagccgcccuccaacgagacccccagcuccacggagaccagcgccauccccgaggaggagaucgacuggaucgagaagcacugcgugaagaucaacaacgaccugcugaucuccaagguguucuacuucuucuucuacagcgccuacgggucccucuacccccugcugcccgucuacuacaagcagcucggcaugagccccucccagagcgggcugcuggugggcauccgcuacuucaucgaguucugcuccgccccguucuggggcguggucgccgaccgguucaagaaggggaagaucgugcuccuguucagccugcucugcugggugcuguucaaccugggcaucggguucgucaagcccgcgacccuccgcugcgugcccaagauccggcccaccacgcacccgaccaacgccucccaccagcugaccauccugcccaccaacagcuccuucacgagcuuccucaccaucucccccaagaugcgcgagaagcggaaccugcuggagacccgccucaacgugagcgacaccgucacgcugcccaccgccccgaacaugaacuccgagcccacccugcagccccagaccggcgagaucacgaaccggaugauggaccucacccugaacagcagcaccgccacccccguguccccggggagcgugacgaaggagaccaccaccgucaucgugacgaccaccaagucccugcccagcgaccaggugaugcucgucuacgaccagcaggagguggaggcgaucuuccuggugauccuggucguggugaucaucggcgaguucuucuccgccagcuccgucaccaucguggacacggucacccuccaguaccuggggaagcaccgcgaccgguacggccugcagcgcauguggggcagccucggguggggccuggccaugcuguccguggggaucggcaucgacuacacccacaucgaggugcucaucgacggcaaggggugcaagccgcccgaguaccggaacuaccagaucgucuucaucguguucggcgugcugaugaccauggcccugaucgucgccacgcaguuccgcuuccgguacaaccacuucaagaacgacgacagcaaggggaaggagguggagaucccccaggucgagcgcaacaacuccaccgagagcuccgaggagacccccaccacgaccagccacucccaggcguucaacuucugggaccucaucaagcugcugugcagcgugcaguacggcuccguccucuucguggccugguucaugggguucggcuacggcuucguguucaccuuccuguacuggcaccuggaggaccucaacgggaccaccacgcuguucggcgugugcagcgugcugucccacgucagcgagcucaccgccuacuucuucagccacaagcugaucgagcugaucgggcacauccgggugcuguacaucggccucgccugcaacaccgcccgcuacaucuacaucuccuaccuggagaacgcguggaccgugcugcccauggagguccuccagggggugacgcacgccgccaucugggccgccugcaucagcuaccuguccgcggccgugcccccggagcugcggaccagcgcccagggcauccuccagggccugcaccuggggcucggccgcgggugcggcgccaugaucgggggcguccuggugaacuacuucggcgccgcggccaccuuccgggggaucggcauggccugccuggugauccuccugcuguucgcccucauccaguggcuggcgguccccgacgaggaggaggacaagaccaugcuggccgagcgcauccccgugccguccagccccgugcccaucgccacgaucgaccucguccagcagcagaccgaggacgugaugccccgcaucgagccgcggcugccgcccaagaagaccaagcaccaggaggagcaggaggacgugaacaagcccgccuggggcgucuccagcucccccugggugaccuucguguacgcccuguaccagaucaaggagaugaugcagcucacgcgcgacaaccgggcgagcgagauccagccccugcaggggaccaacgagaaccgcgagaacucccccgccggccgggcccagcccgucccgugcgagacccacagcgaccccucccgcaaccagcccagccccgacgccgccgcgucccagacccagacgagcccggcccaccccuccguggaccccugcaccgaggagagcgaggagcagcaggcccagcuggccgccgggggccacuga

SEQ ID NO: 32893 - RNA, 1683 nt, Artificial Sequence
  derived and/or modified sequence opt1 from MFSD7__Homo_sapiens__NP_001281270
auggccggccccaccgaggccgagaccgggcuggcggagccgcgcgcccucugcgcccagcggggccaccgcacguacgcccggcgcuggguguuccugcuggccaucagccuccugaacugcuccaacgcgacccuguggcucagcuucgcccccgucgccgacgugaucgccgaggaccuggugcuguccauggagcagaucaacuggcucagccuggucuaccuggugguguccacccccuucggggucgcggccaucuggauccucgacagcgugggccugcgggccgccaccauccugggggccuggcucaacuucgcgggcuccgugcugcgcaugguccccugcaugguggugggcacgcagaacccguucgccuuccugaugggcgggcagagccucugcgcccuggcccagucccuggucaucuucagccccgccaagcucgcggcccugugguuccccgagcaccagcgggccaccgccaacaugcuggccaccauguccaacccccucggggugcugguggcgaacguccugagcccggugcucgugaagaagggcgaggacaucccccugaugcugggggucuacaccauccccgccggcguggugugccuccuguccacgaucugccugugggagagcgugcccccgaccccgcccuccgccggcgccgccagcuccaccagcgagaaguuccucgacgggcugaagcugcagcucauguggaacaaggcguacgucauccuggccgugugccugggcgggaugaucggcaucuccgccagcuucagcgcccuccuggagcagauccugugcgcguccggccacagcuccggguucagcggccucugcggggcccuguucaucaccuucggcauccugggggcccucgcccugggccccuacgucgaccgcacgaagcacuucaccgaggccaccaagaucggccugugccucuucucccuggcgugcgugcccuucgcccuggucagccagcugcaggggcagacccucgcccuggccgccacgugcucccugcucggccuguucggguucagcgugggccccguggcgauggagcuggccgucgagugcuccuuccccgugggggagggcgccgccaccggcaugaucuucgugcucgggcaggccgagggcauccugaucaugcuggcgaugaccgcccucaccguccggcgcagcgagcccucccugagcacgugccagcagggggaggacccgcuggacuggaccgugucccuccugcugauggccggccucugcaccuucuucagcugcauccuggccguguucuuccacacccccuaccggcgccugcaggcggaguccggggagccgcccagcacgcggaacgccgucggcggcgccgacuccgggcccggcguggaccgcgggggcgccggccgggccggggugcucggccccagcaccgcgacccccgagugcaccgcccgcggggccucccuggaggacccccggggcccggggagcccccaccccgccugccaccgcgccacgccgcgggcgcagggccccgccgccaccgacgcccccagccgccccggccggcuggccgggcgcguccaggcgucccgcuucaucgacccggccggcagccacuccagcuucuccagccccugggugaucaccuga

SEQ ID NO: 32894 - RNA, 1557 nt, Artificial Sequence
  derived and/or modified sequence opt1 from MFSD8__Homo_sapiens__NP_689991
auggccggccugcgcaacgagagcgagcaggagccccuccugggggacaccccgggcucccgggagugggacauccuggagaccgaggagcacuacaagagccgcuggcgguccauccgcauccucuaccugacgauguuccugagcuccgugggguucagcgucgugaugauguccaucuggcccuaccuccagaagaucgaccccaccgccgacaccagcuuccugggcugggugaucgcguccuacagccuggggcagauggucgccucccccaucuucggccucuggagcaacuaccggccgcgcaaggagccccugaucguguccauccugaucagcguggccgccaacugccucuacgccuaccugcacauccccgcgucccacaacaaguacuacaugcuggucgcccggggccuccuggggaucggcgccgggaacguggccgugguccgcagcuacaccgcgggcgccacgucccugcaggagcggaccagcuccauggccaacaucagcaugugccaggcccucggguucauccugggccccguguuccagaccugcuucaccuuccugggcgagaagggggugacgugggacgucaucaagcuccagaucaacauguacaccaccccggugcugcugagcgccuuccucggcauccugaacaucauccugauccucgcgauccugcgcgagcaccggguggacgacuccgggcgccagugcaagagcaucaacuucgaggaggccuccaccgacgaggcccaggucccccagggcaacaucgaccagguggccguggucgccaucaacgugcuguucuucgugacccucuucaucuucgcgcuguucgagaccaucaucacgccccugaccauggacauguacgccuggacgcaggagcaggccguccucuacaacggcaucauccuggccgcccuggggguggaggcgguggucaucuuccucggcgugaagcugcugagcaagaagaucggggagcgggccauccuccugggcgggcugaucgucgugugggugggcuucuucauccuccugcccuggggcaaccaguucccgaagauccagugggaggaccugcacaacaacuccauccccaacaccaccuucggggagaucaucaucggccucuggaagucccccauggaggacgacaacgagcgccccaccgggugcagcaucgagcaggccuggugccuguacacgccggucauccaccuggcccaguuccucaccagcgccgugcugaucggccugggguaccccgugugcaaccugauguccuacacccucuacagcaagauccugggccccaagccccagggcgucuacaugggguggcugaccgcguccggcagcggggcccggauccucggcccgauguucaucucccagguguacgcccacugggggccccgcugggccuucagccuggugugcggcaucaucguccugacgaucacccuccugggcgugguguacaagcggcugaucgcgcucuccguccgcuacgggcggauccaggaguga

SEQ ID NO: 32895 - RNA, 8571 nt, Artificial Sequence
  derived and/or modified sequence opt1 from MGA__Homo_sapiens__NP_001074010
auggaggagaagcagcagaucauccuggccaaccaggacggcgggaccguggccggcgcggcccccaccuucuucgucauccucaagcagccggggaacggcaagacggaccaggggauccuggugaccaaccaggacgccugcgcccuggccagcuccgugagcucccccgucaagagcaagggcaagaucugccuccccgcggacugcaccgugggcgggaucaccgugacgcuggacaacaacuccauguggaacgaguucuaccaccgcagcaccgagaugauccugaccaagcagggccggcgcauguuccccuacugccgguacuggaucaccgggcucgacuccaaccugaaguacauccuggucauggacaucagcccgguggacaaccaccgcuacaaguggaacggccgguggugggagcccuccgggaaggccgagccccacgugcucggccgcgucuucauccaccccgagagcccguccacgggccacuacuggaugcaccagcccgugagcuucuacaagcugaagcugaccaacaacacccucgaccaggaggggcacaucauccugcacuccaugcaccgguaccugccccgccuccaccuggugcccgccgagaaggccgucgaggugauccagcugaacggcccgggggugcacaccuucacguucccccagaccgaguucuucgcggucaccgccuaccagaacauccagaucacccagcucaagaucgacuacaaccccuucgccaagggcuuccgggacgacggccugaacaacaagccccagcgcgacgggaagcagaagaacagcuccgaccaggagggcaacaacaucagcuccagcuccgggcaccgggugcgccugacggagggccaggggagcgagauccagccgggcgaccucgacccccugagccggggccacgagaccuccgggaagggccuggagaagaccagccucaacaucaagcgcgacuuccugggguucauggacaccgacuccgcccugagcgaggugccccagcucaagcaggagaucuccgagugccugaucgccagcuccuucgaggacgacagccgggucgcguccccccuggaccagaacggcagcuucaacguggugaucaaggaggagccgcucgacgacuacgacuacgagcugggggagugccccgagggcgucacggugaagcaggaggagaccgacgaggagaccgacguguacuccaacagcgacgacgaccccauccuggagaagcagcucaagcgccacaacaaggucgacaaccccgaggccgaccaccuguccagcaaguggcugccguccagccccuccggcguggccaaggccaagauguucaagcucgacaccgggaagaugcccgucguguaccuggagcccugcgccgugacgcggagcaccgucaagaucuccgagcugccggacaacaugcucagcaccagccgcaaggacaaguccagcaugcuggcggagcuggaguaccuccccaccuacaucgagaacuccaacgagacggccuucugccugggcaaggagagcgagaacgggcugcggaagcacucccccgaccuccgcguggugcagaaguacccgcugcugaaggagccccaguggaaguaccccgacaucagcgacuccaucagcaccgagcggauccucgacgacuccaaggacagcgucggcgacucccugagcgggaaggaggaccugggccgcaagcgcaccaccaugcugaagaucgccacggccgccaagguggugaacgcgaaccagaacgccucccccaacgucccgggcaagcgggggcgcccccggaagcucaagcugugcaaggccggccgcccccccaagaacaccgggaagagccugaucuccaccaagaacaccccggugagccccggcuccacguuccccgacgugaagcccgaccucgaggacgucgacggcgugcuguucgugagcuucgagagcaaggaggcccuggacauccacgccgucgacgggaccaccgaggaguccagcucccuccaggcgagcaccaccaacgacuccggcuaccgggcccgcaucagccagcuggagaaggagcugaucgaggaccucaagacgcugcggcacaagcaggugauccacccggggcugcaggaggugggccucaagcugaacuccgucgaccccaccaugagcaucgaccugaaguaccucggggugcagcugccccuggcccccgccaccuccuucccguucuggaaccucaccggcacgaaccccgcgagccccgacgccggcuuccccuucgugucccgcaccgggaagaccaacgacuucaccaagaucaagggcuggcgggggaaguuccacagcgccuccgccagccgcaacgagggcgggaacuccgagagcucccugaagaaccggagcgccuucugcuccgacaagcuggacgaguaccucgagaacgagggcaagcugauggagacgagcaugggcuucagcuccaacgcgccgaccagccccgucguguaccagcugcccaccaaguccaccagcuacgugcgcacgcucgacuccguccugaagaagcagagcaccaucucccccagcaccuccuacagccugaagccgcacuccgugccccccgugagccggaaggccaagucccagaaccgccaggccaccuucagcgggcggacgaaguccagcuacaaguccauccucccguaccccgucagccccaagcagaaguacucccacgugauccugggcgacaaggugaccaagaacagcagcgggaucaucuccgagaaccaggccaacaacuucgucgugcccacccuggacgagaacaucuucccgaagcagaucagccuccgccaggcccagcagcagcagcagcagcagcagggcucccggccccccgggcugagcaagucccaggugaagcugauggaccucgaggacugcgcgcugugggagggcaagccccgcaccuacaucacggaggagcgggccgacgucagccugaccacccuccugaccgcccaggccucccugaagacgaagccgauccacaccaucauccgcaagcgcgccccccccugcaacaacgacuucugccggcucggcugcgugugcagcucccuggcgcuggagaagcgccagcccgcccacugccggcgcccggacugcauguucgggugcaccugccucaagcggaaggugguccuggugaagggcgggagcaagaccaagcacuuccagcgcaaggccgcccaccgggaccccguguucuacgacacgcugggcgaggaggcgcgcgaggaggaggaggggauccgggaggaggaggagcagcucaaggagaagaagaagcgcaagaagcuggaguacaccaucugcgagaccgagcccgagcagcccguccggcacuacccgcugugggugaagguggagggcgaggucgaccccgagcccguguacauccccaccccguccgugaucgagcccaugaagccccuccugcugccccagccggagguccucagccccacggugaagggcaagcugcugaccgggaucaaguccccccgcagcuacacccccaagccgaaccccgugauccgggaggaggacaaggaccccgucuaccucuacuucgaguccaugaugaccugcgcccgcgugcggguguacgagcgcaagaaggaggaccagcggcagccgagcuccagcuccagccccagccccuccuuccagcagcagacgagcugccacuccagccccgagaaccacaacaacgccaaggagccggacuccgagcagcagccccugaagcagcugaccugcgaccucgaggacgacagcgacaagcugcaggagaaguccuggaagagcuccugcaacgagggcgagagcuccagcaccuccuacaugcaccagcgcagccccgggggccccaccaagcugaucgagaucaucuccgacugcaacugggaggaggaccggaacaagauccucagcauccugucccagcacaucaacagcaacaugccgcagucccugaaggucggcagcuucaucaucgagcucgccagccagcgcaagucccggggggagaagaacccccccguguacagcucccgcgucaagaucagcaugcccuccugccaggaccaggacgacauggccgagaagagcggcuccgagaccccggacgggccccugagccccggcaagauggaggacaucucccccgugcagacggacgcgcuggacagcgugcgcgagcggcuccacgggggcaagggccugccguucuacgccgggcugucccccgccggcaagcucgucgccuacaagcgcaagcccagcuccagcaccuccgggcugauccagguggccagcaacgcgaagguggccgccucccggaagccccgcacccugcucccgagcaccuccaacagcaagauggccagcuccagcggcacggccaccaaccggcccgggaagaaccugaaggcguucguccccgccaagcgccccaucgagaacgccgcccagaucccgguggcgaccccccaggugucccccaacaccgucaagcgggccggcccccgccugcuccugaucccggugcagcagggcagccccacgcugcggcccguguccaacacccagcuccaggggcaccgcaugguccugcagccggugcggagccccuccggcaugaaccuguuccgccaccccaacgggcagaucgugcagcuccugccccugcaccagcuccggggcagcaacacccagccgaaccugcagcccgucauguuccgcaaccccggguccgugaugggcauccggcugcccgccccgagcaagcccuccgagaccccccccagcuccacgagcuccagcgccuucuccgugaugaacccggucauccaggccgugggcagcagcuccgcggugaacgucaucacccaggcccccagccuccuguccagcggggccuccuucgugagccaggccggcacccugacccuccgcaucuccccccccgagccgcagagcuucgccuccaagacggggagcgagaccaagaucaccuacuccagcggcggccagcccguggggaccgcgucccugaucccccugcagagcggcuccuucgcccuccugcagcugcccgggcagaagccgguccccagcuccauccugcagcacguggccagccuccagaugaagcgggagucccagaaccccgaccagaaggacgagacgaacagcaucaagcgcgagcaggagaccaagaaggugcugcagagcgagggcgaggccgucgaccccgaggccaacgugaucaagcagaacuccggggcggccaccagcgaggagacccugaacgacucccucgaggaccggggcgaccaccuggacgaggagugccugccggaggagggcugcgccacggugaagcccagcgagcacuccugcaucaccgggagccacaccgaccaggacuacaaggacgucaacgaggaguacggcgcccgcaaccgcaaguccagcaaggagaagguggccgugcucgagguccggaccaucuccgagaaggcgagcaacaagacggugcagaaccuguccaaggugcagcaccagaagcugggggacgucaagguggagcagcagaagggcuucgacaaccccgaggagaacagcuccgaguucccggugaccuucaaggaggagagcaaguucgagcucuccgggagcaaggucauggagcagcaguccaaccugcagcccgaggccaaggagaaggagugcggcgacagccuggagaaggaccgcgagcgguggcgcaagcaccucaagggcccccugacccggaagugcgugggggccucccaggagugcaagaaggaggccgacgagcagcugaucaaggagaccaagacgugccaggagaacagcgacguguuccagcaggagcagggcaucagcgaccuccuggggaaguccggcaucaccgaggacgcgcgcguccugaagaccgagugcgacagcuggucccggaucagcaaccccuccgccuucagcaucgugccgcgccgggccgccaaguccagccgcgggaacggccacuuccagggccaccuccugcugcccggggagcagauccagcccaagcaggagaagaagggcgggcgguccagcgccgacuucaccgugcucgaccuggaggaggacgacgaggacgacaacgagaagacggacgacuccaucgacgagaucgucgacguggugagcgacuaccaguccgaggaggucgacgacguggagaagaacaacugcguggaguacaucgaggacgacgaggagcacgucgacaucgagaccguggaggagcugagcgaggagaucaacgucgcgcaccucaagaccaccgccgcccacacccaguccuucaagcagcccagcugcacgcacaucuccgccgacgagaaggccgcggagcgcagccggaaggccccgcccaucccccugaagcugaagcccgacuacugguccgacaagcuccagaaggaggccgaggccuucgccuacuaccgccggacccacaccgcgaacgagcgccggcgccggggcgagaugcgcgaccuguucgagaagcugaagaucacccucgggcugcugcacagcagcaagguguccaagagccucauccugacgcgggccuucuccgagauccagggccugaccgaccaggccgacaagcucaucggccagaagaaccugcugacccgcaagcgcaacauccucauccggaaggugagcucccugagcgggaagaccgaggaggucgugcugaagaagcucgaguacaucuacgccaagcagcaggcgcuggaggcccagaagcgcaagaagaagaugggcuccgacgaguucgacaucagcccgcggaucuccaagcagcaggaggggagcuccgccagcuccguggaccugggccagauguucaucaacaaccgccggggcaagccccucauccugagccgcaagaaggaccaggccacggagaacaccuccccccugaacaccccccacaccagcgccaaccucgucaugacgccgcaggggcagcugcugacccucaagggcccccuguucuccgggcccgugguggcggucagccccgaccugcucgaguccgaccugaagccgcagguggccggcagcgccguggcccugcccgagaacgacgaccucuucaugaugccccggaucgucaacgugaccagccuggccaccgaggggggccugguggacaugggcggguccaaguacccccacgaggucccggacagcaagcccuccgaccaccucaaggacacggugcgcaacgaggacaacagccuggaggacaagggccggaucuccagccgcgggaaccgggacggccgcgugacccuggggcccacccaggucuuccucgcgaacaaggacuccggcuacccccagaucguggacgugagcaacaugcagaaggcccaggaguuccugccgaagaagaucuccggcgacaugcgggggauccaguacaaguggaaggagagcgagucccgcggcgagcgggucaagagcaaggacuccagcuuccacaagcugaagaugaaggaccucaaggacuccagcaucgagauggagcugcgcaaggugaccuccgccaucgaggaggccgcccuggacagcuccgagcuccugacgaacauggaggacgaggacgacaccgacgagacccugaccagccuccugaacgagaucgcguuccugaaccagcagcucaacgacgacagcguggggcuggccgagcugcccuccagcauggacacggaguuccccggcgacgcccggcgcgccuucaucuccaaggucccgcccgggagccgggcgaccuuccagguggagcaccucggcaccggccugaaggagcugcccgacgugcagggggaguccgacagcaucuccccccuccugcugcaccucgaggacgacgacuucagcgagaacgagaagcagcuggccgagccggccuccgagcccgacguccugaagaucgugaucgacagcgagaucaaggacucccuccugagcaacaagaaggccaucgacggcgggaagaacaccuccggccugcccgccgagcccgagagcguguccagcccgcccacgcuccacaugaagaccgggcuggagaacuccaacagcaccgacacccuguggcgccccaugcccaagcucgcgccgcugggccugaaggucgccaaccccagcuccgacgccgacggccagagccucaaggugaugcccugccuggcccccaucgccgcgaaggugggguccgucggccacaagaugaaccugacggggaacgaccaggagggccgcgagagcaaggugaugccgacccucgcccccguggucgccaagcugggcaacuccggggccagccccuccagcgccggcaaguga

SEQ ID NO: 32896 - RNA, 5574 nt, Artificial Sequence
  derived and/or modified sequence opt1 from MGAM__Homo_sapiens__NP_004659
auggcccgcaagaagcugaagaaguucaccacccucgagaucgugcugagcgugcugcuccuggugcuguucaucaucagcaucgugcucaucguccugcuggccaaggagagccucaaguccaccgcccccgacccgggcaccaccggcacccccgaccccggcacgaccgggacccccgaccccggcaccacggggaccacccacgcccggaccacggggccgcccgaccccggcaccaccgggaccacgccggugagcgccgagugccccguggucaacgagcuggagcgcaucaacugcauccccgaccagcccccgaccaaggcgaccugcgaccagcggggcugcugcuggaacccccagggggccguguccgugcccuggugcuacuacagcaagaaccacuccuaccacgucgagggcaaccuggugaacaccaacgccggguucacggcccgccucaagaaccugcccagcuccccgguguucggcagcaacgucgacaacgugcugcucaccgccgaguaccagaccuccaaccgguuccacuucaagcugaccgaccagacgaacaaccgcuucgaggugccccacgagcacguccagagcuucuccggcaacgccgcggccagccugaccuaccagguggagaucucccggcagcccuucagcaucaaggugacccgccgguccaacaaccgcguccucuucgacagcuccaucgggccccugcuguucgccgaccaguuccuccagcugagcacccggcugccgagcacgaacguguacggccucggggagcacgugcaccagcaguaccgccacgacaugaacuggaagaccuggcccaucuucaaccgggacaccacccccaacggcaacggcacgaaccuguacggggcccagaccuucuuccugugccucgaggacgccuccggccugagcuucggggucuuccugaugaacuccaacgcgauggagguggugcuccagcccgccccggccaucaccuaccgcaccaucggcgggauccuggacuucuacgucuuccugggcaacacgcccgagcaggucguccaggaguaccucgagcugaucggccggcccgcccugcccagcuacugggcccucggguuccaccugucccgcuacgaguacggcacccuggacaacaugcgggaggugguggagcgcaaccgggcggcccagcucccguacgacguccagcacgccgacaucgacuacauggacgagcgccgggacuucaccuacgacagcguggacuucaagggguuccccgaguucgugaacgagcugcacaacaacggccagaagcuggucaucaucguggaccccgccaucuccaacaacagcuccagcuccaagccguacgggcccuacgaccgcggcagcgacaugaagaucugggugaacuccagcgacggcgucacgccccucaucggggagguguggcccggccagaccguguucccggacuacacgaaccccaacugcgccgucugguggaccaaggaguucgagcuguuccacaaccagguggaguucgacgggaucuggaucgacaugaacgagguguccaacuucgucgacggcagcguguccgggugcagcaccaacaaccugaacaacccgcccuucaccccgcgcauccucgacggcuaccuguucugcaagacgcugugcauggacgcggugcagcacuggggcaagcaguacgacauccacaaccucuacggguacuccauggccgucgccaccgccgaggccgcgaagaccguguuccccaacaagcggagcuucauccugacccgcagcacguucgccggcuccgggaaguucgccgcccacuggcugggcgacaacaccgcgaccugggacgaccugcgguggagcauccccggcgugcucgaguucaaccuguucgggauccccauggucggcccggacaucugcggguucgcccuggacacccccgaggagcucugccgccgguggaugcagcugggcgccuucuaccccuucucccgcaaccacaacgggcagggcuacaaggaccaggaccccgccagcuucggcgccgacucccugcuccugaacagcucccggcacuaccugaacauccgcuacacgcuccugccguaccuguacacccucuucuuccgggcgcacagccgcggggacaccguggcccggccccugcugcacgaguucuacgaggacaacuccaccugggacgugcaccagcaguuccucuggggccccgggcugcugaucacgcccguccucgacgagggcgccgagaaggugauggccuacgugccggacgccgucugguacgacuacgagaccgggagccaggugcgcuggcggaagcagaagguggagauggagcugcccggcgacaagaucggccugcaccuccgcgggggcuacaucuuccccacccagcagcccaacaccacgacccuggcgucccggaagaacccgcuggggcucaucaucgcccuggacgagaacaaggaggccaagggcgagcuguucugggacaacggggagaccaaggacaccgucgccaacaagguguaccuccugugcgaguucagcgugacgcagaaccgccuggaggucaacaucucccagagcaccuacaaggaccccaacaaccucgccuucaacgagaucaagauccugggcaccgaggagcccuccaacgugaccgugaagcacaacggcgucccgagccagacgucccccaccgugaccuacgacagcaaccugaagguggcgaucaucaccgacaucgaccuccugcugggggaggccuacacggucgaguggagcaucaagauccgggacgaggagaagaucgacugcuaccccgacgagaacggcgccuccgccgagaacugcaccgcgcgcgggugcaucugggaggccagcaacuccagcggcgugcccuucugcuacuucgugaacgaccucuacuccgucagcgacgugcaguacaacucccacggggccaccgccgacaucagccugaaguccagcguguacgccaacgcguucccguccacccccgucaacccccugcggcucgacgugacguaccacaagaacgagaugcugcaguucaagaucuacgaccccaacaagaaccgcuacgaggugccggucccccugaacauccccagcaugcccuccagcaccccggagggccagcucuacgacgugcugaucaagaagaaccccuucggcaucgagauccgccggaaguccaccgggaccaucaucugggacagccagcugcucggcuucaccuucuccgacauguucauccgcaucagcacgcggcugcccuccaaguaccuguacggguucggcgagaccgagcaccgcagcuaccggcgcgaccucgaguggcacaccuggggcauguucagccgggaccagcccccgggguacaagaagaacuccuacggcgugcaccccuacuacauggggcuggaggaggacggcagcgcccacgggguccugcuccugaacuccaacgccauggacgugaccuuccagccccugcccgcccucacguaccgcaccaccggcggcguccuggacuucuacguguuccuggggccgacccccgagcucgugacgcagcaguacaccgagcugaucggccggcccgucauggugcccuacuggagccugggguuccagcucugccgcuacggcuaccagaacgacuccgagaucgccagccuguacgacgagaugguggcggcccagaucccguacgacguccaguacuccgacaucgacuacauggagcggcagcuggacuucacccucagccccaaguucgccggguuccccgcccugaucaaccgcaugaaggccgacggcaugcgggugauccugauccucgaccccgcgaucuccggcaacgagacccagccguaccccgccuucacgcgcgggguggaggacgacgucuucaucaaguaccccaacgacggcgacaucgugugggggaagguguggccggacuuccccgacgucguggugaacggcagccuggacugggacucccaggucgagcuguaccgggccuacguggccuuccccgacuucuuccgcaacagcaccgcgaagugguggaagcgggagaucgaggagcucuacaacaacccccagaacccggagcgcucccugaaguucgacgggauguggaucgacaugaacgagcccagcuccuucgugaacggcgccgucagccccggcugccgggacgccucccugaaccacccgcccuacaugccccaccucgagagccgcgaccgggggcuguccagcaagacccugugcauggagagccagcagauccuccccgacggcucccuggugcagcacuacaacgugcacaaccuguacggguggagccagacccgccccacguacgaggccguccaggaggugaccggccagcgcggcguggucaucacccgguccaccuuccccagcuccgggcgcugggccggccacuggcucggggacaacacggcggccugggaccagcugaagaaguccaucaucggcaugauggaguucucccuguucgggaucagcuacaccggcgccgacaucugcggcuucuuccaggacgccgaguacgagaugugcgugcgguggaugcagcucggggccuucuaccccuucucccgcaaccacaacaccaucggcacccggcgccaggaccccgugagcugggacgucgcguucgugaacaucucccggacggugcugcagacccgcuacacccugcuccccuaccuguacacccugaugcacaaggcccacacggagggggucaccguggugcggccgcuccugcacgaguucgucagcgaccaggugaccugggacaucgacucccaguuccugcucggccccgccuuccuggugagccccguccuggagcgcaacgcccggaacgugaccgccuacuucccccgcgcgcggugguacgacuacuacacggggguggacaucaacgcccgcggcgaguggaagacccucccggcgccccucgaccacaucaaccugcacguccggggcggguacauccugcccuggcaggagcccgcccucaacacccaccugucccgccagaaguucaugggcuucaagaucgcccuggacgacgaggggaccgcgggcggguggcuguucugggacgacggccagagcaucgacacguacggcaaggggcuguacuaccuggccuccuucagcgccucccagaacaccaugcagagccacaucaucuucaacaacuacaucaccggcaccaacccgcucaagcugggguacaucgagaucuggggcguggggagcgugcccgucaccuccgugagcaucuccgugagcggcauggucaucacgcccuccuucaacaacgaccccaccacccaggugcugagcaucgacgugaccgaccggaacaucucccuccacaacuucacgagccugaccuggaucuccacccuguga

SEQ ID NO: 32897 - RNA, 723 nt, Artificial Sequence
  derived and/or modified sequence opt1 from MGARP__Homo_sapiens__NP_116012
auguaccugcgccgggccgugagcaagacccucgcccugccccugcgcgcgccgcccaaccccgcgccccucggcaaggacgccucccugcggcgcaugagcuccaaccgguucccggggagcuccggcagcaacaugaucuacuaccuggucgugggggugaccgucuccgccggcggguacuacgccuacaagacggugaccagcgaccaggccaagcacaccgagcacaagaccaaccucaaggagaagacgaaggccgagauccaccccuuccagggcgagaaggagaacguggccgagaccgagaaggccuccagcgaggcgcccgaggagcugaucgucgaggccgaggugguggacgccgaggagucccccagcgccaccgucguggugaucaaggaggccuccgcgugcccgggccacgucgaggccgcccccgagaccacggccgugagcgccgagaccgggcccgaggugaccgacgcggccgcccgcgagaccacggaggucaaccccgagaccaccccggaggugaccaacgccgcccuggacgaggcggugacgaucgacaacgacaaggacaccaccaagaacgagaccuccgacgaguacgccgagcucgaggaggagaacagccccgccgaguccgagagcuccgccggcgacgaccugcaggaggaggccagcgucgggagcgaggcggccuccgcccagggcuga

SEQ ID NO: 32898 - RNA, 1338 nt, Artificial Sequence
  derived and/or modified sequence opt1 from MGAT1__Homo_sapiens__XP_011532865
augcugaagaagcagagcgccggccucgugcuguggggcgccauccuguucgucgcguggaacgcccuccugcuccucuucuucuggacccgccccgccccggggcggccgcccuccgugagcgcccuggacggggaccccgccucccugacccgcgaggugauccggcucgcgcaggacgccgaggucgagcuggagcgccagcggggccugcuccagcagaucggggacgcccugagcucccagcgcggccgggugcccacggccgcgccgcccgcccagccccgcgugcccgucacccccgcccccgccgugauccccauccuggugaucgccugcgaccggagcaccguccgccggugccucgacaagcugcugcacuaccgcccguccgcggagcuguuccccaucaucgugagccaggacugcggccacgaggagaccgcccaggccaucgccuccuacgggagcgccgugacgcacauccggcagcccgaccuguccagcaucgcggugcccccggaccaccgcaaguuccagggcuacuacaagaucgcccggcacuaccgcugggcccugggccaggucuuccggcaguuccgcuuccccgccgccguggucguggaggacgaccucgagguggcgcccgacuucuucgaguacuuccgggccaccuacccccugcugaaggccgacccgucccucuggugcgucagcgccuggaacgacaacgggaaggagcagaugguggacgccucccgccccgagcugcuguaccggaccgacuucuuccccgggcucggcuggcugcugcucgcggagcugugggccgagcuggagcccaaguggccgaaggccuucugggacgacuggaugcgccgccccgagcagcggcagggccgcgccugcauccggcccgagaucagccgcaccaugacguucgggcggaagggcgugucccacgggcaguucuucgaccagcaccucaaguucaucaagcugaaccagcaguucguccacuucacccagcuggaccucagcuaccugcagcgcgaggcguacgaccgggacuuccuggcccgcguguacggcgcgccccagcuccagguggagaagguccggaccaacgaccgcaaggagcugggcgaggugcggguccaguacaccgggcgcgacuccuucaaggccuucgccaaggcccugggcgugauggacgaccucaagagcggggugccgcgggccggcuaccgcgggaucgucacguuccaguuccggggccgccgggugcaccuggccccgccccugaccugggagggcuacgaccccagcuggaacuga

SEQ ID NO: 32899 - RNA, 1344 nt, Artificial Sequence
  derived and/or modified sequence opt1 from MGAT2__Homo_sapiens__NP_002399
augcgcuuccggaucuacaagcgcaaggugcugauccucacccuggucguggccgccugcggguucgugcuguggagcuccaacgggcggcagcgcaagaacgaggcgcucgcgcccccgcugcuggacgccgagcccgcccggggcgccgggggccgcgggggcgaccaccccagcgucgccgugggcauccggcgcguguccaacgucagcgccgccucccucgugcccgccgugccgcagcccgaggcggacaaccugacccugcgguaccgcagccucgucuaccagcugaacuucgaccagacgcugcggaacguggacaaggccgggaccugggcgccccgcgagcucgugcuggucguccaggugcacaaccggcccgaguaccugcgccuccugcuggacucccuccggaaggcccagggcaucgacaacgugcuggugaucuucagccacgacuucugguccaccgagaucaaccagcugaucgccggggugaacuucugcccgguccuccagguguucuuccccuucagcauccagcuguaccccaacgaguuccccggcuccgacccgcgcgacugcccccgggaccugcccaagaacgccgcccucaagcuggggugcaucaacgccgaguaccccgacagcuucggccacuaccgcgaggccaaguucucccagaccaagcaccacuggugguggaagcugcacuucgugugggagcgggucaagauccuccgcgacuacgccggccugauccuguuccucgaggaggaccacuaccuggcgccggacuucuaccacguguucaagaagauguggaagcugaagcagcaggagugccccgagugcgacgugcucagccuggggacguacuccgccagccgguccuucuacggcauggccgacaaggucgacgugaagaccuggaaguccaccgagcacaacauggggcuggcccucacccgcaacgccuaccagaagcugaucgagugcacggacaccuucugcaccuacgacgacuacaacugggacuggacccugcaguaccucacggucuccugccugcccaaguucuggaaggugcuggugccccagaucccgcgcaucuuccacgcgggcgacugcggcaugcaccacaagaagaccugccggcccagcacccagagcgcccagaucgagucccuccugaacaacaacaagcaguacauguuccccgagacccugacgaucagcgagaaguucaccgucguggccaucagcccgccccgcaagaacgggggcuggggcgacauccgggaccacgagcucugcaagagcuaccgccggcugcaguga

SEQ ID NO: 32900 - RNA, 1602 nt, Artificial Sequence
  derived and/or modified sequence opt1 from MGAT3__Homo_sapiens__NP_001091740
augaagaugcgccgguacaagcuguuccucauguucugcauggccggccugugccugaucagcuuccuccacuucuucaagacccuguccuacgugaccuucccccgcgagcuggccagccucucccccaaccuggucagcuccuucuucuggaacaacgcgcccgugacgccccaggccagccccgagcccgggggccccgaccugcuccggacgccccuguacucccacagcccccugcuccagccgcugccgcccuccaaggccgccgaggagcugcaccgcguggaccucguccugcccgaggacaccaccgaguacuucgugcggacgaaggccgggggcgugugcuucaagccggggaccaagaugcuggagcgcccgccgcccggccggcccgaggagaagcccgagggcgcgaacgggagcuccgcccgccggccgccccgcuaccuccugagcgcccgggagcgcaccggcgggcggggcgcccgccggaagugggucgagugcgugugccugcccggguggcacggccccuccugcggcgugcccaccgucgugcaguacagcaaccuccccacgaaggagcgccuggugccccgggaggucccccgccgggugaucaacgcgaucaacgugaaccacgaguucgaccugcucgacguccgcuuccacgagcugggggacgugguggacgccuucgucgugugcgaguccaacuucaccgccuacggcgagccccggccccugaaguuccgcgagaugcucaccaacgggaccuucgaguacauccgccacaaggugcuguacgucuuccuggaccacuucccgcccggcggccggcaggacggguggaucgccgacgacuaccuccgcacguuccugacccaggacggcgugagccggcugcgcaaccuccggcccgacgacguguucaucaucgacgacgccgacgagaucccggcgcgcgacgggguccuguuccugaagcucuacgacggcuggaccgagcccuucgccuuccacaugcggaagucccuguacggguucuucuggaagcagcccggcacccuggagguggucagcggcugcacgguggacaugcuccaggccguguacgggcuggacggcauccgccugcggcgccggcaguacuacaccaugcccaacuuccgccaguacgagaaccggaccgggcacauccucguccaguggucccugggcagcccgcugcacuucgccggguggcacugcagcuggugcuucacccccgagggcaucuacuucaagcucguguccgcccagaacggcgacuucccccgcuggggcgacuacgaggacaagcgggaccugaacuacauccgcgggcugauccggaccgggggcugguucgacgggacccagcaggaguacccgcccgcggaccccagcgagcacauguacgcccccaaguaccuccugaagaacuacgaccgcuuccacuaccugcuggacaaccccuaccaggagccgcgguccaccgccgccggcggcuggcgccaccgcgggcccgagggccggccgcccgcccgcgggaagcucgacgaggcggagguguga

SEQ ID NO: 32901 - RNA, 1272 nt, Artificial Sequence
  derived and/or modified sequence opt1 from MGAT4A__Homo_sapiens__NP_001153626
augaacuacagcaucaccguguccaucgucaugggcauccccaccgugaagcgcgaggucaagagcuaccugaucgagacgcuccacucccugaucgacaaccuguacccggaggagaagcucgacugcgugaucgugguguucaucggggagaccgacaucgacuacguccacggcgugguggccaaccuggagaaggaguucagcaaggagaucuccagcgggcuggucgaggugaucuccccgcccgagagcuacuaccccgaccucaccaaccugaaggagaccuucggcgacuccaaggagcgggugcgcuggcggacgaagcagaaccuggacuacugcuuccucaugauguacgcccaggagaaggggaucuacuacauccagcuggaggacgacaucaucgucaagcagaacuacuucaacaccaucaagaacuucgcccugcagcucagcuccgaggaguggaugauccuggaguucagccagcugggcuucaucggcaagauguuccaggcccccgaccucacccugaucguggaguucaucuucauguucuacaaggagaagcccaucgacuggcugcucgaccacauccugugggugaaggucugcaaccccgagaaggacgccaagcacugcgaccgccagaaggccaaccugcggauccgcuuccggcccucccucuuccagcacguggggcugcacagcucccugagcggcaagauccagaagcucaccgacaaggacuacaugaagccgcugcugcucaagauccacgugaacccgcccgccgaggucuccacgagccugaagguguaccaggggcacacccuggagaagaccuacaugggcgaggacuucuucugggcgaucacccccaucgccggggacuacauccucuucaaguucgacaagcccgugaacgucgaguccuaccuguuccacagcggcaaccaggagcaccccggcgacauccugcucaacacgaccguggaggugcugcccuucaagagcgaggggcuggagaucuccaaggagaccaaggacaagcgccucgaggacggcuacuuccggaucgggaaguucgagaacggcgucgccgagggcaugguggaccccagccugaacccgaucuccgccuuccgccugagcgucauccagaacuccgcggugugggccauccucaacgagcagcggguguucagcgggugguggcagaagucccgcgacaaggccgagggcccccaggcgccccugcuguucuga

SEQ ID NO: 32902 - RNA, 1647 nt, Artificial Sequence
  derived and/or modified sequence opt1 from MGAT4B__Homo_sapiens__NP_055090
augcgccugcggaacggcaccuuccucacccugcuccuguucugccugugcgccuuccugagccucuccugguacgccgcgcugagcgggcagaagggcgacguggucgacguguaccagcgcgaguuccuggcccuccgggaccgccugcacgccgccgagcaggagucccugaagcggagcaaggagcucaaccuggugcuggacgagaucaagcgcgccgucuccgagcggcaggcgcuccgcgacggggacggcaaccggacgugggggcgccugaccgaggacccccggcugaagccguggaacggcagccaccgccacgugcuccaccuccccaccguguuccaccaccucccccaccuccuggccaaggaguccagccugcagcccgccguccgggugggccaggggcgcaccggcguguccgucgugauggggaucccgagcgugcggcgcgagguccacuccuaccugacggacacccugcacagccugaucuccgagcugagcccccaggagaaggaggacuccgugaucgugguccugaucgccgagaccgacagccaguacaccuccgcggugacggagaacaucaaggcccuguuccccaccgagauccacagcggccuccuggaggugaucucccccagcccgcacuucuaccccgacuucagccggcugcgcgaguccuucggggaccccaaggagcggguccgcuggcggaccaagcagaaccucgacuacugcuuccugaugauguacgcccagagcaagggcaucuacuacgugcagcuggaggacgacaucguggccaagcccaacuaccucuccaccaugaagaacuucgcccugcagcagccgagcgaggacuggaugauccuggaguucucccagcucggcuucaucgggaagauguucaagagccuggaccugucccucaucgucgaguucauccugauguucuaccgcgacaagcccaucgacuggcugcucgaccacauccugugggugaaggugugcaaccccgagaaggacgcgaagcacugcgaccgccagaaggccaaccugcggauccgcuucaagcccagccucuuccagcacgucggcacgcacuccagccuggccgggaagauccagaagcugaaggacaaggacuucggcaagcaggcccugcggaaggagcacgugaacccgcccgccgaggucuccaccagccucaagaccuaccagcacuucacccuggagaaggcguaccugcgcgaggacuucuucugggccuucacgcccgccgccggcgacuucauccgguuccgcuucuuccagccccuccggcuggagcgcuucuucuuccgguccgggaacaucgagcacccggaggacaagcuguucaacaccagcguggaggugcuccccuucgacaacccccaguccgacaaggaggcccugcaggagggccgcaccgcgacccugcgguacccccgcagcccggacggguaccuccagaucggcuccuucuacaagggggucgccgagggcgagguggaccccgccuucggcccccuggaggcccugcggcucagcauccagacggacucccccgugugggucauccugagcgagaucuuccugaagaaggccgacuga

SEQ ID NO: 32903 - RNA, 1437 nt, Artificial Sequence
  derived and/or modified sequence opt1 from MGAT4C__Homo_sapiens__NP_037376
auguucaaguuccaccagaugaagcacaucuucgagauccuggacaagaugcgcugccuccggaagcgcagcaccguguccuuccugggcguccuggugaucuuccuccuguucaugaaccuguacaucgaggacagcuacgugcucgagggggacaagcagcugauccgggagaccuccacgcaccagcugaacagcgagcgcuacguccacaccuucaaggaccucuccaacuucagcggcgccaucaacgugaccuaccgguaccuggccgcgacgccccugcagcgcaagcgguaccucaccaucgggcuguccagcgugaagcgcaagaagggcaacuaccugcucgagaccaucaaguccaucuucgagcagagcuccuacgaggagcugaaggagaucagcgucguggugcaccuggccgacuucaacuccagcuggcgggacgccaugguccaggacaucacccagaaguucgcccaccacaucaucgccgggcgccucauggugauccacgcgccggaggaguacuaccccauccuggacggccugaagcggaacuacaacgaccccgaggaccgcgugaaguuccgguccaagcagaacgucgacuacgccuuccuccugaacuucugcgccaacaccagcgacuacuacgugaugcuggaggacgacgugcgcugcuccaagaacuuccucacggccaucaagaaggucaucgcgagccuggagggcaccuacugggugacccuggaguucuccaagcucggguacaucggcaagcuguaccacagccacgaccugccccggcucgcccacuuccugcugauguucuaccaggagaugccgugcgacuggcuccugacccacuuccgcgggcugcucgcccagaagaacgugauccgguucaagcccagccuguuccagcacaugggcuacuacuccagcuacaaggggacggagaacaagcugaaggacgacgacuucgaggaggaguccuucgacauccccgacaacccgcccgccagccucuacaccaacaugaacgucuucgagaacuacgaggccuccaaggcguacagcuccguggacgaguacuucuggggcaagccgcccagcaccggcgacguguucgucaucguguucgagaaccccaucaucaucaagaagaucaaggugaacaccgggacggaggaccgccagaacgacauccugcaccacggcgcccuggacgucggggagaacgugaugcccuccaagcagcggcgccagugcagcaccuaccuccggcugggcgaguucaagaacggcaacuucgagauguccggggucaaccagaagauccccuucgacauccacugcaugcgcaucuacgugaccaagacccagaaggaguggcugaucauccgcagcaucuccaucuggacgagcuga

SEQ ID NO: 32904 - RNA, 2379 nt, Artificial Sequence
  derived and/or modified sequence opt1 from MGAT5B__Homo_sapiens__NP_001186101
augaucaccgugaaccccgacggcaagaucaugguccgccggugccuggugacccuccgcccguuccggcuguucgugcuggggaucggcuucuucacgcucugcuuccugaugaccagccucgggggccaguucuccgcccgccggcugggggacagccccuucaccauccgcaccgaggucaugggcggccccgagucccgcggggugcugcgcaagaugagcgaccugcucgagcugauggugaagcggauggacgcccuggcgcgccucgagaacuccagcgagcugcaccgggccggcggggaccugcacuuccccgccgaccgcaugccgcccggcgccgggcucauggagcggauccaggccaucgcgcagaacgucuccgacaucgccgugaagguggaccagauccugcgccacagccugcuccugcacuccaaggucagcgagggccggcgcgaccagugcgaggcccccuccgaccccaaguucccggacugcagcggcaagguggaguggaugcgggcccgcuggacguccgaccccugcuacgcguucuucgggguggacggcaccgagugcagcuuccugaucuaccucuccgaggucgagugguucugcccgccccugcccuggcggaaccagaccgccgcccagcgcgcccccaagccccugcccaaggugcaggccguguuccggagcaaccucucccaccuccuggaccugauggggagcggcaaggagucccugaucuucaugaagaagcgcaccaagcgccugacggcgcagugggcccucgccgcccagcggcuggcccagaagcugggcgcgacccagcgcgaccagaagcagauccucguccacaucggguuccugaccgaggagagcggcgacguguucagcccgcgggugcugaagggcgggccccucggggagaugguccagugggccgacauccugaccgcccuguacgugcucggccacggccugcgcgugacggucucccugaaggagcuccagagcaaccugggggugccgcccggccggggguccugcccccugaccaugccccuccccuucgaccugaucuacaccgacuaccacggccugcagcagaugaagcgccacauggggcucagcuucaagaaguaccggugccgcauccgggugaucgacaccuucggcacggagcccgccuacaaccacgaggaguacgccacccugcacggcuaccgcaccaacuggggguacuggaaccugaacccgaagcaguucaugaccauguucccccacacgcccgacaacuccuucaugggcuucgucagcgaggagcugaacgagaccgagaagcggcucaucaagggcgggaaggcguccaacauggccguggucuacgggaaggaggccagcaucuggaagcugcagggcaaggagaaguuccugggcauccucaacaaguacauggagauccacgggaccguguacuacgagucccagcggcccccggaggugcccgccuucgucaagaaccacggccugcugccccagccggaguuccagcagcuccugcggaaggccaagcuguucaucggguucggcuuccccuacgagggccccgcgccccucgaggccaucgccaacgggugcaucuuccugcagagccgcuucuccccgccccacagcucccugaaccacgaguucuuccggggcaagcccaccagccgcgagguguucucccagcaccccuacgccgagaacuucaucgggaagccgcacguguggacggucgacuacaacaacagcgaggaguucgaggcggccaucaaggccaucaugcggacccagguggaccccuaccuccccuacgaguacacgugcgagggcaugcuggagcgcauccacgccuacauccagcaccaggacuucugccgggcccccgacccggcgcugcccgaggcccacgcgccccagucccccuucgugcucgccccgaacgccacccaccuggagugggcccgcaacaccagccuggcccccggggccuggccgcccgcccacgcccuccgcgcguggcuggccguccccggccgggccugcaccgacacgugccuggaccacggccucaucugcgagcccuccuucuuccccuuccugaacagccaggacgccuuccugaagcuccaggugcccugcgacagcaccgaguccgagaugaaccaccuguacccggcguucgcccagcccgggcaggagugcuaccugcagaaggagccccuccuguucagcugcgccggcuccaacaccaaguaccgccggcugugcccgugccgcgacuuccggaagggccagguggcccucugccaggggugccuguga

SEQ ID NO: 32905 - RNA, 2226 nt, Artificial Sequence
  derived and/or modified sequence opt1 from MGAT5__Homo_sapiens__XP_011509505
auggcccuguucacccccuggaagcucagcucccagaagcugggguucuuccuggugaccuucggguucaucuggggcaugaugcuccugcacuucacgauccagcagcgcacccagccggagagcuccagcaugcugcgggagcagauccucgaccuguccaagcgcuacaucaaggcccuggcggaggagaaccggaacgucguggacgggcccuacgccggcgugaugaccgccuacgaccucaagaagacccuggccguccugcucgacaacauccugcagcgcaucgggaagcuggagagcaagguggacaaccucguggucaacggcacgggcaccaacuccaccaacagcaccacggccgugcccucccugguggcgcuggagaagaucaacgucgccgacaucaucaacggggcccaggagaagugcgugcugcccccgauggacggcuacccccacugcgaggggaagaucaaguggaugaaggacauguggcggagcgaccccugcuacgccgacuacggcguggacggguccacgugcagcuucuucaucuaccuguccgaggucgagaacuggugcccccaccucccguggcgcgcgaagaaccccuacgaggaggccgaccacaacagccucgccgagauccggaccgacuucaacauccuguacuccaugaugaagaagcacgaggaguuccgcuggaugcggcugcgcauccggcgcauggccgacgccuggauccaggcgaucaagagccucgccgagaagcagaaccuggagaagcggaagcgcaagaaggugcuggugcaccucggccugcugaccaaggaguccggcuucaagaucgccgagaccgccuucagcgggggcccccucggggagcugguccagugguccgaccugaucaccagccucuaccugcugggccacgacauccggaucagcgccucccucgcggagcugaaggagaucaugaagaagguggugggcaaccgcagcgggugccccaccgucggcgaccggaucguggagcugaucuacaucgacaucguggggcucgcccaguucaagaagacccugggcccguccuggguccacuaccagugcaugcugcgcgugcucgacagcuucgggacggagcccgaguucaaccacgccaacuacgcccaguccaagggccacaagacccccuggggcaaguggaaccugaacccccagcaguucuacaccauguucccgcacacccccgacaacagcuuccugggguucguggucgagcagcaccucaacuccagcgacauccaccacaucaacgagaucaagcggcagaaccagucccugguguacggcaaggucgacagcuucuggaagaacaagaagaucuaccuggacaucauccacacguacauggaggugcacgccaccguguacggguccagcaccaagaacauccccuccuacgucaagaaccacggcauccucagcgggcgcgaccugcaguuccugcugcgggagaccaagcuguucgugggccugggcuuccccuacgaggggccggcgccccuggaggccaucgccaacggcugcgccuuccucaaccccaaguucaacccgcccaaguccagcaagaacacggacuucuucaucgggaagcccacccugcgcgagcugaccucccagcaccccuacgccgagguguucaucggccgcccccacgucuggaccguggaccucaacaaccaggaggagguggaggacgcggucaaggccauccugaaccagaagaucgagccguacaugcccuacgaguucacgugcgaggggaugcugcagcggaucaacgccuucaucgagaagcaggacuucugccacggccaggugauguggcccccgcucagcgcccuccaggugaagcuggcggagcccggccaguccugcaagcaggucugccaggagagccagcucaucugcgagcccagcuucuuccagcaccugaacaaggacaaggacaugcugaaguacaaggugaccugccaguccagcgagcucgccaaggacauccuggugcccuccuucgacccgaagaacaagcacugcgucuuccagggggaccugcuccuguucagcugcgccggcgcccacccccgccaccagcgggugugccccugccgcgacuucaucaagggccagguggcccugugcaaggacugccucuga

SEQ ID NO: 32906 - RNA, 2592 nt, Artificial Sequence
  derived and/or modified sequence opt1 from MGEA5__Homo_sapiens__NP_001135906
auggugcagaaggagagccaggccacccuggaggagcgcgaguccgagcucagcuccaaccccgccgcgagcgccggcgccucccuggagccgcccgccgcccccgcgcccggggaggacaacccggccggcgccgggggcgccgcggucgccggggccgccggcggcgcccggcgcuuccugugcggggugguggagggcuucuacgggcggcccugggucauggagcagcgcaaggagcuguuccggcgccuccagaagugggagcugaacaccuaccucuacgcgcccaaggacgacuacaagcaccggauguucuggcgcgagauguacagcguggaggaggccgagcagcugaugacgcugaucuccgccgcccgggaguacgagaucgaguucaucuacgccaucagccccggccucgacaucaccuucuccaacccgaaggaggugagcacccugaagcgcaagcuggaccaggucucccaguucgggugccggagcuucgcgcuccuguucgacgacaucgaccacaacaugugcgccgccgacaaggagguguucuccagcuucgcccacgcccagguguccaucaccaacgagaucuaccaguaccugggcgagcccgagacguuccucuucugccccaccgaguacugcggcaccuucugcuaccccaacgucagccaguccccguaccugcgcaccgugggggagaagcugcuccccggcaucgaggugcuguggacggggcccaaggucgugagcaaggagauccccguggaguccaucgaggaggucagcaagaucaucaagcgggcgccggugaucugggacaacauccacgccaacgacuacgaccagaagcgccuguuccucggccccuacaagggccggagcaccgagcugaucccccgccugaagggggugcucaccaaccccaacugcgaguucgaggccaacuacgucgccauccacacccuggccacgugguacaaguccaacaugaacggcgugcggaaggacguggucaugagccgccagguggcgcacuccggggccaaggccagcguggucgacggcaccccgcugguggccgcgcccucccucaacgccaccaccgucgugacgaccguguaccaggagcccaucaugagccagggggccgcccuguccggcgagcccaccacccugacgaaggaggaggagaagaagcagccggacgaggagcccauggacauggucguggagaagcaggaggagaccgaccacaagaacgacaaccagauccucagcgagaucguggaggccaagauggcggaggagcugaagcccauggacaccgacaaggaguccaucgccgagagcaagucccccgagaugagcaugcaggaggacugcaucuccgacaucgccccgaugcagaccgacgagcagacgaacaaggagcaguucguccccggccccaacgagaagccgcuguacaccgccgagcccgugacccucgaggaccugcagcugcucgccgaccuguucuaccugcccuacgagcacgggcccaagggcgcgcagaugcuccgggaguuccaguggcugcgcgccaacagcuccguggucagcgugaacugcaaggggaaggacuccgagaagaucgaggaguggcggagccgcgccgccaaguucgaggagaugugcggccuggugauggggauguucacccgccucuccaacugcgccaaccggacgauccuguacgacauguacagcuacgucugggacaucaagagcaucauguccauggucaagagcuucgugcaguggcugggcugccgcucccacagcuccgcgcaguuccucaucggcgaccaggagccgugggccuuccgcgggggccuggccggggaguuccagcggcugcuccccaucgacggcgccaacgaccuguucuuccagcccccgccccugacccccaccagcaagguguacaccauccggcccuacuuccccaaggacgaggcguccguguacaagaucugccgcgagauguacgacgacggggugggccugccguuccagagccagcccgaccucaucggcgacaagcuggucgggggccugcucucccugagccuggacuacugcuucgugcucgaggacgaggacgggaucugcggcuacgcccugggcacgguggacgucacccccuucaucaagaagugcaagaucuccuggauccccuucaugcaggagaaguacaccaagccgaacggggacaaggagcugagcgaggccgagaagaucaugcucuccuuccacgaggagcaggaggugcugcccgagaccuuccuggccaacuuccccagccucaucaagauggacauccacaagaaggugacggaccccuccgucgccaagagcaugauggcgugccugcuguccagccucaaggccaacggcagccgcggggccuucugcgaggugcggccggacgacaagcggauccuggaguucuacuccaagcugggcugcuucgagaucgccaagauggagggguuccccaaggacguggucauccucggccgcagccuguga

SEQ ID NO: 32907 - RNA, 912 nt, Artificial Sequence
  derived and/or modified sequence opt1 from MGLL__Homo_sapiens__NP_001003794
augcccgaggagagcuccccgcgccggacgccccagagcauccccuaccaggaccugccccaccucgugaacgccgacggccaguaccuguucugccgcuacuggaagccgaccgggacgcccaaggcccugaucuucgucucccacggcgcgggggagcacagcggccgguacgaggagcucgcccgcaugcugauggggcuggaccuccugguguucgcccacgaccacgugggccacggccaguccgagggggagcggauggucgugagcgacuuccacguguucguccgcgacgugcugcagcacguggacuccaugcagaaggacuaccccggccuccccgucuuccugcuggggcacagcaugggcggggccaucgccauccucaccgcggccgagcggcccggccacuucgccggcauggugcugaucagcccccuggugcucgccaaccccgaguccgcgaccaccuucaagguccuggccgccaaggugcugaaccucgugcugcccaaccugucccucgggccgaucgacagcuccguccugagccgcaacaagaccgagguggacaucuacaacuccgacccccugaucugccgggccggccucaaggugugcuucgggauccagcugcugaacgccgucagccgcguggagcgggcgcuccccaagcugaccgugcccuuccugcuccugcagggcuccgccgaccgccugugcgacagcaagggcgccuaccuccugauggagcuggccaagucccaggacaagacccucaagaucuacgagggggccuaccacguccugcacaaggagcugccggaggugaccaacagcguguuccacgagaucaacaugugggucagccagcggacggcgaccgccggcaccgccuccccgcccuga

SEQ ID NO: 32908 - RNA, 1035 nt, Artificial Sequence
  derived and/or modified sequence opt1 from MGME1__Homo_sapiens__NP_443097
augaagaugaagcuguuccagaccaucugccgccagcuccggagcuccaaguucagcguggaguccgccgcccuggucgcguucagcaccuccagcuacuccugcggccgcaagaagaaggugaaccccuacgaggagguggaccaggagaaguacagcaaccugguccaguccgugcucagcucccgcgggguggcccagacgccgggcagcgucgaggaggacgcccugcugugcgggcccguguccaagcacaagcuccccaaccagggcgaggaccggcgggugccccagaacugguucccgaucuucaaccccgagcgcagcgacaagcccaacgccuccgaccccagcgucccgcugaagaucccccugcagcggaacgugauccccuccgugacccgcguccuccagcagaccaugaccaagcagcaggucuuccugcuggagcgguggaagcagcgcaugauccucgagcugggggaggacggcuucaaggaguacacgagcaacguguuccugcagggcaagcgguuccacgaggcccucgaguccauccugagcccccaggagacccugaaggagcgcgacgagaaccuccucaagagcggguacaucgaguccgugcagcacauccugaaggacgugagcggcgugcgggcgcuggaguccgccguccagcacgagacccugaacuacaucgggcugcucgacugcguggccgaguaccagggcaagcugugcgugaucgacuggaagaccagcgagaagccgaagcccuucauccaguccacguucgacaacccccugcaggucguggccuacaugggggcgaugaaccacgacaccaacuacagcuuccaggugcagugcggccucaucgucguggccuacaaggacggcucccccgcccacccgcacuucauggacgccgagcugugcagccaguacuggaccaaguggcugcuccgccuggaggaguacaccgagaagaagaagaaccagaacauccagaagcccgaguacuccgaguga

SEQ ID NO: 32909 - RNA, 717 nt, Artificial Sequence
  derived and/or modified sequence opt1 from MGMT__Homo_sapiens__NP_002403
augcugggccagcccgccccgcucgagcgcuucgccagccggcgcccccaggugcuggcgguccggaccgugugcgaccuggugcucgggaagauggacaaggacugcgagaugaagcgcaccacgcuggacagcccccugggcaagcucgagcuguccgggugcgagcagggccugcacgagaucaagcuccuggggaagggcaccuccgccgccgacgccgucgaggugcccgccccggcggccgugcugggcgggcccgagccccucaugcagugcaccgccuggcugaacgccuacuuccaccagcccgaggcgaucgaggaguucccgguccccgcccugcaccaccccguguuccagcaggagagcuucacccgccaggugcucuggaagcugcugaaggucgugaaguucggcgaggugaucuccuaccagcagcucgccgcccuggccgggaaccccaaggcggcccgggccgucggcggggccaugcggggcaacccggugcccauccugauccccugccaccgcguggucugcagcuccggcgccguggggaacuacagcggcgggcucgcggugaaggaguggcugcuggcccacgagggccaccggcucggcaagcccgggcugggcggguccagcggccuggccggggccuggcucaagggcgccggcgcgacguccgggagcccgcccgccggccgcaacuga

SEQ ID NO: 32910 - RNA, 312 nt, Artificial Sequence
  derived and/or modified sequence opt1 from MGP__Homo_sapiens__NP_000891
augaagucccugauccuccuggccauccuggccgcgcucgccguggucacccugugcuacgagagccacgagagcauggaguccuacgagcugaaccccuucaucaaccgccggaacgccaacaccuucaucagcccgcagcagcgcuggcgggccaaggugcaggagcgcauccgggagcgcuccaagcccgugcacgagcucaaccgggaggccugcgacgacuaccgccugugcgagcgguacgcgauggucuacggcuacaacgccgccuacaaccgcuacuuccggaagcgccgggggacgaaguga

SEQ ID NO: 32911 - RNA, 1665 nt, Artificial Sequence
  derived and/or modified sequence opt1 from MGRN1__Homo_sapiens__NP_001135761
augggcagcauccugucccgccggaucgccgggguggaggacaucgacauccaggccaacagcgcguaccgcuacccgcccaaguccggcaacuacuucgccagccacuucuucaugggcggggagaaguucgacacgccccaccccgagggguaccucuucggcgagaacauggaccugaacuuccugggcucccggcccguccaguucccguacgugacccccgcgccccacgagcccgugaagacccuccgcagccuggucaacauccggaaggacucccugcgccucgugcgguacaaggacgacgccgacagcccgaccgaggacggggacaagccccgcgugcuguacucccuggaguucaccuucgacgccgacgcccgggucgccaucaccaucuacugccaggccagcgaggaguuccucaacggccgcgccguguacucccccaagagccccucccugcagagcgagaccgugcacuacaagcgcggggucucccagcaguucagccugccguccuucaagaucgacuucagcgaguggaaggacgacgagcucaacuucgaccuggaccggggcguguuccccguggucauccaggcggugguggacgagggggacgucguggaggugaccggccacgcccacguccugcucgccgccuucgagaagcacauggacggcuccuucagcgugaagccccugaagcagaagcagaucguggaccgggucagcuaccugcuccaggagaucuacgggaucgagaacaagaacaaccaggagaccaagcccuccgacgacgagaacagcgacaacuccaacgagugcguggugugccugagcgaccugcgcgacacccucauccugccgugccggcaccugugccucugcacguccugcgccgacacccugcgcuaccaggcgaacaacugccccaucugccggcugcccuuccgcgcccuccugcagauccgggccguccgcaagaagcccggcgcccugagcccgguguccuucagccccguccucgcccagucccuggagcacgacgagcacagcaacuccgacagcgugccgcccggguacgagcccaucucccugcucgaggcgcugaacggccugcgggccgugagccccgccauccccuccgcgccccucuacgaggagaucaccuacagcggcaucuccgacgggcugagccaggccuccugcccgcuggccgccaucgaccacauccucgacagcagccgccagaagggccgcccccaguccaaggcccccgacagcacccugcgguccccgagcucccccauccacgaggaggacgaggagaagcugagcgaggacgucgacgcgcccccgccccucgggggcgccgagcuggcccugcgcgaguccagcucccccgagagcuucaucacggaggagguggacgaguccagcagcccccagcaggggacccgggccgccuccaucgagaacgugcuccaggacuccagccccgagcacugcggccgcggcccgcccgccgacaucuaccugcccgggcggcccaccuccauggagaccgcgcacggccuggccacgaccagcccgaccuggccgccccucgggggccccagccccgaccccuccgccgccgagcugacgccccuguga

SEQ ID NO: 32912 - RNA, 468 nt, Artificial Sequence
  derived and/or modified sequence opt1 from MGST1__Homo_sapiens__NP_001247440
augguggaccugacccaggucauggacgacgagguguucauggccuucgccagcuacgcgaccaucauccucuccaagaugaugcugaugagcaccgccaccgccuucuaccgccugacccggaagguguucgccaaccccgaggacugcgucgccuucggcaagggggagaacgcgaagaaguaccuccgcaccgacgaccggguggagcgcgugcggcgcgcccaccugaacgaccuggagaacaucaucccguuccucggcaucgggcugcuguacucccucagcggccccgaccccuccacggccauccugcacuuccggcuguucgucggggcccgcaucuaccacaccaucgcguaccucacgccccugccgcagcccaaccgggcccugagcuucuucgugggcuacggcgugacccucuccauggccuaccgccugcucaagagcaagcuguaccuguga

SEQ ID NO: 32913 - RNA, 444 nt, Artificial Sequence
  derived and/or modified sequence opt1 from MGST2__Homo_sapiens__NP_001191295
auggccggcaacagcauccugcucgccgcgguguccauccugagcgccugccagcaguccuacuucgcccugcaggucgggaaggcccgccucaaguacaaggugacgcccccggccgugaccggcagccccgaguucgagcgggucuuccgcgcgcagcagaacugcguggaguucuaccccaucuucaucaucacccuguggauggccgggugguacuucaaccagguguucgcgaccugccugggccucgucuacaucuacgggcggcaccuguacuucuggggcuacuccgaggccgccaagaagcgcaucaccggcuuccggcugagccucgggauccuggcccugcucacccugcugggcgcccucgggaucgccaacuccuuccuggacgaguaccuggaccucaacaucgccaagaagcugcgccggcaguucuga

SEQ ID NO: 32914 - RNA, 459 nt, Artificial Sequence
  derived and/or modified sequence opt1 from MGST3__Homo_sapiens__NP_004519
auggccgugcugagcaaggaguacggcuucguccuccugaccggggccgcguccuucaucaugguggcccaccuggccaucaacgugagcaaggcccggaagaaguacaaggucgaguaccccaucauguacuccaccgacccggagaacggccacaucuucaacugcauccagcgggcccaccagaacacgcucgagguguacccgcccuuccuguucuuccuggcggucgggggcguguaccacccccgcaucgccagcgggcucggccuggccuggaucgugggccgggugcuguacgccuacggguacuacaccggcgagcccuccaagcgcagccgcggggcgcucggcuccaucgcccugcuggggcucgucggcaccaccgugugcagcgccuuccagcaccugggcugggugaaguccgggcugggcagcgggcccaagugcugccacuga

SEQ ID NO: 32915 - RNA, 1965 nt, Artificial Sequence
  derived and/or modified sequence opt1 from MIA2__Homo_sapiens__NP_473365
auggccaaguucggcgugcaccgcauccugcuccuggccaucagccugaccaagugccucgaguccaccaagcugcuggcggaccucaagaagugcggggaccuggagugcgaggcccugaucaaccgggucagcgccaugcgcgacuaccggggccccgacugccgcuaccucaacuucacgaagggggaggagaucuccguguacgugaagcuggccggcgagcgggaggaccugugggccgggagcaagggcaaggaguucggcuacuucccgcgcgacgcgguccagaucgaggagguguucaucuccgaggagauccagaugagcaccaaggaguccgacuuccucugccugcugggggugagcuacaccuucgacaacgaggacuccgagcucaacggcgacuacggggagaacaucuaccccuacgaggaggacaaggacgagaaguccagcaucuacgagagcgacuuccagaucgagcccggcuucuacgccaccuacgaguccacgcuguucgaggaccagguccccgcccuggaggccccggaggacaucgggagcaccuccgagagcaaggacugggaggaggugguggucgaguccauggagcaggaccggauccccgaggugcacgugccgcccagcuccgcggucagcggcgugaaggagugguucggccucgggggcgagcaggccgaggagaaggccuucgagagcgugaucgagcccguccaggaguccagcuuccgcucccggaagaucgccguggaggacgagaacgaccuggaggagcugaacaacggggagccccagaccgagcaccagcaggagagcgaguccgagaucgacagcgugcccaagacccaguccgagcucgccagcgaguccgagcacauccccaagccgcagagcacgggcugguucggcgggggcuucaccuccuaccugggguucggcgacgaggacaccgggcuggagcucaucgcggaggagagcaacccgccccugcaggacuuccccaacuccaucagcuccgacaaggaggccaccguccccugcacggagauccugaccgagaagaaggacaccaucaccaacgacagccucucccugaagcccagcugguucgacuucggcuucgccauccugggcuucgccuacgccaaggaggacaagaucaugcucgacgaccgcaagaacgaggaggacgggggcgcggacgagcacgagcacccccugacguccgagcuggaccccgagaaggagcaggagaucgagaccaucaagaucaucgagaccgaggaccagaucgacaagaagccggugagcgagaagaccgacgagagcgacacgauccccuaccucaagaaguuccuguacaacuucgacaaccccuggaacuuccagaacauccccaaggagaccgagcugccguuccccaagcagauccucgaccagaacaacgugaucgagaacgaggagaccggggaguucuccaucgacaacuaccccaccgacaacacgaaggucaugaucuucaagagcuccuacagccuguccgacauggugagcaacaucgagcugcccacccggauccacgaggagguguacuucgagccguccagcuccaaggacagcgacgagaacuccaagcccagcgucgacaccgagggccccgcccucguggagaucgaccgcuccgucgagaacacccugcugaacagccagaugguguccacggacaacagccucuccagccagaacuacaucagccagaaggaggacgccuccgaguuccagauccugaaguaccuguuccagaucgacguguacgacuucaugaacagcgccuucuccccgaucgucauccucaccgagcgggugagccugcccuucaagcccuucgccaucauccugcccauccuccugaacauccgcguggcgaccaaguacgucuga

SEQ ID NO: 32916 - RNA, 2358 nt, Artificial Sequence
  derived and/or modified sequence opt1 from MIA3__Homo_sapiens__NP_001287796
auggacagcgugcccgccaccgucccguccaucgccgcgacccccggcgaccccgagcugguggggccccucagcgugcuguacgccgccuucaucgccaagcugcucgagcuggucgccacgcugccggacgacgugcagcccggccccgacuucuacgggcuccccuggaagccgguguucaucaccgcguuccugggcaucgccuccuucgccaucuuccuguggcgcaccguccucguggugaaggaccgggucuaccaggugaccgagcagcagaucagcgagaagcugaagacgaucaugaaggagaacaccgagcuggugcagaagcucuccaacuacgagcagaagaucaaggagagcaagaagcacguccaggagacccgcaagcagaacaugauccuguccgacgaggccaucaaguacaaggacaagaucaagacccuggagaagaaccaggagauccucgacgacacggcgaagaaccugcgggugaugcuggagagcgagcgcgagcagaacgugaagaaccaggaccucaucuccgagaacaagaagagcaucgagaagcugaaggacgucaucuccaugaacgccagcgaguucuccgaggugcagaucgcccugaacgaggccaagcucagcgaggagaaggugaaguccgagugccaccggguccaggaggagaacgcccgccugaagaagaagaaggagcagcugcagcaggagaucgaggacuggagcaagcuccacgcggagcuguccgagcagaucaagagcuucgagaagucccagaaggaccuggagguggcccucacccacaaggacgacaacaucaacgcccugaccaacugcaucacccagcugaaccuccuggagugcgagagcgagagcgaggggcagaacaagggcggcaacgacuccgacgagcuggccaacggggaggugggcggggaccggaacgagaagaugaagaaccagaucaagcagaugauggacgucagccgcacgcagaccgccaucuccgugguggaggaggaccucaagcugcugcagcucaagcugcgggcgagcgucuccaccaagugcaaccuggaggaccaggugaagaagcucgaggacgaccgcaacagccugcaggccgccaaggccggccuggaggacgagugcaagacccuccggcagaaggucgagauccugaacgagcuguaccagcagaaggagauggcccuccagaagaagcugucccaggaggaguacgagcgccaggagcgggagcaccgccugagcgcggccgacgagaaggccguguccgccgccgaggaggugaagacguacaagcggcgcaucgaggagauggaggacgagcuccagaagaccgagcggagcuucaagaaccagaucgcgacccacgagaagaaggcccacgagaacuggcugaaggcccgcgccgcggagcgggccaucgccgaggagaagcgcgaggccgccaaccugcggcacaagcugcucgagcugacccagaagauggcgaugcugcaggaggagcccgucaucgugaagcccaugcccgggaagccgaacacgcagaaccccccccgccgcggcccccucucccagaacggcagcuucgggccgucccccgugagcggcggggagugcucccccccccugaccgucgagccgcccgugcggccccugagcgccacccucaaccgccgggacaugccccgcuccgaguucggcagcguggacggcccgcugccccacccccggugguccgccgaggccagcgggaagcccagcccguccgaccccggcagcgggaccgccacgaugaugaacuccagcucccgcggcagcucccccacccggguccuggacgaggggaaggugaacauggcgccgaagggccccccccccuucccgggcgugccccucaugagcacccccauggggggccccgucccgccccccauccgcuacgggcccccgccccagcugugcggccccuucgggccccggccgcugcccccccccuucggcccgggcaugcgccccccccucgggcugcgggaguucgcccccggcgugccgcccgggcgccgggaccugccccuccacccgcgcggcuuccugcccgggcacgcccccuuccggccccugggcucccucggcccgcgcgaguacuucauccccgggacccggcugccccccccgacgcacggcccccaggaguacccccccccgcccgccgugcgcgaccugcuccccagcgggucccgggacgagcccccgcccgccagccaguccaccagccaggacugcucccaggcgcugaagcagagccccuga

SEQ ID NO: 32917 - RNA, 396 nt, Artificial Sequence
  derived and/or modified sequence opt1 from MIA__Homo_sapiens__NP_001189482
auggcccgcagccuggugugccucggcgucaucauccugcuguccgccuucagcgggcccggcgugcgcgggggcccgaugcccaagcucgcggaccggaagcugugcgccgaccaggagugcucccaccccaucagcauggccguggcccugcaggacuacauggcccccgacugccgguuccucaccauccaccgcgggcaggucguguacguguucuccaagcugaagggccggggccgccuguucuggggcgggagcguccagggggacuacuacggcgaccucgcggcccggcugggguacuucccguccagcaucgugcgcgaggaccagacccugaagcccggcaagguggacgucaagacggacaagugggacuucuacugccaguga

SEQ ID NO: 32918 - RNA, 3021 nt, Artificial Sequence
  derived and/or modified sequence opt1 from MIB1__Homo_sapiens__NP_065825
augagcaacucccgcaacaaccgggugauggucgagggcgugggggcccgcgugguccggggccccgacuggaagugggggaagcaggacggcggggagggccacgugggcaccgugcgcagcuucgaguccccggaggaggucgugguggucugggacaacgggaccgccgcgaacuaccggugcagcggcgccuacgaccugcgcauccucgacuccgcccccacggggaucaagcacgacggcaccaugugcgacacgugccggcagcagcccaucaucgggauccgcuggaagugcgccgagugcaccaacuacgaccugugcacggugugcuaccacggcgacaagcaccaccuccgccaccgcuucuaccggaucaccacccccggcagcgagcgcgugcugcuggagucccggcgcaagagcaagaagaucaccgcccgggggaucuucgcgggcgcccgcgucgugcgcgggguggacuggcagugggaggaccaggacggcggcaacgggcggcggggcaaggucacggagauccaggacugguccgccagcuccccgcacagcgccgcguacgugcugugggacaacggggccaagaaccucuaccgcgugggcuucgaggggauguccgaccugaagugcguccaggacgccaagggcggcagcuucuaccgggaccacugccccgugcugggggagcagaacggcaaccgcaaccccgggggccuccagaucggggaccuggugaacaucgaccuggaccucgagaucguccagucccugcagcacggccacggcggguggaccgacggcauguucgagacccugaccacgaccgggaccgugugcggcaucgacgaggaccacgacaucgugguccaguaccccagcgggaaccgcuggaccuucaacccggccgugcucacgaaggccaacaucguccgguccggcgacgcggcccagggcgccgagggcgggaccagccaguuccaggugggggaccuggugcaggucugcuacgaccuggagcggaucaagcuccugcagcggggccacggcgagugggccgaggccaugcugcccacccucgggaaggugggccgcgugcagcagaucuacuccgacagcgaccugaaggucgaggugugcgggaccagcuggaccuacaaccccgcggccguguccaaggucgccagcgccggcuccgccaucagcaacgcguccggggagcggcugagccagcuccugaagaagcuguucgagacccaggaguccggcgaccucaacgaggagcuggugaaggccgccgccaacggcgacguggccaaggucgaggaccugcucaagcgccccgacguggacgugaacgggcagugcgcgggccacaccgccaugcaggccgccagccagaacgggcacgucgacauccugaagcugcuccugaagcagaacguggacguggaggcggaggacaaggacggcgaccgggccguccaccacgccgccuucggggacgagggcgccgugaucgaggugcugcaccgcggcuccgcggaccucaacgcccggaacaagcgccggcagaccccgcugcacaucgccgucaacaaggggcaccuccagguggugaagacgcuccuggacuucggcugccaccccagccugcaggacuccgagggggacacgccccuccacgacgccaucagcaagaagcgcgacgacauccuggccguccugcucgaggcgggcgccgacgugaccaucaccaacaacaacggguucaacgcccugcaccacgccgcccugcggggcaaccccuccgcgaugcgcgugcuccugagcaagcugccgcggcccuggaucgucgacgagaagaaggacgacggcuacaccgcccugcaccucgccgcccugaacaaccacguggagguggcggagcugcucguccaccaggggaacgccaaccuggacauccagaacgugaaccagcagaccgcccugcaccucgccguggagcgccagcacacccagaucguccggcugcuggugcgcgccggcgcgaagcucgacauccaggacaaggacggggacacgccccugcacgaggcccugcggcaccacacccucucccagcugcgccagcugcaggacaugcaggacgugggcaaggucgacgccgccugggagcccagcaagaacacccucaucauggggcugggcacccagggcgccgagaagaaguccgcggccagcaucgccugcuuccuggccgccaacggggcggaccucuccauccgcaacaagaagggccagagcccgcuggaccugugccccgaccccaaccucugcaaggcccuggccaagugccacaaggagaaggugagcggccaggugggcucccggagccccuccaugaucagcaacgacuccgagacccuggaggagugcauggucugcagcgacaugaagcgcgacacgcuguucggcccgugcgggcacaucgcgaccugcucccugugcagcccccgggugaagaagugccugaucugcaaggagcagguccagucccgcaccaagaucgaggagugcguggugugcagcgacaagaaggccgccguccucuuccagcccugcggccacaugugcgccugcgagaacugcgccaaccugaugaagaagugcgugcagugccgggccgugguggagcgccggguccccuucaucaugugcugcgggggcaaguccagcgaggacgcgaccgacgacaucuccagcgggaacaucccggugcugcagaaggacaaggacaacaccaacgugaacgccgacguccagaagcuccagcagcagcugcaggacaucaaggagcagacgaugugccccgugugccuggaccgccucaagaacaugaucuuccugugcggccacgggaccugccagcugugcggggaccggauguccgagugccccaucugccgcaaggccaucgagcggcgcauccuccuguacuga

SEQ ID NO: 32919 - RNA, 3804 nt, Artificial Sequence
  derived and/or modified sequence opt1 from MIB2__Homo_sapiens__XP_011539035
auggccggcgcccugcgccgggggcgcgcgcucggcagccggcccuccgggccgaccgugagcucccgccggagcccccagugccccgucgcccaggagggccugggggcccgcucccggccccgcguggccccgcggagccuggcccgcugcggccccuccagccggcucauggugcgcgcgggcgccgaccugcugcccugguccagcgcccccuccccgagccggagcccccucuggcagaacgccagcgcgguccgcuucccccugccccuggcccagcagccgcgggccgggcucggcgugggguccgcccgcgacggccuggggcugcgggcccagcgccggcgcggcgcgagcugggagcucugguccggccacccccgggggacccccgcccccggccgcccgcgcgccgcccgggggcagcgccgguggggccgccgguggggccgccggcccgggcgcgugggcugcggggcccggcaggcgcuguggcccggccuggccgccgccgagcagagcgggcccgucggcggccucgagcgccgggaccgcccgaccgacgggcuggccggcgggcccgcgccgcccuccggcgccgggggcaccgagaccagcggcguggggagccccgcccggcuggaggccucccccaaggugagccgccaccagggcugcucccccggggccagccggcgccccggcgggcggcucgacggccgcaccggcccggagcagcccgggcccccguggacgccccugcccaccggccccgagcagccgcggcccaccuggacccagacgccccgccgcgcgugccggugggccugcggguggugcgccgccuggaccggcuccggcgcgagccgcaccgccgcccgggccgccugggcgcgcugguggucccuggccgccaccgccgcgccccggcacccgacggcccaguggagcugcuccgggacccgcgcccgggcccccaccaccgcccccgccacgcgcgcgcggacgaccugcugcugcguccgccaccccaacaucaucugcgacugcugcaagaagcacggccuccgggggaugcgcuggaagugccgggugugccuggacuacgaccugugcacccagugcuacaugcacaacaagcacgagcucgcccacgccuucgaccgcuacgagaccgcccacagccggccggugacccugagcccccgccagggccugccccggaucccccuccgcgggaucuuccagggcgcgaaggucgugcggggcccggacugggagugggggucccaggacggcggggagggcaagcccgggcgcguggucgacauccggggcugggacguggagaccggccgcuccguggccagcgucaccugggccgacgggacgaccaacguguaccgcgugggccacaaggggaaggucgaccugaagugcgugggcgaggccgccgggggcuucuacuacaaggaccaccucccccggcugggcaagcccgcggagcugcagcgccggguguccgccgacagccagccguuccagcacggggacaaggucaagugccugcucgacaccgacgugcugcgcgagaugcaggagggccacgggggcuggaacccccggauggccgaguucaucgggcagaccggcacgguccaccgcaucaccgaccggggcgacgugcgcgugcaguucaaccacgagacccgguggaccuuccaccccggggcccugacgaaggacacccgcaaggccggccagcuccgggggcgcgagggcggcgggugggcgaagaugcugcugcaccacuccuucugggucggcgacguggugcgggucaucggggaccucgacaccgugaagcgccugcaggccggccacggggaguggaccgacgacauggcccccgcccugggccgggugggcaaggucgugaagguguucggggacggcaaccuccgcgucgccguggcggggcagcgguggacguucagcccguccugccugguggccuaccgccccgaggaggacgccaaccuggacgucgccgagcgggcgcgcgagaacaagagcagccucuccguggcccuggacaagcugcgcgcccagaaguccgaccccgagcacccgggccggcucguggucgagguggcccuggggaacgccgcgcgcgcccuggaccugcuccggcgccggcccgagcaggucgacaccaagaaccagggccgcaccgcccuccagguggccgccuaccugggccagguggagcugauccggcugcugcuccaggcgcgcgccgggguggaccugcccgacgacgagggcaacaccgcccugcacuacgccgcccucgggaaccagcccgaggcgacccggguccugcuguccgccggcugccgcgccgacgccaucaacagcacgcaguccaccgcccuccacguggcggugcagcggggguuccuggaggucgugcgcgcccugugcgagcggggcugcgacgugaaccucccggacgcccacagcgacacgccccugcacuccgccaucagcgcgggcaccggggccuccggcaucgucgaggugcugaccgaggugcccaacaucgacgucaccgccaccaacagccagggguucacccuccugcaccacgccucccugaagggccacgcccucgcggugcgcaagauccuggcccgggcccgccagcugguggacgccaagaaggaggacggcuucacggcccuccaccuggcggcccugaacaaccaccgggaggucgcccagauccucauccgcgaggggcggugcgacgugaacgugcgcaaccggaagcugcagagcccccugcaccucgccguccagcaggcccacgugggccuggugccgcugcucgucgacgcggggugcuccgugaacgccgaggacgaggagggcgacaccgcccugcacguggcccugcagcgccaccagcuccugccccuggucgcggacggggccggcggcgaccccgggccccuccagcugcugagccgcaccuggggcgccgggugcuggggcugccaggugccgggggacgccucccucggccccgcccccgcgcccgcccugaccggcgugugcccggccgcccagcugcaggccagcgggcuccccggcuccgcggagcugacggucggggccgccguggccugcuuccuggcccucgagggcgcggacgugagcuacaccaaccaccgggggcgcagcccccuggaccuggccgccgagggccggguccucaaggcccugcagggcugcgcgcagcgcuuccgggagcgccaggccgggggcggggccgcccccggcccgcggcagacccuggggacccccaacacggugaccaaccuccacgucggcgccgcgcccggccccgaggccgccgagugccuggugugcuccgagcuggcccuccuggugcuguucagcccgugccagcaccgcaccgucugcgaggagugcgcccggcgcaugaagaagugcauccggugccaggugguggucuccaagaagcuccgccccgacgggagcgagguggcguccgccgcccccgcccccggcccgccccggcagcugguggaggagcugcagagccgcuaccggcagauggaggagcgcaucacgugccccaucugcaucgacucccacauccggcucgucuuccagugcgggcacggcgccugcgcgccgugcggcagcgcccuguccgccugccccaucugccgccagcccauccgggaccgcauccagaucuucguguga

SEQ ID NO: 32920 - RNA, 1152 nt, Artificial Sequence
  derived and/or modified sequence opt1 from MICA__Homo_sapiens__NP_000238
augggccuggggcccguguuccuccugcuggccggcaucuucccguucgccccgcccggggcggccgccgagccccacagccuccgcuacaaccugaccguccuguccugggacggcagcgugcaguccggguuccucaccgaggugcaccuggacggccagcccuuccugcggugcgaccgccagaagugccgggccaagccccagggccagugggccgaggacguccucgggaacaagacgugggaccgcgagacccgggaccugaccggcaacgggaaggaccugcgcaugacccucgcgcacaucaaggaccagaaggagggccugcacagccugcaggagauccgggugugcgagauccacgaggacaacuccacgcgcagcucccagcacuucuacuacgacggggagcuguuccucagccagaaccuggagaccaaggaguggaccaugccccaguccagccgggcccagacccucgccaugaacgugcgcaacuuccugaaggaggacgccaugaagacgaagacccacuaccacgcgaugcacgccgacugccugcaggagcuccggcgcuaccugaaguccggcgucgugcugcggcgcaccgugcccccgauggucaacgugacccggagcgaggccuccgagggcaacaucacggugaccugccgcgccagcggguucuaccccuggaacaucacccucuccuggcggcaggacggcgucagccugucccacgacacccagcaguggggcgacgugcugcccgacgggaacggcacguaccagaccuggguggccacccgcaucugccagggggaggagcagcgguucacgugcuacauggagcacagcggcaaccacuccacccaccccgucccgagcgggaaggugcucgugcugcagagccacuggcagaccuuccacgucuccgcgguggccgccgccgccaucuucgugaucaucaucuucuacguccgcugcugcaagaagaagaccagcgcggccgagggccccgagcuggugucccuccaggugcuggaccagcaccccgucgggaccagcgaccaccgggacgccacgcagcugggcuuccagccccucauguccgaccugggcagcaccggguccaccgagggcgccuga

SEQ ID NO: 32921 - RNA, 3375 nt, Artificial Sequence
  derived and/or modified sequence opt1 from MICAL2__Homo_sapiens__NP_001269592
augggcgagaacgaggacgagaagcaggcccaggccggccagguguucgagaacuucguccaggcgagcacgugcaagggcacccugcaggccuucaacauccucacccgccaccuggaccuggacccccucgaccaccggaacuucuacuccaagcucaaguccaaggugaccaccuggaaggccaaggcccugugguacaagcucgacaagcgcgggucccacaaggaguacaagcggggcaagagcugcaccaacacgaagugccugaucgucgggggcggcccgugcgggcugcgcaccgccaucgagcucgcguaccugggcgccaagguggugguggucgagaagcgggacuccuucagccgcaacaacgugcugcaccucuggcccuucaccauccacgaccugcgggggcugggcgccaagaaguucuacgggaaguucugcgccggcuccaucgaccacaucagcauccgccagcuccagcugauccuguucaagguggcgcucaugcugggcgucgagauccacgugaacguggaguucgucaaggugcuggagccgcccgaggaccaggagaaccagaagaucggguggcgggccgaguuccuccccaccgaccacucccugagcgaguucgaguucgacgugaucaucggcgccgacgggcgccggaacacgcuggagggcuuccgccggaaggaguuccgcggcaagcucgccaucgccaucaccgcgaacuucaucaaccggaacuccaccgccgaggccaaggucgaggagaucagcgggguggccuucaucuucaaccagaaguucuuccaggaccugaaggaggagaccggcaucgaccuggagaacaucguguacuacaaggacugcacgcacuacuucgucaugaccgccaagaagcagucccuccuggacaagggggugaucaucaacgacuacaucgacaccgagaugcugcucugcgcggagaacgugaaccaggacaaccugcugagcuacgcccgcgaggccgccgacuucgccaccaacuaccagcuccccucccuggacuucgcgaugaaccacuacggccagcccgacgucgccauguucgacuucacgugcauguacgccagcgagaacgccgcccuggugcgggagcgccaggcgcaccagcugcugguggcccuggucggggacagccuccuggagcccuucuggccgauggggaccggcugcgcccggggguuccuggccgcguucgacaccgccuggauggucaagagcuggaaccagggcaccccgccccucgagcugcuggccgagcgcgagucccucuaccggcugcugccccagacgacccccgagaacaucaacaagaacuucgagcaguacacccucgaccccgggacccgcuaccccaaccugaacagccacugcgugcgcccccaccaggugaagcaccuguacaucacgaaggagcuggagcacuacccgcucgagcggcugggcagcgugcgccgguccgucaaccugagccgcaaggaguccgacauccggcccagcaagcuccugaccuggugccagcagcagaccgagggguaccagcacgugaacgugaccgaccugacgaccuccuggcgcagcggccucgcccugugcgccaucauccaccgguuccgccccgagcugaucaacuucgacucccucaacgaggacgacgcggucgagaacaaccagcuggccuucgacguggccgagcgggaguucggcaucccgcccgugaccaccgggaaggagauggccagcgcccaggagcccgacaagcuguccauggucauguaccucagcaaguucuacgagcuguuccgcggcacgccccugcggcccguggacuccuggcgcaagaacuacggggagaacgcggaccucagccuggccaaguccagcaucuccaacaacuaccugaaccucaccuucccgcggaagcgcacgccccggguggacggccagaccggggagaacgacaugaacaagcgccggcgcaagggcuucaccaaccuggacgagcccagcaacuucuccagccggucccugggcagcaaccaggagugcgggagcuccaaggagggcgggaaccagaacaaggucaagagcauggccaaccagcuccuggccaaguucgaggaguccacccgcaaccccagccugaugaagcaggagcgccggguguccggcaucggcaagccggugcucugcagcuccagcgggccgcccguccacuccugcugccccaagcccgaggaggccacccccagccccuccccgccccugaagcgccaguuccccagcgugguggucaccggccacgugcugcgggagcucaagcaggucuccgcggggagcgagugccugucccgccccuggcgggcccgcgccaagagcgaccugcagcucggcgggaccgagaacuucgccacgcugccguccacccggccccgcgcgcaggcccugagcggcgugcucuggcggcugcagcaggucgaggagaagauccugcagaagcgcgcccagaaccucgccaaccgggaguuccacaccaagaacaucaaggagaaggccgcgcaccuggccagcauguucggccacggggacuucccccagaacaagcugcucuccaagggccugagccacacccacccgcccuccccgcccagccgccugcccucccccgaccccgccgccagcuccagccccuccacgguggacagcgccucccccgcgcggaaggagaagaaguccccgagcggguuccacuuccaccccagccaccuccgcaccgugcacccccagcugaccgugggcaagguguccagcgggaucggcgccgccgccgagguccuggugaaccucuacaugaacgaccaccggcccaaggcccaggcgaccuccccggaccuggagagcaugcgcaaguccuucccccugaaccucggcgggagcgacacgugcuacuucugcaagaagcggguguacgucauggagcgccugagcgccgagggccacuucuuccaccgggagugcuuccgcugcuccaucugcgccaccacccugcggcucgccgcguacaccuucgacugcgacgaggggaaguucuacugcaagccccacuucauccacugcaagacgaacagcaagcagcgcaagcgccgggccgagcugaagcagcagcgcgaggaggaggccaccuggcaggagcaggaggccccgcggcgcgacacccccaccgaguccagcugcgccguggcggccaucggcacgcuggagggguccccgcccgugcacuucagccuccccguccugcacccccugcucggcuga

SEQ ID NO: 32922 - RNA, 2088 nt, Artificial Sequence
  derived and/or modified sequence opt1 from MICALCL__Homo_sapiens__NP_116256
augagccccccgaaggaccccucccccagccugccccucccguccagcuccagccacuccagcuccccccccagcuccagcuccaccagcguguccggcaacgcccccgacgggagcuccccgccccagaugaccgccagcgagccccugucccaggucagccgcggccaccccagcccgcccacgcccaacuuccggcgccgggcgguggcccagggggccccccgcgagaucccgcuguaccucccccaccaccccaagcccgagugggccgaguacugccugguguccccgggcgaggacgggcugagcgaccccgccgagaugaccuccgacgagugccagcccgcggaggccccccucggcgacaucggcagcaaccaccgggacccgcaccccaucugggggaaggaccgcuccuggaccggccaggagcugagcccccuggccggggaggaccgggagaagggcuccaccggggcccgcaaggaggaggagggcggccccguccucgugaaggagaagcuggggcugaagaagcucgugcugacgcaggagcagaagaccaugcugcucgacuggaacgacagcaucccggaguccguccaccugaaggcgggcgagcggaucagccagaaguccgccgagaacgggcgcggcggccgggugcugaagcccgugcgcccccuccugcugccgcgggccgccggggagccccuccccacccagcgcggcgcccaggagaagauggggacccccgcggagcaggcccagggcgagcggaacgucccgccccccaagagcccccugcgccugaucgccaacgccauccggcgcucccucgagccgcugcugagcaacuccgaggggggcaagaaggccugggcgaagcaggagagcaagacgcuccccgcccaggccugcacccgguccuucagccugcgcaagaccaacuccaacaaggacggcgaccagcacagccccgggcggaaccagagcuccgccuucagccccccggaccccgcccugcgcacccacucccuccccaaccgccccagcaagguguucccggcgcugcgguccccccccugcagcaagaucgaggacgugcccacgcugcucgagaaggucucccugcaggagaacuucccggacgccagcaagccccccaagaagcgcaucucccuguucagcucccuccggcugaaggacaagagcuucgaguccuuccugcaggagagccgccagcggaaggacauccgcgaccucuucggcucccccaagcggaaggugcugccggaggacagcgcccaggcccuggagaagcuccugcagcccuucaaguccaccagccugcgccaggccgcgcccccgcccccccccccgcccccccccccgcccccccccccgaccgccgggggcgccgacagcaagaacuucccccuccgggcccaggugaccgaggcguccagcuccgccagcuccacgagcuccagcuccgccgacgaggaguucgacccccagcugagccugcagcucaaggagaagaagacccugcgccggcgcaagaagcuggagaaggccaugaagcagcuggucaagcaggaggagcucaagcggcuguacaaggcccaggcgauccagcgccagcuggaggagguggaggagcggcagcgcgccuccgagauccagggggugcggcucgagaaggcccugcgcggcgaggccgacagcggcacccaggacgaggcccagcugcuccaggagugguucaagcugguccuggagaagaacaagcucaugcgguacgaguccgagcugcugaucauggcgcaggagcucgagcuggaggaccaccagagccgccuggagcagaagcuccgcgagaagaugcugaaggaggagucccagaaggacgagaaggaccugaacgaggagcaggagguguucaccgagcucaugcaggugaucgagcagcgggacaagcuggucgacagccuggaggagcagcgcauccgggagaaggccgaggaccagcacuucgaguccuucguguucagccgcgggugccagcucucccggacguga

SEQ ID NO: 32923 - RNA, 1023 nt, Artificial Sequence
  derived and/or modified sequence opt1 from MICB__Homo_sapiens__NP_001276090
augggccuggggcgcgugcuccuguuccuggccgucgccuuccccuucgcgccgcccgccgccgccgccgagccccacagccuccgguacaaccugauggugcugucccaggacggcagcgugcaguccggguuccucgcggagggccaccuggacgggcagcccuuccugcgcuacgaccggcagaagcgccgggccaagccgcagggccagugggccgagaacguccucggcgccaagaccugggacaccgagacggaggaccugaccgagaacgggcaggaccugcgccggacccucacccacaucaaggaccagaagggcgugccccagagcucccgcgcgcagacgcuggccaugaacgugaccaacuucuggaaggaggacgccaugaagaccaagacccacuaccgggccaugcaggccgacugccugcagaagcuccagcgcuaccucaagagcggggucgcgauccggcgcacggugccgcccauggugaacgugaccugcuccgaggucagcgagggcaacaucaccgugaccugccgggccuccagcuucuacccccgcaacaucacgcugaccuggcggcaggacggggucucccugagccacaacacccagcaguggggcgacgugcugcccgacggcaacgggaccuaccagacguggguggccacccgcauccggcagggcgaggagcagcgcuucacgugcuacauggagcacuccgggaaccacggcacccaccccguccccagcggcaaggcccuggugcuccagucccagcggaccgacuucccguacgugagcgccgcgaugcccugcuucgucaucaucaucauccugugcgugcccugcugcaagaagaagaccuccgccgccgaggggcccgagcuggugagccuccagguccuggaccagcacccggugggcaccggggaccaccgcgacgccgcccagcugggcuuccagccccucauguccgcgaccgggagcacgggcagcaccgagggcaccuga

SEQ ID NO: 32924 - RNA, 1431 nt, Artificial Sequence
  derived and/or modified sequence opt1 from MICU1__Homo_sapiens__NP_001182447
auguuccgccugaacagccucuccgcccuggccgagcuggcggugggcagccggugguaccacgggggcucccagcccauccagauccgccggcgccucaugauggucgccuuccugggggccagcgccgugaccgccuccaccggccugcucuggaagcgggcgcacgccgagagcccgcccugcguggacaaccugaaguccgacaucggggacaagggcaagaacaaggacgagggcgacgucugcaaccacgagaagaagacggccgaccuggcgccccaccccgaggagaagaagaagaagcgcagcggguuccgggaccgcaaggugauggaguacgagaaccggauccgcgccuacuccaccccggacaagaucuuccgguacuucgccacccucaaggugaucagcgagcccggcgaggccgaggucuucaugacccccgaggacuucgugcgcuccaucacgcccaacgagaagcagccggagcaccuggggcuggaccaguacaucaucaagcgguucgacggcaagaagaucagccaggagcgcgagaaguucgccgacgagggguccaucuucuacacccucggcgagugcggccugaucagcuucuccgacuacaucuuccugaccaccgugcucagcacgccccagcggaacuucgagaucgccuucaagauguucgaccugaacggggacggcgaggucgacauggaggaguucgagcagguccaguccaucauccgcagccagaccuccauggggaugcggcaccgcgaccggcccaccaccggcaacacgcucaagagcggccugugcagcgcgcugaccaccuacuucuucggggccgaccugaagggcaagcucaccaucaagaacuuccuggaguuccagcgcaagcugcagcacgacgugcucaagcuggaguucgagcggcacgaccccguggacgggcgcaucacggagcgccaguucggcgggaugcugcucgccuacuccggcgugcagagcaagaagcugaccgccaugcagcggcagcugaagaagcacuucaaggagggcaaggggcucaccuuccaggagguggagaacuucuucaccuuccugaagaacaucaacgacgucgacacggcccuguccuucuaccacauggcgggcgccagccucgacaaggugaccaugcagcaggucgcccgcaccguggccaagguggagcuguccgaccacgugugcgacgucguguucgcccuguucgacugcgacgggaacggcgagcucagcaacaaggaguucguguccaucaugaagcagcggcugaugcgcgggcuggagaagccgaaggacaugggcuucacccggcucaugcaggcgauguggaagugcgcccaggagacggccugggacuucgcccugcccaagcaguga

SEQ ID NO: 32925 - RNA, 1593 nt, Artificial Sequence
  derived and/or modified sequence opt1 from MICU3__Homo_sapiens__NP_859074
auggccgcccugcgccggcuccuguggcccccgccccgcgugagcccgccccugugcgcgcaccagccccuccugggccccugggggcggcccgccgucaccacccugggccuccccgggcgcccguucuccagccgggaggacgaggagcgcgccguggccgaggccgcguggcggcgccggcgccgguggggcgagcuguccguggccgccgccgccgggggcggccuggucgggcucgugugcuaccagcuguacggcgacccccgcgcggggagccccgccacgggccggcccuccaagagcgccgccaccgagccggaggacccgccccgcgggcggggcaugcugcccauccccguggcggccgccaaggagaccgucgccaucggccgcaccgacaucgaggaccucgaccuguacgccacgucccgggagcgccgguuccgccuguucgcgagcaucgagugcgaggggcagcuguucaugacccccuacgacuucauccucgccgugaccaccgacgagcccaagguggccaagacguggaagucccugagcaagcaggagcucaaccagaugcuggccgagacgcccccggucuggaagggcuccagcaagcuguuccggaaccucaaggagaagggggugaucuccuacaccgaguaccuguuccugcucugcauccugaccaagccccacgccggcuuccgcaucgcguucaacauguucgacaccgacggcaacgagaugguggacaagaaggaguuccugguccuccaggagaucuuccgcaagaagaacgagaagcgggagaucaagggggacgaggagaagcgcgccaugcugcggcugcagcucuacggcuaccacagccccaccaacuccgugcugaagaccgacgccgaggagcuggugagccgcuccuacugggacacccuccggcgcaacacgagccaggcccuguucuccgaccuggccgagcgggcggacgacaucaccagccucgucaccgacaccacgcugcuggugcacuucuucgggaagaagggcaaggccgagcucaacuucgaggacuucuaccgcuucauggacaaccugcagaccgaggugcuggagaucgaguuccucagcuacuccaacgggaugaacaccaucagcgaggaggacuucgcccacauccugcugcgguacaccaacgucgagaacacguccguguuccucgagaacgugcgcuacagcauccccgaggagaagggcaucaccuucgacgaguuccgguccuucuuccaguuccugaacaaccuggaggacuucgccaucgcgcucaacauguacaacuucgccagccgcuccaucggccaggacgaguucaagcgggccgucuacguggccaccgggcugaaguucagcccgcaccuggugaacaccgucuucaagaucuucgacguggacaaggacgaccagcuguccuacaaggaguucaucggcaucaugaaggaccgccuccaccggggguuccgcggcuacaagacgguccagaaguaccccaccuucaagagcugccugaagaaggagcugcacucccgguga

SEQ ID NO: 32926 - RNA, 2004 nt, Artificial Sequence
  derived and/or modified sequence opt1 from MID1__Homo_sapiens__NP_001180206
auggagacccuggagagcgagcugaccugccccaucugccuggagcuguucgaggacccgcuccugcugcccugcgcccacucccucugcuucaacugcgcccaccgcauccuggugagccacugcgcgacgaacgaguccgucgagagcaucaccgccuuccagugcccgaccugccggcacgugaucacccugucccagcgcggccucgacgggcugaagcggaacgugacgcugcagaacaucaucgaccgcuuccagaaggccagcgucuccggccccaacagccccuccgagacccggcgcgagcgggccuucgacgccaacaccaugaccagcgcggagaaggugcucugccaguucugcgaccaggaccccgcccaggacgccgugaagacgugcgugaccugcgaggucuccuacugcgacgagugccugaaggccacccaccccaacaagaagcccuucaccgggcaccgccugaucgagccgauccccgacagccacauccggggccucaugugccuggagcacgaggacgagaaggugaacauguacugcgucacggacgaccagcugaucugcgcgcucugcaagcugguggggcgccaccgggaccaccagguggccgcccuguccgagcgcuacgacaagcucaagcagaaccuggagagcaaccugaccaaccucaucaagcggaacaccgagcuggagacccugcucgccaagcugauccagacgugccagcacgucgaggugaacgccucccgccaggaggcgaagcugaccgaggagugcgaccuccugaucgagaucauccagcagcggcgccagaucaucggcaccaagaucaaggagggcaaggugaugcggcugcgcaagcucgcccagcagaucgccaacugcaagcagugcaucgagcggagcgccucccugaucagccaggccgagcacucccugaaggagaacgaccacgcgcgcuuccuccagaccgccaagaacaucacggagcgggucagcauggccaccgccagcucccaggugcugauccccgagaucaaccugaacgacaccuucgacaccuucgcccucgacuucagccgcgagaagaagcugcuggagugccucgacuaccugacggcgcccaacccgcccaccauccgcgaggagcugugcaccgccuccuacgacaccaucacggugcacuggaccagcgacgacgaguucuccgucgugagcuacgagcuccaguacaccaucuucaccgggcaggccaacguggucucccugugcaacagcgccgacuccuggaugaucgugcccaacaucaagcagaaccacuacacggugcacggccugcagagcgggaccaaguacaucuucauggucaaggccaucaaccaggcgggcucccggagcuccgagcccgggaagcucaagaccaacagccagccguucaagcuggaccccaaguccgcccaccgcaagcugaaggugagccacgacaaccugaccgucgagcgggacgaguccagcuccaagaagucccacacgcccgagcgcuucaccagccagggcagcuacggcguggccgggaacguguucaucgacagcggccggcacuacugggaggucgugaucuccgggagcaccugguacgccaucggccucgcguacaaguccgcccccaagcacgaguggaucggcaagaacagcgccuccugggcccugugccgcugcaacaacaacugggugguccggcacaacagcaaggagaucccgaucgagcccgcgccccaccuccgccggguggggauccuccuggacuacgacaacggcuccaucgccuucuacgacgcccugaacagcauccaccucuacaccuucgacguggccuucgcccagcccgucugcccgaccuucacgguguggaacaagugccugaccaucaucaccgggcugcccauccccgaccaccucgacugcaccgagcagcugcccuga

SEQ ID NO: 32927 - RNA, 2208 nt, Artificial Sequence
  derived and/or modified sequence opt1 from MID2__Homo_sapiens__NP_036348
augggcgagagccccgccuccgugguccugaacgccagcgggggccucuucucccugaagauggagacccuggagagcgagcugaccugcccgaucugccuggagcuguucgaggacccccuccugcugcccugcgcgcacucccucugcuucagcugcgcccaccgcauccugguguccagcugcuccagcggggaguccaucgagcccaucacggccuuccagugcccgaccugccgguacgugaucagccugaaccaccgcggccucgacgggcugaagcggaacgucacccugcagaacaucaucgaccgcuuccagaaggccuccgugagcggccccaacucccccagcgagucccggcgcgagcggaccuaccgccccacgaccgccaugagcuccgagcggaucgcgugccaguucugcgagcaggacccgccccgcgacgccgugaagaccugcaucacgugcgaggucagcuacugcgaccggugccuccgcgccacccaccccaacaagaagcccuucaccagccaccggcugguggagccggugcccgacacccaccuccgcggcaucacgugccucgaccacgagaacgagaaggucaacauguacugcguguccgacgaccagcugaucugcgcccugugcaagcucguggggcggcaccgcgaccaccaggucgcgagccugaacgaccgguucgagaagcugaagcagacccucgagaugaaccugaccaaccuggugaagcgcaacuccgagcucgagaaccagauggccaagcugauccagaucugccagcaggucgaggugaacaccgccaugcacgaggccaagcugauggaggagugcgacgagcucguggagaucauccagcagcggaagcagaugaucgccgugaagaucaaggagaccaaggucaugaagcugcgcaagcuggcgcagcaggucgccaacugccggcagugccucgagcgcagcacggugcugaucaaccaggccgagcacauccugaaggagaacgaccaggcccgcuuccuccaguccgccaagaacaucgcggagcggguggccauggccaccgccagcucccaggugcugauccccgacaucaacuucaacgacgccuucgagaacuucgcgcuggacuucagccgcgagaagaagcuccuggagggccuggacuaccucaccgcccccaacccgcccuccauccgggaggagcugugcaccgccagccacgacacgaucaccgugcacuggaucuccgacgacgaguucagcaucuccagcuacgagcugcaguacaccaucuucaccgggcaggccaacuucaucuccaagagcuggugcuccuggggccucuggcccgagauccgcaagugcaaggaggccgucagcugcucccggcuggcgggggcgccccgcggccuguacaacagcguggacagcuggaugaucgucccgaacaucaagcagaaccacuacacggugcacggccuccaguccgggacccgguacaucuucaucgugaaggccaucaaccaggccggcagccgcaacuccgagcccacccggcugaagaccaacagccagcccuucaagcuggaccccaagaugacgcacaagaagcugaagaucuccaacgacgggcuccagauggagaaggacgagagcucccugaagaagucccacaccccggagcgcuucagcggcaccggcugcuacggggccgccggcaacaucuucaucgacagcgggugccacuacugggaggucgugaugggcuccagcaccugguacgccaucgggaucgccuacaaguccgcccccaagaacgaguggaucggcaagaacgcgagcuccuggguguucagccggugcaacuccaacuucgucgugcgccacaacaacaaggagaugcugguggacgucccgccccaccucaagcggcugggcgugcugcucgacuacgacaacaacaugcugagcuucuacgaccccgccaacagccugcaccuccacacguucgacgugaccuucauccugcccgucugccccaccuucaccaucuggaacaagucccugaugauccucagcgggcugccggcccccgacuucaucgacuaccccgagcgccaggagugcaacugccggccccaggaguccccguacgugagcggcaugaagacgugccacuga

SEQ ID NO: 32928 - RNA, 348 nt, Artificial Sequence
  derived and/or modified sequence opt1 from MIEN1__Homo_sapiens__NP_115715
augagcggcgagcccgggcagaccuccguggccccgccgcccgaggaggucgagcccggcagcggggugcgcaucguggucgaguacugcgagcccugcggcuucgaggccaccuaccuggagcucgcguccgccgugaaggagcaguaccccgggaucgagaucgagagccgccugggcggcacgggggccuucgagaucgagaucaacggccagcugguguucuccaagcucgagaacgggggcuuccccuacgagaaggaccugaucgaggccauccgccgggccagcaacggggagacccuggagaagaucaccaacucccggcccccgugcgucauccucuga

SEQ ID NO: 32929 - RNA, 1638 nt, Artificial Sequence
  derived and/or modified sequence opt1 from MIER2__Homo_sapiens__NP_060020
auggccgaggccagcucccugggccgccagagcccccggguggucuccugccucgagcacagccugugcccgggggagcccggccugcagaccaccgcggugguguccauggggagcggcgaccaccaguucaaccucgccgagauccugucccagaacuacagcguccgcggggagugcgaggaggccucccggugccccgacaagcccaaggaggagcuggagaaggacuucaucagccaguccaacgacaugccguucgacgagcuccuggcccuguacggcuacgaggccagcgaccccaucuccgaccgcgagagcgagggcggggacguggcgcccaaccuccccgacaugacgcuggacaaggagcagaucgccaaggaccugcucuccggcgaggaggaggaggagacccagagcuccgccgacgaccugaccccgagcgugaccucccacgaggccagcgaccuguuccccaaccggagcgggucccgcuuccucgcggacgaggaccgggagcccggcagcuccgccagcuccgacacggaggaggacagccugcccgccaacaagugcaagaaggagaucauggucgggccgcaguuccaggccgaccuguccaaccuccaccugaaccgccacugcgagaagaucuacgagaacgaggaccagcugcucugggaccccagcgugcugcccgagcgggagguggaggaguuccuguaccgcgccgucaagcggcgcuggcacgagauggcgggcccccagcucccggagggcgaggccgugaaggacuccgagcaggcccuguacgagcuggugaagugcaacuucaacgucgaggaggcccuccggcgccugcgguucaacgugaaggugauccgcgacgggcugugcgccuggagcgaggaggagugccggaacuucgagcacggcuuccgcguccacgggaagaacuuccaccucauccaggcgaacaaggugcggacccgcuccgugggcgagugcgucgaguacuacuaccuguggaagaaguccgagcgguacgacuacuucgcccagcagacccgccugggccgccggaaguacgugcccagcgggaccacggacgccgaccaggaccucgacggcagcgaccccgacgggcccggccgcccgcggcccgagcaggacacccugaccgggaugcgcaccgacccccuguccguggacggcacggccggcgggcucgacgagcccggcgucgccagcgacgggcugccguccagcgagcccggccccugcuccuuccagcagcuggacgagagccccgcggugccgcucagccaccggccgcccgcccuggccgaccccgccuccuaccagcccgccgugaccgcgcccgagcccgacgccagcccgcgccuggccgucgacuucgcccuccccaaggagcugccccugaucuccagccacguggaccucuccggggaccccgaggagaccgucgcgccggcccagguggcccugagcgugaccgaguucggccugaucggcaucggggacgucaaccccuuccucgccgcccaccccacgugccccgcgccgggccugcacuccgagccccugagccacugcaacgugaugaccugcuga

SEQ ID NO: 32930 - RNA, 1653 nt, Artificial Sequence
  derived and/or modified sequence opt1 from MIER3__Homo_sapiens__NP_001284528
auggccgaggccagcuucggcuccagcucccccguggggagccuguccagcgaggaccacgacuucgacccgaccgcggagaugcucguccacgacuacgacgacgagcgcacccuggaggaggaggagaugauggacgagggcaagaacuucuccagcgagaucgaggaccuggagaaggaggggacgaugccccucgaggaccugcuggccuucuacggcuacgagcccaccauccccgccguggccaacuccagcgccaacuccagcccguccgagcucgcggacgagcugcccgacaugacccuggacaaggaggagaucgccaaggaccuccugagcggggacgacgaggagacccaguccagcgccgacgaccugacgcccuccgugaccagccacgagaccuccgacuucuucccccggccgcuccgcagcaacaccgccugcgacggcgacaaggagagcgaggucgaggacguggagacggacuccggcaacagccccgaggaccugcggaaggagaucaugaucgggcugcaguaccaggcggagaucccgcccuaccucggcgaguacgacgggaacgagaagguguacgagaacgaggaccagcugcuguggugccccgacgucgugcucgaguccaaggugaaggaguaccuggucgagaccagccugcgcaccggcuccgagaagaucauggaccggaucagcgccgggacccacacgcgcgacaacgagcaggcccucuacgagcugcugaagugcaaccacaacaucaaggaggccaucgagcgguacugcugcaacggcaaggccucccaggagggcaugaccgcguggaccgaggaggagugccgcagcuucgagcacgcccucaugcuguucgggaaggacuuccaccugauccagaagaacaaggugcggacccgcacgguggccgagugcgucgccuucuacuacauguggaagaaguccgagcgguacgacuacuucgcccagcagacccgcuucggcaagaagcgguacaaccaccaccccggggugaccgacuacauggaccgccucguggacgagaccgaggcgcugggcggcacggucaacgccagcgcccugaccuccaaccggcccgagcccaucccggaccagcagcucaacauccugaacagcuucaccgccuccgaccugaccgcccucacgaacagcguggcgaccgugugcgaccccaccgacgucaacugccuggacgacuccuucccgccccuggggaacacgccccgcggccaggugaaccacgugcccgucgugaccgaggagcuccugacccugcccagcaacggggaguccgacugcuucaaccucuucgagaccggcuucuaccacagcgagcugaaccccaugaacaugugcuccgaggagagcgagcggccggccaagcgccugaagauggggaucgccgugcccgagagcuucaugaacgaggucuccgugaacaaccucggcgucgacuucgagaaccacacccaccacaucacgagcgccaagauggccguguccguggcggacuucggcagccuguccgccaacgagaccaacggguucaucagcgcccacgcccugcaccagcacgcggcccuccacuccgaguga

SEQ ID NO: 32931 - RNA, 348 nt, Artificial Sequence
  derived and/or modified sequence opt1 from MIF__Homo_sapiens__NP_002406
augcccauguucaucgugaacaccaacgucccgcgcgccagcgugcccgacggcuuccuguccgagcucacccagcagcuggcccaggcgacggggaagccgccccaguacaucgccgugcacgucgugcccgaccagcugauggccuucggcgggagcuccgagcccugcgcccucugcagccugcacuccaucggcaagaucgggggcgcccagaaccggagcuacuccaagcugcucugcggccugcuggcggagcgccuccggaucagccccgaccgcguguacaucaacuacuacgacaugaacgccgccaacgucggguggaacaacuccaccuucgccuga

SEQ ID NO: 32932 - RNA, 1158 nt, Artificial Sequence
  derived and/or modified sequence opt1 from MILR1__Homo_sapiens__XP_011522929
augcagaccagcuccaagcccagcgacuuccugaaccucgccaagaagaagcgcaaguucuccgagcugcugaccacggugguccuccugugccugcucaccccgagcuggaccuccaccggccggauguggagccaccugaaccgccuccuguucugguccaucuucagcuccgugacgugccggaaggccgugcuggacugcgaggccaugaagaccaacgaguuccccagccccugccuggacuccaagaccaaggucgugaugaaggggcagaacgugagcauguucugcucccacaagaacaagagccuccagaucaccuacucccuguuccgccggaagacgcaccugggcacccaggacgggaagggcgagcccgccaucuucaaccucagcaucaccgaggcccacgaguccgggccguacaagugcaaggcccaggucaccagcugcuccaaguacagccgcgacuucagcuucacgaucguggaccccgugaccucccccguccugaacaucauggugauccagaccgagaccgaccggcacaucacgcugcacugccucagcgugaacggcucccugcccaucaacuacaccuucuucgagaaccacgucgccaucagcccggcgaucuccaaguacgaccgcgagcccgccgaguucaaccugaccaagaagaaccccggcgaggaggaggaguaccggugcgaggccaagaaccgccuccccaacuacgccaccuacagccacccggugacgaugcccuccaccgggggcgacagcugccccuucugccugaagcugcuccugcccgggcugcuccugcugcucguggucaucauccugauccuggcguucugggugcucccgaaguacaagacccggaaggccaugcgcaacaacgugccccgggaccgcggcgacaccgccauggaggucgggaucuacgccaacauccuggagaagcaggccaaggaggaguccgugcccgaggugggcagccggcccugcgucuccacggcgcaggacgaggccaagcacagccaggagcugcaguacgccaccccgguguuccaggagguggcgccccgcgagcaggaggccugcgacuccuacaagagcggcuacgucuacuccgagcucaacuucuga

SEQ ID NO: 32933 - RNA, 1395 nt, Artificial Sequence
  derived and/or modified sequence opt1 from MINA__Homo_sapiens__NP_116167
augcccaagaaggccaagccgaccggcagcgggaaggaggagggccccgcccccugcaagcagaugaagcuggaggcggccgggggccccuccgcccucaacuucgacagcccguccagccuguucgagucccugaucagccccaucaagaccgagacguucuucaaggaguucugggagcagaagccccuccugauccagcgcgacgaccccgcccuggccaccuacuacgggucccucuucaagcugaccgaccucaagagccugugcucccggggcauguacuacggccgcgacgugaacgucugccggugcgugaacgggaagaagaaggugcugaacaaggacggcaaggcgcacuuccugcagcuccgcaaggacuucgaccagaagcgggccaccauccaguuccaccagccgcagcgcuucaaggacgagcuguggcggauccaggagaagcuggagugcuacuucgggagccucgucggcuccaacguguacaucacgcccgccgggagccagggccugccgccccacuacgacgacguggaggucuucauccugcagcucgagggcgagaagcacuggcgccuguaccaccccaccgugccccuggcccgggaguacuccguggaggcggaggagcgcaucgggcggcccguccacgaguucaugcucaagcccggcgaccugcuguacuucccgcgcgggaccauccaccaggccgacacccccgccggccucgcccacagcacgcacgugaccaucuccaccuaccagaacaacagcuggggcgacuuccugcuggacaccaucuccgggcucguguucgacacggccaaggaggacgucgagcugcggaccggcaucccccgccagcugcuccugguggagagcaccaccguggcgacgcggcgccuguccggguuccuccggacccuggccgaccgccuggagggcaccaaggagcuccugagcagcgacaugaagaaggacuucaucaugcaccggcugcccccguacuccgccggggacggcgccgagcucagcacccccggcgggaagcugccccgccuggacuccgucgugcggcuccaguucaaggaccacaucgugcugacgguccugcccgaccaggaccagagcgacgaggcccaggagaagaugguguacaucuaccacucccucaagaacagccgcgagacccacaugaugggcaacgaggaggagaccgaguuccacgggcugcgcuucccgcugucccaccucgacgcgcugaagcagaucuggaacagccccgccaucuccgugaaggaccugaagcugaccacggacgaggagaaggagagccucguccugucccuguggaccgagugccucauccaggugguguga

SEQ ID NO: 32934 - RNA, 3939 nt, Artificial Sequence
  derived and/or modified sequence opt1 from MINK1__Homo_sapiens__NP_001020108
augggcgaccccgccccggcccgcagccuggacgacaucgaccucuccgcgcugcgggaccccgccgggaucuucgagcugguggaggucgugggcaacgggaccuacggccagguguacaaggggcgccacgucaagaccggccagcucgccgccaucaaggugauggacgugacggaggacgaggaggaggagaucaagcaggagaucaacaugcugaagaaguacagccaccaccggaacaucgccaccuacuacggcgcguucaucaagaaguccccccccgggaacgacgaccagcuguggcucgucauggaguucugcggcgccgggagcgugaccgaccuggugaagaacaccaagggcaacgcccugaaggaggacugcaucgccuacaucugccgcgagauccuccgggggcuggcgcaccugcacgcccacaaggucauccaccgcgacaucaagggccagaacgugcuccugacggagaacgccgaggugaagcuggucgacuucggcguguccgcccagcucgaccggaccguggggcgccggaacaccuucaucggcaccccguacuggauggcccccgaggucaucgcgugcgacgagaaccccgacgccacguacgacuaccgcagcgacaucuggucccuggggaucaccgccaucgagauggccgagggcgcccccccgcugugcgacaugcaccccaugcgggcgcucuuccugaucccccgcaaccccccgccccggcugaagagcaagaagugguccaagaaguucaucgacuucaucgacaccugccucaucaagaccuaccugagccgcccccccacggagcagcugcucaaguucccguucauccgggaccagcccaccgagcgccaggugcggauccagcugaaggaccacaucgaccgcucccggaagaagcgcggcgagaaggaggagaccgaguacgaguacagcggguccgaggaggaggacgacagccacggcgaggagggggagcccuccagcaucaugaacgugcccggcgaguccacccugcggcgcgaguuccuccgccugcagcaggagaacaagagcaacuccgaggcccugaagcagcagcagcagcuccagcagcagcagcagcgggacccggaggcccacaucaagcaccugcugcaccagcgccagcggcgcaucgaggagcagaaggaggagcggcgccgggucgaggagcagcagcgccgggagcgcgagcagcggaagcuccaggagaaggagcagcagcgccggcuggaggacaugcaggcccugcgccgggaggaggagcgccggcaggccgagcgcgagcaggaguacaagcggaagcagcucgaggagcagcgccagagcgagcgccugcagcggcagcugcagcaggagcacgcguaccucaagagccugcagcagcagcagcagcagcagcagcugcagaagcagcagcagcagcagcuccugcccggggaccgcaagccccuguaccacuacggccggggcaugaaccccgccgacaagccggccugggcccgcgagguggaggagcggacgcgcaugaacaagcagcagaacuccccccucgccaagagcaagcccggguccaccggccccgagccgcccaucccccaggcgagcccggggccccccggcccccugucccagaccccgcccaugcagcggcccguggagccccaggaggggccgcacaagagccugcaggaccagcccacccgcaaccucgccgccuuccccgccucccacgaccccgacccggcgauccccgcccccacggccacccccagcgcccggggcgccgucauccgccagaacuccgacccgaccagcgagggccccgggcccucccccaacccgcccgcgugggugcggcccgacaacgaggcccccccgaaggugccccagcgcaccagcuccaucgccacggcccugaacaccagcggcgccgggggcucccggcccgcgcaggccguccgcgcccggccgcgcagcaacuccgccuggcagaucuaccugcagcggcgcgccgagcgggggacccccaagccccccggcccgcccgcgcagccccccggcccgcccaacgccagcuccaaccccgaccugcgccggagcgaccccgggugggagcgcagcgacuccgugcucccggccagccacggccaccugccccaggccgggucccuggagcgcaaccgggucggcgugagcuccaagcccgacagcucccccgugcucagcccgggcaacaaggcgaagcccgacgaccaccgcucccggcccgggcgccccgccgacuucguccugcugaaggagcggacccucgacgaggccccgcgcccccccaagaaggccauggacuacagcuccagcuccgaggagguggagagcuccgaggacgacgaggaggagggcgaggggggccccgccgaggggagccgggacacgccgggcggccgcuccgacggggacaccgacagcgugagcaccauggucgugcacgacguggaggagaucaccggcacgcagccccccuacgggggcgggaccauggucgugcagcggacccccgaggaggagcgcaaccugcugcacgcggacuccaacggcuacaccaaccucccggacgugguccagcccagccacucccccacggagaacagcaagggccaguccccgcccagcaaggacggguccggcgacuaccagagccgggggcuggugaaggcccccggcaaguccagcuucaccauguucguggaccuggggaucuaccagcccggcggcuccggggacagcaucccgaucaccgcccucgucggcggggagggcacccgccuggaccagcugcaguacgacgugcggaagggguccguggucaacgugaaccccaccaacacgcgcgcccacagcgagacccccgagauccggaaguacaagaagcgcuucaacuccgagauccucugcgccgcgcuguggggcgugaaccugcucgucggcaccgagaacgggcugaugcugcucgaccggagcggccaggggaagguguacggccugaucggccgccggcgcuuccagcagauggacgugcuggaggggcucaaccugcugaucaccaucuccggcaagcgcaacaagcuccgggucuacuaccugagcuggcugcgcaacaagauccuccacaacgaccccgagguggagaagaagcagggguggacgaccgugggcgacauggaggggugcggccacuaccgggucgugaaguacgagcgcaucaaguuccuggugaucgcccugaaguccagcgucgagguguacgccugggccccgaagcccuaccacaaguucauggccuucaagagcuucgcggaccucccccaccggccccugcugguggaccucaccgucgaggagggccagcgccugaaggugaucuacggguccagcgccggcuuccacgccguggacgucgacuccgggaacagcuacgacaucuacaucccggugcacauccagucccagaucaccccccacgccaucaucuuccugcccaacacggacggcauggagaugcuccugugcuacgaggacgaggggguguacgucaacaccuacggccggaucaucaaggacguggugcugcaguggggcgagaugcccaccagcgucgcguacaucugcuccaaccagaucaugggguggggcgagaaggccaucgagauccgcagcguggagaccgggcaccucgacggcguguucaugcacaagcgggcccagcgccugaaguuccugugcgagcggaacgacaaggucuucuucgccuccgugcgcagcgggggcuccagccagguguacuucaugacgcucaaccggaacugcaucaugaacugguga

SEQ ID NO: 32935 - RNA, 939 nt, Artificial Sequence
  derived and/or modified sequence opt1 from MINPP1__Homo_sapiens__NP_001171588
augcugcgcgcccccggcugccuccugcggaccagcguggccccggcggccgcccuggccgccgcgcuccuguccagccuggcccgcugcucccuccuggagccccgggaccccgucgccagcucccugagccccuacuucgggaccaagacgcgcuacgaggacgugaacccggugcuccuguccggccccgaggcccccuggcgggaccccgagcugcucgaggggaccugcaccccgguccagcugguggcgcugauccgccacggcacccgguaccccacggugaagcagauccgcaagcuccggcagcugcacgggcugcuccaggcccgcggcagccgggacggcggggccuccagcaccggcucccgcgaccugggggccgcccuggcggacuggccccucugguacgccgacuggauggacggccagcuggucgagaaggggcggcaggacaugcgccagcuggcccuccggcuggccagccuguuccccgcccucuucucccgcgagaacuacggccggcugcgccugaucaccagcuccaagcaccggugcauggacagcuccgcggccuuccuccagggccuguggcagcacuaccacccggggcugcccccgcccgacguggccgacauggaguucggcccgcccaccgugaacgacaagcucaugcgcuucuucgaccacugcgagaaguuccugacggaggucgagaagaacgccaccgcccuguaccacguggaggcguucaagaccgggcccgagaugcagaacauccucaagaagguggccgccacccugcagguccccgugaacgaccugaacgccggccucagccaguuccugcugcaguccagcagcucccucgugaugcagcggcuguucuuccacugcuuccugagcugggccacguccaagacccgcaaccccuga

SEQ ID NO: 32936 - RNA, 858 nt, Artificial Sequence
  derived and/or modified sequence opt1 from MIOX__Homo_sapiens__NP_060054
augaaggugaccgucggccccgacccgagccugguguaccgccccgacguggaccccgaggucgccaaggacaaggccuccuuccggaacuacaccagcgggccccuccuggaccgcguguucacgaccuacaagcugaugcacacccaccagaccguggacuucguccgguccaagcacgcgcaguucggcggguucagcuacaagaagaugacggugauggaggccguggaccuccuggacggccuggucgacgaguccgacccggacguggacuuccccaacagcuuccacgccuuccagaccgccgaggggauccgcaaggcccaccccgacaaggacugguuccaccucgugggccugcugcacgaccucggcaagguccuggcgcuguucggggagccccagugggccguggugggcgacaccuucccggucgggugccggccccaggccuccgugguguucugcgacagcaccuuccaggacaaccccgaccuccaggacccccgcuacuccacggagcugggcauguaccagccgcacugcgggcuggaccggguccucaugagcuggggccacgacgaguacauguaccaggugaugaaguucaacaaguucucccugccgcccgaggccuucuacaugauccgcuuccacagcuucuaccccuggcacaccggccgggacuaccagcagcugugcucccagcaggaccucgcgaugcugcccugggugcgcgaguucaacaaguucgaccuguacaccaagugccccgaccuccccgacgucgacaagcugcggcccuacuaccaggggcugaucgacaaguacugcccgggcauccucagcugguga

SEQ ID NO: 32937 - RNA, 2142 nt, Artificial Sequence
  derived and/or modified sequence opt1 from MIPEP__Homo_sapiens__NP_005923
augcugugcgugggccgccucgggggccugggggcccgggccgcggcccugcccccgcgccgggccggccgcgggagccucgaggccggcauccgggcccgccgggucuccaccagcuggucccccgugggcgcggccuucaacgugaagccccaggggagccgccuggaccuguucggcgagcggcgcgggcuguucggcguccccgagcuguccgccccggagggguuccacaucgcccaggagaaggcgcugcggaagaccgagcuccugguggaccgcgccugcagcacgccgcccggcccccagaccgugcugaucuucgacgagcucuccgacagccugugccgggucgccgaccuggccgacuucgugaagaucgcccaccccgagcccgcguuccgcgaggccgccgaggaggccugccgguccaucggcaccaugguggagaagcucaacaccaacgucgaccuguaccagagccugcagaagcuccuggccgacaagaagcugguggacucccucgaccccgagacgcgccggguggcggagcuguucauguucgacuucgagaucagcgggauccaccuggacaaggagaagcgcaagcgggccgucgaccucaacgugaagauccuggaccuguccagcaccuuccucaugggcaccaacuuccccaacaagaucgagaagcaccuccugccggagcacauccgccggaacuucaccuccgccggggaccacaucaucaucgacggccuccacgccgagagccccgacgaccuggugcgcgaggccgcguacaagaucuuccuguaccccaacgccggccagcucaagugccuggaggagcugcucuccagccgcgaccugcuggccaagcucgucggguacuccacguucagccaccgggcccugcagggcaccaucgccaagaaccccgagaccgugaugcaguuccuggagaagcucagcgacaagcuguccgagcgcacccugaaggacuucgagaugauccgggggaugaagaugaagcucaacccgcagaacagcgaggugaugcccugggacccgcccuacuacuccggcgucauccgcgcggagcgguacaacaucgagcccagccuguacugccccuucuucucccugggggccugcauggagggccucaacauccugcugaaccgccugcucggcaucagccuguacgccgagcagcccgccaagggggaggugugguccgaggacgugcggaagcuggcggucgugcacgagagcgagggccuccugggguacaucuacugcgacuucuuccagcgcgccgacaagccccaccaggacugccacuucacgauccggggcgggcgccugaaggaggacggcgacuaccagcucccgguggucgugcugaugcugaaccucccccgguccagccgcuccagccccacccugcugacccccggcaugauggagaaccucuuccacgagauggggcacgccaugcacuccaugcugggccggacccgcuaccagcacgucacggggacccggugcccgaccgacuucgccgaggugcccagcauccugauggaguacuucgccaacgacuaccgcguggucaaccaguucgcgcggcacuaccagaccggccagccccucccgaagaacauggugucccgccugugcgagagcaagaaggugugcgccgccgccgacaugcagcugcaggucuucuacgccacgcucgaccagaucuaccacgggaagcacccccugcggaacuccaccaccgacauccugaaggagacccaggagaaguucuacggccuccccuacgugcccaacacggcguggcagcugcgcuucagccaccuggugggcuacggggcccgcuacuacuccuaccucaugagccgggccgucgccagcaugguguggaaggagugcuuccugcaggacccguucaaccgcgccgcgggcgagcgguaccgccgggagaugcuggcccacgggggcggccgcgagcccaugcucaugguggaggggaugcugcagaagugccccuccgucgacgacuucgugagcgcccugguguccgaccucgaccuggacuucgagaccuuccugauggacagcgaguga

SEQ ID NO: 32938 - RNA, 792 nt, Artificial Sequence
  derived and/or modified sequence opt1 from MIP__Homo_sapiens__NP_036196
augugggagcugcgcagcgccuccuucuggcgggccaucuucgcggaguucuucgccacccucuucuacguguucuucggccuggggagcucccugcgcugggcccccggcccgcuccacguccuccagguggccauggccuucgggcuggcgcucgccacccuggugcagagcgucggccacaucuccggggcccacgugaaccccgccgugacguucgcguuccuggucggcagccagaugucccuccugcgggccuucugcuacauggccgcccagcugcucggcgccguggcgggggccgccgugcuguacagcgucaccccgcccgccgugcgcggcaaccuggcccucaacacccugcaccccgcgguguccgucgggcaggccaccacgguggagaucuuccugacccuccaguucgugcugugcaucuucgccaccuacgacgagcggcgcaacggccagcuggggagcgucgcccucgccgugggcuucucccuggcgcugggccaccucuucgggauguacuacaccggcgccgggaugaaccccgcccggagcuucgcccccgccauccugacgggcaacuucaccaaccacuggguguacugggucggccccaucaucgggggcgggcugggcucccuccuguacgacuuccugcuguucccgcgccucaagagcaucuccgagcggcugagcgugcugaagggggcgaagcccgacguguccaacggccagcccgaggucaccggcgagcccguggagcugaacacccaggcccuguga

SEQ ID NO: 32939 - RNA, 1329 nt, Artificial Sequence
  derived and/or modified sequence opt1 from MIPOL1__Homo_sapiens__NP_620059
auggagaacuggagcaaggacaucacccacuccuaccuggagcaggagaccacgggcaucaacaagagcacccagcccgacgagcagcucaccaugaacuccgagaaguccaugcaccgcaagagcaccgagcuggugaacgagaucacgugcgagaacaccgaguggccggggcagcggagcaccaacuuccagaucaucuccagcuaccccgacgacgaguccgucuacugcaccacggagaaguacaacgugauggagcaccgccacaacgacaugcacuacgagugcaugacccccugccaggugaccagcgacuccgacaaggagaagaccaucgccuuccugcucaaggagcuggacauccugcggacgagcaacaagaagcuccagcagaagcuggccaaggaggacaaggagcagcgcaagcugaaguucaagcucgagcugcaggagaaggagaccgaggcgaagaucgccgagaagaccgccgcccuggucgaggagguguacuucgcccagaaggagcgggacgaggcggugaugucccgccuccagcuggccaucgaggagcgggacgaggccaucgcccgcgcgaagcacauggagaugagccugaagguccucgagaacaucaaccccgaggagaacgacaugacccugcaggagcugcucaaccggaucaacaacgccgacacgggcaucgccauccagaagaacggggccaucaucguggaccgcaucuacaagaccaaggagugcaagaugcggaucaccgccgaggagauguccgcgcugaucgaggagcgcgacgccgcccugagcaagugcaagcggcucgagcaggagcugcaccacgugaaggagcagaaccagaccuccgccaacaacaugcgccaccugacggccgagaacaaccaggagcgggcgcucaaggccaagcugcugagcaugcagcaggcccgcgagaccgccguccagcaguacaagaagcucgaggaggagauccagacccugcggguguacuacucccugcacaagagccucagccaggaggagaaccugaaggaccaguucaacuacacccuguccacguacgaggaggcccucaagaaccgcgagaacaucgugagcaucacccagcagcagaacgaggagcuggcgacccagcugcagcaggcccucaccgagcgggccaacauggagcugcagcugcagcacgcccgcgaggccucccaggucgcgaacgagaaggugcagaagcucgagcggcugguggacguccugcgcaagaaggugggcacggggaccaugcgcaccgugaucuga

SEQ ID NO: 32940 - RNA, 354 nt, Artificial Sequence
  derived and/or modified sequence opt1 from MIR1-1HG__Homo_sapiens__NP_848558
augcccagcugcuccugcgcccugauggccccgugcggccccgcggccgggcccgccgccguggagcgcacccagcaggucgcccggggcgagcccgggagcgcgcgcggccagcuccagguguccccggagaugagcaucacccacaaggagaaggagaacgcccaccugaaggagauccuccuguucgugaacgccgaggccuucucccagccccagccccacagcgcgcccgucugcgaggggcagcagcugacgggcaaguucuccaccagcgugcugacccgggccggcggggacgccuccccgugcagcugggagcgccuccugugcuacggcuggucccacugcuga

SEQ ID NO: 32941 - RNA, 3399 nt, Artificial Sequence
  derived and/or modified sequence opt1 from MIS18BP1__Homo_sapiens__XP_005267890
augaucgccacgccccugaagcacagccgcaucuaccucccgcccgaggccuccagccagcggcgcaaccugcccauggacgcgaucuucuucgacuccauccccagcggcacccugaccccggugaaggaccucgucaaguaccagaacuccagccugaagcugaacgaccacaagaagaaccaguuccucaagaugaccaccuucaacaacaagaacaucuuccaguccaccaugcugacggaggccaccaccagcaacuccagccuggacaucuccgccaucaagcccaacaaggacgggcucaagaacaaggccaacuacgagagccccggcaagaucuuccugcggaugaaggagaaggugcugcgcgacaagcaggagcagcccucccggaacagcucccuccuggagccgcagaaguccgggaacaacgagaccuucacgcccaaccgcguggagaagaagaagcugcagcacaccuaccucugcgaggagaaggagaacaacaagagcuuccagagcgacgacuccagccugcgggccagcguccagggcgugccccuggaguccagcaacaacgacaucuuccuccccgugaagcagaagauccagugccagcaggagaagaaggcgccgcugcacaaccugaccuacgagcuccccacccugaaccaggagcaggagaacuuccuggccgucgaggcccgcaacaagacgcucacccgggcccagcuggcgaagcagaucuuccacuccaaggagagcaucguggccaccaccaaguccaagaaggacacguucgugcuggagagcgucgacuccgccgacgagcaguuccagaacaccaacgccgagacccucagcaccaacugcauccccaucaagaacgggucccugcugauggugagcgacuccgagcgcacgaccgagggcaccagccagcagaaggugaaggagggcaacgggaagaccguccccggcgagacggggcucccgggcuccaugaaggacacgugcaagaucgugcuggccacgccccggcugcacaucaccaucccccgccggagcaagcgcaacaucuccaagcucagcccgccccggaucuuccagaccgugaccaacgggcugaagaagaaccaggucgugcagcugcaggaguggaugaucaaguccaucaacaacaacaccgcgaucugcguggagggcaagcucaucgacgucaccaacaucuacuggcacagcaacgugaucaucgagcgcaucgagcacaacaagcugcggaccaucuccggcaacguguacauccugaaggggaugaucgaccagaucagcaugaaggaggccggcuaccccaacuaccucauccgcaaguucauguucggguuccccgagaacuggaaggagcacaucgacaacuuccuggagcagcugcgggccggcgagaagaaccgcgagaagaccaagcagaagcagaagaccggccggagcguccgcgacauccgcaaguccaugaagaacgacgcccgggagaaccagaccgacacggcccagcgcgcgaccaccaccuacgacuucgacugcgacaaccucgagcucaagagcaacaagcacuccgagagccccggggccaccgagcugaacaugugccacuccaacugccagaacaagccgacgcugcgguuccccgacgaccaggugaacaacaccauccagaacggcgggggcgacgaccugagcaaccaggagcugaucgggaagaaggaguacaagauguccagcaagaagcucaagaucggcgagcgcaccaacgagcggaucaucaagucccagaagcaggagaccacggaggagcuggacgugagcaucgacauccugaccucccgcgagcaguucuucagcgacgaggagcggaaguacauggccaucaaccagaagaaggccuacauccuggucacgccccucaagucccgcaaggugaucgagcagcggugcaugcgcuacaaccugagcgccggcaccaucaaggcggucaccgacuucgugauccccgagugccagaagaaguccccgaucagcaaguccauggggacccuggagaacaccuucgagggccacaagagcaagaacaaggaggacugcgacgagcgggaccuccugaccgugaaccgcaagaucaagaucagcaaccuggagaaggagcagaugcucacguccgacuucaagaagaacacccggcugcugcccaagcucaagaagaucgagaaccaggucgccaugagcuucuacaagcaccaguccagccccgaccuguccagcgaggaguccgagaccgagaaggagaucaagcgcaaggccgaggugaagaagaccaaggccgggaacacgaaggaggccgugguccaccuccgcaagagcacccggaacaccuccaacaucccggugauccuggagcccgagaccgaggagagcgagaacgaguucuacaucaagcagaagaaggcgcggcccuccgugaaggagacgcugcagaaguccggcguccgcaaggaguuccccaucaccgaggccguggggagcgacaagaccaaccggcacccgcuggagugccuccccggccugauccaggacaaggaguggaacgagaaggagcugcagaagcuccacugcgccuucgccagccugcccaagcacaagcccggcuucugguccgagguggcggccgccgucgggagccgcuccccggaggagugccagcgcaaguacauggagaacccccggggcaaggggagccagaagcacgugaccaagaagaagcccgccaacuccaagggccagaacgggaagcgcggcgacgccgaccagaagcagacgaucaagaucaccgcgaaggugggcacccugaagcggaagcagcagaugcgcgaguuccucgagcagcugcccaaggacgaccacgacgacuucuucagcaccacgccgcugcagcaccagcggauccuccugcccagcuuccaggacuccgaggacgacgacgacauccugcccaacauggacaagaaccccaccaccccgagcuccgucaucuucccccucgugaagacgccccagugccagcacgugagccccgggaugcugggcuccaucaaccgcaacgacugcgacaaguacgucuuccggaugcagaaguaccacaagagcaacgggggcaucguguggggcaacaucaagaagaagcugguggagaccgacuucuccaccccgacgccccgccggaagacccccuucaacaccgaccucggggagaacagcggcaucgggaagcuguucaccaacgccgucgagucccuggacgaggaggagaaggacuacuacuucagcaacuccgacagcgccuga

SEQ ID NO: 32942 - RNA, 1260 nt, Artificial Sequence
  derived and/or modified sequence opt1 from MITF__Homo_sapiens__NP_000239
augcuggagaugcucgaguacaaccacuaccaggugcagacccaccuggagaaccccaccaaguaccacauccagcaggcccagcgccagcaggucaagcaguaccugagcaccacccucgccaacaagcacgcgaaccaggugcugucccugccgugccccaaccagcccggcgaccacgugaugcccccgguccccgggagcuccgcccccaacagccccauggccaugcucacccugaacuccaacugcgagaaggagggcuucuacaaguucgaggagcagaaccgggccgagagcgagugcccggggaugaacacccacucccgcgccagcugcaugcagauggacgacgugaucgacgacaucaucucccuggagagcuccuacaacgaggagauccucggccugauggaccccgcgcugcagauggccaacacgcuccccgugagcgggaaccugaucgaccuguacggcaaccagggccugcccccgcccgggcucaccaucuccaacagcugccccgccaaccugcccaacaucaagcgggagcucaccgccugcaucuucccgaccgaguccgaggcgcgcgcccuggccaaggagcggcagaagaaggacaaccacaaccugaucgagcgccggcgccgguucaacaucaacgaccgcaucaaggagcucggcacgcugauccccaagagcaacgaccccgacaugcgguggaacaaggggaccauccugaaggccuccgucgacuacauccgcaagcuccagcgggagcagcagcgcgccaaggagcuggagaaccggcagaagaagcuggagcacgcgaaccgccaccuccugcugcggauccaggagcucgagaugcaggcccgcgcccacggccugagccugauccccuccaccgggcucugcagcccggaccuggugaaccggaucaucaagcaggagcccgugcuggagaacugcagccaggaccuccugcagcaccacgccgaccugaccugcacgaccacccucgaccugaccgacggcacgaucaccuucaacaacaaccugggcaccgggaccgaggccaaccaggcguacuccguccccacgaagaugggcagcaagcucgaggacauccugauggacgacacccugucccccgugggggugaccgacccgcuccugagcuccgucagccccggcgccuccaagaccagcucccgccggagcuccaugagcauggaggagacggagcacacgugcuga

SEQ ID NO: 32943 - RNA, 723 nt, Artificial Sequence
  derived and/or modified sequence opt1 from MIXL1__Homo_sapiens__NP_001269331
auggccaccgccgagagccgcgcgcugcaguucgccgagggcgccgccuuccccgccuaccgggcgccgcacgccgggggcgcccuccugcccccgcccucccccgccgcggcccugcuccccgccccgcccgccgggcccggccccgccaccuucgcgggguuccugggccgcgaccccggccccgccccgcccccgcccgccagccuggggucccccgccccgcccaagggcgccgcggcccccagcgccucccagcggcgcaagcggacgagcuucuccgccgagcagcuccagcugcuggagcucguguuccgccggacccgcuaccccgacauccaccuccgggagcgccuggccgcgcugacccugcugcccgagagccggauccagcuccuguucagcccccuguuccaggucugguuccagaaccgccgggccaagucccgccggcaguccggcaagagcuuccagccccucgcccgcccggagaucauccugaaccacugcgcccccgggaccgagacgaagugccugaagccccagcucccccuggagguggacgugaacugccugccggagcccaacggggucggcggcgggaucuccgacagcuccagccagggccagaacuucgagaccugcagcccccucuccgaggacaucggguccaagcuggacagcugggaggagcacaucuucagcgccuucggcaacuucuga

SEQ ID NO: 32944 - RNA, 8691 nt, Artificial Sequence
  derived and/or modified sequence opt1 from MKI67__Homo_sapiens__NP_001139438
auguggcccacccgccggcucgugaccaucaagcgcagcggcguggacgggccccacuucccccucucccugagcacgugccuguucggccgggggaucgagugcgacauccgcauccagcuccccgugguguccaagcagcacugcaagaucgagauccacgagcaggaggccauccugcacaacuucagcuccaccaaccccacccaggucaacggcagcgugaucgacgagcccgugcggcugaagcacggggacgucaucaccaucaucgaccgcuccuuccgguacgagaacgagagccuccagaacggccgcaaguccaccgaguucccccggaagauccgcgagcaggagcccgcccggcgcgugagccgguccagcuucuccagcgaccccgacgaguccgagggcaucccccugaagcgccggcgcgugagcuucgggggccaccuccggcccgagcuguucgacgagaaccugccgcccaacaccccgcugaagcgcggggaggcccccaccaagcggaagucccucgucaugcacaccccgcccgugcugaagaagaucaucaaggagcagccccagcccagcggcaagcaggaguccgggagcgagauccacguggaggucaaggcccagagccuggugaucagcccgcccgccccgagcccccgcaagacgcccguggccuccgaccagcggcgccgcagcugcaagaccgcccccgcguccagcuccaagagccagaccgaggucccgaagcggggcggccgcaaguccgggaaccuccccagcaagcggguguccaucagccgcucccagcacgacauccugcagaugaucugcagcaagcggcgcuccggcgccagcgaggccaaccugaucguggccaaguccugggcggacgucgugaagcucggggccaagcagacccagacgaaggugaucaagcacggcccccagcggagcaugaacaagcgccagcggcgccccgccaccccgaagaagcccgucggcgaggugcacucccaguucagcaccgggcacgccaacagccccugcaccaucaucaucggcaaggcccacacggagaaggugcacgucccggcgcggcccuaccgcgugcugaacaacuucaucuccaaccagaagauggacuucaaggaggaccugagcgggaucgccgagauguucaagacccccgucaaggagcagccccagcucaccagcacgugccacaucgccaucagcaacuccgagaaccugcugggcaagcaguuccaggggaccgacagcggcgaggagccgcuccugcccaccuccgagagcuucggcgggaacguguucuucuccgcccagaacgccgcgaagcagcccagcgacaagugcuccgccagcccgccccugcggcgccagugcauccgggagaacggcaacguggccaagacgccccgcaacaccuacaagaugaccucccucgagaccaagaccagcgacaccgagacggagcccuccaagaccgucagcaccgccaaccgguccgggcgcagcaccgaguuccggaacauccagaagcugcccguggagagcaaguccgaggagacgaacaccgagaucguggagugcauccugaagcgcggccagaaggccacccuccugcagcagcgccgggagggggagaugaaggagaucgagcgcccguucgagaccuacaaggagaacaucgagcugaaggagaacgacgagaagaugaaggcgaugaagcggagccgcacguggggccagaagugcgcccccauguccgaccucaccgaccucaagucccugcccgacaccgagcucaugaaggacaccgcccggggccagaaccugcugcagacccaggaccacgccaaggcccccaaguccgagaaggggaagaucacgaagaugccgugccagagccuccagcccgagcccaucaacacccccacccacaccaagcagcagcugaaggcgucccugggcaaggucggggugaaggaggagcuccuggccgugggcaaguucacgcgcaccagcggggagaccacccacacgcaccgggagccggccggcgacggcaaguccauccgcaccuucaaggagagccccaagcagauccuggaccccgccgcgcgggucaccgggaugaagaaguggccccgcaccccgaaggaggaggcccagucccucgaggaccuggccggcuucaaggagcuguuccagacgcccgggcccagcgaggaguccaugaccgacgagaagaccaccaagaucgccugcaagagcccgccgcccgaguccguggacacgcccaccagcaccaagcaguggccgaagcggucccuccgcaaggccgacguggaggaggaguuccuggcgcugcggaagcugacccccagcgccggcaaggccaugcucacgcccaagcccgccggcggggacgagaaggacaucaaggccuucaugggcaccccgguccagaagcuggaccuggcggggacccuccccggcuccaagcgccagcugcagacccccaaggagaaggcccaggcccuggaggaccucgccggguucaaggagcuguuccagacgcccggccacaccgaggagcugguggccgcgggcaagaccaccaagaucccgugcgacagcccccagagcgaccccguggacacgcccaccuccaccaagcagcggccgaagcgcagcauccggaaggccgacgucgagggggagcuccuggccugccgcaaccugaugcccuccgccggcaaggcgaugcacacccccaagcccagcgugggggaggagaaggacaucaucaucuucgugggcacgccgguccagaagcucgaccugaccgagaaccugaccggguccaagcggcgcccccagacccccaaggaggaggcccaggcccucgaggaccugacgggcuucaaggagcuguuccagacccccggccacaccgaggaggccguggccgcggggaagaccaccaagaugccgugcgagagcagcccgcccgagagcgccgacacgcccaccuccacccggcgccagccgaagacgccccucgagaagcgcgacgugcagaaggagcugagcgcccugaagaagcucacgcagaccuccggcgagaccacccacacggacaagguccccgggggcgaggacaagagcaucaacgccuuccgggagaccgccaagcagaagcuggacccggcggccuccgugaccgggagcaagcgccaccccaagaccaaggagaaggcccagccccuggaggaccucgccggccugaaggagcuguuccagacgcccgugugcaccgacaagccgaccacccacgagaagacgaccaagaucgccugccggucccagcccgaccccgucgacacccccaccagcuccaagccgcagagcaagcgcucccuccggaagguggacguggaggaggaguucuucgcgcugcgcaagcggacgcccagcgccggcaaggccaugcacacccccaagcccgccgucagcggggagaagaacaucuacgcguucaugggcaccccggugcagaagcuggaccucaccgagaaccugacgggguccaagcgccggcugcagacccccaaggagaaggcccaggcccucgaggaccuggccggcuucaaggagcuguuccagacccgcgggcacaccgaggagagcaugacgaacgacaagaccgccaagguggcgugcaaguccagccagcccgaccccgacaagaacccggccuccagcaagcggcgccucaagaccucccugggcaaggucggcgugaaggaggagcugcucgccguggggaagcugacccagacgagcggcgagaccacccacacccacacggagcccaccggggacggcaaguccaugaaggccuucauggagagccccaagcagauccuggacuccgccgcgagccucaccggcuccaagcggcagcugcgcacccccaaggggaaguccgaggucccggaggaccuggccggcuucaucgagcuguuccagacccccucccacacgaaggagagcaugaccaacgagaagaccaccaagguguccuaccgggccagccagcccgaccugguggacacgcccaccuccagcaagccgcagcccaagcgcagccugcggaaggccgacaccgaggaggaguuccucgccuuccgcaagcagacccccuccgcggggaaggccaugcacacgcccaagccggccgucggcgaggagaaggacaucaacaccuuccuggggacccccgugcagaagcuggaccagcccggcaaccucccgggcagcaaccggcgccugcagacccgcaaggagaaggcccaggcccuggaggagcucacgggguuccgggagcuguuccagacccccugcaccgacaaccccaccacggacgagaagaccaccaagaagauccugugcaagagcccccagagcgacccggcggacacccccacgaacaccaagcagcgccccaagcggucccucaagaaggccgacguggaggaggaguuccuggccuuccgcaagcugacccccagcgccggcaaggcgaugcacaccccgaaggccgccgucggggaggagaaggacaucaacacguucgugggcacccccguggagaagcucgaccugcuggggaaccuccccggcuccaagcggcgcccccagaccccgaaggagaaggccaaggcccuggaggaccuggcgggcuucaaggagcuguuccagacccccgggcacacggaggagagcaugaccgacgacaagaucaccgaggucuccugcaagagcccccagcccgacccggugaagacccccacguccagcaagcagcggcugaagaucucccugggcaaggugggggucaaggaggaggugcuccccgugggcaagcugacccagaccagcgggaagaccacgcagacccaccgcgagaccgccggcgacggcaaguccaucaaggccuucaaggagagcgccaagcagaugcuggaccccgccaacuacgggaccggcauggagcgguggccgcgcacgcccaaggaggaggcgcagucccucgaggaccuggccggguucaaggagcuguuccagacccccgaccacaccgaggagagcaccaccgacgacaagacgaccaagaucgccugcaagagcccgccgcccgagagcauggacacccccaccagcacgcggcgccggcccaagacgccccucggcaagcgcgacaucgucgaggagcuguccgcccugaagcagcucacccagaccacgcacaccgacaaggugcccggcgacgaggacaaggggaucaacguguuccgggagaccgccaagcagaagcuggaccccgcggccagcgucaccggcuccaagcgccagccccggacgcccaaggggaaggcccagccccuggaggaccucgccggccugaaggagcuguuccagacccccaucugcaccgacaagccgaccacgcacgagaagaccaccaagaucgcgugccgcagcccccagcccgaccccguggggaccccgacgaucuucaagccccaguccaagcggagccuccgcaaggccgacgucgaggaggagucccuggcccugcggaagcgcacccccagcgugggcaaggccauggacacccccaagccggccggcggggacgagaaggacaugaaggcguucaugggcacccccgugcagaagcucgaccugcccgggaaccugcccggcuccaagcgcuggccgcagacgcccaaggagaaggcccaggcccucgaggaccuggccggguucaaggagcuguuccagacccccggcaccgacaagcccaccacggacgagaagaccaccaagaucgccugcaagagcccgcagcccgaccccgucgacacccccgcguccacgaagcagcggccgaagcgcaaccuccggaaggccgacguggaggaggaguuccuggcccugcgcaagcggacccccagcgccggcaaggccauggacacccccaagccggcgguguccgacgagaagaacaucaacaccuucgucgagacgcccgugcagaagcuggaccuccuggggaaccugcccggcagcaagcgccagccccagaccccgaaggagaaggccgaggcccucgaggaccuggugggguucaaggagcuguuccagacccccggccacaccgaggaguccaugaccgacgacaagaucacggaggucagcugcaagagcccccagcccgagagcuucaagaccucccggagcagcaagcagcgccucaagaucccgcuggugaagguggacaugaaggaggagccccuggccgucuccaagcucacccggaccagcggggagacgacccagacccacaccgagcccacgggcgacuccaagagcaucaaggcguucaaggagucccccaagcagauccuggacccggccgccagcgugaccggcucccgccggcagcugcgcacccggaaggagaaggcccgcgcccucgaggaccugguggacuucaaggagcuguucagcgcgcccgggcacaccgaggaguccaugacgaucgacaagaacaccaagauccccugcaaguccccgccgcccgagcucaccgacaccgccacguccaccaagcggugccccaagacccgcccccggaaggaggucaaggaggagcugagcgccguggagcgccugacccagacguccggccagagcacccacacccacaaggagcccgccuccggggacgagggcaucaaggugcucaagcagcgggccaagaagaagcccaaccccgucgaggaggagcccagccgccgccggccccgcgcgcccaaggagaaggcccagccccuggaggaccuggccggguucaccgagcucuccgagacgagcggccacacccaggagagccugaccgccggcaaggccaccaagauccccugcgaguccccgccccuggaggugguggacacgaccgcgagcaccaagcggcaccuccgcacccggguccagaagguccaggugaaggaggagcccuccgccgucaaguucacgcagaccagcggggagaccaccgacgccgacaaggagccggccggcgaggacaaggggaucaaggcccugaaggaguccgcgaagcagacgcccgcccccgccgccagcgugaccggcucccgccggcgcccccgggcgccgcgcgagagcgcccaggccaucgaggaccuggccggcuucaaggaccccgccgcggggcacaccgaggaguccaugaccgacgacaagaccacgaagauccccugcaagagcucccccgagcucgaggacaccgccaccagcuccaagcggcgcccgcggacccgcgcccagaagguggaggucaaggaggagcugcuggccgugggcaagcucacgcagaccagcggggagaccacccacacggacaaggagcccgugggcgaggggaagggcaccaaggccuucaagcagcccgcgaagcggaagcuggacgccgaggacgucaucggcucccgccggcagccccgcgccccgaaggagaaggcccagccccuggaggaccucgccagcuuccaggagcugucccagacccccgggcacaccgaggagcuggcgaacggcgccgccgacagcuucacguccgcccccaagcagaccccggacagcgggaagccccucaagaucagccggcgcgugcugcgggcgcccaagguggagcccgucggcgacgugguguccacccgcgacccggucaagagccaguccaagagcaacaccucccugccgccccuccccuucaagcgcgggggcggcaaggacgggagcgugacgggcaccaagcggcugcgcugcaugccggcccccgaggagaucguggaggagcugcccgccuccaagaagcagcgggucgcgccccgcgcccgggggaaguccuccgagccgguggugaucaugaagcgcagccuccggaccuccgcgaagcgcaucgagcccgccgaggagcugaacagcaacgacaugaagaccaacaaggaggagcacaagcugcaggacuccguccccgagaacaagggcaucagccuccggucccgccggcagaacaagacggaggccgagcagcagaucaccgagguguucgugcuggccgagcgcaucgagaucaaccggaacgagaagaagccgaugaagaccagccccgagauggacauccagaaccccgacgacggggcccgcaagcccaucccgcgggacaaggucaccgagaacaagcgcugccugcgguccgcgcgccagaacgagagcucccagcccaagguggccgaggagagcggcggccagaaguccgccaaggugcucaugcagaaccagaaggggaagggcgaggccgggaacuccgacagcaugugccugcggucccgcaagaccaagucccagcccgccgcguccacccuggagagcaaguccguccagcgcgugacccggagcgugaagcgcugcgccgagaaccccaagaaggccgaggacaacgucugcgugaagaagauccggacccgcucccaccgggacagcgaggacaucuga

SEQ ID NO: 32945 - RNA, 1713 nt, Artificial Sequence
  derived and/or modified sequence opt1 from MKKS__Homo_sapiens__NP_061336
augagccgccuggaggccaagaagcccucccucugcaagagcgagccgcugaccaccgagcgggugcgcacgacccuguccguccucaagcggaucgugaccagcugcuacggccccuccgggcgccugaagcagcugcacaacggcuucgggggcuacgugugcaccacgagccaguccagcgcccuccugucccaccuccucgucacccaccccauccugaagauccugaccgcgagcauccagaaccacguguccagcuucuccgacugcgggcuguucaccgccauccugugcugcaaccugaucgagaacgugcagcggcucggccugacgcccaccaccgucauccgccugaacaagcaccuccugagccugugcaucuccuaccucaagagcgagaccugcggcugccggaucccgguggacuucuccagcacgcagauccugcugugccucgugcgcuccauccugaccagcaagcccgccugcaugcugacccggaaggagaccgagcacgucagcgcccucauccugcgcgccuuccugcucacgauccccgagaacgcggaggggcacaucauccugggcaagucccugaucgugccccucaaggggcagcgggugaucgacagcaccguccugccgggcauccugaucgagauguccgaggugcagcucaugcgccugcugcccaucaagaaguccaccgcccucaagguggcccuguucugcaccacgcugagcggggacaccagcgacaccggcgagggcaccgucgugguguccuacggggucagccucgagaacgccgugcuggaccagcugcucaaccugggccggcagcugaucuccgaccacguggaccucguccugugccagaaggugauccaccccagccugaagcaguuccugaacaugcaccgcaucaucgcgaucgaccggaucggggugacgcucauggagccccugaccaagaugaccggcacccagccgaucggcucccuggggagcaucugccccaacuccuacggcagcgucaaggacgugugcacggccaaguucggguccaagcacuucuuccaccucauccccaacgaggccaccaucugcagccugcugcucugcaaccgcaacgacaccgccugggacgagcugaagcugaccugccagacggcccuccacguccugcagcugacccucaaggagcccugggcgcugcugggcgggggcugcaccgagacccaccucgccgccuacauccggcacaagacgcacaacgacccggaguccauccugaaggacgacgagugcacccagaccgagcugcagcucaucgccgaggccuucugcagcgcgcuggaguccguggugggcagccuggagcacgacgggggcgagauccucaccgacaugaaguacgggcaccuguggagcguccaggccgacucccccugcguggccaacuggcccgaccugcucagccagugcggcugcgggcuguacaacucccaggaggagcugaacuggagcuuccuccgcuccacccggcgccccuucgugccgcagagcugccugccccacgaggccgucggcuccgccagcaaccugacgcucgacugccugaccgcgaagcuguccggccuccagguggccguggagaccgccaaccugauccuggaccucagcuacgucaucgaggacaagaacuga

SEQ ID NO: 32946 - RNA, 2796 nt, Artificial Sequence
  derived and/or modified sequence opt1 from MKL1__Homo_sapiens__NP_001269589
augcccccgcucaagagccccgccgccuuccacgagcagcgccggucccucgagcgcgcgcggaccgaggacuaccugaagcgcaagauccggagccgccccgagcgguccgagcuggugcgcaugcacauccucgaggagaccagcgccgagcccucccugcaggccaagcagcugaagcucaagcgggcccgccuggccgacgaccugaacgagaagaucgcgcagcggccgggccccauggagcucgucgagaagaacauccugcccguggagagcucccugaaggaggccaucaucguggggcaggucaacuaccccaagguggccgacagcuccagcuucgacgaggacuccagcgacgcccucuccccggagcagcccgcgagccacgagucccagggcagcgugcccagcccccuggaggcccgcgucuccgagccgcugcucuccgccacgagcgccagccccacccagguggugucccagcugcccauggggcgggacagccgcgagaugcuguuccucgccgagcagcccccgcugcccccgccgccccugcucccgcccucccugaccaacggcaccacgauccccaccgccaagagcacccccacccugaucaagcagucccagcccaagagcgccuccgagaagucccagcgguccaagaaggccaaggagcucaagcccaaggucaagaagcugaaguaccaccaguacaucccgcccgaccagaagcaggaccgcggggccccgcccauggacagcuccuacgccaagauccugcagcagcagcagcuguuccugcagcugcagauccucaaccagcagcagcagcagcaccacaacuaccaggcgauccugcccgccccgcccaagagcgccggcgaggcccugggcuccagcgggacgccgcccgugcggucccucagcaccaccaacagcagcuccagcagcggcgcgcccgggcccugcggccucgcgcgccagaacuccaccagccugacggggaagcccggcgcccugcccgccaaccuggacgacaugaagguggccgagcugaagcaggagcucaagcugcggucccugcccgucagcggcaccaagaccgagcucaucgagcgccugcgggccuaccaggaccagaucucccccgugcccggggcgcccaaggcccccgccgccaccagcauccugcacaaggcgggcgagguggucguggccuuccccgccgcccgccucuccacggggcccgcccugguggcggccggccuggccccggccgaggucgugguggccaccgucgcgagcuccggcguggugaaguucgggagcaccggcuccaccccgcccgucagccccacgcccuccgagcgcagccuccuguccaccggggacgagaacagcacccccggcgacaccuucggggagauggugacgagcccccugacccagcugacccuccaggccagcccccugcagauccuggucaaggaggagggcccgcgggccggcuccugcugccucucccccgggggccgcgccgagcuggaggggcgggacaaggaccagaugcugcaggagaaggacaagcagaucgaggcccucacccgcaugcugcggcagaagcagcagcugguggagcgccucaagcugcagcuggagcaggagaagcgggcgcagcagcccgccccggcccccgcgccccucggcacgcccgugaagcaggagaacagcuucuccagcugccagcugucccagcagccgcuggggcccgcccaccccuucaaccccagccucgccgccccggccaccaaccacaucgaccccugcgccgucgcgcccgggcccccguccgugguggucaagcaggaggcccugcagcccgagcccgagcccgugccggcgccccagcugcuccugggcccccagggccccagccugaucaagggcguggccccgcccacccucaucaccgacuccacggggacccaccugguccugaccgugaccaacaagaacgccgacagccccggccucuccagcgggagcccccagcagccguccucccagcccggcagccccgcccccgccccguccgcccagauggaccuggagcacccccugcagccccucuucggcacgccgaccagccugcugaagaaggagccgcccggguacgaggaggccaugucccagcagcccaagcagcaggagaacggcagcagcucccagcagauggacgaccucuucgacauccugauccagagcggggagaucuccgccgacuucaaggagccgcccagccugcccggcaaggagaagcccucccccaagaccgugugcggcagcccccucgcggcccagcccucccccagcgccgagcugccgcaggccgcgcccccgccgcccgggucccccagccugcccggccgccucgaggacuuccuggaguccagcaccgggcugccccuccugaccuccggccacgacgggcccgagccccugagccucaucgacgaccugcacucccagaugcugagcuccacggccauccucgaccacccgcccagccccauggacaccuccgagcugcacuucguccccgagcccagcagcaccaugggccuggaccucgccgacggccaccuggacuccauggacuggcuggagcucagcuccgggggccccgugcugagccuggccccgcucuccaccacggcccccagccuguucuccaccgacuuccuggacgggcacgaccuccagcugcacugggacagcugccuguga

SEQ ID NO: 32947 - RNA, 3150 nt, Artificial Sequence
  derived and/or modified sequence opt1 from MKL2__Homo_sapiens__NP_054767
auggaccacaccggcgccaucgacaccgaggacgagguggggccccuggcccaccucgcgccgagcccccaguccgaggccgucgcccacgaguuccaggagcugagccugcaguccagccagaaccucccgccccugaacgagcgcaagaacgugcugcagcuccggcugcagcagcgccggacgcgcgagcagcugguggaccagggcaucaugccgccccucaagucccccgccgccuuccacgagcagaucaagagccuggagcgggcgcgcaccgagaacuuccugaagcacaagauccggucccgccccgaccggagcgagcucguccgcaugcacauccuggaggagaccuucgccgagccgucccugcaggccacccagaugaagcucaagcgggcccgccuggcggacgaccugaacgagaagaucgcccagcggcccgggcccauggagcucguggagaagaacauccugcccguggacagcuccgucaaggaggccaucaucggcguggggaaggaggacuacccgcacacgcagggcgacuucagcuucgacgaggacuccagcgacgcccugucccccgaccagcccgccagccaggagucccagggcagcgcggccucccccagcgagccgaaggugagcgagucccccagccccgucaccaccaacacccccgcccaguucgccuccgugagcccgacggugcccgaguuccucaagaccccgcccaccgccgaccagcccccgccccgccccgcggcccccguccugcccaccaacacgguguccagcgccaagcccgggccggcccuggugaagcagucccaccccaagaaccccaacgacaagcaccggagcaagaagugcaaggaccccaagccgcgcgucaagaagcucaaguaccaccaguacaucccgcccgaccagaagggcgagaagaacgagccccagauggacuccaacuacgcccggcugcugcagcagcagcagcuguuccugcagcugcagauccucagccagcagaagcagcacuacaacuaccagaccauccuccccgcgcccuucaagccccugaacgacaagaacuccaacagcgggaacuccgcccucaacaacgccacccccaacaccccgcgccagaacacgagcacccccgugcggaagcccggcccccugccguccagccuggacgaccucaagguguccgagcugaagaccgagcugaagcuccgcgggcugcccgucagcggcaccaagcccgaccugaucgagcggcucaagcccuaccaggaggugaacuccagcggccuggccgccgggggcaucguggcggucagcuccagcgccaucgugacguccaacccggaggugaccgucgcccugcccgugaccacccuccacaacacggucaccagcuccgugagcacccugaaggccgagcugccgcccaccgggacguccaacgcgacccgcguggagaacguccacagcccccuccccaucucccccagcccguccgagcagagcucccugagcaccgacgacaccaacauggccgacacguucaccgagaucaugaccaugaugucccccagccaguuccuguccagcagcccccugcgcaugaccaacaacgaggacucccucagccccacguccagcacccuguccaaccuggagcucgacgccgccgagaaggaccggaagcugcaggagaaggagaagcagaucgaggagcugaagcgcaagcucgagcaggagcagaagcugguggaggugcugaagaugcagcucgaggucgagaagcggggccagcagcagcgcccgcuggaggcccagcccagcgcgcccggccacuccgucaagagcgaccagaagcacgggucccugggcagcuccaucaaggacgaggccagccuccccgacugcuccagcucccggcagccgauccccguggccagccacgccguggggcagcccguguccaccggcgggcagacccugguggccaagaaggcggucgugaucaagcaggaggugcccgucggccaggccgagcagcagagcguggugucccaguucuacaccagcccgcaggccggcaugcagacgcagccccagaucgccaccgccgcgcagauccccaccgccgcccuggccagcgggcucgcgcccaccgucccgcagacgcaggacaccuucccccagcacgugcugucccagccccagcagguccgcaagguguucaccaacagcgccuccagcaacaccgugcugcccuaccagcggcacccggcccccgccgugcagcagcccuucaucaacaaggccuccaacagcguccuccagucccgcaacgcgccccugccgagccugcagaacggccccaacacgcccaacaagcccuccagcccgcccccgccccagcaguucguggugcagcacucccucuucgggagccccgucgccaagaccaaggacccgccccgguacgaggaggccaucaagcagacccgcuccacccaggcgccccugcccgagaucagcaacgcccacucccagcagauggacgaccuguucgacauccucaucaagagcggcgagaucucccugcccaucaaggaggagcccagccccaucuccaagaugcggcccgugacggccagcaucaccaccaugcccgugaacaccgucgugagccggcccccgccccaggugcagauggccccgcccgucucccuggagcccauggggagccucuccgccagccuggagaaccagcuggaggccuuccucgacggcacgcugcccuccgccaacgagaucccgccccugcagagcuccagcgaggaccgcgagcccuucucccucaucgaggaccugcagaacgaccugcucagccacuccggcaugcuggaccacagccacucccccauggagaccagcgagacccaguucgcggccgggacccccugccugucccucgaccugagcgacuccaaccuggacaacauggaguggcucgacaucacgaugcccaacagcuccagcggccugaccccgcugagcaccaccgcccccuccauguucagcgccgacuuccucgacccccaggaccugccccugccgugggacuga

SEQ ID NO: 32948 - RNA, 2208 nt, Artificial Sequence
  derived and/or modified sequence opt1 from MKLN1__Homo_sapiens__NP_037387
auggccgccggcggggcgguggccgccgcccccgagugccgccugcucccguacgcccugcacaaguggagcuccuucagcuccaccuaccugcccgagaacauccucgucgacaagcccaacgaccagagcucccgguggagcuccgagagcaacuacccgccccaguaccugauccugaagcucgagcgccccgcgaucgugcagaacaucaccuucggcaaguacgagaagacgcacgugugcaaccugaagaaguucaaggucuucgggggcaugaacgaggagaacaugaccgagcugcucuccagcgggcugaagaacgacuacaacaaggagaccuucacccugaagcacaagaucgacgagcagauguuccccugccgguucaucaagaucgugccccuccuguccuggggcccgagcuucaacuucuccaucugguacguggagcugagcggcaucgacgaccccgacaucguccagcccugccucaacugguacuccaaguaccgcgagcaggaggccauccggcugugccugaagcacuuccgccagcacaacuacacggaggccuucgagagccuccagaagaagaccaagaucgcccuggagcaccccaugcugaccgacauccacgacaagcucgugcugaagggggacuucgacgcgugcgaggagcugaucgagaaggccgugaacgacggccucuucaaccaguacaucucccagcaggaguacaagccgcgguggagccagaucauccccaaguccaccaagggggacggcgaggacaaccgccccgggaugcggggcggccaccagauggucaucgacgugcagacggagaccguguaccuguucgggggcugggacgggacccaggaccuggccgacuucugggccuacagcgucaaggagaaccaguggaccugcaucagccgcgacacggagaaggagaacggccccuccgcccggagcugccacaagaugugcaucgacauccagcgccggcagaucuacacccucggccgcuaccuggacuccagcgugcggaacuccaagagccugaaguccgacuucuaccgcuacgacaucgacaccaacaccuggaugcuccugagcgaggacacggcggccgacgggggcccgaagcugguguucgaccaccagaugugcauggacuccgagaagcacaugaucuacaccuucgggggccggauccugaccugcaacgggagcgucgacgacucccgcgccagcgagccccaguucuccggccucuucgccuucaacugccagugccagaccuggaagcugcuccgggaggacagcugcaacgccggccccgaggacauccagucccgcaucgggcacugcaugcuguuccacagcaagaaccggugccuguacguguucggcgggcagcgcuccaagacguaccucaacgacuucuucagcuacgacguggacuccgaccacgucgacaucaucagcgacggcaccaagaaggacagcgggauggugcccaugaccggcuucacccagcgcgcgacgaucgacccggagcugaacgagauccacgugcuguccggccucagcaaggacaaggagaagcgggaggagaacguccgcaacuccuucuggaucuacgacaucgugcggaacagcugguccugcguguacaagaacgaccaggccgccaaggacaaccccaccaagagccugcaggaggaggagcccugcccccgcuucgcccaccagcuggucuacgacgagcuccacaaggugcacuaccuguucgggggcaacccggggaaguccugcagccccaagaugcggcuggacgacuucuggucccucaagcugugccgccccagcaaggacuaccugcugcggcacugcaaguaccucauccgcaagcaccgguucgaggagaaggcccaggucgacccccuguccgcgcugaaguaccuccagaacgaccuguacaucaccguggaccacagcgacccggaggagaccaaggaguuccagcugcucgccuccgcccuguucaagagcggcuccgacuucacggcccugggguucagcgacguggaccacaccuacgcccagcgcacccagcuguucgacacccucgucaacuucuuccccgacuccaugacgcccccgaagggcaaccugguggaccucaucacccuguga

SEQ ID NO: 32949 - RNA, 990 nt, Artificial Sequence
  derived and/or modified sequence opt1 from MKNK1__Homo_sapiens__XP_011540651
auggccaagagcaugcccuccaagagcucccgcaacaagcagggcaccgugggggucggcugcuucgagcgguggcgccggugcaucagcgugcgcgagaccuccagcauccuggcccacauccagaagcagaagcacuucaacgagcgggaggcgucccgcgugguccgggacguggccgccgcccucgacuuccugcacacgaaggggaucgcccaccgcgaccugaagcccgagaacauccucugcgagagccccgagaaggugucccccgucaagaucugcgacuucgaccugggcagcgggaugaagcugaacaacuccugcacccccaucaccaccccggagcucacgacccccugcggcagcgcggaguacauggcccccgaggugguggaggucuucaccgaccaggccaccuucuacgacaagcggugcgaccuguggucccugggcguggugcucuacaucaugcugagcggguacccgcccuucgucggccacugcggggccgacugcggcugggaccgcggggaggugugccgggugugccagaacaagcuguucgaguccauccaggagggcaaguacgaguuccccgacaaggacugggcgcacaucagcuccgaggccaaggaccucaucagcaagcugcugguccgcgacgccaagcagcggcucuccgccgcccaggugcugcagcaccccugggugcagggccaggcgcccgagaaggggcugccgacgccccagguccuccagcgcaacagcagcaccauggaccugacccuguucgccgccgaggccaucgcccucaaccggcagcugucccagcacgaggagaacgagcuggcggaggagcccgaggcccucgccgacggccugugcagcaugaagcuguccccgcccugcaagagccgccucgcccggcgccgggcccuggcgcaggccgggcgcggcgaggaccgguccccgcccaccgcccuguga

SEQ ID NO: 32950 - RNA, 1245 nt, Artificial Sequence
  derived and/or modified sequence opt1 from MKNK2__Homo_sapiens__NP_060042
auggugcagaagaagcccgccgagcugcagggcuuccaccgcagcuucaaggggcagaacccguucgagcucgccuucucccuggaccagcccgaccacggcgacagcgacuucgggcugcagugcuccgcgcggcccgacaugcccgccagccagccgaucgacauccccgacgccaagaagcgcggcaagaagaagaagcgggggcgcgccaccgacuccuucagcggccgguucgaggacgucuaccagcuccaggaggacgugcugggcgagggggcccacgcgcgcgugcagaccugcaucaaccugaucacgucccaggaguacgccgucaagaucaucgagaagcagcccggccacauccggagccgcguguuccgggagguggagaugcucuaccagugccaggggcaccgcaacguccuggagcugaucgaguucuucgaggaggaggaccgguucuaccucguguucgagaagaugcgcggcggguccauccugagccacauccacaagcggcgccacuucaacgagcuggaggccuccguggucgugcaggacguggccagcgcgcucgacuuccugcacaacaagggcaucgcccaccgggaccugaagcccgagaacauccucugcgagcacccgaaccaggucucccccgugaagaucugcgacuucgaccugggcagcgggaucaagcugaacggcgacugcucccccaucagcacccccgagcuccugaccccgugcggguccgccgaguacauggcccccgagguggucgaggccuucagcgaggaggcguccaucuacgacaagcgcugcgaccuguggagccucggcgugauccuguacauccugcucagcggcuacccgcccuucguggggcggugcggcuccgacugcgggugggaccgcggcgaggccugccccgccugccagaacaugcuguucgagagcauccaggaggggaaguacgaguuccccgacaaggacugggcccacaucuccugcgccgcgaaggaccugaucagcaagcuccugguccgggacgccaagcagcgccuguccgccgcccaggugcuccagcaccccugggugcagggcugcgcccccgagaacacccugccgacgcccaugguccugcagcggugggacagccacuuccuccugccgccccaccccugccgcauccacgugcgccccggcgggcuggugcggaccgucaccgugaacgaguga

SEQ ID NO: 32951 - RNA, 990 nt, Artificial Sequence
  derived and/or modified sequence opt1 from MKRN1__Homo_sapiens__NP_001138597
auggccgaggccgcgacccccggcaccacggccaccaccagcggggccggcgccgccgcggccaccgccgccgcggccuccccgacgcccauccccaccgugaccgcccccagccugggggccggcgggggcggcgggggcuccgacgggagcggcgggggcuggaccaagcaggucacgugccgcuacuucaugcacggcgugugcaaggagggggacaacugccgguacucccacgaccucagcgacuccccguacagcguggucugcaaguacuuccagcgcggcuacugcaucuacggggaccggugccgcuacgagcacuccaagccccugaagcaggaggaggccaccgcgaccgagcugaccaccaagagcucccucgccgccagcuccagccuguccagcaucgugggcccccugguggagaugaacacgggcgaggccgagucccggaacagcaacuucgccaccgucggggcgggcuccgaggacugggugaacgccaucgaguucgugcccgggcagccguacugcggccgcaccgcccccagcugcacggaggcgccccuccaggggagcgucaccaaggaggaguccgagaaggagcagaccgccguggagaccaagaagcagcugugccccuacgccgccgugggcgagugccgguacggcgagaacugcgucuaccugcacggggacagcugcgacaugugcggccuccaggugcugcacccgauggacgccgcccagcgcucccagcacaucaagagcugcaucgaggcccacgagaaggacauggagcuguccuucgcggugcagcggagcaaggacauggucugcgggaucugcauggaggugguguacgagaaggccaaccccuccgagcgccgguucggcauccucagcaacugcaaccacacguacugccugaagugcauccgcaaguggcgguccgccaagcaguucgagagcaagaucaucaaguga

SEQ ID NO: 32952 - RNA, 1524 nt, Artificial Sequence
  derived and/or modified sequence opt1 from MKRN3__Homo_sapiens__NP_005655
auggaggagcccgccgccccgagcgaggcgcacgaggccgccggcgcccaggccggggcggaggccgcccgcgagggcguguccgggcccgaccugcccgucugcgagcccagcggcgaguccgccgcgccggacagcgcccucccccacgccgcccgggggugggcccccuuccccguggcgccggugcccgcccaccuccgccggggcggccugcgccccgcccccgccuccgggggcggggccuggccgagcccccugcccucccggagcuccggcaucuggaccaagcagaucaucugccgcuacuacauccacgggcagugcaaggagggcgagaacugccgguacagccacgaccuguccggccgcaagauggcgaccgagggcggggucagcccgcccggggccuccgccggcggcgggcccagcaccgccgcccacaucgagccgcccacccaggagguggcggaggccccgcccgccgccuccagccugucccuccccgugaucggcagcgccgcggagcggggguucuucgaggccgagcgcgacaacgccgaccggggcgccgccgggggcgccggcgucgaguccugggccgacgccaucgaguucgugcccgggcagcccuaccgcggccgguggguggccagcgcgcccgaggcgccccugcagagcuccgagaccgagcgcaagcagauggccgucgggagcggccugcgguucugcuacuacgccucccgcggggugugcuuccggggcgagagcugcauguaccuccacggcgacaucugcgacaugugcgggcugcagacccugcaccccauggacgccgcgcagcgcgaggagcacaugcgggccugcaucgaggcccacgagaaggacauggagcucuccuucgccgugcagcgcggcauggacaaggucugcgggaucugcauggaggugguguacgagaaggccaacccgaacgaccggcgcuucggcauccugagcaacugcaaccacuccuucugcauccgcugcauccggcgcuggcggagcgcgcgccaguucgagaaccggaucgucaaguccugcccccagugccgcgugacgagcgagcuggugauccccuccgaguucugggucgaggaggaggaggagaagcagaagcucauccagcaguacaaggaggccaugagcaacaaggccugccgguacuucgccgaggggcgcggcaacugcccguucggcgacacgugcuucuacaagcacgaguaccccgagggguggggcgacgagccgcccgggcccggcggcggguccuucagcgcguacuggcaccagcugguggagcccgugcggaugggcgaggggaacaugcuguacaaguccaucaagaaggagcucgucgugcugcgccuggccagccuccuguucaagcgguuccugucccuccgcgacgagcugcccuucagcgaggaccagugggaccugcuccacuacgagcuggaggaguacuucaaccugauccucuga

SEQ ID NO: 32953 - RNA, 1650 nt, Artificial Sequence
  derived and/or modified sequence opt1 from MKS1__Homo_sapiens__NP_001159399
auggccgugcccgucagcuccuucgcccagcgcacccggagccgcuuccgggugcaccuccagcgcaucaccuccagcaacuuccugcacuaccagccggcggccgagcugggcaaggaccugaucgaccucgccacguuccggccccagcccaccgccuccgggcaccgccccgaggaggacgaggaggaggagaucgugaucggcuggcaggagaagcuguucagccaguucgaggucgaccuguaccagaacgagaccgccugccaguccccgcucgacuaccaguaccggcaggagauccugaagcuggagaacagcgggggcaagaagaaccgccggaucuucaccuacacggacuccgaccgcuacaccaaccucgaggagcacugccagcggaugaccaccgcggccagcgaggugcccuccuuccugguggagcgcauggccaacguccggcgccggcgccaggaccggcgcgggauggagggcggcauccugaagucccggaucgugacgugggagcccuccgaggaguucgugcgcaacaaccacgucaucaacacgccccuccagaccaugcacaucauggccgaccuggggccguacaagaagcugggcuacaagaaguacgagcacgugcucugcacccugaagguggacagcaacggggucaucaccgugaagcccgacuucaccggccugaaggggcccuaccggaucgagaccgagggcgagaagcaggagcucuggaaguacaccaucgacaacgugagcccccacgcgcagccggaggaggaggagcgcgagcgccgggucuucaaggaccuguacggccgccacaaggaguaccugagcucccucguggggacggacuucgagaugaccgugcccggcgcccugcggcuguucgucaacggggagguggugagcgcccagggcuacgaguacgacaaccucuacguccacuucuucguggagcugcccaccgcccacugguccagccccgccuuccagcagcugagcggcgugacccagacgugcaccaccaagucccucgcgauggacaaggucgcccacuucagcuacccguucaccuucgaggccuucuuccugcacgaggacgaguccagcgacgcccugcccgaguggcccgugcucuacugcgagguccugucccuggacuucuggcagcgcuaccggguggagggguacggcgccgugguccuccccgcgacgccggggagccacacccugaccguguccaccuggcgccccguggagcugggcacggucgccgagcuccggcgcuucuucaucgggggcagccuggagcuggaggaccucuccuacgugcggauccccggcagcuucaagggggagcgccugucccgguucggccugcgcaccgagaccaccgggacggugaccuuccggcuccacugccugcagcagagccgcgccuucauggaguccagcucccugcagaagcggaugcgcagcguccucgaccggcuggagggcuucucccagcagagcuccauccacaacgugcuggaggccuuccgccgggcccgccgccggaugcaggaggcgcgcgagagccucccccaggaccuggugagcccguccgggacccuggucagcuga

SEQ ID NO: 32954 - RNA, 357 nt, Artificial Sequence
  derived and/or modified sequence opt1 from MLANA__Homo_sapiens__NP_005502
augccccgcgaggacgcccacuucaucuacggcuaccccaagaaggggcacggccacagcuacaccaccgccgaggaggcggccgggaucggcauccugacggugauccucgggguccugcugcucaucggcugcugguacugccggcgccggaacggcuaccgcgcccugauggacaagucccugcacguggggacccagugcgcccucacccggcgcugcccccaggagggcuucgaccaccgggacagcaaggugucccugcaggagaagaacugcgagcccgucgugcccaacgccccgcccgcguacgagaagcugagcgccgagcaguccccgccgcccuacagccccuga

SEQ ID NO: 32955 - RNA, 1134 nt, Artificial Sequence
  derived and/or modified sequence opt1 from MLC1__Homo_sapiens__NP_631941
augacccaggagcccuuccgcgaggagcuggccuacgaccggaugccgacccucgagcgcggccggcaggaccccgccagcuacgcgcccgacgccaagcccuccgaccugcagcugagcaagcgccucccgcccugcuucucccacaagacguggguguucagcguccugaugggguccugccugcucgugaccagcggcuucucccuguaccuggggaacguguuccccgccgagauggacuaccuccggugcgccgccggcagcugcauccccuccgcgaucgucagcuucaccgugucccgccggaacgccaacgugaucccgaacuuccagauccuguucgucagcaccuucgccgugacgacgaccugccugaucugguucgggugcaagcucgugcugaaccccuccgccaucaacaucaacuucaaccugauccuccugcugcuccuggagcugcucauggcggccaccgucaucaucgccgcccgcagcuccgaggaggacugcaagaagaagaagggcagcauguccgacagcgccaacauccuggacgaggugcccuuccccgcgcgggugcugaaguccuacagcgucguggaggugaucgccggcaucagcgccguccucgggggcaucaucgcccugaacguggacgacuccgugagcgggccgcaccuguccgucaccuucuucuggauccucguggccugcuuccccagcgcgaucgccucccacguggccgccgagugccccagcaagugccuggucgaggugcugaucgccaucuccagccucaccagcccccugcuguucaccgcguccggcuaccucuccuucagcaucaugcgcaucguggagauguucaaggacuacccgcccgccaucaagcccuccuacgacguccugcugcuccugcugcuccuggugcugcuccugcaggccgggcugaacaccggcacggccauccagugcguccgguucaaggugagcgcccgccuccagggcgcguccugggacacccagaacgggccccaggagcggcuggccggcgagguggcccgcagcccgcugaaggaguucgacaaggagaaggccuggcgggcggucguggugcagauggcccaguga

SEQ ID NO: 32956 - RNA, 879 nt, Artificial Sequence
  derived and/or modified sequence opt1 from MLEC__Homo_sapiens__NP_055545
augcugggcgccugggccguggaggggaccgcggucgcccuccugcgccugcuccugcugcuccugcccccggccauccggggccccgggcugggcguggccgggguggccggcgcggccggcgccgggcuccccgagagcgucaucugggccgugaacgcgggcggggaggcccacguggacguccacggcauccacuuccgcaaggacccccuggaggggcgggugggccgcgccuccgacuacggcaugaagcugccgauccuccggagcaaccccgaggaccagauccuguaccagaccgagcgcuacaacgaggagacguucggguacgaggugcccaucaaggaggagggcgacuacguccuggugcucaaguucgccgagguguacuucgcccagucccagcagaaggucuucgacgugcggcugaacgggcacguggucgugaaggaccuggacaucuucgaccgcgugggccacagcaccgcgcacgacgagaucauccccauguccauccggaagggcaagcucagcguccagggggagguguccaccuucaccggcaagcuguacaucgaguucgugaagggguacuacgacaacccgaaggucugcgcccuguacaucauggccggcacgguggacgacgugcccaagcuccagccccaccccgggcuggagaagaaggaggaggaggaggaggaggaggaguacgacgagggcagcaaccugaagaagcagaccaacaagaaccgcguccaguccggcccgcggacccccaaccccuacgccagcgacaacuccagccucauguuccccauccugguggccuucggggucuucaucccgacccuguucugccucugccgccuguga

SEQ ID NO: 32957 - RNA, 732 nt, Artificial Sequence
  derived and/or modified sequence opt1 from MLF1__Homo_sapiens__NP_001123629
augcgccagaugauccggagcuucuccgagcccuucggccgcgaccugcucagcaucuccgacgggcggggccgcgcccacaaccggcgcgggcacaacgacggcgaggacagccugacccacaccgacguguccagcuuccagacgauggaccagauggucuccaacaugcggaacuacaugcagaagcuggagcgcaacuucgggcagcucagcguggacccgaacggccacuccuucugcagcuccagcgugaugaccuacuccaagaucggcgacgagccgcccaaggucuuccaggccagcacccagacccggcgcgcgcccgggggcaucaaggagacgcggaaggccaugcgcgacuccgacagcgggcuggagaagauggccaucggccaccacauccacgaccgggcccacgugaucaagaaguccaagaacaagaagaccggggacgaggaggugaaccaggaguucaucaacaugaacgagagcgacgcccacgcguucgacgaggaguggcaguccgagguccugaaguacaagcccggccgccacaaccucggcaacacccggaugcgcagcguggggcacgagaaccccggcagccgggagcugaagcgccgggagaagccccagcagucccccgccaucgagcacgggcgccggagcaacgugcugggcgacaagcuccacaucaagggcuccagcgucaaguccaacaagaaguga

SEQ ID NO: 32958 - RNA, 747 nt, Artificial Sequence
  derived and/or modified sequence opt1 from MLF2__Homo_sapiens__NP_005430
auguuccgcuucaugcgggacguggagcccgaggacccgauguuccugauggaccccuucgccauccaccgccagcacaugagccggaugcucuccggcggguucggcuacagccccuuccuguccaucaccgacgggaacaugcccggcacccgcccggccagccggcgcaugcagcaggcgggggccgucucccccuucggcaugcugggcaugagcgggggcuucauggacauguucgggaugaugaacgacaugaucggcaacauggagcacaugacggccgggggcaacugccagaccuucuccagcuccaccgugaucagcuacuccaacaccggcgacggggcccccaagguguaccaggagacgagcgagaugcgguccgcccccggcgggauccgcgagacccggcgcaccguccgggacagcgacuccggccucgagcagaugagcaucggccaccacauccgcgaccgggcgcacauccugcagcgcucccggaaccaccgcaccggggaccaggaggagcggcaggacuacaucaaccuggacgagagcgaggccgccgccuucgacgacgaguggcgccgggagacgucccgcuuccggcagcagcgcccgcucgaguuccgccggcuggagagcagcggcgccgggggccgccgggcggaggggccgccccgccuggccauccagggccccgaggacucccccagccggcagucccgccgguacgacugguga

SEQ ID NO: 32959 - RNA, 2271 nt, Artificial Sequence
  derived and/or modified sequence opt1 from MLH1__Homo_sapiens__NP_000240
augagcuucguggccggcgucauccgccggcuggacgagaccguggugaaccgcaucgccgcgggggaggucauccagcggcccgccaacgccaucaaggagaugaucgagaacugccucgacgccaaguccaccagcauccaggugaucgugaaggagggcgggcugaagcugauccagauccaggacaacggcacggggauccgcaaggaggaccucgacaucgucugcgagcgguucaccaccuccaagcugcagagcuucgaggaccuggccuccaucagcaccuacggcuuccgcggcgaggcgcucgccuccaucagccacguggcccacgugacgaucaccaccaagaccgccgacgggaagugcgcguaccgggccuccuacagcgacggcaagcugaaggccccgcccaagcccugcgccgggaaccagggcacgcagaucaccgucgaggaccuguucuacaacaucgccacccgccggaaggcgcucaagaaccccuccgaggaguacgggaagauccuggagguggugggccgcuacagcguccacaacgccggcaucuccuucagcgugaagaagcagggggagaccguggccgacguccggacgcugccgaacgccuccaccguggacaacauccgcagcaucuucggcaacgccgugucccgggagcucaucgagaucgggugcgaggacaagacccuggcguucaagaugaacggcuacaucagcaacgccaacuacuccgucaagaagugcaucuuccuccucuucaucaaccaccgccugguggagagcaccagccugcggaaggccaucgagacgguguacgccgccuaccuccccaagaacacccaccccuuccuguaccugucccucgagaucagcccccagaacgucgacgugaacgugcacccgaccaagcacgagguccacuuccugcacgaggaguccauccuggagcgcgugcagcagcacaucgagagcaagcuccugggcuccaacagcucccggauguacuucacccagacgcugcuccccgggcuggcgggccccagcggggagauggucaaguccaccaccagccugaccuccagcuccacgagcggcuccagcgacaagguguacgcccaccagauggugcgcaccgacucccgggagcagaagcucgacgccuuccugcagccccugagcaagccgcucuccagccagccccaggccaucgucaccgaggacaagaccgacaucagcuccgggcgcgcccggcagcaggacgaggagaugcuggagcugcccgcgcccgccgagguggccgccaagaaccagagccucgagggcgacacgaccaagggcaccuccgagaugagcgagaagcgcgggccgaccuccagcaacccccgcaagcggcaccgcgaggacuccgacguggagauggucgaggacgacagccggaaggagaugacggcggccugcacgccccgccggcgcaucaucaaccugaccuccgugcugagccuccaggaggagaucaacgagcagggccacgaggugcugcgggagaugcugcacaaccacuccuucgucgggugcgugaacccccagugggcccucgcccagcaccagaccaagcuguaccugcucaacaccaccaagcugagcgaggagcuguucuaccagauccucaucuacgacuucgccaacuucggcgugcugcgccuguccgagccggcgccccuguucgaccucgccaugcuggcccuggacagccccgaguccggguggaccgaggaggacggccccaaggagggccucgccgaguacaucgucgaguuccugaagaagaaggccgagaugcuggcggacuacuucagccucgagaucgacgaggaggggaaccugaucggccugccgcuccugaucgacaacuacgugccgccccuggaggggcuccccaucuucauccugcggcuggccaccgaggugaacugggacgaggagaaggagugcuucgagucccucagcaaggagugcgccauguucuacagcauccgcaagcaguacaucuccgaggagagcacccuguccggccagcagagcgagguccccggguccauccccaacagcuggaaguggacgguggagcacaucguguacaaggcccugcggucccacauccugcccccgaagcacuucaccgaggacggcaacauccugcagcuggccaaccuccccgaccuguacaaggucuucgagcgcugcuga

SEQ ID NO: 32960 - RNA, 4290 nt, Artificial Sequence
  derived and/or modified sequence opt1 from MLH3__Homo_sapiens__NP_055196
augaucaagugccugagcguggagguccaggccaagcuccgcuccggccuggccaucagcucccuggggcagugcguggaggagcucgcgcugaacagcaucgacgccgaggccaagugcguggccguccgggugaacauggagaccuuccaggugcaggucaucgacaacggcuucgggaugggcuccgacgacguggagaagguggggaaccgcuacuucaccagcaagugccacuccguccaggaccuggagaacccccgguucuacggcuuccgcggcgaggcccucgcgaacaucgccgacauggccagcgccguggagaucuccagcaagaagaaccggacgaugaagaccuucgugaagcuguuccaguccgggaaggcgcugaaggccugcgaggccgacgucacccgcgccagcgccggcaccacggugaccguguacaaccucuucuaccagcugcccguccggcgcaagugcauggacccccggcuggaguucgagaaggugcgccagcggaucgaggcgcucucccugaugcaccccagcaucuccuucagccugcgcaacgacguguccgggagcaugguccuccagcugcccaagaccaaggacgugugcucccgguucugccagaucuacggccugggcaagagccagaagcuccgcgagaucagcuucaaguacaaggaguucgagcuguccggguacaucagcuccgaggcccacuacaacaagaacaugcaguuccuguucgugaacaagcggcucguccugcgcaccaagcugcacaagcucaucgacuuccugcugcggaaggagagcaucaucugcaagccgaagaacggccccacgucccgccagaugaacagcucccuccggcaccgcagcacccccgagcuguacgggaucuacgugaucaacgugcagugccaguucugcgaguacgacgucugcauggagcccgccaagacccugaucgaguuccagaacugggacacccuccuguucugcauccaggagggcgugaagauguuccugaagcaggagaagcuguucgucgagcuguccggggaggacaucaaggaguucagcgaggacaacggcuucucccuguucgacgccacgcuccagaagcgggugaccagcgacgagcgcuccaacuuccaggaggccugcaacaacauccuggacagcuacgagauguucaaccugcaguccaaggcggugaagcgcaagaccaccgccgagaacgucaacacgcagagcucccgggacagcgaggccacccgcaagaacaccaacgacgccuuccucuacaucuacgaguccggcgggccgggccacagcaagaugaccgagcccagccugcagaacaaggacuccagcugcuccgagagcaagaugcuggagcaggagacgaucguggccuccgaggcgggggagaacgagaagcacaagaaguccuuccucgagcacagcagccuggagaaccccugcggcaccucccuggagauguuccucagccccuuccagaccccgugccacuucgaggaguccgggcaggaccuggagaucuggaaggagagcaccacggugaacggcauggccgccaacauccugaagaacaaccggauccagaaccagcccaagcgcuucaaggacgccaccgaggucggcugccagccccuccccuucgccaccacccuguggggcgugcacuccgcgcagacggagaaggagaagaagaaggagagcuccaacugcgggcggcgcaacguguucagcuacgggcgggucaagcugugcuccaccggcuucaucacccacguggugcagaacgagaagaccaagagcacggagaccgagcacagcuucaagaacuacguccgcccggggcccacccgggcccaggagaccuucggcaaccgcacgcggcacuccguggagacccccgacaucaaggaccuggccagcacccucuccaaggagagcggccagcugcccaacaagaagaacugccgcaccaacaucuccuacgggcuggagaacgagccgaccgccacguacaccauguucagcgcguuccaggagggcuccaagaagucccagaccgacugcauccucagcgacaccagccccuccuuccccugguaccggcacgugagcaacgacucccgcaagacggacaagcugaucggguucagcaagcccaucguccggaagaagcugucccucagcucccagcugggcagccuggagaaguucaagcgccaguacgggaagguggagaacccgcucgacaccgagguggaggaguccaacggcgucaccaccaaccugagccuccagguggagcccgacauccuccugaaggacaagaaccggcuggagaacagcgacgugugcaagaucacgaccauggagcacuccgacagcgacuccagcugccagcccgccucccacauccucaacagcgagaaguuccccuucuccaaggacgaggacugccuggagcagcagaugccgagccugcgcgagucccccaugacccucaaggagcugagccuguucaaccggaagccccucgaccuggagaaguccagcgagucccuggccagcaagcucucccgccugaagggcagcgagcgcgagacccagacgauggggaugaugucccgguucaacgagcugccgaacagcgacuccagccgcaaggacagcaagcucugcuccguccugacccaggacuucugcaugcuguucaacaacaagcacgagaagaccgagaacggcgugauccccaccagcgacuccgccacgcaggacaacagcuucaacaagaacuccaagacccacagcaacuccaacaccaccgagaacugcgugaucagcgagacgccccucguccugcccuacaacaacuccaaggugaccgggaaggacagcgacgugcugauccgggccuccgagcagcagaucggcagccucgacuccccgagcggcaugcugaugaaccccgucgaggacgcgaccggggaccagaacggcaucugcuuccaguccgaggagagcaaggcccgcgccugcuccgagaccgaggagagcaacacgugcugcuccgacuggcagcggcacuucgacguggcccuggggcgcaugguguacgucaacaagaugaccggccucagcaccuucaucgcccccaccgaggacauccaggcggccugcacgaaggaccugaccaccguggccguggacgucgugcuggagaacgggagccaguaccggugccagcccuuccgcuccgaccucgugcugccguuccugccccgggcccgcgccgagcggaccgucaugcgccaggacaaccgggacacgguggacgacaccgugagcuccgagagccuccagucccuguucagcgagugggacaaccccgucuucgcgcgcuaccccgagguggccguggacgucuccagcggccaggccgagucccuggccgugaagauccacaacauccucuacccguaccgguucaccaagggcaugauccacagcaugcagguccugcagcaggucgacaacaaguucaucgcgugccugauguccaccaagacggaggagaacggggaggccgacagcuacgagaagcagcaggcccagggcuccgggcgcaagaagcuccugagcuccacccugaucccgccccucgagaucaccgugaccgaggagcagcggcgccugcuguggugcuaccacaagaaccucgaggaccugggccuggaguucguguuccccgacaccagcgacucccucgugcugguggggaaggugccccugugcuucgucgagcgggaggccaacgagcuccgccggggccgcagcacggugaccaaguccaucgucgaggaguucauccgcgagcagcuggagcugcuccagaccaccggcgggauccagggcacgcugccccugaccgugcagaaggugcucgccagccaggcgugccacggggccaucaaguucaacgacggccugagccugcaggaguccugccggcucaucgaggcccugagcuccugccagcugcccuuccagugcgcccacgggcgccccagcaugcucccgcuggccgacaucgaccaccuggagcaggagaagcagaucaagcccaaccucaccaagcugcggaagauggcgcaggccuggcgccuguucggcaaggccgagugcgacacccggcagucccuccagcagagcaugccgcccugcgagccgcccuga

SEQ ID NO: 32961 - RNA, 792 nt, Artificial Sequence
  derived and/or modified sequence opt1 from MLKL__Homo_sapiens__NP_001135969
auggagaaccugaagcacaucaucacccucggccaggugauccacaagcgcugcgaggagaugaaguacugcaagaagcagugccggcgccuggggcaccggguccugggccucaucaagccccuggagaugcugcaggaccaggggaagcgcagcgugccguccgagaagcucaccacggccaugaaccgguucaaggccgcgcuggaggaggccaacggcgagaucgagaaguucagcaaccgcuccaacaucugccgguuccugaccgccagccaggacaagauccucuucaaggacgugaaccgcaagcuguccgacgucuggaaggagcugagccuccugcuccagguggagcagcggaugcccgugucccccaucagccagggggccuccugggcccaggaggaccagcaggacgcggacgaggaccgccgggccuuccagaugcugcgccgggacaacgagaagaucgaggccagccugcgccggcuggagaucaacaugaaggagaucaaggagacccuccgccagucccuggagagcuccagcggcaagagcccccuggagaucucccgguucaaggucaagaacgugaagaccggcuccgccagcgggugcaacuccgagaagauccgcaagcucguggcggucaagcggcagcaggagccgcugggcgaggacugccccagcgagcugcgcgagaucaucgacgagugccgggcccacgaccccagcgugcgccccuccguggacgagauccucaagaagcugagcacguucuccaaguga

SEQ ID NO: 32962 - RNA, 3207 nt, Artificial Sequence
  derived and/or modified sequence opt1 from MLLT10__Homo_sapiens__NP_001182555
auggugagcuccgaccgccccgucagccuggaggacgaggugucccacagcaugaaggagaugaucggcgggugcugcgugugcuccgacgagcggggcugggccgagaacccgcucgucuacugcgacgggcacggcugcagcguggccgugcaccaggcgugcuacgggaucguccaggugcccaccggccccugguucugccgcaagugcgagucccaggagcgggccgcccgcgugcggugcgagcugugcccccacaaggacggcgcccugaagcgcaccgacaacgggggcugggcccacgucgugugcgcgcucuacaucccggaggugcaguucgccaacgucagcacgauggagcccaucgugcugcaguccgugccccacgaccgguacaacaagaccugcuacaucugcgacgagcaggggcgcgagagcaaggccgccaccggcgcgugcaugaccugcaacaagcacgggugccggcaggccuuccacgucacgugcgcccaguucgccggccugcucugcgaggaggagggcaacggggccgacaacgugcaguacugcggcuacugcaaguaccacuucuccaagcugaagaagagcaagcgcggguccaaccggagcuacgaccagucccugagcgacuccagcucccacagccaggacaagcaccacgagaaggagaagaagaaguacaaggagaaggacaagcacaagcagaagcacaagaagcagcccgagccgagccccgcgcucgugcccucccugaccgucaccaccgagaagacguacaccagcaccuccaacaacagcaucuccggcagccugaagcgccucgaggacaccacggcccgguucaccaacgccaacuuccaggagguguccgcccacaccagcuccggcaaggacgugagcgagacccgcggguccgagggcaaggggaagaagagcuccgcccacagcuccggccagcgggggcgcaagcccggcggcgggcggaacccgggcacgaccgucagcgcggccucccccuucccccaggggagcuucuccggcacccccgggagcgugaagagcuccagcggcuccagcgugcaguccccgcaggacuuccugagcuucaccgacuccgaccugcgcaacgacagcuacucccacagccagcaguccagcgccacgaaggacguccacaagggcgaguccgggagccaggagggcggggugaacuccuucagcacccucaucggccugcccuccaccagcgccgucaccagccagcccaaguccuucgagaacagccccggggaccugggcaacuccagccucccgacggccggcuacaagcgggcgcagaccuccgggaucgaggaggagaccgugaaggagaagaagcgcaagggcaacaagcagagcaagcacgggcccggccggcccaagggcaacaagaaccaggagaacgugucccaccugagcgucuccagcgccucccccaccagcuccguggccagcgccgccggguccaucacgagcuccagccugcagaaguccccgacccuccugcgcaacggcagccugcagagccucuccguggggagcucccccgucggcagcgagaucuccaugcaguaccgccacgacggggcgugccccaccaccacguucagcgagcugcugaacgccauccacaacggcaucuacaacuccaacgacguggccgugagcuuccccaacgucguguccggcagcggguccagcaccccgguguccagcucccaccucccccagcagagcuccggccaccugcagcaggucggggcccugagccccuccgcggugagcagcgccgccccggccguggccaccacccaggcgaacacgcucuccggcagcucccugagccaggcccccucccacauguacgggaaccggagcaacuccagcauggccgcccugaucgcccaguccgagaacaaccagaccgaccaggaccucggcgacaacagccgcaaccuggucggccggggguccagcccccgcggcucccugagcccccgguccccggugagcucccuccagauccgcuacgaccagcccgggaacagcucccuggagaaccugccccccguggcggccagcaucgagcagcuccuggagcggcaguggagcgagggccagcaguuccugcucgagcaggggaccccguccgacauccugggcaugcugaagagccuccaccagcugcaggucgagaaccgccggcuggaggagcagaucaagaaccucaccgccaagaaggagcgccugcagcugcugaacgcccagcucuccgugcccuuccccaccaucacggccaaccccagcccgucccaccagauccacaccuucagcgcgcagaccgcccccaccacggacucccugaacagcuccaagagcccccacaucggcaacuccuuccugcccgacaacagccucccggugcugaaccaggaccugaccuccagcgggcaguccaccagcuccagcuccgcccucagcacccccccccccgccggccagagcccggcgcagcagggguccggcgucagcggggugcagcaggugaacggcgucacggugggcgcccuggccuccgggaugcagcccgugaccagcaccauccccgccgucuccgccgugggcgggaucaucggcgcgcugcccggcaaccagcucgccaucaacgggaucgugggcgcccugaacggggucaugcagaccccggugacgaugagccagaaccccaccccccugacccacaccacggugccgcccaacgccacccaccccaugcccgccacccucaccaacuccgcgagcggccuggggcugcucuccgaccagcagcggcagauccugauccaccagcagcaguuccagcagcugcucaacagccagcagcugacgccggagcagcaccaggccuuccuguaccagcucaugcagcaccaccaccagcagcaccaccagcccgagcugcagcagcugcagauccccggccccacccagaucccgaucaacaaccuccuggccggcacccaggcccccccccugcacaccgccacgaccaaccccuuccucaccauccacggggacaacgcgucccagaaggucgcccgccugagcgacaagaccggcccgguggcccaggagaaguccuga

SEQ ID NO: 32963 - RNA, 1680 nt, Artificial Sequence
  derived and/or modified sequence opt1 from MLLT1__Homo_sapiens__NP_005925
auggacaaccagugcaccgugcagguccgccuggagcucggccaccgggcccagcugcgcaagaagcccaccacggagggguucacccacgacuggaugguguucgugcggggccccgagcagugcgacauccagcacuucgucgagaaggugguguucuggcugcacgacagcuuccccaagccccgccgggucugcaaggagcccccguacaagguggaggaguccggguacgccggcuucaucaugcccaucgaggugcacuucaagaacaaggaggagccccgcaaggucugcuucaccuacgaccucuuccugaaccuggaggggaacccgcccgugaaccaccuccggugcgagaagcugaccuucaacaaccccacgaccgaguuccgcuacaagcugcuccgggcgggcggcgugauggucaugcccgagggggccgacaccgugagccgccccuccccggacuaccccaugcugcccaccaucccccugagcgccuucuccgacccgaagaagacgaagcccagccacggcuccaaggacgccaacaaggagagcuccaagaccagcaagccccacaaggugaccaaggagcaccgggagcgcccccggaaggacuccgagagcaaguccagcuccaaggagcucgagcgcgagcaggccaagagcuccaaggacaccagccggaagcugggggagggccgccugcccaaggaggagaaggcgcccccgcccaaggccgccuucaaggagcccaagauggcccucaaggagacgaagcuggaguccaccagccccaagggcgggcccccgcccccgccgcccccgccgccccgggcgagcuccaagcgccccgccaccgccgacagccccaagcccuccgccaagaagcagaagaaguccagcagcaaggggucccggagcgcccccggcaccagcccccgcacguccuccagcuccagcuucuccgacaagaagcccgcgaaggacaagagcuccacccggggcgagaaggucaaggccgagagcgagccccgcgaggccaagaaggcccuggagguggaggaguccaacagcgaggacgaggccagcuucaaguccgagagcgcgcaguccagccccuccaacagcuccagcuccagcgacuccagcuccgacagcgacuucgagcccucccagaaccacagccaggggccccuccgcuccaugguggaggaccugcagagcgaggagagcgacgaggacgacuccagcuccggcgaggaggccgccggcaagaccaaccccgggcgggacagccgccuguccuucagcgacuccgagagcgacaacuccgccgacagcucccuccccagccgggagccgcccccgccccagaagccgccgccgcccaacuccaaggucagcggccgccggucccccgagagcugcuccaagcccgagaagauccugaagaaggggaccuacgacaaggccuacacggacgagcugguggagcuccaccgccggcugauggcgcugcgcgagcggaacgugcuccagcagaucgucaaccugaucgaggagaccggccacuucaacgugaccaacaccacguucgacuucgaccuguucagccucgacgagaccaccgugcgcaagcugcaguccugccuggaggccgucgccaccuga

SEQ ID NO: 32964 - RNA, 1698 nt, Artificial Sequence
  derived and/or modified sequence opt1 from MLLT3__Homo_sapiens__NP_001273620
augugcgccgugcaggucaagcuggagcucggccaccgcgcccaggugcggaagaagcccaccguggagggguucacccacgacuggauggucuucgugcgcggcccggagcacagcaacauccagcacuucguggagaaggucguguuccaccuccacgaguccuucccccggcccaagcgcgugugcaaggacccgcccuacaaggucgaggagagcggguacgcgggcuucauccugcccaucgagguguacuucaagaacaaggaggagccccggaaggugcgcuucgacuacgaccuguuccugcaccuggaggggcacccgcccgucaaccaccuccggugcgagaagcugacguucaacaaccccaccgaggacuuccgccggaagcugcucaaggccggcggcgaccccaaccgcuccauccacaccagcuccagcuccagcuccagcuccagcuccagcuccagcuccagcuccagcagcuccagcuccagcuccagcuccagcuccagcuccagcuccagcuccagcuccagcuccagcagcuccagcuccaccagcuucuccaagccccacaagcugaugaaggagcacaaggagaagccgagcaaggacucccgggagcacaagagcgccuucaaggagcccucccgcgaccacaacaagagcuccaaggagagcuccaagaagcccaaggagaacaagccccugaaggaggagaagaucgugccgaagauggccuucaaggagcccaagcccaugagcaaggagcccaagccggacuccaaccuccugacgaucaccagcgggcaggacaagaaggcccccuccaagcggccgcccaucagcgacagcgaggagcuguccgcgaagaagcgcaagaaguccuccagcgaggcccucuucaaguccuucagcuccgccccgccccucauccugaccugcagcgccgacaagaagcagaucaaggacaagucccacgugaagaugggcaaggucaagaucgagagcgagaccuccgagaagaagaaguccacgcugccgcccuucgacgacaucguggaccccaacgacagcgacguggaggagaacaucagcuccaagagcgacuccgagcagcccagccccgcguccagcagcuccagcuccagcuccagcuucacccccucccagacccggcagcaggggccccugcgcagcaucaugaaggaccugcacuccgacgacaacgaggaggagagcgacgaggucgaggacaacgacaacgacuccgagauggagcggcccgugaaccgcggcgggagccggucccgccgggugagccucuccgacggcagcgacuccgagagcuccagcgccagcagcccccugcaccacgagccgcccccgccccugcucaagaccaacaacaaccagauccuggaggucaagagccccaucaagcaguccaagagcgacaagcagaucaagaacggcgagugcgacaaggccuaccuggacgagcucguggagcugcaccgccgccugaugacgcuccgggagcgccacauccugcagcagaucgugaaccugaucgaggagaccgggcacuuccacaucaccaacaccacguucgacuucgaccucugcucccuggacaagaccaccguccggaagcugcagagcuaccucgagaccuccggcacgagcuga

SEQ ID NO: 32965 - RNA, 4956 nt, Artificial Sequence
  derived and/or modified sequence opt1 from MLLT4__Homo_sapiens__NP_001035089
augagcgccggcgggcgcgacgaggagcggcgcaagcuggccgacaucauccaccacuggaacgcgaaccggcucgaccuguucgagaucucccagcccaccgaggaccuggaguuccacggcgugaugcgcuucuacuuccaggacaaggccgccgggaacuucgccaccaagugcauccgggucagcuccacggccaccacccaggacgugaucgagacccucgcggagaaguuccgcccggacaugcggaugcugagcucccccaaguacagccuguacgaggugcacgucuccggcgagcgccggcucgacaucgacgagaagccccugguggugcagcugaacuggaacaaggacgaccgcgaggggcgguucguccucaagaacgagaacgacgccauccccccgaagaaggcccagagcaacggccccgagaagcaggagaaggagggcgugauccagaacuucaagcgcacgcuguccaagaaggagaagaaggagaagaagaagcgggagaaggaggcccugcgccaggcgagcgacaaggacgaccggcccuuccagggggaggacguggagaacucccgccucgccgccgaggucuacaaggacaugcccgagaccagcuucacccggaccaucuccaacccggagguggugaugaagcgccggcgccagcagaagcuggagaagcggaugcaggaguuccgcagcuccgacggccgccccgacagcgggggcacgcugcggaucuacgccgacucccucaagcccaacauccccuacaagaccauccugcugagcaccaccgacccggccgacuucgcggucgccgaggcccucgagaaguacgggcuggagaaggagaaccccaaggacuacugcaucgcccgcgugaugcugccccccggcgcccagcacuccgacgagaagggcgcgaaggagaucauccucgacgacgacgagugcccgcugcagaucuuccgggaguggcccagcgacaaggggauccugguguuccagcucaagcgccggccccccgaccacaucccgaagaagacgaagaagcaccuggagggcaagacccccaaggggaaggagcgcgccgacggcagcggcuacggguccacccugccccccgagaagcucccguaccuggucgagcugagccccggccggcgcaaccacuucgccuacuacaacuaccacaccuacgaggacggguccgacagccgggacaagcccaagcucuaccgccugcagcuguccgugacggaggugggcaccgagaagcucgacgacaacagcauccagcuguucgggcccggcauccagccgcaccacugcgaccugaccaacauggacggcgucgugaccgugacgccccgguccauggacgccgagaccuacgucgaggggcagcgcaucagcgagaccaccaugcuccaguccggcaugaaggugcaguucggggccagccacguguucaaguucgucgaccccucccaggaccacgcgcuggccaagcggagcguggacggcgggcugauggucaagggcccgcgccacaagcccggcaucgugcaggagacgaccuucgaccucgggggcgacauccacuccgggaccgcccugcccaccagcaaguccacgacccggcuggacagcgaccgcguguccagcgccuccagcaccgccgagcggggcauggucaagcccaugauccgcguggagcagcagccggacuaccggcgccaggagagccgcacccaggacgcguccgggcccgagcucauccugcccgccagcaucgaguuccgggaguccagcgaggacuccuuccugagcgccaucaucaacuacacgaacuccagcaccgugcacuucaagcucucccccaccuacguccuguacauggccugccgcuacgugcugagcaaccaguaccggccggacaucucccccaccgagcgcacgcacaaggugaucgcggucgugaacaagauggugagcaugauggagggcgucauccagaagcagaagaacaucgccggcgcccucgccuucuggauggccaacgcguccgagcugcugaacuucaucaagcaggaccgggaccugagccgcaucacccucgacgcccaggacgugcuggcccaccuggugcagauggccuucaaguaccucguccacugccugcaguccgagcugaacaacuacaugcccgccuuccucgacgaccccgaggagaacagccugcagcggccgaagaucgacgacgugcugcacacccucaccggggcgaugucccugcugcgccggugccgcgugaacgccgcccucaccauccagcuguucagccagcuguuccacuucaucaacauguggcucuucaaccggcuggucacggaccccgacagcggccugugcucccacuacuggggggccaucauccgccagcagcucggccacaucgaggccugggcggagaagcagggccuggagcuggccgccgacugccaccucagccggaucgugcaggccaccacccugcugaccauggacaaguacgcgcccgacgacauccccaacaucaacuccacgugcuucaagcucaacagccugcagcugcaggcccuccugcagaacuaccacugcgccccggacgagcccuucauccccaccgaccugaucgagaacguggucaccguggccgagaacaccgccgacgagcucgcgcgcuccgacgggcgggaggugcagcuggaggaggaccccgaccugcagcucccguuccugcugcccgaggacggcuacagcugcgacgucgugcgcaacauccccaacgggcuccaggaguuccuggacccccugugccagcggggcuucugccgccucaucccgcacacgcggucccccgggaccuggaccaucuacuucgagggcgccgacuacgagagccaccugcugcgcgagaacaccgagcucgcccagccccugcggaaggagccggagaucaucacggugacccugaagaagcagaacggcauggggcucuccaucgucgccgccaagggcgcggggcaggacaagcugggcaucuacgugaagagcguggucaaggggggcgccgccgacguggacggccgccuggccgccggggaccagcuccuguccguggacggccgcagccuggucgggcucucccaggagcgggcggccgagcugaugacccgcaccagcuccguggugacgcuggaggucgccaagcagggcgccaucuaccacgggcucgcgacccugcugaaccagcccagccccaugaugcagcggaucuccgaccgccggggcagcggcaagccccgcccgaaguccgagggguucgagcucuacaacaacagcacccagaacggcagccccgaguccccccagcugcccugggccgaguacagcgagccgaagaagcugcccggggacgaccggcucaugaagaaccgcgccgaccaccgguccagccccaacguggccaaccagcccccgucccccggcgggaagagcgccuacgcguccggcaccacggccaagaucaccagcguguccaccggcaaccugugcaccgaggagcagacgccccccccgcgccccgaggccuaccccauccccacccagaccuacacccgggaguacuucacguucccggccagcaagucccaggaccgcauggcccccccccagaaccaguggcccaacuacgaggagaagccgcacaugcacaccgacagcaaccacuccagcaucgcgauccagcgggucacccgcucccaggaggagcugcgggaggacaaggccuaccagcucgagcgccaccggaucgaggccgccauggaccgcaagagcgacuccgacauguggaucaaccagagcuccagccuggacagcuccaccagcucccaggagcaccugaaccacagcuccaagagcgugacgcccgccuccacccucaccaagagcgggcccggccgguggaagacccccgcggccaucccggccacgcccguggccgucucccagcccauccgcaccgaccugccgcccccccccccgcccccccccgugcacuacgccggggacuucgacggcaugagcauggaccugccgcuccccccccccccguccgcgaaccagaucggccugcccagcgcccagguggccgccgcggagcgccggaagcgcgaggagcaccagcggugguacgagaaggagaaggcccgccuggaggaggagcgggagcgcaagcggcgcgagcaggagcggaagcucgggcagaugcgcacccagucccugaaccccgcccccuucagcccgcugaccgcccagcagaugaagcccgagaagcccuccacccuccagcggccccaggagacggucauccgcgagcugcagccgcagcagcagccccggaccaucgagcgccgggaccugcaguacaucaccgugagcaaggaggagcucuccagcggcgacucccugagccccgaccccuggaagcgcgacgccaaggagaagcuggagaagcagcagcagaugcacaucguggacaugcucagcaaggagauccaggagcugcaguccaagccggaccggagcgcggaggaguccgaccgccugcggaagcucaugcuggaguggcaguuccagaagcgccugcaggagagcaagcagaaggacgaggacgacgaggaggaggaggacgacgacgucgacaccaugcucaucaugcagcggcuggaggccgagcgccgcgcccgggacgaggagcgccggcgccagcagcagcuggaggagaugcggaagcgcgaggccgaggaccgggcccgccaggaggaggagcggcgccggcaggaggaggagcgcacgaagcgggacgcggaggagaaggugauggugcucuga

SEQ ID NO: 32966 - RNA, 3282 nt, Artificial Sequence
  derived and/or modified sequence opt1 from MLLT6__Homo_sapiens__NP_005928
augaaggagauggugggcgggugcugcgucugcagcgacgagcgcggcugggccgagaacccccugguguacugcgacgggcacgccugcuccguggcgguccaccaggccugcuacggcaucgugcaggugccgaccgggcccugguucugccggaagugcgagagccaggagcgcgccgcccggguccgcugcgagcucugcccccacaaggacggcgcccugaagcggaccgacaacggcgggugggcgcacguggugugcgcccuguacauccccgagguccaguucgccaacgugcucacgauggagccgaucgugcugcaguacgucccccacgaccgcuucaacaagaccugcuacaucugcgaggagcagggccgggaguccaaggccgcgagcggggccugcaugaccugcaaccgccacggcugccggcaggccuuccacgugaccugcgcccagauggccgggcugcucugcgaggaggaggugcuggaggucgacaacgugaaguacugcggcuacugcaaguaccacuucuccaagaugaagacgagccgccacuccagcggcgggggcgggggcggcgcggggggcgggggcggguccaugggcggcgggggcagcggguucaucuccggccggcgcagccgguccgccagccccuccacccagcaggagaagcaccccacccaccacgagcgcgggcagaagaagagccggaaggacaaggagcgccugaagcagaagcacaagaagcggccggaguccccccccagcauccucacccccccggugguccccacggccgacaagguguccagcagcgccuccagcuccagccaccacgaggccuccacccaggagaccagcgaguccagccgcgaguccaagggcaagaagagcuccagccacucccugagccacaagggcaagaagcuguccagcgggaagggcguguccagcuucaccuccgcgagcagcuccagcuccagcuccagcuccagcuccgggggccccuuccagcccgccgucagcucccuccagagcuccccggacuucagcgccuuccccaagcuggagcagcccgaggaggacaaguacuccaagcccacggccccggcccccagcgcgccccccuccccgagcgcccccgagccccccaaggccgaccuguucgagcagaaggugguguucagcggguucggcccgaucaugcgguucuccaccaccaccagcuccagcggccgcgcccgggcccccucccccggggacuacaagagcccgcacgucacgggcuccggggcgagcgccggcacccacaagcgcaugcccgcccucuccgccacccccgugcccgcggacgagaccccggagacgggccugaaggagaagaagcacaaggccagcaagcgcucccggcacgggcccggccgccccaaggggagccggaacaaggagggcaccgggggccccgccgccccgucccugcccagcgcccagcucgcgggcuucaccgccaccgccgccucccccuucagcgggggcucccuggucagcuccgggcugggcgggcucagcagccgcacguucggccccuccggcagccugccgucccugagccucgaguccccccugcugggggccggcaucuacaccagcaacaaggaccccaucucccacagcgggggcaugcuccgggcggugugcuccaccccccugagcuccagccugcucgggccgcccggcaccuccgcccugccccgccugagccggucccccuucacgagcacccucccguccagcuccgccagcaucagcaccacccagguguucucccuggccggcagcacguucucccugcccagcacccacaucuucgggacccccaugggcgccgucaacccccuccugucccaggcggagagcucccacaccgagccggaccuggaggacugcagcuuccgcugccgggggacguccccccaggagagccucuccagcaugucccccaucagcucccugccggcccuguucgaccagaccgccagcgcccccugcggcgggggccagcucgaccccgcggcccccggcaccaccaacauggagcagcugcuggagaagcagggggacggcgaggccggggugaacaucguggagaugcucaaggcccugcacgcccugcagaaggagaaccagcgccuccaggagcagauccugucccugaccgcgaagaaggagcggcugcagauccucaacguccagcugagcgugccguuccccgcccugcccgccgcccuccccgccgcgaacggcccggugcccggccccuacgggcugcccccgcaggccggcuccagcgacagccuguccacgagcaaguccccccccgggaagagcucccucggccuggacaacagccuguccaccagcuccgaggacccccacagcgggugcccgucccgcagcuccagcucccucagcuuccacuccaccccccccccccugccgcugcuccagcagagccccgccacccugccccuggcccuccccggcgccccggcgccccugcccccccagccgcagaacggccuggggcgggcccccggcgccgccgggcucggcgcgaugcccauggccgaggggcugcugggcggccucgccggguccggcgggcugccgcugaacggccuccuggggggccugaacggcgccgccgcgcccaaccccgccagccucagccaggccgggggcgcccccacgcugcagcugccggggugccucaacucccugaccgagcagcagcgccaccugcuccagcagcaggagcagcagcugcagcagcugcagcagcuccuggccagcccccagcugacccccgagcaccagaccgucguguaccagaugauccagcagauccagcagaagcgggagcuccagcgccugcagauggcgggcggcucccagcugcccauggccagccuccuggccggguccagcacgccgcugcucuccgccggcacccccgggcugcugcccaccgccagcgcgcccccgcuccugcccgccggcgcccugguggcccccucccucgggaacaacaccagccugauggccgcggccgccgccgcggccgccgucgccgccgcgggcggccccccggugcugacggcccagaccaaccccuuccucucccugagcggggccgagggcuccgggggcgggcccaagggcggcaccgccgacaagggggccagcgcgaaccaggagaagggcuga

SEQ ID NO: 32967 - RNA, 345 nt, Artificial Sequence
  derived and/or modified sequence opt1 from MLN__Homo_sapiens__NP_001035198
auggugagccgcaaggccgucgccgcccugcucguggugcacgucgccgccaugcuggccucccagaccgaggccuucgugcccaucuucaccuacggcgagcugcagcggaugcaggagaaggagcgcaacaaggggcagaagaagucccucagcguguggcagcggagcggcgaggaggggccggucgaccccgcggagcccauccgcgaggaggagaacgagaugaucaagcugacggcgccccuggagaucggcaugcggaugaacucccgccagcucgagaaguacccggccacccuggaggggcugcucagcgagaugcugccccagcacgccaaguga

SEQ ID NO: 32968 - RNA, 1239 nt, Artificial Sequence
  derived and/or modified sequence opt1 from MLNR__Homo_sapiens__NP_001498
augggcagccccuggaacggguccgacggccccgagggggcccgcgagccgcccuggcccgcccugccgcccugcgacgagcggcgcugcagccccuucccccucggcgcgcuggugccggucaccgccgugugccugugccucuucguggucgggguguccggcaacguggucaccgugaugcugaucggccgguaccgcgacaugcggacgaccaccaaccuguaccucgggagcauggccguguccgaccugcugauccuccugggccugcccuucgaccucuaccgccuguggcggagccgccccugggucuucgggccccugcucugccggcugucccuguacgugggcgaggggugcaccuacgccacgcuccugcacaugaccgcccugagcguggagcgcuaccucgcgaucugccggccgcugcgcgcccggguccuggugacccgccggcgcgugcgggcccucaucgccguccugugggcgguggcccugcucuccgccggccccuuccuguuccuggugggcgucgagcaggaccccgggaucagcguggugcccggccucaacgggaccgcccgcaucgccuccagcccgcuggcguccagcccgccccuguggcucucccgggccccgccgcccagcccgcccuccggccccgagacggccgaggccgccgcgcuguucagccgcgagugccggcccucccccgcccagcugggcgcccuccgcgucaugcugugggugaccaccgccuacuucuuccugcccuuccucugccugagcauccuguacgggcucaucggccgcgagcuguggagcucccggcgcccccugcgggggcccgccgcgagcggccgcgagcgggggcaccgccagaccgugcggguccuccugguggucgugcuggccuucaucaucugcuggcuccccuuccacgugggccgcaucaucuacaucaacacggaggacucccggaugauguacuucagccaguacuucaacaucgucgcccugcagcuguucuaccuguccgccagcaucaaccccauccucuacaaccugaucuccaagaaguaccgcgccgcggccuucaagcugcuccuggcccgcaagagccggccccggggcuuccaccgcucccgggacaccgccggggagguggcgggcgacaccgggggcgacaccgugggguacacggagaccagcgccaacgucaagaccaugggcuga

SEQ ID NO: 32969 - RNA, 1719 nt, Artificial Sequence
  derived and/or modified sequence opt1 from MLPH__Homo_sapiens__NP_001035932
augggcaagaagcuggaccucagcaagcugaccgacgaggaggcccagcacgugcuggaggucgugcagcgcgacuucgaccuccggcgcaaggaggaggagcggcuggaggcccugaaggggaagaucaagaaggaguccagcaagcgcgagcuccuguccgacaccgcgcaccugaacgagacgcacugcgcccggugccuccagcccuaccagcugcuggugaacagcaagcgccagugccucgagugcggccuguucacgugcaaguccugcgggcggguccacccggaggagcagggcuggaucugcgaccccugccaccuggcccgcguggugaagaucgggagccucgagugguacuacgagcacgucaaggcccgguucaagcgcuucggcuccgccaaggugauccggagccugcacggccgccugcagggcggggcggggcccgagcucaucuccgaggagcggagcggcgacuccgaccagaccgacgaggacggggagcccggcagcgaggcccaggcccaggcccagccguucggcuccaagaagaagcgccugcugagcgugcacgacuucgacuucgagggggacuccgacgacagcacccagccccagggccacucccuccaccugagcuccguccccgaggcgcgggacagcccccagagccugaccgacgaguccugcagcgagaaggccgccccgcacaaggccgaggggcucgaggaggccgacaccggcgcguccggcugccacagccaccccgaggagcagcccaccuccaucagccccucccgccacggggcccuggccgagcugugcccgcccggcgggagccaccggauggcccucggcaccgccgcggcccugggguccaacgugauccgcaacgagcagcugccccuccaguaccuggccgacguggacacgagcgacgaggaguccauccgggcccacgucauggccagccaccacuccaagcgccggggccgcgcgagcuccgagagccagggccugggggccggcgugcgcaccgaggccgacguggaggaggaggcccuccggcgcaagcuggaggagcugaccuccaacgucagcgaccaggagaccuccagcgaggaggaggaggccaaggacgagaaggcggagcccaaccgggacaagagcguggggccgcucccccaggccgaccccgaggugggcacggccgcccaccagaccaaccgccaggagaaguccccgcaggaccccggggaccccguccaguacaaccggaccaccgacgaggagcugagcgagcuggaggaccgcguggcggugacggccuccgagguccagcaggccgagagcgagguguccgacaucgagagccggaucgccgcccuccgcgcggccggccugaccgugaagcccuccggcaagccccggcgcaagagcaaccugccgaucuuccucccccgggucgccgggaagcugggcaagcgccccgaggaccccaacgccgacccguccagcgaggccaaggcgauggccgugcccuaccugcuccggcgcaaguucuccaacagccugaagucccaggggaaggacgacgacagcuucgaccggaaguccgucuaccgcggcagccugacccagcggaaccccaacgcccgcaaggggauggccucccacaccuucgccaagccggugguggcgcaccagagcuga

SEQ ID NO: 32970 - RNA, 981 nt, Artificial Sequence
  derived and/or modified sequence opt1 from MLST8__Homo_sapiens__NP_001186102
augaacaccagccccggcaccgugggguccgacccggucauccuggccacggccggcuacgaccacaccgugcgcuucuggcaggcgcacagcgggaucugcacccggaccgugcagcaccaggacucccaggucaacgcccucgaggugacgcccgaccgcagcaugaucgccgccgccggcuaccagcacauccggauguacgaccugaacuccaacaaccccaaccccaucaucagcuacgacggggugaacaagaacaucgcguccgucggcuuccacgaggacggccgcuggauguacaccgggggcgaggacugcaccgcccggaucugggaccugcgcagccggaaccuccagugccagcgcaucuuccaggugaacgccccgaucaacugcgugugccugcaccccaaccaggccgagcugaucgucggggaccaguccggcgcgauccacaucugggaccucaagaccgaccacaacgagcagcugauccccgagcccgaggugagcaucacguccgcccacaucgacccggacgccagcuacauggccgccgugaacuccaccgggaacugcuacgucuggaaccugaccggcggcaucggggacgaggugacccagcucauccccaagacgaagauccccgcgcacacccgguacgcccugcagugccgcuucagccccgacuccacccugcucgcgaccugcagcgccgaccagacgugcaagaucuggcggaccuccaacuucagccugaugaccgagcuguccaucaagagcggcaacccgggggagagcucccgcggcuggauguggggcugcgccuucagcggggacucccaguacaucgugaccgccagcuccgacaaccucgcccggcuguggugcgucgagacgggcgagaucaagcgcgaguacgggggccaccagaaggccguggugugccuggccuucaacgacagcguccucggguga

SEQ ID NO: 32971 - RNA, 897 nt, Artificial Sequence
  derived and/or modified sequence opt1 from MLX__Homo_sapiens__NP_733752
augaccgagcccggcgccagccccgaggaccccugggugaaggccucccccgucggggcgcacgccggcgaggggcgcgccggccgggcccgcgcccggcgcggggcgggccggcgcggcgccagccugcucucccccaagagcccgacccuguccgugccccgggggugccgcgaggacagcucccaccccgccugcgccaagguggaguacgcguacagcgacaacucccuggaccccggccucuucgucgagagcacgcggaagggguccguggugagccgcgccaacuccaucggcagcaccuccgccagcuccgucccgaacaccgacgacgaggacagcgacuaccaccaggaggccuacaaggaguccuacaaggaccggcgccggcgcgcccacacccaggcggagcagaagcggcgcgacgccaucaagcggggguacgacgaccugcagacgaucgugccgaccugccagcagcaggacuucagcaucggcagccagaagcuguccaaggccaucgugcuccagaagaccaucgacuacauccaguuccugcacaaggagaagaagaagcaggaggaggaggucagcacccugcgcaaggacgugacggcccucaagaucaugaaggugaacuacgagcagaucgucaaggcccaccaggacaacccccacgagggcgaggaccagguguccgaccaggugaaguucaacgucuuccaggggaucauggacagccuguuccaguccuucaacgcgagcaucuccguggccagcuuccaggagcuguccgccugcguguucagcuggaucgaggagcacugcaagccccagacccuccgggagaucgucaucggcgugcugcaccagcugaagaaccagcucuacuga

SEQ ID NO: 32972 - RNA, 2760 nt, Artificial Sequence
  derived and/or modified sequence opt1 from MLXIP__Homo_sapiens__NP_055753
auggccgccgacguguucaugugcagcccccgccggccgcgcucccggggccgccagguccugcucaagccccaggugagcgaggacgacgacgacuccgacaccgacgagcccagcccgccgcccgcguccggggccgccacccccgcccgggcccacgcgagcgccgccccgcccccgccccgcgccggccccgggcgggaggagccgccccgccggcagcagaucauccacuccggccacuucauggugagcagcccccaccgcgagcacccgcccaagaagggguacgacuucgacacggucaacaagcagaccugccagaccuacuccuucggcaagaccuccagcugccaccuguccaucgacgcgagccugacgaagcuguucgagugcaugacccuggccuacuccggcaagcuggugagccccaaguggaagaacuucaaggggcucaagcugcaguggcgggacaagauccgccugaacaacgccaucuggcgggccugguacaugcaguaccucgagaagcgcaagaaccccgugugccacuucgucacgccccuggacggcuccguggacguggacgagcaccggcgccccgaggccaucaccaccgaggggaaguacuggaagucccggaucgagaucgucauccgcgaguaccacaaguggcggaccuacuucaagaagcgccugcagcagcacaaggacgaggaccucuccagccuggugcaggacgacgacaugcuguacuggcacaagcacggcgacggguggaagacccccgugcccauggaggaggacccccuccuggacaccgacaugcugaugagcgaguucuccgacacccucuucagcacccuguccagccaccagcccgucgcguggcccaacccccgggagaucgcccaccugggcaacgccgacaugauccagcccggccucaucccgcuccagcccaaccuggacuucauggacacguucgagcccuuccaggaccucuucagcagcucccgcagcaucuucggguccaugcugccggccagcgccuccgcgcccgugcccgaccccaacaacccgcccgcccaggagagcauccugcccaccacggcccuccccaccgugucccugccggacagccugaucgccccgcccaccgcccccucccucgcgcacauggacgagcagggcugcgagcacaccagccgcacggaggaccccuucauccagcccaccgacuucgggcccuccgagcccccgcugagcgucccccagcccuuccugcccguguucaccaugccgcuccugucccccagccccgcgcccccgcccaucagccccgugcugccgcucgucccgccgcccgccaccgcccugaacccgcccgccccgcccacguuccaccagccccagaaguucgccggcgugaacaaggcccccuccgugaucacccacaccgccagcgccacccugacgcacgacgcgcccgccaccaccuucucccagagccagggccucgucaucaccacgcaccaccccgcccccuccgccgcccccugcgggcuggcgcugagccccgugacccggccgccccagccccgccucaccuucgugcaccccaagcccgucucccugaccggcgggcggcccaagcagccccacaagaucgugcccgcccccaagccggagcccgucagccuggugcucaagaacgcccgcaucgcccccgccgcguucuccggccagccccaggccgugaucaugacgagcgggccgcugaagcgggagggcaugcuggccuccaccgucagccaguccaacguggugaucgcccccgccgcgaucgcccgcgcccccggcgucccggaguuccacagcuccauccucgugaccgaccuggggcacggcaccagcuccccgcccgcccccgugagccggcuguuccccagcaccgcgcaggacccccuggggaagggcgagcaggucccccuccacgggggcagcccccaggugacggugaccggcccgucccgcgacugccccaacuccgggcaggccagccccugcgccuccgagcagagccccuccccgcagagcccccagaacaacugcuccggcaagagcgaccccaagaacgucgccgcccugaagaaccggcagaugaagcacaucuccgcggagcagaagcgccgguucaacaucaagaugugcuucgacaugcugaacagccucaucuccaacaacagcaagcugaccucccacgccaucacccugcagaagacgguggaguacaucaccaagcuccagcaggagcgcgggcagaugcaggaggaggcccggcgccugcgggaggagaucgaggagcugaacgccaccaucaucagcugccagcagcuccugcccgccaccggcgugccggucacgcgccggcaguucgaccacaugaaggacauguucgacgaguacgugaagacccgcacccugcagaacuggaaguucuggaucuucuccaucaucaucaagccccucuucgagagcuucaaggggaugguguccaccagcagccuggaggagcugcaccggacggcgcucuccuggcuggaccagcacugcagccugcccauccuccgccccaugguccuguccacccugcgccagcucagcaccuccaccagcauccugacggacccggcccagcugcccgagcaggccuccaaggccgugacccggaucggcaagcgccucggcgagagcuga

SEQ ID NO: 32973 - RNA, 2559 nt, Artificial Sequence
  derived and/or modified sequence opt1 from MLXIPL__Homo_sapiens__NP_116569
auggccggcgcccuggcggggcucgccgccggccuccaggucccccgcgucgcccccucccccgacuccgacuccgacaccgacuccgaggaccccagccugcggcgcuccgccgggggccuccugcggucccaggugauccacuccgggcacuucaugguguccagcccccacagcgacucccugccccgccggcgcgaccaggagggcuccgucggccccuccgacuucgggccccggagcaucgaccccacccucacccgccuguucgagugccugucccucgcguacagcggcaagcuggugucccccaaguggaagaacuucaaggggcugaagcuccugugccgggacaagauccgccugaacaacgccaucuggcgggccugguacauccaguacgugaagcgccggaagucccccgucugcggcuucgugacgccccuccaggggcccgaggccgacgcgcaccgcaagccggaggccgugguccuggagggcaacuacuggaagcggcgcaucgagguggugaugcgggaguaccacaaguggcgcaucuacuacaagaagcggcugcgcaagcccucccgggaggacgaccuccuggcccccaagcaggccgagggccgcuggcccccgcccgagcaguggugcaagcagcuguucagcagcgucgugcccgugcuccugggggaccccgaggaggagcccggcgggcgccagcugcucgaccugaacugcuuccuguccgacaucagcgacacccucuucaccaugacccaguccggccccagcccccugcagcugccgcccgaggacgccuacgucggcaacgcggacaugauccagcccgaccucacgccccuccagcccucccuggacgacuucauggacaucagcgacuucuucaccaacucccggcucccccagccgcccaugcccagcaacuuccccgagccgcccuccuucagccccgugguggacucccuguucagcuccgggacccugggccccgaggugccgcccgccagcuccgccaugacccaccucagcgggcacucccgccugcaggcccggaacagcugccccggcccccuggacuccagcgccuuccucagcuccgacuuccugcugcccgaggaccccaagccccgccugcccccgccgcccgugcccccgccccugcugcacuacccgccgcccgcgaaggugcccgggcucgagccgugcccgccgccgcccuucccgcccauggccccgcccaccgcccugcugcaggaggagccccucuucagcccccgguuccccuuccccaccgucccgcccgcccccggcgugagcccccugcccgcccccgcggccuucccgcccacgccccagagcgugcccucccccgcccccacgcccuuccccaucgagcugcugccccucggcuacagcgagcccgccuucgggcccugcuucuccaugccccgcggcaagccgcccgcccccagcccgcgggggcagaaggcgagcccgcccacccuggcccccgccaccgccagcccgcccaccaccgcgggcuccaacaaccccugccugacccagcuccugaccgccgccaagcccgagcaggcccuggagccgccccucgucagcuccacccugcugcgcagccccgggagcccccaggagacggugccggaguuccccugcaccuuccugccgcccaccccggcccccacgccgccccggccgccgcccggccccgcgacgcuggccccgagccgcccccugcucguccccaaggccgagcggcugagcccgcccgcccccagcggcagcgagcgccggcuguccggggaccucagcuccaugcccggccccgggacccugagcgugcgcgugagcccgccccagcccauccugagccggggccgcccggacuccaacaagaccgagaaccggcgcaucacccacaucagcgccgagcagaagcggcgcuucaacaucaagcucggguucgacacgcugcacggccuggucuccacccucagcgcgcagcccucccugaaggugagcaaggccaccacccugcagaagacggccgaguacauccucaugcugcagcaggagcgcgccggccugcaggaggaggcccagcagcuccgggacgagaucgaggagcugaacgcggccaucaaccugugccagcagcagcuccccgccaccggggugcccaucacccaccagcgcuucgaccagaugcgggacauguucgacgacuacguccgcacccggacgcugcacaacuggaaguucuggguguucuccauccugauccgcccccucuucgagagcuucaacggcaugguguccaccgccagcguccacacccugcggcagaccucccuggcguggcucgaccaguacugcagccugcccgcccugcgccccaccgugcucaacucccugcggcagcuggggacgagcaccagcauccucaccgaccccggccgcaucccggagcaggccacccgggccgugacggagggcacccuggggaagccccuguga

SEQ ID NO: 32974 - RNA, 1482 nt, Artificial Sequence
  derived and/or modified sequence opt1 from MLYCD__Homo_sapiens__NP_036345
augcgcggcuucgggcccggccugaccgcccggcgccuccugccgcugcggcucccgccccgcccgcccgggccccggcuggccagcggccaggcggccggggcccuggagcgcgccauggacgagcuccugcggcgcgccgugccgcccacccccgcguacgagcugcgggagaagacgcccgcccccgccgagggccagugcgccgacuucgucuccuucuacggcgggcucgcggagaccgcccagcgcgccgagcugcugggccggcucgcccgcggguucggcguggaccacggccagguggccgagcagagcgcggggguccugcaccuccggcagcagcagcgcgaggccgccgugcugcugcaggccgaggaccggcugcgcuacgcccucgugccccgguaccgcggccuguuccaccacaucuccaagcuggacgggggcguccgguuccucgugcagcugcgcgcggaccugcucgaggcccaggcccugaagcugguggaggggcccgacguccgggagaugaacggcgugcucaagggcaugcugagcgagugguucuccagcggguuccugaaccucgagcgcgugaccuggcacucccccugcgagguccugcagaagaucagcgaggccgaggccgugcaccccgugaagaacuggauggacaugaagcgccgggucggccccuaccgccggugcuacuucuucucccacugcagcaccccgggggagccccugguggugcuccacgucgcgcugacgggcgacaucuccagcaacauccaggccaucgugaaggagcacccgcccuccgagaccgaggagaagaacaagaucaccgccgccaucuucuacagcaucucccugacccagcaggggcuccagggcguggagcugggcacguuccugaucaagcgcgucgugaaggagcuccagcgggaguucccccaccuggggguguucagcucccugagccccauccccggcuucaccaaguggcuccuggggcugcucaacucccagaccaaggagcacggccgcaacgagcuguucaccgacagcgagugcaaggagaucagcgagaucaccgggggccccaucaacgagacgcugaagcuccugcuguccagcuccgaguggguccagagcgagaagcuggugcgggcccuccagaccccgcugaugcgccugugcgcgugguaccucuacggcgagaagcaccggggguacgcccugaaccccgucgccaacuuccaccuccagaacggcgccgugcuguggcgcaucaacuggauggcggacgugucccugcgggggaucaccggcagcugcgggcugauggccaacuaccgcuacuuccucgaggagacgggccccaacuccaccagcuaccugggcuccaagaucaucaaggccagcgagcagguccugucccucguggcccaguuccagaagaacagcaagcuguga

SEQ ID NO: 32975 - RNA, 1257 nt, Artificial Sequence
  derived and/or modified sequence opt1 from MMAA__Homo_sapiens__NP_758454
augcccaugcugcucccgcacccccaccagcacuuccugaagggccugcuccgcgcccccuuccggugcuaccacuucaucuuccacagcuccacccaccuggggagcggcauccccugcgcccagccguucaacucccuggggcuccacugcaccaaguggaugcugcugagcgacggccucaagcgcaagcugugcgugcagacgacccugaaggaccacaccgaggggcucuccgacaaggagcagcgguucgucgacaagcuguacaccggccugauccagggccagcgcgcgugccucgccgaggccaucacgcugguggagagcacccacucccggaagaaggagcuggcccaggugcuccugcagaagguccugcucuaccaccgcgagcaggagcagagcaacaaggggaagccccuggccuuccgggugggccuguccgggccgcccggcgcgggcaagagcaccuucaucgaguacuucgggaagaugcucaccgagcgcggccacaagcuguccgugcuggccgucgaccccagcuccugcacgagcgggggcucccuccugggggacaagacccggaugaccgagcugagccgcgacaugaacgccuacauccggcccucccccacccgcggcacgcucggcggggugacccggaccaccaacgaggccauccugcugugcgagggcgcgggguacgacaucauccucaucgagacggugggcgucgggcagagcgaguucgccguggccgacaugguggacauguucguccugcugcugcccccggccggcggcgacgagcuccaggggaucaagcgcggcaucaucgagauggccgaccugguggcggugaccaaguccgacggggaccucaucguccccgcccggcgcauccaggccgaguacgugagcgcccugaagcugcuccggaagcgcagccagguguggaagcccaaggucauccggaucuccgcccgcagcggcgaggggaucuccgagaugugggacaagaugaaggacuuccaggaccugaugcuggcgagcggcgagcucaccgccaagcggcgcaagcagcagaagguguggauguggaaccugauccaggaguccgugcuggagcacuuccgcacccaccccacgguccgggagcagaucccgcuccuggagcagaaggugcugaucggcgcccugagccccgggcucgccgccgacuuccugcugaaggcguucaagucccgcgacuga

SEQ ID NO: 32976 - RNA, 753 nt, Artificial Sequence
  derived and/or modified sequence opt1 from MMAB__Homo_sapiens__NP_443077
auggccgugugcggccuggggagccgccucggccuggggucccggcugggccuccgcgggugcuucggcgccgcgcggcugcuguacccccgcuuccagagccggggcccgcagggggucgaggacggcgaccgcccccagcccuccagcaagacgccccggaucccgaagaucuacaccaagaccggggacaagggcuucuccagcaccuucaccggggagcgccggcccaaggacgaccagguguucgaggccgugggcaccacggacgagcucuccagcgccaucggcuucgcccuggagcuggucaccgagaaggggcacaccuucgccgaggagcuccagaagauccagugcacccugcaggacgugggcuccgcgcuggccacgcccugcagcuccgcccgcgaggcccaccucaaguacaccaccuucaaggcggggcccauccuggagcuggagcaguggaucgacaaguacaccagccagcucccgccccugacggccuucauccugcccuccggcggcaagaucagcuccgcccuccacuucugccgggccgugugccgccgggccgagcgccgggucgugccccuggugcagaugggggagaccgacgcgaacgucgccaaguuccugaaccgccucagcgacuaccuguucacccuggcccgguacgccgccaugaaggagggcaaccaggagaagaucuacaugaagaacgacccguccgcggagagcgaggggcucuga

SEQ ID NO: 32977 - RNA, 891 nt, Artificial Sequence
  derived and/or modified sequence opt1 from MMADHC__Homo_sapiens__NP_056517
auggccaacgugcugugcaaccgcgcccggcucgucagcuaccugcccggcuucugcucccuggugaagcgcguggucaacccgaaggcguucagcaccgccggguccagcggcuccgacgagagccacguggccgccgccccgcccgacaucugcucccggaccguguggcccgacgagacgauggggcccuucggcccccaggaccagcgcuuccagcuccccgggaacaucggcuucgacugccaccugaacggcaccgcgagccagaagaagucccugguccacaagacccuccccgacgugcuggccgagccgcugagcuccgagcggcacgaguucgugauggcccaguacgucaacgaguuccaggggaacgacgcccccguggagcaggagaucaacagcgcggagaccuacuucgaguccgcccgcguggagugcgccauccagacgugccccgagcuccugcggaaggacuucgagagccuguuccccgaggucgccaacggcaagcucaugauccugaccgugacccagaagaccaagaacgacaugacggugugguccgaggaggucgagaucgagcgcgaggugcugcucgagaaguucaucaacggggccaaggagaucugcuacgcgcugcgggccgagggcuacugggccgacuucaucgacccgagcuccgggcuggccuucuucggccccuacaccaacaacacccucuucgagaccgacgagcgcuaccggcaccugggcuucagcguggacgaccuggggugcugcaaggucauccgccacucccucuggggcacgcacgugguggucgggagcaucuucaccaacgccacccccgacagccacaucaugaagaagcuguccggcaacuga

SEQ ID NO: 32978 - RNA, 813 nt, Artificial Sequence
  derived and/or modified sequence opt1 from MMD2__Homo_sapiens__NP_001094070
auguucgcgccccgccugcucgacuuccagaagaccaaguacgcccgguucaugaaccaccgcgugccggcccacaagcgguaccagcccaccgaguacgagcacgccgccaacugcgccacgcacgccuucuggaucauccccagcauccugggcuccagcaaccuguacuuccucuccgacgacgacugggagaccaucagcgcguggaucuacgggcugggccugugcgggcuguucgucguguccaccguguuccacaccaucagcuggaagaagucccaccuccgcauggucgagcacugccugcacauguucgaccggauggugaucuacuucuucaucgccgccagcuacgcccccuggcucaaccugcgcgagcugggcccgugggcgucccacaugcgguggcucguguggaucauggccagcgucgggacgaucuacguguucuucuuccacgagcgcaccggcuccugcgugcaguuccugcggggcgaggccugccccaaggccgggaccgccugccugcccgcgcgcuacaagcucgucgagcugcugugcuacguggugaugggcuucuuccccgcccucgucauccugagcaugccgaacaccgaggggaucugggagcuggugacgggcgggguguucuacugccucggcauggucuucuucaaguccgacggccggauccccuucgcccacgccaucuggcaccuguucguggccuucggggcgggcacccacuacuacgccaucuggcgcuaccuguaccuccccagcacccugcagaccaagguguccaaguga

SEQ ID NO: 32979 - RNA, 717 nt, Artificial Sequence
  derived and/or modified sequence opt1 from MMD__Homo_sapiens__NP_036461
augcgcuucaagaaccgguuccagcgcuucaugaaccaccgggcccccgccaacggccgcuacaagccgaccugcuacgagcacgcggccaacugcuacacccacgccuuccugaucgugcccgccaucgucgggagcgcccuccugcaccggcuguccgacgacugcugggagaagaucacggcguggaucuacggcauggggcucugcgcccuguucaucgugagcaccguguuccacaucgucuccuggaagaagucccaccuccgcaccguggagcacugcuuccacaugugcgaccggauggugaucuacuucuucaucgccgccagcuacgcgcccuggcucaaccugcgcgagcugggcccccucgccagccacaugcggugguucaucuggcugauggccgccgggggcaccaucuacgucuuccuguaccacgagaaguacaaggugguggagcuguucuucuaccugacgaugggcuucuccccggcccuggucgugaccagcaugaacaacaccgacgggcuccaggagcuggcgugcggcgggcugaucuacugccucggcguggucuucuucaaguccgacgggaucauccccuucgcccacgccaucuggcaccuguucguggccaccgccgcggccgugcacuacuacgccaucuggaaguaccuguaccgcagccccacggacuucaugcggcaccucuga

SEQ ID NO: 32980 - RNA, 2253 nt, Artificial Sequence
  derived and/or modified sequence opt1 from MME__Homo_sapiens__XP_011511160
augggcaagagcgagucccagauggacaucaccgacaucaacacccccaagccgaagaagaagcagcgcuggacgccccuggagaucagccucuccgugcugguccugcuccugaccaucaucgccgugaccaugaucgcccuguacgcgaccuacgacgacgggaucugcaagagcuccgacugcaucaagagcgccgcccggcucauccagaacauggacgccacgaccgagcccugcaccgacuucuucaaguacgccugcggcggguggcugaagcgcaacgugauccccgagaccuccagccgguacggcaacuucgacauccugcgcgacgagcucgaggucgugcugaaggacgugcugcaggagccgaagacggaggacaucgucgcggugcagaaggccaaggcccucuaccgguccugcaucaacgagagcgccaucgacucccgcgggggcgagccccugcugaagcuccugcccgacaucuacggcuggcccguggcgaccgagaacugggagcagaaguacggggccagcuggaccgccgagaaggccaucgcccagcugaacuccaaguacggcaagaagguccucaucaaccuguucguggggaccgacgacaagaacagcgugaaccacgucauccacaucgaccagccgcggcugggccuccccucccgcgacuacuacgagugcacggggaucuacaaggaggcgugcaccgccuacguggacuucaugaucagcguggcccggcugauccgccaggaggagcggcugcccaucgacgagaaccagcucgcccuggagaugaacaaggucauggagcuggagaaggagaucgccaacgcgaccgccaagcccgaggaccgcaacgacccgaugcuccuguacaacaagaugacccuggcccagauccagaacaacuucucccucgagaucaacggcaagcccuucagcuggcugaacuucacgaacgagaucauguccaccgugaacaucagcaucaccaacgaggaggacguggucguguacgcccccgaguaccugaccaagcucaagcccauccugacgaaguacagcgcccgggaccugcagaaccucauguccuggcgcuucaucauggaccuggugagcucccugagccggaccuacaaggagucccgcaacgcguuccggaaggcccucuacggcaccaccagcgagacggccaccuggcgccggugcgccaacuacgucaacgggaacauggagaacgccgugggccgccuguacguggaggcggccuucgccggggaguccaagcacgucguggaggaccugaucgcccagauccgggaggucuucauccagacccucgacgaccugaccuggauggacgcggagacgaagaagcgcgccgaggagaaggcccuggccaucaaggagcgcaucggcuacccggacgacaucgugagcaacgacaacaagcucaacaacgaguaccuggagcugaacuacaaggaggacgaguacuucgagaacaucauccagaaccucaaguucucccagagcaagcagcugaagaagcugcgggagaagguggacaaggacgaguggaucuccggcgccgcggucgugaacgccuucuacagcuccgggcgcaaccagaucguguuccccgccggcauccugcagccgcccuucuucagcgcccagcaguccaacagccucaacuacgggggcaucgggauggucaucggccacgagaucacccacggcuucgacgacaacgggcggaacuucaacaaggacggcgaccugguggacugguggacccagcaguccgccagcaacuucaaggagcagucccagugcaugguguaccaguacgggaacuucagcugggaccuggcgggcgggcagcaccucaacggcaucaacacccugggcgagaacaucgccgacaacgggggccuggggcaggccuaccgcgccuaccagaacuacaucaagaagaacggcgaggagaagcuccugcccgggcuggaccucaaccacaagcagcuguucuuccugaacuucgcccaggucuggugcggcacguaccggcccgaguacgcggugaacagcaucaagaccgacgugcacucccccggcaacuuccgcaucaucgggacccuccagaacagcgccgaguucuccgaggccuuccacugccggaagaacagcuacaugaaccccgagaagaagugccgcgucugguga

SEQ ID NO: 32981 - RNA, 1206 nt, Artificial Sequence
  derived and/or modified sequence opt1 from MMEL1__Homo_sapiens__XP_011540425
augggcaagagcgaggggcccgugggcauggucgaguccgccgggcgcgccggccagaagcggccgggguuccuggagggcggccuccugcugcuccugcugcucgugaccgcggcccugguggcccuggggguccucuacgccgaccgccggggcaagcagcugccccgccuggccagccggcucugcuuccugcaggaggagcgcaccuucgugaagcggaagccccgcgggauccccgaggcgcaggagguguccgaggucugcacgaccccgggcugcgugaucgccgccgcccggauccugcagaacauggaccccaccaccgagcccugcgacgacuucuaccaguucgcgugcgggggcuggcuccgccggcacgugauccccgagacgaacagccgcuacuccaucuucgacguccugcgggacgagcuggaggugauccucaaggccgugcuggagaacagcaccgccaaggaccgcccggccgucgagaaggcccggacccuguaccgcuccugcaugaaccagagcgugaucgagaagcggggcucccagccccuccuggacauccuggagguggucgggggcuggcccguggcgauggaccgcuggaacgagaccguggggcucgagugggagcuggagcggcagcuggcccucaugaacagccaguucaaccgccggguccugaucgaccuguucaucuggaacgacgaccagaacuccagccgccacaucaucuacgugcgcgccgcccccgugggccgggaccgcccggcccaccucggccacgcgcugccccggguccugcuccagcgccggcagcagcccgaggagaacucccugggggccaugguggccgaggccacgcagcugugccccgccagcuucggcccgggggcgggcucccuccccgccgugcacggggucagcggccacguggccgccggcgggugcaagcccgcccagggccagcugcccggggcgggcgggcacggcgccggcgccggggccggcgacaccgcggggcagggccacgggaccccgggcggcgagacccgccggcaccgccuggucccgcccgacgggacgggcggggccgccaagcccguguggcccgagggcuccggcgccggggagggccagaaguccggggugaccagcaagaccugccagaaggcccggaagggcgcgggguga

SEQ ID NO: 32982 - RNA, 1431 nt, Artificial Sequence
  derived and/or modified sequence opt1 from MMP10__Homo_sapiens__NP_002416
augaugcaccuggccuuccucgugcugcugugccuccccgucugcagcgccuacccgcuguccggcgcggccaaggaggaggacagcaacaaggaccuggcccagcaguaccucgagaaguacuacaaccuggagaaggacgugaagcaguuccgccggaaggacuccaaccugaucgugaagaagauccaggggaugcagaaguuccucggccuggaggucaccgggaagcuggacaccgacacgcucgaggugaugcgcaagccccggugcggcgugcccgacgucgggcacuucagcuccuuccccggcaugccgaaguggcgcaagacccaccugaccuaccggaucgugaacuacacccccgaccugccccgcgacgccguggacagcgccaucgagaaggcgcucaaggucugggaggaggugacgccccugaccuucucccggcuguacgagggcgaggccgacaucaugaucagcuucgccgugaaggagcacggggacuucuacuccuucgacggcccggggcacagccucgcccacgcguacccgcccggccccgggcuguacggcgacauccacuucgacgacgacgagaaguggaccgaggacgccuccggcaccaaccuguuccucgucgccgcccacgagcuggggcacagccugggccucuuccacuccgccaacacggaggcgcugauguacccccuguacaacagcuucaccgagcucgcccaguuccgccugucccaggacgacgugaacgggauccagagccuguacgggcccccgcccgccuccaccgaggagccccucgugcccaccaagagcguccccuccggcagcgagaugcccgccaagugcgacccggcccugagcuucgacgcgaucuccacgcugcggggcgaguaccucuucuucaaggaccgcuacuucuggcggcgcagccacuggaaccccgagcccgaguuccaccugaucuccgccuucuggcccagccugccguccuaccucgacgccgccuacgaggugaacagccgggacaccguguucaucuucaagggcaacgaguucugggccauccgcgggaacgagguccaggcgggcuacccccgggggauccacacccugggcuucccgcccaccauccgcaagaucgacgccgccguguccgacaaggagaagaagaagacguacuucuucgccgccgacaaguacuggcgguucgacgagaacagccaguccauggagcagggcuucccccgccugaucgcggacgacuuccccgggguggagcccaaggucgacgccgugcuccaggccuucggcuucuucuacuucuucagcggguccagccaguucgaguucgacccgaacgcccggauggugacccacauccugaaguccaacagcuggcugcacugcuga

SEQ ID NO: 32983 - RNA, 1467 nt, Artificial Sequence
  derived and/or modified sequence opt1 from MMP11__Homo_sapiens__NP_005931
auggcccccgccgcguggcugcgcagcgccgccgcccgggcccuccugccgcccaugcugcuccugcugcuccagcccccgccccugcuggcgcgcgcccucccgcccgacgcccaccaccuccacgccgagcggcgcggcccccagcccuggcacgcggcccugcccuccagccccgcccccgccccggccacccaggaggcgccccggcccgccuccagccugcggcccccgcggugcggggugcccgaccccuccgacggccugagcgcccgcaaccggcagaagcgcuucguccuguccgggggccggugggagaagaccgaccucacguaccgcauccugcgguuccccuggcagcuggugcaggagcagguccgccagaccauggccgaggcccucaagguguggagcgacgugaccccgcugaccuucacggaggugcacgaggggcgggcggacaucaugaucgacuucgcccgcuacuggcacggcgacgaccugcccuucgacggccccgggggcauccucgcccacgccuucuuccccaagacccaccgggagggggacguccacuucgacuacgacgagaccuggaccaucggcgacgaccaggggacggaccugcuccagguggccgcgcacgaguucggccacgugcugggccugcagcacaccaccgccgccaaggcccugauguccgccuucuacaccuuccgcuacccgcucagccugucccccgacgacugccgcgggguccagcaccuguacggccagcccuggcccacggugaccagccgcaccccggcgcucgggccccaggccggcaucgacaccaacgagaucgcgccccuggagccggacgccccgcccgacgccugcgaggccuccuucgacgccgugagcacgauccggggcgagcuguucuucuucaaggccggguucgucuggcgccuccgcggcgggcagcugcagcccggcuaccccgcccuggcgucccggcacuggcaggggcuccccagccccguggacgccgccuucgaggacgcccagggccacaucugguucuuccagggcgcccaguacuggguguacgacggggagaagcccguccugggcccggcgccccugaccgagcucgggcuggugcgcuuccccgugcacgccgcccuggucuggggccccgagaagaacaagaucuacuucuuccgggggcgcgacuacuggcgguuccacccguccacccgccggguggacagccccgugccccgccgggccaccgacuggcgcggcguccccuccgagaucgacgccgcguuccaggacgccgacggcuacgccuacuuccuccgggggcgccuguacuggaaguucgacccggugaaggugaaggcccuggagggcuucccccggcucgucgggcccgacuucuucggcugcgcggagcccgccaacacguuccuguga

SEQ ID NO: 32984 - RNA, 1413 nt, Artificial Sequence
  derived and/or modified sequence opt1 from MMP12__Homo_sapiens__NP_002417
augaaguuccugcugauccugcugcuccaggccaccgccagcggcgcgcugccccugaacuccagcaccucccucgagaagaacaacgugcuguucggggagcgcuaccuggagaaguucuacggccucgagaucaacaagcugccggucacgaagaugaaguacagcgggaaccugaugaaggagaagauccaggagaugcagcacuuccucggccugaaggugaccgggcagcuggacaccuccacccucgagaugaugcacgccccgcggugcggcgugcccgacguccaccacuuccgcgagaugcccggcgggccgguguggcggaagcacuacaucacguaccgcaucaacaacuacacccccgacaugaaccgggaggacguggacuacgccauccgcaaggccuuccaggucuggagcaacgugacgccccugaaguucuccaagaucaacaccggcauggccgacauccugguggucuucgcgcgcggggcccacggcgacuuccacgccuucgacgggaagggcggcauccucgcccacgcguucgggcccggcagcgggaucggcggcgacgcccacuucgacgaggacgaguucuggaccacccacuccgggggcaccaaccuguuccugaccgccgugcacgagaucgggcacagccucggccuggggcacuccagcgacccgaaggccgugauguuccccacguacaaguacgucgacaucaacaccuuccggcuguccgccgacgacauccggggcauccagagccucuacggcgaccccaaggagaaccagcgccugcccaacccggacaacuccgagcccgcgcugugcgaccccaaccucagcuucgacgccgugaccaccguggggaacaagaucuucuucuucaaggaccgguucuucuggcugaaggucuccgagcgccccaagacgagcgugaaccugaucuccagccucuggccgacccugcccagcggcaucgaggccgccuacgagaucgaggcccggaaccagguguuccuguucaaggacgacaaguacuggcucaucuccaaccugcgccccgagcccaacuaccccaagagcauccacuccuucggguuccccaacuucgucaagaagaucgacgcggccguguucaacccccgguucuaccgcaccuacuucuucguggacaaccaguacuggcgguacgacgagcgccggcagaugauggaccccggcuacccgaagcugaucaccaagaacuuccaggggaucggccccaagaucgacgccgucuucuacagcaagaacaaguacuacuacuucuuccagggcuccaaccaguucgaguacgacuuccuccugcagcgcaucacgaagacccucaagagcaacuccugguucgggugcuga

SEQ ID NO: 32985 - RNA, 1416 nt, Artificial Sequence
  derived and/or modified sequence opt1 from MMP13__Homo_sapiens__NP_002418
augcaccccggcgugcuggccgccuuccucuuccugagcuggacccacugccgcgcgcugccgcuccccuccgggggcgacgaggacgaccugagcgaggaggaccugcaguucgccgagcgguaccuccgcuccuacuaccaccccaccaaccuggccgggauccugaaggagaacgccgccagcuccaugacggagcggcuccgcgagaugcagagcuucuucggccuggaggucaccgggaagcuggacgacaacacccucgacgugaugaagaagccccggugcggcgugccggacgucggcgaguacaacguguucccccgcacccugaagugguccaagaugaaccugacguaccggaucgugaacuacacccccgacaugacccacagcgaggucgagaaggcguucaagaaggccuucaaggugugguccgacgugacgccccucaacuucacccgccugcacgacgggaucgccgacaucaugaucagcuucggcaucaaggagcacggggacuucuacccguucgacggccccuccgggcugcucgcccacgcguucccgcccggccccaacuacggcggggacgcccacuucgacgacgacgagaccuggaccagcuccagcaagggcuacaaccuguuccuggucgccgcccacgaguucgggcacucccucggccuggaccacagcaaggaccccggcgcccugauguuccccaucuacaccuacacggggaagucccacuucaugcuccccgacgacgacgugcagggcauccagagccuguacgggccgggcgacgaggaccccaaccccaagcaccccaagaccccggacaagugcgaccccucccugagccucgacgcgaucaccagccugcgcggggagaccaugaucuucaaggaccgguucuucuggcggcugcacccccagcaggucgacgccgagcuguuccugacgaaguccuucuggcccgagcugccgaaccgcaucgacgccgccuacgagcaccccagccacgaccucaucuucaucuuccggggccgcaaguucugggcccugaacggcuacgacauccuggagggguaccccaagaagaucuccgagcucggccugcccaaggaggugaagaagaucagcgcggccgugcacuucgaggacaccgggaagacccuccucuucuccggcaaccagguguggcgguacgacgacaccaaccacaucauggacaaggacuacccgcgccugaucgaggaggacuuccccgggaucggcgacaaggucgacgccguguacgagaagaacggcuacaucuacuucuucaacgggcccauccaguucgaguacagcaucugguccaaccggaucgugcgcgucaugccggccaacagcauccuguggugcuga

SEQ ID NO: 32986 - RNA, 1749 nt, Artificial Sequence
  derived and/or modified sequence opt1 from MMP14__Homo_sapiens__NP_004986
augagccccgccccgcgcccgccccggugccugcuccugccccugcucacccugggcaccgcccuggcgucccucgggagcgcccaguccagcuccuucagccccgaggccuggcugcagcaguacggcuaccugccgcccggggaccuccgcacccacacccagcggagcccccagucccuguccgccgccaucgcggccaugcagaaguucuacggccuccaggugaccgggaaggccgacgccgacaccaugaaggcgaugcgccggccccgcugcggcguccccgacaaguucggcgccgagaucaaggccaacgugcggcgcaagcgguacgccauccaggggcugaaguggcagcacaacgagaucacguucugcauccagaacuacacccccaaggugggcgaguacgccaccuacgaggcgauccgcaaggccuuccgggucugggagagcgccacgccccugcgcuuccgggaggugccguacgccuacauccgcgaggggcacgagaagcaggccgacaucaugaucuucuucgcggagggcuuccacggggacuccacccccuucgacggcgagggcggguuccuggcccacgccuacuuccccggccccaacaucgggggcgacacccacuucgacagcgccgagccguggaccgugcggaacgaggaccucaacggcaacgacaucuuccuggucgccgugcacgagcuggggcacgcgcucggccuggagcacuccagcgaccccuccgccaucauggcccccuucuaccaguggauggacaccgagaacuucgugcugcccgacgacgaccgccgggggauccagcagcucuacggcggggagagcggcuucccgacgaagaugccgccccagccccgcaccaccucccggcccagcguccccgacaagcccaagaaccccaccuacggcccgaacaucugcgacgggaacuucgacacgguggccaugcugcgcggcgagauguucguguucaaggagcggugguucuggcgcguccgcaacaaccaggugauggacggguaccccaugcccaucggccaguucuggcgggggcugccggccuccaucaacaccgcguacgagcgcaaggacggcaaguucguguucuucaagggcgacaagcacugggucuucgacgaggccagccucgagcccggguaccccaagcacaucaaggagcugggccgggggcugcccaccgacaagaucgacgccgcccucuucuggaugccgaacggcaagaccuacuucuuccgcgggaacaaguacuaccgguucaacgaggagcugcgcgcgguggacagcgaguaccccaagaacaucaaggugugggagggcauccccgagagcccccggggcuccuucaugggguccgacgaggucuucacguacuucuacaagggcaacaaguacuggaaguucaacaaccagaagcugaagguggagccgggguaccccaagagcgcccuccgcgacuggaugggcugccccuccggcgggcggcccgacgagggcaccgaggaggagaccgaggugaucaucaucgaggucgacgaggagggcggcggggccgugagcgccgccgcggugguccugccggugcugcuccugcugcucguccuggccguggggcuggccguguucuucuuccgccggcacggcacgccccgccggcuccuguacugccagcgcucccugcucgacaaggucuga

SEQ ID NO: 32987 - RNA, 2010 nt, Artificial Sequence
  derived and/or modified sequence opt1 from MMP15__Homo_sapiens__NP_002419
augggcagcgaccccuccgccccggggcgccccggcuggaccgggagccugcucggcgaccgggaggaggccgcgcgcccccggcugcugccccuccugcuggugcuccuggggugccugggccucggcgucgccgccgaggacgccgaggugcacgccgagaacuggcugcgccuguacggguaccucccgcagcccucccggcacaugagcaccaugcgcuccgcgcagauccuggccagcgcccuggccgagaugcagcgguucuacggcauccccgugacggggguccucgacgaggagaccaaggaguggaugaagcgcccccggugcggcgugccggaccaguucggggugcgcgucaaggcgaaccugcggcgccggcgcaagcgguacgcccugaccggccgcaaguggaacaaccaccaccucaccuucuccauccagaacuacacggagaagcugggcugguaccacagcauggaggccgugcggcgcgccuuccgggugugggagcaggccacgccccuggucuuccaggaggugcccuacgaggacauccgccuccggcgccagaaggaggcggacaucauggugcuguucgccuccggguuccacggcgacagcucccccuucgacgggaccggcggcuuccuggcccacgccuacuucccggggcccggccucgggggcgacacccacuucgacgccgacgagcccuggaccuucagcuccaccgaccugcacgggaacaaccuguuccucgucgcggugcacgagcugggccacgcccugggccucgagcacagcuccaaccccaacgccaucauggccccguucuaccaguggaaggacguggacaacuucaagcugcccgaggacgaccugcgcgggauccagcagcucuacggcacccccgacgggcagccccagccgacccagccccugcccacggucacgccccggcgcccgggccggcccgaccaccgcccgccccgcccgccccagcccccgccgcccgggggcaagcccgagcggccgcccaagcccggcccgcccgugcagccccgggccaccgagcgccccgaccaguacgggcccaacaucugcgacggcgacuucgacaccguggcgaugcugcgcggggagauguucgucuucaagggccggugguucuggcgggugcgccacaaccgggugcucgacaacuaccccaugcccaucgggcacuucuggcgcggccugcccggcgacaucagcgccgccuacgagcggcaggacgggcgcuucgucuucuucaagggcgaccgguacuggcuguuccgcgaggccaaccucgagcccggguacccccagccccugaccuccuacggccugggcauccccuacgaccggaucgacaccgccaucuggugggagcccaccgggcacaccuucuucuuccaggaggaccgcuacuggcgcuucaacgaggagacgcagcggggcgacccgggguaccccaagcccaucagcguguggcagggcauccccgcguccccgaagggggccuuccucagcaacgacgccgccuacaccuacuucuacaagggcaccaaguacuggaaguucgacaacgagcgccugcggauggagcccggcuaccccaagagcauccugcgcgacuucauggggugccaggagcacguggagccgggcccccgguggcccgacgucgcgcgcccgcccuucaacccccacgggggcgccgagcccggggccgacuccgccgagggcgacgugggcgacggggacggcgacuucggggccggcgucaacaaggacgggggcagccggguggugguccagauggaggagguggcgcgcaccgugaacgucgugauggugcucgucccccugcugcuccugcugugcgugcugggccucacguacgcccuggugcagaugcagcggaagggggccccgcgcguccugcucuacugcaagcggucccugcaggaguggguguga

SEQ ID NO: 32988 - RNA, 1824 nt, Artificial Sequence
  derived and/or modified sequence opt1 from MMP16__Homo_sapiens__NP_005932
augauccugcucaccuucagcaccggccgccggcuggacuucgugcaccacuccggggucuucuuccugcagacccuccuguggauccugugcgccaccgugugcggcaccgagcaguacuucaacguggaggucuggcuccagaaguacggguaccugcccccgaccgacccccgcaugagcgugcugcgguccgccgagacgaugcagagcgcgcucgccgccaugcagcaguucuacggcaucaacaugaccgggaagguggaccgcaacaccaucgacuggaugaagaagccccggugcggcguccccgaccagacccgcggcuccagcaaguuccacauccggcgcaagcgguacgcccugacggggcagaaguggcagcacaagcacaucaccuacuccaucaagaacgugaccccgaaggugggcgaccccgagacccgcaaggccauccggcgcgcguucgacgucuggcagaacgugacgccccugaccuucgaggaggugcccuacagcgagcucgagaacgggaagcgggacgucgacaucaccaucaucuucgccuccggcuuccacggggacagcuccccguucgacggcgagggcggguuccuggcccacgccuacuuccccggccccgggaucggcggcgacacccacuucgacagcgacgagcccuggacgcuggggaacccgaaccacgacggcaacgaccucuuccugguggcggugcacgagcuggggcacgcccucggccuggagcacuccaacgaccccaccgccaucauggcccccuucuaccaguacauggagaccgacaacuucaagcugcccaacgacgaccuccaggggauccagaagaucuacggcccgcccgacaagaucccgccgcccacccgcccccugcccacggucccgccccaccggagcaucccgcccgccgacccccgcaagaacgaccggcccaagccgccccggccgcccaccggccgccccuccuaccccggggcgaagcccaacaucugcgacggcaacuucaacacccuggccauccuccgccgggagauguucguguucaaggaccagugguucuggcgcgugcgcaacaaccgggucauggacggguaccccaugcagaucaccuacuucuggcgcggccugccgcccagcaucgacgccguguacgagaacuccgacgggaacuucguguucuucaagggcaacaaguacugggucuucaaggacacgacccugcagcccggcuacccccacgaccucaucacccuggggagcggcaucccgccccacgggaucgacuccgccaucuggugggaggacgugggcaagaccuacuucuucaagggggaccgguacuggcgcuacagcgaggagaugaagacgauggaccccggcuaccccaagcccaucaccguguggaagggcauccccgagagcccccagggggccuucguccacaaggagaacggcuucaccuacuucuacaaggggaaggaguacuggaaguucaacaaccagauccugaagguggagcccggcuacccccgguccauccucaaggacuucaugggcugcgacgggcccaccgaccgcgucaaggagggccacagcccgcccgacgacguggacaucgugaucaagcuggacaacacggcguccaccgucaaggccaucgccaucgugauccccugcauccuggcccucugccugcuggugcucgucuacaccguguuccaguucaagcggaaggggacgccccgccacauccuguacugcaagcggagcaugcaggaguggguguga

SEQ ID NO: 32989 - RNA, 1812 nt, Artificial Sequence
  derived and/or modified sequence opt1 from MMP17__Homo_sapiens__NP_057239
augcgccggcgcgccgcccggggccccgggccgcccccgcccggccccgggcugagccgccucccccugccccugcuccugcugcucgcgcugggcacccgcgggggcugcgccgcccccgccccggcgccccgggccgaggaccugucccucggcguggaguggcugagccgguucggguaccugccgcccgccgaccccaccacgggccagcuccagacccaggaggagcuguccaaggccaucaccgccaugcagcaguucgggggccuggaggcgaccgggauccucgacgaggccacgcuggcccugaugaagacgccccgcugcagccuccccgaccugcccguccugacccaggcccggcgccggcgccaggccccggcgcccaccaaguggaacaagcggaaccucuccuggcgcgugcggaccuucccccgcgacagcccccugggccacgacaccgugcgggcccugauguacuacgcccucaaggucugguccgacaucgccccgcugaacuuccacgagguggccggcagcgcggccgacauccagaucgacuucuccaaggccgaccacaacgacggguaccccuucgacggccccgggggcaccguggcccacgccuucuuccccggccaccaccacaccgcgggggacacgcacuucgacgacgacgaggccuggaccuuccgcagcuccgacgcccacggcauggaccuguucgccgucgccgugcacgaguucgggcacgcgaucggccucagccacguggccgccgcccacuccaucaugcggccguacuaccaggggcccgucggcgacccccugcgcuacggccugcccuacgaggacaaggugcggguguggcagcucuacgggguccgcgagagcguguccccgaccgcgcagcccgaggagcccccgcugcugcccgagccgcccgacaaccgcagcuccgccccgccccggaaggacgugccccaccgcugcagcacccacuucgacgccgucgcccagauccggggcgaggccuucuucuucaaggggaaguacuucuggcgccucacgcgggaccgccaccuggugucccugcagcccgcgcagaugcaccgguucuggcgcggccucccccugcaccuggacagcguggacgccgucuacgagcggaccagcgaccacaagaucguguucuucaagggggaccgcuacuggguguucaaggacaacaacgucgaggagggcuacccccggcccguguccgacuucagccugcccccgggcgggaucgacgccgccuucuccugggcccacaacgaccgcaccuacuucuucaaggaccagcucuacuggcgguacgacgaccacacccgccacauggaccccggcuaccccgcgcagagcccccuguggcgcggggugccguccacgcucgacgacgccaugcgguggagcgacggcgccuccuacuucuuccgggggcaggaguacuggaagguccuggacggcgagcuggagguggcccccggcuacccccagagcaccgcccgcgacuggcucgucugcggggacucccaggcggacggcagcguggccgccgggguggacgccgcggagggcccccgggccccgcccggccagcacgaccagucccgcagcgaggacggguacgaggucugcuccugcaccagcggcgccuccagcccgcccggggcccccggcccccugguggccgcgaccaugcugcuccugcugcccccgcugucccccggggcccucuggacggccgcccaggcccugacccuguga

SEQ ID NO: 32990 - RNA, 918 nt, Artificial Sequence
  derived and/or modified sequence opt1 from MMP19__Homo_sapiens__NP_001259030
augaacugccagcagcuguggcucggcuuccugcugcccaugaccgugagcgggcgcguccucggccuggccgagguggccccgguggacuaccugucccaguacggguaccuccagaagccccuggagggcagcaacaacuucaagcccgaggacaucaccgaggcgcugcgggccuuccaggaggccuccgagcuccccgucagcgggcagcuggacgacgccacgcgcgcccggaugcgccagccgcggugcggccuggaggaccccuucaaccagaagacccucaaguaccugcugcucggccgcuggcggaagaagcaccugaccuuccgcauccugaaccuccccuccacccugcccccgcacacggcgcgggccgcccugcgccaggccuuccaggacuggagcaacguggcgccccucaccuuccaggaggugcaggccggggccgccgacauccggcuguccuuccacggccgccagagcuccuacugcagcaacaccuucgacgggcccggcaagaagucccccgucauccgggacgaggaggaggaggagaccgagcugccgacggugccgcccgugcccaccgagcccagccccaugcccgaccccugcuccagcgagcucgacgccaugaugcugggggaggcgccgccccugcaggccgucggccgccgguggggccagcccgccgaccccgaggccuggaccaacggguccgacaugggccuccagcacgagcaguggcgcgccccgugggaggaccugugcuuccagggcgggcugugcguggacugcauccgguuccgcaccggcccccucgugcccagcgucugcccccucgggggcgcgccgcggaagcccgggugcugcugccugcuggccuccaacacgauggacagccugcuguga

SEQ ID NO: 32991 - RNA, 1410 nt, Artificial Sequence
  derived and/or modified sequence opt1 from MMP1__Homo_sapiens__NP_002412
augcacagcuucccgccccugcuccugcuccuguucuggggcguggucucccacagcuuccccgccacccuggagacccaggagcaggacguggaccuggugcagaaguaccucgagaaguacuacaaccugaagaacgacgggcgccaggucgagaagcggcgcaacuccggccccgugguggagaagcugaagcagaugcaggaguucuucgggcucaaggucacgggcaagcccgacgccgagacccugaaggugaugaagcagccgcggugcggggugcccgacgucgcgcaguucgugcugaccgagggcaacccccgcugggagcagacccaccucacguaccggaucgagaacuacacccccgaccugccgcgcgccgacguggaccacgccaucgagaaggccuuccagcuguggagcaacgucacgccccucaccuucaccaagguguccgagggccaggccgacaucaugaucagcuucgugcgcggggaccaccgggacaacucccccuucgacggccccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacuga

SEQ ID NO: 32992 - RNA, 1452 nt, Artificial Sequence
  derived and/or modified sequence opt1 from MMP20__Homo_sapiens__NP_004762
augaaggugcugcccgccagcggccucgccgucuuccugaucauggcgcugaaguucuccaccgccgccccgagccucguggccgccagcccccgcaccuggcggaacaacuaccgccuggcgcaggccuaccuggacaaguacuacacgaacaaggaggggcaccagaucggcgagaugguggcccgggggagcaacuccaugauccgcaagaucaaggagcuccaggccuucuucggccugcaggucaccgggaagcuggaccagaccaccaugaacgugaucaagaagccccggugcggcgugcccgacgucgcgaacuaccgccucuucccgggcgagcccaaguggaagaagaacacgcugaccuaccggaucagcaaguacacccccuccaugagcuccguggagguggacaaggccgucgagauggcccugcaggccuggagcuccgccgugccccucagcuucgugcgcaucaacuccggggaggcggacaucaugaucagcuucgagaacggcgaccacggggacuccuacccguucgacggcccccgggggacccuggcccacgccuucgcccccggcgagggccucgggggcgacacgcacuucgacaacgccgagaaguggaccauggggaccaacggcuucaaccucuucaccgucgcggcccacgaguucggccacgcccuggggcuggcccacagcacggaccccuccgcccucauguacccgaccuacaaguacaagaaccccuacggcuuccaccuccccaaggacgacgugaaggggauccaggcgcuguacggcccccgcaagguguuccuggggaagccgacccugccccacgcgccccaccacaagcccagcaucccggaccugugcgacuccagcagcuccuucgacgccgucaccaugcucggcaaggagcugcugcuguucaaggaccggaucuucuggcgccgccaggugcaccuccggacgggcauccggcccagcaccaucaccuccagcuucccccagcugauguccaacguggacgccgccuacgaggucgccgagcgcgggaccgccuacuucuucaagggcccccacuacuggaucacgcggggguuccagaugcagggcccgccccgcaccaucuacgacuucggguucccccggcacgugcagcagaucgacgccgccguguaccugcgcgagccccagaagacccuguucuucgucggcgacgaguacuacagcuacgacgagcggaagcgcaagauggagaaggacuacccgaagaacaccgaggaggaguucuccggcgugaacgggcagaucgacgcggccguggagcugaacggcuacaucuacuucuucagcgggcccaagacguacaaguacgacaccgagaaggaggacgucguguccgucgugaaguccuccagcuggaucggcugcuga

SEQ ID NO: 32993 - RNA, 1710 nt, Artificial Sequence
  derived and/or modified sequence opt1 from MMP21__Homo_sapiens__XP_011537559
augcuggccgccagcaucuuccgccccacccuccugcugugcuggcucgcggccccguggcccacccagcccgagucccuguuccacagccgggaccgcuccgaccuggagcccagcccgcuccggcaggccaagcccaucgccgaccugcacgccgcgcagcgcuuccugucccgguacggcuggagcggggugugggccgccuggggccccucccccgaggggccgcccgagacgcccaagggcgccgcgcucgccgaggccguccgccgguuccagcgcgccaacgcccugcccgcgagcggggagcuggacgccgccacccucgccgccaugaaccggccgcgcugcggcgugcccgacaugcggcccccgccgcccuccgcgccgcccagcccgcccgggcccccgccccgcgcccggucccgccggagcccccgcgcgccccugucccugagccggcgcggcuggcagccccggggcuaccccgacgggggcgccgcccaggccuucuccaagcgcacccucagcuggcggcugcugggggaggcccucuccagccagcuguccguggccgaccagcgccgcaucgucgcccuggccuuccggauguggagcgaggugacgccccucgacuuccgcgaggaccuggcggcccccggcgccgccguggacaucaagcugggcuucgggcggggccgccaccucgggugcccccgggcguucgacggcagcggccaggaguucgcccacgccuggcgccugggggacauccacuucgacgacgacgagcacuucaccccgcccaccuccgacaccggcaucagccugcucaaggucgccgugcacgagaucgggcacgugcugggccugccccacaccuaccggacgggguccaucaugcagcccaacuacaucccccaggagcccgccuucgagcucgacuggagcgaccgcaaggcgauccagaagcuguacggcuccugcgagggcagcuucgacaccgccuucgacuggauccggaaggagcgcaaccaguacggggaggucauggugcgguucuccaccuacuucuuccgcaacagcugguacuggcuguacgagaaccggaacaaccgcacccgguacggcgaccccauccagauccucacgggguggccgggcauccccacccacaacaucgacgccuucgugcacaucuggaccuggaagcgcgacgagcgguacuucuuccaggggaaccaguacuggcgcuacgacuccgacaaggaccaggcccugaccgaggacgagcagggcaagagcuaccccaagcugaucuccgagggcuuccccgggaucccgagcccccucgacacggccuucuacgaccggcgccagaagcugaucuacuucuucaaggagucccuggucuucgcguucgacgugaaccgcaaccgggugcucaacagcuaccccaagcgcaucaccgaggucuuccccgccgugaucccgcagaaccaccccuuccggaacaucgacuccgccuacuacagcuacgccuacaacuccaucuucuucuucaagggcaacgccuacuggaagguggucaacgacaaggacaagcagcagaacagcuggcugcccgcgaacgggcuguuccccaagaaguucaucuccgagaagugguucgacgugugcgacgugcacaucagcacccucaacauguga

SEQ ID NO: 32994 - RNA, 1938 nt, Artificial Sequence
  derived and/or modified sequence opt1 from MMP24__Homo_sapiens__NP_006681
augccccgcagccggggcgggcgcgccgccccggggcccccgcccccgcccccgccgcccggccaggcgccccgguggucccgcuggcgggugcccggccgccugcuccugcugcuccugcccgcccugugcugccuccccggggccgcccgggccgcggccgccgccgcgggcgccggcaaccgcgccgccgucgccguggcgguggcccgggccgacgaggccgaggcccccuucgcggggcagaacuggcucaagagcuacggcuaccugcugcccuacgacucccgcgccagcgcccugcacuccgccaaggcccugcagagcgcggucuccaccaugcagcaguucuacgggauccccgugaccggcgugcucgaccagacgaccaucgaguggaugaagaagccccggugcgggguccccgaccacccccaccugagccgccggcgccggaacaagcgcuacgcccugaccggccagaaguggcggcagaagcacaucaccuacuccauccacaacuacacgcccaaggugggcgagcucgacacccgcaaggccauccggcaggccuucgacguguggcagaaggucaccccgcugaccuucgaggaggugcccuaccacgagaucaagagcgaccgcaaggaggccgacaucaugaucuucuucgcguccggguuccacggcgacagcucccccuucgacggggagggcggcuuccuggcccacgccuacuuccccgggccgggcaucgggggcgacacgcacuucgacagcgacgagcccuggacccucgggaacgccaaccacgacggcaacgaccuguuccugguggcgguccacgagcucggccacgcccuggggcuggagcacuccagcgaccccuccgccaucauggcccccuucuaccaguacauggagacccacaacuucaagcucccgcaggacgaccugcagggcauccagaagaucuacgggccgcccgccgagccccuggagcccacccggccccuccccacgcugccggugcgccgcauccacagccccuccgagcggaagcacgagcgccagccccggcccccgcgcccgccccugggcgaccggcccagcacccccgggaccaagcccaacaucugcgacggcaacuucaacaccguggcccucuuccgcggcgagauguucgucuucaaggaccggugguucuggcgccugcggaacaaccgcgugcaggagggguaccccaugcagaucgagcaguucuggaagggccugcccgcgcggaucgacgccgccuacgagcgcgccgacgggcgguucguguucuucaagggcgacaaguacugggucuucaaggaggugacgguggagccgggguacccccacagccucggcgagcugggcuccugccugccccgcgaggggaucgacaccgcgcuccggugggagcccgucggcaagaccuacuucuucaagggggagcgcuacuggcgguacagcgaggagcgccgggccaccgacccgggcuaccccaagcccaucacgguguggaagggcaucccccaggccccgcagggggccuucaucuccaaggagggcuacuacaccuacuucuacaaggggcgcgacuacuggaaguucgacaaccagaagcugagcguggagcccggcuacccccgcaacauccugcgggacuggauggggugcaaccagaaggaggucgagcgccggaaggagcgccggcucccgcaggacgacguggacaucauggucaccaucaacgacgugcccggcuccgugaacgccgucgcgguggugauccccugcauccugagccugugcauccucguccugguguacaccaucuuccaguucaagaacaagacgggcccccagccggugaccuacuacaagcgccccguccaggaguggguguga

SEQ ID NO: 32995 - RNA, 1689 nt, Artificial Sequence
  derived and/or modified sequence opt1 from MMP25__Homo_sapiens__NP_071913
augcgccugcggcuccgccugcuggcccuccugcugcuccugcuggcgcccccggcccgggcccccaagcccagcgcccaggacgugucccucggcgucgacuggcugacccgcuacggguaccugcccccgccccaccccgcccaggcccagcuccagagccccgagaagcugcgggacgcgaucaaggugaugcagcgcuucgccggccugccggagaccgggcggauggaccccggcacgguggccaccaugcgcaagccccggugcucccuccccgacguccuggggguggccggccuggugcgccggcgccggcgcuacgcgcucagcggcuccgucuggaagaagcggacccugaccuggcgcgugcggagcuucccgcaguccagccagcugucccaggagacggugcgcguccucaugagcuacgcccugauggccugggggauggaguccggccugaccuuccacgagguggacagcccccaggggcaggagcccgacauccucaucgacuucgcccgggccuuccaccaggacuccuaccccuucgacggccucgggggcacccuggcgcacgccuucuucccgggcgagcaccccaucagcggggacacccacuucgacgacgaggagacguggaccuucggcuccaaggacggggagggcaccgaccuguucgccguggccguccacgaguucggccacgcccuggggcugggccacagcuccgcgcccaacagcaucaugcgccccuucuaccaggggccggugggcgaccccgacaaguaccggcucucccaggacgaccgcgacgggcugcagcagcuguacggcaaggcgccccagacccccuacgacaagccgacgcgcaagccccucgccccgccgccccagccgcccgccagccccacccacagccccuccuuccccauccccgaccggugcgagggcaacuucgacgccaucgccaacauccgcggggagaccuucuucuucaagggccccugguucuggcggcugcagcccagcgggcagcuggugagcccccgccccgcccggcuccaccgcuucugggagggccugccggcccagguccggguggugcaggccgccuacgcgcgccaccgggacgggcgcauccuccuguucuccggcccccaguucugggucuuccaggaccggcagcuggagggcggggcccgcccccugaccgagcucggccugcccccgggggaggagguggacgccguguucuccuggccccagaacggcaagacguaccugguccgggggcgccaguacuggcgguacgacgaggccgcggcccgccccgaccccggcuacccgcgggaccucagccugugggagggcgccccgcccucccccgacgacgugaccgugagcaacgccggggacaccuacuucuucaagggcgcccacuacuggcgcuuccccaagaacuccaucaagaccgagcccgacgcgccccagcccauggggccgaacuggcuggacugccccgcccccagcuccggcccgcgggcgccccggccgcccaaggccacgcccgucagcgagaccugcgacugccagugcgagcucaaccaggccgccggccgcuggcccgcccccaucccccugcugcugcucccgcugcuggucgggggcguggccucccgcuga

SEQ ID NO: 32996 - RNA, 786 nt, Artificial Sequence
  derived and/or modified sequence opt1 from MMP26__Homo_sapiens__NP_068573
augcagcuggugauccuccgcgucaccaucuuccugcccuggugcuucgccgugccggugccgcccgccgcggaccacaagggcugggacuucgucgagggguacuuccaccaguucuuccugaccaagaaggagagcccccuccugacgcaggagacccagacccagcugcuccagcaguuccaccggaacggcaccgaccugcuggacaugcagaugcacgcccuccugcaccagccccacugcggggugcccgacggcuccgacacgagcaucucccccgggcgcugcaaguggaacaagcacacccugaccuaccggaucaucaacuacccccacgacaugaagccgagcgccgugaaggacuccaucuacaacgccgucagcaucugguccaacgugacgccccucaucuuccagcagguccagaacggcgacgccgacaucaaggugagcuucuggcagugggcgcacgaggacggcuggcccuucgacgggcccggcgggauccugggccacgccuuccugccgaacuccgggaaccccggcguggugcacuucgacaagaacgagcacuggagcgccuccgacaccggcuacaaccucuuccuggucgccacccacgagaucgggcacagccugggccuccagcacuccgggaaccagagcuccaucauguaccccaccuacugguaccacgacccccgcaccuuccagcugagcgcggacgacauccagcggauccagcaccuguacggcgagaagugcuccagcgacaucccguga

SEQ ID NO: 32997 - RNA, 393 nt, Artificial Sequence
  derived and/or modified sequence opt1 from MMP28__Homo_sapiens__NP_001027449
augguggcccgcgucggccugcuccugcgggcccugcagcuccugcugugggggcaccucgacgcgcagcccgccgagcgcggcgggcaggagcugcggaaggaggccgaggccuuccuggagaaguacggcuaccucaacgagcaggucccgaaggcccccaccagcacccgcuucuccgacgcgauccgggccuuccagugggugagccagcugcccguguccggggugcuggaccgcgccacgcuccggcagaugacccgcccccggugcggcgugaccgacaccaacagcuacgccgcgugggccgagcgcaucuccgaccuguucgcccggcaccgcacgaagaugcggcgcaagaagcgguucgccaagcagggcgagcacugcuga

SEQ ID NO: 32998 - RNA, 1833 nt, Artificial Sequence
  derived and/or modified sequence opt1 from MMP2__Homo_sapiens__NP_001121363
augcaguaccugaacaccuucuacggcugccccaaggagagcugcaaccucuucgugcugaaggacacccugaagaagaugcagaaguucuucgggcucccgcagacgggcgaccuggaccagaacaccaucgagaccaugcgcaagccccggugcgggaaccccgacgucgccaacuacaacuucuucccccgcaagccgaagugggacaagaaccagaucaccuaccggaucaucggcuacacgcccgaccuggaccccgagaccguggacgacgccuucgcgcgcgccuuccaggugugguccgacgucacgccccuccgguucagccgcauccacgacggggaggccgacaucaugaucaacuucggccggugggagcacggcgacggguacccguucgacggcaaggacgggcugcuggcccacgccuucgcgcccggcaccggggugggcggcgacucccacuucgacgacgacgagcucuggacccugggggagggccaggugguccgcgugaaguacgggaacgccgacggcgaguacugcaaguuccccuuccuguucaacggcaaggaguacaacagcugcaccgacaccgggcgguccgacggcuuccucuggugcagcaccacguacaacuucgagaaggacgggaaguacggcuucugcccccacgaggcccuguucaccaugggcgggaacgccgagggccagccgugcaaguuccccuuccgcuuccaggggaccuccuacgacagcugcaccacggagggccggaccgacggguaccgcuggugcggcaccaccgaggacuacgaccgggacaagaaguacggguucugccccgagacggcgauguccaccgugggcggcaacagcgagggggcccccugcgucuucccguucaccuuccugggcaacaaguacgaguccugcaccagcgccgggcgcuccgacggcaagauguggugcgccacgaccgccaacuacgacgacgaccggaaguggggguucugccccgaccagggcuacagccucuuccugguggcggcccacgaguucggccacgccauggggcuggagcacucccaggaccccggcgcccucauggcccccaucuacaccuacaccaagaacuuccgccugagccaggacgacaucaaggggauccaggagcuguacggcgcguccccggacaucgaccucggcacggggcccacccccacccugggccccgugaccccggagaucugcaagcaggacaucgucuucgacgggaucgcccagauccggggcgagaucuucuucuucaaggaccgcuucaucuggcggacggugacgccccgcgacaagcccauggggccccugcucguggccaccuucuggccggagcugcccgagaagaucgacgccgucuacgaggcgccccaggaggagaaggccguguucuucgccggcaacgaguacuggaucuacagcgccuccacccuggagcggggcuacccgaagccccucaccagccuggggcugccgcccgacgugcagcgcgucgacgccgccuucaacuggagcaagaacaagaagaccuacaucuucgcgggcgacaaguucuggcgcuacaacgaggugaagaagaagauggaccccggguuccccaagcucaucgccgacgccuggaacgccauccccgacaaccuggacgcgguggucgaccugcagggcgggggccacuccuacuucuucaagggcgccuacuaccucaagcuggagaaccagagccugaaguccgugaaguucgggagcaucaaguccgacuggcucggcugcuga

SEQ ID NO: 32999 - RNA, 1434 nt, Artificial Sequence
  derived and/or modified sequence opt1 from MMP3__Homo_sapiens__NP_002413
augaagucccugcccauccugcugcugcucugcguggccgucugcagcgccuacccgcuggacggcgcggcccgcggggaggacaccagcaugaaccuggugcagaaguaccucgagaacuacuacgaccugaagaaggacgugaagcaguucguccggcgcaaggacuccggccccguggugaagaagauccgggagaugcagaaguuccuggggcucgaggucaccggcaagcuggacagcgacacgcuggaggugaugcgcaagccccggugcggggugcccgacgucggccacuuccgcaccuucccgggcauccccaaguggcggaagacccaccucaccuaccgcaucgugaacuacacgcccgaccugcccaaggacgccguggacuccgccgucgagaaggcccugaaggugugggaggaggugaccccgcucaccuucagccggcuguacgagggggaggcggacaucaugaucuccuucgccguccgcgagcacggcgacuucuaccccuucgacgggcccggcaacgugcuggcccacgccuacgcgcccgggccgggcaucaacggcgacgcccacuucgacgacgacgagcaguggaccaaggacacgaccgggaccaaccucuuccugguggccgcccacgagaucggccacagccugggccucuuccacuccgccaacaccgaggcgcugauguacccccuguaccacagccucacggaccugacccgguuccgccugucccaggacgacaucaacggcauccagagccucuacgggcccccgcccgacucccccgagacgccccugguccccaccgagccggugccgcccgagcccgggacccccgccaacugcgaccccgcccugagcuucgacgccguguccacccuccggggcgagauccugaucuucaaggaccgccacuucuggcgcaagagccugcggaagcucgagcccgagcugcaccugaucuccagcuucuggcccucccucccgagcggggucgacgccgcguacgaggugaccagcaaggaccugguguucaucuucaagggcaaccaguucugggccauccgggggaacgagguccgcgccggcuacccccggggcauccacacccugggguucccgcccacggugcgcaagaucgacgccgccaucuccgacaaggagaagaacaagaccuacuucuucgucgaggacaaguacuggcgguucgacgagaagcgcaacagcauggagcccggcuuccccaagcagaucgcggaggacuuccccgggaucgacuccaagaucgacgccguguucgaggaguucggcuucuucuacuucuucaccgggagcucccagcucgaguucgacccgaacgccaagaaggugacccacacgcucaagagcaacuccuggcugaacugcuga

SEQ ID NO: 33000 - RNA, 804 nt, Artificial Sequence
  derived and/or modified sequence opt1 from MMP7__Homo_sapiens__NP_002414
augcgccugaccgugcucugcgccgucugccugcugcccggcagccucgcccugccgcugccccaggaggccgggggcauguccgagcuccagugggagcaggcgcaggacuaccugaagcgguucuaccuguacgacagcgagaccaagaacgccaacucccucgaggccaagcugaaggagaugcagaaguucuucgggcugcccaucacgggcaugcucaacagccgcgugaucgagaucaugcagaagccccggugcggggugccggacgucgccgaguacucccuguuccccaacagccccaaguggaccuccaagguggugaccuaccgcaucgucagcuacacccgggaccugccccacaucacgguggaccgccucguguccaaggcgcugaacauguggggcaaggagaucccgcugcacuuccggaaggucguguggggcaccgccgacaucaugaucggguucgcccgcggcgcccacggggacagcuaccccuucgacggccccgggaacacccucgcgcacgccuucgcccccggcaccggccucgggggcgacgcccacuucgacgaggacgagcgguggacggacggguccagccugggcaucaacuuccuguacgccgcgacccacgagcugggccacucccuggggaugggccacagcuccgacccgaacgccgugauguaccccaccuacgggaacggcgacccccagaacuucaagcucagccaggacgacaucaaggggauccagaagcuguacggcaagcgcuccaacagccggaagaaguga

SEQ ID NO: 33001 - RNA, 1404 nt, Artificial Sequence
  derived and/or modified sequence opt1 from MMP8__Homo_sapiens__NP_002415
auguucagccugaagacccuccccuuccugcugcuccugcacgugcagaucuccaaggccuucccggucagcuccaaggagaagaacaccaagacggugcaggacuaccuggagaaguucuaccagcuccccagcaaccaguaccaguccacccgcaagaacggcaccaacgugaucgucgagaagcugaaggagaugcagcgguucuucgggcugaacgugaccggcaagcccaacgaggagacgcucgacaugaugaagaagccccgcugcggggugccggacagcggcggguucaugcugacccccggcaaccccaagugggagcggaccaaccugaccuaccgcauccggaacuacacgccccagcucuccgaggccgaggucgagcgcgcgaucaaggacgccuucgagcuguggagcguggccuccccgcugaucuucacccggaucagccagggcgaggccgacaucaacaucgccuucuaccagcgcgaccacggggacaacucccccuucgacggccccaacgggauccucgcgcacgccuuccagcccggccaggggaucggcggcgacgcccacuucgacgccgaggagaccuggaccaacacgagcgcgaacuacaaccuguuccugguggccgcccacgaguucgggcacucccucggccuggcccacagcuccgacccgggggcccugauguaccccaacuacgcguuccgggagaccagcaacuacucccucccccaggacgacaucgacggcauccaggccaucuacggccugagcuccaaccccauccagccgaccgggcccagcacccccaagcccugcgacccgagccugacguucgacgccaucaccacccuccgcggcgagauccuguucuucaaggaccgguacuucuggcgccggcacccccagcugcagcgcgucgagaugaacuucaucucccucuucuggcccagccugcccaccgggauccaggccgccuacgaggacuucgaccgggaccugaucuuccucuucaagggcaaccaguacugggcgcuguccggguacgacauccugcagggcuacccgaaggacaucagcaacuacggcuuccccuccagcgugcaggccaucgacgccgccguguucuaccgcuccaagacguacuucuucgucaacgaccaguucuggcgguacgacaaccagcgccaguucauggagcccggguaccccaagagcaucuccggcgccuucccggggaucgagagcaagguggacgcgguguuccagcaggagcacuucuuccacgucuucuccggcccccgguacuacgccuucgaccucaucgcccagcgcgugacccggguggcccgcgggaacaaguggcugaacugccgcuacggcuga

SEQ ID NO: 33002 - RNA, 2124 nt, Artificial Sequence
  derived and/or modified sequence opt1 from MMP9__Homo_sapiens__NP_004985
augagccuguggcagccccucgugcugguccugcucgugcugggcugcugcuucgccgccccgcgccagcggcaguccacccugguccucuuccccggggaccugcgcaccaaccugacggaccggcagcucgcggaggaguaccuguaccgcuacggcuacacccggguggccgagaugcgcggggagagcaagucccugggccccgcccuccugcugcuccagaagcagcugagccugcccgagaccggggagcucgacuccgccacccugaaggccaugcggacgccgcgcugcggcgugcccgaccugggccgguuccagaccuucgagggggaccucaaguggcaccaccacaacaucaccuacuggauccagaacuacagcgaggaccugccccgcgcggugaucgacgacgccuucgcccgggccuucgcgcugugguccgccgucacgccccucaccuucacccgcguguacagccgggacgccgacaucgugauccaguucggcgucgccgagcacggggacggcuacccguucgacgggaaggacggccugcuggcccacgcguucccgcccggccccgggauccagggcgacgcccacuucgacgacgacgagcucuggucccuggggaagggcguggugguccccacccgcuucggcaacgccgacggggccgccugccacuuccccuucaucuucgagggccggagcuacuccgcgugcaccacggacgggcgcagcgacggccugcccuggugcuccaccaccgccaacuacgacaccgacgaccgguucggguucugccccagcgagcgccucuacacgcaggacggcaacgccgacggcaagccgugccaguuccccuucaucuuccaggggcaguccuacagcgccugcaccaccgacggccgguccgacggguaccgcuggugcgccaccacggcgaacuacgaccgggacaagcuguucggcuucugccccacccgcgccgacagcaccgugaugggcggcaacuccgccggcgagcugugcguguuccccuucaccuuccucgggaaggaguacagcacgugcaccagcgagggccgcggggacggccggcuguggugcgccaccaccuccaacuucgacagcgacaagaaguggggguucugcccggaccagggcuacucccuguuccucgucgccgcgcacgaguucggccacgcccuggggcuggaccacagcuccgugcccgaggcccucauguaccccauguaccgcuucacggaggggcccccgcugcacaaggacgacgugaacgggauccggcaccuguacggcccccgccccgagcccgagccgcggccgcccaccaccaccacgccccagcccaccgccccgcccaccgucugccccaccggcccgcccacggugcaccccagcgagcgccccaccgcggggcccaccggcccgcccuccgccgggcccaccggcccgcccaccgccgggcccagcacggccaccaccgugccccucucccccgucgacgacgccugcaacgugaacaucuucgacgcgaucgccgagaucggcaaccagcuguaccuguucaaggacggcaaguacuggcgguucagcgaggggcgcggcucccggccccaggggcccuuccucaucgccgacaaguggccggcccugccccgcaagcuggacagcguguucgaggagcggcucuccaagaagcuguucuucuucagcggccgccaggucuggguguacaccggggccuccguccugggcccccggcgccuggacaagcucggccugggggcggacguggcccaggugacgggcgcccugcggagcgggcgcggcaagaugcuccuguucuccgggcggcgccuguggcgguucgacgucaaggcccagaugguggacccccgcagcgccuccgagguggaccgcauguucccgggcgucccccucgacacccacgacguguuccaguaccgggagaaggcguacuucugccaggaccgcuucuacuggcgggugagcagccgcuccgagcugaaccaggucgaccaggugggcuacgugaccuacgacauccugcagugccccgaggacuga

SEQ ID NO: 33003 - RNA, 3687 nt, Artificial Sequence
  derived and/or modified sequence opt1 from MMRN1__Homo_sapiens__NP_031377
augaagggcgcccgccuguucgugcuccugagcucccuguggagcgggggcaucgggcucaacaacuccaagcacagcuggaccauccccgaggacggcaacucccagaagaccaugcccagcgccuccgucccgcccaacaagauccagagccugcagauccugcccacgacccgggugauguccgcggagaucgccaccacccccgaggcccgcacgagcgaggacucccuccucaagagcacccugccgcccuccgagaccagcgcccccgccgagggggugcggaaccagacccucacguccaccgagaaggcggagggcgucgugaagcugcagaaccugacccuccccaccaacgccagcaucaaguucaaccccggcgccgaguccgugguccugagcaacuccacgcugaaguuccuccagagcuucgcccgcaagagcaacgagcaggcgaccucccugaacaccgucgggggcaccgggggcaucgggggcgugggcgggacgggcggggugggcaaccgggcgccccgcgagaccuaccugagccggggcgacuccagcuccagccagcgcaccgacuaccagaaguccaacuucgagaccacgcgggggaagaacuggugcgccuacgugcacacccgccucagccccaccgugauccuggacaaccaggucaccuacgugccgggcgggaagggccccugcggguggacgggcggcuccugcccccagcggagccagaagaucuccaaccccguguaccgcaugcagcacaagaucgucaccagccuggacuggcggugcugcccgggguacuccggccccaagugccagcuccgcgcccaggagcagcagagccugauccacaccaaccaggccgagucccacaccgccguggggcggggcguggccgagcagcagcagcagcaggggugcggcgaccccgaggucaugcagaagaugacggaccaggugaacuaccaggccaugaagcugacccuccugcagaagaagaucgacaacaucagccugaccgugaacgacguccgcaacaccuacuccagccucgagggcaagguguccgaggacaagagccgggaguuccagagccugcugaaggggcucaaguccaagagcaucaacgugcugauccgcgacaucguccgggagcaguucaagaucuuccagaacgacaugcaggagacgguggcccagcuguucaagaccgucuccagccucuccgaggaccuggagagcacccgccagaucauccagaaggugaacgaguccguggucagcaucgccgcgcagcagaaguucgugcuggugcaggagaaccggcccacccucacggacaucgucgagcugcgcaaccacaucgugaacgugcgccaggagaugacccugaccugcgagaagccgaucaaggagcucgaggucaagcagacccaccuggagggcgcccuggagcaggagcacucccggagcauccucuacuacgagucccugaacaagacccugagcaagcucaaggaggugcacgagcagcugcuguccacggagcaggucagcgaccagaagaacgcccccgccgccgaguccgugagcaacaacgugaccgaguacauguccacccuccacgagaacaucaagaagcagagccugaugaugcugcagauguucgaggaccugcacauccaggagagcaagaucaacaaccucaccgugucccuggagauggagaaggagagccugcgcggggagugcgaggacaugcucuccaagugccggaacgacuucaaguuccagcugaaggacacggaggagaaccugcacguccucaaccagacccuggcggaggugcuguuccccauggacaacaagauggacaagaugagcgagcagcucaacgaccugaccuacgacauggagauccugcagccccuccuggagcagggcgccucccugcgccagaccaugacguacgagcagccgaaggaggccaucgugauccggaagaagaucgagaaccucaccagcgccgucaacucccugaacuucaucaucaaggagcugaccaagcgccacaaccuccugcggaacgaggugcaggggcgcgacgacgcccuggagcggcgcaucaacgaguacgcgcucgagauggaggacggccugaacaagaccaugacgaucaucaacaacgccaucgacuucauccaggacaacuacgcccugaaggagacccucagcaccaucaaggacaacuccgagauccaccacaagugcaccagcgacauggagacgauccugaccuucaucccccaguuccaccggcugaacgacuccauccagacccucgugaacgacaaccagcgcuacaacuucguccuccagguggccaagacccuggcgggcaucccccgggacgagaagcugaaccagagcaacuuccagaagauguaccagauguucaacgagacgaccucccaggugcgcaaguaccagcagaacaugagccaccuggaggagaagcugcuccugaccaccaagaucuccaagaacuucgagacgcggcugcaggacaucgagagcaaggucacccagacccucauccccuacuacaucuccgugaagaaggggagcguggucaccaacgagcgcgaccaggcccugcagcuccaggugcugaacucccgguucaaggcccuggaggccaagagcauccaccugagcaucaacuucuucucccucaacaagacgcugcacgaggugcugaccaugugccacaacgccagcaccuccgucagcgagcucaacgcgaccaucccgaaguggaucaagcacucccugcccgacauccagcugcuccagaagggccugacggaguucguggagcccaucauccagaucaagacccaggccgcccugagcaaccugaccugcugcaucgaccgcucccugccggggagccuggccaacguggucaagucccagaagcaggucaagagccuccccaagaagaucaacgcccugaagaagcccaccgugaaccugacgaccgugcucaucggccggacccagcgcaacaccgacaacaucaucuaccccgaggaguacuccagcugcucccgccacccgugccagaacggcgggaccugcaucaacggccggacgagcuucacgugcgcgugccgccaccccuucaccggggacaacugcaccaucaagcugguggaggagaacgcccuggcccccgacuucuccaagggcagcuaccgguacgcccccaugguggccuucuucgcgucccacaccuacgggaugaccaucccgggccccauccucuucaacaaccuggacgucaacuacggcgccagcuacacgccccgcaccgggaaguuccggauccccuaccugggcguguacguguucaaguacaccaucgaguccuucagcgcccacaucagcggguuccucgucguggacggcaucgacaagcuggccuucgaguccgagaacaucaacagcgagauccacugcgaccgcgugcugaccggggacgcgcuccuggagcugaacuacggccaggaggucuggcuccggcuggccaagggcaccaucccggccaaguucccgcccgugaccacguucuccggguaccugcucuaccgcaccuga

SEQ ID NO: 33004 - RNA, 2850 nt, Artificial Sequence
  derived and/or modified sequence opt1 from MMRN2__Homo_sapiens__NP_079032
augauccugagccuccuguucucccugggcgggccccucggcugggggcugcugggcgccugggcccaggcgagcuccaccagccucuccgaccugcagagcucccgcaccccggggguguggaaggccgaggccgaggacacgggcaaggaccccgucggccggaacuggugccccuaccccaugagcaagcuggugacccuccuggcccugugcaagaccgagaaguuccucauccacucccagcagccgugcccccagggggcccccgacugccagaaggugaaggucauguaccgcauggcgcacaagcccguguaccaggugaagcagaagguccugaccagccuggccuggcggugcugcccgggcuacacggggcccaacugcgagcaccacgacuccauggccauccccgagcccgccgacccgggcgacagccaccaggagccccaggacgggcccguguccuucaagcccggccaccucgcggccgugaucaacgaggucgaggugcagcaggagcagcaggagcaccuccugggcgaccugcagaacgacgugcaccgcgucgccgacagccugccggggcuguggaaggcccuccccggcaaccugaccgccgcggugauggaggccaaccagaccgggcacgaguuccccgaccggucccuggagcagguccuccugccccacguggacaccuuccuccaggugcacuucagcccgaucuggcgcuccuucaaccagagccugcacucccugacgcaggccauccggaaccugagccucgacguggaggccaaccgccaggccaucagccggguccaggacuccgcgguggcccgcgccgacuuccaggagcugggcgccaaguucgaggccaaggugcaggagaacacccagcgggucggccagcugcgccaggacguggaggaccggcuccacgcgcagcacuucacccugcaccgcagcaucuccgagcugcaggccgacguggacaccaagcucaagcggcugcacaaggcccaggaggcccccgggacgaacggcagccugguccucgccacccccggggcgggcgcccgccccgagccggacucccugcaggcccggcuggggcagcuccagcgcaaccugagcgagcugcacaugaccaccgcccggcgcgaggaggagcuccaguacacgcuggaggacaugcgggcgacccugacccgccacguggacgagaucaaggagcucuacuccgagagcgacgagaccuucgaccagaucuccaaggucgagcgccagguggaggagcuccaggugaaccacacggcccugcgggagcugcgcgucauccugauggagaagucccugaucauggaggagaacaaggaggagguggagcggcagcugcucgagcugaaccugacccuccagcaccuccagggcggccacgccgaccugaucaaguacgugaaggacugcaacugccagaagcuguaccuggaccuggacgucauccgcgaggggcagcgggacgccacccgcgcccucgaggagacccaggugagccuggacgagcggcgccagcuggacggcagcucccuccaggcgcugcagaacgccguggacgccgucagccuggccguggacgcccacaaggcggagggggagcgggcccgcgccgccacgucccggcuccgcagccaggugcaggcccuggacgacgaggucggcgcgcugaaggccgccgccgcggaggcccggcacgaggugcgccagcuccacuccgccuucgccgcccugcuggaggacgcgcuccggcacgaggccgugcuggccgcccuguucggggaggagguccucgaggagaugagcgagcagacccccggcccccugccccuguccuacgagcagauccgcguggcccuccaggacgcggccagcggccugcaggagcaggcccuggggugggacgagcucgccgcccgggugaccgcgcuggagcaggccagcgagccgccccgccccgccgagcaccuggagccgucccacgacgccggccgggaggaggcggccaccacggcccucgccgggcuggcccgcgagcugcagagccucuccaacgacgucaagaacgugggccgcugcugcgaggcggaggccggggccggcgccgccagccugaacgcgucccugcacggccuccacaacgcccuguucgccacccagcggagccuggagcagcaccagcgccucuuccacucccuguucgggaacuuccagggccugauggaggccaacgugagccucgaccuggggaagcugcagaccaugcucucccggaagggcaagaagcagcagaaggaccuggaggcgccccgcaagcgggacaagaaggaggccgagccccuggucgacauccgcgugaccggccccgugccgggggcccucggcgccgcccugugggaggccgggagccccgucgcguucuacgccuccuucagcgagggcacggccgcccugcagaccgugaaguucaacaccaccuacaucaacaucggguccagcuacuuccccgagcacggcuacuuccgggcgcccgagcgcggcguguaccucuucgccgucuccguggaguucgggccgggccccgggacgggccagcugguguucgggggccaccaccggacccccgucugcaccaccggccaggggagcggcuccaccgccacgguguucgccauggccgagcugcagaagggggagcgcgugugguucgagcucacccagggcagcaucaccaagcggagccuguccgggaccgcguucggcggcuuccugauguucaagacguga

SEQ ID NO: 33005 - RNA, 2964 nt, Artificial Sequence
  derived and/or modified sequence opt1 from MMS19__Homo_sapiens__NP_001276332
auggccgccgcggccgccguggaggccgccgcgcccaugggcgcccugugggggcucguccacgacuucguggugggccagcaggaggggccggccgaccaggucgccgcggacgugaaguccggcaacuacaccgugcugcaggucguggaggcccuggggagcagccucgagaaccccgagccccgcacccgggcccgcgccauccagcugcugucccaggugcuccugcacugccacacgcugcuccuggagaaggaggucgugcaccugauccucuucuacgagaaccggcugaaggaccaccaccuggugauccccagcguccuccagggccugaaggcccugucccucugcguggcgcugccgcccggccuggccgugagcguccucaaggccaucuuccaggaggugcacgugcagucccugccccaggucgaccgccacaccguguacaacaucaucaccaacuucaugcggacccgcgaggaggggcccuucguggaggagcuguucgaggucacgagcugcuacuucccgaucgacuucaccccgccgcccaacgacccccacggcauccagcgggaggaccucauccugucccugcgcgccgugcucgccagcacgccccgguucgcggaguuccugcugccccuccugaucgagaagguggacuccgagguccugagcgccaagcucgacucccugcagacccugaacgccugcugcgccguguacgggcagaaggagcucaaggacuuccugcccagccugugggccuccauccgccgggaggucuuccagaccgcgagcgagcgcguggaggccgagggccucgccgcccugcacucccugaccgccugccucagccgguccgugcugcgcgcggacgccgaggaccugcucgacagcuuccugagcaacauccugcaggacugccggcaccaccucugcgagccggacaugaagcuggucuggcccuccgccaagcugcugcaggccgcggccggggccagcgcccgcgccugcgacuccgugaccagcaacgugcucccccugcugcucgagcaguuccacaagcacucccagagcucccagcggcgcaccauccuggagaugcugcucggcuuccugaagcugcagcagaaguggagcuacgaggacaaggaccagcggccccucaacggcuucaaggaccagcugugcucccuggucuucauggcgcucacggacccgagcacccagcugcagcugguggggauccgcacccucaccgugcugggcgcccagcccgaccugcucuccuacgaggaccuggagcuggccgucgggcaccucuaccggcugagcuuccugaaggaggacucccagagcugccgcguggccgcccucgaggcguccggcacgcuggccgcccuguaccccguggccuucagcucccaccucguccccaagcuggccgaggagcugcgcgugggcgagagcaaccucaccaacggggacgagccgacccagugcucccggcaccugugcugccugcaggcgcucagcgccgugagcacccaccccuccaucgucaaggagacgcugccccugcuccugcagcaccuguggcaggucaaccgcggcaacaugguggcccagagcuccgacgugaucgccgugugccagagccuccggcagauggcggagaagugccagcaggaccccgaguccugcugguacuuccaccagaccgccaucccgugccugcuggcccucgccgugcaggccagcaugcccgagaaggagcccuccguccugcgcaaggugcugcucgaggacgaggugcuggcggccauggucagcgugaucgggaccgccaccacgcaccuguccccggagcucgccgcccagagcgugacccacaucgucccccuguuccuggacggcaacguguccuuccuccccgagaacagcuuccccucccgguuccagccguuccaggacgggagcuccggccagcgccggcugaucgcgcugcucauggccuucgugugcagccugccccgcaacgucgagaucccccagcugaaccagcucaugcgggagcugcuggagcucuccugcugccacagcugccccuucagcuccaccgccgccgccaagugcuucgcgggccugcugaacaagcacccggccgggcagcagcucgacgaguuccugcagcuggccguggacaagguggaggccggccucgggagcggccccugccgcucccaggcguucacccugcugcucugggucacgaaggcccuggugcugcgguaccacccccucagcuccugccugaccgcccgccugauggggcuccugagcgaccccgagcugggcccggccgccgcggacggcuucucccuccugaugagcgacugcaccgacgugcugacccgggccgggcacgccgagguccgcaucauguuccggcagcgcuucuucacggacaacgugcccgcccucgugcagggcuuccacgccgcgccccaggacgucaagcccaacuaccugaaggggcugucccacgugcucaaccggcugccgaagcccgugcugcuccccgagcugcccacccugcucagccugcugcucgaggcccuguccugcccggacugcgucgugcagcugagcacccuguccugccuccagccccugcugcucgaggcgccccaggugaugagccugcacgucgacacccuggugacgaaguuccucaaccuguccagcucccccagcauggccgugcgcaucgccgcccugcagugcaugcacgcccucacccggcugccgacccccguccugcuccccuacaagccccaggugauccgcgcccuggccaagccccuggacgacaagaagcgccucgugcggaaggaggccgucuccgcgcgcggcgagugguuccugcuggggagccccggcagcuga

SEQ ID NO: 33006 - RNA, 3732 nt, Artificial Sequence
  derived and/or modified sequence opt1 from MMS22L__Homo_sapiens__NP_940870
auggagaacugcagcgccgccuccaccuuccugaccgacagccucgagcuggagcugggcacggaguggugcaagcccccguacuucuccugcgcgguggacaaccgcgggggcgggaagcacuucagcggcgaguccuaccucugcagcggggcccugaagcggcugauccucaaccuggacccccugcccaccaacuucgaggaggacacccucgagaucuucggcauccagugggucaccgagacggcccuggugaacuccagccgcgagcuguuccaccucuuccggcagcagcuguacaaccuggagacccuccugcaguccagcugcgacuucggcaagguguccacccugcacugcaaggccgacaacauccgccagcagugcguccucuuccugcacuacgugaagguguucaucuuccgguaccugaagguccagaacgccgagagccacgugcccgugcacccguacgaggcgcucgaggcccagcugcccuccguccugaucgacgagcuccacgggcugcugcucuacaucggccaccugagcgagcugcccuccgugaacaucggggccuucgugaaccagaaccagaucaagcucuuccccccgagcuggcaccugcugcaccuccaccuggacauccacuggcugguccucgagauccuguacaugcugggcgagaagcucaagcaggugguguacgggcaccaguucaugaaccuggccuccgacaaccugaccaacaucagccucuucgaggagcacugcgagacgcugcugugcgaccucaucucccugagccugaaccgcuacgacaagguccggagcuccgagagccucauguccgaccagugccccugccugugcaucaaggagcugugggugcugcucauccaccugcuggaccaccgcagcaagugguucguguccgagagcuucuggaacuggcucaacaagcugcugaagacccuccuggagaaguccagcgaccggcgccgguccagcaugcccgucauccagucccgcgacccccugggcuucagcugguggaucaucacccacguggcguccuucuacaaguucgaccggcacggcgugccggacgagaugcgcaaggucgagagcaacuggaacuucguggaggagcuccugaagaaguccaucagcgugcagggggucauccuggaggagcagcuccggauguaccugcacugcugccugacccucugcgacuucugggagcccaacaucgccaucgugacgauccugugggaguacuacuccaagaaccugaacagcuccuucagcaucagcuggcuccccuucaagggccuggccaacaccaugaaguccccccugagcaugcucgagauggucaagaccugcugcugcgacaagcaggaccaggagcuguacaaguccagcuccagcuacaccaucuuccugugcauccucgccaagguggugaagaaggccaugaaguccaacgggccgcaccccuggaagcaggucaagggccgcaucuacagcaaguuccaccagaagcggauggaggagcugacggaggugggccugcagaacuucuucucccucuuccugcugcucgcggccguggccgaggucgaggacguggccagccacgugcuggaccugcucaacuuccugaagcccgccuucgucaccucccagcgcgcgcugaucuggaaggggcacauggccuuccuccugauguacgcccagaagaaccuggacaucggcgugcucgccgagaaguucagcugcgccuuccgggagaaggcgaaggaguuccugguguccaagaacgaggagaugguccagcgccagaccaucuggacccugcucagcaucuacaucgacggggugcaggagguguucgagacguccuacugccuguaccccagccacgagaagcugcucaacgacggcuucuccaugcugcugcgggccugccgcgagagcgagcuccgcaccguccugagcuuccugcaggccgugcucgcccggauccgcuccaugcaccagcagcugugccaggagcugcagcgggacaacguggaccucuucguccagagcucccugagcgccaaggagcgccaccuggcggccguggccuccgcccucuggcggcacuucuucagcuuccugaagucccagcgcaugagccagguggucccguucucccagcuggcggacgccgccgccgacuucacccuccuggccauggacaugcccagcaccgcgcccuccgacuuccagccccagccggugaucagcaucauccagcuguucgggugggacgacaucaucugcccccagguggucgcccgguaccucucccacgugcugcagaacagcacgcugugcgaggcccucucccacagcggcuacguguccuuccaggcccugaccguccgcagcuggauccggugcgugcugcagauguacaucaagaaccucuccggccccgacgaccugcugaucgacaagaaccucgaggaggccguggagaaggaguacaugaagcagcuggucaagcugacccgccuccuguucaaccugagcgaggugaagagcaucuucuccaaggcgcagguggaguaccucagcaucuccgaggaccccaagaaggcccugguccgguucuucgaggccgugggggugaccuacggcaacguccagacgcugagcgacaaguccgccauggugaccaagagccucgaguaccugggggaggugcugaaguacaucaagccguaccucggcaagaaggucuucuccgccgggcugcagcugaccuacggcaugaugggcauccucgugaagagcugggcgcagaucuucgccaccuccaaggcccagaagcugcuguuccgcaucaucgacugccuccugcugccccacgccgugcuccagcaggagaaggagcugcccgcgccgaugcugagcgccauccagaagucccugccccucuaccugcaggggaugugcaucgucugcugccagagccagaaccccaacgccuaccugaaccagcuccugggcaacgugaucgagcaguacaucgggcgguuccugcccgccuccccguacgugagcgaccucggccagcaccccguccugcuggcccuccgcaacacggcgaccaucccccccaucuccagccugaagaagugcaucgugcaggugauccggaaguccuaccuggaguacaaggggagcuccccgcccccccgccucgccagcauccuggccuucauccugcagcucuucaaggagaccaacaccgacaucuacgaggucgagcugcugcuccccggcauccugaagugccuggugcucgugagcgagccgcaggucaagcggcuggccacggagaaccugcaguacauggugaaggccugccaggucggcuccgaggaggagcccagcucccagcucaccagcguguuccgccaguucauccaggacuacgggaugcgguacuacuaccagguguacuccauccuggagaccgucgcgacccuggaccagcagguggugauccaccucaucagcacccugacgcagucccugaaggacagcgagcagaaguggggccucgggcgcaacaucgcccagcgcgaggccuacuccaagcugcugagccaccucggccagaugggccaggacgagaugcagcggcuggagaacgacaacaccuga

SEQ ID NO: 33007 - RNA, 3963 nt, Artificial Sequence
  derived and/or modified sequence opt1 from MN1__Homo_sapiens__NP_002421
auguucggccuggaccaguucgagccccaggugaacagccgcaacgccgggcagggcgagcggaacuucaacgagaccgggcuguccaugaacacccacuucaaggcccccgcguuccacaccggcgggccgcccggccccguggaccccgccaugagcgcccugggcgagccgcccauccuggggaugaacauggagcccuacggcuuccacgcccgcgggcacuccgagcugcacgccggcgggcugcaggcccagcccgugcacggcuucuucggcgggcagcagccccaccacggccaccccgggagccaccacccccaccagcaccacccccacuucggcggcaacuucgggggccccgaccccggggccuccugccugcacggcgggcggcuccugggcuacggcggggccgccggcgggcugggcagccagccgcccuucgccgagggguacgagcacauggccgagucccagggccccgagagcuucggcccccagcgccccgggaaccuccccgacuuccacuccagcggcgccuccagccacgccgugcccgcccccugccugccccuggaccagucccccaaccgggccgccagcuuccacgggcuccccuccagcuccggcagcgacucccacagccuggagccccgccgggugaccaaccagggggccguggacagccuggaguacaacuaccccggcgaggcccccuccggccacuucgacauguucagccccuccgacagcgaggggcagcucccccacuacgccgcgggccgccaggugcccggcggggccuuccccggggccuccgccaugccccgggccgcggggauggucggccugagcaagaugcacgcccagccgccccagcagcagccccagcagcagcagcagccccagcagcagcagcagcagcacgggguguucuucgagcgcuucuccggcgcccggaagaugcccguggggcuggagcccagcgucggcucccgccacccccucaugcagccgccccagcaggcgcccccgccgccccagcagcagccgccccagcagccgccccagcagcagcccccgccgccgcccggccugcuggugcggcagaacagcugcccgcccgcccucccccgcccccagcagggggaggccggcacccccuccgggggccugcaggacgggggccccaugcugccgagccagcacgcccaguucgaguaccccauccaccggcucgagaaccgcuccaugcaccccuacagcgagcccguguucuccaugcagcacccgccgccccagcaggcccccaaccagcggcugcagcacuucgacgccccgcccuacaugaacgucgcgaagcgcccccgguucgacuuccccggcagcgccgggguggaccgcugcgccuccuggaacggcagcaugcacaacggggcccuggacaaccaccucuccccgagcgccuaccccggccugcccggggaguucacgccgcccgugcccgacagcuuccccuccgggccgccccugcagcaccccgcgcccgaccaccagagccuccagcagcagcagcagcagcagcagcagcagcagcagcagcagcagcagcagcagcagcagcagcagcagcagcagcagcagcagcggcagaacgccgcccugaugaucaagcagauggccucccgcaaccagcagcagcgccugcggcagcccaaccucgcccagcugggccaccccggggacgucggccagggcggccuggugcacgggggccccgugggcgggcucgcgcagcccaacuucgagcgcgagggcgggagcaccggcgccggccggcuggggaccuucgagcagcaggcgccccaccuggcccaggaguccgccugguucagcggcccccacccgccgcccggggaccuccugccccgccggaugggcggguccggccugcccgccgacugcggcccccacgaccccagccucgcgccgccgcccccgcccgggggcuccgggguccuguuccgcggcccccugcaggagcccaugcggaugcccggggagggccacgugcccgcccuccccagccccggccugcaguucgggggcucccucgggggccucgggcagcugcagagcccgggcgccggcguggggcugcccuccgcggccagcgagcgccggccgcccccgcccgacuucgccaccuccgcccugggcgggcagcccggcuuccccuucggcgccgcggggcgccagagcacgccccacuccggccccggggucaacagcccgcccagcgccggcgggggcggcggguccagcggcgggggcgggggcggcggggccuacccgccccagcccgacuuccagcccucccagcggaccagcgccuccaagcucggcgcccugagccugggguccuucaacaagcccagcuccaaggacaaccucuucggccagagcugccuggcggcccuguccaccgccugccagaacaugaucgccagccucggggcccccaaccugaacgugaccuucaacaagaagaacccgcccgagggcaagcgcaagcugucccagaacgagaccgacggcgcggccguggccgggaaccccggcagcgacuacuuccccgggggcacggcccccggggcgcccggccccggcgggcccuccggcaccagcuccagcggguccaaggccagcggcccgcccaacccgcccgcccagggcgacgggaccagccucucccccaacuacacccuggagagcacguccggcaacgacgggaagcccgucagcggcgggggcggccgggggcgcggccggcgcaagcgggacuccgggcacgugagccccggcaccuucuucgacaaguacuccgccgcccccgacagcgggggcgcgcccggcgucuccccggggcagcagcaggccagcggcgccgccgucgggggcuccagcgccggggagacccgcggcgcgcccacgccccacgagaaggcccugacguccccgagcuggggcaagggggccgagcuccugcugggcgaccagcccgaccucaucgggucccuggacggcggggccaagagcgacuccagcucccccaacgugggcgaguucgccagcgacgaggucagcaccuccuacgcgaacgaggacgaggugagcuccagcuccgacaacccccaggcccuggugaaggccagccgguccccgcucgucaccggcagccccaagcugccgccccgcggggugggcgccggggagcacggccccaaggcgccgccgcccgcgcugggccucgggaucauguccaacagcaccuccacgccggacagcuacggcgggggcgggggccccggccaccccgggacccccggccuggagcagguccgcaccccgaccuccagcuccggggcgccgccgcccgacgagauccacccgcuggagauccuccaggcccagauccagcugcagcggcagcaguucagcaucuccgaggaccagccccugggccucaagggcggcaagaagggcgagugcgccgucggggcgagcggcgcccagaacggggacuccgagcugggcagcugcugcagcgaggccgugaaguccgccaugagcacgaucgaccuggacucccucauggccgagcacagcgcggccugguacaugcccgccgacaaggcccugguggacuccgccgacgacgacaagacccuggcgcccugggagaaggccaagccgcagaaccccaacagcaaggaggcccacgaccuccccgccaacaaggccuccgcgagccagcccgggucccaccuccagugccugagcguccacugcaccgacgacgugggcgacgccaaggcccgcgccuccgugccgaccuggcggagccuccacuccgacaucagcaaccgcuucggcacguucgucgcggcccugaccuga

SEQ ID NO: 33008 - RNA, 804 nt, Artificial Sequence
  derived and/or modified sequence opt1 from MNAT1__Homo_sapiens__NP_001171434
auggacgaccagggcugcccccgcugcaagaccaccaaguaccggaacccgagccugaagcucauggugaacgucugcgggcacacgcugugcgaguccugcguggaccuccucuucgugcgcggcgccgggaacugccccgagugcggcacgccccugcggaaguccaacuuccgcguccagcuguucgaggaccccaccguggacaaggagguggagauccggaagaagguccucaagaucuacaacaagcgcgaggaggacuucccgucccugcgggaguacaacgacuuccuggaggagguggaggagaucguguucaaccucaccaacaacgucgaccuggacaacaccaagaagaagauggagaucuaccagaaggagaacaaggacgugauccagaagaacaagcugaagcucacccgcgagcaggaggagcuggaggaggcccuggagguggagcggcaggagaacgagcagcgccggcuguucauccagaaggaggagcagcugcagcagauccugaagcgcaagaacaagcaggcguuccucgacgagcuggggcagcacaucagccuggcccccauccacaagcucgaggaggcccuguacgaguaccagccccugcagaucgagaccuacggcccccacgucccggagcucgagaugcugggccggcugggguaccucaaccacgugcgcgccgccagcccccaggaccuggcgggcggguacaccagcucccuggccugccaccgggcccuccaggacgccuucagcggccuguucuggcagcccuccuga

SEQ ID NO: 33009 - RNA, 1224 nt, Artificial Sequence
  derived and/or modified sequence opt1 from MNDA__Homo_sapiens__NP_002423
auggugaacgaguacaagaagauccugcuccugaagggcuucgagcugauggacgacuaccacuucaccagcaucaagucccuccuggccuacgaccuggggcucaccacgaagaugcaggaggaguacaaccgcaucaagaucaccgaccugauggagaagaaguuccagggcgucgccugccuggacaagcucaucgagcuggcgaaggacaugcccagccugaagaaccucgugaacaaccugcggaaggagaaguccaagguggccaagaagaucaagacccaggagaaggccccggucaagaagaucaaccaggaggagguggggcuggccgcccccgcgcccaccgcccgcaacaagcucacgagcgaggcccggggccgcauccccguggcccagaagcggaagaccccgaacaaggagaagaccgaggcgaagcgcaacaaggucucccaggagcagagcaagccgcccgggcccuccggcgccagcaccuccgccgccguggaccacccgccccugccccagacgagcuccagcacccccuccaacaccagcuucacccccaaccaggagacgcaggcccagcgccagguggacgcgcggcggaacgucccccagaacgaccccgugaccguggucgugcugaaggccaccgcccccuucaaguacgaguccccggagaacggcaagagcaccauguuccacgccacgguggccuccaagacccaguacuuccacgucaagguguucgacaucaaccucaaggagaaguucgugcgcaagaaggucaucaccaucagcgacuacuccgagugcaagggggugauggagaucaaggaggcgagcagcguguccgacuucaaccagaacuucgagguccccaaccggaucaucgagaucgccaacaagacccccaagaucagccagcuguacaagcaggccuccggcacgaugguguacgggcuguucaugcuccagaagaaguccgugcacaagaagaacaccaucuacgagauccaggacaacaccggcagcauggacgucguggggagcggcaaguggcacaacaucaagugcgagaagggcgacaagcugcgccuguucugccuccagcugcggaccgucgaccgcaagcugaagcucgugugcgggucccacagcuucaucaaggugaucaaggccaagaagaacaaggagggccccaugaacgucaacuga

SEQ ID NO: 33010 - RNA, 1488 nt, Artificial Sequence
  derived and/or modified sequence opt1 from MNS1__Homo_sapiens__NP_060835
augggcagcaagcgccggaaccuguccugcagcgagcgccaccagaagcucguggacgagaacuacugcaagaagcugcacguccaggcccugaagaacgugaacucccagauccggaaccagauggugcagaacgagaacgacaaccgcguccagcggaagcaguuccuccgccugcugcagaacgagcaguucgagcucgacauggaggaggccauccagaaggcggaggagaacaagcggcugaaggagcugcagcucaagcaggaggagaagcuggccauggagcuggccaagcucaagcacgagagccugaaggacgagaagaugcgccagcagguccgggagaacuccaucgagcugcgcgagcucgagaagaagcugaaggccgccuacaugaacaaggagcgggcggcccagaucgccgagaaggacgccaucaaguacgagcagaugaagcgcgacgcggagaucgccaagaccaugauggaggagcacaagcggaucaucaaggaggagaacgccgccgaggacaagcgcaacaaggccaaggcgcaguacuaccuggaccucgagaagcagcuggaggagcaggagaagaagaagcaggaggccuacgagcagcugcucaaggagaagcugaugaucgacgagaucgugcggaagaucuacgaggaggaccagcuggagaagcagcagaagcucgagaagaugaacgccaugcgccgguacaucgaggaguuccagaaggagcaggcccuguggcgcaagaagaagcgggaggagauggaggaggagaaccgcaagaucaucgaguucgccaacaugcagcagcagcgggaggaggaccgcauggcgaaggugcaggagaacgaggagaagcgccugcagcuccagaacgcccugacccagaagcuggaggagaugcuccggcagcgcgaggaccuggagcagguccggcaggagcuguaccaggaggagcaggccgagaucuacaagagcaagcucaaggaggaggccgagaagaagcugcgcaagcagaaggagaugaagcaggacuucgaggagcagauggcccugaaggagcucgugcugcaggcggccaaggaggaggaggagaacuuccggaagacgaugcuggccaaguucgccgaggacgaccgcaucgagcucaugaacgcccagaagcagcggaugaagcagcuggagcaccgccgggcgguggagaagcugaucgaggagcgccggcagcaguuccucgccgacaagcagcgcgagcuggaggaguggcagcugcagcagcggcgccagggguucaucaacgccaucaucgaggaggagcggcucaagcugcugaaggagcacgccaccaaccuccugggcuaccugcccaaggggguguucaagaaggaggacgacaucgaccugcucggcgaggaguuccgcaagguguaccagcagcgguccgagaucugcgaggagaaguga

SEQ ID NO: 33011 - RNA, 1749 nt, Artificial Sequence
  derived and/or modified sequence opt1 from MNT__Homo_sapiens__NP_064706
augagcaucgagacccugcucgaggccgcccgcuuccuggaguggcaggcccagcagcagcagcgggcccgcgaggagcaggagcggcugcgccucgagcaggagcgggagcaggagcagaagaaggccaacucccuggcccgccuggcccacacccuccccguggaggagccccggauggaggccccgccccugccccugagcccgcccgcgcccccgcccgcgcccccgccgccccucgccacgcccgccccgcugaccgucauccccauccccguggugaccaacagcccccagccccugccgccgcccccgccccugcccgccgccgcccagccccugccccuggcgccccgccagcccgcccucgucggcgcccccgggcugagcaucaaggagcccgcgccccugcccucccggccccaggugcccacccccgcgccccuccugcccgacagcaaggccacgaucccgcccaacggcucccccaagccccugcagccccuccccacccccgugcugaccaucgccccgcaccccgggguccagccccagcuggccccgcagcagcccccgccgcccacccucggcacgcugaagcuggcccccgccgaggaggucaagagcuccgagcagaagaagcgccccgggggcaucggcacccgggaggugcacaacaagcucgagaagaaccgccgggcccaccugaaggagugcuucgagacccugaagcgcaacauccccaacguggacgacaagaagaccagcaaccucuccgugcugcggacggcccugcgcuacauccagagccucaagcggaaggagaaggaguacgagcacgagauggagcgccuggcccgggagaagaucgccacccagcagcgccuggccgagcucaagcacgagcugucccaguggauggacgugcuggagaucgaccggguccuccgccagaccgggcagcccgaggacgaccaggccagcaccuccacggccagcgagggcgaggacaacaucgacgaggacauggaggaggaccgcgccgggcuggggccgcccaagcugucccaccggccccagcccgagcuccugaaguccacccugcccccgcccuccaccacccccgcgccccucccgccccacccccacccccacccccacagcguggcccugccgcccgcgcaccuccccgugcagcagcagcagccgcagcagaagacgccccuccccgcgccgccgccgccgcccgccgcccccgcccagacccugguccccgcgcccgcccaccugguggccaccgccggcggcggcagcaccgugaucgcccacacggcgaccacccacgccuccgucauccagaccgugaaccacgugcugcaggggcccggcgggaagcacaucgcccacaucgcccccagcgcccccucccccgcgguccagcucgcccccgccacgccgcccaucggccacaucaccgugcaccccgccacccugaaccacguggcgcaccugggcagccagcucccgcuguacccccagcccgucgccgugucccacaucgcccacacccugagccaccagcaggucaacgggacggccggccucgggcccccggccaccgugauggcgaagcccgccgugggcgcccaggucgugcaccacccccagcugguggggcagaccguccugaaccccgugaccauggugacgaugccguccuuccccgucagcacccucaagcuggccuga

SEQ ID NO: 33012 - RNA, 570 nt, Artificial Sequence
  derived and/or modified sequence opt1 from MNX1__Homo_sapiens__NP_001158727
augggcgggcugagcaccgugggcgccugccccgggauccucggcgcccagcaggcccaggcccaguccaaccugcuggggaagugccgccggccgcgcaccgccuucacgagccagcagcuccuggagcuggagcaccaguucaagcucaacaaguaccugucccggcccaagcgcuucgaggucgccaccagccugaugcucaccgagacccaggugaagaucugguuccagaaccggcgcaugaaguggaagcgguccaagaaggccaaggagcaggcggcccaggaggccgagaagcagaagggcggcgggggcggggccggcaagggcggggcggaggagcccggcgccgaggagcugcuggggcccccggcccccggcgacaaggggagcggccgccggcuccgcgaccugcgggacuccgaccccgaggaggacgaggacgaggacgacgaggaccacuuccccuacagcaacggcgccuccgugcacgccgcgagcuccgacugcagcuccgaggacgacagcccgccgccccgccccucccaccagcccgcgccccaguga

SEQ ID NO: 33013 - RNA, 1056 nt, Artificial Sequence
  derived and/or modified sequence opt1 from MOAP1__Homo_sapiens__NP_071434
augacccugcgccuccuggaggacuggugccggggcauggacaugaacccccgcaaggcccugcucaucgccgggaucagccaguccugcagcguggcggagaucgaggaggcccugcaggccggccuggccccgcucggggaguaccggcugcugggccgcauguuccggcgcgacgagaaccggaaggucgcccucguggggcugaccgcggagacgucccacgcccuggugcccaaggagauccccggcaagggcgggaucuggcgcgucaucuucaagcccccggaccccgacaacaccuuccucagccggcugaacgaguuccuggccggcgaggggaugaccgugggcgagcucucccgcgcccuggggcacgagaacggcagccuggaccccgagcagggcaugauccccgagaugugggcgccgaugcucgcccaggcccuggaggcccugcagcccgcccuccagugccugaaguacaagaagcugcggguguucuccgggcgcgagagccccgagcccggcgaggaggaguucgggcgguggauguuccacaccacgcagaugaucaaggcguggcaggucccggacguggagaagcgccggcgccuccuggagucccugcggggccccgcccucgacgugauccgcguccugaagaucaacaacccccugaucaccguggacgagugccuccaggcccuggaggagguguucggcgucaccgacaacccccgggagcuccaggugaaguaccugaccacguaccagaaggacgaggagaagcugagcgccuacgugcugcgccucgagccgcugcugcagaagcucguccagcgcggggccaucgagcgggacgcggugaaccaggcccgccuggaccaggugaucgccggcgccguccacaagaccauccggcgcgagcugaaccuccccgaggacgggcccgcccccggcuuccugcagcugcucgugcugaucaaggacuacgaggcggccgaggaggaggaggcccugcuccaggccauccuggaggggaacuucaccuga

SEQ ID NO: 33014 - RNA, 651 nt, Artificial Sequence
  derived and/or modified sequence opt1 from MOB1A__Homo_sapiens__NP_060691
augagcuuccuguucuccagccgcuccagcaagaccuucaagcccaagaagaacaucccggagggcucccaccaguacgagcuccugaagcacgccgaggccacccuggggagcggcaaccuccggcaggcggugaugcugcccgagggggaggaccugaacgaguggaucgccgucaacacgguggacuucuucaaccagaucaacaugcucuacggcaccaucaccgaguucugcaccgaggccuccugccccgugaugagcgccgggccccgcuacgaguaccacugggccgacggcacgaacaucaagaagccgaucaagugcuccgcgcccaaguacaucgacuaccugaugaccuggguccaggaccagcuggacgacgagacccucuuccccagcaagaucggcgugcccuucccgaagaacuucauguccguggccaagaccauccugaagcggcuguuccgcgucuacgcccacaucuaccaccagcacuucgacagcgugaugcagcuccaggaggaggcccaccugaacacguccuucaagcacuucaucuucuucgugcaggaguucaaccugaucgaccggcgcgagcucgcgccccugcaggagcugaucgagaagcucgggagcaaggaccgguga

SEQ ID NO: 33015 - RNA, 651 nt, Artificial Sequence
  derived and/or modified sequence opt1 from MOB1B__Homo_sapiens__NP_775739
augagcuuccuguucggcucccgcagcuccaagaccuucaagcccaagaagaacaucccggaggggagccaccaguacgagcuccugaagcacgccgaggccacccugggcuccgggaaccuccggauggccgugaugcugcccgagggcgaggaccugaacgagugggucgccgugaacacgguggacuucuucaaccagaucaacaugcucuacgggaccaucaccgacuucugcaccgaggagagcugccccgucauguccgccggccccaaguacgaguaccacugggccgacggcacgaacaucaagaagccgaucaagugcagcgcccccaaguacaucgacuaccugaugaccugggugcaggaccagcuggacgacgagacccucuuccccuccaagaucggggugcccuucccgaagaacuucaugagcgucgcgaagaccauccugaagcgccuguuccggguguacgcccacaucuaccaccagcacuucgaccccgugauccagcuccaggaggaggcccaccugaacacguccuucaagcacuucaucuucuucguccaggaguucaaccugaucgaccgccgggagcucgcgccccugcaggagcugaucgagaagcucaccagcaaggaccgcuga

SEQ ID NO: 33016 - RNA, 807 nt, Artificial Sequence
  derived and/or modified sequence opt1 from MOB2__Homo_sapiens__NP_001165694
augcugggcgaccacugcagccuccccgaggaccaggcccgcccggggcagucccugcagagcggccugugcugcaagauggugcuccaggccgucuccaaggugcugcgcaagagcaaggcgaagcccaacgggaagaagcccgccgccgaggagcggaaggccuaccuggagcccgagcacaccaaggcccggaucaccgacuuccaguucaaggagcucgugguccugccgcgcgagaucgaccugaacgaguggcucgcguccaacacgaccaccuucuuccaccacaucaaccugcaguacagcaccaucuccgaguucugcacgggcgagaccugccagaccauggccgugugcaacacccaguacuacugguacgacgagcgggggaagaaggugaagugcacggcgccccaguacgucgacuucgugaugagcuccgugcagaagcuggucaccgacgaggacguguuccccaccaaguacggccgcgaguuccccagcuccuucgagagccucgugcggaagaucugccgccaccuguuccacguccuggcccacaucuacugggcccacuucaaggagacccucgcccuggagcugcacggccaccucaacacgcuguacgugcacuucauccuguucgcccgggaguucaaccuccuggacccgaaggagaccgccaucauggacgaccugaccgaggugcucugcuccggggccggcgggguccacagcggcggguccggcgacggcgcggggagcggcgggcccggcgcccagaaccacgugaaggagcgcuga

SEQ ID NO: 33017 - RNA, 651 nt, Artificial Sequence
  derived and/or modified sequence opt1 from MOB3B__Homo_sapiens__NP_079037
augagcaucgcccugaagcaggucuucaacaaggacaagaccuuccgccccaagcggaaguucgagccgggcacccagcgcuucgagcuccacaagcgggcccaggcgucccugaacagcgggguggaccugaaggccgccgugcagcuccccuccggcgaggaccagaacgacuggguggccguccacgugguggacuucuucaaccgcaucaaccugaucuacgggaccaucugcgaguucugcaccgagcggaccugccccgucaugagcggcgggcccaaguacgaguaccgcuggcaggacgaccugaaguacaagaagccgaccgcccuccccgcgccccaguacaugaaccugcugauggacuggaucgaggugcagaucaacaacgaggagaucuuccccacgugcgugggcgucccguuccccaagaacuuccuccagaucugcaagaagauccugugccggcuguuccgcguguucgugcacgucuacauccaccacuucgaccgggugaucgugaugggcgccgaggcccacgucaacacgugcuacaagcacuucuacuacuucgugaccgagaugaaccucaucgaccgcaaggagcuggagccccugaaggagaugaccucccggaugugccacuga

SEQ ID NO: 33018 - RNA, 615 nt, Artificial Sequence
  derived and/or modified sequence opt1 from MOB4__Homo_sapiens__NP_001094289
auggugauggccgagggcaccgccguccugcgccggaaccgccccgggaccaaggcgcaguacauccagcagaacauccgggccgacugcagcaacaucgacaagauccucgagccgcccgagggccaggacgaggggguguggaaguacgagcaccuccgccaguucugccuggagcugaacggccuggccgugaagcugcaguccgagugccaccccgacacgugcacccagaugaccgccaccgagcaguggaucuuccucugcgccgcgcacaagacgcccaaggagugcccggccaucgacuacacccggcacacccuggacggggccgccugccugcucaacagcaacaaguacuuccccucccgcgucagcaucaaggaguccagcguggcgaagcugggcuccgugugccggcgcaucuaccggaucuucagccacgccuacuuccaccaccgccagaucuucgacgaguacgagaacgagaccuuccugugccaccgguucacgaaguucgucaugaaguacaaccucauguccaaggacaaccugaucgugcccauccuggaggaggaggugcagaacagcgucuccggcgagagcgaggccuga

SEQ ID NO: 33019 - RNA, 621 nt, Artificial Sequence
  derived and/or modified sequence opt1 from MOBP__Homo_sapiens__NP_001265251
augagccagaagcccgccaaggagggcccccgccuguccaagaaccagaaguacagcgagcacuucuccauccacugcugcccgcccuucaccuuccucaacagcaagaaggagaucguggaccggaaguacuccaucugcaagagcgggugcuucuaccagaagaaggaggaggacuggaucugcugcgccugccagaagaccuccagcugccagcgccggcuguccagccgcggcgagcccuggcugcccccgcccgcguccuucgggccccuccggacgagccgccgggccaaguccccgcagcgccccaagcagcagcccgccgccccgcccgccgucgugcgggcgcccgccaagccccgcagcccgccccgguccgagcgccagccccggagcccgccccgcuccgagcggcagccccgcagcccgccccgguccgagcgccagccccggagcccgccccgcagcgagcggcagccccgcccccgccccgaggugcggcccccgcccgccaagcagcgcccgccccagaaguccaagcagcagccccggagcagcccccugcgcggccccggggccucccggggcggcucccccgucaaggcgagccgcuucuga

SEQ ID NO: 33020 - RNA, 2667 nt, Artificial Sequence
  derived and/or modified sequence opt1 from MOCOS__Homo_sapiens__NP_060417
auggccggcgccgcggccgagagcgggcgcgagcuguggaccuucgccggcucccgggaccccagcgccccgcgccucgccuacggguacggccccgggucccugcgggagcugcgcgcgcgggaguucagccgccucgccggcaccguguaccuggaccacgccggcgccacgcuguucucccagagccagcucgaguccuucaccagcgaccugauggagaacaccuacgggaacccccacucccagaacaucagcuccaagcugacccacgacacggucgagcagguccgguaccgcauccucgcgcacuuccacaccaccgccgaggacuacaccgugaucuucacggccggcagcaccgccgcccugaagcugguggcggaggccuuccccugggugucccaggggccggagagcuccggcagccgguucugcuaccucaccgacucccacaccagcguggucgggaugcgcaacgugacgauggccaucaacgugaucuccacccccguccggcccgaggaccuguggagcgccgaggagcgcagcgccuccgcgagcaaccccgacugccagcugccgcaccucuucugcuaccccgcccaguccaacuucagcggcgugcgguacccccuguccuggaucgaggaggucaagagcggccgccugcaccccguguccaccccggggaagugguucgugcuccuggacgccgccagcuacguguccaccagcccccuggaccucuccgcccaccaggcggacuucguccccaucagcuucuacaagaucuucggcuuccccacggggcugggcgcccugcucgugcacaaccgggccgccccgcugcugcgcaagaccuacuucggcgggggcaccgccuccgcguaccucgccggggaggacuucuacaucccccggcagagcguggcccagcgcuucgaggacggcaccaucuccuuccuggacgucaucgcccugaagcacggguucgacacgcucgagcggcugaccggcggcauggagaacaucaagcagcacaccuucacccuggcgcaguacacguacguggcccucagcucccugcaguaccccaacggggcccccgugguccgcaucuacagcgacuccgaguucagcagcccggaggugcagggccccaucaucaacuucaacgugcuggacgacaaggggaacaucaucggcuacucccaggucgacaagauggccagccucuacaacauccaccuccggaccgggugcuucugcaacaccggcgccugccagcgccaccugggcaucuccaacgagauggugcgcaagcacuuccaggcggggcacgucugcggcgacaacauggaccugaucgacgggcagcccaccggcagcgugcggaucuccuucggguacaugagcacgcuggacgacgugcaggccuuccugcgcuucaucaucgacacccggcuccacuccagcggcgacuggcccgucccgcaggcccacgccgacaccggcgagaccggggcccccuccgcggacagccaggccgacgugauccccgccgugaugggccgccggucccugagcccccaggaggacgcccugacggggucccgcgucuggaacaacagcuccaccgugaacgccgugccggucgcgccgcccgugugcgacguggcccggacccagcccacccccagcgagaaggccgccggcguccucgagggcgcgcuggggccccacguggugacgaaccuguaccucuaccccaucaaguccugcgccgccuucgaggucacccgcuggccggugggcaaccaggggcugcuguacgaccggagcuggaugguggucaaccacaacggcgugugccugagccagaagcaggagccccgccucugccugauccagcccuucaucgaccugcggcagcgcaucauggugaucaaggccaaggggauggagcccaucgaggucccgcucgaggagaacuccgagcggacccagauccgccagagccgggugugcgccgaccgcguguccaccuacgacugcggcgagaagaucagcuccuggcugagcaccuucuucggccggcccugccaccugaucaagcaguccagcaacucccagcgcaacgcgaagaagaagcacgggaaggaccagcuccccggcacgauggccacccugagccuggucaacgaggcccaguaccuccugaucaacaccuccagcauccuggagcuccaccggcagcugaacaccuccgacgagaacgggaaggaggagcuguucagccucaaggaccugucccugcgcuuccgcgccaacaucaucaucaacggcaagcgggccuucgaggaggagaagugggacgagaucagcaucgggucccuccgcuuccaggugcugggccccugccaccggugccagaugaucugcaucgaccagcagacgggccagcgcaaccagcacguguuccagaagcugagcgagucccgggagaccaaggucaacuucgggauguaccucaugcacgcgagccuggaccugagcuccccgugcuuccucagcgugggcucccaggugcugcccguccugaaggagaacguggaggggcacgaccuccccgccagcgagaagcaccaggacgugaccuccuga

SEQ ID NO: 33021 - RNA, 1158 nt, Artificial Sequence
  derived and/or modified sequence opt1 from MOCS1__Homo_sapiens__NP_001068566
auggccgcccgcccccugagccggaugcuccgccggcugcugcgcuccagcgcgcgguccugcagcuccggcgccccggugacccagcccugccccggggagagcgcccgcgccgccuccgaggaggucagccggcgccggcaguuccuccgcgagcacgcggcccccuucuccgccuuccugaccgacagcuucggccggcagcacuccuaccugcgcaucagccucacggagaagugcaaccugcggugccaguacugcaugccggaggagggggugccccugacccccaaggccaaccuccugaccaccgaggagauccugacgcucgcgcgccuguucgugaaggagggcaucgacaagauccggcugaccgggggcgagccccucauccgcccggacgucguggacaucguggcccagcugcagcggcuggagggccuccgcaccaucggggucaccacgaacggcaucaaccuggcccggcugcucccccagcugcagaaggccgggcuguccgccaucaacaucagccucgacacccuggugcccgcgaaguucgaguucaucgugcgccggaagggcuuccacaaggucauggaggggauccacaaggccaucgagcugggcuacaaccccgugaaggugaacugcgucgugaugcgcggccucaacgaggacgagcugcuggacuucgccgcccucaccgaggggcugccgcuggacgugcgcuucaucgaguacaugcccuucgacggcaacaaguggaacuucaagaagauggucuccuacaaggagaugcucgacaccgugcggcagcaguggcccgagcuggagaaggugcccgaggaggagagcuccacggccaaggcguucaagaucccgggguuccagggccagaucagcuucaucaccuccaugagcgagcacuucugcgggaccugcaaccgccugcggaucaccgccgacggcaaccucaaggucugccuguucggcaacagcgaggugucccugcgcgaccaccuccgggccggggccagcgagcaggagcugcugcgcaucaucggcgccgcgguggggcggaagaagcgccagcacgccggcauguucuccaucagccagaugaagaaccggcccaugauccucaucggcggguga

SEQ ID NO: 33022 - RNA, 567 nt, Artificial Sequence
  derived and/or modified sequence opt1 from MOCS2__Homo_sapiens__NP_004522
augagcucccuggagaucagcuccagcugcuucucccucgagaccaagcugccccugagcccgccccucguggaggacuccgccuucgagcccagccgcaaggacauggacgaggucgaggagaaguccaaggacgugaucaacuucaccgccgagaagcugagcguggacgaggucucccagcuggugaucagcccccucugcggcgcgaucucccuguucguggggacgacccggaacaacuucgagggcaagaaggucaucagccuggaguacgaggccuaccucccgauggccgagaacgaggugcgcaagaucugcuccgacauccggcagaaguggcccgugaagcacaucgccgucuuccaccgccuggggcuggugcccgugagcgaggccuccaucaucaucgcggucagcuccgcccaccgggccgccagccucgaggcggugagcuacgccaucgacacccugaaggccaaggugcccaucuggaagaaggagaucuacgaggaguccagcaccuggaagggcaacaaggagugcuucugggccuccaacagcuga

SEQ ID NO: 33023 - RNA, 1008 nt, Artificial Sequence
  derived and/or modified sequence opt1 from MOGAT1__Homo_sapiens__NP_477513
augaagguggaguucgcgccccugaacauccagcucgcccgccggcugcagaccgucgccgugcugcagugggugcucaaguaccugcugcucggcccgaugagcaucgggaucaccgucaugcugaucauccacaacuaccuguuccucuacauccccuaccugauguggcuguacuucgacuggcacacgcccgagcgcggcgggcggcgcuccagcuggaucaagaacuggacccucuggaagcacuucaaggacuacuuccccauccaccugaucaagacccaggaccuggacccgucccacaacuacaucuucggcuuccacccccacgggaucauggccgugggcgccuucggcaacuucagcgugaacuacuccgacuucaaggaccucuuccccggguucaccagcuaccugcacguccugccccucugguucuggugcccgguguuccgggaguacgugauguccgucggccuggugagcguguccaagaaguccgucagcuacauggugagcaaggagggcggcgggaacaucuccgugaucguccucgggggcgccaaggagagccuggacgcccaccccgggaaguucacgcuguucauccgccagcggaagggcuucgugaagaucgcgcugacccacggggccucccucgugcccgucgugagcuucggcgagaacgagcuguucaagcagaccgacaaccccgagggcuccuggauccgcaccgugcagaacaagcugcagaagaucaugggguucgcccucccgcuguuccacgcccggggcgucuuccaguacaacuucgggcugaugacguaccgcaaggcgauccacaccguggugggccggcccauccccguccgccagacccucaaccccacccaggagcagaucgaggagcugcaccagacguacauggaggagcugcggaagcuguucgaggagcacaaggggaaguacggcaucccggagcacgagacccucgugcugaaguga

SEQ ID NO: 33024 - RNA, 1005 nt, Artificial Sequence
  derived and/or modified sequence opt1 from MOGAT2__Homo_sapiens__NP_079374
augguggaguucgccccgcuguucaugccgugggagcgccggcuccagacccuggccguccugcaguucguguucagcuuccucgcgcuggccgagaucugcaccgugggcuucaucgcccuccuguucacgcgcuucuggcugcugaccguccucuacgccgccuggugguaccuggaccgggacaagccccgccagggcgggcggcacauccaggcgauccgcugcuggaccaucuggaaguacaugaaggacuacuuccccaucucccuggugaagaccgccgagcucgaccccagccggaacuacaucgccggguuccacccgcacggcgugcuggccgucggggcguucgccaaccugugcacggaguccaccggcuucagcuccaucuuccccggcauccgcccccaccucaugaugcugacccugugguuccgggcccccuucuuccgcgacuacaucaugagcgccgggcucgugaccuccgagaaggagagcgccgcgcacauccugaaccggaagggcgggggcaaccugcucgggaucaucgugggcggcgcccaggaggcccuggacgcccgcccgggguccuucacgcugcuccugcggaaccgcaagggcuucguccggcuggcccucacccacggggcgccccuggugcccaucuucagcuucggcgagaacgaccuguucgaccagauccccaacuccagcggcuccuggcuccgcuacauccagaaccggcugcagaagaucauggggaucagccugccccucuuccacggccgcgggguguuccaguacuccuucggccugauccccuaccggcgccccaucaccaccgucguggggaagcccaucgaggugcagaagacgcugcacccgagcgaggaggaggucaaccagcuccaccagcgguacaucaaggagcugugcaaccuguucgaggcccacaagcucaaguucaacauccccgccgaccagcaccuggaguucugcuga

SEQ ID NO: 33025 - RNA, 846 nt, Artificial Sequence
  derived and/or modified sequence opt1 from MOGAT3__Homo_sapiens__NP_001274076
augggcguggccaccacccugcagccgcccacgaccagcaagacccugcagaagcagcaccuggaggccgucggggcguaccaguacgugcugaccuuccucuucaugggccccuucuucucccugcugguguucguccuccuguucacgagccuguggcccuucuccguguucuaccucguguggcuguacgucgacugggacacccccaaccagggcgggcgccggagcgaguggauccgcaaccgggccaucuggcgccagcugcgggacuacuaccccgugaagcucgugaagaccgccgagcugccgcccgaccgcaacuacguccugggggcccacccccacggcaucaugugcaccggcuuccucugcaacuucuccacggagagcaacggguucucccagcuguuccccggccugcggcccuggcucgccgugcuggcggggcuguucuaccuccccguguaccgcgacuacaucaugagcuucggccugugccccgucucccggcagagccuggacuucauccucucccagccgcagcuggggcaggccguggugaucauggucggcggcgcccacgaggcccuguacagcgugcccggggagcacugccucacccugcagaagcgcaagggcuucgugcggcuggcgcuccgccacgggggcccgccccacccccggccgcccgcgccgccgccccaccgcggcgggucccagagccugucccggccccugcacgacggccccggggccgcccuccgcggcgcccaggggaagcuguggggcccccgguuccaccucccccaccuccaccugggccuggccgccgccuuccgcuga

SEQ ID NO: 33026 - RNA, 675 nt, Artificial Sequence
  derived and/or modified sequence opt1 from MOG__Homo_sapiens__NP_001008229
auggccagccugucccgccccagccucccguccugccugugcagcuuccugcuccugcugcuccuccagguguccagcuccuacgccggccaguuccgggucaucgggccccgccaccccauccgggcgcuggugggcgacgagguggagcugcccugccgcaucagcccggggaagaacgccaccggcauggaggucgggugguaccggccgcccuucucccgcguggugcaccuguaccggaacggcaaggaccaggacggcgaccaggcccccgaguaccgcgggcggaccgagcugcucaaggacgccaucggcgaggggaaggucacgcugcgcauccggaacgugcgcuucagcgacgagggcggguucacgugcuucuuccgggaccacuccuaccaggaggaggccgcgauggagcugaagguggaggaccccuucuacugggucagccccggcgugcucgugcugcuggccguccuccccgugcugcugcuccagaucaccgugggccugaucuuccugugccuccaguaccgccugcgggggaagcugcgcgccgagaucgagaaccuccaccggaccuucgaguccuucggcguccuggggccccaggugaaggagccgaagaagaccggccaguuccuggaggagcuccgcaaccccuucuga

SEQ ID NO: 33027 - RNA, 2196 nt, Artificial Sequence
  derived and/or modified sequence opt1 from MOGS__Homo_sapiens__NP_001139630
augaagacccgcagccccaagccgcugcucaccggccugaugugggcccagcaggggacgacccccggcacccccaagcugcggcacacgugcgagcagggggacggcguggggcccuacggcugggaguuccacgacggccucuccuucgggcgccagcacauccaggacggcgcccugcggcugaccaccgaguucgucaagcgccccgggggccagcacgggggcgacuggagcuggcgggugaccguggagccccaggacuccggcaccagcgcgcucccccuggucucccuguucuucuacguggugacggacgggaaggagguccuccugcccgaggugggcgccaaggggcagcugaaguucaucagcggccacaccuccgagcucggcgacuuccgcuucacccugcugccgcccaccagccccggggacacggcccccaaguacggcuccuacaacguguucuggaccagcaacccggggcucccccugcugaccgagauggucaagucccggcucaacagcugguuccagcaccgcccgcccggcgccccgcccgagcgguaccuggggcugcccggcucccucaagugggaggaccgcggccccagcgggcagggccaggggcaguuccugauccagcaggucacccugaagaucccgaucuccaucgaguucguguucgagagcggcuccgcccaggccgggggcaaccaggcgcucccccggcuggccggcagccugcucacgcaggcccuggagucccacgcggagggguuccgcgagcgguucgagaagaccuuccagcugaaggagaagggccucagcagcggggagcagguccugggccaggccgcccuguccgggcuccugggcggcaucggguacuucuacggccaggggcuggugcuccccgacaucggcguggagggcagcgagcagaagguggaccccgcccuguucccgcccgugccccuguucaccgccgugcccucccgcagcuucuucccgcggggguuccucugggacgagggcuuccaccagcuggucgugcagcgcugggaccccucccugacccgggaggcgcucgggcacuggcugggccugcucaacgccgacggguggaucggccgcgagcagauccugggcgacgaggcccgggcccgcgugcccccggaguuccugguccagcgggccgugcacgcgaacccgcccacgcuccugcugcccguggcccacaugcuggaggucggggaccccgacgaccucgccuuccugcgcaaggcccugccccgccuccacgccugguucagcuggcugcaccagucccaggcgggcccccugccccucagcuaccgguggcgcgggcgggacccggcccugcccacccugcucaaccccaagacccugcccuccggccuggacgacuacccgcgcgccagccaccccuccgugaccgagcggcaccucgaccugcgcugcugggucgcccugggggcccgggugcucacgcgccuggcggagcaccugggcgaggccgagguggccgccgagcucggcccccuggcggccagccuggaggccgccgagucccucgacgagcugcacugggcccccgagcugggggucuucgcggacuucggcaaccacaccaaggccgugcagcucaagccgcggccgccccaggggcuggugcgcgucgugggccggccccagccccagcugcaguacguggacgcccucggguacgucagccuguucccccugcuccugcgccugcucgaccccaccuccagccggcugggcccccugcucgacauccuggccgacucccgccaccuguggagcccguucggccuccggucccuggccgcgagcagcuccuucuacgggcagcgcaacagcgagcacgacccgcccuacuggcggggcgccguguggcugaacgugaacuaccucgcccugggggcccugcaccacuacggccaccucgaggggccccaccaggcccgcgcggccaagcugcacggcgagcugcgggccaacgucgugggcaacguguggcgccaguaccaggccaccggguuccucugggagcaguacuccgaccgcgacggccgggggaugggcugccgccccuuccacggcuggacgagccugguccugcucgcgauggccgaggacuacuga

SEQ ID NO: 33028 - RNA, 1260 nt, Artificial Sequence
  derived and/or modified sequence opt1 from MOK__Homo_sapiens__NP_055041
augaagaacuacaaggccaucggcaagaucggggagggcaccuucagcgaggugaugaagaugcagucccugcgcgacgggaacuacuacgccugcaagcagaugaagcagcgguucgagagcaucgagcaggucaacaaccuccgcgagauccaggcccugcggcgccugaacccccacccgaacauccucaugcugcacgaggugguguucgaccggaaguccggcagccuggcccucaucugcgagcugauggacaugaacaucuacgagcugauccgcgggcggcgcuacccccucuccgagaagaagaucaugcacuacauguaccagcugugcaagagccuggaccacauccaccggaacggcaucuuccaccgcgacgucaagcccgagaacauccucaucaagcaggacgugcugaagcugggcgacuucggguccugccggagcguguacuccaagcagcccuacaccgaguacaucagcacgcgcugguaccgggccccggagugccuccugaccgacggcuucuacaccuacaagauggaccugugguccgccgggugcgucuucuacgagaucgccagccuccagccccuguuccccggcgugaacgagcuggaccagaucuccaagauccacgacgugaucgggacccccgcgcagaagauccucacgaaguucaagcagagccgcgccaugaacuucgacuucccguucaagaagggcuccggcaucccccugcugaccaccaaccucagcccccagugccugucccugcuccacgccauggucgccuacgaccccgacgagcggaucgcggcccaccaggcccugcagcacccguacuuccaggagcagcgcaagaccgagaagcgggcccuggggagccaccgcaaggccggcuuccccgagcaccccguggcgcccgagccgcucuccaacagcugccagaucagcaaggaggggcggaagcagaagcagucccugaagcaggaggaggaccgccccaagcggcgcggccccgccuacgugauggagcugcccaagcucaagcugagcggcgucgugcgccuguccagcuacuccagcccgacgcuccaguccgugcuggggagcggcaccaacgggcggguccccgugcugcgcccccucaagugcauccccgccuccaagaagaccgacccgcagaaggaccugaagcccgcgccccagcagugccggcugcccaccaucgugcgcaagggcgggcgguga

SEQ ID NO: 33029 - RNA, 1473 nt, Artificial Sequence
  derived and/or modified sequence opt1 from MON1A__Homo_sapiens__NP_001135973
augcaccccggcgggggcccgagccgcgccgagcggcuggagcucgggcugggccgcgagcggcccgccaaggcgaucuuccugcaccgccggcccggggagggcggcgggcgcgagcggugccuccgcugcggccacgugugcguccggcgcgggcccggcccgcgggaggccgugcccuccgggcgcccccggcccgacacccugaccccgcccugggugcgccagcgggccgucaccggcaccuucugcgccagcuggacgccccugcgcaaccggcgcgcccagcggauggcgaccgacaugcagcgcaagcgguccagcgagugccucgacggcacccugacccccuccgacgggcagagcauggagcgcgccgaguccccgacccccggcauggcccaggggauggagcccgacggcuacaaggugguguucguccgccggagcccccuggugcucguggccgucgcgcgcacccggcaguccgcccaggagcuggcccaggagcugcucuacaucuacuaccagauccugagccugcucacgggcgcccagcugucccacaucuuccagcagaagcagaacuacgaccugcgccggcuccugagcggguccgagcgcaucaccgacaaccugcuccagcugauggcccgggacccgagcuuccugaugggcgcggcccgcugccucccccuggccgccgccgugcgggacaccguguccgcgagccugcagcaggcccgcgcccggucccucgucuucagcauccugcuggcccgcaaccagcucguggcccuggugcggcgcaaggaccaguuccugcaccccaucgaccuccaccuccuguucaaccugaucuccagcagcuccagcuuccgggagggggaggcguggacccccgucugccugccgaaguucaacgccgccggcuucuuccacgcccacaucuccuaccuggagcccgacacggaccucugccugcugcucgugagcaccgaccgcgaggacuucuucgccguguccgacugccggcgccgguuccaggagcgccugcgcaagcgcggggcgcaccuggcccuccgggaggcccugcggacccccuacuacagcgucgcccaggugggcauccccgaccugcgccacuuccucuacaaguccaagagcuccggccuguucaccagcccggagaucgaggcgcccuacacguccgaggaggagcaggagcggcugcuggggcucuaccaguaccugcacagccgcgcccacaacgccucccggccccugaagaccaucuacuacaccggccccaacgagaaccuccuggccugggugaccggggccuucgagcuguacaugugcuacagcccgcucggcacgaaggcguccgccgucagcgccauccacaagcugaugcgcuggauccggaaggaggaggaccgccuguucauccucacgccccugaccuacuga

SEQ ID NO: 33030 - RNA, 1317 nt, Artificial Sequence
  derived and/or modified sequence opt1 from MON1B__Homo_sapiens__NP_001273568
auggaggugggcggggacaccgccgcccccgcgcccggcggggccgaggaccuggaggacacccaguuccccagcgaggaggcccgcgagggcgggggcguccacgccgugccgcccgaccccgaggacgagggccucgaggagacggaggaccacaagcugguguuccugcagcaggggccccuccugcuggucgccaugucccggaccagccaguccgcggcccagcuccgcggcgagcugcuggccgugcacgcccagaucgugagcacccucacccgggcguccgucgcccgcaucuucgcccacaagcagaacuacgaccugcggcgccugcucgccgggagcgagcggacgcuggaccgccugcucgacuccauggagcaggaccccggcgcccugcugcucggggcggugcggugcgugccccuggcccgcccgcugcgggacgcccucggcgcccugcugcgccggugcaccgcccccggccucgcgcugagcguccuggccgucgggggccgccucaucaccgccgcccaggagcggaacgugcuggccgagugccgccuggaccccgcggaccuccagcugcugcucgacugggugggggcccccgccuucgccgccggcgaggcgugggccccggugugccugccccgguucaaccccgacggcuucuucuacgccuacguggcccgccuggacgcgaugcccgucugccuccugcugcucgggacccagcgggaggccuuccacgccauggccgccugccgccggcugguggaggacggcaugcacgcgcugggggccaugcgcgcccucggcgaggccgccuccuucagcaacgcguccagcgccuccgccccggccuacagcgugcaggccgucggggcgcccggccugcgccacuuccuguacaagccccucgacauccccgaccaccaccggcagcugccgcaguucacgucccccgagcuggaggcccccuacagccgcgaggaggagcggcagcgccucuccgaccuguaccaccggcugcacgcccgccugcacagcaccucccggccccuccgccugaucuaccacguggccgagaaggagacccugcucgcgugggugaccagcaaguucgagcuguacacgugccugagcccgcucgucaccaaggccggcgccauccugguggugaccaagcugcuccggugggucaagaaggaggaggaccgccuguucauccgguacccgcccaaguacuccaccccgcccgccacgagcaccgaccaggccgcgcacaacgggcuguucaccggccucuga

SEQ ID NO: 33031 - RNA, 5028 nt, Artificial Sequence
  derived and/or modified sequence opt1 from MON2__Homo_sapiens__NP_001265398
augagcgggaccuccagccccgaggccgugaagaagcugcucgagaacaugcaguccgaccugcgggcccugagccucgagugcaagaagaaguucccgcccgugaaggaggcggccgaguccgggaucaucaaggugaagaccaucgccgcccggaacaccgagauccuggccgcgcugaaggagaacagcuccgaggugguccagcccuuccucaugggcugcgggaccaaggagcccaagaucacccagcugugccuggccgccauccagcgccucaugagccacgaggugguguccgagaccgccgcgggcaacaucaucaacaugcuguggcagcugauggagaacagccucgaggagcugaagcugcuccagacgguccuggugcugcucaccaccaacaccgugguccacgacgaggcccuguccaaggccaucgugcugugcuuccggcuccacuucacgaaggacaacaucaccaacaacaccgccgccgcgaccgugcgccaggucgugacgguggucuucgagcggaugguggccgaggacgagcgccaccgggacaucaucgagcagcccgugcugguccaggggaacagcaaccgccgguccgugagcacccugaagcccugcgccaaggacgccuacaugcuguuccaggaccugugccagcuggugaacgccgacgcgcccuacuggcucgucggcaugaccgagaugacccgcacguucggccuggagcugcucgaguccgugcugaacgacuucccccagguguuccugcagcaccaggaguucagcuuccuccugaaggagcgggucugcccccuggugaucaagcuguucucccccaacaucaaguuccgccaggggagcuccaccagcagcucccccgcccccgucgagaagccguacuuccccaucugcaugcggcugcugcgcguggugagcguccucaucaagcaguucuacucccugcuggugaccgagugcgagaucuuccucagccugcuggugaaguuccucgacgccgacaagccccaguggcugcgggccgucgccguggaguccauccaccgcuucugcgugcagccccagcugcuccggagcuucugccaguccuacgacaugaagcagcacagcaccaaggucuuccgcgacaucgugaacgcgcugggcuccuucauccagagccuguuccuggugccgcccacggggaaccccgccaccuccaaccaggccggcaacaacaaccucgggggcagcgucuccgcccccgccaacagcggcaugguggggaucggcgggggcgugacccugcugccggcguucgaguaccggggcaccuggauccccauccucacgaucaccguccagggguccgccaaggccaccuaccuggagaugcuggacaagguggagccgcccaccaucccggagggcuacgccaugagcguggcguuccacugccuccuggaccugguccgcgggaucacguccaugaucgagggcgagcucggggagcuggagaccgagugccagaccaccacggaggagggcagcucccccacccagagcaccgagcagcaggaccugcagagcaccuccgaccagauggacaaggagaucgugagccgggccgugugggaggagauggucaacgccugcuggugcggccuccuggccgcccugucccuccugcuggacgcgagcacggacgaggccgccaccgagaacauccucaaggccgagcugaccauggccgcgcugugcgggcgccucggccuggugaccucccgcgacgccuucaucaccgccaucugcaaggggagccugccgccccacuacgcccucacggugcugaacaccaccaccgccgcgacgcuguccaacaagagcuacuccguccagggccagagcgugaugaugaucuccccgagcuccgagagccaccagcaggucguggccguggggcagccccucgccgugcagccccagggcaccgucaugcugaccuccaagaacauccagugcaugcggacccugcucaaccuggcccacugccacggcgcggugcuggggacgagcuggcagcucgugcuggccacccugcagcaccucgucuggauccugggccugaagccguccagcgggggcgcccucaagcccgggcgcgccguggagggccccagcaccgugcugaccacggccgucaugaccgaccugcccgugaucuccaacauccucagccggcuguucgaguccagccaguaccuggacgacgugucccuccaccaccugaucaacgcgcugugcagccucucccuggaggccauggacauggccuacggcaacaacaaggagccgagccuguucgccgucgccaagcuccuggagaccgggcuggugaacaugcaccgcaucgagauccucuggcggccccugaccggccaccuccuggaggugugccagcaccccaacucccgcaugcgggaguggggcgcggaggcccugacgagccugaucaaggccggccucaccuucaaccacgacccgccccugucccagaaccagcgccugcagcuccugcugcucaacccccugaaggagaugagcaacaucaaccaccccgacauccggcugaagcagcucgagugcguccugcagauccugcagucccagggcgacagccucgggcccggcuggccccuggugcugggggugaugggcgccauccgcaacgaccagggggagucccucauccggaccgccuuccagugccugcagcuggucgugaccgacuuccuccccacgaugcccugcacgugccugcagaucguggucgacguggcgggcagcuucggccugcacaaccaggagcucaacaucucccugaccagcaucgggcugcucuggaacaucuccgacuacuucuuccagcgcggcgagaccaucgagaaggagcugaacaaggaggaggccgcccagcagaagcaggccgaggagaagggggugguccugaaccggcccuuccacccggcgccgcccuucgacugccucuggcugugccuguacgccaagcucggcgagcugugcguggacccccgcccggccguccgcaagagcgccgggcagacgcuguucagcaccaucggcgcccacggcacccuccugcagcacuccaccuggcacacggugaucuggaaggugcuguuccaccuccucgaccgcguccgggagagcuccaccaccgcggacaaggagaagaucgagagcgggggcgggaacauccugauccaccacucccgcgacaccgccgagaagcagugggccgagacgugggugcugacccucgccggcguggcccggaucuucaacacccgccgcuaccugcugcagccccucggggacuucagccgggcgugggacguccugcuggaccacauccaguccgccgcccucagcaagaacaacgaggugucccuggccgcccucaagagcuuccaggagauccuccagaucgugucccccguccgcgacagcgacaagcccgagaccccgcccguggugaacguccccgugccggugcugaucggccccaucuccggcaugagccggcccuucguccgcacggacuccaucggggagaagcugggccgguacagcuccagcgagcccccgaucgugaccgacgagcucgaggaccugaaccuguggugggcggccuggaacaccugguaccgcaucggguccgagagcaccaagccgcccaucaccuucgacaagcucacguucauccccagccagccguuccugaccgcccugauccagaucuuccccgcccucuaccagcacaucaagaccggcuucaacauggacgaccugcagaagcugggggugauccuccacuccgccaucagcguccccaucuccagcgacgcgucccccuucauccugccgagcuacaccgaggccgugcugacgucccuccaggaggccgugcugaccgcccuggacguccuccagaaggcgaucugcgugggccccgagaacaugcagaucauguaccccgccaucuucgaccagcugcuggccuucguggaguucagcugcaagcccccgcaguacggccagcucgagaccaagcacaucgccaacgccaaguacaaccagauccagcuguucgcgcccgccgagugggucgcccugaacuacgugcccuucgccgagcggucccucgagguggucguggaccuguaccagaagaccgccugccacaaggcgguggucaacgagaaggugcugcagaacaucaucaagacgcuccgcgugccccugagccugaaguacuccugcccgagcgaguccaccuggaagcucgccgucagcucccugcugcgggugcucagcaucgggcugcccguggcccgccagcacgccuccagcggcaaguucgacuccauguggcccgagcuggccaacaccuucgaggacuuccucuucaccaagagcaucccgcccgacaaccugagcauccaggaguuccagcggaacgagaacaucgacgucgagguggugcagcugaucuccaacgagauccuccccuacgcgaacuucauccccaaggaguucgucgggcagaucaugacgaugcugaacaagggcagcauccacucccagagcuccagcuucaccgaggccgagaucgacauccgccugcgggaggaguucuccaagaugugcuucgagacccuccugcaguucagcuucuccaacaaggugaccacgccccaggagggcuacaucagccgcauggcccuguccgugcuccugaagcggagccaggacguccugcaccgcuacaucgaggacgagcggcucuccgggaagugcccccugccccgccagcaggucaccgagaucaucuucgugcugaaggccgucagcacccucaucgacucccugaagaagacccagcccgagaacgcgugcaucagccuguucggcaucccgcccuacuucuga

SEQ ID NO: 33032 - RNA, 2820 nt, Artificial Sequence
  derived and/or modified sequence opt1 from MORC3__Homo_sapiens__NP_056173
auggccgcccagcccccgcgcggcauccggcugagcgcgcucugccccaaguuccugcacaccaacuccaccagccacacguggcccuucuccgccguggccgagcugaucgacaacgccuacgaccccgacgucaacgccaagcagaucuggaucgacaagaccgugaucaacgaccacaucugccucaccuucaccgacaacgggaacggcaugacgagcgacaagcugcacaagaugcuguccuucggguucagcgacaaggugaccaugaacggccacgucccgguggggcucuacggcaacggcuucaaguccgggagcaugcgccugggcaaggacgcgaucguguucaccaagaacggggaguccaugagcgucggccugcucucccagaccuaccuggaggugaucaaggccgagcacguggucgugcccaucguggccuucaacaagcaccggcagaugaucaaccuggccgagagcaaggcgucccucgccgccauccuggagcacagccuguucuccacggagcagaagcuccuggccgagcuggacgccaucaucgggaagaagggcacccgcaucaucaucuggaaccuccggagcuacaagaacgcgaccgaguucgacuucgagaaggacaaguacgacauccgcauccccgaggaccuggacgagaucaccggcaagaagggguacaagaagcaggagcggauggaccagaucgcccccgaguccgacuacagccugcgcgccuacugcuccauccucuaccugaagccgcggaugcagaucauccugcgcggccagaaggucaagacgcagcucgugagcaagagccuggccuacaucgagcgggacguguaccgccccaaguuccuguccaagaccguccggaucaccuucggguucaacugccgcaacaaggaccacuacggcaucaugauguaccaccggaaccgccucaucaaggccuacgagaaggugggcugccagcugcgggcgaacaacaugggggugggcgucguggggaucaucgagugcaacuuccugaagcccacccacaacaagcaggacuucgacuacacgaacgaguaccgccucaccaucaccgcccugggcgagaagcugaacgacuacuggaacgagaugaaggugaagaagaacaccgaguacccccucaaccugccggucgaggacauccagaagcggcccgaccagacgugggugcagugcgacgccugccugaaguggcgcaagcuccccgacgggauggaccagcugcccgagaagugguacugcagcaacaacccggacccccaguuccggaacugcgaggugcccgaggagcccgaggacgaggaccugguccacccgaccuacgagaagaccuacaagaagaccaacaaggagaaguuccgcauccgccagcccgagaugaucccccggaucaacgccgagcuccuguuccgccccacggcccuguccaccccgagcuucuccagccccaaggaguccgugccccggcgccaccucagcgagggcaccaacuccuacgcgacccggcugcugaacaaccaccaggugcccccgcagagcgagcccgaguccaacagccucaagcgccggcuguccacgcgcagcuccauccugaacgccaagaaccggcgccucagcucccaguucgagaacagcgucuacaagggcgacgacgacgacgaggacgugaucauccuggaggagaacuccacccccaagccggccgucgaccacgacaucgacaugaaguccgagcagagccacguggagcagggcggggugcaggucgaguucgugggggacagcgagcccugcggccagaccgggagcaccuccacgagcuccagccggugcgaccagggcaacaccgccgccacccagaccgaggugcccucccuggucgugaagaaggaggagacgguggaggacgagaucgacguccgcaacgacgcggugauccugcccagcugcguggaggccgaggccaagauccacgagacccaggagaccaccgacaaguccgccgacgacgcgggcugccagcuccaggagcugcggaaccagcugcuccuggucaccgaggagaaggagaacuacaagcgccagugccacauguucacggaccagaucaaggugcugcagcagcggauccucgagaugaacgacaaguacgugaagaaggagaccugccaccagagcaccgagaccgacgccgucuuccugcuggaguccaucaacggcaagagcgaguccccggaccacauggugagccaguaccagcaggcccucgaggagaucgagcgccugaagaagcagugcuccgcccugcagcacgugaaggccgagugcagccagugcuccaacaacgagagcaagagcgagauggacgagauggcgguccagcucgacgacguguuccggcagcuggacaagugcuccaucgagcgcgaccaguacaagagcgagguggagcugcucgagauggagaagucccagauccggagccagugcgaggagcugaagacggaggucgagcagcugaaguccaccaaccagcagaccgccaccgacgugagcacguccagcaacaucgaggaguccgugaaccacauggacggggagagccucaagcugcgcucccugcgcgucaacguggggcagcuccuggccaugaucgugcccgaccuggaccuccagcaggucaacuacgacguggacguggucgacgagauccugggccaggugguggagcagaugagcgagaucuccagcaccuga

SEQ ID NO: 33033 - RNA, 708 nt, Artificial Sequence
  derived and/or modified sequence opt1 from MORF4L1__Homo_sapiens__NP_001252534
augcgcggcgccgcccccgggaagaagaccagcggccugcagcagaagaacguggaggucaagaccaagaagaacaagcagaagacgcccgggaacggcgacgggggcuccaccagcgagacgccccagccgccccggaagaagcgcgcgcggguggaccccaccguggagaacgaggagaccuucaugaaccgcgucgaggugaaggugaagauccccgaggagcucaagcccuggcuggucgacgacugggaccugaucacccggcagaagcagcuguucuaccugcccgccaagaagaacguggacuccauccuggaggacuacgccaacuacaagaagucccgcggcaacaccgacaacaaggaguacgccgugaacgaggucguggccgggaucaaggaguacuucaacgugaugcucggcacccagcugcuguacaaguucgagcggccgcaguacgcggagauccucgccgaccaccccgacgcccccaugagccaggucuacggggcgccccaccuccugcgccucuucgugcggaucggcgccaugcuggccuacacgccgcuggacgagaagucccucgcccugcugcucaacuaccugcacgacuuccugaaguaccucgccaagaacagcgccacccuguucagcgcguccgacuacgagguggccccgcccgaguaccaccgcaaggccgucuga

SEQ ID NO: 33034 - RNA, 1053 nt, Artificial Sequence
  derived and/or modified sequence opt1 from MORN1__Homo_sapiens__NP_001287989
auggccgccgcgggcgaggggacccccagcucccgcggcccgcggcgcgacccgccccggcgcccgccccggaacggguacggcguguacgucuaccccaacagcuucuuccgcuacgagggggaguggaaggccggccggaagcacggccacgggaagcuccucuucaaggacggcuccuacuacgagggggccuucguggacggcgagaucaccggggagggccgccggcacugggccuggagcggcgacacguucuccgggcaguucgugcugggcgagccccagggguacggcgucauggaguacaaggccggcgggugcuacgagggcgaggugagccacgggaugcgcgagggccacggguuccugguggaccgggacggccaggucuaccagggcuccuuccacgacaacaagcgccacgggcccggccagaugcuguuccagaacggggacaaguacgacggcgacugggugcgggaccgccggcaggggcacggcgugcugcgcugcgcggacggcagcaccuacaaggggcaguggcacuccgacgucuucagcggccugggguccauggcccacugcagcggcgugaccuacuacgggcucuggaucaacggccaccccgccgagcaggccacccggaucgugauccugggccccgaggucauggagguggcgcaggggucccccuucagcgugaacguccagcugcuccaggaccacggcgagaucgccaaguccgagagcgggcgcgugcugcagaucuccgccggcgugcgguacguccagcugagcgccuacuccgaggugaacuucuucaagguggaccgcgacaaccaggagacgcucauccagacccccuucggcuucgagugcaucccguaccccgucagcagccccgccgcgggggugcccggcccgcgggccgccaagggcggggccgaggccgacgugccccugccccgcggggaccuggagcuccaccugggcgcgcugcacggccaggaggacacccccgggggccuccugggguccagccuguucuga

SEQ ID NO: 33035 - RNA, 240 nt, Artificial Sequence
  derived and/or modified sequence opt1 from MORN2__Homo_sapiens__NP_001138922
augaacggcuucgggcgccuggagcacuucagcggcgccguguacgaggggcaguucaaggacaacauguuccacggccucgggaccuacaccuuccccaacggcgccaaguacacgggcaacuucaacgagaaccgggucgagggggagggcgaguacaccgacauccaggggcuggagugguccggcaacuuccacuucaccgcggccccggaccugaagcucaagcugcacauguga

SEQ ID NO: 33036 - RNA, 486 nt, Artificial Sequence
  derived and/or modified sequence opt1 from MORN5__Homo_sapiens__NP_940871
auggaguacaccggcagcaaguacaucggggaguacguggacggccgcauggaggggaaggccaaguacauccugcccaccgagacgaucuacgucggcgagaugaaggacgggauguuccacggcgagggcacccucuacuucccguccgggagccaguacgacgccaucugggagaacggccuggcgaucaaggggaccuacaccuucuccgacggccugcacuacgacgagaagaacuggcacuacugcgacggguacgaccggcgcuucuacacggagauccucaacggccugaagcccgccggcauggcccagcugaccaacauggacccgccccggaagauccccaagggguacuacgacugcggcgacggguucuacaaccccgugacccgcguggucaaggacuaccggaaccgcuuccuccggaacgccgacgacgacgagcacgaguggaucacccgcacgugccggaagggcuga

SEQ ID NO: 33037 - RNA, 1041 nt, Artificial Sequence
  derived and/or modified sequence opt1 from MOS__Homo_sapiens__NP_005363
augcccagcccgcuggcccuccgccccuaccugcgguccgaguucagccccuccguggacgcccgccccugcagcuccccgagcgagcugcccgcgaagcuccugcugggcgccacccucccccgggcgccccgccugccgcggcgccuggccuggugcuccaucgacugggagcaggucugccuccugcagcggcugggggccggcggguucggcagcguguacaaggccaccuaccgcggggugcccgucgccaucaagcaggucaacaagugcacgaagaaccggcucgccucccgccggagcuucugggccgagcugaacguggcgcgccugcggcacgacaacaucgugcgcgugguggccgccuccacccggacccccgccggcagcaacucccucggcaccaucaucauggaguucgggggcaacgucacgcugcaccaggugaucuacggggccgcgggccaccccgagggggacgccggcgagccgcacugccgcaccggcgggcagcugagccucggcaagugccugaaguacucccuggacguggucaacgggcuccuguuccugcacagccaguccaucgugcaccucgaccugaagcccgccaacauccugaucagcgagcaggacgugugcaagaucuccgacuucggcugcagcgagaagcucgaggaccugcugugcuuccagacccccagcuacccccucggcgggaccuacacgcaccgggccccggagcugcugaagggcgagggggucacccccaaggccgacaucuacuccuucgcgaucacccucuggcagaugaccacgaagcaggcccccuacagcggcgagcgccagcacauccuguacgccgugguggccuacgaccugcggcccucccucagcgccgcggucuucgaggacucccugccggggcagcgccugggcgacgugauccagcggugcuggcgccccagcgccgcccagcgccccuccgcccggcuccugcugguggaccucaccagccugaaggccgagcugggcuga

SEQ ID NO: 33038 - RNA, 3498 nt, Artificial Sequence
  derived and/or modified sequence opt1 from MOV10L1__Homo_sapiens__NP_001157576
augcugagccucgccgccaagcugguggcguucuucuggcgcaccgccgacacgccccgggaggaggccggccagcuggagccggagcucgccgagggggacaccaagcugaagaccguccgcggcguggugacccgguacugcuccgacuacgggaugaucgacgacaugaucuacuucagcuccgacgccgucaccagccgcgugcugcucaacgugggccaggaggucaucgcggugguggaggagaacaaggucuccaacgggcugaaggccauccggguggaggccgugagcgacaagugggaggacgacucccgcaaccacggcagccccuccgacugcggcccccggguccugaucgggugcgugacgagccucguggagggcgccgggugcaucucccagaccaccuacuucagccuggaguccgucugcgagggcuucgagcccugcaagggggacuggguggaggcggaguaccgcauccggccgggcaccuggagcuccgaggccacgagcgugaagccccugcgcuacaagcgggucgacaaggugugcaucuccagccucugcggccgcaacggggugcuggaggaguccaucuucuucacccuggacagccucaagcugcccgacggcuacacgccccggcgcggggacgucgugaacgccguggucguggagagcucccagagcugcuacgucuggcgggcccugugcaugacccucgugaagcgccgggacgccgcgccggugcacgaggccacccacuucuacggcaccauccugcugaagaacaagggcgacaucgaggucacccaggugacccacuucgggacgcucaaggagggccgcuccaagaccauggugaucuggaucgagaacaagggggacaucccccagaaccuggucagcugcaagcuggccggcugggacaaguccaagcaguuccgguuccagaugcucgacaaggaccagaugugccccguggugagcuucgucuccgugcccgagaaggagaacagcuccgacgagaacaucaacagccugaacucccacaccaagaacaagaccagccagauguccgagagcucccuggugaacaaccgcgggaucagcccgggcgacugcacgugcaagggcgagaacggggagaaggacaacauccucucccggaagcagaugaccgagcccgagcccggcgggcuggugcccccgggcgggaagaccuucaucguggugaucugcgacggcaagaaccccggccgcugcaaggagcugcuccugcugugcuucagcgacuuccucaucgggcgcuaccuggaggucaacgugaucuccggcgaggagagccugaucgccgcccgggagcccuucagcuggaagaagcucaaguccagccaggcgcugaccuccgccaagacgaccguggucgugaccgcccagaagcgcaacagccggcgccagcugcccuccuuccucccgcaguaccccauccccgaccggcugcgcaagugcguggagcagaagaucgacauccugaccuuccagccccuccuggccgagcugcucaacaugagcaacuacaaggagaaguucuccacgcugcuguggcucgaggagaucuacgccgagauggagcugaaggaguacaacaugagcgggaucauccugcggcgcaacggcgaccugcucguccuggaggugccggggcuggcggagggccggcccucccucuacgccggcgacaagcugauccugaagacccaggaguacaacgggcacgccaucgaguacaucagcuacgugaccgagauccacgaggaggacgucacccucaagaucaaccccgaguucgagcaggccuacaacuucgagcccauggacguggaguucacguacaaccgcaccaccucccggcgcugccacuucgcccuggagcacgugauccaccugggcgucaagguccucuucccggaggagaucauccugcagagcccccaggugaccgggaacuggaaccacgcgcaggacacgaaguccagcggccaguccaccagcaagaagaaccggaagaccaugaccgaccaggccgagcacggcaccgaggagcgccgggucggggacaaggaccugcccgugcucgccccguucacggccgagauguccgacuggguggacgagauccagacccccaaggcgcgcaagauggaguucuucaaccccguccugaacgagaaccagaagcuggccgugaagcggauccucagcggcgacugccgcccccugccguacauccuguucgggccgcccggcaccgggaagaccgugacgaucaucgaggccguccuccaggugcacuucgcccugcccgacagccggauccuggugugcgcccccuccaacagcgcggccgaccucgucugccugcgccugcacgaguccaaggugcuccagcccgccaccauggugcgcgucaacgcgaccugccgguucgaggagaucgugaucgacgccgugaagcccuacugccgcgacggcgaggacaucuggaaggccagccgguuccgcaucaucaucaccacgugcuccagcuccggccuguucuaccagaucgggguccgggugggccacuucacccacguguucgucgacgaggccgggcaggccagcgagcccgagugccugaucccgcucggccugauguccgacaucagcgggcagaucgugcuggccggcgaccccaugcagcucggccccgugaucaagucccgccuggccauggcguacgggcugaacgucagcuuccucgagcggcugaugucccgccccgccuaccagcgggacgagaacgccuucggcgccugcggggcgcacaacccgcugcucgugaccaagcuggucaagaacuaccgcagccacgaggcccugcucaugcugcccucccggcuguucuaccaccgcgagcucgaggugugcgccgaccccaccguggucacgagccugcugggcugggagaagcuccccaagaagggguucccgcugaucuuccacggcgugcggggcuccgaggcccgcgagggcaagagccccuccugguucaaccccgccgaggcggugcagguccugcgguacugcugccuccuggcccacagcaucagcucccaggugagcgccuccgacaucggggugaucacccccuaccgcaagcaggucgagaagauccggauccugcuccgcaacguggaccugauggacaucaagguggggagcgucgaggaguuccagggccaggaguaccuggugaucaucaucuccaccgacccgugcuucggggcccuccuggaguacagcaucaccaacggcguguacaugggcugcgaccugccgcccgcccuccagucccugcagaacugcggggagggcgucgcggaccccagcuaccccguggugcccgaguccacggggcccgagaagcaccaggagccgagcuga

SEQ ID NO: 33039 - RNA, 201 nt, Artificial Sequence
  derived and/or modified sequence opt1 from MPC1__Homo_sapiens__NP_001257808
augaagaagucccccgagaucaucagcggccgcaugaccuucgcccugugcugcuacagccucaccuucaugcgguucgccuacaaggugcagccgcgcaacuggcugcuguucgcgugccacgccacgaacgaggucgcccagcucauccagggcgggcggcugaucaagcacgagaugaccaagaccgccuccgccuga

SEQ ID NO: 33040 - RNA, 384 nt, Artificial Sequence
  derived and/or modified sequence opt1 from MPC2__Homo_sapiens__NP_001137146
augagcgccgccggcgcgcgcgggcugcgggccaccuaccaccgccuccuggacaagguggagcugaugcuccccgagaagcugcggccgcuguacaaccaccccgccggcccccgcaccgucuucuucugggcccccaucaugaagugggggcucgugugcgccggccuggcggacauggcccggccggccgagaagcuguccacggcccagagcgcggugcucauggccaccggguucaucuggucccgcuacagccuggucaucauccccaagaacuggucccuguucgccgugaacuucuucgugggcgccgccggcgcgagccagcuguuccggaucuggcgcuacaaccaggagcucaaggccaaggcccacaaguga

SEQ ID NO: 33041 - RNA, 744 nt, Artificial Sequence
  derived and/or modified sequence opt1 from MPDU1__Homo_sapiens__NP_004861
auggccgccgaggcggacggcccccugaagcgccuccuggugcccauccugcuccccgagaagugcuacgaccagcuguucguccagugggaccugcuccacgugcccugccugaagauccugcucagcaaggggcugggccuggggaucguggccggcucccuccuggucaagcugccccagguguucaagauccucggggccaagagcgccgagggccugucccugcagagcgugaugcucgagcuggucgcccugaccggcaccaugguguacuccaucacgaacaacuucccguucagcuccuggggcgaggcgcuguuccugaugcugcagaccaucaccaucugcuuccucgugaugcacuaccgggggcagaccgucaaggggguggccuuccuggccugcuacggccuggugcuccugguccugcucagcccccugacgccccugaccguggugacccuccugcaggccuccaacguccccgcggugguggucgggcgccugcuccaggccgccaccaacuaccacaacggccacacgggccagcugagcgccaucaccguguuccuccucuucgggggcucccuggcccggaucuucaccagcauccaggagaccggggacccgcugauggcgggcacguucguggucuccagccucugcaacggccugaucgccgcccagcuccuguucuacuggaacgccaagccgccccacaagcagaagaaggcccaguga

SEQ ID NO: 33042 - RNA, 6114 nt, Artificial Sequence
  derived and/or modified sequence opt1 from MPDZ__Homo_sapiens__NP_001248335
augcuggaggccaucgacaagaaccgcgcccuccacgccgccgagcggcugcagaccaagcugcgcgagcggggcgacguggccaacgaggacaagcucagccugcugaaguccgugcuccagagcccccuguucucccagauccugagccuccagaccuccgugcagcagcugaaggaccaggugaacaucgccaccagcgccaccuccaacaucgaguacgcgcacgugccgcaccugagccccgccgugauccccacccuccagaacgaguccuuccugcugagccccaacaacgggaaccucgaggcccugaccggccccgggaucccccacaucaacggcaagcccgccugcgacgaguucgaccagcugaucaagaacauggcgcaggggcgccacguggaggucuucgagcuccugaagcccccguccggcggccugggguucagcguggugggccuccgguccgagaaccgcggggagcugggcaucuucguccaggagauccaggaggggagcguggcccaccgggacggccgccugaaggagacggaccagauccucgccaucaacggccaggcccuggaccagaccaucacccaccagcaggccaucuccauccugcagaaggcgaaggacaccgugcagcucgucaucgcccgggggagccugccccagcuggugucccccaucgugagccgcucccccagcgccgccagcacgaucuccgcccacagcaacccgguccacuggcagcacauggagaccaucgagcucgugaacgacggcuccgggcugggcuucggcaucaucgggggcaaggcgaccggggugaucgucaagaccauccugcccggcgggguggccgaccagcacggccggcucugcagcggcgaccacauccugaagaucggggacacggaccuggccggcauguccagcgagcaggucgcccagguccuccgccagugcgggaaccgggugaagcugaugaucgcccgcggcgcgaucgaggagcggaccgcccccaccgcccuggggaucacccucuccagcucccccacgagcaccccggagcugcgcguggacgccuccacccagaagggcgaggagagcgagaccuucgacgucgagcugacgaagaacgugcagggccucgggaucaccaucgccggcuacaucggggacaagaagcuggagcccuccggcaucuucgucaagagcaucaccaaguccagcgcgguggagcacgacgggcggauccagaucggcgaccagaucaucgccguggacggcaccaaccugcagggguucacgaaccagcaggccgucgaggugcuccgccacaccggccagaccgugcugcugacccucaugcggcgcgggaugaagcaggaggccgagcugaugucccgggaggacgucacgaaggacgcggaccugagccccgugaacgccuccaucaucaaggagaacuacgagaaggacgaggacuuccugagcagcacccgcaacaccaacauccuccccaccgaggaggagggcuacccgcugcuguccgccgagaucgaggagaucgaggacgcccagaagcaggaggccgcgcuccugacgaaguggcagcgcaucaugggcaucaacuacgagaucguggucgcccacgugagcaaguucuccgagaacagcgggcugggcaucucccucgaggccaccguggggcaccacuucauccggagcguccugcccgagggccccguggggcacuccggcaagcuguucagcggcgacgagcuccuggaggugaacgggaucacccugcucggcgagaaccaccaggacgucgugaacauccugaaggagcugcccaucgaggugaccauggucugcugccgccggacggugccgcccaccacccaguccgagcucgacagccuggaccugugcgacaucgagcucaccgagaagccccacguggaccugggggaguucaucggcuccagcgagaccgaggaccccguccuggccaugacggacgccgggcaguccaccgaggaggugcaggcgccgcucgccaugugggaggccggcauccagcacaucgagcuggagaagggcagcaaggggcugggcuucuccauccucgacuaccaggaccccaucgaccccgccagcaccgugaucaucauccgcucccugguccccggcgggaucgccgagaaggacgggcggcugcuccccggcgaccgccugauguucgugaacgacgugaaccuggagaacagcagccucgaggaggcggucgaggcccugaagggcgcccccuccgggaccgugcggaucggcguggccaagccccugccgcucagccccgaggagggguacgucuccgcgaaggaggacagcuuccuguacccgccccacuccugcgaggaggccggccuggccgacaagccccuguuccgcgccgaccuggcccugguggggacgaacgacgcggaccucguggacgagagcaccuucgagucccccuacagccccgagaacgacuccaucuacagcacccaggccuccauccugagccugcacggcuccagcugcggcgacgggcucaacuacggcuccagccugcccuccagcccgcccaaggacgucaucgagaacuccugcgaccccgugcuggaccuccacaugagccuggaggagcuguacacccagaaccuccugcagcggcaggacgagaacacgcccagcguggacaucuccauggggccggccagcggcuucaccaucaacgacuacacccccgccaacgccaucgagcagcaguacgagugcgagaacaccaucgucuggacggagucccaccuccccagcgaggugaucuccagcgcggagcuccccuccgugcugccggacagcgccggcaagggguccgaguaccugcucgagcagagcucccuggccugcaacgccgagugcgucaugcugcagaacgugagcaaggaguccuucgagcgcaccaucaacaucgccaagggcaacagcucccucgggaugaccgugagcgcgaacaaggacggccuggggaugaucguccgguccaucauccacggcggcgccaucagccgcgacgggcggaucgccaucggcgacugcauccuguccaucaacgaggagagcaccaucagcgugacgaacgcccaggcgcgcgccaugcuccggcgccacucccugaucgggcccgacaucaagaucaccuacgugcccgccgagcaccuggaggaguucaagaucagccucggccagcaguccgggcgggucauggcccuggacaucuucagcuccuacaccggccgcgacauccccgagcugccggagcgggaggagggcgagggggaggagagcgagcuccagaacaccgccuacuccaacuggaaccagccccgccgcguggagcuguggcgggagcccagcaagucccugggcaucagcaucgucgggggccgcgggaugggcucccggcucagcaacggcgaggucaugcgcgggaucuucaucaagcacgugcuggaggacuccccggcgggcaagaacgggacgcugaagcccggcgaccggaucguggaggucgacggcauggaccuccgcgacgccagccacgagcaggccguggaggccauccggaaggccgggaaccccgucguguucauggugcaguccaucaucaaccgcccccgggcgccgagccaguccgagagcgagcccgagaaggcgccccugugcuccgugcccccgcccccgcccagcgccuucgccgagaugggcagcgaccacacccaguccagcgccuccaagaucagccaggacguggacaaggaggacgaguucggguacuccuggaagaacauccgcgagcgguacggcacccugaccggggagcuccacaugaucgagcuggagaagggccacagcggccuggggcucucccuggcgggcaacaaggaccgcagccggauguccguguucaucgucgggaucgacccgaacggcgccgccgggaaggacggccgccugcagaucgccgacgagcuccuggagaucaacggccagauccuguacgggcggagccaccagaacgccuccagcaucaucaagugcgcgcccuccaaggugaagaucaucuucauccgcaacaaggacgccgugaaccagauggccgucugccccggcaacgccguggagccccucccgagcaacuccgagaaccugcagaacaaggagacggagcccaccgugaccaccagcgacgcggccgucgaccuguccagcuucaagaacgugcagcaccucgagcugcccaaggaccagggcggccuggggaucgccaucuccgaggaggacacgcucagcggcgugaucaucaagagccugaccgagcacggcgucgccgccaccgacgggcggcugaaggugggcgaccagauccucgcgguggacgacgagaucgucgugggguaccccaucgagaaguucaucucccugcugaagaccgccaagaugacggugaagcugaccauccacgccgagaacccggacagccaggccguccccuccgccgcgggcgccgccagcggggagaagaagaacuccagccagucccucauggugccccagagcggcucccccgagccggagagcauccgcaacaccucccggagcuccacccccgccaucuucgccagcgaccccgcgacgugccccaucaucccgggcugcgagaccaccaucgagaucuccaaggggcgcaccggccuggggcugagcaucgugggcggcuccgacacccuccugggggccaucaucauccacgaggucuacgaggagggcgccgccugcaaggacgggcggcugugggcgggcgaccagauccucgaggugaacgggaucgaccugcgcaaggccacgcacgacgaggccaucaacgugcugcgccagacgccccagcggguccgccucacccuguaccgggacgaggcccccuacaaggaggaggaggugugcgacacccugacgaucgagcuccagaagaagccgggcaagggccuggggcugagcaucgugggcaagcgcaacgacaccggggucuucguguccgacaucgugaagggcgggaucgccgacgcggacggccggcucaugcagggcgaccagauccugauggucaacggggaggacgugcgcaacgccacccaggaggccguggccgcccugcucaagugcagccugggcaccgucacgcuggagguggggcggaucaaggcgggccccuuccacagcgagcgccggcccucccagagcucccaggugagcgaggggucccucagcuccuucaccuucccccugagcggcuccagcaccuccgagagccuggaguccagcuccaagaagaacgcccucgccagcgagauccagggccugcgcaccgucgagaugaagaaggggccgacggacucccugggcaucagcaucgccgggggcguggggagcccccucggcgacgugcccaucuucaucgccaugaugcaccccaccggcgucgcggcccagacccagaagcugcgggugggggaccgcaucgugaccaucugcggcacguccaccgaggggaugacccacacccaggccgucaaccugcucaagaacgccagcggcuccaucgagaugcaggucguggcgggcggggacgucagcguggugacgggccaccagcaggagccggccuccagcucccugagcuucaccgggcugaccuccagcuccaucuuccaggacgaccucgggccgccccagugcaagagcaucacccuggagcgggggcccgacggccugggcuucuccaucgucgggggcuacgggagcccgcacggcgaccuccccaucuacgugaagacggucuucgccaagggggccgccuccgaggacggccgccugaagcggggcgaccagaucaucgcggugaacgggcagagccuggagggcgugacccacgaggaggccgucgccauccucaagcgcaccaaggggaccgugacgcugauggugcuguccuga

SEQ ID NO: 33043 - RNA, 2151 nt, Artificial Sequence
  derived and/or modified sequence opt1 from MPEG1__Homo_sapiens__NP_001034485
augaacaacuuccgcgccaccauccuguucugggccgcggccgccugggccaagagcggcaagcccuccggggagauggacgaggugggcguccagaagugcaagaacgcccucaagcugccggugcuggaggugcuccccgggggcgggugggacaaccugcggaacgucgacaugggccgcgugauggagcugaccuacagcaacugccggacgaccgaggacggccaguacaucauccccgacgagaucuucaccaucccccagaagcaguccaaccucgagaugaacagcgagauccuggaguccugggcgaacuaccagagcuccaccagcuacuccaucaacacggagcugagccucuucuccaaggugaacgggaaguucagcaccgaguuccagcgcaugaagacccugcaggucaaggaccaggccaucaccacgcggguccaggugcgcaaccugguguacaccgugaagaucaacccgacccucgagcuguccagcggcuuccggaaggagcugcucgacaucuccgaccgccuggagaacaaccagacccggauggccacguaccuggccgagcuccuggugcugaacuacgggacccacgucaccaccagcguggacgcgggcgccgcccucauccaggaggaccaccuccgcgccuccuuccugcaggacagccaguccagccggagcgccgugacggcguccgccgggcuggccuuccagaacaccgucaacuucaaguucgaggagaacuacaccagccagaacgugcugaccaaguccuaccugagcaaccgcacgaacucccgggugcagagcaucggcggcguccccuucuaccccgggaucacccuccaggccuggcagcagggcaucaccaaccaccugguggccaucgaccgcuccgggcugccccuccacuucuucaucaacccgaacaugcugcccgaccugcccggcccccucgugaagaaggucagcaagaccguggagacggcggugaagcgguacuacaccuucaacaccuacccgggcugcaccgaccugaacucccccaacuucaacuuccaggccaacacggacgacgggagcugcgagggcaagaugaccaacuucuccuucgggggcgucuaccaggagugcacccagcugagcgggaaccgcgacgugcuccugugccagaagcuggagcagaagaacccccucaccggcgacuucuccugccccagcggcuacuccccgguccaccuccugagccagauccacgaggagggguacaaccaccuggagugccaccggaagugcacgcugcugguguucugcaagaccgugugcgaggacgucuuccagguggccaaggccgaguuccgcgccuucuggugcguggcguccagccagguccccgagaacuccggccuccuguucgggggccuguucagcagcaaguccaucaaccccaugaccaacgcccagagcugccccgccggguacuucccgcuccggcuguucgagaaccugaaggugugcgugucccaggacuacgagcugggcagccgcuucgccguccccuucggcggguucuucuccugcaccgugggcaacccccucguggaccccgccaucagccgggaccugggggcgccgucccugaagaagugccccggcggguucagccagcaccccgcccucaucuccgacggcugccaggucagcuacugcgugaaguccggccuguucaccgggggcagccugcccccggcccgccucccgcccuucacgcgcccgccccugaugucccaggccgcgaccaacaccgugaucgucaccaacagcgagaacgcccgguccuggaucaaggacagccagacgcaccaguggcgccugggggagcccaucgagcuccggcgcgccaugaacgugauccacggcgacggcgggggccuguccgggggcgccgccgcgggggugaccgucggcgugaccaccauccuggccguggucaucacgcucgccaucuacggcacccggaaguucaagaagaaggccuaccaggccaucgaggagcgccagagccuggugcccgggaccgcggccaccggcgacacgaccuaccaggagcaggggcagagccccgccuga

SEQ ID NO: 33044 - RNA, 882 nt, Artificial Sequence
  derived and/or modified sequence opt1 from MPG__Homo_sapiens__NP_001015052
augcccgcccgcagcggcgcccaguucugccggcgcauggggcagaagaagcagcggccggcgcgcgccggccagccccacuccagcuccgacgccgcccaggcccccgcggagcagccccacagcuccagcgacgccgcccaggccccgugcccccgggagcgcugccuggggccgcccaccacccccggccccuaccgguccaucuacuucagcucccccaaggggcaccucacgcgccugggccuggaguucuucgaccagcccgcggugccgcucgcccgggccuuccugggccagguccuggugcgccggcuccccaacgggaccgagcugcgcggccggaucguggagaccgaggccuaccuggggcccgaggacgaggccgcgcacagccgcggcgggcggcagacgccccgcaaccggggcauguucaugaagccgggcacccucuacgucuacaucaucuacgggauguacuucugcaugaacaucuccagccagggcgacggggccugcgugcugcugcgcgcccucgagccccuggagggccuggagaccaugcggcagcuccgcuccacccugcggaagggcaccgccagccgcgugcugaaggaccgcgagcucugcuccgggcccagcaagcugugccaggcccuggcgaucaacaaguccuucgaccagcgggaccucgcccaggacgaggccgucuggcuggagcgcggcccccuggagccgagcgagcccgccgugguggccgcggcccgggucggggugggccacgccggggagugggcccgcaagccccuccgguucuacgugcgcggcucccccugggucagcgugguggaccgggucgccgagcaggacacgcaggcguga

SEQ ID NO: 33045 - RNA, 2046 nt, Artificial Sequence
  derived and/or modified sequence opt1 from MPHOSPH10__Homo_sapiens__NP_005782
auggcgccccagguguggcgccggcgcacccuggagcggugccucaccgaggucggcaaggccacggggcgcccggagugcuuccugaccauccaggagggccuggccagcaaguucaccucccucaccaaggugcuguacgacuucaacaagauccuggagaacgggcggauccacggcagcccccuccagaagcuggugaucgagaacuucgacgacgagcagaucuggcagcagcuggagcuccagaacgagcccauccugcaguacuuccagaacgccgucuccgagacgaucaacgacgaggacaucagccugcuccccgaguccgaggagcaggagcgcgaggaggacgggagcgagaucgaggccgacgacaaggaggaccuggaggaccuggaggaggaggagguguccgacaugggcaacgacgacccggagaugggcgagcgggccgagaacagcuccaagagcgaccuccgcaagucccccguguucagcgacgaggacuccgaccuggacuucgacaucagcaagcuggagcagcaguccaagguccagaacaaggggcagggcaagccccgggagaaguccaucguggacgacaaguucuucaagcucagcgagauggaggccuaccuggagaacaucgagaaggaggaggagcgcaaggacgacaacgacgaggaggaggaggacaucgacuucuucgaggacaucgacagcgacgaggacgagggcgggcuguucggguccaagaagcucaagagcggcaagagcucccggaaccugaaguacaaggacuucuucgaccccguggagagcgacgaggacaucaccaacguccacgacgacgagcuggacuccaacaaggaggacgacgagaucgcggaggaggaggccgaggagcucagcaucuccgagaccgacgaggacgacgaccugcaggagaacgaggacaacaagcagcacaaggagagccugaagcgcgugaccuucgcccucccggacgacgccgagacggaggacaccggcgugcugaacgucaagaagaacuccgacgaggucaagagcuccuucgagaagcggcaggagaagaugaacgagaagaucgcgagccuggagaaggagcuccuggagaagaagcccuggcagcugcagggggaggugaccgcccagaagcgccccgagaacucccuccuggaggagacccugcacuucgaccacgccgugcggauggcccccgugaucacggaggagaccacccuccagcuggaggacaucaucaagcagcgcauccgggaccaggccugggacgacgugguccgcaaggagaagccgaaggaggacgcguacgaguacaagaagcggcugacccucgaccacgagaaguccaagcugagccuggccgagaucuacgagcaggaguacaucaagcucaaccagcagaagacggccgaggaggagaaccccgagcacguggagauccagaagaugauggacagccuguuccugaagcucgacgcccuguccaacuuccacuucauccccaagcccccggugcccgagaucaaggucgugagcaaccugcccgccaucaccauggaggagguggcgcccgucuccgugagcgacgccgcccuccuggccccggaggagaucaaggagaagaacaaggccggcgacaucaagaccgcggccgagaagaccgccacggacaagaagcgcgagcggcgcaagaagaaguaccagaagcgcaugaagaucaaggagaaggagaagcggcgcaagcugcuggagaaguccagcgucgaccaggccgggaaguacagcaagaccguggccuccgagaagcucaagcagcugaccaagaccggcaaggcgagcuucaucaaggacgagggcaaggacaaggcccugaaguccagccaggccuucuucuccaagcuccaggaccaggugaagaugcagaucaacgacgccaagaagacggagaagaagaagaagaagcggcaggacaucagcguccacaagcugaagcuguga

SEQ ID NO: 33046 - RNA, 483 nt, Artificial Sequence
  derived and/or modified sequence opt1 from MPHOSPH6__Homo_sapiens__NP_005783
auggccgccgagcgcaagacccggcugagcaagaaccuccugcgcaugaaguucaugcagcggggccuggacuccgagaccaagaagcagcucgaggaggaggagaagaagaucaucagcgaggagcacugguaccuggaccugcccgagcucaaggagaaggaguccuucaucaucgaggagcagagcuuccugcugugcgaggaccuccuguacgggcgcauguccuuccggggcuucaacccggagguggagaagcugaugcuccagaugaacgcgaagcacaaggccgaggaggucgaggacgagacgguggagcuggacgugagcgacgaggagauggcccgccgguacgagacccuggucgggaccaucggcaagaaguucgcccgcaagcgggaccacgccaacuacgaggaggacgagaacggggacaucacccccaucaaggcgaagaagauguuccucaagccccaggacuga

SEQ ID NO: 33047 - RNA, 2583 nt, Artificial Sequence
  derived and/or modified sequence opt1 from MPHOSPH8__Homo_sapiens__NP_059990
auggagcaggucgccgagggcgcccgcgugaccgcggugcccgugagcgccgccgacuccaccgaggagcuggccgaggucgaggagggggugggcguggucggggaggacaacgacgccgcggcccggggcgccgaggccuucggggacagcgaggaggacggcgaggacguguucgagguggagaagauccucgacaugaagacggagggcgggaagguccuguacaaggugcgcuggaagggcuacaccuccgacgacgacaccugggagccggagauccaccuggaggacugcaaggaggugcuccuggaguuccggaagaagaucgcggagaacaaggccaaggccguccgcaaggacauccagcggcugagccucaacaacgacaucuucgaggccaacuccgacagcgaccagcaguccgagaccaaggaggacacgagccccaagaagaagaagaagaagcugcgccagcgggaggagaagucccccgacgaccugaagaagaagaaggccaaggcggggaagcucaaggacaagagcaagcccgaccuggaguccagccuggagucccucguguucgaccugcgcaccaagaagcggaucagcgaggccaaggaggagcugaaggaguccaagaagccgaagaaggacgaggugaaggagaccaaggagcucaagaaggucaagaagggcgagauccgcgaccugaagaccaagacgcgggaggaccccaaggagaaccgcaagaccaagaaggagaaguucguggagagccagguggaguccgagagcuccguccugaacgacagccccuuccccgaggacgacagcgaggggcuccacuccgacagccgggaggagaagcagaacaccaaguccgcccgcgagcgggccggccaggacaugggccuggagcacggguucgagaagccgcuggacagcgccauguccgcggaggaggacaccgacgugcgcggccggcgcaagaagaagacgccccggaaggccgaggacacccgcgagaaccggaagcucgagaacaagaacgccuuccuggagaagaagaccgugcccaagaagcagcgcaaccaggaccgcagcaaguccgccgccgagcuggagaagcucaugcccgucagcgcgcagaccccgaaggggcggcgccuguccggcgaggagcggggccuguggagcacggacuccgccgaggaggacaaggagaccaagcgcaacgagagcaaggagaaguaccagaagcggcacgacuccgacaaggaggagaaggggcgcaaggagcccaagggccucaagacccugaaggagauccggaacgccuucgaccuguucaagcucacccccgaggagaagaacgacgugagcgagaacaaccgcaagcgggaggagaucccccuggacuucaagacgaucgacgaccacaagaccaaggagaacaagcagucccugaaggagcgccggaacacccgcgacgagaccgacacgugggccuacaucgccgcggagggggaccaggaggugcucgacagcgucugccaggccgacgagaacuccgacggccggcagcagauccugagccuggggauggaccuccagcuggaguggaugaagcuggaggacuuccagaagcaccucgacggcaaggacgagaacuucgccgccaccgacgcgaucccguccaacgugcugcgcgacgccgucaagaacggcgacuacaucaccgugaagguggcccugaacagcaacgaggaguacaaccucgaccaggaggacagcuccgggaugacccuggucaugcuggccgccgcgggcgggcaggacgaccuccugcggcugcucaucacgaagggcgccaaggugaacgggcgccagaagaacggcaccaccgcccugauccacgccgccgagaagaacuuccugaccacgguggcgauccugcucgaggccggcgccuucgucaacgugcagcagagcaacggggagaccgcccugaugaaggccugcaagcggggcaacuccgacaucgugcgccuggucaucgagugcggggcggacugcaacauccucagcaagcaccagaacuccgcccugcacuucgccaagcagagcaacaacgugcugguguacgaccuccugaagaaccaccuggagacccucucccgggucgccgaggagaccaucaaggacuacuucgaggcgcgccuggcccugcucgagcccguguuccccaucgccugccaccgccugugcgagggccccgacuucagcacggacuucaacuacaagccgccccagaacauccccgagggguccggcauccuccucuucaucuuccacgccaacuuccugggcaaggaggugaucgcccggcugugcgggcccugcagcguccaggcgguggugcucaacgacaaguuccagcugccggucuuccuggacucccacuucguguacagcuucucccccguggccggccccaacaagcuguucauccgccugaccgaggcccccagcgccaaggucaagcugcucaucggggccuaccgggugcagcugcaguga

SEQ ID NO: 33048 - RNA, 3552 nt, Artificial Sequence
  derived and/or modified sequence opt1 from MPHOSPH9__Homo_sapiens__NP_073619
auggaggaguucgaccuggugaagacccuccacaagaccagcuccagcgucggcuccgacgagaacagccugcacucccuggggcucaaccugaacacggaccgcagcagcccccaccugagcaccaacggcguguccagcuucuccgggaagacccggccgagcgugauccagggcaccgucgaggugcucacgucccugaugcaggagcugcagaacagcgggaagaccgacuccgagcucuggaagaacugcgagacccgcuggcugcagcuguucaaccucguggagaagcagugccaggagcagaucgucgcccagcaggagcaguuccacaaccagauccagcacauccaggaggagaucaagaaccuggugaagcugcagaccagcuccgccagccucgcguccugcgagggcaacagcagcaacaagcaggucuccagcgagucccagaugggcuucuucagccuguccagcgagcggaacgaguccgugauccacuaccccgagagcacggagcccgagauccagcaggagauguccaccagccagcccgacugcaacguggacuccugcagcguguccagcggguacggcaccuucugcaucuccgagcugaaccucuacaagagcaaggacccgaaggaguucauggagcacaucgacguccccaaggggcaguacguggcccccgccgugcccgccgagucccuggucgacggcgugaagaacgagaacuucuacauccagaccccggaggagugccacgugagccugaaggaggacgucuccaucagccccggggaguucgagcacaacuuccucggcgagaacaaggugagcgagguguacuccggcaagacgaacagcaacgccaucaccuccugggcgcagaagcugaagcagaaccagcccaagcgcgcccacgucgaggacgggggcagccgguccaagcaggggaacgagcagagcaagaagacccccaucgagaaguccgacuucgccgccgcgacccacccgcgcgccuucuaccugagcaagcccgacgagacgcccaacgccuggauguccgacagcggcaccggccucaccuacuggaagcuggaggagaaggacaugcaccacucccugcccgagacccucgagaagacguucaucagccuguccagcaccgacguguccccgaaccagagcaacaccuccaacgagaugaagcugcccagccucaaggacaucuacuacaagaagcagcgggagaacaagcagcugcccgagcgcaaccugaccagcgccuccaaccccaaccacccgcccgaggugcucacgcuggaccccacccugcacaugaagcccaagcagcagaucagcgggauccagccgcacggccuccccaacgcccuggacgaccggaucuccuucagccccgacuccguccuggagcccagcauguccagcccguccgacaucgacagcuucucccaggcgagcaacgugaccucccagcuccccggguuccccaaguacccgagccacaccaaggccucccccgucgacagcuggaagaaccagacguuccagaacgagucccgcaccagcuccaccuuccccagcguguacaccaucacgagcaacgacaucuccgugaacaccgucgacgaggagaacaccgugaugguggccagcgccuccgucagccagucccagcugcccggcaccgccaacagcgugccggagugcaucucccugacgagccucgaggaccccgugauccuguccaagauccggcagaaccugaaggagaagcacgcgcgccacaucgccgaccuccgggccuacuacgagagcgagaucaacucccugaagcagaagcuggaggccaaggagaucagcggggucgaggacuggaagaucaccaaccagauccucguggaccgcugcggccagcuggacuccgcccugcacgaggcgaccagccgggugcgcacccuggagaacaagaacaaccuccuggagaucgaggucaacgaccugcgggagcgcuucuccgccgccagcuccgccagcaagauccuccaggagcggaucgaggagaugcgcaccuccagcaaggagaaggacaacacgaucauccggcugaagucccgccugcaggaccucgaggaggccuucgagaacgcguacaagcuguccgacgacaaggaggcccagcugaagcaggagaacaagauguuccaggaccuccugggcgaguacgagagccuggggaaggagcaccgccgggugaaggacgcccucaacaccaccgagaacaagcugcuggacgccuacacccagaucuccgaccucaagcgcaugaucagcaagcuggaggcccaggugaagcaggucgagcacgagaacaugcugucccuccggcacaacagccgcauccacgugcggcccucccgcgcgaacacgcuggccaccagcgacgugucccggcgcaaguggcugauccccggcgccgaguacagcaucuucaccgggcagccgcucgacacccaggacuccaacgucgacaaccagcuggaggagacgugcagccugggccaccggagcccccucgagaaggacagcucccccgggagcuccagcaccucccugcugaucaagaagcagcgcgagaccagcgacacccccaucaugcgggcccucaaggagcuggacgagggcaagaucuucaagaacuggggcacgcagaccgagaaggaggacaccagcaacaucaacccgcgccagaccgagacguccgugaacgcgagccggucccccgagaagugcgcccagcagcgccagaagcggcugaacagcgccucccagcgcagcuccagccucccgcccuccaaccggaaguccuccacccccaccaagcgcgagaucaugcugacccccgugacggucgccuacagccccaagcggucccccaaggagaaccugagcccgggguucucccaccuccugagcaagaacgaguccagccccauccgcuucgacauccugcucgacgaccuggacaccgugcccguguccacccugcagcgcaccaacccccggaagcagcuccaguuccugccgcuggacgacagcgaggagaagacguacagcgagaaggccaccgacaaccacgucaaccacuccagcugccccgagcccgugccgaacggcgugaagaaggucuccgugcgcaccgcgugggagaagaacaagagcguguccuacgagcagugcaagcccgucagcgugacgccccaggggaacgacuucgaguacaccgccaagauccggacccucgccgagaccgagcgcuucuucgacgagcugaccaaggagaaggaccagaucgaggccgcccugucccggaugcccagcccgggcgggcgcaucacgcuccagacccggcugaaccaggaggcgcuggaggaccgccucgagcggaucaaccgcgagcugggcuccgugcggaugacccugaagaaguuccacguccuccgcaccagcgccaaccuguga

SEQ ID NO: 33049 - RNA, 864 nt, Artificial Sequence
  derived and/or modified sequence opt1 from MPI__Homo_sapiens__NP_001276084
auggccgcgccccgcguguucccgcugagcugcgccguccagcaguacgccuggggcaagaugggguccaacagcgagguggcccggcuccuggccuccagcgacccccuggcccagaucgcggaggacaagcccuacgccgagcucuggaugggcacccacccccgcggggacgccaagauccuggacaaccggaucucccagaagacccugagccaguggaucgccgagaaccaggacucccucggcagcaaggugaaggacacguucaacgggaaccugccguuccuguucaagguccucuccguggagacgccccugagcauccaggcgcaccccaacaaggagcuggccgagaagcuccaccuccaggcgccccagcacuacccggacgccaaccacaagcccgagauggccaucgcccugacccccuuccagggccugugcggcuuccgccccguggaggagaucgucaccuuccugaagaaggugccggaguuccaguuccugaucggggacgaggccgccacccaccucaagcagaccaugucccacgacagccaggccguggccuccagccugcaguccugcuucagccaccugaugaaguccgagaagaaggucgugguggagcagcucaaccugcuggucaagcggaucagccagcaggcggccgccggcaacaacauggaggacaucuucggggagcuccugcugcagcuccaccagcaguaccccggcgacaucgggugcuucgccaucuacuuccugaaccugcucacccugaagcccggcgaggccauguuccuggaggcgaacgugccccacgccuaccucaagggcgggccguggcugugccacuga

SEQ ID NO: 33050 - RNA, 540 nt, Artificial Sequence
  derived and/or modified sequence opt1 from MPLKIP__Homo_sapiens__NP_619646
augcagcgccagaacuuccggcccccgaccccgcccuaccccggccccgggggcgggggcugggggagcggcuccagcuuccgcggcacccccgggggcgggggcccccggcccccgagcccccgcgacggguacggcagcccccaccacacgcccccguacggcccccggucccgccccuacggguccucccacagcccgcggcacggcggguccuuccccggcggccgcuucgggagccccucccccggcggguaccccggcagcuacucccggagcccggccgggucccagcagcaguucggcuacagccccggccagcagcagacccacccccaggggagcccccgcaccuccaccccguucggcuccgggcgggugcgcgagaagcggaugagcaacgagcuggagaacuacuucaagcccagcaugcucgaggaccccugggccggccuggagcccgucuccgugguggacaucagccagcaguacuccaacacgcagaccuucaccgggaagaagggccgcuacuucugcuga

SEQ ID NO: 33051 - RNA, 2238 nt, Artificial Sequence
  derived and/or modified sequence opt1 from MPO__Homo_sapiens__NP_000241
augggcgugcccuucuucagcucccugcgcugcauggucgaccucgggccgugcugggccggcgggcugaccgccgagaugaagcugcuccuggcgcuggccggccuccuggccauccuggccacgccccagcccagcgagggggccgcgcccgccgugcucggcgagguggacaccucccugguccugagcuccauggaggaggccaagcagcucguggacaaggccuacaaggagcggcgcgagagcaucaagcagcggcugcgcuccggcagcgcguccccgauggagcugcucagcuacuucaagcagcccguggccgccacccggaccgccguccgcgccgcggacuaccugcacguggcccuggaccuccuggagcggaagcugcgcucccucuggcggcgccccuucaacgugaccgacguccugacgcccgcccagcugaacgugcucagcaaguccagcgggugcgccuaccaggacgugggcgugaccugcccggagcaggacaaguaccggaccaucaccgggaugugcaacaaccgccggucccccacgcugggcgccagcaaccgcgcguucgugcgguggcugcccgccgaguacgaggacggguucucccuccccuacggcuggaccccgggcgugaagcgcaacggguuccccgucgcccuggcccgggccgugagcaacgagaucgugcgcuuccccaccgaccagcugacccccgaccaggagcggucccucauguucaugcaguggggccagcugcuggaccacgaccucgacuucacgccggagcccgcggcccgcgccagcuucgucaccggggugaacugcgagaccagcugcgugcagcagccgcccugcuucccccugaagaucccgcccaacgacccccggaucaagaaccaggccgacugcauccccuucuuccgcuccugccccgccugccccggcagcaacaucaccauccgcaaccagaucaacgcgcugacguccuucgucgacgccagcaugguguacggcuccgaggagccccucgcccggaaccugcgcaacaugagcaaccagcuggggcuccuggccgugaaccagcgguuccaggacaacggccgcgcgcugcucccguucgacaaccugcacgacgaccccugccugcucaccaaccgguccgcccgcauccccugcuuccuggccggggacacccggagcuccgagaugccggagcugaccagcaugcacacgcuccugcugcgcgagcacaaccggcuggccaccgagcucaagucccugaacccccgcugggacggcgagcggcuguaccaggaggcccgcaagaucgucggggcgauggugcagaucaucaccuaccgggacuaccucccccugguccugggccccaccgccaugcgcaaguaccucccgacguaccggagcuacaacgacuccguggacccccgcaucgccaacguguucaccaacgccuuccgguacggccacacccugauccagcccuucauguuccgccuggacaaccgguaccagcccauggagccgaacccccgcgucccccucagccgcguguucuucgccuccuggcgggugguccuggagggcgggaucgaccccauccugcgcgggcucauggcgaccccggccaagcugaaccggcagaaccagaucgccguggacgagauccgcgagcggcuguucgagcaggucaugcgcaucggccucgaccugcccgcccugaacaugcagcggagccgcgaccacgggcuccccggcuacaacgccuggcggcgcuucugcggccugccccagccggagacggucgggcagcugggcaccgugcuccggaaccugaagcuggcgcgcaagcucauggagcaguacgggacccccaacaacaucgacaucuggaugggcgggguguccgagccccugaagcggaagggccgcgucggcccccugcucgccugcaucaucgggacccaguuccggaagcugcgcgacggcgaccgguucuggugggagaacgaggggguguucagcaugcagcagcgccaggcccuggcccagaucucccucccgcggaucaucugcgacaacacgggcaucaccaccgugagcaagaacaacaucuucaugagcaacuccuacccccgcgacuucgucaacugcagcacccugcccgcgcugaaccucgccuccuggcgggaggccagcuga

SEQ ID NO: 33052 - RNA, 1341 nt, Artificial Sequence
  derived and/or modified sequence opt1 from MPP1__Homo_sapiens__NP_001159933
augacccugaaggccagcgagggcgaguccgggggcagcaugcacaccgcccucuccgaccuguaccuggagcaccuccugcagaagcgcagccggcccgaggcggugucccacccgcugaacacggucaccgaggacauguacaccaacgggagccccgcccccggcucccccgcccaggugaaggggcaggaggugcgcaagguccggcucauccaguucgagaaggugaccgaggagccgaugggcaucacgcugaagcugaacgagaagcagagcugcaccguggcccgcauccuccacggcgggaugauccaccggcagggcucccugcacgucggggacgagauccuggagaucaacggcaccaacgugaccaaccacagcguggaccagcuccagaaggccaugaaggagacgaaggggaugaucucccugaaggucauccccaaccagcagagccgccugcccgcgcuccaggaggccggccugaaguucgccaccggcgacaucauccagaucaucaacaaggacgacuccaacugguggcaggggcggguggagggcagcuccaaggagagcgccgggcugauccccuccccggagcuccaggaguggcgcguggcgagcauggcccaguccgcccccagcgaggcccccagcugcucccccuucggcaagaagaagaaguacaaggacaaguaccuggccaagcacagcuccaucuucgaccagcuggacgucgugagcuacgaggaggugguccggcucccggcguucaagcgcaagacccuggugcugaucggcgccuccggggugggccggagccacaucaagaacgcccuccugucccagaaccccgagaaguucgucuaccccgugcccuacaccacgcgcccgccccggaaguccgaggaggacgggaaggaguaccacuucaucuccaccgaggagaugacccgcaacaucagcgccaacgaguuccuggaguucggcuccuaccaggggaacauguucggcaccaaguucgagacggugcaccagauccacaagcagaacaagaucgccauccucgacaucgagccccagacccugaagaucguccggaccgcggagcugagccccuucaucguguucaucgccccgaccgaccagggcacgcagaccgaggcccuccagcagcugcagaaggacuccgaggccauccgcagccaguacgcccacuacuucgaccugucccucgugaacaacggggucgacgagacccugaagaagcugcaggaggcguucgaccaggccugcagcagcccccagugggugcccgucagcuggguguacuga

SEQ ID NO: 33053 - RNA, 1794 nt, Artificial Sequence
  derived and/or modified sequence opt1 from MPP2__Homo_sapiens__NP_001265299
augagcugggcgcccccgccccaggugggccagaaccugcgcucccagaccguccuccggauccugaacgggauggaggaccugauguggguggccauggaggagcgccgguuccgcgcccucgccagcuucaccaugcccguggccgccacgaacuccgagaccgccaugcagcagguccuggacaaccugggcagccuccccuccgcgaccggggccgccgagcuggaccugaucuuccuccggggcaucauggagagcccgaucgugcgcucccuggccaaggcgcacgagcggcuggaggagaccaagcucgaggccgugcgcgacaacaaccuggagcugguccaggagauccuccgggaccuggcccagcuggccgagcagagcuccacggccgcggagcucgcccacauccugcaggagccccacuuccagagccugcucgagacccacgacuccguggccagcaagaccuacgagacgcccccgcccucccccgggcuggaccccaccuucagcaaccagcccgugccgcccgacgccguccgcauggugggcauccggaagaccgccggcgagcaccugggggugaccuuccgcgucgagggcggggagcucgugaucgcgcggauccugcacggcgggaugguggcccagcagggccugcuccacgucggcgacaucaucaaggaggugaacgggcagcccgugggcuccgacccccgcgcccugcaggagcugcuccggaacgccagcggguccgucauccugaagauccugccgagcuaccaggagccccaccucccccgccagguguucgugaagugccacuucgacuacgaccccgcccgggacucccugaucccgugcaaggaggcgggccugcgcuucaacgccggcgaccuccugcagaucgucaaccaggacgacgccaacugguggcaggccugccacguggagggcgggagcgccgggcugauccccagccagcuccuggaggagaagcggaaggcguucgugaagcgcgaccuggagcucacccccaacuccggcacgcugugcgggagccuguccggcaagaagaagaagcggaugauguaccucaccaccaagaacgccgaguucgaccgccacgagcugcugaucuacgaggaggucgcccgcaugcccccguuccggcgcaagacccucgugcugaucggcgcccagggggucggccggcgcagccugaagaacaagcugaucaugugggaccccgaccgguacgggacgaccgugcccuacaccucccgccggcccaaggacagcgagcgcgagggccagggguacuccuucgugagccggggcgagauggaggcggacguccgcgccggccgguaccucgagcacggggaguacgagggcaaccuguacgggacccgcaucgacuccauccggggcgugguggccgccgggaaggucugcgugcuggacgugaacccgcaggccgucaaggugcuccgcacggcggaguucgugcccuacgucguguucaucgaggcccccgacuucgagacccugcgggccaugaaccgcgccgcccuggagagcggcaucuccaccaagcagcucaccgaggcggaccugcggcgcacgguggaggagagcucccggauccagcgcggcuacgggcacuacuucgaccugugccucgucaacagcaaccuggagcgcaccuuccgggagcugcagaccgccauggagaagcuccgcaccgagccgcagugggugcccguguccugggucuacuga

SEQ ID NO: 33054 - RNA, 1758 nt, Artificial Sequence
  derived and/or modified sequence opt1 from MPP3__Homo_sapiens__NP_001923
augcccgugcugagcgaggacuccggccuccacgagacccuggcccugcucaccagccagcugcgcccggacuccaaccacaaggaggagaugggguuccugcgggacgucuucagcgagaagucccucagcuaccugaugaagauccacgagaagcugcgcuacuacgagcggcagucccccacgcccgugcuccacagcgccguggcgcuggccgaggacgucauggaggagcugcaggccgccuccgugcacagcgacgagcgcgagcuccugcagcugcucuccacgccccaccuccgggccgugcugaugguccacgacaccguggcgcagaagaacuucgacccggugcugccgccccugcccgacaacaucgacgaggacuucgacgaggagagcgucaagaucgugcgccuggugaagaacaaggagccccucggcgccaccauccggcgcgacgagcacuccggggccgucgugguggcccggaucaugcgcggcggggcggccgaccggagcggccugguccacgugggcgacgagcugcgcgaggugaacgggaucgccguccuccacaagcggcccgacgagaucucccagauccuggcccagagccagggcuccaucacccugaagaucauccccgccacccaggaggaggaccgccucaaggagagcaagguguucaugcgggcgcuguuccacuacaacccccgcgaggaccgggccaucccgugccaggaggccgggcugcccuuccagcgccgccaggugcucgaggucgugucccaggacgaccccaccugguggcaggccaagcgggugggcgacaccaaccugcgggccgggcugauccccagcaagggcuuccaggagcgccgccucagcuaccggcgcgcggccggcacgcugccgagcccccagucccugcggaagccgcccuacgaccagcccugcgacaaggagaccugcgacugcgagggguaccucaagggccacuacgucgccgggcugcgccgguccuuccgccugggcugccgggagcgccucggcgggagccaggagggcaagauguccagcggggccgagucccccgagcugcugaccuacgaggagguggcccgguaccagcaccagcccggcgagcgcccccggcucgucgugcugaucgggagccugggcgcgcgccuccacgagcugaagcagaagguggucgccgagaacccgcagcacuucggcguggccgugccccacaccacgcggccccgcaagucccacgagaaggagggggucgaguaccacuucgugagcaagcaggccuucgaggccgaccugcaccacaacaaguuccucgagcacggcgaguacaaggagaaccuguacgggaccucccuggaggcgauccaggccgugauggccaagaacaaggucugccugguggacguggagcccgaggcccucaagcagcugcggaccagcgaguucaagccguacaucaucuucgucaagcccgcgauccaggagaagcgcaagacgcccccgaugucccccgccugcgaggacaccgccgcccccuucgacgagcagcagcaggagauggccgcgagcgccgccuucaucgaccggcacuacggccaccugguggacgccgugcucgucaaggaggaccugcagggggccuacucccagcugaagguggugcucgagaagcugagcaaggacacccacuggguccccguguccugggugcgcuga

SEQ ID NO: 33055 - RNA, 1926 nt, Artificial Sequence
  derived and/or modified sequence opt1 from MPP5__Homo_sapiens__NP_001243479
auggccguggacugccccggcgaccuggggacccgcaugaugccgauccggcgcagcgcccagcucgagcggauccgccagcagcaggaggacaugcggcgccggcgcgaggaggagggcaagaagcaggagcuggaccugaacuccagcaugcggcucaagaagcuggcgcagaucccgcccaagaccgggaucgacaaccccauguucgacacggaggagggcaucguccuggagagcccccacuacgccgugaagauccucgagaucgaggaccuguucuccucccugaagcacauccagcacacccucguggacagccagucccaggaggacaucagccugcugcuccagcugguccagaacaaggacuuccagaacgccuucaagauccacaacgccaucaccgugcacaugaacaaggccuccccgcccuucccccugaucagcaacgcgcaggaccucgcccaggaggugcagaccguccugaagcccgugcaccacaaggaggggcaggagcugacggcccuccugaacacgccccacauccaggcccugcuccuggcgcacgacaagguggccgagcaggagaugcagcuggagcccaucaccgacgagcgcgucuacgaguccaucggccaguacggcggggagaccgugaagaucgugcggaucgagaaggcccgcgacaucccccucggcgccaccguccggaacgagauggacagcgugaucaucucccgcaucgugaagggcggggccgcggagaaguccgggcugcugcacgagggcgacgagguccucgagaucaacggcaucgagauccgggggaaggacgugaacgagguguucgaccugcugagcgacaugcacggcacccucaccuucguccugaucccgagccagcagaucaagcccccgcccgccaaggagaccgugauccacgugaaggcccacuucgacuacgaccccuccgacgaccccuacguccccugccgcgagcuggggcucagcuuccagaagggcgacauccugcacgugaucucccaggaggaccccaacugguggcaggccuaccgggagggcgacgaggacaaccagccgcuggccgggcucgugcccggcaagagcuuccagcagcagcgcgaggcgaugaagcagacgaucgaggaggacaaggagcccgagaaguccgggaagcuguggugcgccaagaagaacaagaagaagcggaagaagguccuguacaacgccaacaagaacgacgacuacgacaacgaggagauccucaccuacgaggagaugagccuguaccaccagcccgccaaccgcaagcggccgaucauccugaucggcccccagaacugcgggcagaacgagcuccgccagcgccugaugaacaaggagaaggaccgguucgccagcgcggugccccacaccacccgcucccggcgcgaccaggaggucgccggccgggacuaccacuucgugagccgccaggccuucgaggccgacaucgccgcgggcaaguucaucgagcacggggaguucgagaagaaccuguacggcacguccaucgacagcgugcggcaggucaucaacuccgggaagaucugccuccugagccugcgcacccagucccucaagacccugcggaacagcgaccugaagcccuacaucaucuucaucgccccgcccucccaggagcgccugcgggcccuccuggccaaggagggcaagaaccccaagccggaggagcugcgcgagaucaucgagaagacccgggagauggagcagaacaacgggcacuacuucgacacggcgaucgugaacagcgaccucgacaaggccuaccaggagcugcugcgccucaucaacaagcuggacaccgagccccagugggugcccuccaccuggcugcgguga

SEQ ID NO: 33056 - RNA, 1500 nt, Artificial Sequence
  derived and/or modified sequence opt1 from MPP7__Homo_sapiens__XP_005252425
augcccgcccuguccaccggcuccgggagcgacaccggccucuacgagcugcuggccgcgcucccggcccagcugcagccccacguggacucccaggaggaccugacguuccucugggacauguucggggagaagucccugcacagccuggucaagauccacgagaagcuccacuacuacgagaagcagagccccgugcccauccugcacggcgccgccgcccuggcggacgaccucgccgaggagcugcagaacaagccgcugaacuccgagauccgcgagcuccugaagcugcucagcaagcccaacgugaaggcccugcuguccguccacgacaccguggcccagaagaacuacgaccccgugcugcccccgaugcccgaggacaucgacgacgaggaggacagcgucaagaucauccggcucgugaagaaccgcgagccccugggggcgaccaucaagaaggacgagcagaccggcgccaucaucguggcccggaucaugcgcggcggggccgccgaccgguccggccucauccacgucggggacgagcugcgcgaggugaacggcauccccguggaggacaagcggccggaggagaucauccagauccuggcgcagagccagggggccaucacguucaagaucauccccggcuccaaggaggagacccccagcaaggagggcaagauguucaucaaggcccucuucgacuacaaccccaacgaggacaaggccaucccgugcaaggaggccgggcuguccuucaagaagggcgacauccugcagaucaugagccaggacgacgcgaccugguggcaggccaagcacgaggccgacgccaacccccgcgccgggcucauccccuccaagcacuuccaggagcggcgccuggcgcugcggcgccccgagauccucguccagccgcugaaggugagcaaccggaaguccagcggcuuccgcaagagcuuccggcugucccgcaaggacaagaagaccaacaagagcauguacgagugcaagaaguccgaccaguacgacacggccgacgugcccaccuacgaggaggucacccccuaccggcgccagaccaacgagaaguaccggcucguggugcuggucggccccgugggggugggccugaacgagcucaagcgcaagcugcugaucagcgacacgcagcacuacggggucaccgugccgcacaccacccgggcccgccgcucccaggagagcgacggcguggaguacaucuucaucuccaagcaccucuucgagacggacguccagaacaacaaguucaucgaguacggggaguacaagaacaacuacuacggcaccagcaucgacuccgugcggagcguccuggccaagaacaaggugugccugcucgacgugcagccccacggccccugguuccugcugccccucauggccgucccguggggcgcgaagccgcccaacgcccgcaugaccugcgggagcccccuggaccuguga

SEQ ID NO: 33057 - RNA, 1002 nt, Artificial Sequence
  derived and/or modified sequence opt1 from MPPE1__Homo_sapiens__NP_001229833
auggccaugaucgagcugggcuucgggcgccagaacuuccacccccucaagcgcaagagcucccugcugcucaagcugaucgccguggucuucgcggugcugcuguucugcgaguuccugaucuacuaccuggccaucuuccagugcaacuggccggaggugaagaccaccgccagcgacggcgagcagacgacccgggagcccguccucaaggccauguuccuggccgacacccaccuccucggggaguuccugggccacuggcuggacaagcuccggcgcgaguggcagauggagcgggcguuccagaccgcccuguggcugcuccagcccgaggugguguucauccugggggacaucuucgacgagggcaagugguccacgcccgaggccugggccgacgacgucgagcgcuuccagaagauguuccggcacccgagccacgugcagcugaagguggucgcgggcaaccacgacaucggguuccacuacgagaugaacaccuacaagguggagcgcuucgagaagguguucuccagcgagcgccucuucuccuggaagggcaucaacuucgucauggugaacagcguggcccugaacggggacggcugcgggaucugcuccgagaccgaggccgagcugaucgaggucagccaccggcucaacugcucccgggagcugcugugguggcuccagccccgccuggugcugagcggccacacccacuccgccugcgaggugcaccacggcgggcggguccccgagcucagcgugcccuccuucagcuggcgcaaccggaacaacccguccuucaucaugggcagcaucacgcccaccgacuacacccuguccaagugcuaccugccccgcgaggacgugguccucaucaucuacugcgggguggugggcuuccuggucgugcugacccucacgcacuucggccugcuggccagccccuuccucagcgggcugaaccugcucggcaagcggaagacccgcuga

SEQ ID NO: 33058 - RNA, 834 nt, Artificial Sequence
  derived and/or modified sequence opt1 from MPPED2__Homo_sapiens__NP_001138871
auggcccacggcauccccagccaggggaaggugaccaucaccgucgacgaguacuccagcaacccgacgcaggccuucacccacuacaacaucaaccagucccgcuuccagccgccccacgugcacaugguggaccccauccccuacgacacccccaagcccgcgggccacacccgguucgucugcaucagcgacacgcacucccgcaccgacgggauccagaugcccuacggcgacauccugcuccacaccggggacuucaccgagcugggccugccgagcgaggugaagaaguucaacgacuggcucggcaaccugcccuacgaguacaagaucgugaucgccgggaaccacgagcugacguucgacaaggaguucauggccgaccucgucaagcaggacuacuaccgguuccccuccgugagcaagcugaagcccgaggacuucgacaacgugcagucccugcucaccaacagcaucuaccugcaggacuccgaggucaccgugaagggcuuccgcaucuacggggccccguggacccccugguucaacggcuggggguucaaccugccccggggccagagccuccuggacaaguggaaccugauccccgagggcaucgacauccucaugacgcacgggccgccccugggcuuccgcgacugggugcccaaggagcugcagcgggucgggugcguggagcuccugaacaccgugcagcgccggguccgccccaagcugcacguguucggcggcauccacgaggugaacccggucuccaucagcaaggcccuccggaccaagaucugcucccugcccagcaagaccuccuga

SEQ ID NO: 33059 - RNA, 3117 nt, Artificial Sequence
  derived and/or modified sequence opt1 from MPRIP__Homo_sapiens__NP_055949
augagcgccgccaaggagaaccccugccgcaaguuccaggcgaacaucuucaacaaguccaagugccagaacugcuucaagccgcgggagagccaccuccugaacgacgaggaccugacccaggccaagcccaucuacggcggguggcugcuccuggcccccgacggcaccgacuucgacaaccccgugcaccgcucccggaaguggcagcgccgguucuucauccuguacgagcacgggcuccugcgcuacgcccuggacgagaugccgacgacccucccccagggcaccaucaacaugaaccagugcaccgacgucguggacggggagggccggacgggccagaaguucagccugugcauccugacccccgagaaggagcacuucauccgcgccgagaccaaggagaucguguccggguggcucgagaugcugauggucuacccccggaccaacaagcagaaccagaagaagaagcgcaagguggagccgcccacgccccaggagcccggcccggcgaagguggccgucaccagcuccagcuccagcuccagcuccagcuccagcauccccuccgccgagaaggugcccaccaccaagagcacgcuguggcaggaggagaugcggaccaaggaccagcccgacggguccagccucagcccggcccagucccccagccagucccagccgcccgcggccagcucccugcgcgagcccggccuggagagcaaggaggaggaguccgccaugagcuccgaccggauggacugcgggcgcaaggugcgggucgagagcggcuacuucucccucgagaagaccaagcaggaccugaaggccgaggagcagcagcugcccccgccccucagcccgcccucccccagcacccccaaccaccgccggucccaggugaucgagaaguucgaggcccuggacaucgagaaggcggagcacauggagacgaacgccgugggccccagccccuccagcgacacccgccaggggcgguccgagaagcgcgccuucccccggaagcgcgacuucaccaacgaggccccgcccgcgccccugcccgacgccagcgccagcccgcucagcccccaccgccgggccaagagccuggaccgccgguccaccgagcccagcgucacgcccgaccugcucaacuucaagaagggcuggcugaccaagcaguacgaggacgggcaguggaagaagcacugguucgugcuggccgaccagucccuccgcuacuaccgggacagcguggccgaggaggcggccgaccuggacggcgagaucgaccuguccgccugcuacgacgucaccgaguacccggugcagcgcaacuacggcuuccagauccacaccaaggagggggaguucacgcucagcgccaugaccuccggcauccggcgcaacuggauccagaccaucaugaagcacgugcaccccaccacggcccccgacgucaccagcucccugcccgaggagaagaacaagagcuccugcagcuucgagaccugcccgcggcccaccgagaagcaggaggcggagcugggggagcccgaccccgagcagaagcgcucccgggcccgcgagcggcgccgggagggccgcagcaagacguucgacugggccgaguuccggccgauccagcaggcccucgcgcaggagcgcgucgggggcgugggccccgccgacacccacgagccccugcggcccgaggccgagccgggggagcuggagcgcgagcgcgcccggcgccgggaggagcgccggaagcgcuucggcaugcucgacgccaccgacgggcccggcaccgaggacgcggcccugcggauggagguggaccgcucccccgggcugcccaugagcgaccucaagacgcacaacgugcacguggagaucgagcagcgguggcaccaggucgagaccaccccgcugcgcgaggagaagcagguccccaucgcccccgugcaccugagcuccgaggacggcggcgaccggcucagcacccacgagcugaccucccugcucgagaaggagcuggagcagagccagaaggaggccuccgaccugcuggagcagaaccgccuccugcaggaccagcugcggguggcccucgggcgcgagcagagcgcgcgggagggcuacgugcugcaggccacgugcgagcgcggguucgccgccauggaggagacccaccagaagaagaucgaggaccugcagcggcagcaccagcgcgagcucgagaagcugcgggaggagaaggaccgccugcucgccgaggagaccgcggccaccaucuccgccaucgaggccaugaagaacgcgcaccgggaggagauggagcgcgagcuggagaagucccagcgcucccagaucagcuccgucaacagcgacguggaggcccugcggcgccaguaccucgaggagcugcaguccgugcagcgggagcuggagguccucagcgagcaguacucccagaagugccuggagaacgcccaccuggcccaggcccucgaggcggagcgccaggcccugcggcagugccagcgcgagaaccaggagcugaacgcccacaaccaggagcucaacaaccggcuggccgccgagaucacgcgccugcggacccuccugaccggcgacgggggcggcgaggcgaccgggagcccgcuggcccagggcaaggacgccuacgagcucgaggugcugcugcgcgugaaggaguccgagauccaguaccucaagcaggagaucagcucccugaaggacgagcugcagacggcccuccgggacaagaaguacgccagcgacaaguacaaggacaucuacaccgagcugagcaucgcgaaggccaaggccgacugcgacaucucccgccugaaggagcagcucaaggccgcgaccgaggcccugggggagaagucccccgacagcgccaccgucagcggcuacgacaucaugaaguccaagagcaaccccgacuuccugaagaaggaccgguccugcgugacgcgccagcuccggaacauccgcagcaagucccugaaggagggccugaccgugcaggagcggcucaagcuguucgagagccgcgaccugaagaaggacuga

SEQ ID NO: 33060 - RNA, 894 nt, Artificial Sequence
  derived and/or modified sequence opt1 from MPST__Homo_sapiens__NP_001123989
auggccagcccccagcugugccgcgcccucguguccgcgcagugggucgccgaggcccugcgggccccgcgcgccggccagccccugcagcuccuggacgcgagcugguaccugcccaagcucgggcgggacgcccgccgggaguucgaggagcgccacauccccggcgccgccuucuucgacaucgaccagugcuccgaccggaccagcccguacgaccacaugcugcccggggcggagcacuucgccgaguacgccggccgccugggggugggcgccgccacccacguggucaucuacgacgcguccgaccagggccucuacagcgcgccccgggugugguggauguuccgcgccuucgggcaccacgccgugucccugcuggacggcgggcuccggcacuggcugcgccagaaccugccccucagcuccggcaagagccagccggcccccgccgaguuccgggcccagcuggaccccgccuucaucaagacguacgaggacaucaaggagaaccuggagucccgccgguuccaggucguggacagccgcgccaccgggcgguuccgcggcaccgagcccgagccgcgggacggcaucgagcccgggcacauccccggcaccgugaacauccccuucacggacuuccucucccaggaggggcuggagaaguccccggaggagauccgccaccuguuccaggagaagaaggucgaccucagcaagccccugguggcgaccugcggcagcggcgugaccgccugccacgucgcccugggggccuaccucugcggcaagcccgacgugcccaucuacgacggguccuggguggagugguacaugcgggcccgcccggaggacgucaucagcgagggccgcgggaagacccacuga

SEQ ID NO: 33061 - RNA, 531 nt, Artificial Sequence
  derived and/or modified sequence opt1 from MPV17__Homo_sapiens__XP_005264383
auggcccuguggcgcgccuaccagcgggcgcucgccgcccaccccuggaaggugcagguccugaccgccggcagccugauggggcucggcgacaucaucucccagcagcugguggagcgccgggggcugcaggagcaccagcgcggccggacccucacgauggugagccuggggugcggcuucgucggcccgguggucgggggcugguacaaggugcuggaccgcuucauccccgggaccaccaagguggacgcccucaagaagaugcugcuggaccagggcggguucgcgcccugcuuccucggcugcuuccugccccuggugggcgcccucaacgggcuguccgcccaggacaacugggccaagcugcagcgggacuacccggacgcgcucaucaccaacuacuaccuguggcccgccguccagcuggccaacuucuaccucgugccccugcacuaccgccuggccgugguccagugcguggccgugaucuggaacagcuaccucuccuggaaggcgcaccggcuguga

SEQ ID NO: 33062 - RNA, 621 nt, Artificial Sequence
  derived and/or modified sequence opt1 from MPV17L2__Homo_sapiens__NP_116072
auggcccgcggcggguggcggcgccugcggcgccuccugagcgccggccagcuccuguuccaggggcgggcgcugcuggugaccaacacccucggcugcggggcccugauggccgccggcgacggcguccgccaguccugggagauccgggcccgccccggccagguguucgacccccggcgcagcgcguccauguucgccguggggugcagcauggggcccuuccugcacuacugguaccucucccuggaccggcuguuccccgccagcggccuccgcggguuccccaacguccugaagaaggugcugguggaccagcucgucgccuccccgcugcugggcgugugguacuuccucggccuggggugccuggagggccagacggugggggagagcugccaggagcuccgggagaaguucugggaguucuacaaggcggacuggugcgucuggcccgccgcccaguucgugaacuuccuguucgugccgccccaguuccgcgucaccuacaucaacggccugacccucggcugggacaccuaccuguccuaccugaaguaccggagccccgugccccucacgccgcccgggugcguggcccuggacacccgcgccgacuga

SEQ ID NO: 33063 - RNA, 747 nt, Artificial Sequence
  derived and/or modified sequence opt1 from MPZ__Homo_sapiens__NP_000521
auggcccccggcgccccgagcuccagccccucccccauccuggcggugcuccuguucagcucccugguccucagccccgcccaggccaucgugguguacaccgaccgcgagguccacggggccgugggcucccgggugacccugcacugcagcuucugguccagcgagugggucuccgacgacaucagcuucacguggcgcuaccagccggagggcgggcgggacgccaucuccaucuuccacuacgcgaaggggcagcccuacaucgacgaggugggcaccuucaaggagcgcauccagugggugggcgacccccgguggaaggacgggagcaucgucauccacaaccuggacuacuccgacaacggcaccuucacgugcgacgugaagaacccgcccgacaucguggggaagaccagccaggucacccucuacguguucgagaaggugcccacccgcuacggcgucgugcugggggccgugaucggcggcguccuggggguggugcuccugcugcuccugcuguucuacgucgugcgguacugcuggcuccgccggcaggccgcccugcagcgccggcuguccgcgauggagaagggcaagcuccacaagcccgggaaggacgccagcaagcgcggccggcagacccccgugcuguacgccaugcuggaccacucccgcagcacgaaggccgucagcgagaagaaggccaagggccucggggagucccggaaggacaagaaguga

SEQ ID NO: 33064 - RNA, 360 nt, Artificial Sequence
  derived and/or modified sequence opt1 from MPZL1__Homo_sapiens__NP_001139663
auggccgccagcgcgggcgccggggccgugaucgccgcccccgacucccgccgguggcuguggagcguccucgcggccgcccugggccugcucaccgccgggguguccgcgcuggagguguacaccccgaaggagaucuucgucgccaacggcacgcaggggaagcugaccugcaaguucaagagcaccuccaccacgggcggccucaccagcguguccuggagcuuccagcccgagggggccgacaccaccguguccggccccgucaucuacgcccagcuggaccacagcgggggccaccacuccgacaagaucaacaagagcgaguccgugguguacgccgacauccgcaagaacuga

SEQ ID NO: 33065 - RNA, 648 nt, Artificial Sequence
  derived and/or modified sequence opt1 from MPZL2__Homo_sapiens__NP_658911
auguacggcaagagcuccacccgcgccgugcugcuccugcuggggauccagcucaccgcccuguggcccaucgcggccgucgagaucuacacgagccgggugcuggaggccgugaacggcaccgacgcccgccucaagugcaccuucuccagcuucgcccccgucggggacgcgcugaccgugacguggaacuuccggccccuggacggcgggcccgagcaguucguguucuacuaccacaucgaccccuuccagccgauguccggccgcuucaaggaccgggucagcugggacggcaaccccgagcgcuacgacgccuccauccuccuguggaagcugcaguucgacgacaacgggaccuacacgugccaggugaagaacccgcccgacguggacggcgucaucggggagauccggcucagcguggugcacaccguccgcuucuccgagauccacuuccuggcccuggccaucggcagcgcgugcgcccucaugaucaucaucgugaucguggucgugcuguuccagcacuaccggaagaagcgcugggccgagcgggcccacaagguggucgagaucaaguccaaggaggaggagcgccugaaccaggagaagaaggugagcguguaccucgaggacaccgacuga

SEQ ID NO: 33066 - RNA, 672 nt, Artificial Sequence
  derived and/or modified sequence opt1 from MPZL3__Homo_sapiens__NP_001273081
augcagcagcgcggcgccgccgggagccggggcugcgcgcuguucccccuccugggggugcuguucuuccaggacgcccacguccgcggcuacgugggggagaagaucaagcucaagugcaccuucaaguccaccagcgacgugacggacaagcugaccaucgacuggaccuaccggccgcccuccagcucccacaccgucagcaucuuccacuaccaguccuuccaguaccccacgaccgccggcaccuuccgcgaccggaucagcugggugggcaacguguacaagggggacgccuccaucagcaucuccaaccccaccaucaaggacaacggcacguucagcugcgccgucaagaacccgcccgacgugcaccacaacauccccaugaccgagcugaccgugaccgagcgcggguucggcacgaugcucuccagcgucgcgcugcuguccauccucguguucgugcccagcgccgucgugguggcccugcugcucguccggauggggcgcaaggccgcgggccugaagaagcggucccgcagcggcuacaagaaguccagcaucgaggugagcgacgacaccgaccaggaggaggaggaggccugcauggcccggcugugcgugcgcugcgccgagugccucgacuccgacuacgaggagaccuacuga

SEQ ID NO: 33067 - RNA, 891 nt, Artificial Sequence
  derived and/or modified sequence opt1 from MR1__Homo_sapiens__NP_001181928
augggcgagcugauggccuuccuccugccccugaucaucgugcucauggucaagcacagcgacucccgcacccacagccugcgguacuuccgccuggggguguccgacccgauccacggcgugcccgaguucaucagcgucggguacguggacucccaccccaucaccacguacgacagcgugacccggcagaaggagccccgcgccccguggauggcggagaaccucgcccccgaccacugggagcgguacacccagcugcugcgcggcuggcagcagauguucaaggucgagcucaagcggcugcagcgccacuacaaccacuccgacaacguggcccacaccaucaagcaggccugggaggccaaccagcacgagcugcucuaccagaagaacuggcuggaggaggagugcaucgcguggcugaagcgguuccucgaguacgggaaggacacgcugcagcgcaccgagccgccccuggugcgggucaaccgcaaggagaccuuccccggcgugaccgcccucuucugcaaggcccacggcuucuacccgcccgagaucuacaugacguggaugaagaacggggaggagaucgugcaggagaucgacuacggcgacauccugcccagcggggacggcaccuaccaggccugggcguccaucgagcuggacccccagagcuccaaccucuacagcugccacgucgagcacugcggggugcacauggugcugcaggucccccaggaguccgagaccaucccccuggugaugaaggccgugagcggcuccaucguccucgugaucgugcuggccggcgucggggugcugguguggcggcgccggccccgcgagcagaacggcgccaucuaccucccgacccccgaccgguga

SEQ ID NO: 33068 - RNA, 618 nt, Artificial Sequence
  derived and/or modified sequence opt1 from MRAP2__Homo_sapiens__XP_011533703
augagcgcccagcgccugaucuccaaccggaccagccagcaguccgccagcaacuccgacuacaccugggaguacgaguacuacgagaucggccccgugagcuucgaggggcucaaggcgcacaaguacuccaucgucaucggcuucuggguggggcuggccguguucgucaucuucauguucuucgugcugacgcuccugaccaagaccggcgcgccccaccaggacaacgccgagagcuccgagaagcgcuuccggaugaacagcuucguguccgacuucgggcgcccccuggagcccgacaaggucuucagccggcagggcaacgaggagucccgcagccucuuccacugcuacaucaacgagguggagcggcuggaccgcgccaaggccugccaccagaccacggcccuggacuccgacgugcagcuccaggaggccauccggagcuccggccagcccgaggaggagcugaaccgccugaugaaguucgacaucccgaacuucgucaacaccgaccagaacuacuucggggaggacgaccuccugaucagcgagccgcccaucgugcuggagaccaagccccucucccagaccagccacaaggaccuggacuga

SEQ ID NO: 33069 - RNA, 519 nt, Artificial Sequence
  derived and/or modified sequence opt1 from MRAP__Homo_sapiens__NP_848932
auggccaacggcaccaacgccagcgcgcccuacuacuccuacgaguacuaccuggacuaccucgaccugauccccguggacgagaagaagcugaaggcccacaagcacagcaucgucaucgccuucugggugucccucgccgccuucgugguccugcuguuccucauccugcuguacaugagcugguccgcgagcccccagaugcgcaacucccccaagcaccaccagaccugccccuggagccacgggcucaaccugcaccugugcauccagaagugccucccgugccaccgggagccccuggccacgucccaggcccaggccagcuccguggagcccggcagccgcaccgggcccgaccagccgcugcggcaggaguccagcuccacccucccccugggcggguuccagacccaccccacgcugcucugggagcugacccugaacggcggcccccucgugcgcagcaagccguccgagcccccgcccggggaccggaccagccagcugcaguccuga

SEQ ID NO: 33070 - RNA, 627 nt, Artificial Sequence
  derived and/or modified sequence opt1 from MRAS__Homo_sapiens__NP_001239019
auggccaccagcgccgugcccuccgacaaccugcccaccuacaagcucgucguggugggcgacgggggcgucggcaagagcgcgcugacgauccaguucuuccagaagaucuucgugcccgacuacgaccccaccaucgaggacuccuaccugaagcacaccgagaucgacaaccagugggccauccucgacgugcuggacaccgccgggcaggaggaguucagcgccaugcgcgagcaguacaugcggacgggggacggcuuccugaucgucuacuccgugaccgacaaggccagcuucgagcacguggaccgcuuccaccagcucauccugcgggucaaggaccgcgaguccuuccccaugauccugguggcgaacaagguggaccucaugcaccuccggaagaucacccgcgagcagggcaaggagauggccaccaagcacaacaucccguacaucgagacgagcgccaaggacccgccccugaacgucgacaaggccuuccacgaccuggugcgggugauccgccagcagauccccgagaagucccagaagaagaagaagaagaccaaguggcgcggggaccgggcgaccggcacccacaagcugcagugcgucauccuguga

SEQ ID NO: 33071 - RNA, 4371 nt, Artificial Sequence
  derived and/or modified sequence opt1 from MRC1__Homo_sapiens__NP_002429
augcgccugccccuccugcugguguucgccagcgucaucccgggcgccgugcuccugcuggacacccggcaguuccucaucuacaacgaggaccacaagcgcugcguggacgcggucucccccagcgccgugcagaccgccgccugcaaccaggacgccgagucccagaaguuccggugggugagcgagucccagaucaugagcgucgcguucaagcugugccugggggugcccuccaagacggacuggguggccaucacccucuacgccugcgacagcaaguccgaguuccagaagugggagugcaagaacgacacccugcugggcaucaagggggaggaccucuucuucaacuacggcaaccgccaggagaagaacaucaugcuguacaaggggagcggccuguggucccgguggaagaucuacggcaccacggacaaccucugcagccgcggguacgaggccauguacacccugcugggcaacgcgaacggggcgaccugcgccuuccccuucaaguucgagaacaagugguacgccgacugcaccuccgccggccggagcgacggguggcucuggugcggcacgaccaccgacuacgacaccgacaagcuguucggcuacugcccgcugaaguucgagggguccgagagccucuggaacaaggacccccugacguccgucagcuaccagaucaacuccaagagcgcccugaccuggcaccaggcccgcaagagcugccagcagcagaacgccgagcuccuguccaucaccgagauccacgagcagaccuaccugacgggccucaccagcucccugaccagcgggcuguggaucggccucaacucccugagcuucaacuccggcuggcaguggagcgaccggucccccuuccgcuaccugaacuggcuccccgggagcccguccgccgagcccggcaagagcugcgugucccugaaccccgggaagaacgccaagugggagaaccuggagugcgugcagaagcucggcuacaucugcaagaaggggaacaccacgcugaacagcuucgucauccccuccgagagcgacgugccgacccacugccccucccagugguggcccuacgcgggccacugcuacaagauccaccgggacgagaagaagauccagcgcgacgcccugacgaccugccggaaggagggcggggaccucaccagcauccacaccaucgaggagcuggacuucaucaucucccagcugggcuacgagcccaacgacgagcucuggaucgggcugaacgacaucaagauccagauguacuucgaguggagcgacggcaccccggugaccuucacgaaguggcugcgcggggagcccagccacgagaacaaccggcaggaggacugcgucgugaugaagggcaaggacggcuacugggccgaccgcgggugcgaguggccccucggcuacaucugcaagaugaagucccggagccaggggcccgagaucguggaggucgagaagggcugccgcaagggguggaagaagcaccacuucuacugcuacaugaucggccacacccuguccaccuucgccgaggccaaccagaccugcaacaacgagaacgcguaccugacgaccaucgaggaccgguacgagcaggccuuccucaccagcuucgugggccugcgcccggagaaguacuucuggaccgggcuguccgacauccagacgaagggcaccuuccaguggaccaucgaggaggaggugcgguucacccacuggaacagcgacaugcccgggcgcaagcccggcugcgucgccaugcgcaccggcaucgccgggggccugugggacgugcucaagugcgacgagaaggccaaguucgugugcaagcacugggcggagggggucacgcacccgcccaagcccaccaccacccccgagcccaagugcccggaggacuggggcgccuccagccggacgucccugugcuucaagcuguacgccaaggggaagcacgagaagaagaccugguucgagagccgcgacuucugccgggcccucggcggcgaccuggcguccaucaacaacaaggaggagcagcagaccaucuggcgccugaucaccgccagcggguccuaccacaagcuguucuggcugggccugacguacgggagccccuccgagggcuucaccuggagcgacgggucccccgugagcuacgagaacugggccuacggcgagccgaacaacuaccagaacgucgaguacugcggcgagcucaagggggaccccaccaugagcuggaacgacaucaacugcgagcaccugaacaacuggaucugccagauccagaagggccagacccccaagcccgagccgacgcccgcgccccaggacaacccgcccgugaccgaggacgggugggugaucuacaaggacuaccaguacuacuucuccaaggagaaggagaccauggacaacgcccgggccuucugcaagcgcaacuucggcgaccuggucagcauccaguccgagagcgagaagaaguuccucuggaaguacgugaaccggaacgacgcccaguccgccuacuucaucgggcugcugaucagccucgacaagaaguucgccuggauggacggcuccaagguggacuacgucagcugggccaccggcgagcccaacuucgcgaacgaggacgagaacugcgugacgauguacuccaacagcggguucuggaacgacaucaacugcggcuaccccaacgccuucaucugccagcgccacaacuccagcaucaacgccaccaccgugaugcccaccaugccguccguccccagcgggugcaaggagggcuggaacuucuacuccaacaagugcuucaagaucuucggguucauggaggaggagcggaagaacuggcaggaggcccgcaaggccugcaucggcuucggcgggaaccuggugagcauccagaacgagaaggagcaggcguuccugacguaccacaugaaggacuccaccuucagcgccuggaccggccucaacgacgugaacuccgagcacaccuuccuguggacggacgggcggggcguccacuacaccaacuggggcaagggguaccccggcgggcgccggagcagccuguccuacgaggacgccgacugcguggugaucaucggcggggccagcaacgaggcgggcaaguggauggacgacacgugcgacuccaagcgcggcuacaucugccagacccggagcgaccccucccucaccaacccgcccgccaccauccagaccgacggguucgucaaguacggcaagagcuccuacagccugaugcgccagaaguuccaguggcacgaggccgagaccuacugcaagcugcacaacucccucaucgccagcauccuggaccccuacuccaacgccuucgcguggcugcagauggagacgagcaacgagcggguguggaucgcccucaacuccaaccugaccgacaaccaguacaccuggaccgacaaguggcgcgugcgguacacgaacugggccgccgacgagcccaagcucaagagcgccugcgucuaccucgaccuggacggguacuggaagaccgcgcacugcaacgaguccuucuacuuccugugcaagcgcagcgacgagaucccggccaccgagccgccccagcuccccggccgcugccccgaguccgaccacaccgccuggauccccuuccacgggcacugcuacuacaucgagagcuccuacacccggaacuggggccaggccagccuggagugccugcgcaugggcagcucccucgugagcaucgaguccgccgcggagagcuccuuccugagcuaccggguggagccccugaaguccaagacgaacuucuggaucggccucuuccgcaacgucgaggggaccuggcuguggaucaacaacagcccgguguccuucgugaacuggaacaccggggaccccagcggcgagcggaacgacugcgucgcccugcacgccuccagcggguucugguccaacauccacugcagcuccuacaagggcuacaucugcaagcgccccaagaucaucgacgccaagcccacccacgagcuccugacgaccaaggcggacacccggaagauggacccgagcaagcccuccagcaacguggccggcguggucaucaucgugauccugcucauccugaccggggccggccuggccgccuacuucuucuacaagaagcgccgggugcaccucccccaggagggggcguucgagaacacgcuguacuucaacucccagagcagccccggcaccuccgacaugaaggaccuggucggcaacaucgagcagaacgagcacagcgugaucuga

SEQ ID NO: 33072 - RNA, 4440 nt, Artificial Sequence
  derived and/or modified sequence opt1 from MRC2__Homo_sapiens__NP_006030
augggccccgggcgcccggcccccgcccccuggccccggcaccuccugcgcugcgugcugcugcucggcugccugcaccuggggcggccgggcgcgcccggggacgccgcccuccccgagcccaacgucuuccugaucuucagccacggccugcagggcugccucgaggcccagggcggccaggugcgcgugaccccggccugcaacaccucccugcccgcgcagcgguggaagugggucagccgcaaccggcuguucaaccucgggacgaugcagugccugggcaccggguggcccggcaccaacaccacggccucccugggcauguacgagugcgaccgcgaggcccucaaccugcgguggcacugccgcacccugggggaccagcucagccugcugcucggcgcccggaccuccaacaucagcaagcccgggacccuggagcgcggcgaccagacgcgguccggccaguggcgcaucuacgggagcgaggaggaccugugcgcgcucccguaccacgagguguacaccauccagggcaacucccacgggaagcccugcaccauccccuucaaguacgacaaccagugguuccacggcugcaccagcacggggcgggaggacggccaccuguggugcgccaccacccaggacuacggcaaggacgagcgcuggggguucugccccaucaaguccaacgacugcgagaccuucugggacaaggaccagcugacggacagcugcuaccaguucaacuuccaguccacccucagcuggcgggaggccugggccuccugcgagcagcagggcgccgaccugcugagcaucaccgagauccacgagcagaccuacaucaacgggcuccugacgggcuacuccagcacccuguggaucgggcucaacgaccuggacaccuccggcggcuggcaguggagcgacaacagcccgcugaaguaccucaacugggaguccgaccagcccgacaaccccagcgaggagaacugcggggugauccgcaccgaguccagcggcggguggcagaaccgggacugcuccaucgcgcugcccuacgucugcaagaagaagccgaacgccacggccgagcccaccccgcccgaccgcugggccaacgugaagguggagugcgagcccagcuggcagcccuuccagggccacugcuaccggcugcaggccgagaagcgcuccuggcaggagagcaagaaggcgugccuccgcgggggcggcgaccuggucuccauccacagcauggccgagcuggaguucaucaccaagcagaucaagcaggagguggaggagcucuggaucgggcugaacgaccugaagcuccagaugaacuucgagugguccgacggcagccugguguccuucacccacuggcaccccuucgagcccaacaacuuccgggacagccuggaggacugcgucacgaucugggggccggagggccgcuggaacgacucccccugcaaccagagccuccccuccaucugcaagaaggccggccagcugagccagggggccgccgaggaggaccacggcugccggaagggguggaccuggcacuccccgagcugcuacuggcugggcgaggaccaggugaccuacagcgaggcgcgccggcugugcaccgaccacgggucccagcucgugacgaucaccaaccgcuucgagcaggccuucgucagcucccugaucuacaacugggagggcgaguacuucuggaccgcccugcaggaccucaacagcaccggcuccuucuucuggcugagcggggacgaggugauguacacgcacuggaaccgggaccagcccggcuacucccgcgggggcugcguggcccuggccaccgggagcgcgaugggccucugggaggucaagaacugcaccuccuuccgggcccgcuacaucugccggcagagccugggcacccccgugacccccgagcugccggggcccgaccccacgcccucccucaccggcagcugcccgcaggggugggccuccgacaccaagcugcgcuacugcuacaagguguucagcuccgagcggcugcaggacaagaaguccuggguccaggcccagggcgcgugccaggagcucggggcccagcugcugagccucgccagcuacgaggaggagcacuucguggccaacaugcugaacaagaucuucggcgagagcgagcccgagauccacgagcagcacugguucuggaucggccugaaccgccgggacccccgcgggggccaguccuggcgguggagcgacggggugggcuucuccuaccacaacuucgaccgcagccggcacgacgacgacgacauccgcgggugcgccguccucgaccuggcgucccugcaguggguggccaugcagugcgacacccagcucgacuggaucugcaagaucccccgcggcacggacguccgggagccggacgacagcccccagggccgccgggaguggcugcgcuuccaggaggccgaguacaaguucuucgagcaccacuccaccugggcccaggcccagcggaucugcaccugguuccaggcggagcugaccagcgugcacucccaggccgagcucgacuuccugagccacaaccugcagaaguucucccgcgcccaggagcagcacugguggaucgggcuccacacgagcgaguccgacggccgguuccgcuggaccgacgggagcaucaucaacuucaucuccugggcccccggcaagccccggccggugggcaaggacaagaagugcgucuacaugaccgccagccgcgaggacuggggcgaccagcggugccugaccgcgcugcccuacaucugcaagcgcuccaacgugacgaaggagacccagccgcccgaccuccccaccaccgcccugggcgggugccccagcgacuggauccaguuccugaacaagugcuuccaggugcaggggcaggagccccagucccgggucaaguggagcgaggcccaguucagcugcgagcagcaggaggcccagcucgugacgaucaccaacccccuggagcaggcguucaucaccgccucccugccgaacgugaccuucgaccucuggaucgggcugcacgccagccagcgcgacuuccagugggucgagcaggagccccugauguacgccaacugggcccccggcgagccguccggccccagccccgcgcccuccgggaacaagccgacgagcugcgccguggugcuccacucccccagcgcccacuucaccggccggugggacgaccgcuccugcaccgaggagacccacggguucaucugccagaagggcacggaccccagccugucccccagcccggccgcccugccgcccgcgcccgggaccgagcucuccuaccugaacggcaccuuccggcugcuccagaagccccugcgcuggcacgacgcccugcuccugugcgagagccggaacgccucccuggccuacguccccgaccccuacacccaggccuuccucacgcaggcggcccgcggccugcggacgccccuguggaucgggcucgccggcgaggaggggagccgccgcuacuccugggugagcgaggagccgcugaacuacgugggcuggcaggacggggagccccagcagcccggcggcugcaccuacgucgacguggacggggccuggcggaccaccuccugcgacaccaagcugcagggcgcggugugcggggucagcagcgggcccccgccgccccgccggaucuccuaccacggcagcugcccccaggggcucgccgacuccgccuggauccccuuccgcgagcacugcuacagcuuccacauggagcugcugcucggccacaaggaggcccggcagcgcugccagcgggccgggggcgcggugcuguccauccuggacgagauggagaacguguucgucugggagcaccuccagagcuacgaggggcagucccgcggcgccuggcugggcaugaacuucaaccccaagggcgggacccugguguggcaggacaacaccgccgugaacuacagcaacugggggccgcccggccucgggcccuccaugcugagccacaacuccugcuacuggauccagagcaacuccggccuguggcggcccggcgccugcacgaacaucaccaugggggucgugugcaagcucccccgcgccgagcagagcuccuucagcccguccgcgcugcccgagaaccccgccgcccugguggucgugcucauggccgugcugcugcuccuggcccugcucaccgcggcccugauccuguaccggcgccggcagagcaucgagcgcggcgccuucgagggggcccgguacucccgcagcagcuccagccccaccgaggccaccgagaagaacauccucgucuccgacauggagaugaacgagcagcaggaguga

SEQ ID NO: 33073 - RNA, 2043 nt, Artificial Sequence
  derived and/or modified sequence opt1 from MRE11A__Homo_sapiens__NP_005581
augagcaccgccgacgcccuggacgacgagaacaccuucaagauccucguggcgacggacauccaccugggcuucauggagaaggacgccguccgcgggaacgacaccuucgugacccuggacgagauccuccggcuggcccaggagaacgagguggacuucauccugcucggcggggaccuguuccacgagaacaagcccucccgcaagacccugcacacgugccucgagcugcugcggaaguacugcaugggcgaccgcccgguccaguucgagauccucagcgaccaguccgugaacuucggguucagcaaguuccccugggugaacuaccaggacggcaaccugaacaucuccauccccgucuucagcauccacggcaaccacgacgaccccaccggggccgacgcccugugcgcgcucgacauccuguccugcgccggcuucgugaaccacuucgggcggagcauguccguggagaagaucgacaucagcccgguccugcuccagaagggcuccaccaagaucgcccuguacgggcugggcagcauccccgacgagcgccucuaccggauguucgugaacaagaaggugaccaugcugcgccccaaggaggacgagaacuccugguucaaccuguucgucauccaccagaaccggagcaagcacggcuccacgaacuucauccccgagcaguuccucgacgacuucaucgaccuggugaucugggggcacgagcacgagugcaagaucgccccgaccaagaacgagcagcagcuguucuacaucagccagcccggcuccagcguggucaccucccucagccccggggaggcggugaagaagcacgugggccugcugcgcaucaagggccggaagaugaacaugcacaagaucccccuccacaccguccgccaguucuucauggaggacaucgugcuggccaaccacccggacaucuucaaccccgacaaccccaaggugacgcaggccauccagagcuucugccuggagaagaucgaggagaugcucgagaacgccgagcgggagcgccuggggaacucccaccagcccgagaagccgcugguccggcuccgcguggacuacagcggcggguucgagcccuucuccgugcugcgguucagccagaaguucgucgaccgcguggccaaccccaaggacaucauccacuucuuccggcaccgcgagcagaaggagaagaccggcgaggagaucaacuucgggaagcugaucaccaagcccuccgagggcaccacgcuccgggucgaggaccuggugaagcaguacuuccagaccgcggagaagaacgugcagcugagccuccugaccgagcgcggcaugggggaggccguccaggaguucguggacaaggaggagaaggacgccaucgaggagcuggugaaguaccagcucgagaagacccagcgcuuccugaaggagcggcacaucgacgcccuggaggacaagaucgacgaggagguccgccgguuccgcgagacgcggcagaagaacaccaacgaggaggacgacgaggugcgcgaggccaugacccgggcgcgcgcccuccggucccagagcgaggaguccgccagcgccuucuccgccgacgaccugaugagcaucgaccuggcggagcagauggccaacgacuccgacgacagcaucuccgccgccaccaacaagggccgcgggcggggccgcgggcggcgcggcggccgggggcagaacagcgccucccgcggcgggagccagcggggccgcgcguucaaguccacgcggcagcagccgagccgcaacgugaccaccaagaacuacagcgaggucaucgagguggacgaguccgacguggaggaggacaucuuccccaccacgagcaagaccgaccagcgcugguccagcaccuccagcuccaagaucaugagccagucccaggucagcaaggggguggacuucgaguccagcgaggacgacgacgacgaccccuucaugaacaccuccagccugcggcgcaaccggcgcuga

SEQ ID NO: 33074 - RNA, 645 nt, Artificial Sequence
  derived and/or modified sequence opt1 from MREG__Homo_sapiens__NP_060470
augggccugcgcgacuggcuccggaccgugugcugcugcugcgggugcgagugccuggaggagcgcgcccugcccgagaaggagccgcucgucagcgacaacaaccccuacuccagcuucggcgccacccuggugcgggacgacgagaagaaccugugguccaugccccacgacgugagccacacggaggcggacgacgaccgcacccucuacaaccugaucgucauccggaaccagcaggccaaggacuccgaggaguggcagaagcugaacuacgacauccacacccuccgccaggugcggcgcgaggugcggaaccgcuggaagugcauccuggaggaccugggguuccagaaggaggccgacagccuccuguccgucaccaagcugagcacgaucuccgacagcaagaacacccggaaggcccgcgagaugcuccugaagcuggccgaggagaccaacaucuuccccaccuccugggagcucagcgagcgguaccuguucgugguggaccgccugaucgcgcucgacgccgccgaggaguucuucaagcuggcccggcgcacguacccgaagaagcccggcguccccugccuggcggacgggcagaaggagcuccacuaccugcccuucccgucccccuga

SEQ ID NO: 33075 - RNA, 384 nt, Artificial Sequence
  derived and/or modified sequence opt1 from MRFAP1__Homo_sapiens__NP_150638
augcgcccccuggacaucguggagcucgccgagccggaggaggucgaggugcuggagcccgaggaggacuucgagcaguuccugcuccccgugaucaacgagaugcgggaggacaucgccagccugacccgcgagcacggccgggcguaccugcgcaaccgguccaagcucugggagauggacaacaugcugauccagaucaagacccaggucgaggccagcgaggaguccgcccugaaccaccuccagaaccccggggacgccgccgagggccgcgcggccaagcggugcgagaaggccgaggagaaggccaaggagaucgcgaagauggccgagaugcugguggagcuggugcgccggaucgagaaguccgagagcagcuga

SEQ ID NO: 33076 - RNA, 615 nt, Artificial Sequence
  derived and/or modified sequence opt1 from MRGBP__Homo_sapiens__NP_060740
augggcgaggccgaggucgggggcgggggcgccgcgggggacaagggccccggcgaggccgccaccagcccggccgaggagaccgugguguggucccccgagguggaggucugccuguuccacgccaugcucgggcacaagcccgugggcgugaaccgccacuuccacaugaucugcauccgggacaaguucagccagaacaucgggcgccagguccccuccaaggugaucugggaccaccugagcacgauguacgacaugcaggcgcugcacgaguccgagauccucccguuccccaaccccgagcggaacuucgugcugcccgaggagaucauccaggagguccgcgagggcaaggugaugaucgaggaggagaugaaggaggagaugaaggaggacguggacccgcacaacggggccgacgacgucuucagcuccagcggcucccugggcaaggccagcgagaaguccagcaaggacaaggagaagaacuccagcgaccucgggugcaaggagggcgccgacaagcggaagcgcucccgggugaccgacaaggugcugaccgcgaacagcaaccccuccagccccuccgccgccaagcgccggcgcaccuga

SEQ ID NO: 33077 - RNA, 1032 nt, Artificial Sequence
  derived and/or modified sequence opt1 from MRGPRF__Homo_sapiens__NP_659452
auggccggcaacugcagcugggaggcccaccccgggaaccgcaacaagaugugccccggccuguccgaggcgcccgagcucuacagccggggguuccugaccaucgagcagaucgccaugcugcccccgcccgccgugaugaacuacaucuuccuccugcugugccucugcggccuggucgggaacggccuggugcucugguucuucggcuucuccaucaagcgcaaccccuucagcaucuacuuccugcaccuggccuccgccgacgugggguaccucuucagcaaggcggucuucuccauccugaacaccggcggguuccugggcacguucgccgacuacauccggagcgugugccgcgugcucgggcugugcauguuccugaccggcgucucccuccugcccgccgugagcgccgagcggugcgcguccgugaucuuccccgccugguacuggcgccggcgcccgaagcggcugagcgccgucgugugcgcccuccugugggugcugucccuccuggugaccugccugcacaacuacuucugcgucuuccucggccgcggggcccccggcgcggccugccggcacauggacaucuuccuggggauccuccuguuccugcugugcugcccccucauggugcugcccugccuggcccucauccugcacgucgagugccgcgcccggcgccggcagcgcagcgccaagcugaaccacgugauccucgcgaugguguccgucuuccuggugagcuccaucuaccugggcaucgacugguuccucuucuggguguuccagaucccggcccccuuccccgaguacgucaccgaccugugcaucugcaucaacagcuccgccaagcccaucguguacuuccuggccggccgggacaagagccagcgccucugggagccgcugcggguggucuuccagcgcgcccugcgggacggggcggagcucggcgaggccgggggcagcacgcccaacaccgugaccauggagaugcagugcccgcccgggaacgccuccuga

SEQ ID NO: 33078 - RNA, 969 nt, Artificial Sequence
  derived and/or modified sequence opt1 from MRGPRX1__Homo_sapiens__NP_671732
auggaccccaccaucagcacccuggacacggagcucaccccgaucaacggcaccgaggagacccugugcuacaagcagacgcugucccucaccgugcugaccugcaucgucagccugguggggcucaccggcaacgccgugguccuguggcugcucgggugccgcaugcggcgcaacgccuucuccaucuacauccugaaccuggcggccgccgacuuccucuuccugagcggccggcugaucuacucccuccugagcuucaucuccaucccccacacgaucagcaagauccuguaccccgugaugauguucuccuacuucgccgggcucagcuuccuguccgccgugagcaccgagcgcugccuguccguccucuggcccaucugguaccggugccaccgcccgacccaccugagcgcgguggugugcguccugcucugggcccugucccugcuccggagcauccuggaguggaugcugugcggcuuccucuucuccggcgccgacagcgccuggugccagaccuccgacuucaucacgguggcguggcugaucuuccugugcgugguccucugcgggagcagccuggugcugcucauccgcauccugugcggcucccggaagaucccccugacccgccucuacgugaccauccugcugaccguccucguguuccugcugugcgggcuccccuucggcauccaguucuuccuguuccuguggauccacguggaccgggagguccucuucugccacgugcaccuggugagcaucuuccuguccgcccugaacagcuccgccaaccccaucaucuacuucuucgucgggagcuuccgccagcggcagaaccgccagaaccucaagcuggugcugcagcgggcccuccaggacgccuccgagguggacgagggcggcgggcagcugccggaggagauccuggagcucagcggcucccgccuggagcaguga

SEQ ID NO: 33079 - RNA, 969 nt, Artificial Sequence
  derived and/or modified sequence opt1 from MRGPRX3__Homo_sapiens__NP_473372
auggacagcaccauccccgugcugggcaccgagcucacgccgaucaacgggcgcgaggagacccccugcuacaagcagacccuguccuucaccggccugacgugcaucgucagccucguggcccugaccgggaacgccgugguccuguggcuccugggcugccggaugcgccggaacgcgguguccaucuacauccugaaccucguggccgccgacuuccuguuccugagcgggcacaucaucugcagcccccuccgccugaucaacauccggcaccccaucuccaagauccuguccccggucaugaccuuccccuacuucaucggccucagcaugcuguccgccaucagcaccgagcgcugccuguccauccucuggcccaucugguaccacugccggcgcccccgguaccugagcuccgugaugugcgugcugcucugggcccugagccugcuccgcuccauccuggaguggauguucugcgacuuccuguucagcggcgcgaacuccgucuggugcgagacgagcgacuucaucaccaucgccuggcucguguuccugugcgugguccugugcggguccagccucgugcugcuggugcggauccucugcggcagccgcaagaugccgcugacccggcuguacgucaccauccuccugacggugcugguguuccuccugugcgggcugcccuucggcauccagugggcccucuucucccgcauccaccuggacuggaagguccuguucugccacgugcaccucgugagcaucuuccuguccgcccugaacagcuccgcgaaccccaucaucuacuucuucgucgggagcuuccggcagcgccagaaccggcagaaccucaagcuggugcugcagcgcgcccugcaggacacccccgagguggacgagggcggcggguggcucccgcaggagacccuggagcuguccggcagccggcucgagcaguga

SEQ ID NO: 33080 - RNA, 969 nt, Artificial Sequence
  derived and/or modified sequence opt1 from MRGPRX4__Homo_sapiens__NP_473373
auggaccccaccgugccggucuucggcaccaagcugacgcccaucaacgggcgcgaggagacccccugcuacaaccagacccucagcuucaccgugcugacgugcaucaucucccuggugggccucaccgggaacgccgucgugcuguggcugcucggcuaccggaugcgccggaacgccgugagcaucuacauccugaaccuggcggccgccgacuuccucuuccuguccuuccagaucauccgccugccccuccggcugaucaacaucagccaccugauccgcaagauccucgucuccgugaugaccuucccguacuucaccgggcugagcaugcuguccgccaucagcacggagcggugccucuccgugcuguggcccaucugguaccgcugccggcgccccacccaccugagcgccgucgugugcgugcuccuguggggccugucccuccuguucagcaugcuggaguggcgguucugcgacuuccucuucuccggcgcggacagcuccuggugcgagaccagcgacuucauccccgucgccuggcugaucuuccugugcguggugcucugcgucuccagccuggugcugcucgugcgcauccugugcgggucccggaagaugccgcugacccgccucuacgucacgauccugcugaccgugcucguguuccugcugugcggccuccccuucgggauccugggcgcccugaucuaccggaugcaccucaaccuggagguccuguacugccacguguaccucgugugcaugagccugagcucccugaacagcuccgccaaccccaucaucuacuucuucgucgggagcuuccgccagcggcagaaccgccagaaccugaagcucgugcugcagcgggcgcugcaggacaagcccgaggucgacaagggcgagggccagcucccggaggagucccuggagcugagcgggucccgccucggccccuga

SEQ ID NO: 33081 - RNA, 1110 nt, Artificial Sequence
  derived and/or modified sequence opt1 from MRI1__Homo_sapiens__NP_001026897
augacccuggaggccauccgcuacagccggggcucccuccagauccuggaccagcugcuccugcccaagcagagccgcuacgaggccgugggguccguccaccaggcgugggaggccauccgggccaugaaggugcgcggcgccccggccaucgcgcugguggggugccucagccuggccgucgagcugcaggccggcgccgggggccccggccucgcggcccugguggccuucgugcgggacaagcuguccuuccucgucaccgcccgccccacggccgugaacauggcgcgggccgcccgcgaccuggccgacguggccgcgcgggaggccgagcgcgagggggccaccgaggaggccguccgggagcgcgugaucugcugcaccgaggacaugcuggagaaggaccuccgggacaaccgcagcaucggcgaccugggggcccggcaccuccuggagcgcguggcgcccuccggcgggaaggucaccgugcugacgcacugcaacaccggcgcccuggccaccgccggcuacgggaccgcccucggcgugauccggagccugcacucccuggggcgccucgagcacgcguucugcacggagacccggccguacaaccagggcgcccgccugaccgccuucgagcuggucuacgagcagauccccgccacccucaucacggacagcaugguggcggccgccauggcccaccggggcguguccgccgucguggugggggcggaccgcgucguggccaacggcgacaccgccaacaagguggggaccuaccagcuggccaucgucgccaagcaccacggcauccccuucuacguggcggcccccagcuccagcugcgaccugcgccucgagaccgggaaggagaucaucaucgaggagcggccgggccaggagcugacggacgucaacggcgugcgcaucgccgcccccgggaucggcguguggaaccccgccuucgacgucacgccccacgaccugaucaccgggggcaucaucaccgagcucgggguguucgcgccggaggagcugcggaccgcccugaccaccaccaucuccagccgcgacggcacgcucgacggcccccagauguga

SEQ ID NO: 33082 - RNA, 1062 nt, Artificial Sequence
  derived and/or modified sequence opt1 from MRM1__Homo_sapiens__NP_079140
auggcccugcucagcaccgugcgcggcgccaccugggggcggcuggucacgcgccacuucucccacgcggcccggcacggcgagcgccccgggggcgaggagcugagccggcuccugcuggacgaccucgugccgaccucccgccuggagcuccuguucgggaugacccccugccugcuggcccuccaggccgcccggcgcagcguggcgcggcugcugcuccaggccggcaaggccggccugcaggggaagcgcgccgagcugcuccggauggcggaggcccgcgacauccccguccugcggccccgccggcagaagcuggacaccaugugccgcuaccaggugcaccagggcgugugcauggaggucuccccgcuccggccccgccccuggcgggaggccggggaggccagccccggcgacgacccgcagcagcuguggcuggugcucgacgggauccaggacccccgcaacuucggcgccgugcugcgguccgcgcacuuccugggcgucgacaaggugaucacgagccgccgcaacuccugcccccucacccccguggucagcaaguccagcgccggggccauggaggugauggacguguucuccaccgacgaccugaccggcuuccugcagacgaaggcccagcagggguggcucgucgccggcaccgugggcugcccgagcaccgaggacccccaguccagcgagauccccaucauguccugccuggaguuccugugggagcggcccacccuccuggugcuggggaacgagggcagcgggcucucccaggagguccaggcgagcugccagcugcugcucacgauccugccgcgccggcagcugccgcccggccucgagagccugaacguguccguggccgccgggauccugcuccacagcaucugcucccagcgcaagggcuuccccaccgagggcgagcggcgccagcugcugcaggacccccaggagcccagcgcccgguccgaggggcucagcauggcccagcaccccggccuguccagcgggcccgagaaggagcgccagaacgagggcuga

SEQ ID NO: 33083 - RNA, 4758 nt, Artificial Sequence
  derived and/or modified sequence opt1 from MROH2B__Homo_sapiens__NP_775760
augacccugagcaccgaggaguccaucgagauguucggcgacaucaaccucacgcuggggaugcugaacaaggaggacaucgugaacaaggaggacaucuacagccaccucaccuccgucauccagaacaccgacauccuggacgacgccaucgugcagcgccugaucuacuacgccagcaaggacaugcgggacaacaacaugcuccgcgagauccggaugcuggcgggcgaggugcuggucucccucgccgcccacgacuucaacagcgugauguacgaggugcaguccaacuuccgcauccuggagcugcccgacgaguucgucgugcucgcccuggccgagcuggcgaccagcuacgugucccagagcaucccguucaugaugaugacgcuccugaccaugcagaccaugcugcggcucgccgaggacgagcgcaugaaggggaccuucugcaucgcccuggagaaguucuccaaggccaucuacaaguacgucaaccacuggcgggacuuccccuacccccgccuggacgcgaaccggcucagcgacaagaucuucaugcuguucugguacaucauggagaagugggcgccccuggccuccccgaugcagacgcucagcaucgugaaggcccacggccccaccgugucccugcugcuccaccgcgaggacuuccggggguacgcccugggccagguccccuggcugcucaaccaguacaaggacaaggagaucgacuuccacgugacccagagccugaagcagauccugaccgccgccgugcucuacgacaucggccugccccgcucccugcggcgcagcaucuucaucaaccuccugcagcagaucugccgggccccggagccgcccgucaaggagaacgagaugaaggccuccagcugcuuccugauccucgcccacagcaaccccggggagcugauggaguucuucgacgagcagguccgcuccaacaacgaggcgauccgggugggcauccugacgcuccugcgccuggccgugaacgccgacgagccgcggcuccgcgaccacaucaucagcaucgagcggaccgugaagaucgugaugggggaccuguccaccaagguccgcaacagcgugcugcuccugauccagaccaugugcgagaaguccuacaucgaggcccgcgagggcuggccccugaucgacuacguguucagccaguucgccacgcugaaccggaaccucgagaagcccgucaagaccaacuuccacgagaacgagaaggaggaggaguccgugcgcgagaccagccuggagguccugaagacccucgacccccuggugaucgggaugccccaggugcuguggccccggauccucacguucgucgugcccgcggaguacaccgaggcccuggagccccuguucuccaucauccgcauccucaucauggccgaggagaagaagcagcacagcgccaaggaguccaccgcccugguggucagcaccggcgcggugaagcugccgagcccccagcagcuccuggcccggcugcucgugaucagcaugcccgccucccugggcgagcugcgcggggccggcgcgaucgggcuccugaagauccugcccgagaucauccacccgaagcucgucgaccuguggaagacgcggcugcccgagcuccugcagccccuggagggcaagaacaucagcaccgugcucugggagaccaugcugcugcagcuccugaaggagucccuguggaagaucagcgacguggccuggaccauccagcucacgcaggacuucaagcagcagaugggcuccuacagcaacaacagcaccgagaagaaguuccuguggaaggcccuggggaccacccucgccugcugccaggacuccgacuucgucaacagccagaucaaggaguuccugacggcccccaaccagcugggcgaccagcgccaggggaucaccuccauccucggcuacugcgcggagaaccaccuggacaucgugcugaaggugcucaagaccuuccagaaccaggagaaguucuucaugaaccggugcaagagccuguucuccgggaagaagucccugaccaagacggacgucauggugaucuacggcgccguggcccuccacgccccgaagaagcagcugcugucccgccucaaccaggacaucaucagccagguccugucccugcacggccagugcagccaggugcucgggauguccgugaugaacaaggacauggaccugcagaugagcuucacccgguccaucaccgagaucggcaucgccguccaggacgcggaggaccagggguuccaguucagcuacaaggagaugcugaucggcuacaugcucgacuucauccgcgacgagccccuggacucccuggccagccccauccgguggaaggcccucaucgccauccgcuaccuguccaagcugaagccgcagcucagccugcaggaccaccugaacauccucgaggagaacauccggcgccugcugccccucccgccccuggagaaccucaagagcgaggggcagaccgacaaggacaaggagcacauccaguuccuguacgagcgguccauggacgcccugggcaagcugcucaagaccaugaugugggacaacgugaacgcggaggacugccaggagauguucaaccugcugcagauguggcucgugagccagaaggagugggagcgcgagcgggccuuccagaucacggccaagguccugaccaacgacaucgaggcccccgagaacuucaagaucggcucccugcucgggcugcuggcgccccacagcugcgacacccuccccaccauccgccaggccgccgccuccagcacgaucggccuguucuacaucaaggggauccaccuggagguggagcgccuccagggccugcaggaggggcuggaguccgacgacgugcagguccagaucaagaucagcuccaagaucgccaagaucgugagcaaguucauccccaacgaggagauccucauguuccuggaggagaugcuggacggccucgagucccugaacccgaccugcaccaaggcgugcggcaucuggaugaucaccgugcugaagcagcagggggccgcccucgaggaccagcugcuggagauccugggcacgaucuaccaccacaugcccguccuccggcagaaggaggagagcuuccaguucauccuggaggccaucucccagaucgccagcuuccacauggacaccgugguggucaaccugcuccagaagccccugcccuucgaccgcgacaccaagacccuguggaaggcgcucgccgagaagccggccuccagcgggaagcugcugcaggcccucaucgacaagcuggagacggagcuggaggacgacaucgcccggguggaggcgaucuccguggccugcgccauguacgaggucaucagcaugggcaccuccgugaccggccucuaccccgagcuguucacccugcuccugaagcuggugagcugcacgcucgggcagaagaugcugaccugccccuggagccaccgccggcacgucaugcagcagggcgagcagcagcagauccccgacccgugccgccuguccaccgccacccucaagugccugcaggcgcaggccaugcgggaggggcuggccaaggagagcgacgagggcgacaaccucuggacgcugcuguccagccccuccacccaccacaucggggugugcagccucgcccgcuccauggccguguggcagcacggcgucauccuggacaucauggagcagcugcucagcucccugaccagcuccagcgagaacuaccggaucaccggcgcggccuucuucuccgagcugaugaaggagcccauccucuggaagcacgggaaccugcgcaacgugcugauccucauggaccagagcgccugggacuccaacgccacgcugcggcagauggccauccgcggccuggggaacaccgcgagcggcgcgccccacaaggugaagaagcacaagcagcucaugcuggaguccaucauccgggggcuguaccaccucgcccgcaccgaggucgugugcgagagccugaaggcccugaagaagauccucgagcugcugaccgaccgggacguguccuucuacuucaaggagaucguccuccagacgcgcaccuucuucgaggacgagcaggacgacgugcggcugaccgccaucuuccuguucgaggaccucgccccgcugaccggccgccgguggaagaucuucuucgccgaggagaucaagaagucccugaucagcuuccuccugcaccugugggaccccaaccccaagaucggcguggccugccgcgacguccucauggugugcauccccuuccuggggcugcaggagcucuacggcguccuggaccggcugcucgaccaggaccugccgcgcgcccgcgacuucuaccggcaguucugcgugaagcuggccaagaagaaccaggagauccucuggauccugcacacgcacagcuucaccuucuucaccagcaccugggaggugauccgcuccgcggccgucaagcugacggacgccguggugcucaaccugaccagccaguacgucgagcugcucgaccgggagcagcugaccacccgccugcaggcccuccggcaggaccccugcaucuccgugcagcgcgcggccgaggccgcccugcagacccugcuccggcgcugcaaggagacgagcaucccccuguga

SEQ ID NO: 33084 - RNA, 633 nt, Artificial Sequence
  derived and/or modified sequence opt1 from MRO__Homo_sapiens__NP_001120647
auggccuggggcagcaaggggauccagggcugggagaaccuggccgaguccagccaccucgcgaccacccgcgaguccagcccgcccgaguccgggacgggcagcggguccagccggggcucccgccugcaggagccccaggugagcuggaagcugcgguuccagaagcgcgagccccucaagaacgucuucuucauccuggccgagcgggcccgcgaccccuccgccaagaagcggcacauggccaugcgcaaccugggcaccauggcguacgaggccccggacaaggugcggaaguacaagaagaucgugcucgaccugcuggucuacgggcucuacgaccccgugaaccuggaggugauccacgagagcaugaagacccugaccgucgugcucggcaagauccaggggaagggccugggguccuucuucaucgacaucacgcugcagacccgcacccuccuggacgacgccugcaagaccacguuccaggccugcagccccuaccugaagcucaaggaggaguacuccuuccagagcgaggaggaccagcggaacaccaagcuguaccagcagcugucccacuaccaccccgagauccuccaguucuucuacgcgaacaagauccuguga

SEQ ID NO: 33085 - RNA, 786 nt, Artificial Sequence
  derived and/or modified sequence opt1 from MRPL10__Homo_sapiens__NP_660298
auggccgccgcgguggccggcaugcugcgcgggggccuccugccccaggccgggcggcugccgacccuccagaccguccgcuacggcagcaaggccgugacgcggcaccgccgggugaugcacuuccagcgccagaagcugauggccgucaccgaguacaucccgcccaagcccgcgauccacccguccugccugcccuccccgcccagcccgccccaggaggagaucgggcucauccggcugcugcgccgggagaucgccgccguguuccaggacaaccgcaugaucgccgugugccagaacgucgcgcucagcgccgaggacaagcugcugaugcggcaccagcuccgcaagcacaagauccugaugaagguguuccccaaccaggugcugaagcccuuccucgaggacuccaaguaccagaaccugcugccccucuucgucggccacaacaugcugcuggugagcgaggagcccaaggugaaggagaugguccggauccuccgcaccgugcccuuccugccccugcucggcgggugcaucgacgacaccauccugucccggcagggcuucaucaacuacagcaagcugcccucccucccccuggugcagggggagcuggucggcgggcucacgugccugaccgcccagacccacagccugcuccagcaccagccccugcagcugaccacgcuccuggaccaguacauccgcgagcagcgggagaaggacuccgugaugagcgccaacggcaagcccgacccggacaccgugcccgacuccuga

SEQ ID NO: 33086 - RNA, 579 nt, Artificial Sequence
  derived and/or modified sequence opt1 from MRPL11__Homo_sapiens__NP_057134
augagcaagcugggccgcgccgcccgggggcuccgcaagcccgaggugggcggggucauccgggcgaucgugcgcgccggccuggccaugccggggccgccccugggccccgugcucggccagcgcggggucuccaucaaccaguucugcaaggaguucaacgagcggaccaaggacaucaaggagggcaucccccugcccaccaagauccuggugaagcccgaccggacguucgagaucaagaucgggcagcccaccgugagcuacuuccucaaggccgccgcgggcaucgagaagggggcccgccagaccggcaaggaggucgccggccuggugacccugaagcacguguacgagaucgcccggaucaaggcgcaggacgaggccuucgcccuccaggacgucccgcuguccagcguggugcgcuccaucaucgggagcgcccggucccugggcauccgcgucgugaaggaccucagcuccgaggagcuggccgcguuccagaaggagcgggccaucuuccuggccgcccagaaggaggccgaccucgcggcccaggaggaggccgccaagaaguga

SEQ ID NO: 33087 - RNA, 537 nt, Artificial Sequence
  derived and/or modified sequence opt1 from MRPL13__Homo_sapiens__NP_054797
augagcuccuucagccgcgcgccccagcagugggccaccuucgcccggaucugguaccugcucgacggcaagaugcagccgcccgggaagcuggccgccauggccuccauccgccugcagggccuccacaagcccguguaccacgcccugagcgacugcggggaccacgucgugaucaugaacacccggcacaucgcguucuccggcaacaagugggagcagaagguguacagcucccacacgggguaccccggcggcuuccgccaggucaccgccgcccagcugcaccuccgggacccgguggccaucgugaagcuggcgaucuacgggaugcugcccaagaaccuccaccgccggaccaugauggagcgccugcaccuguuccccgacgaguacauccccgaggacauccucaagaaccuggucgaggagcugccgcagccccggaagauccccaagcgccucgacgaguacacccaggaggagaucgacgccuucccccggcuguggacgccgcccgaggacuaccgccuguga

SEQ ID NO: 33088 - RNA, 891 nt, Artificial Sequence
  derived and/or modified sequence opt1 from MRPL15__Homo_sapiens__NP_054894
auggccggcccccugcagggcggcggggcccgcgcgcucgaccugcugcgggggcucccgcgcgugagccuggccaaccugaagcccaaccccggguccaagaagcccgagcggcgcccgcggggccgccggcgcggccggaagugcgggcgcggccacaagggggagcggcagcgcggcacccggccccgccucggguucgagggcggccagacccccuucuacauccggauccccaaguacggguucaacgagggccacagcuuccgccggcaguacaagccgcugucccugaaccgccuccaguaccugaucgaccuggggcgggucgaccccagccagcccaucgaccucacgcagcuggugaacggccgcggcgugaccauccagccccugaagcgggacuacgggguccagcucguggaggagggcgccgacaccuucaccgccaaggugaacaucgagguccagcuggccuccgagcuggcgaucgccgccaucgagaagaacgggggcguggugacgaccgccuucuacgacccgcgcagccucgacaucgucugcaagcccgugcccuucuuccugcgcgggcagcccaucccgaagcggaugcugccgcccgaggagcucgugcccuacuacaccgacgcgaagaaccgcggcuaccuggccgaccccgccaaguuccccgaggcccggcuggagcucgcccgcaaguacggcuacauccugcccgacaucaccaaggacgagcuguucaagaugcucugcacgcggaaggacccccgccagaucuucuucgggcuggcgccgggcugggucgugaacauggccgacaagaagauccugaagcccaccgacgagaaccuccugaaguacuacaccuccuga

SEQ ID NO: 33089 - RNA, 528 nt, Artificial Sequence
  derived and/or modified sequence opt1 from MRPL17__Homo_sapiens__NP_071344
augcgccugagcguggccgccgcgaucucccacggccgggucuuccgccggauggggcucggccccgagagccgcauccaccuccugcggaaccugcugaccgggcuggugcgccacgagcggaucgaggccccgugggcccgcguggacgagaugcggggcuacgccgagaagcucaucgacuacgggaagcugggcgacaccaacgagcgcgccaugcggauggcggacuucuggcugacggagaaggaccucauccccaagcuguuccagguccuggcgccccgcuacaaggaccagaccggcggguacacccggaugcuccagauccccaaccgcucccuggaccgggccaagauggccgugaucgaguacaagggcaacugccugccgccccucccccugccccgccgggacagccaccugacccuccugaaccagcugcuccaggggcugcgccaggaccugcggcagucccaggaggccagcaaccacuccagccacacggcccagaccccgggcaucuga

SEQ ID NO: 33090 - RNA, 879 nt, Artificial Sequence
  derived and/or modified sequence opt1 from MRPL19__Homo_sapiens__NP_055578
auggccgccugcaucgcggccggccacugggccgccauggggcugggccgcagcuuccaggccgcgcggacccuccugcccccgcccgccuccaucgccugccgcgugcacgccgggcccguccggcagcagagcaccggccccuccgagccgggggcguuccagcccccgcccaagcccgugaucguggacaagcaccgccccgucgagcccgagcggcgcuuccugagccccgaguucaucccgcggcgcggccggacggacccccucaaguuccagaucgagcgcaaggacaugcuggagcggcgcaaggugcugcacauccccgaguucuacgugggcuccauccuccgggucaccaccgccgaccccuacgccagcgggaagaucucccaguuccugggcaucugcauccagcgcagcgggcggggccugggggccaccuucauccuccgcaacgugaucgagggccagggcguggagaucugcuucgagcuguacaacccgcggguccaggagauccagguggugaagcuggagaagcgccucgacgacucccugcuguaccuccgggacgcccugcccgaguacagcacguucgacgucaacaugaagcccguggugcaggagcccaaccagaaggucccggugaacgagcugaaggugaagaugaagcccaagcccugguccaagcgcugggagcggcccaacuucaacaucaaggggauccgcuucgaccucugccugaccgagcagcagaugaaggaggcgcagaaguggaaccagccguggcuggaguucgacaugaugcgcgaguacgacaccagcaagaucgaggccgccaucuggaaggagaucgaggccuccaagcggagcuga

SEQ ID NO: 33091 - RNA, 978 nt, Artificial Sequence
  derived and/or modified sequence opt1 from MRPL1__Homo_sapiens__NP_064621
auggccgccgcggugcgcugcaugggccgggcccugauccaccaccagcgccacagccucuccaagauggucuaccagaccagccugugcuccugcagcgugaacauccgggugcccaaccgccacuucgccgccgccaccaaguccgcgaagaagacgaagaagggggccaaggagaagaccccggacgagaagaaggacgagaucgagaagaucaaggccuaccccuacauggagggcgagcccgaggacgacgucuaccugaagcggcucuacccccgccagaucuacgagguggagaaggccgugcaccuccugaagaaguuccagauccuggacuucaccagcccgaagcaguccgucuaccuggaccugacccucgacauggcgcuggggaagaagaagaacguggagcccuucacgagcgugcugucccuccccuaccccuucgccagcgagaucaacaaggucgccguguucaccgagaacgccuccgaggugaagaucgccgaggagaacggcgcggccuucgccgggggcaccagccugauccagaagaucugggacgacgagaucgucgccgacuucuacguggccgugccggagaucaugcccgagcugaaccggcuccgcaagaagcugaacaagaaguaccccaagcugucccggaacagcaucggccgcgacauccccaagaugcucgagcuguucaagaacgggcacgagaucaaggucgacgaggagcgggagaacuuccugcagaccaagaucgcgacgcucgacauguccagcgaccagaucgccgccaaccugcaggccgugaucaacgaggugugccgccaccggccgcugaaccucggccccuucgucgugcgcgccuuccugcgguccagcaccuccgaggggcugcuccugaagaucgacccccugcuccccaaggaggugaagaacgaggagagcgagaaggaggacgcguga

SEQ ID NO: 33092 - RNA, 462 nt, Artificial Sequence
  derived and/or modified sequence opt1 from MRPL23__Homo_sapiens__NP_066957
auggcccgcaacguggucuacccccuguaccggcucggcgggccgcagcugcgcguguuccggaccaacuucuucauccagcuggugcgccccggcgucgcccagcccgaggacaccgugcaguuccggauccccauggagaugacgcgcguggaccuccggaacuaccuggaggggaucuacaacgucccgguggcggccgugcgcacccggguccagcacggcagcaacaagcgccgggaccaccgcaacgugcggaucaagaagcccgacuacaagguggccuacguccagcuggcccacgggcagaccuucaccuuccccgaccucuuccccgagaaggacgaguccccggagggcagcgccgcggacgaccuguacuccaugcuggaggaggagcgccagcagcggcagagcuccgacccccgccggggcggggugcccagcugguucggccucuga

SEQ ID NO: 33093 - RNA, 771 nt, Artificial Sequence
  derived and/or modified sequence opt1 from MRPL28__Homo_sapiens__XP_011520653
augccccugcacaaguacccgguguggcucuggaagcgccugcagcugcgggagggcaucugcagccgccuccccgggcacuaccugcggucccuggaggaggagcgcacccccacccccguccacuaccggccgcacggcgccaaguucaagaucaaccccaagaacgggcagcgcgagcggguggaggacgugcccauccccaucuacuucccgcccgagagccagcgcggccucuggggcggggagggcuggauccuggggcagaucuacgccaacaacgacaagcuguccaagcggcucaagaaggucuggaagccccagcuguucgagcgcgaguucuacagcgagauccuggacaagaaguucacggugaccgugaccaugcggacccucgaccugaucgacgaggcguacggccuggacuucuacauccucaagacgcccaaggaggaccugugcuccaaguucgggauggaccugaagcgcggcaugcuccugcggcuggcccgccaggacccgcagcuccaccccgaggaccccgagcggcgcgccgccaucuacgacaaguacaaggaguucgccauccccgaggaggaggcggagugggucgggcugacccuggaggaggccaucgagaagcagcggcuccuggaggagaaggacccggugccccuguucaagaucuacguggccgagcucauccagcagcugcagcagcaggcccugagcgagcccgcggucgugcagaagcgcgccuccggccaguga

SEQ ID NO: 33094 - RNA, 198 nt, Artificial Sequence
  derived and/or modified sequence opt1 from MRPL33__Homo_sapiens__NP_004882
auguuccugagcgccguguucuucgccaaguccaagagcaagaacauccucguccgcaugguguccgaggcgggcaccggguucugcuucaacaccaagcggaaccgccugcgggagaagcugacgcuccugcacuacgaccccguggucaagcagcgcgugcuguucguggagaagaagaagauccggagccucuga

SEQ ID NO: 33095 - RNA, 312 nt, Artificial Sequence
  derived and/or modified sequence opt1 from MRPL36__Homo_sapiens__NP_115868
auggccaaccuguucauccgcaagauggugaacccccuccuguaccugagccggcacaccgucaagccgcgcgcccucuccaccuuccuguucggcagcauccgcggggcggcccccguggccguggagcccggcgccgccguccggucccugcucagccccgggcugcugccgcaccuccugcccgcgcugggcuucaagaacaagacggugcucaagaagcggugcaaggacugcuaccuggugaagcgccgggggcgcugguacgucuacugcaagacccacccccggcacaagcagcgccagauguga

SEQ ID NO: 33096 - RNA, 1047 nt, Artificial Sequence
  derived and/or modified sequence opt1 from MRPL3__Homo_sapiens__NP_009139
augcccggcuggcgccugcucacccaggugggggcccagguccugggccggcugggggacggccucggggccgcgcugggcccgggcaaccgcacccacaucuggcuguucgugcgggggcuccacggcaagagcgggacguggugggacgagcaccuguccgaggagaacgugcccuucaucaagcagcuggucagcgacgaggacaaggcccagcucgccuccaagcugugcccccugaaggacgagcccuggccgauccaccccugggagcccggcagcuuccgcguggggcucaucgcccugaagcugggcaugaugccccucuggaccaaggacggccagaagcacguggucacccugcuccaggugcaggacugccacgugcugaaguacaccuccaaggagaacugcaacgggaagauggccacgcugagcgucggcgggaagaccgugucccgguuccgcaaggcgaccagcauccuggaguucuaccgggagcucggccugccgcccaagcagaccgugaagaucuucaacaucacggacaacgccgccaucaagcccggcacgccccuguacgccgcgcacuuccgcccggggcaguacgucgacgugaccgccaagaccaucggcaagggguuccagggcgugaugaagcgguggggguucaagggccagcccgccacccacggccagaccaagacccaccgccggcccggggccgucgccaccggcgacaucgggcgcguguggcccggcacgaagaugccggggaagaugggcaacaucuaccggaccgaguacggccucaagguguggcgcaucaacaccaagcacaacaucaucuacgucaacggguccgugcccggccacaagaacugccuggugaaggucaaggacagcaagcugcccgcguacaaggaccucgggaagaaccugcccuucccgaccuacuuccccgacggcgacgaggaggagcugcccgaggaccucuacgacgagaacgugugccagcccggggccccguccaucacguucgccuga

SEQ ID NO: 33097 - RNA, 621 nt, Artificial Sequence
  derived and/or modified sequence opt1 from MRPL40__Homo_sapiens__NP_003767
augaccgccagcgugcugcgcuccaucagccucgcccugcggcccaccuccggccugcucgggacguggcagacccagcugcgcgagacccaccagcgggcgagccugcucuccuucugggagcugauccccaugcgcagcgagccccugcggaagaagaagaaggucgaccccaagaaggaccaggaggccaaggagcgccucaagcggaagauccgcaagcuggagaaggccacccaggagcugauccccaucgaggacuucaucacgccgcucaaguuccuggacaaggcccgggagcgcccccagguggagcugaccuucgaggagaccgagcggcgcgcccuccugcugaagaaguggucccucuacaagcagcaggagcggaagauggagcgcgacaccauccgggcgaugcuggaggcccagcaggaggcccuggaggagcuccagcuggagagccccaagcugcacgccgaggcgaucaagcgcgaccccaaccucuucccguucgagaaggagggcccccacuacacgccgcccauccccaacuaccagccgcccgaggggcgguacaacgacaucaccaagguguacacccaggucgaguucaagcgcuga

SEQ ID NO: 33098 - RNA, 414 nt, Artificial Sequence
  derived and/or modified sequence opt1 from MRPL41__Homo_sapiens__NP_115866
augggcgugcuggccgccgcggcccgcugccucguccgcggggccgaccggaugagcaaguggaccuccaagcggggcccccgcagcuuccgggggcgcaagggccgcggggccaagggcaucggcuuccugaccuccggguggcgguucgugcagaucaaggagauggugccggaguucgucgugcccgaccugacgggcuucaagcucaagcccuacgugagcuaccuggcccccgaguccgaggagaccccgcugaccgcggcccagcuguucagcgaggccgucgcccccgcgaucgagaaggacuucaaggacgggaccuucgaccccgacaaccucgagaaguacggcuucgagcccacgcaggaggggaagcuguuccagcucuacccgcggaacuuccugcgcuga

SEQ ID NO: 33099 - RNA, 999 nt, Artificial Sequence
  derived and/or modified sequence opt1 from MRPL44__Homo_sapiens__NP_075066
auggccagcggccuggugcgccuccugcagcaggggcaccggugccugcucgcccccgucgcgccgaagcuggugccgcccgugcgcggcgucaagaagggguuccgggccgccuuccgcuuccagaaggagcuggagcggcagcgccuccugcggugcccgcccccgcccgugcgccgguccgagaagcccaacugggacuaccacgccgagauccaggccuucggccaccgccugcaggagaacuucagccucgaccugcugaagaccgcguucgugaacuccugcuacaucaagagcgaggaggccaagcggcagcagcucgggaucgagaaggaggccguccugcugaaccucaaguccaaccaggagcugagcgagcagggcaccuccuucagccagacgugccugacccaguuccucgaggacgaguaccccgacaugcccaccgagggcaucaagaaccugguggacuuccugaccggggaggagguggucugccacguggcccgcaaccucgcgguggagcagcugacgcuguccgaggaguuccccgucccgcccgccgugcuccagcagaccuucuucgccgugaucggcgcccugcugcagagcuccgggcccgagcggaccgcccucuucauccgcgacuuccugaucacccagaugacgggcaaggagcuguucgagauguggaagaucaucaaccccauggggcuccuggucgaggagcugaagaagcggaacgugagcgcgcccgagucccgccucacccggcagagcggcggcaccaccgcccugccccuguacuucguggggcucuacugcgacaagaagcugaucgccgagggccccggggagacgguccugguggccgaggaggaggccgcgcgcguggcccuccggaagcuguacggcuucaccgagaaccgccggcccuggaacuacuccaagcccaaggagacccugcgcgccgagaaguccaucaccgccagcuga

SEQ ID NO: 33100 - RNA, 501 nt, Artificial Sequence
  derived and/or modified sequence opt1 from MRPL49__Homo_sapiens__NP_004918
auggccgccaccauguuccgcgcgacccugcggggcuggcgcacgggggugcagcggggcugcgggcuccgccugcugagccagacccaggggcccccggacuacccccgguucgucgaguccguggacgaguaccaguucguggagcgccuccugcccgccacccggauccccgacccgcccaagcacgagcacuaccccacccccagcggcuggcagccgccccgcgacccgccgcccaaccugcccuacuucguccggcgcucccggaugcacaacauccccguguacaaggacaucacgcacggcaaccgccagaugaccgugauccggaaggucgagggcgacaucugggcccuccagaaggacguggaggacuuccugagcccccugcucgggaagacccccgugacccaggucaacgaggugacgggcacccugcgcaucaagggguacuucgaccaggagcugaaggccuggcuccuggagaagggcuucuga

SEQ ID NO: 33101 - RNA, 372 nt, Artificial Sequence
  derived and/or modified sequence opt1 from MRPL52__Homo_sapiens__NP_848026
auggccgcccugggcaccguccucuucaccggggugcgccggcugcacugcagcguggcggccugggccggcgggcaguggcgccugcagcagggccucgccgccaaccccuccggguacggcccccugacggagcugcccgacuggagcuacgcggacggccggcccgcgcccccgaugaaggggcagcuccgccggaaggccgagcgcgagaccuucgcccggcgcgugguccugcugucccaggagauggacgccggccuccaggccuggcagcugcggcagcagaagcugcaggaggagcagcgcaagcaggagaacgcccucaagcccaagggggccagccugaaguccccgcugcccagccaguga

SEQ ID NO: 33102 - RNA, 702 nt, Artificial Sequence
  derived and/or modified sequence opt1 from MRPL9__Homo_sapiens__NP_001287662
auggccgcccccguggucaccgcgccgggccgcgcccugcuccgggccggggccggccgccugcugcgcgggggcgugcaggagcuccugcggccccggcacgaggggaacgcccccgaccuggcgugcaacuucagccucucccagaaccgcggcaccgugaucgucgagcggugguggaaggugccccuggccggcgaggggcgcaagccgcggcugcaccgccggcaccgcguguacaagcucgucgaggacacgaagcaccggcccaaggagaaccuggagcugauccucacccagagcguggagaacgugggcguccgcggggaccugguguccgugaagaagucccugggccggaaccgccuccugccccaggggcuggccgucuacgccucccccgagaacaagaagcuguucgaggaggagaagcuccugcggcaggagggcaagcucgagaagauccagaccaaggcgggcgaggcccugggggugguggucgccccgcacacccugaagcuccccgaggagcccaucacgcgcuggggcgaguacuggugcgaggugaccgugaacgggcuggacaccguccgggugcccaugagcguggucaacuucgagaagccgaagaccaagcgcuacaaguacuggcuggcccagcaggccgcgaaggccauggcccccacgagcccccagaucuga

SEQ ID NO: 33103 - RNA, 585 nt, Artificial Sequence
  derived and/or modified sequence opt1 from MRPS11__Homo_sapiens__NP_073750
augcaggccgugcgcaacgccggcagccgguuccugcgcuccuggaccuggccccagaccgcggggcgggucguggcccgcacgccggccggcaccaucugcaccggggcccggcagcuccaggacgccgcggccaagcagaagguggagcagaacgccgcccccagccacaccaaguucuccaucuacccgcccauccccggcgaggagagcucccugcgcugggcggggaagaaguucgaggagauccccaucgcccacaucaaggccagccacaacaacacgcagauccaggucguguccgccagcaacgagccccuggccuucgcguccugcggcaccgagggcuuccggaacgccaagaaggggaccggcaucgccgcccagaccgccgggaucgcggccgccgcccgcgccaagcagaagggcgugauccacauccgggucguggugaaggggcucggccccggccgccugagcgcgaugcacgggcugaucaugggcgggcucgaggucaucuccaucacggacaacaccccgaucccccacaacggcugccggccccgcaaggcccggaagcuguga

SEQ ID NO: 33104 - RNA, 417 nt, Artificial Sequence
  derived and/or modified sequence opt1 from MRPS12__Homo_sapiens__NP_203527
augagcugguccggccugcuccacgggcugaacaccagccugaccugcggccccgcccucgugccgcgccugugggccacgugcuccauggcgacccugaaccagaugcaccggcucgggccgcccaagcgcccgccccggaagcugggccccaccgaggggcgcccccagcugaagggcgucgugcucugcaccuucacgcggaagcccaagaagcccaacagcgccaaccgcaagugcugccgggugcgccuguccaccggccgggaggccgucugcuucauccccggggagggccacacccugcaggagcaccagaucgugcucguggagggcgggcgcacccaggaccugcccggggucaagcugacgguggugcggggcaaguacgacugcggccacguccagaagaaguga

SEQ ID NO: 33105 - RNA, 414 nt, Artificial Sequence
  derived and/or modified sequence opt1 from MRPS16__Homo_sapiens__NP_057149
auggugcaccugaccacccuccugugcaaggccuaccgcggcgggcaccugacgauccggcucgcccugggcgggugcaccaaccgccccuucuaccggaucgucgcggcccacaacaagugcccgcgcgacggccgguucguggagcagcuggggagcuacgacccccuccccaacucccacggcgagaagcugguggcccugaaccucgaccgcauccggcacuggaucggcugcggggcccaccugagcaagcccauggagaagcugcucggccuggccggguucuucccgcugcaccccaugaugaucaccaacgcggagcgccuccggcgcaagcgggcccgcgagguccugcuggccucccagaagaccgacgccgaggcgacggacaccgaggccaccgagaccuga

SEQ ID NO: 33106 - RNA, 777 nt, Artificial Sequence
  derived and/or modified sequence opt1 from MRPS18B__Homo_sapiens__NP_054765
auggccgccagcgugcugaacaccguccugcgccggcugcccaugcugucccucuuccgcggcagccaccggguccaggugccccugcagacccugugcacgaaggcgcccuccgaggaggacagccucuccagcgugcccaucucccccuacaaggacgagccguggaaguaccuggagagcgaggaguaccaggagcgcuacgggucccggcccgugugggccgacuaccgccggaaccacaagggcggggugccgccccagcgcacccggaagaccugcauccgccggaacaaggucgugggcaaccccugccccaucugccgcgaccacaagcugcacguggacuuccggaacgucaagcuccuggagcaguucgugugcgcccacaccgggaucaucuucuacgcccccuacacgggcgugugcgucaagcagcacaagcgccugacccaggccauccagaaggcgcgggaccacggccuccugaucuaccacaucccccagguggagccgcgcgaccuggacuucagcaccucccacggggccgugagcgccaccccgcccgcccccacgcucgucuccggcgaccccugguaccccugguacaacuggaagcagccgcccgagcgggagcugagccgccugcggcgccucuaccaggggcaccuccaggaggaguccgggcccccgcccgagagcaugcccaagaugccgccccggacccccgcggaggccuccagcaccggccagaccggcccccaguccgcccuguga

SEQ ID NO: 33107 - RNA, 1083 nt, Artificial Sequence
  derived and/or modified sequence opt1 from MRPS22__Homo_sapiens__NP_064576
auggcgccccugggcaccaccgugcuccuguggagccugcuccgcuccagcccgggggucgagcgggugugcuuccgcgcccggauccagcccuggcacggcgggcugcugcagccccuccccugcuccuucgagaugggccugccgcgccggcgcuucagcuccgaggccgccgagagcgggucccccgagacgaagaagcccaccuucauggacgaggaggugcagagcauccugaccaagaugaccggccucaaccugcagaagacguucaagcccgccauccaggagcugaagccgcccaccuacaagcucaugacccaggcccagcuggaggaggccacccggcaggcggucgaggccgccaaggugcgccugaagaugccgcccgugcucgaggagcggguccccaucaacgacgugcuggccgaggacaagauccuggagggcacggagaccaccaaguacguguucaccgacaucuccuacagcaucccccaccgcgagcgguucaucgucgugcgcgagcccuccgggacgcuccggaaggcgagcugggaggagcgcgaccggaugauccagguguacuuccccaaggagggccgcaagauccugaccccgaucaucuucaaggaggagaaccugcggaccauguacucccaggaccgccacgucgacgugcucaaccugugcuucgcccaguucgagcccgacagcaccgaguacaucaaggugcaccacaagacguacgaggacaucgacaagcgggggaaguacgaccugcuccgcuccacccgguacuucggcgggauggucugguacuucgugaacaacaagaagaucgacggccugcugaucgaccagauccagcgcgaccucaucgacgacgccaccaaccuggugcagcuguaccacguccuccaccccgacggccagagcgcccagggggccaaggaccaggcggccgagggcaucaaccugaucaagguguucgccaagaccgaggcccagaagggggccuacaucgagcugacgcuccagaccuaccaggaggcgcugucccgccacagcgccgccuccuga

SEQ ID NO: 33108 - RNA, 573 nt, Artificial Sequence
  derived and/or modified sequence opt1 from MRPS23__Homo_sapiens__NP_057154
auggccggcagccgccuggagaccgugggguccaucuucagccggacccgcgaccucguccgggccggcgugcugaaggagaagccccugugguucgacguguacgacgcguucccgccccuccgcgagcccgucuuccagcggccccgcgugcgguacgggaaggccaaggccccgauccaggacaucugguaccacgaggaccgcauccgggccaaguucuacuccguguacggcagcgggcagcgcgccuucgaccuguucaaccccaacuucaaguccacgugccagcgguucgucgagaaguacaccgagcugcagaagcucggcgagaccgacgaggagaagcuguucguggagaccggcaaggcgcugcucgccgagggggugauccugcgccgggucggcgaggcccgcacgcagcacgggggcagccacgugucccgcaagagcgagcaccuguccgugcggccccagaccgcccucgaggagaacgagacccagaaggaggucccccaggaccagcaccuggaggcgcccgccgaccagagcaaggggcugcucccgcccuga

SEQ ID NO: 33109 - RNA, 564 nt, Artificial Sequence
  derived and/or modified sequence opt1 from MRPS28__Homo_sapiens__NP_054737
auggccgcccugugccgcacccgggcgguggccgccgagagccacuuccuccgcgucuuccuguucuuccggcccuuccgcggcguggggaccgaguccggcagcgaguccgggagcuccaacgccaaggagccgaagacgcgggccggcggguucgcgagcgcccuggagcgccacuccgagcuccugcagaagguggagccccugcagaagggcagccccaagaacgucgaguccuucgccagcaugcuccggcacagcccccugacccagaugggcccggccaaggacaagcuggugaucgggcgcaucuuccacaucguggagaacgaccucuacaucgacuucggcgggaaguuccacugcgucugccggcgccccgagguggacggcgagaaguaccagaaggggacccgggugcgccugcggcugcucgaccuggagcugaccucccgcuuccucggcgcgacgaccgacaccaccguccuggaggccaacgccgugcugcucggcauccaggaguccaaggacagccgguccaaggaggagcaccacgagaaguga

SEQ ID NO: 33110 - RNA, 1320 nt, Artificial Sequence
  derived and/or modified sequence opt1 from MRPS30__Homo_sapiens__NP_057724
auggccgccgcgcgcugcuggcggccccugcuccgcggcccgcggcugagccugcacaccgccgccaacgccgccgcgaccgccacggagacgaccugccaggacguggccgccacccccgucgcgcgcuacccgcccaucguggccuccaugaccgccgacagcaaggccgcccggcuccgccggaucgagcgcuggcaggcgaccgugcacgccgccgaguccgucgacgagaagcugcggauccugaccaagaugcaguucaugaaguacaugguguacccccagaccuucgcccucaacgccgaccgcugguaccaguacuucacgaagaccguguuccugagcgggcugcccccgccgcccgcggagcccgagcccgagcccgagcccgagcccgagcccgcccucgaccuggccgcccugcgggccgucgcgugcgacugccuccugcaggagcacuucuaccugcgccggcgccggcgcgugcaccgguacgaggaguccgaggugaucagccuccccuuccuggaccagcuggucuccacccucgugggccugcugagcccgcacaaccccgcccucgccgccgccgcgcuggacuaccgcugccccgugcacuucuacuggguccgcggggaggagaucaucccccggggccaccggcgcgggcgcaucgacgaccugcgguaccagaucgacgacaagccgaacaaccagauccgcaucuccaagcagcucgccgaguucgugccccuggacuacagcgugcccaucgagauccccaccaucaagugcaagccggacaagcugccccucuucaagcggcaguacgagaaccacaucuucgucggcuccaagacggccgaccccugcugcuacggccacacccaguuccaccuccugcccgacaagcugcgccgggagcgccugcugcggcagaacugcgccgaccagaucgaggugguguuccgcgcgaacgccaucgccagccucuucgccuggaccggggcccaggcgauguaccagggcuucugguccgaggccgacgucacccggccguucgugagccaggccgugaucacggacgggaaguacuucuccuucuucugcuaccagcugaacacccuggcccucaccacccaggccgaccagaacaacccccgcaagaacaucugcuggggcacgcagagcaagccccuguacgagaccaucgaggacaacgacgucaagggguucaacgacgacgugcugcuccagaucgugcacuuccugcugaaccggccgaaggaggagaagucccagcuccuggagaacuga

SEQ ID NO: 33111 - RNA, 1188 nt, Artificial Sequence
  derived and/or modified sequence opt1 from MRPS31__Homo_sapiens__NP_005821
auguucccccgcgugagcaccuuccugccgcuccggccccugucccgccacccccugagcuccggcagccccgagaccuccgccgccgcgaucaugcuccugacgguccggcacgggaccgugcgcuaccggagcuccgcccugcucgcccgcaccaagaacaacauccagcgguacuucggcaccaacagcgugaucugcuccaagaaggacaagcagagcguccgcacggaggagaccuccaaggagaccagcgagucccaggacagcgagaaggagaacaccaagaaggaccugcuggggaucaucaagggcaugaagguggagcucuccacggugaacguccggaccaccaagccgcccaagcgccggccccucaagagccuggaggccacccuggggcgccugcggcgcgccacggaguacgcgcccaagaagcggaucgagccgcugucccccgagcucguggccgccgccagcgcgguggccgacucccugcccuucgacaagcagaccaccaagagcgagcugcucagccagcugcagcagcacgaggaggagucccgcgcccagcgggacgccaagcgccccaagaucagcuucuccaacaucaucagcgacaugaaggucgcccgguccgcgaccgcccgcgugcggagccgcccggagcugcgcauccaguucgacgagggcuacgacaacuaccccggccaggagaagacggacgaccucaagaagcggaagaacaucuucaccgggaagcgccugaacaucuucgacaugauggccgugaccaaggaggcccccgagaccgacacgucccccagccugugggacgucgaguucgccaagcagcucgcgaccgugaacgagcagccgcugcagaacggcuucgaggagcugauccaguggaccaaggaggggaagcucugggaguuccccaucaacaacgaggccggcuucgacgacgacggguccgaguuccacgagcacaucuuccuggagaagcaccuggagagcuuccccaagcagggccccauccggcacuucauggagcucgugaccugcggccuguccaagaacccguaccugagcgucaagcagaagguggagcacaucgagugguuccgcaacuacuucaacgagaagaaggacauccucaaggaguccaacauccaguucaacuga

SEQ ID NO: 33112 - RNA, 321 nt, Artificial Sequence
  derived and/or modified sequence opt1 from MRPS33__Homo_sapiens__NP_444263
augagcucccugagcgaguacgccuuccgcaugucccggcucagcgcccgccuguucggcgaggugacccggcccaccaacuccaagagcaugaaggucgugaagcuguucuccgagcucccgcuggcgaagaagaaggagacguacgacugguaccccaaccaccacaccuacgccgagcugaugcagacccuccgcuuccuggggcuguaccgggacgagcaccaggacuucauggacgagcagaagcgccucaagaagcugcggggcaaggagaagcccaagaagggggagggcaagcgcgccgccaagcggaaguga

SEQ ID NO: 33113 - RNA, 378 nt, Artificial Sequence
  derived and/or modified sequence opt1 from MRPS6__Homo_sapiens__NP_115865
augccccgcuacgagcuggcccucauccugaaggccaugcagcggccggagaccgcggccacccugaagcgcacgaucgaggcccucauggaccggggcgccaucgugcgcgaccuggagaaccugggggagcgggcccuccccuaccgcaucagcgcgcacucccagcagcacaaccggggcggguacuuccuggucgacuucuacgcccccaccgccgccguggagagcaugguggagcaccugucccgcgacaucgacgucauccggggcaacaucgugaagcacccccucacccaggagcugaaggagugcgaggggaucgugccggucccccuggcggagaagcucuacagcaccaagaagcgcaagaaguga

SEQ ID NO: 33114 - RNA, 729 nt, Artificial Sequence
  derived and/or modified sequence opt1 from MRPS7__Homo_sapiens__NP_057055
auggccgcccccgcggugaaggucgcccgcggcuggagcgggcuggcccucggcgugcggcgcgccgugcugcagcugccggggcucacccagguccgguggucccgcuacagccccgaguucaaggacccccugaucgacaaggaguacuaccggaagcccguggaggagcugaccgaggaggagaaguacgugcgcgagcucaagaagacgcagcugaucaaggccgcgccggccggcaagaccuccagcgucuucgaggaccccgugaucuccaaguucaccaacaugaugaugaucgggggcaacaaggugcuggcccggagccucaugauccagacccuggaggccgucaagcgcaagcaguucgagaaguaccacgcggccuccgccgaggagcaggccacgaucgagcggaaccccuacaccaucuuccaccaggcccugaagaacugcgagcccaugaucggccucgugccgauccugaagggcgggcgcuucuaccaggugcccgucccccugcccgaccggcgccggcgcuuccucgcgaugaaguggaugaucaccgagugccgggacaagaagcaccagcgcacccugaugccggagaagcugagccacaagcuccuggaggccuuccacaaccaggggcccgugaucaagcggaagcacgaccugcacaagauggccgaggccaaccgcgcccucgcgcacuaccgguggugguga

SEQ ID NO: 33115 - RNA, 1191 nt, Artificial Sequence
  derived and/or modified sequence opt1 from MRPS9__Homo_sapiens__NP_872578
auggccgcccccugcgugagcuacggcggggcggucuccuaccgccugcuccuguggggccgggggagccuggcccgcaagcagggccucuggaagaccgccgccccggagcugcagaccaacgugcggucccagauccugcgccuccggcacacggccuucgugauccccaagaagaacguccccaccagcaagcgcgagaccuacaccgaggacuucaucaagaagcagaucgaggaguucaacaucgggaagcggcaccuggcgaacaugaugggcgaggaccccgagacguucacccaggaggacaucgaccgcgccaucgccuaccuguucccguccggccucuucgagaagcgggcccgccccgugaugaagcaccccgagcagaucuucccccggcagcgcgcgauccaguggggcgaggacgggcggccguuccacuaccuguucuacaccgggaagcagagcuacuacucccugaugcacgacguguacggcaugcuccugaaccuggagaagcaccagagccaccuccaggccaagucccugcugcccgagaagaccgucacgcgcgacgugaucgggagccgguggcucaucaaggaggagcuggaggagaugcugguggagaagcucuccgaccuggacuacaugcaguucauccgccugcucgagaagcugcugaccagccagugcggcgccgccgaggaggaguucguccagcgguuccgccgguccgugacccucgagagcaagaagcagcugaucgagcccgugcaguacgacgagcagggcauggccuucuccaagagcgaggggaagcgcaagaccgcgaaggccgaggccaucgucuacaagcacggcuccgggcggaucaaggugaacggcaucgacuaccagcuguacuuccccaucacgcaggaccgcgagcagcucauguucccguuccacuucguggaccgccugggcaagcacgacgugaccugcaccgucagcgggggcgggcgguccgcccaggccggcgcgauccgccuggccauggccaaggcccucugcagcuucgugaccgaggacgaggucgaguggaugcggcaggccgggcugcugacgaccgacccccgcgugcgggagcgcaagaagcccggccaggagggcgcgcggcgcaaguucaccuggaagaagcgguga

SEQ ID NO: 33116 - RNA, 633 nt, Artificial Sequence
  derived and/or modified sequence opt1 from MRRF__Homo_sapiens__NP_001166983
auggcccugggccucaagugcuuccgcauggugcaccccaccuuccggaacuaccuggccgcgagcauccgcccggucuccgaggugacccugaagacggugcacgagcggcagcacgggcaccgccaguacauggccuacagcgccguccccgugcggcacuucgccaccaagaaggccaagggcucccucgacaagaucgcgguggucaccgccgacgggaagcuggcccugaaccagaucagccagaucuccaugaaguccccgcagcucauccuggugaacauggccagcuuccccgagugcaccgcggccgccaucaaggccauccgcgagagcggcaugaaccugaaccccgagguggaggggacgcucauccggguccccaucccccaggugacccgcgagcaccgggagaugcuggugaagcuggccaagcagaacaccaacaaggcgaaggacucccuccgcaagguccggaccaacagcaugaacaagcugaagaaguccaaggacacggugagcgaggacaccauccgccugaucgagaagcagaucucccagauggccgacgacaccguggccgagcucgaccggcaccuggccgucaagaccaaggagcugcucggcuga

SEQ ID NO: 33117 - RNA, 1341 nt, Artificial Sequence
  derived and/or modified sequence opt1 from MRS2__Homo_sapiens__NP_001273193
auggagugccugcgcagccuccccugccugcugccccgggccaugcgccucccccggcgcacccugugcgcccuggcgcucgacgugaccuccgucggcccgcccguggccgccugcgggcggcgcgccaaccugaucggccggagccgcgccgcgcagcugugcgggcccgaccggcuccgcguggccggcgagguccaccgguuccgcacguccgacgugagccaggccacccuggccuccguggcgcccgucuucaccgugaccaaguucgacaagcaggggaacgugacgagcuucgagcggaagaagaccgagcuguaccaggagcucggccugcaggcccgcgaccugcgguuccagcacgucauguccaucaccgugcgcaacaaccggaucaucaugcgcauggagaaguacagccuccugcuggaguccguggccagcauccuccagaacuccgucagcuucauggagcggcagaccgagcaguggcuguuccgcgagcugcccucccagcucagcggcgaggggcagcuggugacguacccccugccguucgaguuccgggccaucgaggcccuccugcaguacuggaucaacacccugcagggcaagcucuccauccugcagccccugauccucgagacccuggacgcgcugguggaccccaagcacagcuccgucgaccgcagcaagcuccacauccugcugcagaacgggaagucccucagcgagcuggagaccgacaucaagaucuucaaggagagcauccuggagauccucgacgaggaggagcugcuggaggagcucugcguguccaaguggagcgacccccagguguucgagaaguccagcgccggcaucgaccacgccgaggagauggagcugcugcucgagaacuacuaccgccuggccgacgaccuguccaacgccgcgcgggagcuccgcguccugaucgacgacagccaguccaucaucuucaucaaccuggacagccaccggaacgugaugaugcgccugaaccuccagcugacgauggggaccuucucccugagccucuucggccugaugggcguggccuucgggaugaaccuggaguccagccucgaggaggaccaccggaucuucuggcugaucaccggcaucauguucaugggguccggccugaucuggcgccggcuccugagcuuccugggccgccagcucgaggccccgcugccgcccaugauggccucccugcccaagaagacccuccuggccgaccggagcauggagcugaagaacucccuccgccuggacgggcugggcagcgggcgguccauccucacgaaccgcuga

SEQ ID NO: 33118 - RNA, 2715 nt, Artificial Sequence
  derived and/or modified sequence opt1 from MRVI1__Homo_sapiens__NP_001092049
augggcauggaccugaccugccccuucgggaucagcccggccugcggcgcccaggcguccuggagcaucuucggggccgacgccgccgaggugcccggcacccgcgggcacucccagcaggaggccgcgaugccccacauccccgaggacgaggagccgcccggcgagccccaggccgcccagagccccgccggccaggggccgcccgcggccggcgucuccugcagccccacgcccaccaucgugcucaccggggacgccaccuccccggagggcgagacggacaagaaccuggccaaccgggugcacagcccccacaagcgccugucccaccggcaccucaaggucagcaccgccucccugaccagcguggaccccgcggggcacaucaucgaccuggugaacgaccagcuccccgacaucuccaucagcgaggaggacaagaagaagaaccuggcccugcucgaggaggccaagcuggucuccgagcgcuuccugacccggcgcggccgcaagagccgcuccagcccgggcgacucccccagcgccgugagccccaaccucucccccagcgccuccccgacgagcucccggagcaacucccugaccgugcccaccccgcccgggcuggacgucugcagcggcccgcccagcccccuccccggggcgccgccccagcagaagggcgacgaggccgacguguccagcccccacccgggcgagcccaacgugcccaaggggcuggccgaccgcaagcagaacgaccagcggaaggucucccagggccgccuggcgccccggccgccgcccguggagaaguccaaggagaucgccaucgagcagaaggagaacuucgacccccuccaguaccccgagaccacgcccaaggggcuggcccccgugaccaacagcuccggcaagauggcccugaacagcccccagcccgggcccgucgaguccgagcucggcaagcagcugcugaagaccggcugggaggggagcccccucccccgguccccgacccaggacgccgccggcguggggccgcccgccagccagggccgggggcccgcgggcgagcccaugggccccgaggccgggagcaaggccgagcugccgcccacggugucccgcccgccccugcuccggggccugagcugggacuccgggcccgaggagcccggcccccgccugcagaagguccucgccaagcugccccuggcggaggaggagaagcgguucgccgggaaggccggcggcaagcucgccaaggcccccgggcugaaggacuuccagauccaggugcagccggugcgcaugcagaagcugaccaagcuccgggaggagcacauccugaugcgcaaccagaaccuggucggccucaagcugcccgaccugagcgaggcggccgagcaggagaaggggcuccccuccgagcugagccccgccaucgaggaggaggaguccaagagcggccuggacgugaugccgaacaucuccgacgugcuccugcgcaagcugcggguccaccgcagccuccccggcuccgccccgccccugaccgagaaggagguggagaacgucuucgugcagcugagccuggccuuccggaacgacuccuacacccucgagagccgcaucaaccaggcggagcgggagcgcaaccugacggaggagaacaccgagaaggagcuggagaacuucaaggccuccaucaccagcuccgccagccucuggcaccacugcgagcaccgggagaccuaccagaagcugcuggaggacaucgccgugcuccaccgccuggccgcgcggcugagcucccgcgccgaggucgugggggccgugcggcaggagaagcgcaugagcaaggccacggaggucaugaugcaguacguggagaaccucaagcggaccuacgagaaggaccacgcggagcugauggaguucaagaagcuggccaaccagaacuccagccgcuccugcggccccagcgaggacggggugccccggaccgcccgcuccaugagccucacccugggcaagaacaugccccggcgccgggucuccguggccgugguccccaaguucaacgcccugaaccucccggggcagacgcccagcuccagcuccauccccagccugcccgcgcuguccgagagcccgaacggcaagggcucccuccccgugaccagcgcccugcccgcccugcucgagaacgggaagaccaacggcgaccccgacugcgaggccuccgccccggcgcugacccugagcugccucgaggagcugagccaggagacgaaggcccgcauggaggaggaggccuacuccaagggguuccaggagggccugaagaagaccaaggagcuccaggaccugaaggaggaggaggaggagcagaaguccgagagccccgaggagcccgaggagguggaggagaccgaggaggaggagaaggggccccgcagcuccaagcuggaggagcucguccacuuccuccaggugauguacccgaagcugugccagcacuggcaggucaucuggaugauggccgccgugaugcuggugcugaccgugguccugggccucuacaacagcuacaacuccugcgcggagcaggccgacggcccccuggggcggagcacgugcuccgccgcccagcgcgacagcuggugguccagcggccugcagcacgagcagcccaccgagcaguga

SEQ ID NO: 33119 - RNA, 666 nt, Artificial Sequence
  derived and/or modified sequence opt1 from MS4A12__Homo_sapiens__NP_001157942
augaugagcuccaagcccaccagccacgccgaggugaacgagaccauccccaaccccuacccgcccuccagcuucauggcccccggcuuccagcagccccugggguccaucaaccucgagaaccaggcgcagggcgcccagcgcgcccagcccuacgggaucacgagccccggcaucuucgccuccagccagccggggcagggcaacauccagaugaucaaccccuccgucggcaccgccgugaugaacuucaaggaggaggcgaaggcccugggguucaucaucagcggcucccugagcguguccgccagcaaggagcucucccggugccuggucaaggggagccugggcaugaacaucguguccagcauccucgccuucaucggggugauccugcugcucgucgacaugugcaucaacggcguggcgggccaggacuacugggccgugcuguccgggaagggcaucagcgccacccugaugaucuucagccuccuggaguucuucgucgccugcgccaccgcgcacuucgccaaccaggccaacacgaccaccaacauguccgugcuggugauccccaacauguacgagagcaaccccgucaccccggccuccagcuccgccccgccccgcugcaacaacuacagcgcgaacgcccccaaguga

SEQ ID NO: 33120 - RNA, 894 nt, Artificial Sequence
  derived and/or modified sequence opt1 from MS4A1__Homo_sapiens__NP_068769
augaccacgccccgcaacagcgugaacggcaccuucccggccgagcccaugaaggggcccaucgccaugcaguccggccccaagccgcuguuccggcgcaugagcucccucgucgggcccacccagagcuucuucaugcgggaguccaagacccugggcgcggugcagaucaugaacgggcuguuccacaucgcccucggcggccugcugaugauccccgccgggaucuacgcccccaucugcgugaccgucugguacccgcucuggggcgggaucauguacaucaucagcggcucccugcuggccgcgacggagaagaacagccgcaagugccucgugaaggggaagaugaucaugaacucccugagccuguucgccgccaucuccggcaugauccucagcaucauggacauccugaacaucaagaucucccacuuccugaagauggagagccucaacuucauccgggcccacacccccuacaucaacaucuacaacugcgagcccgcgaaccccuccgagaagaacagcccguccacccaguacugcuacagcauccagucccuguuccugggcauccucagcgugaugcugaucuucgccuucuuccaggagcuggucaucgccgggaucguggagaacgaguggaagcggaccugcagccgccccaaguccaacaucgugcuccugagcgccgaggagaagaaggagcagacgaucgagaucaaggaggaggucgugggccugaccgagaccuccagccagcccaagaacgaggaggacaucgagaucauccccauccaggaggaggaggaggaggagaccgagacgaacuucccggagccgccccaggaccaggaguccagccccaucgagaacgacuccagccccuga

SEQ ID NO: 33121 - RNA, 600 nt, Artificial Sequence
  derived and/or modified sequence opt1 from MS4A2__Homo_sapiens__NP_001243845
auggacaccgagagcaaccgccgggccaaccuggcccucccccaggagccguccagcgugcccgcguucgagguccuggagaucagcccccaggaggugagcuccggccgccugcucaagagcgccuccagcccgccccugcacaccuggcugacggugcucaagaaggagcaggaguuccugggguucuccaucagcggcaugcuguccaucaucagcgagcggcgcaacgccaccuaccucguccgggggucccugggcgccaacaccgccagcuccaucgccgggggcaccggcaucacgauccugaucaucaaccucaagaagucccuggcguacauccacauccacuccugccagaaguucuucgagaccaagugcuucauggccagcuucuccaccgagaucguggugaugaugcuguuccucaccauccuggggcugggcagcgccgucagccucacgaucugcggggcgggcgaggagcugaaggggaacaaggugcccgaggaccgcguguacgaggagcugaacaucuacuccgccaccuacagcgagcucgaggaccccggcgagauguccccgcccaucgaccuguga

SEQ ID NO: 33122 - RNA, 276 nt, Artificial Sequence
  derived and/or modified sequence opt1 from MS4A3__Homo_sapiens__NP_001026836
augaacaucgccagcgccaccaucgcgcuggugggcaccgccuuccucucccugaacaucgccgucaacauccagagccugcgcuccugccacagcuccagcgagucccccgaccucugcaacuacauggggagcaucuccaacggcauggugagccugcugcucauccugacgcugcucgagcugugcgugaccaucuccaccaucgccauguggugcaacgccaacugcugcaacagccgggaggagaucuccagcccgcccaacuccgucuga

SEQ ID NO: 33123 - RNA, 561 nt, Artificial Sequence
  derived and/or modified sequence opt1 from MS4A4A__Homo_sapiens__NP_001230195
augcaccagaccuacagccgccacugccggcccgaggaguccaccuucagcgccgccaugacgaccaugcagggcauggagcaggcgaugccgggggccggccccggggugccccagcugggcaacauggccgucauccacucccaccucuggaaggggcugcaggagaaguuccugaagggcgagcccaaggugcucggcgugguccagauccugaccgcccugaugagccucuccauggggaucaccaugaugugcauggccagcaacacguacggcuccaacccgaucagcguguacaucggguacaccaucuggggcuccgugauguucaucaucagcgggucccugagcaucgcggccggcauccgcaccaccaagggccuggggcucgacggcaugguccugcugcucuccgugcuggaguucugcaucgccgugagccuguccgccuucgggugcaagguccucugcugcacgcccggcggcguggugcugauccugcccagccacucccacauggcggagaccgccagccccaccccgcucaacgaggucuga

SEQ ID NO: 33124 - RNA, 762 nt, Artificial Sequence
  derived and/or modified sequence opt1 from MS4A6A__Homo_sapiens__NP_001234928
auggugcugcucaagcugcuggaggucuaccgcaagggcagcgccgggaccuuccacaaguccaccaucuucggcaacacgaucaugaccagccagcccgugccgaacgagaccaucaucgugcuccccuccaacgucaucaacuucagccaggccgagaagcccgagcccaccaaccaggggcaggacucccugaagaagcaccuccacgcggagaucaaggugaucggcacgauccagauccugugcgggaugauggugcugagccugggcaucauccucgccuccgccagcuucuccccgaacuucacccaggucaccagcacccugcugaacuccgccuaccccuucaucggccccuucuucuucaucaucagcgggucccucagcaucgccacggagaagcggcugaccaagcugcucgugcacuccagccuggugggcuccauccugagcgcgcucuccgcccuggucggguucaucauccugagcgugaagcaggccacccucaaccccgccagccugcagugcgagcuggacaagaacaacaucccgacccgcuccuacgugagcuacuucuaccacgacucccucuacacgaccgacugcuacaccgcgaaggccagccuggccggcacccugucccucaugcugaucugcacgcugcucgaguucugccuggccguccugaccgccgugcuccgguggaagcaggcguacagcgacuuccccgggguguccguccuggccggcuucaccuga

SEQ ID NO: 33125 - RNA, 753 nt, Artificial Sequence
  derived and/or modified sequence opt1 from MS4A8__Homo_sapiens__NP_113645
augaacagcaugaccuccgccgugcccgucgccaacagcgugcugguggucgcgccccacaacggcuaccccgugacccccgggaucaugucccacgugccccucuacccgaacagccagccccagguccaccuggugcccggcaacccgcccucccuggugagcaacgucaacgggcagcccgugcagaaggcccucaaggagggcaagacgcugggggccauccagaucaucaucggccuggcccacaucggccucggguccaucauggccaccgugcuggucggcgaguaccugagcaucuccuucuacgggggcuuccccuucuggggcgggcucugguucaucaucagcggcucccugagcguggcggccgagaaccagcccuacuccuacugccugcucagcgggucccugggccugaacaucgugagcgccaucugcuccgccgucggggugauccucuucaucaccgaccugagcaucccgcaccccuacgcguaccccgacuacuaccccuacgccuggggcgugaacccgggcauggccaucuccgggguccugcucguguucugccugcuggaguucggcaucgccugcgccagcagccacuucgggugccagcucgugugcugccaguccagcaacgucuccgugaucuaccccaacaucuacgcggccaaccccgugaucacccccgagccggucacgagcccgcccuccuacagcuccgagauccaggccaacaaguga

SEQ ID NO: 33126 - RNA, 1365 nt, Artificial Sequence
  derived and/or modified sequence opt1 from MSANTD3-TMEFF1__Homo_sapiens__NP_001185741
augcagaacaacgagaucaucaagcccgccaaguacuucagcgagcuggagaaguccauccuccuggcccugguggagaaguacaaguacguccucgagugcaagaaguccgacgcgcgcaccaucgcccugaagcagcggaccuggcaggcccuggcccacgaguacaacucccagccgagcgugucccuccgcgacuucaagcagcugaagaagugcugggagaacaucaaggcccggacgaagaagaucauggcgcacgagcgccgggagaaggugaagcgcagcgucagcccccugcucagcacccacgugcugggcaaggagaagaucgccuccaugcugcccgagcagcucuacuuccugcagagcccgcccgaggaggagcccgaguaccaccccgacgccuccgcccaggagcugaacgugcgggagagcgacguccgcgugugcgacgaguccagcugcaaguacgggggcgugugcaaggaggacggggacggccucaagugcgcgugccaguuccagugccacaccaacuacauccccgucugcggguccaacggcgacaccuaccagaacgagugcuuccugcggcgcgccgccugcaagcaccagaaggagaucacggugaucgcccggggcccgugcuacagcgacaacggguccggcagcggggagggcgaggaggagggguccggcgccgaggugcaccgcaagcacagcaagugcggccccugcaaguacaaggcggagugcgacgaggacgccgagaacgucgggugcgugugcaacaucgacugcagcggcuacuccuucaaccccgugugcgccagcgacggguccagcuacaacaaccccugcuucguccgggaggccuccugcaucaagcaggagcagaucgacauccgccaccugggccacugcaccgacaccgacgacaccagccuccugggcaagaaggacgacgggcugcaguaccggccggacgugaaggacgccuccgaccagcgcgaggacguguacaucggcaaccacaugcccugccccgagaaccucaacggguacugcauccacggcaagugcgaguucaucuacagcacgcagaaggcguccugccggugcgagagcggguacaccggccagcacugcgagaagaccgacuucuccauccuguacgucgugcccagccgccagaagcugacccacgugcucaucgccgccaucaucggcgccguccagaucgccaucaucguggcgaucgugaugugcaucacgcggaagugcccgaagaacaaccgcgggcggcgccagaagcagaaccugggccacuucaccuccgacaccagcucccgcauggucuga

SEQ ID NO: 33127 - RNA, 621 nt, Artificial Sequence
  derived and/or modified sequence opt1 from MSC__Homo_sapiens__NP_005089
augagcaccggcuccgugagcgaccccgaggagauggagcugcgcgggcuccagcgggaguacccgguccccgccuccaagcgcccgccccugcggggcguggagcgcagcuacgccucccccagcgacaacuccagcgcggaggaggaggaccccgacggggaggaggagcggugcgcccugggcaccgccggguccgccgagggcugcaagcgcaagcggccccgcguggccggcgggggcggggcgggcgggagcgccggcggcgggggcaagaagccccucccggccaagggguccgccgcggagugcaagcagagccagcggaacgccgccaacgcccgcgagcgggcccgcaugcggguccuguccaaggcguucagccgccugaagacgucccuccccugggugccgcccgacaccaagcugagcaagcuggacacccuccggcuggccuccagcuacaucgcccaccuccgccagcugcugcaggaggaccgguacgagaacggcuacgugcaccccgucaaccugaccuggcccuucgugguguccggccgccccgacagcgacacgaaggaggucagcgccgccaaccggcucugcgggaccaccgcguga

SEQ ID NO: 33128 - RNA, 582 nt, Artificial Sequence
  derived and/or modified sequence opt1 from MSGN1__Homo_sapiens__NP_001099039
auggacaaccugcgcgagaccuuccucagccuggaggacggccugggguccagcgacucccccggccuccugagcuccugggacuggaaggaccgggccgggccguucgagcugaaccaggccagccccucccagagccucucccccgcgcccagccuggaguccuacagcuccagcccgugccccgccguggccggccugcccugcgagcacgggggcgccuccagcggcggguccgagggcugcagcgucgggggcgccuccgggcucguggagguggacuacaacaugcuggcguuccagcccacccaccuccagggcggcgggggcccgaaggcccagaaggggacgaagguccgcaugagcgugcagcggcgccggaaggccagcgagcgcgagaagcugcggaugcgcacccuggccgacgcgcugcacacccuccggaacuaccugccgcccguguacucccagcgcggccagccccugaccaagauccagacgcucaaguacaccaucaaguacaucggcgagcugaccgaccugcucaaccgggggcgcgagccccgggcccagagcgccuga

SEQ ID NO: 33129 - RNA, 2805 nt, Artificial Sequence
  derived and/or modified sequence opt1 from MSH2__Homo_sapiens__NP_000242
auggccgugcagcccaaggagacccugcagcucgagagcgccgcggaggucggcuucgugcgcuucuuccaggggaugccggagaagcccaccacgaccgugcggcuguucgaccgcggcgacuucuacaccgcccacggggaggacgcccugcucgccgcccgggaggucuucaagacccagggcgugaucaaguacauggggcccgcgggcgccaagaaccugcaguccgugguccugagcaagaugaacuucgaguccuucgugaaggaccuccugcuggugcgccaguaccgggucgagguguacaagaaccgcgccggcaacaaggccagcaaggagaacgacugguaccucgcguacaaggccucccccgggaaccugagccaguucgaggacauccuguucggcaacaacgacauguccgccagcaucgggguggucggcgugaagauguccgccguggacgggcagcggcaggucggcgugggcuacguggacagcauccagcgcaagcucgggcugugcgaguucccggacaacgaccaguucuccaaccuggaggcccuccugauccagaucggccccaaggagugcguccugcccgggggcgagacggcgggcgacauggggaagcuccggcagaucauccagcgcggcgggauccugaucaccgagcggaagaaggccgacuucagcaccaaggacaucuaccaggaccugaaccgccuccugaagggcaagaagggggagcagaugaacuccgccgugcugcccgagauggagaaccagguggccgucagcucccucagcgccgugaucaaguuccuggagcugcucuccgacgacagcaacuucggccaguucgagcugaccacguucgacuucucccaguacaugaagcuggacaucgcggccgugcgggcccucaaccuguuccagggcagcgucgaggacaccaccgggagccagucccuggccgcccuccugaacaagugcaagaccccgcagggccagcgccuggugaaccaguggaucaagcagccccucauggacaagaaccggaucgaggagcgccugaaccuggucgaggcguucguggaggacgccgagcuccggcagacgcugcaggaggaccugcuccgccgguuccccgaccugaaccgccuggccaagaaguuccagcggcaggccgccaaccuccaggacugcuaccgccuguaccaggggaucaaccagcugcccaacgugauccaggcgcucgagaagcacgagggcaagcaccagaagcugcugcuggccgucuucgugaccccgcucaccgaccugcgcagcgacuucuccaaguuccaggagaugaucgagaccacgcuggacauggaccagguggagaaccacgaguuccucgucaagcccagcuucgaccccaaccuguccgagcugcgggagaucaugaacgaccucgagaagaagaugcagagcacccugaucuccgccgcccgcgaccuggggcucgaccccggcaagcagaucaagcuggacagcuccgcgcaguucggcuacuacuuccgggugaccugcaaggaggagaaggugcugcgcaacaacaagaacuucagcaccgucgacauccagaagaacggggugaaguucacgaacuccaagcucaccagccugaacgaggaguacaccaagaacaagaccgaguacgaggaggcccaggacgccaucgugaaggagaucgucaacaucuccagcggcuacguggagccgaugcagacgcugaacgacgugcucgcccagcuggacgccgucguguccuucgcgcacgugagcaacggggcccccguccccuacgugcggcccgccauccuggagaagggccaggggcgcaucauccucaaggccucccggcacgccugcguggagguccaggacgagaucgcguucaucccgaacgacguguacuucgagaaggacaagcagauguuccacaucaucaccggccccaacaugggcggcaagagcaccuacauccgccagaccggggugaucguccugauggcccagaucgggugcuucgugcccugcgaguccgccgaggugagcaucgucgacugcauccuggcccgggugggcgccggcgacagccagcucaaggggguguccacguucauggcggagaugcuggagaccgccagcauccugcgcuccgccaccaaggacagccucaucaucaucgacgagcugggccgggggaccuccacguacgacggcuucgggcuggccugggcgaucagcgaguacaucgccaccaagaucggcgccuucugcauguucgccacccacuuccacgagcucaccgcccuggcgaaccagauccccacggucaacaaccugcacgugaccgcccucaccaccgaggagacccugacgaugcuguaccaggugaagaagggcgucugcgaccaguccuucgggauccacguggccgagcucgccaacuucccgaagcacgugaucgagugcgccaagcagaaggcgcuggagcuggaggaguuccaguacaucggcgagagccagggguacgacaucauggagcccgccgccaagaagugcuaccucgagcgcgagcagggcgagaagaucauccaggaguuccuguccaaggucaagcagaugcccuucaccgagaugagcgaggagaacaucaccaucaagcugaagcagcucaaggccgaggugaucgccaagaacaacuccuucgugaacgagaucaucagccggaucaaggucaccacguga

SEQ ID NO: 33130 - RNA, 3414 nt, Artificial Sequence
  derived and/or modified sequence opt1 from MSH3__Homo_sapiens__NP_002430
augagccgccggaagcccgccuccggcgggcuggccgcgagcuccagcgcccccgcccgccaggccgugcucucccgguucuuccagagcaccggcucccugaaguccaccuccagcuccacgggggccgcggaccaggucgaccccggcgccgccgccgcggccgccgccgccgcggccgccgccccgcccgccccgcccgcgcccgccuucccgccccagcugccgccccacaucgccaccgagaucgaccgccggaagaagcgcccccucgagaacgacgggcccgugaagaagaaggugaagaagguccagcagaaggagggcggcagcgaccuggggauguccggcaacagcgagcccaagaagugccugcggacccgcaacguguccaagagccucgagaagcugaaggaguucugcugcgacuccgcccugccccagagccgggugcagaccgagucccuccaggagcgcuucgccguccugcccaagugcacggacuucgacgacaucagccugcuccacgcgaagaacgccgugagcuccgaggacagcaagcggcagaucaaccagaaggacaccacccuguucgaccugucccaguucgggagcuccaacaccagccacgagaaccuccagaagacggccuccaagagcgccaacaagcgcuccaagagcaucuacaccccgcuggagcugcaguacaucgagaugaagcagcagcacaaggacgccgugcucugcgucgagugcggcuacaaguaccgguucuucggggaggacgcggagaucgccgcccgcgagcugaacaucuacugccaccuggaccacaacuucaugaccgccuccauccccacccaccgccucuucgugcacgugcgccggcuggucgcgaagggcuacaaggugggcguggucaagcagacggagaccgccgcccugaaggccaucggggacaaccgcagcucccucuucagccggaagcugaccgcccuguacaccaaguccacgcucaucggcgaggacgugaacccccugaucaagcuggacgacgcggugaacgucgacgagaucaugaccgacaccagcaccuccuaccuccugugcaucagcgagaacaaggagaacgugcgcgacaagaagaaggggaacaucuucaucggcaucgugggcguccagcccgccacgggggaggugguguucgacagcuuccaggacagcgccagccgguccgagcuggagacccggaugagcucccuccagccggucgagcugcugcuccccagcgcccuguccgagcagaccgaggcccugauccaccgcgcgaccagcguguccguccaggacgaccggauccgcguggagcggauggacaacaucuacuucgaguacagccacgccuuccaggccgugacggaguucuacgccaaggacaccgucgacaucaagggcucccagaucaucagcgggaucgugaaccucgagaagcccgugaucugcucccuggccgcgaucaucaaguaccugaaggaguucaaccucgagaagaugcugagcaagcccgagaacuucaagcagcuguccagcaagauggaguucaugaccaucaacggcaccacgcuccgcaaccuggagauccugcagaaccagaccgacaugaagaccaaggggucccuccuguggguccuggaccacaccaagacgagcuucggccggcgcaagcugaagaagugggugacccagccgcuccugaagcugcgggagaucaacgcccgccucgacgccguguccgagguccugcacagcgagagcuccguguucggccagaucgagaaccaccuccggaagcuccccgacaucgagcgcgggcugugcagcaucuaccacaagaagugcuccacccaggaguucuuccugaucgugaagacccucuaccaccugaaguccgaguuccaggccaucauccccgcggucaacagccacauccagagcgaccugcuccggacggugauccuggagauccccgagcugcucuccccgguggagcacuaccugaagauccugaacgagcaggccgccaaggucggcgacaagaccgagcuguucaaggaccugagcgacuucccccugaucaagaagcgcaaggacgagauccagggggugaucgacgagauccggaugcaccuccaggagauccgcaagauccugaagaaccccuccgcccaguacgugaccgucagcggccaggaguucaugaucgagaucaagaacuccgccgugagcugcaucccgaccgacugggugaaggucggguccaccaaggcggugagccgguuccacucccccuucaucguggagaacuaccgccaccugaaccagcuccgggagcagcugguccuggacugcagcgccgaguggcucgacuuccuggagaaguucuccgagcacuaccacagccugugcaaggccgugcaccaccucgccacgguggacugcaucuucucccuggccaaggucgcgaagcagggcgacuacugccgccccaccgugcaggaggagcggaagaucgugaucaagaacggccgccaccccgucaucgacgugcugcucggggagcaggaccaguacgugccgaacaacaccgaccugagcgaggacagcgagcgcgucaugaucaucaccggccccaacaugggcgggaaguccagcuacaucaagcaggucgcccugaucacgaucauggcccagaucggguccuacgugcccgccgaggaggccaccaucggcaucguggacggcaucuucacccggaugggggcggccgacaacaucuacaagggccagagcaccuucauggaggagcucacggacaccgccgagaucauccgcaaggccaccucccagagccuggugauccuggacgagcucgggcggggcaccuccacgcacgacggcaucgcgaucgccuacgccacccuggaguacuucauccgcgacgucaagagccugacccucuucgugacccacuacccgcccgugugcgagcuggagaagaacuacucccaccagguggggaacuaccacaugggcuuccuggucagcgaggacgaguccaagcucgaccccggggccgccgagcagguccccgacuucgugacguuccuguaccagaucacccggggcaucgcggcccgcagcuacgggcugaacguggccaagcucgccgacgugcccggcgagauccugaagaaggccgcgcacaaguccaaggagcuggagggccucaucaacaccaagcggaagcgccugaaguacuucgccaagcuguggaccaugcacaacgcccaggaccuccagaaguggacggaggaguucaacauggaggagacccagaccagccugcugcacuga

SEQ ID NO: 33131 - RNA, 2469 nt, Artificial Sequence
  derived and/or modified sequence opt1 from MSH5__Homo_sapiens__NP_079535
auggccagccugggcgccaacccccgccggaccccgcaggggccccgccccggcgcggccuccagcggguuccccuccccggcccccgugcccggcccccgggaggccgaggaggaggaggucgaggaggaggaggagcucgccgagauccaccugugcgugcuguggaacagcggguaccucggcaucgcguacuacgacaccuccgacagcacgauccacuucaugccggacgcccccgaccacgagucccugaagcugcuccagcgcgugcuggacgagaucaacccccagagcgucgugaccuccgccaagcaggacgagaacaugacccgguuccugggcaagcucgccagccaggagcaccgcgagcccaagcggccggagaucaucuuccugcccuccguggacuucgggcuggagaucagcaagcagcgccuccuguccggcaacuacagcuucauccccgacgcgaugaccgccacggagaagauccuguuccucuccagcaucauccccuucgacugccugcugaccccgcccggggaccuccgguucacccccaucccccugcugaucccgucccagguccgcgcccucggcgggcugcugaaguuccucggccggcgccggaucggcguggagcuggaggacuacaacgugagcguccccauccugggguucaagaaguucaugcucacccaccuggugaacaucgaccaggacacguacuccgugcugcagaucuucaagagcgagagccaccccuccgucuacaagguggccagcggccucaaggaggggcugucccuguucggcauccucaaccgcugccacugcaaguggggcgagaagcugcugcggcucugguucacccgccccacccacgaccugggggagcugagcucccggcucgacgugauccaguucuuccugcugccgcagaaccucgacauggcccagaugcugcaccgccugcucggccacaucaagaacgucccccugauccugaagcggaugaagcucagccacaccaagguguccgacuggcagguccuguacaagacgguguacagcgcgcuggggcugcgcgacgccugccggucccucccccagagcauccagcuguuccgcgacaucgcccaggaguucuccgacgaccugcaccacaucgccagccucaucggcaaggugguggacuucgaggggucccuggccgagaaccgcuucaccguccugcccaacaucgacccggagaucgacgagaagaagcggcgccucaugggccugcccagcuuccugaccgagguggcgcggaaggagcucgagaaccuggacucccgcauccccagcugcuccgugaucuacaucccgcugaucggcuuccuccugagcaucccccggcugcccuccauggucgaggccagcgacuucgagaucaacgggcucgacuucauguuccugagcgaggagaagcugcacuaccgcuccgcccggaccaaggagcucgacgcccugcugggcgaccuccacugcgagauccgcgaccaggagacgcugcugauguaccagcuccagugccaggugcuggcccgggcggccguccugacccgcgugcucgaccuggccagccggcuggacgugcuccuggcccuggccuccgcggcccgcgacuacggguacagccggccccgcuacuccccgcagguccucggcgugcggauccagaacgggcgccacccccugauggagcugugcgcccggaccuucgugcccaacagcaccgagugcggcggcgacaaggggcgcgucaaggugaucacgggccccaacuccagcgggaaguccaucuaccucaagcaggucggccugaucaccuucauggcccugguggggagcuucgugccggcggaggaggccgagaucggcgccguggacgccaucuucacccggauccacuccugcgagagcaucucccucggccugagcaccuucaugaucgaccugaaccagcaggucgccaaggcggugaacaacgccacggcccagucccucgugcugaucgacgaguucgggaagggcaccaacaccgucgacgggcuggcccuccuggccgcggugcugcgccacuggcucgcccgcggcccgaccugcccccacaucuucguggccacgaacuuccugagccugguccagcuccagcugcugccccagggcccccucgugcaguaccugaccauggagaccugcgaggacgggaacgaccugguguucuucuaccaggucuccgaccucauccggagcggcaagcccaucaagcccgugaaggaccugcugaagaagaaccagauggagaacugccagacccucguggacaaguucaugaagcuggaccuggaggaccccaaccucgaccugaacgucuucaugagccaggaggugcugccggccgccacguccauccucuga

SEQ ID NO: 33132 - RNA, 4083 nt, Artificial Sequence
  derived and/or modified sequence opt1 from MSH6__Homo_sapiens__NP_000170
augagccgccaguccacccuguacagcuucuuccccaaguccccggcccucagcgacgccaacaaggcguccgcccgggccagccgcgagggcgggcgggccgccgcggcccccggcgccucccccagccccgggggcgacgccgcgugguccgaggccgggccgggcccccgcccccuggcccggagcgccagcccgcccaaggccaagaaccugaacggcgggcuccgccggagcguggcgcccgccgcccccaccuccugcgacuucagccccggcgaccuggucugggccaagauggagggguacccgugguggcccugccugguguacaaccaccccuucgacggcacguucauccgcgagaaggggaaguccgugcggguccacgugcaguucuucgacgacagccccacccgcggcuggguguccaagcggcuccugaagccguacaccggcagcaaguccaaggaggcccagaagggcgggcacuucuacagcgcgaagcccgagauccugcgcgccaugcagcgggccgacgaggcccucaacaaggacaagaucaagcgccuggagcuggccgucugcgacgagcccagcgagcccgaggaggaggaggagauggagguggggaccacguacgugaccgacaaguccgaggaggacaacgagaucgagagcgaggaggagguccagccgaagacccagggcucccggcgcagcucccggcagaucaagaagcgccgggugaucagcgacuccgagagcgacaucggcggguccgacguggaguucaagcccgacaccaaggaggagggcagcuccgacgagaucagcuccggggucggcgacagcgaguccgaggggcucaacagccccgugaagguggcgcgcaagcggaagcgcauggucacgggcaacggcucccugaagcgcaagagcucccggaaggagacccccagcgccaccaagcaggccaccagcaucuccagcgagacgaagaacacccugcgcgccuucuccgccccgcagaacagcgagucccaggcgcacgugagcgggggcggggacgacuccagccggcccaccgugugguaccacgagacccucgaguggcugaaggaggagaagcgccgggacgagcaccgccggcgccccgaccaccccgacuucgacgccuccacgcuguacgucccggaggacuuccucaacagcugcacccccggcaugcggaagugguggcagaucaagucccagaacuucgaccuggugaucugcuacaagguggggaaguucuacgagcuguaccacauggacgcccucaucggcgucagcgagcugggccugguguucaugaaggggaacugggcccacuccggcuuccccgagaucgcguucgggcgcuacagcgacucccucgugcagaagggcuacaaggucgcccggguggagcagaccgagaccccggagaugauggaggcccgcugccggaagauggcccacaucagcaaguacgaccgcgucgugcggcgcgagaucugccggaucaucacgaaggggacccagaccuacuccgugcuggagggcgaccccagcgagaacuacagcaaguaccugcucucccugaaggagaaggaggaggacagcuccggccacacccgcgccuacggggucugcuucguggacacgagccugggcaaguucuucaucgggcaguucuccgacgaccggcacugcagccgcuuccgcacccucguggcgcacuacccgcccguccaggugcuguucgagaagggcaaccuguccaaggagaccaagaccauccucaagagcucccugagcugcucccugcaggagggccucauccccgggagccaguucugggacgccuccaagacgcugcggacccugcucgaggaggaguacuuccgcgagaagcugagcgacggcaucggggugaugcugccccagguccucaagggcaugaccuccgagagcgacuccaucgggcugacccccggcgagaaguccgagcuggcccucuccgcccugggcgggugcguguucuaccugaagaagugccucaucgaccaggagcugcugagcauggccaacuucgaggaguacaucccccuggacagcgacacgguguccaccacccggagcggcgcgaucuucaccaaggccuaccagcgcaugguccucgacgccgugacgcugaacaaccuggagaucuuccucaacgggaccaacggcuccaccgaggggacccugcuggagcggguggacacgugccacaccccguucggcaagcgccuccugaagcaguggcugugcgcgccccucugcaaccacuacgccaucaacgaccggcuggacgccaucgaggaccugauggucgugcccgacaagaucagcgagguggucgagcuccugaagaagcugcccgaccucgagcgccugcuguccaagauccacaacgugggcagcccgcucaagucccagaaccaccccgacagccgggccaucauguacgaggagaccaccuacuccaagaagaagaucaucgacuuccugagcgcccuggagggguucaaggugaugugcaagaucaucggcaucauggaggaggucgccgacggguucaaguccaagauccucaagcaggucaucagccugcagaccaagaaccccgagggccgcuuccccgaccugacgguggagcucaaccggugggacaccgcguucgaccacgagaaggcccgcaagaccgggcugaucaccccgaaggccggcuucgacuccgacuacgaccaggcccuggccgacauccgggagaacgagcagagccuccuggaguaccuggagaagcagcgcaaccggaucggcugccgcacgaucguguacugggggaucggccggaaccgcuaccagcucgagauccccgagaacuucaccacccggaaccugcccgaggaguacgagcugaaguccaccaagaaggggugcaagcgcuacuggacgaagaccaucgagaagaagcucgcgaaccugaucaacgccgaggagcggcgcgacgugagccugaaggacugcaugcgccgccucuucuacaacuucgacaagaacuacaaggacuggcaguccgccguggagugcaucgccguccuggacgugcugcucugccuggccaacuacagccggggcggggacggccccaugugccggccggugauccugcuccccgaggacaccccgcccuuccuggagcugaagggcucccgccaccccugcaucaccaagacguucuucggggacgacuucauccccaacgacauccucaucggcugcgaggaggaggagcaggagaacgggaaggcguacugcguccuggugaccggccccaacaugggcggcaagagcacccugaugcggcaggccgggcuccuggccgugauggcccagauggggugcuacgucccggccgaggugugccgccugacccccaucgaccggguguucacgcgccucggcgcgagcgaccggaucauguccggggagagcaccuucuucgucgagcuguccgagaccgccagcauccugaugcacgccaccgcccacucccucgugcugguggacgagcugggccgcggcacggcgaccuucgacgggaccgccaucgccaacgccgucgugaaggagcucgccgagaccaucaagugccggacgcuguucagcacccacuaccacucccugguggaggacuacagccagaacgucgcggugcgccucggccacauggccugcaugguggagaacgagugcgaggaccccucccaggagaccaucaccuuccuguacaaguucaucaagggggccugccccaagagcuacggcuucaacgccgcccggcuggcgaaccucccggaggaggucauccagaaggggcaccgcaaggcccgggaguucgagaagaugaaccagucccugcgccuguuccgggaggugugccucgccagcgagcgcuccacgguggacgccgaggccguccacaagcugcugacccucaucaaggagcuguga

SEQ ID NO: 33133 - RNA, 1089 nt, Artificial Sequence
  derived and/or modified sequence opt1 from MSI1__Homo_sapiens__NP_002433
auggagaccgacgcgccccagccgggccuggccagccccgacagcccccacgaccccugcaagauguucaucgggggccucuccuggcagaccacgcaggaggggcugcgcgaguacuucggccaguucggggaggugaaggagugccuggucaugcgggacccgcucaccaagcgcucccggggcuucggcuucgugaccuucauggaccaggccgggguggacaagguccuggcccagagccgccacgagcuggacuccaagaccaucgaccccaagguggccuucccccggcgcgcccagcccaagauggugacgcggaccaagaagaucuucgucggcgggcucagcgugaacaccaccguggaggacgucaagcaguacuucgagcaguucggcaagguggacgacgccaugcugauguucgacaagacgaccaaccgccaccggggguucggcuucgugaccuucgaguccgaggacaucgucgagaaggugugcgagauccacuuccacgagaucaacaacaagaugguggagugcaagaaggcgcagccgaaggaggucaugagccccaccggcuccgcccgcgggcggagccgcgugaugcccuacggcauggacgccuucaugcuggggaucggcaugcucggcuaccccggguuccaggccacgaccuacgcgucccggagcuacaccggccuggccccgggguacaccuaccaguuccccgaguuccgcguggagcggacgccccugcccuccgccccgguccuccccgagcugaccgccaucccccugaccgccuacggccccauggcggccgccgccgccgcggccgccguggugcgcgggaccggcagccacccguggacgauggccccgccgcccggcuccacccccagccggaccgggggcuuccucgggaccacgucccccggccccauggccgagcuguacggggcggccaaccaggacagcggcgucuccagcuacaucagcgccgccucccccgcccccagcaccggcuucgggcacucccugggcgggccccucaucgcgaccgccuucaccaacggcuaccacuga

SEQ ID NO: 33134 - RNA, 987 nt, Artificial Sequence
  derived and/or modified sequence opt1 from MSI2__Homo_sapiens__NP_620412
auggaggccaacggcagccaggggaccuccggcagcgccaacgacucccagcacgaccccgggaagauguucaucggcgggcugagcuggcagaccuccccggacagccuccgcgacuacuucuccaaguucggcgagauccgggagugcauggugaugcgcgaccccacgaccaagcggagccgcggcuucggguucgucaccuucgcggaccccgccuccguggacaaggugcugggccagccccaccacgagcuggacagcaagaccaucgacccgaaggucgccuucccccggcgcgcccagcccaagauggugacgcggaccaagaagaucuucgucgggggccucuccgccaacaccgugguggaggacgugaagcaguacuucgagcaguucgggaaggucgaggacgcgaugcugauguucgacaagaccacgaaccgccaccggggcuucggcuucgugaccuucgagaacgaggacguggucgagaaggugugcgagauccacuuccacgagaucaacaacaagaugguggagugcaagaaggcccagcccaaggaggucauguucccgcccgggacccgcggccgggcccgcgggcugcccuacaccauggacgccuucaugcucggcaugggcaugcugggguaccccaacuucguggcgacguacggccggggguacccgggcuucgcccccagcuacggguaccaguuccccggcuuccccgccgccgccuacggcccgguggcggccgccgccgucgccgcggcccgcggguccggcagcaaccccgcccggcccgggggcuuccccggggccaacuccccgggccccguggccgaccuguacggccccgcgagccaggacuccggggugggcaacuacaucagcgccgccagcccccagccgggguccggcuucgggcacggcaucgccggcccccucaucgccaccgcguucaccaacggguaccacuga

SEQ ID NO: 33135 - RNA, 1866 nt, Artificial Sequence
  derived and/or modified sequence opt1 from MSLN__Homo_sapiens__XP_005255091
auggcccugcccaccgcccgcccgcuccugggcagcugcgggacccccgcgcugggcucccuccuguuccuccuguucagccuggggugggugcagcccucccggacgcuggccggcgagaccgggcaggccgcgccccucgacggcguccuggccaacccgcccaacaucagcucccugagcccccgccagcuccugggcuuccccugcgccgagguguccgggcugagcaccgagcgggugcgcgagcucgccgucgcccuggcccagaagaacgugaagcuguccaccgagcagcuccggugccuggcgcaccgccugagcgagccgcccgaggaccucgacgcccugccccuggaccuccugcuguuccucaaccccgacgccuucuccggcccgcaggccugcacgcgguucuucagccgcaucaccaaggccaacguggaccugcugccccgcggggcgcccgagcggcagcggcuccugcccgccgcccuggccugcuggggcguccgcgggucccuccugagcgaggccgacgugcgggcgcugggcggccucgccugcgaccugccggggcgcuucguggccgaguccgccgagguccugcucccccggcuggugagcugccccggcccccuggaccaggaccagcaggaggccgcgcgcgccgcccuccagggcgggggcccgcccuacgggccgcccuccaccuggagcguguccaccauggacgcccugcggggccugcuccccguccuggggcagcccaucauccgcagcaucccccagggcaucguggccgcguggcggcagcgcagcucccgggaccccagcuggcgccagccggagcgcacgauccugcggccccgcuuccggcgcgagguggagaagaccgccugccccuccgggaagaaggcccgggagaucgacgagagccucaucuucuacaagaagugggagcuggaggccugcgucgacgcggcccugcuggccacccagauggaccgcgugaacgccaucccguucaccuacgagcagcucgacgugcugaagcacaagcuggacgagcucuacccccagggcuaccccgaguccgucauccagcaccugggcuaccuguuccucaagaugagccccgaggacauccggaaguggaacgugacgucccuggagacccugaaggcccuccuggaggugaacaaggggcacgagaugagcccgcaggucgcgacccugaucgaccgcuucgugaagggccgggggcagcucgacaaggacacccuggacacgcugaccgccuucuaccccggcuaccucugcucccugagccccgaggagcuguccagcgugcccccguccagcaucugggccguccgcccccaggaccucgacacgugcgacccccggcagcuggacgugcuguaccccaaggcccgccucgccuuccagaacaugaacggguccgaguacuucgucaagauccagagcuuccugggcggcgcgccgaccgaggaccugaaggcccucucccagcagaacgugagcauggaccuggccaccuucaugaagcugcggaccgacgccgugcucccccugaccgucgccgaggugcagaagcugcucgggccccacguggagggccugaaggcggaggagcgccaccggcccguccgcgacuggauccugcggcagcgccaggacgaccucgacacccuggggcugggccuccagggcgggaucccgaacggcuaccuggugcuggaccucuccaugcaggaggcccugagcgggacgcccugccugcucggccccgggcccgugcugaccguccuggcccuccugcuggccagcacccucgcguga

SEQ ID NO: 33136 - RNA, 345 nt, Artificial Sequence
  derived and/or modified sequence opt1 from MSMB__Homo_sapiens__NP_002434
augaacgugcugcucggcagcgucgugaucuucgccaccuucgugacccugugcaacgccuccugcuacuucauccccaacgagggggucccgggcgacagcacgcgcaagugcauggaccugaaggggaacaagcaccccaucaacuccgaguggcagaccgacaacugcgagaccugcacgugcuacgagaccgagaucagcugcugcacccucguguccacccccgugggcuacgacaaggacaacugccagcggaucuucaagaaggaggacugcaaguacaucgucguggagaagaaggaccccaagaagaccugcagcguguccgaguggaucaucuga

SEQ ID NO: 33137 - RNA, 489 nt, Artificial Sequence
  derived and/or modified sequence opt1 from MSMO1__Homo_sapiens__NP_001017369
augccccgcugguacuuccugcucgcccggugcuucggcugcgccgugaucgaggacaccuggcacuacuuccugcaccgccugcuccaccacaagcggaucuacaaguacauccacaagguccaccacgaguuccaggcgccguucgggauggaggccgaguacgcccacccccuggagacccugauccucggcacgggguucuucaucggcaucgugcugcugugcgaccacgugauccuccugugggccugggucaccauccgccugcucgagaccaucgacgugcacagcggguacgacaucccccugaacccccugaaccucaucccguucuacgccggcucccggcaccacgacuuccaccacaugaacuucaucggcaacuacgcgagcaccuucacguggugggaccgcaucuucgggaccgacucccaguacaacgccuacaacgagaagcggaagaaguucgagaagaagaccgaguga

SEQ ID NO: 33138 - RNA, 420 nt, Artificial Sequence
  derived and/or modified sequence opt1 from MSMP__Homo_sapiens__NP_001037729
auggcccugcgcaugcucugggccggccaggccaaggggauccugggcggguggggcaucaucugccuggugaugagccuccugcugcagcaccccggggucuacuccaagugcuacuuccaggcccaggccccgugccacuacgagggcaaguacuucacccucggcgagagcuggcugcggaaggacugcuuccacugcacgugccugcaccccgugggggugggcugcugcgacaccucccagcaccccaucgacuuccccgccgggugcgagguccgccaggaggccgggaccugccaguucagccucgugcagaaguccgacccgcggcugcccugcaagggcggcggccccgaccccgagugggggagcgcgaacaccccggugcccggcgcccccgcgccccacuccagcuga

SEQ ID NO: 33139 - RNA, 1734 nt, Artificial Sequence
  derived and/or modified sequence opt1 from MSN__Homo_sapiens__NP_002435
augcccaagaccaucagcgugcgcgucaccacgauggacgccgagcuggaguucgccauccagccgaacaccaccggcaagcagcuguucgaccagguggugaagaccaucgggcugcgggaggucugguucuucggccugcaguaccaggacacgaagggguucuccaccuggcucaagcugaacaagaaggugaccgcgcaggacgugcgcaaggagagcccccuccucuucaaguuccgggccaaguucuaccccgaggacgucuccgaggagcugauccaggacaucacccagcgccuguucuuccuccaggugaaggagggcauccugaacgacgacaucuacugcccgcccgagacggccgugcugcucgccagcuacgccguccaguccaaguacggggacuucaacaaggaggugcacaagagcggcuaccuggcgggcgacaagcugcucccccagcgggugcuggagcagcacaagcugaacaaggaccagugggaggagcgcauccaggucuggcacgaggagcaccgggggaugcuccgcgaggacgccgugcuggaguaccugaagaucgcccaggaccucgagauguacggcgugaacuacuucuccaucaagaacaagaaggggagcgagcuguggcugggcgucgacgcccucgggcugaacaucuacgagcagaacgaccggcugacccccaagaucggcuuccccugguccgagauccgcaacaucagcuucaacgacaagaaguucgugaucaagccgaucgacaagaaggcgcccgacuucguguucuacgcgccccggcuccgcaucaacaagcggauccuggcccugugcaugggcaaccacgagcucuacaugcgccggcgcaagcccgacaccaucgagguccagcagaugaaggcccaggcccgggaggagaagcaccagaagcagauggagcgcgccaugcuggagaacgagaagaagaagcgggagauggccgagaaggagaaggagaagaucgagcgcgagaaggaggagcugauggagcggcucaagcagaucgaggagcagaccaagaaggcccagcaggagcuggaggagcagacgcgccgcgcccuggagcucgagcaggagcggaagcgcgcccaguccgaggcggagaagcuggccaaggagcggcaggaggccgaggaggccaaggaggcccugcuccaggcgagccgcgaccagaagaagacccaggagcagcuggcccuggagauggccgagcucaccgcccggaucucccagcuggagauggcccgccagaagaaggagagcgaggcgguggaguggcagcagaaggcccagauggugcaggaggaccuggagaagacccgggccgagcucaagacggccauguccaccccgcacgucgcggagcccgccgagaacgagcaggacgagcaggacgagaacggggccgaggccagcgccgaccugcgcgcggacgccauggccaaggaccgguccgaggaggagcgcaccaccgaggccgagaagaacgagcgggugcagaagcaccugaaggcccucacgagcgagcuggcgaacgcccgcgacgaguccaagaagaccgccaacgacaugauccacgccgagaacaugcggcugggccgcgacaaguacaagacccugcggcagauccgccaggggaacaccaagcagcggaucgacgaguucgagagcauguga

SEQ ID NO: 33140 - RNA, 1077 nt, Artificial Sequence
  derived and/or modified sequence opt1 from MSR1__Homo_sapiens__NP_002436
auggagcagugggaccacuuccacaaccagcaggaggacaccgacagcugcuccgagagcgugaaguucgacgcccgcuccaugaccgcccugcugcccccgaaccccaagaacagccccucccugcaggagaagcucaagagcuucaaggcggcccucaucgcccuguaccugcucgucuucgccgugcugaucccccugaucggcaucguggccgcgcagcuccugaagugggagacgaagaacugcuccgucagcuccaccaacgccaacgacaucacccagagccugaccgggaagggcaacgacuccgaggaggagaugcgguuccaggagguguucauggagcacaugagcaacauggagaagcgcauccagcacauccucgacauggaggccaaccugauggacacggagcacuuccagaacuucuccaugaccaccgaccagcgguucaacgacauccugcuccagcugagcacccuguucuccagcgugcaggggcacggcaacgccaucgacgagaucuccaagagccucaucucccugaacacgacccugcucgaccugcagcugaacaucgagaaccucaacgggaagauccaggagaacaccuucaagcagcaggaggagaucagcaagcuggaggagcgcgucuacaacgugagcgcggagaucauggccaugaaggaggagcagguccaccuggagcaggagaucaagggcgaggugaaggugcucaacaacaucaccaacgaccugcggcugaaggacugggagcacucccagacgcuccgcaacaucacccugauccagggcccgcccgggccgcccggcgagaagggggaccggggccccaccggggagagcggcccccgcggcuuccccgggcccaucggcccgcccgggcugaagggcgaccggggcgccaucggguuccccggcucccgcgggcuccccggcuacgccgggcggccgggcaacagcggccccaaggggcagaagggcgagaagggguccggcaacacccugcgccccgugcagcugacggaccacauccgggccgggcccagcuga

SEQ ID NO: 33141 - RNA, 588 nt, Artificial Sequence
  derived and/or modified sequence opt1 from MSRA__Homo_sapiens__NP_001129142
augcugagcgccacccgccgggccugccagcuccugcugcuccacucccuguuccccgugccgcgcaugggcaacagcgcguccaacaucgucagcccccaggaggcccugcccgggcggaaggagcagacccccguggccgccaagcaccacgugaacggcaaccgcacggucgagccguuccccgaggggacccagauggccguguucgagaagaccggccacgcggaggugguccgggugguguaccagcccgagcacauguccuucgaggagcuccugaaggucuucugggagaaccacgaccccacccaggggaugcgccagggcaacgaccacggcacgcaguaccggagcgccaucuacccgaccuccgccaagcagauggaggccgcgcugagcuccaaggagaacuaccagaaggugcucagcgagcacggguucggccccaucaccaccgacauccgcgaggggcagacguucuacuacgccgaggacuaccaccagcaguaccuguccaagaaccccaacggcuacugcgggcugggcggcaccggggugagcugccccgucggcaucaagaaguga

SEQ ID NO: 33142 - RNA, 549 nt, Artificial Sequence
  derived and/or modified sequence opt1 from MSRB2__Homo_sapiens__NP_036360
auggcccgccugcucuggcugcugcggggccucacccuggggaccgcgccccgccgggccgugcgcggccaggccgggggcgggggcccgggcacggggcccggccugggggaggccggcagccucgcgaccugcgagcugccccuggccaaguccgaguggcagaagaagcucacccccgagcaguucuacgucacccgggagaaggggacggagccgcccuucagcggcaucuaccugaacaacaaggaggccggcauguaccacugcgugugcugcgacagcccccuguucuccuccgagaagaaguacugcagcgggaccggcuggcccuccuucagcgaggcccacgggaccuccggcagcgacgagucccacaccggcauccuccgccggcuggacacgagccugggguccgcccgcaccgagguggucugcaagcagugcgaggcccaccucggccacguguucccggacgggcccggccccaacgggcagcgguucugcaucaacagcguggcgcugaaguucaagccccgcaagcacuga

SEQ ID NO: 33143 - RNA, 558 nt, Artificial Sequence
  derived and/or modified sequence opt1 from MSRB3__Homo_sapiens__NP_001180390
augagcgccuucaaccugcuccaccuggugaccaagucccagcccgucgcccugcgcgcgugcggccucccgagcggguccugccgggacaagaagaacugcaaggugguguucagccagcaggagcugcgcaagcggcugacgccccuccaguaccacgucacccaggagaagggcaccgaguccgccuucgagggggaguacacccaccacaaggaccccggcaucuacaagugcguggugugcgggacgccccuguucaagagcgagaccaaguucgacuccggcagcggcuggccguccuuccacgacgucaucaacagcgaggccaucaccuucaccgacgacuucuccuacgggaugcaccgcguggagaccagcugcucccagugcggcgcccaccuggggcacaucuucgacgacggcccccggcccacggggaagcgcuacugcaucaacagcgccgcgcucuccuucacccccgccgacagcuccggcaccgccgagggcgggagcggcguggccuccccggcgcaggccgacaaggccgagcuguga

SEQ ID NO: 33144 - RNA, 2178 nt, Artificial Sequence
  derived and/or modified sequence opt1 from MST1__Homo_sapiens__NP_066278
augggccuguggugggugaccguccagcccccggcccgccggaugggguggcucccccugcugcuccugcugacccagugccucggcgugcccgggcagcgcagcccccugaacgacuuccaggugcugcggggcacggagcuccagcaccuccugcacgccgucgugccggggcccuggcaggaggacguggcggacgccgaggagugcgccggccgcugcggcccccugauggacugccgggccuuccacuacaacgucuccagccacgggugccagcugcugcccuggacccagcacuccccgcacacccgccuccggcgcagcggccggugcgaccuguuccagaagaaggacuacgugcggaccugcaucaugaacaacggggugggcuaccgcgggacgauggccaccaccgucggcggccugcccugccaggcguggucccacaaguuccccaacgaccacaaguacacccccacgcuccgcaacgggcuggaggagaacuucugccggaacccggacggcgaccccgggggccccuggugcuacaccaccgaccccgccgugcgcuuccagagcugcggcaucaaguccugccgggaggccgccugcguguggugcaacggggaggaguaccgcggcgcggucgaccggaccgagagcgggcgcgagugccagcggugggaccugcagcacccgcaccagcaccccuucgagcccggcaaguuccucgaccaggggcuggacgacaacuacugccgcaaccccgacggcuccgagcggccguggugcuacacgaccgacccccagaucgagcgcgaguucugcgaccugccccgcugcggcagcgaggcccagccccggcaggaggccaccaccguguccugcuuccgcgggaagggcgagggguaccggggcacggccaacaccaccaccgccggggugccgugccagcgcugggacgcgcagaucccccaccagcaccgguucacgcccgagaaguacgccugcaaggaccuccgcgagaacuucugccggaaccccgacggcagcgaggccccguggugcuucacccugcgccccggcaugcgggccgccuucugcuaccagauccgccggugcaccgacgacguccgcccccaggacugcuaccacggggcgggcgagcaguaccgggggaccguguccaagacgcgcaagggcgugcagugccagcgguggagcgccgagaccccgcacaagccccaguucaccuucaccuccgagccccacgcccagcuggaggagaacuucugccgcaaccccgacggggacagccacggcccguggugcuacacgauggacccccggacccccuucgacuacugcgcccuccgccggugcgccgacgaccagcccccguccauccuggacccgcccgaccagguccaguucgagaagugcggcaagcgcguggaccgccuggaccagcggcgcagcaagcuccggguggucgggggccaccccgggaacucccccuggaccgugagccugcgcaaccggcagggccagcacuucugcggcgggagccuggugaaggagcaguggauccucaccgcgcgccagugcuucuccagcugccacaugccccugacgggcuacgaggucuggcuggggacccucuuccagaacccccagcacggcgagcccucccugcagcgggugccggucgccaagauggugugcgggcccagcggcucccagcuggugcuccugaagcuggagcgcagcgucacccucaaccagcggguggcccugaucugccugccgcccgagugguacguggucccgcccggcaccaagugcgagaucgccggguggggcgagacgaaggggaccggcaacgacaccgugcucaacguggcccugcugaacgucaucuccaaccaggagugcaacaucaagcaccgcgggcgggugcgcgagagcgagaugugcaccgagggccuccuggcgcccgugggcgccugcgagggggacuacggcgggccccuggccugcuucacccacaacugcuggguccuggagggcaucaucauccccaaccgggugugcgcccgcucccgguggcccgcgguguucacgcgcgucagcguguucguggacuggauccacaaggucaugcggcucggguga

SEQ ID NO: 33145 - RNA, 4056 nt, Artificial Sequence
  derived and/or modified sequence opt1 from MST1R__Homo_sapiens__NP_001231866
auggagcugcuccccccgcugccccagagcuuccugcuccugcugcuccugcccgccaagcccgccgcgggcgaggacuggcagugcccgcgcacccccuacgccgccucccgggacuucgacgugaaguacgucgugcccagcuucuccgccgggggccuggugcaggccauggucaccuacgagggggaccgcaacgagagcgcgguguucguggccauccggaaccgccuccacguccugggccccgaccugaaguccgugcagagccucgccacggggccggccggcgaccccggcugccagaccugcgcggccugcgggcccggcccccacgggccgcccggcgacaccgacaccaaggugcugguccuggaccccgcccuccccgcccugguguccugcgggagcucccugcagggccggugcuuccuccacgaccuggagccgcagggcacggccgugcaccuggcggcccccgccugccucuucagcgcccaccacaaccgccccgacgacugccccgacugcgucgccuccccgcuggggacccgggugaccguggucgagcagggccaggcgagcuacuucuacguggccuccagccuggacgccgccguggccgcguccuucagcccccgcuccgucagcauccggcgccucaaggccgacgccuccggguucgcccccggcuucguggcccugagcgugcugcccaagcaccucgucagcuacuccaucgaguacgugcacagcuuccacaccggcgcguucguguacuuccugacgguccagccggccuccgugaccgacgaccccagcgcccugcacacccggcucgcccgccuguccgcgaccgagcccgagcugggggacuaccgggagcucguccuggacugccgcuucgcccccaagcggcgccggcgcggcgccccggaggggggccagcccuaccccgugcugcggguggcccacagcgccccggucggggcgcagcucgccacggagcuguccaucgccgagggccaggaggugcuguucggcguguucgucaccgggaaggacggcgggcccggcguggggcccaacagcguggucugcgccuuccccaucgaccuccuggacacccugaucgacgagggcguggagcgcugcugcgaguccccggugcaccccggccuccggcgcgggcuggacuucuuccagagccccuccuucugccccaacccgcccggccuggaggcccucagccccaacaccuccugccgccacuucccccugcuggucagcuccagcuucucccggguggaccucuucaacgggcugcugggcccggugcaggucacggcgcuguacgugacccgccucgacaacgugaccgucgcccacauggggaccauggacggccggauccugcagguggagcuggugcgcagccucaacuaccugcuguacgucuccaacuucagccucggcgacagcgggcagcccgugcagcgggacgugucccgccugggcgaccaccugcucuucgccagcggggaccaggucuuccaggugcccauccagggccccggcugccggcacuuccugacgugcgggcgcugccugcgggccuggcacuucaugggcugcggguggugcggcaacaugugcgggcagcagaaggagugcccgggcuccuggcagcaggaccacugcccccccaagcucaccgaguuccacccccacagcggcccgcugcgcggguccacccggcugacccucugcggcagcaacuucuaccugcaccccuccgggcuggugcccgagggcacgcaccaggucaccguggggcagagccccugccgcccgcuccccaaggacuccagcaagcugcggcccgugccgcgcaaggacuucgucgaggaguucgagugcgagcuggagccccucggcacccaggccgugggccccaccaacgugucccugacggucaccaacaugcccccggggaagcacuuccggguggacggcaccagcgugcugcgcggguucuccuucauggagcccguccucaucgcggugcagccccuguucggcccccgggccgggggcaccugccugacgcucgagggccagagccuguccguggggaccagccgcgccguccuggugaacggcaccgagugccuccuggcccggguguccgaggggcagcugcucugcgcgaccccgcccggcgccacggucgccagcgugccccugagccugcagguggggggcgcccagguccccggcuccuggaccuuccaguaccgcgaggacccgguggugcucagcaucucccccaacugcggguacaucaacagccacaucaccaucugcggccagcaccugaccuccgccuggcaccugguccucagcuuccacgacgggcugcgcgcgguggagucccggugcgagcgccagcugcccgagcagcagcucugccggcugcccgaguacgugguccgcgacccgcagggcuggguggccggcaaccugagcgcccggggggacggcgccgccggguucacccuccccggcuuccgcuuccugccccccccgcacccccccuccgcgaaccuggucccccucaagccggaggagcacgccaucaaguucgaggugugcguggacggggagugccacauccugggccgggucgugcgccccggccccgacggggugccccagagcacgcugcucggcauccugcugccgcuccugcugcucgucgccgcccuggccaccgcgcugguguucuccuacugguggcggcgcaagcagcucgugcugccccccaaccugaacgaccucgccagccuggaccagaccgccggggccaccccgcugcccauccucuacuccggcagcgacuaccgguccgggcuggcgcugcccgccaucgacggccucgacagcacgaccugcguccacggcgccuccuucagcgacuccgaggacgagagcugcgugccccugcugcgcaaggagagcauccagcuccgggaccuggacuccgcccugcucgccgaggugaaggacguccugaucccgcacgagcgcguggugacccacagcgaccgggucaucgggaagggccacuucggggugguguaccacggcgaguacaucgaccaggcgcagaaccgcauccagugcgccaucaagucccugagccggaucaccgagaugcagcaggucgaggccuuccuccgcgaggggcugcugaugcggggccucaaccaccccaacgugcuggcccugaucggcaucaugcucccccccgaggggcugccgcacgugcugcuccccuacaugugccacggcgaccugcugcaguucauccgcuccccccagcggaaccccacggucaaggaccucaucagcuucgggcugcagguggcccgcggcauggaguaccuggcggagcagaaguucgugcaccgcgaccucgccgcccggaacugcaugcuggacgaguccuucaccgucaagguggccgacuucggccuggcccgcgacauccuggaccgggaguacuacagcgugcagcagcaccgccacgcgcggcucccggucaaguggauggcccuggagucccugcagaccuaccgcuucaccacgaagagcgacgugugguccuucggggugcuccugugggagcugcucacccggggcgccccccccuaccgccacaucgaccccuucgaccugacccacuuccuggcccaggggcggcgccucccgcagcccgaguacugccccgacagccuguaccaggucaugcagcagugcugggaggccgaccccgcggugcggccgaccuuccgcgugcuggucggcgagguggagcagaucguguccgcccuccugggggaccacuacguccagcugcccgccacguacaugaaccucggccccagcaccucccacgagaugaacgugcggcccgagcagccgcaguucagccccaugcccggcaacgugcgccggccccgcccgcuguccgagcccccccggccgaccuga

SEQ ID NO: 33146 - RNA, 1128 nt, Artificial Sequence
  derived and/or modified sequence opt1 from MSTN__Homo_sapiens__NP_005250
augcagaagcugcagcucugcguguacaucuaccuguucaugcugaucgucgccggccccguggaccucaacgagaacagcgagcagaaggagaacguggagaaggaggggcugugcaacgccugcaccuggcgccagaacaccaaguccagccggaucgaggcgaucaagauccagauccuguccaagcuccgccuggagacggccccgaacaucagcaaggacgucauccggcagcugcuccccaaggccccgccccugcgcgagcugaucgaccaguacgacgugcagcgggacgacuccagcgacggcucccucgaggacgacgacuaccacgccaccaccgagaccaucaucacgaugcccaccgagagcgacuuccugaugcaggucgacgggaagcccaagugcugcuucuucaaguucuccagcaagauccaguacaacaagguggugaaggcccagcuguggaucuaccuccgccccguggagacccccaccacggucuucgugcagauccugcggcugaucaagccgaugaaggacggcacccgcuacaccgggauccggucccucaagcuggacaugaaccccggcaccggcaucuggcagagcaucgacgugaagacgguccugcagaacuggcucaagcagcccgaguccaaccuggggaucgagaucaaggcgcuggacgagaacggccacgaccucgccgugaccuuccccgggccgggcgaggacgggcugaaccccuuccuggaggugaaggucaccgacacccccaagcgcagccggcgcgacuucggccucgacugcgacgagcacuccacggagagccggugcugccgcuacccccugaccguggacuucgaggccuucggcugggacuggaucaucgccccgaagcgguacaaggcgaacuacugcuccggggagugcgaguucguguuccugcagaaguacccccacacccaccucguccaccaggccaacccccgcggcagcgccgggcccugcugcaccccgacgaagaugucccccaucaacaugcuguacuucaacggcaaggagcagaucaucuacggcaagauccccgccauggugguggaccggugcgggugcagcuga

SEQ ID NO: 33147 - RNA, 1677 nt, Artificial Sequence
  derived and/or modified sequence opt1 from MSTO1__Homo_sapiens__NP_001243462
auggccggcggggcccgcgaggugcugacccuccagcugggccacuucgcgggguucgucggcgcccacugguggaaccagcaggacgccgcccuggggcgggccaccgacagcaaggagcccccgggcgagcucugccccgacgugcuguaccgcacgggccggacccugcacgggcaggagaccuacacgccccgccucauccugauggaccugaagggcucccucagcucccugaaggaggagggcgggcuguaccgggacaagcagcucgacgcggccaucgccuggcaggggaagcugaccacccacaaggaggagcuguaccccaagaacccguaccuccaggacuuccugagcgccgagggcgugcuguccagcgacggcgucuggcgcgugaaguccauccccaacgggaagggcagcagcccccuccccaccgcgaccacgccgaagccccugauccccaccgaggccuccauccgggugugguccgacuuccugcgcguccaccuccacccccggagcaucugcaugauccagaaguacaaccacgacggggaggccggccgccuggaggccuucggccagggggaguccgugcugaaggagcccaaguaccaggaggagcucgaggaccggcugcacuucuacguggaggagugcgacuaccugcagggcuuccagauccucugcgaccugcacgacggguucagcggcgucggggccaaggcggccgagcugcuccaggacgaguacuccggccgcggcaucaucaccugggggcugcugcccggccccuaccaccgcggggaggcccagcggaacaucuaccggcuccugaacaccgccuucggccuggugcaccucacggcccacagcucccuggugugcccccugagccucgggggcucccugggccugcgcccggagccgcccgucagcuuccccuaccuccacuacgacgcgacccugcccuuccacugcagcgccauccuggccaccgcccucgacaccgugacggugcccuaccggcugugcuccagccccgucuccauggugcaccuggccgacaugcucagcuucugcgggaagaagguggucaccgcgggcgccaucauccccuucccgcuggcccccgggcagucccugcccgacagccugaugcaguucggcggggccacccccuggaccccgcucuccgccugcggcgagcccagcggcacgcgcugcuucgcgcaguccguggugcugcgggggaucgaccgcgccugccacaccagccagcugacccccggcaccccgccgcccuccgcccuccacgccugcacgaccggggaggagauccuggcgcaguaccugcagcagcagcagcccggcgucaugagcuccagccaccuccugcugacccccugccggguggccccgcccuacccccaccucuucuccagcugcuccccgcccguggagagcauccccgucuucggcgcccugugcuccagcagcucccugcaccagacccucgaggcccuggcccgcgaccugacgaagcucgaccugcgccggugggcgagcuucauggacgccgggguggagcacgacgacgucgccgagcugcuccaggagcugcagucccuggcccagugcuaccagggcggggacagccucguggacuga

SEQ ID NO: 33148 - RNA, 912 nt, Artificial Sequence
  derived and/or modified sequence opt1 from MSX1__Homo_sapiens__NP_002439
auggcccccgccgcggacaugaccagccugccgcucggcgugaaggucgaggacuccgccuucgggaagcccgccggcgggggcgccgggcaggcccccagcgcggccgccgccaccgcggccgccaugggcgccgacgaggagggcgccaagcccaagguguccccgagccugcugcccuucuccguggaggcgcucauggccgaccaccgcaagcccggggccaaggagagcgcccuggcccccuccgagggcguccaggcggccgggggcagcgcccagccgcugggggugccgcccggcucccucggcgcccccgacgcccccagcagcccccggccccuggggcacuucuccgugggcgggcugcucaagcugcccgaggacgcgcuggucaaggccgaguccccggagaagcccgagcgcacgcccuggaugcagagcccccgguucuccccgccgcccgcccgccggcucagcccgcccgccugcacccugcgcaagcacaagaccaaccggaagccccgcacccccuucacgaccgcccagcugcucgcgcuggagcggaaguuccgccagaagcaguaccuguccaucgccgagcgggccgaguucagcuccagccucagccugaccgagacccaggugaagaucugguuccagaaccgccgggccaaggcgaagcgccugcaggaggccgagcucgagaagcugaagauggccgccaagcccaugcugccgcccgccgcguucggccucuccuucccccugggcgggcccgccgccguggccgccgcggccggcgccagccuguacggggccuccggccccuuccagcgggccgcgcuccccgucgcccccguggggcuguacacggcccacgugggcuacagcauguaccaccugaccuga

SEQ ID NO: 33149 - RNA, 804 nt, Artificial Sequence
  derived and/or modified sequence opt1 from MSX2__Homo_sapiens__NP_002440
auggccagccccuccaagggcaacgaccuguucagcccggacgaggaggggcccgccguggucgcgggccccgggcccggcccggggggcgccgagggcgccgccgaggagcgccgggugaagguguccagccuccccuucuccgucgaggcccugaugagcgacaagaagccccccaaggaggcguccccgcugcccgccgagagcgccuccgccggggcgacccuccgcccccugcugcucagcggccacggggcccgggaggcccacucccccggcccgcuggugaagcccuucgagaccgccagcgugaaguccgagaacagcgaggacggggccgcguggaugcaggagcccggccgcuacucccccccgccccggcacaugagccccacgaccugcacccugcgcaagcacaagaccaaccggaagccccgcacgccguucaccaccucccagcuccuggcccuggagcggaaguuccgccagaagcaguaccucagcaucgccgagcgggccgaguucuccagcagccugaaccugaccgagacgcaggucaagaucugguuccagaaccgccgggccaaggcgaagcgccuccaggaggccgagcuggagaagcugaagauggccgccaagcccaugcuccccuccagcuucucccugcccuucccgaucagcuccccccugcaggccgcgagcaucuacggcgccuccuaccccuuccaccggcccgugcucccgaucccccccguggggcuguacgccaccccggucggcuacgggauguaccaccugagcuga

SEQ ID NO: 33150 - RNA, 186 nt, Artificial Sequence
  derived and/or modified sequence opt1 from MT1A__Homo_sapiens__NP_005937
auggaccccaacugcagcugcgccaccggcggguccugcacgugcaccggcagcugcaagugcaaggagugcaagugcaccuccugcaagaaguccugcugcagcugcugcccgaugagcugcgccaagugcgcgcaggggugcaucugcaagggcgccuccgagaagugcagcugcugcgccuga

SEQ ID NO: 33151 - RNA, 186 nt, Artificial Sequence
  derived and/or modified sequence opt1 from MT1B__Homo_sapiens__NP_005938
auggaccccaacugcagcugcaccaccggcggguccugcgccugcgccggcagcugcaagugcaaggagugcaagugcacguccugcaagaagugcugcugcagcugcugcccgguggggugcgcgaagugcgcccagggcugcgucugcaagggguccagcgagaagugccgcugcugcgccuga

SEQ ID NO: 33152 - RNA, 186 nt, Artificial Sequence
  derived and/or modified sequence opt1 from MT1E__Homo_sapiens__NP_783316
auggaccccaacugcagcugcgccaccggcggguccugcacgugcgccggcagcugcaagugcaaggagugcaagugcaccuccugcaagaaguccugcugcagcugcugcccgguggggugcgcgaagugcgcccagggcugcgucugcaagggggccagcgagaagugcuccugcugcgccuga

SEQ ID NO: 33153 - RNA, 186 nt, Artificial Sequence
  derived and/or modified sequence opt1 from MT1F__Homo_sapiens__NP_005940
auggaccccaacugcagcugcgccgccggcguguccugcaccugcgcggggagcugcaagugcaaggagugcaagugcaccuccugcaagaagagcugcugcuccugcugcccggucggcugcagcaagugcgcccaggggugcgugugcaagggcgccuccgagaagugcagcugcugcgacuga

SEQ ID NO: 33154 - RNA, 189 nt, Artificial Sequence
  derived and/or modified sequence opt1 from MT1G__Homo_sapiens__NP_001288196
auggaccccaacugcagcugcgccgccgcgggcguguccugcaccugcgccagcuccugcaagugcaaggagugcaagugcaccagcugcaagaaguccugcugcagcugcugcccggucgggugcgccaagugcgcccagggcugcaucugcaagggggccuccgagaagugcagcugcugcgcguga

SEQ ID NO: 33155 - RNA, 186 nt, Artificial Sequence
  derived and/or modified sequence opt1 from MT1H__Homo_sapiens__NP_005942
auggaccccaacugcagcugcgaggccggcggguccugcgccugcgcgggcagcugcaagugcaagaagugcaagugcaccuccugcaagaaguccugcugcagcugcugcccgcuggggugcgccaagugcgcccagggcugcaucugcaagggggccagcgagaagugcuccugcugcgccuga

SEQ ID NO: 33156 - RNA, 186 nt, Artificial Sequence
  derived and/or modified sequence opt1 from MT1M__Homo_sapiens__NP_789846
auggaccccaacugcagcugcaccaccggcguguccugcgccugcacggggagcugcaagugcaaggagugcaagugcaccuccugcaagaaguccugcugcagcugcugcccggucggcugcgccaagugcgcgcacgggugcgugugcaagggcacccuggagaacugcagcugcugcgccuga

SEQ ID NO: 33157 - RNA, 186 nt, Artificial Sequence
  derived and/or modified sequence opt1 from MT1X__Homo_sapiens__NP_005943
auggaccccaacugcagcugcuccccggugggcagcugcgccugcgccggguccugcaagugcaaggagugcaagugcaccagcugcaagaaguccugcugcagcugcugccccgucggcugcgcgaagugcgcccaggggugcaucugcaagggcaccuccgacaagugcagcugcugcgccuga

SEQ ID NO: 33158 - RNA, 186 nt, Artificial Sequence
  derived and/or modified sequence opt1 from MT2A__Homo_sapiens__NP_005944
auggaccccaacugcagcugcgccgccggcgacuccugcaccugcgcggggagcugcaagugcaaggagugcaagugcaccuccugcaagaagagcugcugcuccugcugcccggugggcugcgccaagugcgcccaggggugcaucugcaagggcgccagcgacaagugcuccugcugcgccuga

SEQ ID NO: 33159 - RNA, 207 nt, Artificial Sequence
  derived and/or modified sequence opt1 from MT3__Homo_sapiens__NP_005945
auggaccccgagaccugcccgugccccagcggcggguccugcacgugcgccgacagcugcaagugcgagggcugcaagugcaccuccugcaagaaguccugcugcagcugcugccccgccgagugcgagaagugcgcgaaggacugcgugugcaagggcggggaggccgccgaggccgaggccgagaagugcagcugcugccaguga

SEQ ID NO: 33160 - RNA, 189 nt, Artificial Sequence
  derived and/or modified sequence opt1 from MT4__Homo_sapiens__NP_116324
auggacccccgcgagugcgugugcaugagcggcgggaucugcaugugcggcgacaacugcaagugcacgaccugcaacugcaagaccugccggaaguccugcugccccugcugcccgcccgggugcgccaagugcgcccgcggcugcaucugcaagggcgggagcgacaagugcuccugcugccccuga

SEQ ID NO: 33161 - RNA, 1293 nt, Artificial Sequence
  derived and/or modified sequence opt1 from MTA1__Homo_sapiens__NP_001190187
auggccgccaacauguaccgcgugggcgacuacgucuacuucgagaacagcuccagcaaccccuaccugauccggcgcaucgaggagcucaacaagaccgcgaacgggaacguggaggccaagguggucugcuucuaccggcgccgggacaucuccagcacccugaucgcccuggccgacaagcacgccacgcucuccgugugcuacaaggcgggcccgggggccgacaacggcgaggagggggagaucgaggaggagauggagaaccccgagaugguggaccugcccgagaagcugaagcaccagcuccgccaccgggagcuguuccugagccgccagcucgagucccugcccgccacccacauccggggcaagugcagcgucacccugcucaacgagaccgagucccucaagagcuaccuggagcgcgaggacuucuucuucuacucccugguguacgacccgcagcagaagacgcugcuggccgacaagggcgagauccggguggggaaccgcuaccaggcggacaucaccgaccuccugaaggagggcgaggaggacgggcgggaccagagccgccuggagacccaggucugggaggcccacaacccccucaccgacaagcagaucgaccaguuccuggugguggcccgguccgucggcacguucgcccgcgcccuggacugcagcuccagcgugcggcagcccucccuccacaugagcgcggccgccgccucccgcgacaucacccuguuccacgccauggacacccugcacaagaacaucuacgacaucagcaaggcgaucagcgcccucgugccccagggcgggccgguccugugccgggacgagauggaggagugguccgccagcgaggccaaccuguucgaggaggcccucgagaaguacggcaaggacuucaccgacauccagcaggacuuccugcccuggaagucccugacgagcaucaucgaguacuacuacauguggaagaccaccgaccgcuacgugcagcagaagcggcucaaggcggccgaggccgaguccaagcugaagcaggucuacauccccaacuacaacaagcccaacccgaaccagaucagcgugaacaacgugaaggccgggguggucaacggcaccggggcccccggccagucccccggcgcggggcgcgccugcgagagcugcuacauguccagccugcgcauccuccuggacauccuggaggagaucugguggcucgagaacgccaaccccgugcgguggcgcgaggcccggacgaagccgcaguga

SEQ ID NO: 33162 - RNA, 2007 nt, Artificial Sequence
  derived and/or modified sequence opt1 from MTA2__Homo_sapiens__NP_004730
auggccgccaacauguaccgcgugggcgacuacgucuacuucgagaacagcuccagcaaccccuaccuggugcggcgcaucgaggagcucaacaagaccgcgaacgggaacguggaggccaaggucgugugccuguuccggcgccgggacaucuccagcucccugaacagccucgccgacuccaacgcccgcgaguucgaggaggagagcaagcagccgggcguguccgagcagcagcggcaccagcugaagcaccgcgagcuguuccucagccggcaguucgagucccugcccgccacccacauccgcgggaagugcagcgucacgcugcucaacgagaccgacauccugucccaguaccuggagaaggaggacugcuucuucuacagccucguguucgaccccgugcagaagacccugcuggcggaccagggcgagauccgggucgggugcaaguaccaggccgagauccccgaccgccucguggagggcgaguccgacaaccggaaccagcagaagauggagaugaaggugugggacccggacaacccccugaccgaccgccagaucgaccaguuccuggucguggcccgggccgugggcacguucgcgcgcgcccucgacugcagcuccagcauccggcagcccucccugcacaugagcgccgccgccgcgagccgcgacaucacccuguuccacgccauggacacccuccagcggaacggguacgaccuggccaaggccauguccacccuggucccccagggcgggccggugcucugccgcgacgagauggaggaguggagcgccuccgaggcgaugcuguucgaggaggcccuggagaaguacggcaaggacuucaacgacauccggcaggacuuccuccccuggaagucccuggccagcaucgugcaguucuacuacauguggaagacgaccgaccgcuacauccagcagaagcgccugaaggccgccgaggcggacagcaagcucaagcaggucuacauccccaccuacaccaagcccaacccgaaccagaucaucuccguggggagcaagcccggcaugaacggcgccggguuccagaagggccugacgugcgaguccugccacaccacccagagcgcccagugguacgccugggggccgcccaacaugcagugccggcugugcgccuccugcuggaucuacuggaagaaguacggcggccucaagacccccacgcagcuggagggggcgacccgcggcaccaccgagccccacagccgggggcaccugucccgccccgaggcccagagccucucccccuacacgaccagcgccaaccgggccaagcugcuggcgaagaaccgccagaccuuccuccugcagaccacgaagcugacccggcucgcccgccggaugugccgcgaccugcugcagccgcggcgcgccgcccggcgccccuacgcccccaucaacgcgaacgccaucaaggccgagugcuccauccggcuccccaaggccgccaagaccccgcugaagauccacccccuggugcgccucccccuggcgaccaucgucaaggaccugguggcccaggcgccccugaagccgaagacgccccggggcaccaagacccccaucaaccgcaaccagcucagccagaaccgggggcugggcggcaucauggugaagcgcgccuacgagaccauggccggggccggcgucccguucuccgccaacgggcgcccccuggccagcggcauccggagcuccagccagcccgccgcgaagcgccagaagcucaaccccgccgacgccccgaaccccguggucuucguggccacgaaggacacccgggcccugcgcaaggcgcugacccaccucgagaugcggcgcgccgcccggcgccccaaccugccccugaaggugaagccgacccucaucgccguccggccgcccgugccccugcccgcccccucccaccccgcgagcacgaacgagcccaucgugcuggaggacuga

SEQ ID NO: 33163 - RNA, 1548 nt, Artificial Sequence
  derived and/or modified sequence opt1 from MTA3__Homo_sapiens__NP_065795
auggccgccaacauguaccgcgugggcgacuacgucuacuucgagaacagcuccagcaaccccuaccugauccggcgcaucgaggagcucaacaagaccgcguccgggaacguggaggccaagguggucugcuucuaccggcgccgggacaucagcaacacccugaucaugcuggccgacaagcacgccaaggagaucgaggaggaguccgagacgaccguggaggccgaccucaccgacaagcagaagcaccagcugaagcaccgcgagcuguuccucagccggcaguacgagucccugccggcgacccacauccgcggcaagugcagcguggcccugcucaacgagacggaguccguccugagcuaccuggacaaggaggacaccuucuucuacucccucguguacgaccccagccugaagacccugcucgccgacaagggggagauccgggugggcccccgcuaccaggccgacauccccgagaugcugcuggagggggaguccgacgagcgggagcagagcaagcucgaggucaaggugugggacccgaacagcccccugaccgaccgccagaucgaccaguuccugguggucgcgcgggccgugggcacguucgcccgcgcccucgacugcagcuccagcgugcggcagcccucccugcacaugagcgccgcggccgccagccgcgacaucacccuguuccacgccauggacacccucuaccggcacuccuacgaccugagcuccgccaucagcguccuggugccccucggcgggccggugcugugccgcgacgagauggaggagugguccgcgagcgaggccucccuguucgaggaggcccucgagaaguacggcaaggacuucaacgacauccggcaggacuuccugcccuggaagucccugaccuccaucaucgaguacuacuacauguggaagacgaccgaccgcuacguccagcagaagcggcucaaggccgccgaggcggagagcaagcugaagcaggucuacauccccaccuacuccaagcccaacccgaaccagaucagcaccuccaacgggaagcccggcgccgugaacggggccgugggcacgaccuuccagccccagaacccccugcucggccgcgccugcgagagcugcuacgccacccagucccaccagugguacagcugggggccgcccaacaugcagugccgccugugcgcgaucugcuggcuguacuggaagaaguacggcgggcucaagaugcccacccaguccgaggaggagaagcugagccccuccccgacgaccgaggacccccgggugcgcagccacgugagccggcaggccaugcagggcaugcccguccgcaacaccggcucccccaagagcgccgugaagacccggcaggccuucuuccugcacacgaccuacuucaccaaguucgcgcgccaggucugcaagaacacccuccggcugcgccaggccgcccggcgcccguucguggccaucaacuacgccgcgauccgggccgagugcaagaugcugcucaacuccuga

SEQ ID NO: 33164 - RNA, 852 nt, Artificial Sequence
  derived and/or modified sequence opt1 from MTAP__Homo_sapiens__NP_002442
auggccagcggcaccaccacgaccgccgugaagaucgggaucaucggcgggaccggccuggacgaccccgagauccucgaggggcgcaccgagaaguacgucgacacgccguucggcaagcccuccgacgcgcugauccugggcaagaucaagaacguggacugcgugcuccuggcccggcacgggcgccagcacaccaucaugcccagcaaggucaacuaccaggccaacaucugggcccugaaggaggagggcugcacccacgugaucgugaccacggccugcgggucccuccgggaggagauccagcccggcgacaucgucaucaucgaccaguucaucgaccgcaccaccaugcggccgcagagcuucuacgacgggucccacagcugcgcgcgcggcgugugccacauccccauggccgagcccuucugccccaagacccgggaggugcugaucgagacggccaagaagcugggccuccgcugccacuccaaggggaccauggucaccaucgagggcccgcgguucagcucccgcgccgagagcuucauguuccggaccuggggcgcggacgugaucaacaugacgaccgugcccgaggucgugcuggccaaggaggccgggaucugcuacgccuccaucgccauggcgaccgacuacgacugcuggaaggagcacgaggaggccgugagcgucgaccgcgugcugaagacccucaaggagaacgccaacaaggccaagucccugcugcucacgaccaucccccagaucggcagcaccgagugguccgagacccugcacaaccugaagaacauggcccaguucagcgugcuccugccccggcacuga

SEQ ID NO: 33165 - RNA, 2715 nt, Artificial Sequence
  derived and/or modified sequence opt1 from MTBP__Homo_sapiens__NP_071328
auggaccgcuaccugcuccuggugaucuggggcgaggggaaguuccccagcgccgccucccgggaggcggagcacggcccggaggucagcuccggggagggcaccgagaaccagcccgacuucaccgccgccaacguguaccaccuccucaagcgcagcaucuccgccagcaucaaccccgaggacuccacguuccccgccugcagcgucgggggcaucccgggcuccaagaagugguucuucgcggugcaggccaucuacggguucuaccaguucugcagcuccgacuggcaggagauccacuucgacaccgagaaggacaagaucgaggacgugcugcagaccaacaucgaggagugccugggcgccguggagugcuucgaggaggaggacagcaacucccgggagagccucucccuggccgaccuguacgaggaggcggccgagaaccuccaccagcugagcgacaagcugcccgcccccgggcgcgccauggucgacaucauccuccugcuguccgacaaggacccgcccaagcucaaggacuaccugcccaccgugggcgcccugaagcaccuccgggagugguacagcgcgaagaucacgaucgccgggaaccacugcgagaucaacugccagaagaucgccgaguaccuguccgccaacguggucagccuggaggaccuccgcaacgugaucgacagcaaggagcuguggcggggcaagauccagaucugggagcgcaaguucggcuucgagaucuccuuccccgaguucugccugaagggggugacccucaagaacuucagcaccuccaaccugaacaccgacuuccuggccaagaagaucauccccagcaaggacaagaacauccucccgaaggucuuccacuacuacggccccgcgcuggaguucgugcagaugaucaagcuguccgaccuccccagcugcuacauguccgacaucgaguucgagcuggggcugacgaacagcaccaagcagaacuccgugcuccugcuggagcagaucagcucccucugcagcaaggucggcgcccuguucgugcugcccugcaccaucuccaacauccucaucccgccgcccaaccagcugagcucccggaaguggaaggaguacaucgccaagaagcccaagaccaucagcgugcccgacgucgaggugaagggcgagugcuccagcuacuaccugcuccugcaggggaacggcaaccgccggugcaaggccacgcugauccacuccgccaaccagaucaacgggagcuucgcgcucaaccugauccacggcaagaugaagaccaagaccgaggaggccaagcugagcuuccccuucgaccuccugucccugccccacuucagcggggagcagaucgugcagcgcgagaagcagcuggccaacguccaggugcucgcccuggaggagugccugaagcggcgcaagcucgccaagcagcccgagaccguguccgucgcggagcucaagagccugcuggugcugacgcggaagcacuuccuggacuacuucgacgccgucaucccgaagaugauccuccgcaagauggacaagaucaagaccuucaacauccugaacgacuucucccccguggagcccaacagcuccagccugauggagaccaacccccucgaguggccggagcggcacgugcugcagaaccuggagaccuucgagaagacgaagcagaagaugcgcaccggcucccucccccacagcuccgagcagcugcugggccacaaggaggggccccgggacagcaucacccuccuggacgccaaggagcugcucaaguacuucaccuccgacggccugccgaucggggaccugcagccccuccccauccagaagggcgagaagacguucguccugacccccgagcugagcccggggaagcuccaggugcugcccuucgagaaggccuccgugugccacuaccacggcaucgaguacugccuggacgaccgcaaggcgcucgagcgggacggcggguucagcgagcugcagucccgccugauccgcuacgagacccagaccacgugcacccgggagagcuuccccguccccaccgugcucagcccgcugcccucccccguggucagcuccgaccccggcagcgugccggacggggaggugcugcagaacgagcuccgcaccgaggucucccggcugaagcgccggagcaaggaccugaacugccucuacccccgcaagcggcuggugaaguccgagagcuccgagagccugcucucccagacgaccggcaacagcaaccacuaccaccaccacgugaccucccgcaagccccagaccgagcggagccugcccgucacgugcccgcuggugcccauccccuccugcgagacccccaagcucgccaccaagaccagcuccgggcagaaguccaugcacgagagcaagaccagccgccagaucaaggagagccggucccagaagcacacgcgcauccugaaggagguggucaccgagacccugaagaagcacagcaucaccgagacgcacgagugcuucaccgccugcucccagcggcuguucgagaucagcaaguucuaccugaaggaccugaagaccucccgcggccucuucgaggagaugaagaagaccgccaacaacaacgccguccaggugaucgacugggugcuggagaagacgagcaagaaguga

SEQ ID NO: 33166 - RNA, 1170 nt, Artificial Sequence
  derived and/or modified sequence opt1 from MTCH1__Homo_sapiens__NP_001258570
augggcgccagcgaccccgagguggccccgugggcgcgcgggggcgccgccgggauggccggcgccggggcgggcgccggcgcccgcgggggcgccgcggccggggucgaggcccgggcccgggacccgccgcccgcccaccgcgcgcacccccggcacccccgccccgccgcccagcccuccgcccggcgcauggacggcgggagcggcggccugggguccggcgacaacgcccccaccaccgaggcgcuguucguggcccugggggccggcgugacggcccugagccacccccuccuguacgucaagcugcucauccaggugggccacgagcccaugcccccgacccuggggaccaacgugcugggccggaagguccucuaccugcccuccuucuucaccuacgccaaguacaucguccagguggacgggaagaucggccuguuccgcgggcucagcccccggcugauguccaacgcgcugagcacggugacccgcggcuccaugaagaagguguucccgcccgacgagaucgagcaggucagcaacaaggacgacaugaagaccucccucaagaagguggugaaggagaccagcuacgagaugaugaugcagugcgugucccggaugcuggcccacccccugcacgucaucagcaugcgcugcauggugcaguucgugggccgggaggccaaguacuccgggguccucagcuccaucggcaagaucuucaaggaggaggggcugcugggcuucuucguggggcucaucccccaccuccugggcgacguggucuuccucuggggcugcaaccugcuggcccacuucaucaacgccuaccucguggacgacagcguguccgacacgcccgggggccuggggaacgaccagaacccgggcagccaguucagccaggcgcuggccauccgcuccuacaccaaguucgucauggggaucgccgugagcaugcucaccuaccccuuccugcuggucggcgaccucauggccgugaacaacugcggccugcaggcggggcugccgcccuacucccccguguucaagagcuggauccacugcuggaaguaccucuccguccagggccagcuguuccgggggagcucccuccuguuccgccgggugagcuccggcagcugcuucgcccuggaguga

SEQ ID NO: 33167 - RNA, 912 nt, Artificial Sequence
  derived and/or modified sequence opt1 from MTCH2__Homo_sapiens__NP_055157
auggccgacgccgcgagccaggugcugcucggcuccgggcugaccauccugagccagccccucauguacgucaaggugcugauccaggugggcuacgagccgcugccgcccaccaucgggcgcaacaucuucggccggcaggucugccagcuccccgggcuguucuccuacgcccagcacaucgccagcaucgacggccgccggggccuguucacggggcucacgccccgccugugcuccggcgugcuggggaccgugguccacggcaaggugcuccagcacuaccaggagagcgacaagggggaggagcugggccccggcaacgugcagaaggaggucuccagcuccuucgaccacgugaucaaggagaccacccgggagaugaucgcccgcagcgccgcgacccugaucacccaccccuuccacgugaucacccuccgguccaugguccaguucaucgggcgcgagagcaaguacugcggccugugcgacuccaucaucacgaucuaccgggaggaggggauccugggcuucuucgccggccucgugccccgccugcugggggacauccucagccuguggcugugcaacucccucgccuaccuggugaacaccuacgcccuggacagcggcgucuccaccaugaacgagaugaaguccuacagccaggcggugaccggguucuucgccagcaugcucacguacccguucgugcuggucagcaaccugauggccgugaacaacugcggccucgccgggggcugcccgcccuacucccccaucuacaccagcuggaucgacugcuggugcaugcugcagaaggagggcaacaugucccgggggaacagccuguucuuccgcaaggugcccuucggcaagaccuacugcugcgaccucaagaugcugaucuga

SEQ ID NO: 33168 - RNA, 4761 nt, Artificial Sequence
  derived and/or modified sequence opt1 from MTCL1__Homo_sapiens__NP_056025
auggaggagaugcgcgacagcuaccuggaggaggacguguaccagcuccaggagcugcggcgcgagcuggaccgggccaacaagaacugccgcauccuccaguaccggcugcgcaaggccgagcagaagucccugaaggucgcggagaccggccagguggacggggagcucauccggagccuggagcaggaccugaagguggccaaggacgucuccgugcgccuccaccacgagcugaagaccguggaggagaagcgggccaaggccgaggacgagaacgagacgcugcgccagcagaugaucgaggucgagaucagcaagcaggcccuccagaacgagcuggagcggcugaaggaguccagccucaagcgccgguccacccgcgagauguacaaggagaagaagaccuucaaccaggacgacagcgcggaccugcggugccagcugcaguucgccaaggaggaggccuuccucaugcgcaagaagauggccaagcugggccgggagaaggacgagcuggagcaggagcuccagaaguacaagucccuguacggggacguggacagcccccugccgaccggcgaggcgggcgggccgcccuccacgcgcgaggccgagcucaagcugcggcugaagcucguggaggaggaggccaacauccuggggcgcaagaucgucgagcuggagguggagaaccggggccucaaggccgagauggaggacaugcgcggccagcaggagcgcgaggggcccggccgggaccacgcccccagcauccccaccucccccuucggggacagccuggaguccagcaccgagcugcgccggcaccuccaguucguggaggaggaggcggagcugcugcgccgguccaucagcgagaucgaggaccacaaccgccagcucacccacgagcuguccaaguucaaguucgagcccccgcgggagcccggcuggcugggcgagggggccagccccggcgccgggggcggcgcgccccuccaggaggagcugaaguccgcccgccugcagaucuccgagcucagcgggaagguccugaagcugcagcacgagaaccacgcccuccuguccaacauccagcggugcgaccuggccgcccaccucggccugcgcgccccgagcccccgggacuccgacgccgagagcgacgcggggaagaaggaguccgacggcgaggagagccgccugccccagcccaagcgggaggggccggugggcggcgaguccgacagcgaggagauguucgagaagacguccggguucggcagcgggaagcccuccgaggccagcgagcccugccccaccgagcugcucaaggcccgcgaggacuccgaguaccuggugacccugaagcacgaggcccagcggcucgagcgcaccgucgagcggcugaucacggacaccgacagcuuccugcacgacgccggccuccgcgggggcgcgccgcugcccggccccgggcugcagggcgaggaggagcagggggagggcgaccagcaggagccccagcuccuggggaccaucaacgccaagaugaaggccuucaagaaggagcugcaggccuuccucgagcaggucaaccggaucggcgacggccugagcccgcugccccaccucaccgagagcuccagcuuccugagcacggugaccuccgugagccgcgacucccccaucgggaaccugggcaaggagcucgggcccgaccugcagagccgccugaaggagcagcucgaguggcagcugggcccggcgcggggcgacgagcgcgagucccugcggcuccgcgccgcccgggagcugcaccgccgggccgacggggacaccggcagccacgggcugggcgggcagaccugcuucucccucgagcugcgcggcccgcccgugcugcccgagcagagcguguccaucgaggagcuccagggccagcugguccaggccgcgcggcugcaccaggaggagacggagaccuucaccaacaagauccacaagauggaggaggagcaccucuacgcccugcgcuggaaggagcuggagaugcacagccucgcccugcagaacacccugcacgagcggacgugguccgacgagaagaaccucaugcagcaggagcugcgcagccugaagcagaacaucuuccucuucuacgugaagcugcgguggcugcucaagcacuggcgccaggggaagcagauggaggaggagggcgaggaguucaccgagggggagcaccccgagacccugucccggcugggcgagcucggggugcagggcggccaccaggccgacgggcccgaccacgacagcgaccgcggcugcggguuccccgucggcgagcacuccccgcacagccgggugcagaucggggaccacucccugcgccugcagaccgccgaccggggccagccccacaagcaggucguggagaaccagcagcuguucagcgcguucaaggcccuccuggaggacuuccgcgccgagcuccgggaggacgagcgcgcccgccugcggcugcagcagcaguacgccagcgacaaggcggccugggacguggagugggccguccucaagugccgccuggagcagcuggaggagaagacggagaacaagcucggcgagcugggguccagcgccgaguccaagggcgcgcugaagaaggagcgggaggugcaccagaagcuccuggccgacagccacucccuggugauggaccuccgcuggcagauccaccacagcgagaagaacuggaaccgggagaaggucgagcugcuggaccgccucgaccgggaccgccaggagugggagcggcagaagaaggaguuccuguggcgcaucgagcagcugcagaaggagaacagcccccggcgcgggggcuccuuccucugcgaccagaaggacgggaacgugcggcccuucccgcaccagggcucccugcgcaugccccggcccguggccauguggcccugcgccgacgccgacagcaucccguucgaggaccgcccccuguccaagcucaaggagagcgaccggugcuccgcgagcgagaaccuguaccuggacgcccucucccuggacgacgagcccgaggagcccccggcccaccgccccgagcgggaguuccgcaaccgccugcccgaggaggaggagaaccacaagggcaaccuccagcgggccgucagcguguccagcauguccgaguuccagcgccugauggacaucagccccuuccugccggagaaggggcuccccagcaccuccagcaaggaggacgugaccccgccccugucccccgacgaccugaaguacaucgaggaguucaacaagagcugggacuacacccccaaccggggccacaacgggggcggccccgaccucugggccgaccgcacggaggucgggcgggcgggccacgaggacuccaccgagccguuccccgacagcuccugguaccugaccaccagcgugacgaugaccaccgacaccaugaccucccccgagcacugccagaagcagccccugcgcagccacgugcucacggagcaguccgggcugcggguccugcacagcccgcccgccgugcgccggguggacuccaucaccgccgccggcggggagggccccuuccccaccagccgcgcccggggcuccccgggggacaccaagggcgggccgcccgagcccaugcucagccgcuggcccugcacgagcccccggcacucccgcgacuacgucgagggcgcgcggcgcccccuggacagcccccugugcaccucccugggguucgccagcccgcuccacucccuggagaugagcaagaaccuguccgacgacaugaaggagguggccuucagcgugcggaacgccaucugcuccggccccggcgagcuccaggucaaggacauggcgugccagaccaacgggagccgcaccaugggcacgcagaccgugcagaccaucuccguggggcugcagaccgaggcccugcggggcagcggggucacguccagcccccacaagugccucacccccaaggccggcggcggggccaccccgguguccagccccucccgcagccugcggucccgccagguggcccccgcgaucgagaagguccaggccaaguucgagcggaccugcugcagccccaaguacggcuccccgaagcugcagcgcaagccccuccccaaggccgaccagcccaacaaccgcacgagcccggggauggcccagaagggcuacuccgagagcgccugggcgcggagcaccaccacccgcgagucccccgugcacacgaccaucaacgacggccugagcucccuguucaacaucaucgaccacagccccgugguccaggacccguuccagaaggggcuccgggccggcucccgcagccgguccgccgagccccgccccgagcuggggcccggccaggagaccgggaccaacagccggggccgcuccccgagccccaucggcgugggguccgagaugugccgggaggagggcggggagggcacgcccgugaagcaggaccugagcgcgcccccgggguacacccucaccgagaacgucgcccgcauccugaacaagaagcugcucgagcacgcccugaaggaggagcggcgccaggccgcccacggcccgcccggccugcacuccgacagccacucccucggggacaccgccgagcccggccccauggagaaccagacggugcugcugaccgcccccugggggcucuga

SEQ ID NO: 33169 - RNA, 324 nt, Artificial Sequence
  derived and/or modified sequence opt1 from MTCP1__Homo_sapiens__NP_001018025
auggccggcgaggacgugggggcgcccccggaccaccuguggguccaccaggagggcaucuaccgcgacgaguaccagcggaccuggguggccguggucgaggaggagaccagcuuccuccgcgcccgggugcagcagauccaggugccccugggggacgccgcccgccccucccaccuccugacgagccagcugccccugauguggcagcucuacccggaggagcgguacauggacaacaacucccgccuguggcagauccagcaccaccugaugguccggggcgugcaggagcuccugcugaagcuccugcccgacgacuga

SEQ ID NO: 33170 - RNA, 1749 nt, Artificial Sequence
  derived and/or modified sequence opt1 from MTDH__Homo_sapiens__NP_848927
auggccgcccgcagcuggcaggacgagcuggcgcagcaggccgaggagggcuccgcccggcuccgcgagaugcugagcguggggcugggcuuccuccggaccgagcuggggcuggaccucggccuggagcccaagcgcuaccccgggugggucauccuggugggcaccggcgcccucgggcugcugcuccuguuccugcucggcuacgggugggccgcggccugcgccggcgcccggaagaagcgccgguccccgccccgcaagcgggaggaggcggccgccgugcccgccgccgcgcccgacgaccuggcccugcucaagaaccugcgcagcgaggagcagaagaagaagaaccggaagaagcuguccgagaagcccaagcccaacgggcgcacggucgagguggccgagggcgaggccgugcggacgccccagagcgucaccgccaagcagccgcccgagaucgacaagaagaacgagaaguccaagaagaacaagaagaaguccaagagcgacgcgaaggccgugcagaacagcucccgccacgacggcaaggagguggacgagggggccugggagaccaagaucagccaccgggagaagcgccagcagcggaagcgcgacaagguccucaccgacuccggcagccuggacuccaccauccccgggaucgagaacaccaucaccgugacgaccgagcagcugaccaccgccagcuuccccgugggcuccaagaagaacaagggcgacagccaccucaacguccagguguccaacuucaagagcgggaagggcgacagcacgcuccagguguccagcgggcugaacgagaaccugaccgucaacggcgggggcuggaacgagaaguccgugaagcugagcucccagaucagcgccggcgaggagaaguggaacuccgugagcccggcguccgccgggaagcggaagaccgagcccagcgccuggucccaggacaccggcgacgccaacacgaacgggaaggacuggggccgcagcugguccgaccggagcaucuucuccgggaucggcagcaccgccgagcccgucucccagagcaccaccuccgacuaccagugggacgugagccgcaaccagcccuacaucgacgacgaguggagcggccugaacgggcucuccagcgcggacccgaacuccgacuggaacgcccccgccgaggaguggggcaacuggguggacgaggagcgcgccagccugcugaagucccaggagcccauccccgacgaccagaaggucagcgacgacgacaaggagaagggggagggcgcgcucccgacggggaaguccaagaagaagaagaagaagaagaagaagcagggcgaggacaacagcaccgcccaggacaccgaggagcuggagaaggagauccgggaggaccugcccgugaacaccuccaagacgcgccccaagcaggagaaggccuucagccucaagaccaucuccaccagcgaccccgccgaggugcuggucaagaacucccagccgaucaagacccugccgcccgccacgagcaccgagcccuccgugauccucagcaaguccgacagcgacaagagcuccagccaggucccgcccauccugcaggagaccgacaaguccaagagcaacaccaagcagaacuccgugccgcccagccagacgaaguccgagaccagcugggagucccccaagcagaucaagaagaagaagaaggcgcggcgcgagaccuga

SEQ ID NO: 33171 - RNA, 1200 nt, Artificial Sequence
  derived and/or modified sequence opt1 from MTERF1__Homo_sapiens__XP_006716189
augcagagccugucccucggccagaccagcaucuccaaggggcugaacuaccugaccaucauggcccccggcaaccucuggcacaugcgcaacaacuuccuguucgggagccggugcuggaugacgcgcuucuccgccgagaacaucuucaagagcguguccuuccggcuguucggcgucaagugccacaacaccgacagcgagccgcucaagaacgaggaccugcugaagaaccuccugaccauggggguggacaucgacauggcgcgcaagcggcagcccggcguguuccaccgcaugaucaccaacgagcaggaccugaagauguuccuccuguccaagggcgccagcaaggaggucaucgccuccaucaucagccgguacccccgcgccaucacgcggacccccgagaaccuguccaagcgcugggaccucuggcggaagaucgugaccagcgaccuggagaucgugaacauccuggagcgcuccccggagagcuucuuccgguccaacaacaaccucaaccuggagaacaacaucaaguuccuguacagcgucgggcucacccgcaagugccugugccggcugcucacgaacgcgccccgcaccuucuccaacagccuggaccugaacaagcagaugguggaguuccuccaggccgccggccugagccuggggcacaacgaccccgccgacuucgugcggaagaucaucuucaagaaccccuucauccucauccaguccaccaagcgcgucaaggccaacaucgaguuccugcggagcaccuucaaccugaacuccgaggagcuccuggugcugaucugcggcccgggggcggagauccucgaccugagcaacgacuacgcccgccgguccuacgccaacaucaaggagaagcuguucagccucggcugcacggaggaggaggugcagaaguucguccuguccuaccccgacgugaucuuccuggccgagaagaaguucaacgacaagaucgacugccucauggaggagaacaucagcaucucccagaucaucgagaacccccgcgugcuggacagcuccaucagcacccugaagucccgcaucaaggagcucgucaacgccggcugcaaccugagcacccugaacaucacccuccuguccuggagcaagaagcgguacgaggcgaagcugaagaagcugucccgcuucgccuga

SEQ ID NO: 33172 - RNA, 2262 nt, Artificial Sequence
  derived and/or modified sequence opt1 from MTF1__Homo_sapiens__XP_011539794
augggcgagcacagccccgacaacaacaucaucuacuucgaggccgaggaggacgagcugaccccggacgacaagaugcuccgcuucguggacaagaacgggcugguccccuccagcuccggcaccguguacgaccggacgaccgugcugaucgagcaggaccccgggacccucgaggacgaggacgacgacggccagugcggggagcaccuccccuuccuggucggcggcgaggagggguuccaccugaucgaccacgaggccaugagccagggcuacgugcagcacaucaucuccccggaccagauccaccugaccaucaaccccgggagcacgcccaugccccgcaacaucgagggcgcgacccugacccuccaguccgagugcccggagaccaagcggaaggaggugaagcgcuaccagugcacguucgaggggugcccccggaccuacagcaccgccggcaaccugcgcacccaccagaagacgcaccggggcgaguacaccuucgucugcaaccaggaggggugcggcaaggccuuccugaccuccuacagccuccgcauccacgugcgggugcacaccaaggagaagcccuucgagugcgacguccaggggugcgagaaggccuucaacacgcuguaccgccugaaggcccaccagcggcuccacaccggcaagaccuucaacugcgaguccgagggcugcagcaaguacuucaccacgcuguccgaccugcgcaagcacauccggacccacaccggggagaagcccuuccgcugcgaccacgacggcugcgggaaggcguucgccgccagccaccaccucaagacccacgugcggacgcacaccggcgagcgcccguucuucugccccuccaacgggugcgagaagaccuucagcacccaguacucccucaagagccacaugaagggccacgacaacaagggccacuccuacaacgcccugccccagcacaacgggagcgaggacacgaaccacagccugugccuguccgaccugagccuccuguccaccgacagcgagcugcgggagaacuccagcaccacccagggccaggaccucuccacgaucagccccgcgaucaucuucgaguccauguuccagaacagcgacgacaccgccauccaggaggacccgcagcagaccgccucccugaccgagagcuucaacggggacgccgaguccgugagcgacgucccgcccuccacgggcaacagcgccucccugagccucccccuggugcugcagcccgggcucuccgagccgccccagccccugcugcccgcgagcgcccccagcgcgcccccgcccgcccccucccucggccccggcagccagcaggccgccuucgggaacccgcccgcccugcugcagccgcccgaggugcccgucccccacuccacccaguucgccgccaaccaccaggaguuccucccccacccccaggccccgcagcccaucgugcccggccugagcguggucgcgggggccuccgccagcgccgccgcgguggccuccgccguggccgcgcccgccccgccccagagcaccaccgagccccugcccgccaugguccagacccucccgcugggcgccaacuccgugcugacgaacaaccccaccaucaccaucacccccacgcccaacaccgccauccuccagagcucccuggugaugggggagcagaaccugcaguggauccucaacggcgcgaccagcuccccgcagaaccaggagcagauccagcaggccagcaaggucgagaagguguucuucaccacggccguccccguggccuccagccccggcuccagcgugcagcagaucgggcugagcguccccgugaucaucaucaagcaggaggaggccugccagugccagugcgcgugccgcgacuccgccaaggagcgggccagcucccgccggaagggcugcagcuccccgcccccgcccgagcccagcccccaggcccccgacgggccgucccugcagcugcccgcccagaccuucagcuccgcgcccgugcccggcagcuccagcuccacccucccgagcuccugcgagcagagccgccaggccgagacccccuccgacccccagacggagacccugagcgccauggacgucuccgaguuccugagccuccagagccuggacacccccuccaaccugaucccgaucgaggcccuccugcagggcgaggaggagauggggcugaccagcuccuucagcaaguga

SEQ ID NO: 33173 - RNA, 1170 nt, Artificial Sequence
  derived and/or modified sequence opt1 from MTFMT__Homo_sapiens__NP_640335
augcgcgugcugguccggcgcugcugggggcccccgcucgcccacggcgcccggcgcggccggcccagcccccaguggcgcgcgcuggcccggcuggggugggaggacugccgcgacucccgggugcgcgagaagcccccguggcggguccucuucuucggcaccgaccaguucgcccgcgaggcccugcgggcccugcacgcggcccgcgagaacaaggaggaggagcucaucgacaagcuggagguggugaccaugcccagccccucccccaaggggcugccggugaagcaguacgccguccagagccagcuccccguguacgaguggcccgacgugggcuccggcgaguacgacgucggggugguggccagcuucggccggcugcugaacgaggcgcucauccugaaguuccccuacgggauccugaacguccacccguccugccucccccgcuggcggggccccgcccccgugauccacacggugcugcacggggacaccgucaccggcgugaccaucaugcagauccgcccgaagcgguucgacgugggccccauccugaagcaggagacgguccccgugcccccgaaguccaccgccaaggagcucgaggccgugcugagccgccugggggccaacaugcucaucagcguccugaagaaccugcccgagucccucagcaacggccggcagcagcccauggagggggcgaccuacgcccccaagaucuccgccggcaccagcugcaucaagugggaggagcagacguccgagcagaucuuccgccuguaccgcgccaucggcaacaucaucccgcugcagacccucuggauggccaacaccaucaagcugcuggaccucguggaggugaacagcuccguccuggcggaccccaagcugaccgggcaggcccucauccccggcagcgugaucuaccacaagcagucccagauccugcuggucuacugcaaggacggguggaucggcgugcggagcgugaugcucaagaagucccugacggccaccgacuucuacaacggguaccugcaccccugguaccagaagaacagccaggcccagccgagccagugccgcuuccagacccuccggcugcccaccaagaagaagcagaagaagacggucgccaugcagcagugcaucgaguga

SEQ ID NO: 33174 - RNA, 408 nt, Artificial Sequence
  derived and/or modified sequence opt1 from MTFP1__Homo_sapiens__NP_001003704
augagcgagccccagccgcgcggcgccgagcgggaccuguaccgcgacaccugggugcgguaccucggguacgccaacgaggucggcgaggcguuccgcucccuggugcccgccgccguggucuggcugagcuacgggguggccuccagcuacgugcucgccgacgcgaucgacaagggcaagaaggccggggaggucggcggcuucccgcccgggcugcagcccgcccaggcccugcccaacuccggcgaggcgcagcuccugcugaucauccucugguaccuggccugcgccagcgccuccugcuucaugagcaccuccuacagcugccaggggauguggacgcccggcucccuggugagcaaggaccccgggaccugggugggccucuccuggaccgaggccuga

SEQ ID NO: 33175 - RNA, 1005 nt, Artificial Sequence
  derived and/or modified sequence opt1 from MTG1__Homo_sapiens__NP_612393
augcgccugacgccccgggcccucugcagcgccgcgcaggccgccuggcgcgagaacuucccccugugcggccgggacguggcccgcugguuccccgggcacauggccaagggccugaagaagaugcaguccagccucaagcuggucgacugcaucaucgaggugcacgacgcgcggaucccccuguccgggcgcaacccccucuuccaggagacccugggccugaagccgcaccuccuggugcugaacaagauggaccucgccgaccugaccgagcagcagaagaucaugcagcaccuggagggggagggccucaagaacgucaucuucaccaacugcgugaaggacgagaacgugaagcagaucauccccauggucaccgagcugaucggccggagccaccgcuaccaccggaaggagaaccuggaguacugcaucauggugaucggggugcccaacgucggcaaguccagccucaucaacucccugcgccggcagcaccuccgcaaggggaaggccacccgggugggcggggagcccggcaucacgcgcgccgugaugagcaagauccaggucuccgagcggccgcugauguuccugcuggacacccccggcgugcucgcgccccgcaucgagagcguggagaccgggcugaagcuggcccucugcggcaccguccuggaccaccuggugggggaggagacgauggccgacuaccuccuguacacccugaacaagcaccagcgguucggcuacgugcagcacuacggccucggguccgccugcgacaacgucgagcgcgugcucaagagcguggccgucaagcugggcaagacccagaaggugaaggugcugaccgggacgggcaacgucaacaucauccagcccaacuacccggcggccgcccgggacuuccugcagaccuuccgccgggggcugcucggcuccgugaugcuggaccuggacguccuccgcggccacccgcccgccgagacccugcccuga

SEQ ID NO: 33176 - RNA, 2808 nt, Artificial Sequence
  derived and/or modified sequence opt1 from MTHFD1__Homo_sapiens__NP_005947
auggcccccgccgagauccugaacggcaaggagaucagcgcgcagauccgcgcccggcucaagaaccaggugacccagcugaaggagcaggucccgggguucacgccccgccuggccauccuccaggugggcaaccgggacgacuccaaccuguacaucaacgugaagcugaaggccgccgaggagaucgggaucaaggcgacccacaucaagcucccccgcaccaccaccgagagcgaggugaugaaguacaucacgucccugaacgaggacagcaccgugcacggcuuccuggugcagcucccccuggacuccgagaacagcaucaacaccgaggaggucaucaacgccaucgccccggagaaggacguggacgggcugaccuccaucaacgccggcaagcucgcgcggggcgaccugaacgacugcuucauccccugcacgcccaaggggugccuggagcucaucaaggagaccggcgugcccaucgccgggcgccacgccgucguggugggccggagcaagaucgucggggccccgaugcacgaccugcugcucuggaacaacgccaccgugaccacgugccacuccaagaccgcgcaccuggacgaggaggugaacaagggcgacauccuggucguggccaccggccagcccgagauggugaagggggaguggaucaagcccggcgccaucgucaucgacugcgggaucaacuacgugcccgacgacaagaagccgaacggccgcaagguggucggcgacguggccuacgacgaggccaaggagcgggcgagcuucaucacccccgugcccgggggcgucgggcccaugacgguggccaugcucaugcaguccaccgucgagagcgccaagcgcuuccuggagaaguucaagccgggcaaguggaugauccaguacaacaaccugaaccucaagacccccgugcccuccgacaucgacaucagccgguccugcaagcccaagccgaucgggaagcuggcccgcgagaucggccugcucagcgaggagguggagcuguacggcgagaccaaggccaagguccugcucuccgcgcuggagcggcugaagcaccgccccgacgggaaguacgugguggucacgggcaucacccccacgccccucggggagggcaagagcaccaccaccaucgggcuggugcaggcccugggcgcccaccucuaccagaacguguucgccugcguccggcagccgucccagggccccaccuucgggaucaagggcggggccgcgggcgggggcuacagccaggugauccccauggaggaguucaaccugcaccugaccggcgacauccacgccaucacggccgccaacaaccucguggcggccgccaucgacgcccgcaucuuccacgagcugacccagaccgacaaggcccuguucaaccggcucguccccagcgugaacggggugcgccgguucuccgacauccagauccgccggcugaagcgccugggcaucgagaagaccgacccgacgacccucaccgacgaggagaucaaccgcuucgcgcggcuggacaucgaccccgagaccaucacguggcagcgcguccuggacaccaacgaccgguuccuccgcaagaucaccaucgggcaggcccccaccgagaagggccacacccggacggcccaguucgacaucagcguggccuccgagaucauggccgugcuggcgcugaccaccagccuggaggacaugcgcgagcggcucggcaagauggucguggccuccagcaagaagggggagccgguguccgccgaggaccugggcgucagcggggcccugaccgugcucaugaaggacgccaucaagcccaaccugaugcagacgcuggagggcacccccguguucguccacgcggggcccuucgccaacaucgcccacggcaacuccagcaucaucgccgaccgcaucgcgcucaagcuggugggcccggagggguucguggucaccgaggccggcuucggggccgacaucggcauggagaaguucuucaacaucaagugccgguacuccgggcugugcccccacguggugguccucguggccaccgugcgcgcccugaagaugcacggcggcgggcccacggucaccgcgggccugccccucccgaaggccuacauccaggagaaccuggagcugguggagaagggguucagcaaccucaagaagcagaucgagaacgcccggauguucggcauccccguggucguggccgugaacgccuucaagaccgacaccgaguccgagcuggaccugaucagccgccucucccgggagcacggggcguucgacgccgucaagugcacgcacugggccgagggcggcaagggggcccuggcccuggcgcaggccgugcagcgcgccgcccaggcgcccagcuccuuccagcuccuguacgaccugaagcuccccguggaggacaagauccggaucaucgcccagaagaucuacggcgccgacgacaucgagcugcugccggaggcccagcacaaggccgaggucuacaccaagcagggguucggcaaccuccccaucugcauggcgaagacccaccugagccugucccacaaccccgagcagaagggggugcccaccggcuucauccucccgauccgcgacauccgggccagcgugggcgccggguuccuguacccccuggucggcacgaugagcaccaugcccgggcuccccacccgcccgugcuucuacgacaucgaccuggaccccgagaccgagcaggucaacggccuguucuga

SEQ ID NO: 33177 - RNA, 2940 nt, Artificial Sequence
  derived and/or modified sequence opt1 from MTHFD1L__Homo_sapiens__NP_001229696
augggcacccgccugccccucgugcugcggcagcugcgccggccgccccagccgcccgggccgccccgccggcuccgcguccccugccgggccagcuccggcgggggcgggggcggcgggggcgggcgcgagggccugcuggggcagcggcgcccccaggacggccaggcccggagcuccugcagcccgggcgggcgcacccccgcggcccgggacuccaucgugcgcgaggugauccagaacagcaaggagguccucucccugcugcaggagaagaaccccgccuucaagcccgugcucgccaucauccaggccggcgacgacaaccugaugcaggagaucaaccagaaccuggcggaggaggccgggcucaacaucacgcacaucugccugccgcccgacagcuccgaggccgagaucaucgacgagauccugaagaucaacgaggacacccgggugcacggccucgcccugcagaucagcgagaaccuguucuccaacaagguccucaacgcgcugaagcccgagaaggacguggacggcgugaccgacaucaaccuggggaagcucguccgcggcgacgcccacgagugcuucgugagccccguggccaaggccgucaucgagcugcuggagaaguccgugggggugaaccucgacggcaagaagauccuggucgugggggcccacggcagccuggaggcggcccuccagugccuguuccagcggaagggcuccaugaccaugagcauccaguggaagacgcgccagcugcaguccaagcuccacgaggccgacaucgugguccuggggagcccgaagcccgaggagaucccccugaccuggauccagcccggcaccaccgugcucaacugcucccacgacuuccugagcgggaaggugggcugcgggagcccgcggauccacuucggcggccugaucgaggaggacgacgucauccuccuggccgccgcgcugcgcauccagaacaugguguccagcgggcggcgcuggcuccgcgagcagcagcaccggcgcuggcggcugcacugccugaagcuccagccccugucccccgugcccagcgacaucgagaucucccgcggccagacgcccaaggccgucgacgugcuggccaaggagaucgggcuccuggccgacgagaucgagaucuacggcaagagcaaggccaagguccggcuguccgugcucgagcgccugaaggaccaggcggacgggaaguacgugcuggucgccggcaucacccccacgccccugggcgagggcaagagcaccgugaccaucgggcucgugcaggcccugaccgcccaccugaacgucaacuccuucgccugccuccggcagcccagccaggggccgaccuucggcgugaagggcggggcggccggcgggggcuacgcccaggugauccccauggaggaguucaaccugcaccugaccggggacauccacgccaucacggcggccaacaaccuccuggccgccgccaucgacacccgcauccugcacgagaacacccagaccgacaaggcgcucuacaaccggcuggucccccuggugaacggcgugcgcgaguucuccgagauccagcucgcccggcugaagaagcugggcaucaacaagacggacccgagcacccucaccgaggaggaggucuccaaguucgcccgccuggacaucgaccccagcaccaucacguggcagcgggugcuggacaccaacgaccgcuuccuccggaagaucaccaucgggcagggcaacaccgagaaggggcacuaccgccaggcccaguucgacaucgccguggcguccgagaucauggccguccuggcccugacggacagccucgccgacaugaaggcccggcugggccgcauggugguggcguccgacaagagcgggcagcccgucaccgccgacgaccugggcgugaccggcgcccucaccgugcugaugaaggacgccaucaagcccaaccugaugcagacgcucgaggggaccccggucuucgugcacgcgggccccuucgccaacaucgcccacgggaacuccagcgugcuggccgacaagaucgcccugaagcucgucggcgaggagggguucguggugaccgaggcgggcuucggcgccgacaucgggauggagaaguucuucaacaucaagugccgggccagcggccugguccccaacguggugguccugguggccaccgugcgcgcccucaagaugcacgggggcgggcccuccgucacggcgggcgugccgcugaagaaggaguacaccgaggagaacauccagcugguggccgacggcugcugcaaccuccagaagcagauccagaucacccagcuguucgggguccccgugguggucgcccugaacguguucaagaccgacacccgcgccgagaucgaccucgugugcgagcuggccaagcgggcgggcgccuucgacgccguccccugcuaccacuggagcgucgggggcaagggcuccguggaccuggcccgcgcggugcgggaggccgccagcaagcgcucccgguuccaguuccucuacgacguccaggugcccaucguggacaagauccgcacgaucgcccaggccguguacggggcgaaggacaucgagcugagcccggaggcccaggccaagaucgaccgguacacccagcagggcuucgggaaccugcccaucugcauggccaagacccaccucucccugagccaccagcccgacaagaagggcgugccccgcgacuucauccugccgaucuccgacguccgggccagcaucggggcgggcuucaucuacccccucgugggcaccauguccacgaugcccgggcugcccacccgcccgugcuucuacgacaucgaccuggacaccgagaccgagcaggucaagggccucuucuga

SEQ ID NO: 33178 - RNA, 1053 nt, Artificial Sequence
  derived and/or modified sequence opt1 from MTHFD2__Homo_sapiens__NP_006627
auggccgccaccagccugauguccgcgcucgccgcccgccugcugcagcccgcccacagcugcucccuccggcugcgcccguuccaccuggccgcggugcggaacgaggccgucgugaucagcggccgcaagcucgcccagcagaucaagcaggaggugcggcaggaggucgaggaguggguggccuccgggaacaagcgcccccaccugagcgugauccuggucggcgagaaccccgcgucccacagcuacgugcucaacaagacccgggccgccgccguggucgggaucaacuccgagacgaucaugaagcccgccagcaucuccgaggaggagcugcugaaccucaucaacaagcugaacaacgacgacaacguggacggccugcucgugcagcugccgcugcccgagcacaucgacgagcgccggaucugcaacgcggucagccccgacaaggacguggacggguuccacgugaucaacgucggccgcaugugccucgaccaguacuccaugcugcccgccaccccguggggcgugugggagaucaucaagcggaccgggauccccacccugggcaagaacguggucguggccgggcgcagcaagaacgugggcaugcccaucgccaugcuccugcacacggacggggcccacgagcggcccggcggcgacgcgaccgucaccaucucccaccgcuacaccccgaaggagcagcugaagaagcacacgauccucgccgacaucgugaucagcgccgccgggauccccaaccugaucaccgccgacaugaucaaggagggcgcggccgugaucgacgucgggaucaaccgggugcacgaccccgucaccgccaagcccaagcuggugggcgacguggacuucgagggcguccgccagaaggccggguacaucaccccggugcccggcggggugggccccaugacggucgccaugcucaugaagaacaccaucaucgcggccaagaaggugcugcggcuggaggagcgcgaggugcucaaguccaaggagcugggggucgccaccaacuga

SEQ ID NO: 33179 - RNA, 2091 nt, Artificial Sequence
  derived and/or modified sequence opt1 from MTHFR__Homo_sapiens__XP_011539797
auggaccaccgcaaggcccgggugcugcccgccggccacuacugcccgagccucgggaucugggcgucccaggucggcagcgugcgcuccagcgugccgcccuccauccggaaccccgccauggucaacgaggcccgcgggaacagcucccugaaccccugccuggagggcagcgccuccagcggguccgagagcuccaaggacagcucccggugcagcacccccggccucgaccccgagcgccacgagcggcugcgcgagaagaugcggcgccggcuggaguccggcgacaagugguucagccucgaguucuucccgccccgcaccgccgagggggcggugaaccugaucucccgguucgaccgcauggccgccggcgggccccuguacaucgacgugacguggcaccccgccggcgaccccgggagcgacaaggagaccagcuccaugaugaucgcgagcaccgccgucaacuacugcggccucgagaccauccugcacaugacgugcugccggcagcgccuggaggagaucaccggccaccuccacaaggccaagcagcuggggcugaagaacaucauggcccuccggggcgacccgaucggggaccagugggaggaggaggagggcggcuucaacuacgccguggaccuggugaagcacauccgcuccgaguucggggacuacuucgacaucugcgucgcgggcuaccccaaggggcaccccgaggccggcagcuucgaggccgaccugaagcaccucaaggagaagguguccgccggggccgacuucaucaucacccagcuguucuucgaggcggacaccuucuuccgguucgugaaggccugcacggacaugggcaucacgugccccaucgucccgggcaucuuccccauccagggguaccacagccugcgccagcucgugaagcuguccaagcuggaggugccccaggagaucaaggacgucaucgagcccaucaaggacaacgacgccgccauccggaacuacggcaucgagcucgccgugagccugugccaggagcugcucgcguccgggcuggugccgggccugcacuucuacacccucaaccgcgagauggccaccaccgagguccugaagcgccuggggauguggaccgaggacccccggcgcccccuccccugggcccugagcgcccacccgaagcggcgcgaggaggacgugcggcccaucuucugggccucccgccccaagagcuacaucuaccggacccaggagugggacgaguuccccaacggccgcuggggcaacuccagcuccccggcguucggggagcugaaggacuacuaccucuucuaccucaagagcaagucccccaaggaggagcugcugaagauguggggcgaggagcugaccagcgaggaguccguguucgaggucuucgugcuguaccucagcggggagcccaaccggaacggccacaaggugacgugccugccguggaacgacgagccccuggccgccgagaccagccuccugaaggaggagcugcuccgcgucaaccggcaggggauccugaccaucaacucccagcccaacaucaacggcaagcccagcuccgacccgaucgugggcugggggcccagcggcggguacgucuuccagaaggccuaccuggaguucuucaccucccgcgagacggcggaggcccugcuccaggugcugaagaaguacgagcugcgggugaacuaccaccucgucaacgugaagggcgagaacaucaccaacgcccccgagcugcagcccaacgccgugaccuggggcaucuucccggggcgcgagaucauccagcccaccgucguggaccccgugagcuucauguucuggaaggacgaggccuucgcgcuguggaucgagcgguggggcaagcucuacgaggaggagucccccagccgcacgaucauccaguacauccacgacaacuacuuccuggucaaccugguggacaacgacuucccgcucgacaacugccuguggcaggucguggaggacacccuggagcuccugaaccggcccacccagaacgcccgcgagaccgaggcccccuga

SEQ ID NO: 33180 - RNA, 612 nt, Artificial Sequence
  derived and/or modified sequence opt1 from MTHFS__Homo_sapiens__NP_006432
auggccgccgcggccgugagcuccgccaagcgcagccugcggggcgagcugaagcagcgccugcgggccauguccgccgaggagcgccugcggcagagccgcguccucucccagaaggugaucgcgcacagcgaguaccagaaguccaagcggaucagcaucuuccuguccaugcaggacgagaucgagaccgaggagaucaucaaggacaucuuccagcgcgggaagaucugcuucaucccccgguaccgcuuccagagcaaccacauggacauggugcggaucgaguccccggaggagaucagccugcuccccaagaccuccuggaacaucccccagcccggcgagggggacguccgcgaggaggcccugagcacgggcgggcuggaccucaucuucaugccgggccugggcuucgacaagcacgggaaccggcugggccgcgggaagggcuacuacgacgccuaccucaagcggugccugcagcaccaggaggugaagcccuacacccuggcccucgcguucaaggagcagaucugccuccaggugcccgucaacgagaacgacaugaagguggacgaggugcuguacgaggacuccagcaccgccuga

SEQ ID NO: 33181 - RNA, 2184 nt, Artificial Sequence
  derived and/or modified sequence opt1 from MTIF2__Homo_sapiens__NP_001005369
augaaccagaagcugcucaagcuggagaaccugcuccgcuuccacaccaucuaccggcagcugcacagccugugccagcgccgggcccuccgccaguggcggcacggcuucuccagcgccuaccccguguggaccgcgcagcugugcgccuggccguggcccacggacguccugaccggggccgcccucucccaguaccgccugcuggugaccaagaaggaggagggccccuggaagucccagcucagcagcaccaaguccaagaagguggucgagguguggaucgggaugacgaucgaggagcuggcccgggcgauggagaagaacaccgacuacguguacgaggcccugcucaacaccgacaucgacaucgacagccuggaggccgacucccaccuggacgaggucuggaucaaggaggugaucaccaaggccggcaugaagcucaaguggagcaagcugaagcaggacaaggugcgcaagaacaaggacgcgguccggcgcccccaggccgacccggcccugcucacgccccggucccccguggugaccaucauggggcacgucgaccacggcaagaccacccugcuggacaaguuccgcaagacccagguggccgccguggagacgggcgggaucacccagcacaucggcgcguuccucgucagccugcccuccggggagaagaucaccuuccuggacacgccgggccacgccgccuucagcgccaugcgggcccgcggggcccaggugaccgacaucgugguccucgugguggcggccgacgacggcgucaugaagcagaccguggaguccauccagcacgccaaggacgcccaggugcccaucauccuggcggucaacaagugcgacaaggccgaggccgaccccgagaaggugaagaaggagcugcucgccuacgacgucgugugcgaggacuacggcggggacgugcaggccguccccgugagcgcgcugaccggcgacaaccugauggcccucgccgaggccacgguggcgcuggccgagaugcuggagcucaaggccgacccgaacgggcccgucgagggcaccgugaucgaguccuucaccgacaagggccgggggcuggugaccacggccaucauccagcgcggcacccugcggaaggggagcguccucguggccggcaagugcugggcgaaggugcgccugauguucgacgagaacgggaagaccaucgacgaggccuaccccuccaugcccgucggcaucaccggcuggcgggaccugccgagcgccggggaggagauccucgagguggagagcgagccccgcgcccgggagguggucgacuggcgcaaguacgagcaggagcaggagaagggccaggaggaccugaagaucaucgaggagaagcgcaaggagcacaaggaggcccaccagaaggcgcgggagaaguacgggcaccuccuguggaagaagcgcuccauccugcgguuccuggagcgcaaggagcagaucccccucaagcccaaggagaagcgggagcgcgacagcaacgugcuguccgugaucaucaagggcgacgucgacgggagcguggaggccauccugaacaucaucgacacguacgacgccucccacgagugcgagcuggagcucgugcacuucggcgucggcgacgugagcgccaacgacgugaaccuggccgagaccuucgacggggucaucuacggcuucaacgugaacgcggggaacgugauccagcaguccgccgccaagaagggcgucaagaucaagcugcacaagaucaucuaccggcucguggaggaccugcaggaggagcugagcucccgccucccgugcgccguggaggagcaccccgucggggaggcgagcauccuggccaccuucuccgugaccgagggcaagaagaaggugcccgucgccggcugccgggugcagaaggggcagcuggagaagcagaagaaguucaagcucacgcgcaacggccacgugaucuggaaggggagccugaccucccugaagcaccacaaggacgacaucagcaucgucaagaccggcauggacugcggccucucccuggacgaggacaacauggaguuccaggugggggaccggaucgugugcuacgaggagaagcagauccaggccaagaccagcugggaccccggcuucuga

SEQ ID NO: 33182 - RNA, 837 nt, Artificial Sequence
  derived and/or modified sequence opt1 from MTIF3__Homo_sapiens__XP_011533265
auggccgcccuguuccucaagcgccugacccugcagaccgucaagagcgagaacuccugcauccggugcuucggcaagcacauccuccagaagacggcgcccgcccagcugagcccgaucgccuccgcgccccgccugagcuuccucauccacgccaaggccuucuccaccgccgaggacacccagaacgaggggaagaagaccaagaagaacaagacggccuucagcaacgugggccggaagaucucccagcgcgugauccaccuguucgacgagaaggggaacgaccugggcaacaugcaccgggccaacgugauccgccucauggacgagcgggaccugcgccugguccagcggaacaccagcaccgagcccgcggaguaccagcucaugaccgggcugcagauccugcaggagcgccagcggcuccgcgagauggagaaggccaaccccaagacgggcccgacccugcggaaggagcugauccucuccagcaacaucggccagcacgaccuggacaccaagaccaagcagauccagcaguggaucaagaagaagcaccuggugcagaucacgaucaagaaggggaagaacguggacgucuccgagaacgagauggaggagaucuuccaccagauccuccagaccaugcccggcaucgccaccuucagcucccgcccccaggccgugcagggcgggaaggcccugaugugcgugcugcgggcguucagcaagaacgaggagaaggccuacaaggagacccaggagacgcaggagcgcgacacccucaacaaggaccacgggaacgacaaggaguccaacguccugcaccaguga

SEQ ID NO: 33183 - RNA, 921 nt, Artificial Sequence
  derived and/or modified sequence opt1 from MTL5__Homo_sapiens__NP_001034745
auggaggagggcccccugcccggcggccuccccagccccgaggacgccauggugaccgagcugcugucccccgaggggccguucgccagcgagaacaucggccucaaggcgcccgucaaguacgaggaggacgaguuccacguguucaaggaggccuaccuggggcccgccgaccccaaggagccggugcugcacgccuucaaccccgcccucggcgcggacugcaagggccaggucaaggccaagcuggccgggggcgacuccgacgggggcgagcugcucggggaguaccccggcauccccgagcugagcgcccuggaggacguggcgcuccugcaggccccgcagccgcccgccugcaacgugcacuuccuguccagccuccugcccgcccaccgcuccccggccguccugccccucggcgcgugggugcuggagggggccagccaccccggcgugcggaugauccccgucgagaucaaggaggccgggggcaccacgaccuccaacaacccggaggaggccacccugcagaaccuccuggcccaggagagcugcugcaaguuccccuccagccaggagcuggaggacgcguccugcugcagccucaagaaggacuccaaccccauggugaucugccagcugaagggcgggacccagaugcugugcaucgacaacagccgcacgcgggagcucaaggcccugcaccuggugccccaguaccaggaccagaacaacuaccuccaguccgacgucccgaagcccaugaccgcccuggugggccgcuuccugcccgccagcaccaagcucaaccugaucacccagcagcuggagggggcccuccccuccguggucaacggcagcgcguucccgagcggguccacgcugcccgggcccccgaagaucacccuggccggcuga

SEQ ID NO: 33184 - RNA, 1812 nt, Artificial Sequence
  derived and/or modified sequence opt1 from MTM1__Homo_sapiens__XP_011529475
auggccagcgccuccaccagcaaguacaacucccacagccuggagaacgaguccaucaagcgcaccagccgggacggcgugaaccgcgaccucacggaggcggucccccggcugccgggggagacccugaucaccgacaaggaggugaucuacaucugccccuucaacggccccaucaaggggcgcguguacaucaccaacuaccggcucuaccugcgcucccuggagacggacagcucccucauccuggacgucccccugggcgugaucagccggaucgagaagaugggcggggccaccucccgcggcgagaacagcuacgggcucgacaucacgugcaaggacaugcggaaccugcgcuucgcccugaagcaggagggccacucccggcgcgacauguucgagauccucacccgguacgccuucccgcuggcccacagccugccccucuucgcguuccugaacgaggagaaguucaacguggacggguggaccgucuacaaccccguggaggaguaccgccggcagggccugcccaaccaccacuggcgcaucaccuucaucaacaagugcuacgagcucugcgacaccuacccggcccugcuggugguccccuaccgggccuccgacgacgaccuccgccggguggccaccuuccgcagccggaaccgcauccccgugcuguccuggauccaccccgagaacaagacggucaucgugcgcugcagccagccgcugguggggauguccggcaagcggaacaaggacgacgagaaguaccucgacgucauccgcgagaccaacaagcagaucagcaagcugaccaucuacgacgcgcggcccagcgugaacgccguggccaacaaggccaccggcgggggcuacgaguccgacgacgccuaccacaacgcggagcuguucuuccucgacauccacaacauccacgucaugcgcgagagccugaagaaggugaaggacaucguguaccccaacgucgaggagucccacuggcugagcucccucgagagcacgcacuggcuggagcacaucaagcuggugcucaccggggccauccagguggccgacaaggucuccagcggcaaguccagcgugcugguccacugcuccgacggcugggaccggaccgcccagcugaccagccucgccaugcugaugcuggacuccuucuaccgcagcaucgagggguucgagauccucgugcagaaggaguggaucuccuucggccacaaguucgcgagccggaucgggcacggcgacaagaaccacacggacgccgaccgcucccccaucuuccugcaguucaucgacugcguguggcagaugagcaagcaguucccgaccgccuucgaguucaacgagcaguuccugaucaucauccucgaccaccuguacuccugccgguucgggaccuuccuguucaacugcgagagcgcccgcgagcggcagaaggucaccgagcgcacggugagccucuggucccugaucaacagcaacaaggagaaguucaagaaccccuucuacaccaaggagaucaaccgggugcuguaccccgucgccuccaugcgccaccucgagcugugggugaacuacuacauccgguggaacccccgcaucaagcagcagcagccgaaccccguggagcagcgguacauggagcugcuggcgcuccgcgacgaguacaucaagcggcuggaggagcugcagcucgccaacagcgccaagcuguccgacccgcccaccagccccuccagccccucccagaugaugccccacguccagacccacuucuga

SEQ ID NO: 33185 - RNA, 1239 nt, Artificial Sequence
  derived and/or modified sequence opt1 from MTMR11__Homo_sapiens__XP_011507401
augugguggggcgggcgcggccagagcuucaacaucgcgccccagaaggaggagccggagaugggguccgugcaggagaaccggaugcccgagccccgcagccggcagcccuccagcugccuggccucccgcugccucccgggcgagcagauccuggccugggcccccgggguccggaagggccuggagcccgagcucagcggcacccugaucugcaccaacuuccgcgugacguuccagcccugcggguggcaguggaaccaggacaccccgcugaacuccgaguacgacuucgcccucgugaacaucggccggcuggaggccgucagcgggcugucccgcgugcagcuccugcggcccggcagccugcacaaguucauccccgaggagauccucauccacgggcgcgacuuccggcugcugcgcgugggcuucgaggccggcgggcucgagccccaggcguuccaggucaccauggccaucgugcaggcccgggcccaguccaaccaggcgcagcaguacagcggcaucacccuguccaaggccgggcagggcagcggcucccgcaagccgcccaucccccugauggagacggccgaggacugggagaccgagcggaagaagcaggccgcccgcggguggcgggugagcaccgucaacgagcgcuucgacguggcgaccucccucccccgguacuucugggugccgaaccgcauccuggacagcgagguccggcgcgccuucggccacuuccaccaggggcgcggcccccggcuguccuggcaccaccccgggggcagcgaccuccugcgcugcggcggguucuacacggccagcgaccccaacaaggaggacauccgggccguggagcugaugcuccaggccggccacuccgacgugguccugguggacaccauggacgagcugccgagccucgcggacgugcagcuggcccaccuccgccugcgggcccugugccugcccgacuccagcgucgccgaggacaaguggcucuccgcccuggaggggacccgcuggcuggacuacgugcgggcgugccuccgcaaggccagcgacaucuccgugcuggucaccagccgggugcgcuccgugauccugcaggccgccuucagcccccggucccccaacacggucuggcucccgaucaccagcaccgcccgcgugggcggguccuggaccagccugcccgacuccgcguggggcaacuggggccaguga

SEQ ID NO: 33186 - RNA, 2244 nt, Artificial Sequence
  derived and/or modified sequence opt1 from MTMR12__Homo_sapiens__NP_001035536
augcugggcaaggggguggucggcgggggcgggggcaccaaggcccccaagccgagcuucguguccuacgugcgccccgaggagauccacaccaacgagaaggaggucacggagaaggaggugacccuccaccuccugcccggcgagcagcuccugugcgaggccagcaccgugcugaaguacguccaggaggacuccugccagcacgggguguacggccggcucgugugcaccgacuucaagaucgcguuccugggggacgacgagagcgcccuggacaacgacgagacgcaguucaagaacaaggucaucggcgagaacgacaucacccuccacugcguggaccagaucuacgggguguucgacgagaagaagaagacccuguucggccagcugaagaaguaccccgagaagcucaucauccacugcaaggaccugcgcgucuuccaguucugccugcgguacaccaaggaggaggaggugaagcgcaucguguccggcaucauccaccacacgcaggccccgaagcuccugaagcggcuguuccucuucagcuacgccaccgccgcgcagaacaacaccgucaccgaccccaagaaccacacggugauguucgacacccugaaggacuggugcugggagcuggagcgcaccaaggggaacaugaaguacaaggccguguccgucaacgagggcuacaaggugugcgagcggcuccccgccuacuucgugguccccaccccgcugcccgaggagaacgugcagcgcuuccaggggcacggcauccccaucuggugcuggagcugccacaacggcuccgcccugcucaagaugagcgcgcugcccaaggagcaggacgacgggauccugcagauccagaaguccuuccucgacggcaucuacaagacgauccaccggccgcccuacgagaucgugaagaccgaggaccugagcuccaacuuccugagccuccaggagauccagaccgccuacuccaaguucaagcagcuguuccugaucgacaacagcaccgaguucugggacacggacaucaagugguucucccuccuggagagcuccagcuggcuggacaucauccgccggugccucaagaaggccaucgagaucaccgagugcauggaggcccagaacaugaacguccugcugcucgaggagaacgccagcgaccugugcugccugaucuccagccucgugcagcugaugauggacccccacugccgcacccggaucggguuccagucccugauccagaaggagugggucaugggcgggcacugcuuccucgaccgcugcaaccaccuccggcagaacgacaaggaggaggugcccguguuccugcuguuccuggacugcgucuggcagcuggugcaccagcacccgcccgcguucgaguucaccgagacguaccugaccgugcugagcgacucccuguacauccccaucuucagcaccuucuucuucaacagcccccaccagaaggacaccaacaugggccgcgagggccaggacacgcaguccaagccgcugaaccuccugaccgucugggacugguccgugcaguucgagcccaaggcccagacccugcucaagaacccccuguacguggagaagcccaagcuggacaaggggcagcggaagggcaugcgcuucaagcaccagcggcagcucagccugccgcugacccaguccaagagcucccccaagcgcggguucuuccgggaggagacggaccaccucaucaagaaccugcugggcaagcgcaucagcaagcucaucaacuccagcgacgagcugcaggacaacuuccgcgaguucuacgacuccuggcacagcaaguccaccgacuaccacgggcugcuccugccccacaucgagggccccgagaucaaggucugggcccagcgguaccugcgcuggaucccggaggcccagauccucggcgggggccagguggccacccugagcaagcugcucgagaugauggaggaggugcagagccugcaggagaagaucgacgagcggcaccacucccagcaggcgccccaggccgaggcccccugccugcuccgcaacagcgcccggcuguccagccuguucccguucgcccuccugcagcgccacuccagcaagcccguccugcccaccuccggguggaaggcgcucggcgacgaggacgaccuggccaagcgggaggacgaguucguggaccugggggacguguga

SEQ ID NO: 33187 - RNA, 1953 nt, Artificial Sequence
  derived and/or modified sequence opt1 from MTMR14__Homo_sapiens__NP_001070993
auggccggcgcccgcgcggccgccgccgccgcgagcgccggguccagcgccuccagcggcaaccagcccccgcaggagcuggggcucggcgagcugcuggaggaguucucccggacccaguaccgcgccaaggacgggagcggcaccggcggguccaagguggagcggaucgagaagcgcugccucgagcuguucggccgggacuacugcuucagcgucauccccaacacgaacggggacaucugcggccacuacccccgccacaucguguuccuggaguacgaguccagcgagaaggagaaggacaccuucgaguccaccgugcaggucagcaagcuccaggaccugauccaccgguccaagauggcgcgcugccgggggcgcuucgugugccccgugauccuguucaagggcaagcacaucugccggagcgccacccucgccggcuggggcgagcuguacgggcgcuccggguacaacuacuucuucagcggcggcgccgacgacgccugggcggacgucgaggacgugacggaggaggacugcgcccugcgguccggggacacccaccucuucgacaaggugcgcggcuacgacaucaagcugcugcgguaccucagcgucaaguacaucugcgaccugaugguggagaacaagaaggugaaguucgggaugaacgucaccuccagcgagaagguggacaaggcccagcgcuacgccgacuucacccugcucagcaucccguaccccggcugcgaguucuucaaggaguacaaggaccgggacuacauggccgaggggcugaucuucaacuggaagcaggacuacguggacgcgccccuguccauccccgacuuccucacgcacagccugaacaucgacuggucccaguaccagugcugggaccugguccagcagacccagaacuaccucaagcugcugcucagccuggugaacuccgacgacgacagcggccugcucgugcacugcaucuccggcugggaccgcaccccgcuguucaucagccugcuccggcugucccugugggccgacgggcucauccacaccagccugaagcccacggagauccuguaccucaccgucgccuacgacugguuccuguucggccacaugcugguggaccgccucuccaagggggaggagaucuucuucuucugcuucaacuuccugaagcacaucaccagcgaggaguucuccgcccugaagacccagcggcgcaagagccuccccgcccgcgacggcggguucacgcuggaggacaucugcaugcugcggcgcaaggaccggggcuccaccaccagccucggcuccgacuucagccuggugauggaguccagccccggggcgaccggcagcuucacguacgaggccgucgagcuggugccggccggggcccccacccaggccgcguggcgcaagucccacagcuccagcccccaguccgugcuguggaaccggccccagccgagcgaggaccgccuccccucccagcagggccuggccgaggcccggagcuccagcuccagcuccagcaaccacuccgacaacuucuuccgcauggggagcagcccccuggagguccccaagccgcgguccguggaccacccccuccccggcagcucccugagcaccgacuacggcuccuggcagauggucaccgggugcggcagcauccaggagcgcgccgugcugcacacggacuccagccuccccuucuccuucccggacgagcugcccaacagcugccugcucgcggcccuguccgaccgggagacccgccugcaggaggugcggagcgccuuccucgccgccuacuccagcaccgucgggcugcgcgcgguggcccccucccccagcggcgccaucggcgggcugcucgagcaguucgcccggggcguggggcugcgcuccaucagcuccaacgcccuguga

SEQ ID NO: 33188 - RNA, 1998 nt, Artificial Sequence
  derived and/or modified sequence opt1 from MTMR1__Homo_sapiens__NP_003819
auggaccgccccgccgccgcggccgccgccggcugcgagggcgggggcgggccgaaccccgggcccgccggcggccggcggcccccgcgcgcggccgggggcgccaccgccgggagccgccagcccuccguggagacccuggacagccccacgggcucccacgucgaguggugcaagcagcucaucgcggccaccaucagcucccagaucagcggguccgugaccagcgagaacgugucccgggacuacaaggcccugcgcgacggcaacaagcuggcccagauggaggaggcgccccucuucccgggcgagagcaucaaggccaucgucaaggacgugauguacaucugccccuucaugggggccguguccggcacccugacggucaccgacuucaagcuguacuucaagaacguggagcgggacccccacuucauccucgacgugccccugggggucaucagccgcguggagaagaucggcgcccagucccacggcgacaacagcugcgggaucgagaucgugugcaaggacaugcggaaccugcgccucgccuacaagcaggaggagcaguccaagcugggcaucuucgagaaccugaacaagcacgccuucccgcucagcaacgggcaggcgcuguucgccuucuccuacaaggagaaguuccccaucaacggcuggaaggucuacgaccccgugagcgaguacaagcggcaggggcugcccaacgaguccuggaagaucagcaagaucaacagcaacuacgaguucugcgacaccuacccggccaucaucgugguccccaccuccgugaaggacgacgaccucagcaagguggccgccuuccgcgcgaagggccggguccccgugcuguccuggauccaccccgagagccaggccacgaucacccgcugcucccagccgcuggugggccccaacgacaagcggugcaaggaggacgagaaguaccuccagaccaucauggacgccaacgcccagagccacaagcugaucaucuucgacgcccgccagaacuccgucgcggacaccaacaagacgaagggcggcggguacgagagcgaguccgccuaccccaacgccgagcugguguuccucgagauccacaacauccacgugaugcgggagagccugcgcaagcugaaggagaucgucuaccccuccaucgacgaggcccgguggcucagcaacguggacgggacccacuggcuggaguacauccgcaugcugcucgcgggggccguccggaucgccgacaagaucgaguccggcaagaccagcguggugguccacugcuccgacggcugggaccgcaccgcccagcugacgagccuggccaugcucaugcuggacuccuacuaccgcaccaucaagggguucgagacccugguggagaaggaguggaucagcuucggccaccgguucgcgcuccgcguggggcacggcaacgacaaccacgccgacgccgaccgguccccgaucuuccugcaguucgucgacugcguguggcagaugacccgccaguuccccagcgccuucgaguucaacgagcuguuccucaucacgauccuggaccaccuguacagcugccucuucgggaccuuccugugcaacugcgagcagcagcgguucaaggaggacguguacaccaagaccaucucccuguggagcuacaucaacucccagcucgacgaguucagcaaccccuucuucgucaacuacgagaaccacgugcuguaccccguggccucccugagccaccucgagcugugggucaacuacuacgugcgcuggaacccgcggaugcgcccccagaugcccauccaccagaaccugaaggagcuccuggcggugcgggccgagcugcagaagcgcgucgagggccugcagcgggagguggccacgcgcgccguguccagcuccagcgagcggggcuccagcccgucccacagcgccaccuccguccacaccagcguguga

SEQ ID NO: 33189 - RNA, 1932 nt, Artificial Sequence
  derived and/or modified sequence opt1 from MTMR2__Homo_sapiens__NP_057240
auggagaaguccagcagcugcgagucccugggcagccagcccgccgccgcgcgcccgcccuccguggacagccucuccagcgccuccaccagccacuccgagaacagcguccacaccaaguccgccagcgugguguccagcgacuccaucagcacguccgccgacaacuucagccccgaccugcggguccugcgcgagagcaacaagcucgccgagauggaggagcccccgcugcugcccggggagaacaucaaggacauggcgaaggacgugaccuacaucugccccuucaccggcgccgugcgggggacccucacggucaccaacuaccgccuguacuucaaguccauggagcgggacccgcccuucgugcuggacgccagccucggcgugaucaaccgcgucgagaagaucgggggcgccuccagccggggcgagaacuccuacgggcuggagaccgugugcaaggacauccgcaaccugcgguucgcgcacaagcccgagggccgcacccggcgcagcaucuucgagaaccucaugaaguacgccuuccccguguccaacaaccugccccuguucgccuucgaguacaaggaggucuucccggagaacggguggaagcucuacgacccccugcuggaguaccggcgccagggcauccccaacgagagcuggcggaucacgaagaucaacgagcgcuacgagcucugcgacaccuaccccgcccugcugguggugccggccaacauccccgacgaggagcucaagcgggucgcguccuuccgcagccgggggcgcauccccgugcuguccuggauccaccccgagagccaggccaccaucacccggugcucccagccgauggugggcgucagcggcaagcgcuccaaggaggacgagaaguaccugcaggccaucauggacagcaacgcccagucccacaagaucuucaucuucgacgcccgccccagcgugaacgcgguggccaacaaggccaagggcggcggguacgaguccgaggacgccuaccagaacgccgagcucgucuuccuggacauccacaacauccacgugaugcgggagagccugcgcaagcucaaggagaucguguaccccaacaucgaggagacgcacuggcugagcaaccuggaguccacccacuggcucgagcacaucaagcugauccuggcgggggcccuccggaucgccgacaaggucgagagcggcaagaccuccguggucgugcacugcagcgacgggugggaccgcaccgcccagcugacgucccuggccaugcucaugcuggacggcuacuaccggaccauccgcggguucgaggugcuggucgagaaggaguggcucagcuucggccaccgguuccagcugcgcguggggcacggcgacaagaaccacgcggacgccgaccggucccccguguuccugcaguucaucgacugcgucuggcagaugacccgccaguucccgaccgccuucgaguucaacgaguacuuccucaucacgauccuggaccaccuguacagcugccucuucggcaccuuccugugcaacuccgagcagcagcgggggaaggagaaccugcccaagcgcaccgugagccucugguccuacaucaacagccagcuggaggacuucaccaacccccuguacggcuccuacagcaaccacgugcuguaccccgucgccuccaugcggcaccucgagcugugggugggguacuacauccgcuggaacccgcggaugaagccccaggagcccauccacaaccgcuacaaggagcugcucgcgaagcgggccgagcugcagaagaagguggaggagcugcagcgcgagaucagcaaccgguccacgagcagcuccgagcgcgccagcuccccggcccagugcgucacccccgugcagaccguggucuga

SEQ ID NO: 33190 - RNA, 3597 nt, Artificial Sequence
  derived and/or modified sequence opt1 from MTMR3__Homo_sapiens__NP_066576
auggacgaggagacccgccacagccuggagugcauccaggccaaccagaucuucccccggaagcagcucauccgcgaggacgagaaccuccaggugccguuccuggagcugcacggcgaguccaccgaguucgucgggcgggccgaggacgcgaucaucgcccugagcaacuaccgccugcacaucaaguucaaggagucccucgugaacgugccccugcagcugaucgagagcgucgagugccgggacaucuuccagcuccaccugacgugcaaggacugcaaggugauccgcugccaguucuccaccuucgagcagugccaggaguggcugaagcggcucaacaacgccauccgcccgcccgccaagaucgaggaccuguucagcuucgccuaccacgcguggugcauggagguguacgccuccgagaaggagcagcacggcgaccugugccggccgggggagcacgucaccagccgcuucaagaacgagguggagcggaugggcuucgacaugaacaacgccuggcgcaucuccaacaucaacgagaaguacaagcucugcgggagcuacccccaggagcugaucgugcccgccuggaucaccgacaaggagcuggaguccgucagcuccuuccggagcuggaagcgcauccccgcggugaucuaccggcaccaguccaacggcgccgugaucgcccgcugcggccagccggaggucagcugguggggguggcggaacgccgacgacgagcaccucgugcaguccguggccaaggcgugcgccagcgacucccgcagcagcggcuccaagcugagcacgcggaacaccucccgcgacuuccccaacgggggcgaccugagcgacgucgaguucgacuccagccucuccaacgccagcggggccgagucccuggccauccagccccagaagcugcucauccuggacgcgcggagcuacgccgccgccguggccaaccgcgcgaagggcggcgggugcgagugccccgaguacuacccgaacugcgagguggucuucaugggcauggccaacauccacuccauccgccggagcuuccagucccugcgccuccugugcacccagaugcccgaccccgggaacuggcugagcgcccucgaguccaccaaguggcugcaccaccugagcgugcuccugaaguccgcccugcucgugguccacgccguggaccaggaccagcggcccgugcugguccacugcagcgacggcugggaccgcacgccgcagaucguggcgcuggccaagcuccugcuggaccccuacuaccggaccaucgagggcuuccagguccucguggagauggaguggcuggacuucgggcacaaguucgccgaccgcugcggccacggggagaacuccgacgaccugaacgagcggugccccguguuccuccaguggcuggacugcguccaccagcugcagcgccaguuccccugcagcuucgaguucaacgaggccuuccucgugaagcuggugcagcacaccuacagcugccuguucggcaccuuccugugcaacaacgcgaaggagcgcggggagaagcacacgcaggagcggaccugcuccgucuggagccuccugcgggccggcaacaaggccuucaagaaccugcucuacuccagccaguccgaggccgugcuguacccggugugccacguccgcaaccugaugcucuggagcgccguguaccugcccugccccucccccaccaccccgguggacgacagcugcgcgcccuaccccgcccccggcacguccccggacgacccgccccugagccggcuccccaagacccgcuccuacgacaaccugaccaccgccugcgacaacacggucccccuggccagccggcgcugcuccgaccccagccucaacgagaaguggcaggagcaccggcgcucccuggagcugagcucccucgccgggcccggcgaggacccgcugagcgcggacagccuggggaagcccacccgggugcccggcggggccgagcucuccguggccgccggcgucgccgagggccagauggagaacauccugcaggaggcgaccaaggaggagagcgggguggaggagcccgcccaccgcgccggcaucgagauccaggaggggaaggaggacccgcugcucgagaaggagucccgccggaagacccccgaggccagcgcgaucggccugcaccaggaccccgagcugggggacgccgcccuccgcucccaccuggacaugagcuggccccuguucucccagggcaucagcgagcagcaguccggccucagcgugcugcuguccagccuccaggucccgccccgcggggaggacucccuggaggugcccguggagcaguuccggaucgaggagaucgccgagggccgggaggaggccguccugcccaucccgguggacgcgaaggugggguacggcacgagccaguccugcagccuccugcccucccagguccccuucgagacccgcggccccaacguggacagcuccaccgacaugcugguggaggacaaggucaagagcgugagcgggccgcagggccaccaccgguccugccucgugaacagcgggaaggaccgccugccccagaccauggagcccucccccagcgagacgucccuggucgagcggccccaggugggcagcgugguccaccgcaccucccucgggagcacccugucccugacccggagccccugcgcccucccccuggccgagugcaaggagggccuggugugcaacggcgccccggagacggagaaccgcgccuccgagcagccgcccgggcucagcacccugcagauguaccccacccccaacggccacugcgcgaacggggaggccggccgguccaaggacagccugucccgccagcucagcgccauguccugcagcuccgcccaccuccacagccggaaccugcaccacaaguggcugcacagccacuccgggcgccccagcgccaccuccagccccgaccagcccucccggagccaccuggacgacgacggcauguccguguacacggacaccauccagcagcgccugcggcagaucgagagcggccaccagcaggaggucgagacccucaagaagcagguccaggagcugaagucccgccuggagagccaguaccucaccuccagccugcacuucaacggggacuucggcgacgaggugaccuccaucccggacagcgaguccaaccuggaccagaacugccucagccggugcuccacggagaucuucagcgaggcguccugggagcaggucgacaagcaggacaccgagaugacccgcuggcugcccgaccaccuggccgcccacugcuacgccugcgacagcgcguucuggcucgccagccgcaagcaccacugccggaacugcgggaacguguucugcuccagcugcugcaaccagaaggugcccgugcccucccagcagcuguucgagccgagccgcgugugcaaguccugcuacagcucccugcaccccaccagcuccagcaucgaccucgagcuggacaagcccaucgccgccacguccaacuga

SEQ ID NO: 33191 - RNA, 3588 nt, Artificial Sequence
  derived and/or modified sequence opt1 from MTMR4__Homo_sapiens__XP_006722231
augggcgaggaggggcccccgagccuggaguacauccaggccaaggaccucuucccgcccaaggagcuggugaaggaggaggagaaccugcagguccccuucaccgugcuccagggcgaggggguggaguuccugggccgcgccgcggacgcccugaucgccaucuccaacuaccggcuccacaucaaguucaaggacagcgucaucaacgugccccugcgcaugaucgacuccguggagagccgggacauguuccagcugcacaucuccugcaaggacagcaaggucgugcgcugccacuucuccaccuucaagcagugccaggaguggcucagccggcugucccgcgccacggcccggcccgcgaagcccgaggaccuguucgccuucgccuaccacgccuggugccucgggcugaccgaggaggaccagcacacccaccugugccagcccggcgagcacauccgcugccggcaggaggcggagcucgcccgcaugggcuucgaccugcagaacguguggcgggucagccacaucaacuccaacuacaagcugugcccgagcuacccccagaagcuccuggugcccguguggaucaccgacaaggagcuggagaacgucgccuccuuccgcagcuggaagcggauccccgugguggucuaccgccaccuccggaacggggccgccaucgcgcgcugcucccagccggagaucagcugguggggcuggcggaacgccgacgacgaguaccuggugacguccaucgccaaggccugcgcccuggaccccgggacccgcgcgaccggcgggagccucuccaccggcaacaacgacacgagcgaggccugcgacgccgacuucgacagcucccugaccgccugcagcggcguggaguccaccgccgcgccccagaagcugcucauccuggacgcccggagcuacaccgccgccgucgccaaccgcgcgaagggcggcgggugcgagugcgaggaguacuaccccaacugcgaggugguguucauggggauggccaacauccacgccauccggaacuccuuccaguaccugcgcgccgucugcagccagaugccggaccccuccaacuggcucagcgcgcuggaguccacgaaguggcugcagcaccucagcgugaugcugaaggccgccgugcuggucgccaacaccguggaccgcgagggccggcccguccucgugcacugcuccgacgggugggaccgcacgccccagaucguggcccuggcgaagauccugcucgacccguacuaccggacccuggagggcuuccagguccugguggagagcgacuggcucgacuucgggcacaaguucggcgaccgcugcgggcaccaggagaacguggaggaccagaacgagcagugccccgucuuccugcaguggcuggacuccgugcaccagcuccugaagcaguuccccugccuguucgaguucaacgaggccuuccucgugaagcugguccagcacaccuacagcugccuguacggcaccuuccuggccaacaaccccugcgagcgggagaagcgcaacaucuacaagcggaccugcuccgugugggcccuccugcgcgccggcaacaagaacuuccacaacuuccuguacaccccgagcuccgacauggugcuccaccccgucugccacgugcgggcgcugcaccuguggacggccguguaccuccccgccagcucccccugcacccugggggaggagaacauggaccuguaccucagcccggucgcccagagccaggaguucuccggccgcagccuggaccggcugcccaagacccgcuccauggacgaccuccugagcgccugcgacaccuccagcccccugacgcggaccuccagcgacccgaaccucaacaaccacugccaggaggugcgcguggggcuggagcccuggcacuccaaccccgagggcagcgagaccuccuucgucgacagcggggugggcggcccccagcagaccgugggggaggucggccugccgccgccccuccccuccagccagaaggacuaccuguccaacaagcccuucaagagccacaaguccugcagccccagcuacaagcugcucaacacggcggugccccgggagaugaaguccaacaccagcgaccccgagaucaaggugcuggaggagaccaaggggccggcccccgaccccuccgcccaggacgagcugggccgcacccucgacgggaucggcgagcccccggagcacugccccgagacggaggccgucagcgcgcuguccaaggugaucagcaacaagugcgacggcgugugcaacuuccccgaguccagccagaacucccccaccgggaccccgcagcaggcccagcccgacagcaugcugggcguccccuccaagugcgugcucgaccacagccuguccaccgugugcaacccgcccagcgccgccugccagacgccccuggaccccuccaccgacuuccucaaccaggacccgagcggguccgucgccagcaucucccaccaggagcagcugagcagcgugcccgaccugacccacggcgaggaggacaucggcaagcgggggaacaaccgcaacggccagcuccuggagaacccccgguucgggaagaugccccuggagcucgugcgcaagccgaucucccagagccagaucuccgaguucagcuuccugggcuccaacugggacagcuuccaggggauggucaccuccuuccccagcggcgaggcgacgccccgccggcugcucuccuacggcugcugcagcaagcgccccaacuccaagcagaugcgggccaccgggccgugcuucggcgggcagugggcccagcgcgagggcgugaagucccccgugugcagcagccacuccaacgggcacugcaccggccccggcgggaagaaccagauguggcugagcucccaccccaagcaggucagcuccaccaagccggugccccugaacugccccagccccgugccgccccucuaccuggacgacgacggccugcccuuccccaccgacgucauccagcaccggcuccgccagaucgaggccggguacaagcaggagguggagcagcugcggcgccaggugcgggagcugcagaugcgccucgacauccggcacugcugcgccccgcccgcggagccgcccauggacuacgaggacgacuucacgugccugaaggagagcgacggcuccgacaccgaggacuucgggagcgaccacuccgaggacugccugagcgaggccuccugggagcccgucgacaagaaggagaccgaggugacccgcugggugcccgaccacauggccagccacugcuacaacugcgacugcgaguucuggcucgccaagcggcgccaccacugccggaacugcggcaacgucuucugcgccggcugcugccaccugaagcugcccauccccgaccagcagcucuacgacccggugcuggugugcaacuccugcuacgagcacauccaggucagccgcgcgcgggagcugaugucccagcagcucaagaagcccaucgccacggccagcuccuga

SEQ ID NO: 33192 - RNA, 1866 nt, Artificial Sequence
  derived and/or modified sequence opt1 from MTMR6__Homo_sapiens__NP_004676
auggagcacauccgcaccaccaagguggagcaggucaagcugcucgaccgguucagcacguccaacaagagccugaccggcacccuguaccucaccgccacgcaccuccuguucaucgacucccaccagaaggagaccuggauccugcaccaccacaucgccagcguggagaagcuggcgcugaccaccuccgggugcccccucgugauccagugcaagaacuuccgcacgguccacuucaucgugccgcgggagcgcgacugccacgacaucuacaacagccugcugcagcucuccaagcaggccaaguacgaggaccuguacgccuucagcuacaaccccaagcagaacgacuccgagcggcugcagggcuggcagcucaucgaccuggccgaggaguacaagcgcaugggggugcccaacagccacuggcagcuguccgacgccaaccgggacuacaagaucugcgagaccuacccccgcgagcucuacgucccgcggaucgcgagcaagcccaucaucgugggcuccagcaaguuccgcuccaaggggcgguuccccgugcugagcuacuaccaccaggacaaggaggccgccaucugccgcugcucccagccccugagcggcuucuccgcccggugccucgaggacgagcaccuccugcaggcgaucagcaaggccaacccggucaaccgcuacauguacgugauggacacccggcccaagcugaacgccauggccaaccgcgccgcgggcaagggguacgagaacgaggacaacuacagcaacauccgguuccaguucgugggcaucgagaacauccacgucaugcgcuccagccugcagaagcugcucgaggugaacgggaccaagggccuguccgugaacgacuucuacagcgggcuggaguccagcggcuggcuccggcacaucaaggccgucauggacgccgccaucuuccuggccaaggcgaucacgguggagaacgccuccgugcugguccacugcagcgacggcugggaccgcaccucccaggugugcagccucgggucccugcugcucgacagcuacuaccggaccaucaagggcuucauggugcugaucgagaaggacuggaucuccuucgggcacaaguucagcgagcgcugcggccagcuggacggcgaccccaaggaggucucccccguguucacccaguuccucgagugcguguggcaccugacggagcaguucccgcaggccuucgaguucagcgaggccuuccugcuccagauccacgagcacauccacuccugccaguucgggaacuuccugggcaacugccagaaggagcgcgaggagcugaagcucaaggagaagaccuacagccuguggcccuuccugcucgaggaccagaagaaguaccugaacccccuguacuccagcgagagccaccgguucaccguccuggagcccaacaccguguccuucaacuucaaguucuggcgcaacauguaccaccaguucgaccggacgcuccacccgcgccagagcgucuucaacaucaucaugaacaugaacgagcagaacaagcagcuggagaaggacaucaaggaccuggaguccaagaucaagcagcggaagaacaagcagaccgacgggauccucaccaaggagcugcugcacagcgugcaccccgagucccccaaccucaagaccagccugugcuucaaggagcagacgcugcuccccgugaacgacgcccugcgcaccaucgagggcuccagcccggcggacaaccgguacuccgaguacgccgaggaguucagcaaguccgagcccgccgucgugagccuggaguacgggguggcccgcaugaccugcuga

SEQ ID NO: 33193 - RNA, 1983 nt, Artificial Sequence
  derived and/or modified sequence opt1 from MTMR7__Homo_sapiens__NP_004677
auggagcacauccgcacccccaagguggagaacguccggcugguggaccgcgugagcccgaagaaggccgcccucggcacccuguaccugacggcgacccacgucaucuucguggagaacucccccgacccccggaaggagaccuggauccuccacagccagaucuccaccaucgagaagcaggccacgaccgccaccgggugcccccugcugauccgcugcaagaacuuccagaucauccagcucaucaucccgcaggagcgggacugccacgacguguacaucagccugauccgccuggcccggcccgucaaguacgaggagcucuacugcuucuccuucaaccccaugcuggacaaggaggagcgcgagcagggcugggugcugaucgaccucagcgaggaguacacccggauggggcugcccaaccacuacuggcagcuguccgacgugaaccgcgacuaccgggucugcgacagcuacccgacggagcucuacgugcccaaguccgccaccgcgcacaucaucgugggcagcuccaaguuccgcagccggcgccgguuccccguccuguccuacuacuacaaggacaaccacgccagcaucugccgcuccagccagccccuguccggguucagcgcccggugccucgaggacgagcagaugcugcaggccauccgcaaggcgaacccgggcuccgacuucguguacguggucgacacccggcccaagcugaacgccauggccaaccgcgccgccggcaagggguacgagaacgaggacaacuacagcaacaucaaguuccaguucaucggcaucgagaacauccacgugaugcggaacagccuccagaagaugcuggaggugugcgagcugaagucccccagcauguccgacuuccucugggggcuggagaacagcggcuggcugcgccacaucaaggcgaucauggacgccgggaucuucaucgccaaggccgucuccgaggagggcgccagcgugcucgugcacugcuccgacggcugggaccgcaccgcgcaggucugcagcguggccucccugcugcucgacccccacuaccggacgcugaagggguucauggugcugaucgagaaggacuggaucagcuucggccacaaguucaaccaccgcuacgggaaccucgacggcgacccgaaggagaucucccccgucaucgaccaguucaucgagugcguguggcagcugauggagcaguuccccugcgccuucgaguucaacgagcgguuccugauccacauccagcaccacaucuacagcugccaguucggcaacuuccucugcaacucccagaaggagcgccgggagcugaagauccaggagcgcaccuacagccugugggcccaccucuggaagaaccgggccgacuaccugaacccccuguuccgcgcggaccacucccagacccaggggacccuccaccucccgacgacccccugcaacuucauguacaaguucuggagcggcauguacaaccgguucgagaaggggaugcagccccgccaguccgucaccgacuaccugauggccgugaaggaggagacccagcagcuggaggaggagcuggaggcccuggaggagcggcucgagaagauccagaaggugcagcugaacugcacgaaggucaagagcaagcaguccgagcccagcaagcacagcggcuucuccaccagcgacaacuccaucgccaacaccccgcaggacuacagcgggaacaugaaguccuuccccagccgcucccccagccagggcgacgaggacuccgcccugauccugacccaggacaaccucaagagcuccgaccccgaccugagcgcgaacuccgaccaggagagcggcguggaggaccuguccugccggagcccguccgggggcgagcacgcccccagcgaggacagcgggaaggaccgcgacuccgacgaggccguguuccucacggccuga

SEQ ID NO: 33194 - RNA, 2115 nt, Artificial Sequence
  derived and/or modified sequence opt1 from MTMR8__Homo_sapiens__NP_060147
auggaccacaucaccgugcccaaggucgagaacgugaagcugguggaccgcuacgucagcaagaagccggccaacggcauccucuaccugaccgccacgcaccugaucuacguggaggcguccggggccgcccggaaggagaccuggaucgcccuccaccacaucgccaccguggagaagcugcccaucaccagccugggcugcccccucacgcugcgcugcaagaacuuccgggucgcgcacuucgugcuggacuccgaccucgugugccacgaggucuacaucagccugcugaagcucucccagcccgcccugccggaggaccuguacgccuucagcuacaaccccaaguccagcaaggagaugcgcgaguccggguggaagcucaucgaccccaucagcgacuucggccggauggggauccccaaccgcaacuggaccaucaccgacgccaaccggaacuacgagaucugcuccaccuacccgcccgagaucguggugcccaagagcgucacgcugggcaccguggugggcuccagcaaguuccgcuccaaggagcggguccccgugcugagcuaccucuacaaggagaacaacgcggccaucugccgcugcucccagccgcugagcggguucuacacccggugcguggacgacgagcugcuccuggaggccaucucccagaccaaccccggcagccaguucauguacgucguggacacgcgccccaagcugaacgccauggccaaccgggcggccgggaagggcuacgagaacgaggacaacuacgccaacauccgcuuccgguucauggggaucgagaacauccacgugaugcgcagcucccuccagaagcugcuggaggucugcgagcucaagacccccaccaugagcgaguuccuguccggccuggagagcuccggcuggcuccggcacaucaaggccaucauggacgccgggaucuucaucaccaaggcggugaagguggagaaggccagcguccuggugcacugcuccgacggcugggaccgcacggcccaggucugcagcguggccuccauccugcucgacccguucuaccggaccuucaaggggcugaugauccugaucgagaaggaguggaucagcaugggccacaaguucucccagcgcugcggccaccucgacggggacagcaaggaggugucccccaucuucacccaguuccuggacugcaucuggcagcugauggagcaguuccccugcgccuucgaguucaacgagaacuuccuccuggagauccacgaccacgucuucagcugccaguucggcaacuuccuggggaacugccagaaggaccgggaggaccuccgcguguacgagaagacccacuccguguggcccuuccugguccagcgcaagccggacuuccggaacccccuguacaagggcuucacgauguacggggugcucaaccccagcaccgugcccuacaacauccaguucuggugcggcauguacaaccgcuucgacaagggccugcagccgaagcaguccaugcuggagagccuccuggagaucaagaagcagcgggcgaugcuggagaccgacguccacgagcuggagaagaagcucaaggugcgcgacgagccgcccgaggagaucugcacgugcucccagcuggggaacauccugagccagcaccucggcagcccccugaccaacccccugggguucaugggcaucaacggggaccucaacacccugauggagaacggcacccugucccgggagggcgggcuccgcgcccagauggaccaggucaagagccagggcgccgaccugcaccacaacugcugcgagaucguggggucccugcgggccaucaacaucagcggcgacguggggaucuccgaggccaugggcaucagcggcgacaugugcaccuucgaggcgacgggguucuccaaggaccucggcaucugcggggccauggacaucagcgaggccaccggcaucuccggcaaccuggggaucagcgaggcccgcggcuucuccggggacaugggcauccugggggacaccggcaucagcaaggcguccaccaaggaggccgacuacagcaagcaccaguga

SEQ ID NO: 33195 - RNA, 1650 nt, Artificial Sequence
  derived and/or modified sequence opt1 from MTMR9__Homo_sapiens__NP_056273
auggaguucgccgagcugaucaagacgccccgcguggacaacgucgugcuccaccggccguucuaccccgccguggagggcacccugugccugaccgggcaccaccucauccugagcucccgccaggacaacaccgaggagcuguggcuccugcacagcaacaucgacgcgaucgacaagcgguucgucggcucccuggggaccaucaucaucaagugcaaggacuuccgcaucauccagcucgacauccccggcauggaggagugccugaacaucgccagcuccaucgaggcccugagcacccucgacuccaucacgcugauguaccccuucuucuaccggccgauguucgaggugaucgaggacggguggcacagcuuccugcccgagcaggaguucgagcucuacuccagcgccaccuccgaguggcgccugagcuacgugaacaaggaguucgccgucugccccuccuacccgcccaucgugaccgugcccaagagcaucgacgacgaggcgcugcggaaggucgccaccuuccgccacggcggccgguuccccgugcucuccuacuaccacaagaagaacgggauggugaucaugcgcagcggccagccccugacggggaccaacggccggcgcugcaaggaggacgagaagcugaucaacgccacccuccgggccgggaagcgcggcuacaucaucgacacccggucccugaacgucgcgcagcagacgcgcgccaagggcgggggcuucgagcaggaggcccacuacccgcaguggcggcgcauccacaagagcaucgagcgguaccacauccugcaggagucccucaucaagcugguggaggccugcaacgaccagacccacaacauggaccgcuggcugagcaagcucgaggccagcaacuggcugacccacaucaaggagauccugaccacggcgugccucgccgcccagugcaucgaccgggagggggccuccauccugauccacggcaccgagggcaccgacagcacccuccaggugacgucccucgcccagaucauccuggagccccgcagccgcaccauccggggguucgaggcgcugaucgagcgcgaguggcuccaggccggccaccccuuccagcagcggugcgcccaguccgccuacugcaacaccaagcagaagugggaggcccccgucuuccugcuguuccucgacugcguguggcagauccugcgccaguucccgugcagcuucgaguucaacgagaacuuccugaucaugcuguucgagcacgcguacgccucccaguucgggaccuuccugggcaacaacgagagcgagcggugcaagcugaagcuccagcagaagacgaugucccuguggagcugggugaaccagcccuccgagcugagcaaguucaccaacccccucuucgaggccaacaaccuggucaucuggcccuccguggccccgcagagccugccccugugggaggggaucuuccuccgcuggaaccgguccagcaaguaccuggacgaggccuacgaggagauggugaacaucaucgaguacaacaaggagcugcaggcgaaggucaacauccuccgccggcagcuggccgagcuggagaccgaggacggcaugcaggagucccccuga

SEQ ID NO: 33196 - RNA, 1053 nt, Artificial Sequence
  derived and/or modified sequence opt1 from MTNR1A__Homo_sapiens__NP_005949
augcagggcaacgggagcgcccugcccaacgccucccagccggugcuccgcggcgacggggcgcggcccagcuggcuggccuccgcccuggccugcguccucaucuucaccaucgugguggacauccugggcaaccugcucgucauccugagcguguaccgcaacaagaagcugcggaacgccgggaacaucuucguggucucccucgcgguggccgaccugguggucgccaucuaccccuacccccuggugcucaugagcaucuucaacaacggcuggaaccugggcuaccugcacugccagguguccggguuccucaugggccugagcgucaucggguccaucuucaacaucaccggcaucgccaucaaccgcuacugcuacaucugccacagccugaaguacgacaagcucuacuccagcaagaacucccugugcuacgugcugcucaucuggcugcugacgcucgcggccgugcugccgaaccugcgggccgggacccuccaguacgacccccgcaucuacagcugcaccuucgcccaguccgucagcuccgccuacaccaucgcggugguggucuuccacuuccuggugcccaugaucaucgugaucuucugcuaccugcggaucuggauccucguccuccaggugcgccagcgggugaagcccgaccgcaagccgaagcugaagccccaggacuuccggaacuucgucacgauguucguggucuucguccucuucgccaucugcugggcgccccugaacuucaucggccuggccguggccagcgaccccgccuccauggugccgcgcauccccgaguggcuguucguggccagcuacuacauggccuacuucaacagcugccugaacgccaucaucuacggccugcucaaccagaacuuccggaaggaguaccgccggaucaucgugucccugugcaccgcccgcgucuucuucguggacagcuccaacgacguggcggaccgggucaaguggaagcccagcccccugaugaccaacaacaacguggugaaggucgacuccguguga

SEQ ID NO: 33197 - RNA, 1089 nt, Artificial Sequence
  derived and/or modified sequence opt1 from MTNR1B__Homo_sapiens__NP_005950
augagcgagaacggcuccuucgccaacugcugcgaggccgggggcugggccgugcgccccggguggagcggcgccggguccgcccggccgagccgcacgccccggccgcccugggucgcccccgcccuguccgcggugcucaucgugaccaccgccgucgacguggugggcaaccugcuggucauccucagcgugcugcgcaaccggaagcugcgcaacgccggcaaccucuuccuggugucccuggcccucgcggaccuggucguggccuucuaccccuacccccugauccucguggccaucuucuacgacgggugggcccugggcgaggagcacugcaaggccagcgcguucgucauggggcuguccgugaucggcagcguguucaacaucaccgccaucgccaucaaccgguacugcuacaucugccacuccauggccuaccaccgcaucuaccggcgcuggcacacgccccuccacaucugccugaucuggcugcucaccgucguggcccugcugccgaacuucuucguggggagccucgaguacgacccccggaucuacuccugcaccuucauccagaccgcgagcacccaguacaccgccgccgucguggugauccacuuccugcugcccaucgccgucguguccuucugcuaccuccgcaucugggugcugguccugcaggcccggcgcaaggcgaagcccgagagccggcucugccugaagccguccgaccugcgcagcuuccucacgauguucguggucuucgugaucuucgccaucugcugggccccgcugaacugcaucggccuggccguggccaucaacccccaggagauggcgccccagauccccgagggccucuucgucaccuccuaccugcuggccuacuucaacagcugccucaacgccaucguguacgggcugcugaaccagaacuuccggcgcgaguacaagcggauccuccuggcccuguggaacccccgccacugcauccaggacgcgagcaagggcucccacgccgaggggcuccagagccccgcgcccccgaucaucggcgugcagcaccaggccgacgcccuguga

SEQ ID NO: 33198 - RNA, 2199 nt, Artificial Sequence
  derived and/or modified sequence opt1 from MTO1__Homo_sapiens__NP_001116698
auguucuacuuccgcggcugcgggcgguggguggccgucagcuucaccaagcagcaguucccccuggcccgccucuccagcgacuccgcggccccgcggacgccccacuucgacgugaucgugaucggcgggggccacgccgggaccgaggccgccaccgcggccgcccgcugcggcagccggacccugcugcucacccaccgcgucgacacgaucggccagauguccugcaaccccagcuucgggggcaucgggaagggccaccugaugcgggagguggacgcccuggacgggcucugcucccgcaucugcgaccagagcggcgugcacuacaagguccugaaccggcgcaagggccccgcggugugggggcugcgggcccagaucgaccgcaagcucuacaagcagaacaugcagaaggagauccugaacaccccgcugcucaccgugcaggagggcgccgucgaggaccugauccugaccgagcccgagcccgagcacacggggaagugccggguguccggcgugguccucguggacggcagcaccguguacgccgaguccgucauccugaccaccgggacguuccugcgcggcaugaucgugaucgggcucgagacccaccccgccggccggcugggggaccagccgagcaucggccuggcgcagacccucgagaagcugggcuucguggucgggcgccugaagaccggcacgccgccccggaucgccaaggaguccaucaacuucagcauccucaacaagcacauccccgacaaccccuccauccccuucagcuucaccaacgagaccguguggaucaagcccgaggaccagcugcccugcuaccugacccacacgaacccgcgcguggacgagaucguccucaagaaccugcaccugaacucccacgugaaggagaccacccgggggccccgcuacugccccagcaucgaguccaaggugcuccgguuccccaaccgccugcaccaggucuggcuggagccggagggcauggacagcgaccucaucuacccccaggggcugagcaugacccugcccgccgagcuccaggagaagaugaucacgugcauccgcggccuggagaaggccaaggugauccagcccggcuacgggguccaguacgacuaccuggacccgcggcagaucacccccucccucgagacccaccuggugcagcgccuguucuucgccggccagaucaacgggaccacgggcuacgaggaggcggccgcccagaccgagugcugcagcguggcccggcucgagugcuccgacaugaucagccagcugcaggccauccugcucccccagcccucccuggucgcggggaccgccggcaugcaccacaacacccagggcgugaucgccgggaucaacgccagccugcgcgugucccggaagccgcccuucgucgugagccgcacggagggcuacaucggggugcucaucgacgaccugaccacccugggcaccuccgagcccuaccggauguucacgagccgcgucgaguuccggcugucccuccgcccggacaacgccgacagccggcugacccugcgcggcuacaaggacgcggggugcgugucccagcagcgguacgagcgcgccugcuggaugaaguccagccucgaggagggcaucagcgugcugaaguccaucgaguuccugagcuccaaguggaagaagcucauccccgaggccagcaucagcaccucccggagccugcccguccgcgcccuggacgugcucaaguacgaggagguggacauggacucccuggcgaaggccguccccgagccgcugaagaaguacaccaagugccgggagcucgccgagcgccugaagaucgaggccaccuacgagagcgugcuguuccaccagcuccaggagaucaagggggugcagcaggacgaggcccugcagcugcccaaggaccucgacuaccugacgauccgggacgucucccugagccacgaggugcgcgagaagcuccacuucucccgcccccagaccaucggcgcggccagccggauccccggggugaccccggccgccaucaucaaccugcugcgcuucgucaagaccacgcagcggcgccaguccgccaugaacgagagcuccaagaccgaccaguaccucugcgacgcggaccggcugcaggagcgcgagcuguga

SEQ ID NO: 33199 - RNA, 1749 nt, Artificial Sequence
  derived and/or modified sequence opt1 from MTPAP__Homo_sapiens__NP_060579
auggccgugcccggcgucgggcugcucacccgccugaaccugugcgcccggcgccggacccgcgugcagcggccgaucgugcgccuccugagcugccccggcacggucgcgaaggaccugcggcgcgacgagcagcccuccgggagcguggagaccggcuucgaggacaagauccccaagcggcgcuucuccgagaugcagaacgagcggcgcgagcaggcccagcggaccgugcucauccacugcccggagaagaucagcgagaacaaguuccugaaguaccugucccaguucgggcccaucaacaaccacuucuucuacgagagcuucggccucuacgccgucguggaguucugccagaaggaguccaucggcagccugcagaacgggacccacacgcccuccaccgccauggagaccgccauccccuuccgcagccgguucuucaaccugaagcucaagaaccagaccuccgagcgcagccgggugcgcuccagcaaccagcugccgcgguccaacaagcagcuguucgagcuccugugcuacgcggagagcaucgacgaccagcugaacacgcuccugaaggaguuccagcugaccgaggagaacaccaagcuccgcuaccugaccugcucccugaucgaggacauggccgccgccuacuuccccgacugcaucguccggcccuucggcagcuccgugaacacguucgggaagcucggcugcgaccuggacauguuccuggaccucgacgagacccgcaaccugagcgcgcacaagaucagcgggaacuuccugauggaguuccaggugaagaacguccccuccgagcgcaucgccacccagaagauccucagcgugcugggcgagugccuggaccacuucggcccggggugcgugggcguccagaagauccucaacgcccggugcccccuggugcgcuucucccaccaggccagcggguuccagugcgaccugaccacgaacaaccggaucgcccucaccuccagcgagcugcuguacaucuacggcgcgcucgacucccgcgugcgggcccuggucuucagcgugcgcugcugggcccgggcccacucccugaccagcuccauccccggcgccuggaucaccaacuucagccucacgaugauggugaucuucuuccugcagcgccggagcccgcccauccugcccacccucgacagccugaagacccuggcggacgccgaggacaagugcgucaucgaggggaacaacugcaccuucgugcgcgaccucucccggaucaagcccagccagaacacggagacccuggagcugcugcucaaggaguucuucgaguacuucggcaacuucgccuucgacaagaacuccaucaacauccgccaggggcgggagcagaacaagcccgacagcuccccgcuguacauccagaaccccuucgagaccagccugaacaucagcaagaacgugucccagagccagcuccagaaguucgucgaccuggcccgcgaguccgccuggauccugcagcaggaggacaccgaccggcccagcaucuccagcaaccgccccuggggccucgugucccugcugcucccgagcgcgcccaaccggaaguccuucacgaagaagaaguccaacaaguucgccaucgagaccgucaagaaccugcuggagucccucaaggggaaccgcaccgagaacuucaccaagacgagcggcaagcggaccaucuccacccagaccuga

SEQ ID NO: 33200 - RNA, 357 nt, Artificial Sequence
  derived and/or modified sequence opt1 from MTPN__Homo_sapiens__NP_665807
augugcgacaaggaguucaugugggcccugaagaacggcgaccucgacgaggugaaggacuacgucgccaagggggaggacgugaaccgcacccuggagggcgggcggaagccccugcacuacgcggccgacugcggccagcucgagauccuggaguuccugcuccugaagggggccgacaucaacgccccggacaagcaccacaucacgccccugcucagcgccguguacgagggccacgucuccugcgugaagcugcugcucagcaagggcgcggacaagaccgugaaggggcccgacggccugaccgccuucgaggccaccgacaaccaggccaucaaggcgcugcuccaguga

SEQ ID NO: 33201 - RNA, 1338 nt, Artificial Sequence
  derived and/or modified sequence opt1 from MTRF1__Homo_sapiens__XP_006719963
augaaccgccaccugugcguguggcuguuccggcaccccagccugaacggcuaccugcagugccacauccagcugcacucccaccaguuccgccagauccaccuggacacccggcugcaggucuuccgccagaaccggaacugcauccuccaccuccugagcaagaacuggucccgccgguacugccaccaggacaccaagaugcucuggaagcacaaggcccugcagaaguacauggagaaccugagcaaggaguaccagacgcucgagcagugccugcagcacaucccggugaacgaggagaaccgccggucccugaaccgccggcacgccgagcucgcgccccuggccgccaucuaccaggagauccaggagaccgagcaggccaucgaggagcuggagagcaugugcaagucccucaacaagcaggacgagaagcagcugcaggagcuggcccucgaggagcgccagaccaucgaccagaagaucaacaugcuguacaacgagcuguuccagagccucgugcccaaggagaaguacgacaagaacgacgucauccuggaggugaccgcggggcggacgaccggcggggacaucugccagcaguucacccgcgagaucuucgacauguaccagaacuacuccugcuacaagcacuggcaguucgagcugcucaacuacacccccgccgacuacggcgggcugcaccacgccgccgcgcggaucagcggcgacggcguguacaagcaccugaaguacgagggcgggauccaccgcguccagcggaucccggagguggggcucuccagccgcaugcagcggauccacacgggcaccauguccgugaucguccugccccagcccgacgagguggacgugaagcuggaccccaaggaccuccgcaucgacaccuuccgggccaagggggccggcggccagcacgucaacaagaccgacagcgccgugcgccuggugcacaucccgacggggcuggucguggagugccagcaggagcgcucccagaucaagaacaaggagaucgccuuccgggugcuccgcgcgcggcuguaccagcagaucaucgagaaggacaagcgccagcagcagagcgcccggaagcugcaggucggcacccgcgcccaguccgagcggauccgcaccuacaacuucacccaggaccgggugagcgaccaccgcaucgccuacgaggugcgggacaucaaggaguuccucugcgggggcaagggccuggaccagcugauccagcgccuccugcaguccgccgacgaggaggcgaucgccgagcugcucgacgagcaccucaagagcgccaaguga

SEQ ID NO: 33202 - RNA, 3798 nt, Artificial Sequence
  derived and/or modified sequence opt1 from MTR__Homo_sapiens__NP_000245
augagccccgcccugcaggaccucucccagccggagggccugaagaagacccugcgcgacgagaucaacgccauccuccagaagcggaucauggugcuggacgggggcauggggaccaugauccagcgcgagaagcugaacgaggagcacuuccggggccaggaguucaaggaccacgcgcgcccccucaaggggaacaacgacauccugagcaucacgcagcccgacgucaucuaccagauccacaaggaguaccugcucgccggcgccgacaucaucgagaccaacaccuucuccagcaccuccaucgcccaggccgacuacggccuggagcaccuggcguaccggaugaacaugugcagcgccgggguggcccgcaaggccgcggaggaggugacgcuccagaccggcaucaagcgguucgucgccggggcccugggccccaccaacaagacccuguccgugagcccguccguggagcgccccgacuaccggaacaucacguucgacgagcucgucgaggccuaccaggagcaggccaaggggcugcuggacggcggcguggacauccuccugaucgagaccaucuucgacaccgcgaacgccaaggccgcccuguucgcccuccagaaccuguucgaggagaaguacgcgccccgccccaucuucaucagcgggaccaucguggacaaguccggccggacgcugagcgggcagaccggcgagggcuucgucaucuccgugagccacggggagccgcucugcaucggccugaacugcgcccugggggccgccgagaugcgccccuucaucgagaucaucggcaagugcaccaccgccuacgugcucugcuaccccaacgcggggcugcccaacacguucggcgacuacgacgagaccccguccaugauggccaagcaccugaaggacuucgccauggacggccucgucaacaucgucgggggcugcugcgggagcacccccgaccacauccgggagaucgccgaggccgugaagaacugcaagccccgcgugcccccggcgaccgccuucgagggccacaugcugcuguccgggcucgagcccuuccggaucggccccuacacgaacuucgugaacaucggcgagcgcugcaacguggccgggagccggaaguucgccaagcugaucauggcgggcaacuacgaggaggcccugugcgucgccaagguccagguggagaugggggcccaggugcucgacgugaacauggacgacggcaugcuggacgggcccuccgccaugacccgcuucugcaaccugaucgcgagcgagccggacaucgccaaggugccccucugcaucgacagcuccaacuucgccgucaucgaggccggccugaagugcugccagggcaagugcaucgugaacagcaucucccugaaggagggggaggacgacuuccucgagaaggcccggaagaucaagaaguacggcgcggccauggucgugauggccuucgacgaggaggggcaggccaccgagaccgacacgaagauccgcgugugcacccgggccuaccaccuccuggucaagaagcugggcuucaaccccaacgacaucaucuucgaccccaacauccugaccaucggcaccgggauggaggagcacaaccuguacgcgaucaacuucauccacgccacgaaggugaucaaggagacccucccgggcgcccgcaucagcgggggccuguccaaccugagcuucuccuuccgcgggauggaggccauccgggaggcgaugcacggcguguuccuguaccacgccaucaagagcggcauggacauggggaucgucaacgccggcaaccuccccguguacgacgacauccacaaggagcugcugcagcucugcgaggaccugaucuggaacaaggaccccgaggccaccgagaagcugcuccgcuacgcccagacccaggggacgggcgggaagaaggugauccagaccgacgaguggcggaacggccccgucgaggagcgccuggaguacgcgcuggugaagggcaucgagaagcacaucaucgaggacaccgaggaggcccggcucaaccagaagaaguacccgcgcccccugaacaucaucgaggggccccugaugaacggcaugaagaucgugggggaccucuucggcgccgggaagauguuccugccgcaggucaucaaguccgcccgggugaugaagaaggccgugggccaccugauccccuucauggagaaggagcgcgaggagacccggguccucaacggcacgguggaggaggaggaccccuaccaggggaccaucgugcuggcgaccgucaagggcgacgugcacgacaucgggaagaacaucgugggcgucgugcuggggugcaacaacuuccgcgugaucgaccucggcgucaugacccccugcgacaagauccugaaggccgcccuggaccacaaggccgacaucaucggccucagcgggcugaucaccccgucccuggacgagaugaucuucguggccaaggagauggagcggcucgcgauccgcaucccccugcugaucggcggggccacgaccagcaagacccacaccgccgugaagaucgcgccccgguacuccgcccccgucauccacgugcucgacgccagcaaguccguggucgugugcagccagcugcuggacgagaaccucaaggacgaguacuucgaggagaucauggaggaguacgaggacauccgccaggaccacuacgagucccugaaggagcggcgcuaccugccgcucagccaggcccggaaguccggcuuccagauggacuggcugagcgagccccaccccgugaagcccacguucaucggcacccaggucuucgaggacuacgaccugcagaagcucguggacuacaucgacuggaagccguucuucgacguguggcagcugcgcgggaaguaccccaaccggggcuuccccaagaucuucaacgacaagaccgucgggggcgaggcccgcaagguguacgacgacgcccacaacaugcugaacacccucaucagccagaagaagcugcgcgcgcgcgggguggucggcuucuggcccgcccaguccauccaggacgacauccaccuguacgccgaggccgccgugccgcaggcggccgagcccaucgccacguucuacggccuccggcagcaggccgagaaggacagcgccuccaccgagcccuacuacugccugagcgacuucaucgcgccccugcacuccgggauccgggacuaccucggccuguucgccguggccugcuucggggucgaggagcugagcaaggccuacgaggacgacggcgacgacuacuccagcaucauggugaaggcccucggggaccgccuggcggaggccuucgccgaggagcugcacgagcgggugcgccgggagcucugggccuacugcggcuccgagcagcuggacgucgcggaccugcgccggcuccgcuacaagggcauccggccggcccccggguaccccagccagcccgaccacaccgagaagcugaccauguggcgccuggccgacaucgagcaguccacgggcauccggcucaccgagagccuggccauggccccggcguccgccgugagcgggcuguacuucuccaaccucaagagcaaguacuucgccgugggcaagaucuccaaggaccaggucgaggacuacgcccugcgcaagaacaucagcguggccgagguggagaaguggcuggggcccauccucggcuacgacaccgacuga

SEQ ID NO: 33203 - RNA, 75 nt, Artificial Sequence
  derived and/or modified sequence opt1 from MTRNR2L7__Homo_sapiens__NP_001177418
auggccaccggcggguucggcugccugcuccugcugauccgcgagaucgaccucagcgugaagcggcagaucuga

SEQ ID NO: 33204 - RNA, 2097 nt, Artificial Sequence
  derived and/or modified sequence opt1 from MTRR__Homo_sapiens__NP_002445
augcgccgguuccugcuccuguacgccacccagcagggccaggccaaggcgaucgccgaggagaucugcgagcaggccgugguccacggguucagcgccgaccugcacugcaucuccgagagcgacaaguacgaccucaagaccgagacggcgccccuggugguggucguguccaccaccggcaccggggacccgcccgacacggcccgcaaguucgugaaggagauccagaaccagacccugcccgucgacuucuucgcccaccuccgguacggccugcuggggcucggcgacagcgaguacaccuacuucugcaacggcgggaagaucaucgacaagcgccugcaggagcugggcgcccggcacuucuacgacaccgggcacgccgacgacugcgugggccucgagcugguggucgagcccuggaucgcggggcuguggccggcccuccgcaagcacuuccgguccagccgcggccaggaggagaucuccggcgcccugcccguggccagccccgccuccagccggacggaccuggugaaguccgagcuccugcacaucgagagccaggucgagcugcuccgcuucgacgacuccgggcggaaggacagcgaggugcugaagcagaacgcggugaacuccaaccagagcaacgucgugaucgaggacuucgaguccagccugacccgcuccgugcccccgcucagccaggccagccugaacauccccggccugccgcccgaguaccuccagguccaccuccaggagucccuggggcaggaggagagccagguguccgugaccagcgccgaccccgucuuccaggugcccaucuccaaggccgugcagcucaccacgaacgacgccaucaagaccacccugcuggucgagcucgacaucagcaacaccgacuucuccuaccagcccggcgacgcguucagcgugaucugccccaacuccgacagcgagguccagucccugcugcagcggcuccagcuggaggacaagcgcgagcacugcgugcugcucaagaucaaggccgacacgaagaagaagggcgccacccugccgcagcacauccccgccgggugcagccugcaguucaucuucaccuggugccucgagauccgggccauccccaagaaggcguuccugcgcgcccugguggacuacaccuccgacagcgccgagaagcggcgccuccaggagcugugcuccaagcagggcgccgccgacuacagccgguucguccgcgacgcgugcgccugccugcucgaccugcugcuggccuuccccuccugccagccgccccucagccugcugcucgagcaccuccccaagcugcagccccggccguacuccugcgccagcagcucccuguuccaccccgggaagcugcacuucguguucaacaucguggaguuccugagcacggcgaccaccgagguccuccgcaagggcgugugcaccggguggcuggcccugcucguggccuccguccugcagcccaacauccacgccagccacgaggacuccggcaaggcccuggcgcccaagaucagcaucuccccgcgcacgaccaacagcuuccaccuccccgacgaccccuccaucccgaucaucauggugggccccgggaccggcaucgcccccuucaucggguuccugcagcaccgggagaagcugcaggagcagcaccccgacggcaacuucggggccauguggcuguucuucggcugccgccacaaggaccgggacuaccuguuccgcaaggagcugcggcacuuccucaagcacggcauccugacccaccugaaggugagcuucucccgcgacgccccggucggggaggaggaggcccccgcgaaguacgugcaggacaacauccagcuccacggccagcaggucgcccggauccugcugcaggagaacgggcacaucuacgugugcggcgacgccaagaacauggccaaggacgugcacgacgcccucgugcagaucaucagcaaggaggucgggguggagaagcuggaggcgaugaagacgcuggccacccucaaggaggagaagcgcuaccugcaggacaucugguccuga

SEQ ID NO: 33205 - RNA, 2193 nt, Artificial Sequence
  derived and/or modified sequence opt1 from MTSS1__Homo_sapiens__NP_001269903
auggaggccgugaucgagaaggagugcagcgcccugggcgggcuguuccagaccaucaucuccgacaugaagggcagcuaccccgucugggaggacuucaucaacaaggccgggaagcugcagucccagcugcgcaccacggugguggccgccgccgccuuccucgacgcguuccagaaggucgccgacauggccaccaacacccggggcgggacccgcgagaucggcagcgcccugacgcggaugugcaugcgccaccgguccaucgaggcgaagcugcgccaguucagcuccgcccucaucgacugccugaucaacccgcugcaggagcagauggaggaguggaagaagguggccaaccagcucgacaaggaccacgccaaggaguacaagaaggcccggcaggagaucaagaagaaguccagcgacacccugaagcugcagaagaaggcgaagaagggccgcggggacauccagccccagcucgacagcgcccugcaggacgugaacgacaaguaccugcuccuggaggagaccgagaagcaggccguccggaaggcccugaucgaggagcgcggccgguucugcaccuucaucuccaugcuccgccccgugaucgaggaggagaucagcaugcugggggagaucacgcaccuccagaccaucuccgaggaccucaagagccugaccauggacccccacaagcugccguccagcuccgagcaggucauccucgaccugaagggcagcgacuacuccuggagcuaccagaccccgcccagcucccccagcacgaccaugucccgcaagagcuccgugugcagcucccugaacagcgugaacuccagcgacucccggagcuccgggagccacucccacagccccuccagccacuaccgguaccgcuccagcaaccucgcccagcaggcgcccgugcggcugagcuccgucagcucccacgacagcggcuucaucucccaggacgccuuccagagcaagucccccagccccaugccgcccgaggcccccaaccagaacuccagcuccagcgccuccagcgaggccuccgagaccugccagagcguguccgagugcagcagccccaccuccgugagcuccggcagcacgaugggggcgugggucuccaccgagaaggacugggccaagccgggccccuacgaccagccccuggugaacacccuccagcgccggaaggagaagcgcgagcccgacccgaacgggggcggccccaccacggccagcgggccgcccgccgccgcggaggaggcccagcggccccgcuccaugaccgugagcgccgccacccgccccggcgaggagauggaggcgugcgaggagcuggcccuggcccucucccgggggcugcagcuggacacccagcgcagcucccgggacagccuccagugcuccagcggcuacuccacgcagaccaccacccccugcugcagcgaggacacgauccccucccaggucagcgacuacgacuacuucuccgugagcggggaccaggaggccgaccagcaggaguucgacaagagcuccaccaucccgcgcaacagcgacaucucccagagcuaccggcgcauguuccaggccaagcggcccgcguccaccgccggccugcccaccacgcugggcccggccauggugacccccggggucgccaccauccgccggacccccagcacgaagcccuccgugcgccggggcaccaucggggccggcccgauccccaucaagacccccgugauccccgucaagaccccgaccgugcccgaccuccccgggguccugcccgcgccgcccgacggccccgaggagcgcggcgagcacagccccgaguccccgagcgugggggagggcccccagggggugacguccaugcccagcuccauguggagcggccaggccuccgucaacccgccccugcccgggcccaagcccagcaucccggaggagcaccggcaggccauccccgaguccgaggccgaggaccaggagcgcgagcccccgagcgccaccgugucccccggccagauccccgagagcgaccccgcggaccucagcccgcgggacacgccccagggcgaggacaugcugaacgccauccgccgcggggugaagcugaagaagaccaccaccaacgaccgguccgcgccccgguucagcuga

SEQ ID NO: 33206 - RNA, 2685 nt, Artificial Sequence
  derived and/or modified sequence opt1 from MTTP__Homo_sapiens__NP_000244
augauccugcucgccgugcuguuccugugcuucaucagcuccuacagcgccuccgucaagggccacaccaccgggcucagccugaacaacgaccgccuguacaagcucacguacuccaccgaggugcugcuggaccggggcaaggggaagcuccaggacagcgugggcuaccgcaucuccagcaacgucgacguggcccugcuguggcggaaccccgacggggacgacgaccagcucauccagaucaccaugaaggacgugaacgucgagaacgugaaccagcagcgcggcgagaaguccaucuucaagggcaagagcccguccaagaucauggggaaggagaaccuggaggcccugcagcggcccacccuccugcaccugauccacggcaaggugaaggaguucuacagcuaccagaacgaggccgucgccaucgagaacaucaagcgcgggcucgccucccuguuccagacgcagcugagcuccggcaccaccaacgagguggacaucagcgggaacugcaaggugaccuaccaggcgcaccaggacaaggucaucaagaucaaggcccucgacuccugcaagaucgcccggagcggcuucacgacccccaaccaggugcugggcguguccagcaaggccaccagcgucaccacguacaagaucgaggacuccuucgugaucgcggugcuggccgaggagacccacaacuucgggcucaacuuccugcagaccaucaagggcaagaucgucagcaagcagaagcuggagcucaagaccacggaggccgggccccgccugauguccggcaagcaggccgccgcgaucaucaaggccguggacagcaaguacaccgccaucccgaucgugggccaggucuuccagucccacugcaaggggugccccagccuguccgagcucuggcggagcacccgcaaguaccugcagcccgacaaccuguccaaggccgaggccgugcggaacuuccucgcguucauccagcaccuccgcaccgccaagaaggaggagauccugcagauccugaagauggagaacaaggaggugcugccccagcuggucgacgccgugacgagcgcccagaccuccgacagccucgaggccauccuggacuuccuggacuucaaguccgacagcuccaucauccuccaggagcgguuccuguacgcgugcggcuucgccagccacccgaacgaggagcugcuccgcgcccugaucuccaaguucaaggggagcaucggcuccagcgacauccgggagaccgucaugaucaucaccgggacgcuggugcgcaagcucugccagaacgagggcugcaagcugaaggccguggucgaggccaagaagcugauccugggcgggcucgagaaggcggagaagaaggaggacacccggauguaccugcuggcccucaagaacgcccugcugcccgagggcauccccagccuccugaaguacgccgaggcgggggagggccccaucucccaccuggccaccaccgcccuccagcgcuacgaccugccguucaucacggacgaggugaagaagacccugaaccggaucuaccaccagaaccgcaaggugcacgagaagaccguccggaccgccgccgcggccaucauccucaacaacaaccccagcuacauggacgugaagaacauccugcuguccaucggggagcucccccaggagaugaacaaguacaugcuggccaucgugcaggacauccugcgcuucgagaugcccgccagcaagaucguccgccgggugcucaaggagaugguggcccacaacuacgaccgcuucucccggagcggcuccagcuccgcguacacgggcuacaucgagcgcagcccgcgguccgccagcaccuacucccuggacauccuguacagcggguccggcauccuccgccggagcaaccugaacaucuuccaguacaucgggaaggccggccugcacgggucccaggucgugaucgaggcccagggccucgaggcccugaucgcggccacccccgacgagggcgaggagaaccuggacagcuacgccgggaugagcgccauccucuucgacgugcagcugcgccccgucaccuucuucaacggcuacuccgaccugaugagcaagaugcucuccgcgagcggggaccccaucuccguggugaagggccugauccugcucaucgaccacagccaggagcugcagcugcaguccggccucaaggccaacaucgagguccagggcgggcuggccaucgacaucagcggggccauggaguucucccugugguaccgggagagcaagacgcgcgugaagaaccgggugaccgucgugaucaccaccgacaucaccguggacuccagcuucgucaaggccggccucgagacguccaccgagaccgaggcggggcuggaguucaucagcaccgugcaguucucccaguacccguuccuggugugcaugcagauggacaaggacgaggcccccuuccgccaguucgagaagaaguacgagcggcucagcacgggccgcggcuacgucucccagaagcggaaggagagcgugcuggccgggugcgaguucccccugcaccaggagaacuccgagaugugcaagguggucuucgcgccccagccggacagcaccagcuccggcugguucuga

SEQ ID NO: 33207 - RNA, 396 nt, Artificial Sequence
  derived and/or modified sequence opt1 from MTURN__Homo_sapiens__NP_690006
auggacuuccagcagcuggccgacguggccgagaaguggugcagcaacacccccuucgagcucaucgcgaccgaggagacggagcgccggauggacuucuacgccgacccgggcgucuccuucuacgugcugugccccgacaacgggugcggcgacaacuuccacguguggagcgaguccgaggacugccugcccuuccuccagcuggcccaggacuacaucagcuccugcgggaagaagacccugcacgagguccucgagaagguguucaagagcuuccgcccccugcugggccucccggacgccgacgacgacgccuucgaggaguacuccgcggacguggaggaggaggagcccgaggccgaccacccccagaugggggucagccagcaguga

SEQ ID NO: 33208 - RNA, 1554 nt, Artificial Sequence
  derived and/or modified sequence opt1 from MTUS1__Homo_sapiens__NP_001001931
augaccgugcccggcggguuccgcagcugcaccgagacggacaucuccagcaagaucuucaucaacuccacccugaccccgcccgccggcagcgagcggcacuacgacgccacccuccugacgcugcucgucgugggguccuacagccugugcaucaucccccugcucgcgaccuucaccggcaagaagaccgggaacgccgccgugaucaaguacgaggagaagcccccgaagcccgccuuccagaacggcuccagcggcuccuucuaccugaagccccuggucagccgcgcccacgugcaccucaugaagacgcccccgaaggggcccucccggaagaaccuguucaccgcgcugaacgccguggagaagucccgccagaagaacccccggucccucugcauccagccccagaccgccccggacgcccugccgcccgagaagacccuggagcucacgcaguacaagaccaagugcgagaaccagagcggcuucauccugcagcugaagcagcuccuggcgugcgggaacaccaaguucgaggcccugaccgucgugauccagcaccuccuguccgagcgcgaggaggcccugaagcagcacaagacgcucagccaggagcuggugaaccugcggggcgagcucgucaccgccuccacgaccugcgagaagcuggagaaggcccgcaacgagcugcagaccguguacgaggcguucgugcagcagcaccaggccgagaagaccgagcgggagaaccgccucaaggaguucuacacccgggaguacgagaagcugcgcgacaccuacaucgaggaggccgagaaguacaagaugcagcugcaggagcaguucgacaaccucaacgccgcccacgagacgagcaagcuggagaucgaggcgucccacagcgagaagcuggagcuccugaagaaggccuacgaggccagccuguccgagaucaagaaggggcacgagaucgagaagaagucccucgaggaccugcuguccgagaagcaggagagccucgagaagcagaucaacgaccugaaguccgagaacgacgcccugaacgagaagcucaagagcgaggagcagaagcggcgcgcccgggagaaggcgaaccugaagaacccccagaucauguaccuggagcaggagcucgagucccugaaggccguccuggagaucaagaacgagaagcugcaccagcaggacaucaagcucaugaagauggagaagcugguggacaacaacaccgcccugguggacaagcucaagcgcuuccagcaggagaacgaggagcugaaggcccggauggacaagcacauggccaucagccgccagcuguccaccgagcaggcgguccuccaggagagccuggagaaggaguccaaggugaacaagcggcugagcauggagaacgaggagcuccuguggaagcugcacaacggcgaccucugcucccccaagcgcagccccaccuccagcgccaucccccugcagagcccccggaacagcggcuccuucccgagccccagcaucagcccccgcuga

SEQ ID NO: 33209 - RNA, 4140 nt, Artificial Sequence
  derived and/or modified sequence opt1 from MTUS2__Homo_sapiens__NP_001028774
auggccagcucccccaccaagggccugaccaugagcgugccggucgcccccaagaaguccugcuacacgcagcuccgcgacaaccggaacgcggcccgcaacaacaacgagagcauccugucccugggggacaccaacgccaaccagaucaugcucgaggugagcuccagccacgacgaguccaagaccugcgaccugggcgacgagaucgggaacaccaacagcuccgagcccgagaaccggacgcacuuccacaaggaguuccaccagcugcagggcuucgggaagggcagccaggccggcuccgccagccucaaggacuuccgccuguccagcaccauccagcgggagcugaacgaggagcacaccguggagcgcgggaccgacucccuccagacgacccggagcauccagggccccucccugagcagcuggcgcaacgucauguccgaggcgagccuggacgugcucgccaagcgggacgccgagaucccgcgccacgugcccaaggacaagcuggccaagacccuggacaacgaggagcuccggcgccacucccuggagcgggcgagcuccagcgucgccgccguggggucccugacgccccagcacccccagccgcucagccuggacucccgcgaggcccggggccagauccccgggggcggcgaggggccccagaagacccugcccgaccacgccgugccggcggccuuccccgccaccgacagcaccuccgagggcaagagcguccgccaccccaagcccuccaccagcgaguccaagcagagcacgccguccgagacccagaccgugggggcccacgugcuccaggucugcagcgagcacaccucccacagcgcccaccccgagcccgcgcugaaccugacgcucgccagcaaggagauccccuccaagcuggaggcccagcugggccagggcaagggggaggccaagcucgaccugaaguacgugccgccccggcgcguggagcaggagggcaaggccgcgcaggagggguaccugggcugccacaaggaggagaaccucagcgcccuggaggggcgggaccccugcggcgaggcccaccccgaggccaccgacgcccugggccaccuccugaacuccgaccugcaccaccucggggucggccgcgggaacugcgaggagaagcggggcgugaacccgggggagcaggacagccugcacaccacccccaagcagggcuccgcgagccugggcggggccgacaaccagcccacgggcaagaucucccccugcgccggggagaagcucggcgagcgcaccagcuccagcuucuccccgggggacagccacguggccuucauccccaacaaccugaccgacuccaagccccuggacgucaucgaggaggagcgccggcucggcagcggcaacaaggacuccgugauggugcuggucuucaacccgagcgugggggagaacaagaccgaggugcccgagccccuggacccccaguccggccgcagcgaggcgcgggagagcaaggaggucacgaccuccguggccgagaaccgcaaccuccuggagaacgccgacaagaucgagagcaccuccgcccgggccgacagcguccugaacaucccggcgccccuccaccccgagaccacggugaacaugaccuaccagcccaccaccccguccagcuccuuccaggacgugagcgucuucgggauggacgccggcagcccccugguggugccgccgcccacggacuccgcccgccugcugaacaccucccccaagguccccgacaagaacacgugccccagcggcauccccaagcccguguucacccacuccaaggacacccccagcucccaggaggggauggagaacuaccagguggagaagaccgaggagcggaccgagaccaagcccaucaucaugccgaagcccaagcacguccgccccaagaucaucaccuacauccggcgcaacccccaggcccucggccagguggacgccagccuggugccggucgggcugcccuacgcgcccccgacgugcaccaugccccucccccacgaggagaaggccgccggcggggaccugaagcccuccgccaaccuguacgagaaguucaagccggaccuccagaagccccggguguucagcuccggccugauggugagcggcaucaagccgcccgggcaccccuucagccagauguccgagaaguuccugcaggaggucaccgaccaccccggcaaggaggaguucugcagcccgcccuacgcccacuacgaggugccgcccaccuucuaccgcuccgcgaugcuccugaagccccagcuggggcucggcgccaugagccggcugcccuccgccaagagccgcauccugaucgccucccagcggagcuccgcgagcgccauccacccgcccgggcccaucacgaccgccaccucccucuacagcuccgaccccagcgccgaccugaagaaggccuccagcuccaacgcggccaagagcaaccugcccaaguccggccuccgcccgcccggcuacagccggcugcccgccgccaagcuggccgcguucggguucgugcgcagcuccagcgucuccagcguguccagcacccaguccggcgacagcgcccagcccgagcaggggcggcccgccacgcgcuccaccuucggcaacgaggagcagcccgugcucaaggccagccugcccuccaaggacaccccgaagggggccggccgcgucgcgccgcccgccagcuccagcgugaccgcgccccggcgcucccugcuccccgcccccaagagcacguccacccccgccggcaccaagaaggacgcccagaaggaccaggacaccaacaagccggccgugagcucccccaagcgggucgccgccagcacgaccaagcugcacagccccggguaccccaagcagcgcaccgcggccgcccggaacggcuucccgcccaagcccgacccccaggcccgcgaggccgagcggcagcuggugcuccgccugaaggagcggugcgagcagcagacccgccagcuggggguggcgcagggcgagcucaagcgggccaucugcggguucgacgcccuggccgucgccacgcagcacuucuuccgcaagaacgaguccgcgcuggugaaggagaaggagcucagcaucgagcuggccaacauccgggacgagguggccuuccacaccgccaagugcgagaagcugcagaaggagaaggaggagcucgagcgccgguucgaggacgaggucaagcgccugggcuggcagcagcaggccgagcugcaggagcucgaggagcggcugcagcugcaguucgaggcggagauggcccgccuccaggaggagcacggcgaccagcugcuguccauccggugccagcaccaggagcaggucgaggaccucaccgccagccacgacgccgcgcugcuggagauggagaacaaccacaccguggccaucacgauccuccaggacgaccacgaccacaaggugcaggagcugauguccacccacgagcuggagaagaaggagcucgaggagaacuucgagaagcugcgccugagccuccaggaccagguggacacccugaccuuccagucccagagccugcgggaccgcgcccgccgguucgaggaggcccuccgcaagaacacggaggagcagcuggagaucgcccuggcgccguaccagcaccucgaggaggacaugaagucccugaagcagguccuggagaugaagaaccagcagauccacgagcaggagaagaagauccucgagcuggagaagcuggccgagaagaacaucauccucgaggagaagauccaggugcugcagcagcagaacgaggaccugaaggcccggaucgaccagaacaccguggugacccgccagcucagcgaggagaacgccaaccugcaggaguacgucgagaaggagacccaggagaagaagcggcugucccgcacgaacgaggagcuccuguggaagcugcagaccggggaccccaccagccccaucaagcucucccccaccagcccgguguaccggggcuccagcuccgggcccagcucccccgcccgcgugagcaccacgccccgguga

SEQ ID NO: 33210 - RNA, 1401 nt, Artificial Sequence
  derived and/or modified sequence opt1 from MTX1__Homo_sapiens__NP_002446
augcugcucggcgggcccccgcgcagcccccgguccggcaccagccccaaggggcccugguccagcaccggccacgugcaguucgggaaguccccgcagacguggccccgccggacccgcccccggagccccgagccggccgcccccuccggcguccgcggcagcaccuggacccggcgccgggacagcccccgccgggcggggcccacggcccugucccgcuacgugggccaccuguggauggggcggcgcccgcccucccccgaggcccggggccccgugccgcgcagcuccgccgccagccgggcgcgccggucccucgccagccccgggaucucccccggcccccugaccgccaccaucggcggggccgucgcgggcgggggcccgcgccagggccgggccgaggcccacaaggagguguuccccgggcagcgcgugggcaagauggccgcccccauggagcuguucugcuggagcgggggcugggggcuccccuccgucgaccuggacagccuggcggugcucaccuacgcccgcuucacgggcgccccgcugaaggugcacaagaucagcaaccccuggcagucccccagcggcacccugcccgcccuccggaccucccacggggaggucaucagcgugccgcacaagaucaucacccaccuccgcaaggagaaguacaacgccgacuacgaccuguccgcgcggcagggcgccgacacgcuggccuucaugagccugcuggaggagaagcuccugcccgugcugguccacaccuucuggaucgacaccaagaacuacguggaggugacccgcaagugguacgccgaggccaugcccuucccgcucaacuucuuccugcccgggcggaugcagcgccaguacauggagcggcugcagcuccugacgggcgagcaccgccccgaggacgaggaggagcuggagaaggagcucuaccgggaggcgcgcgagugccugacccugcucucccagcggcuggggagccagaaguucuucuucggcgacgcccccgccucccuggacgccuucgucuucagcuaccucgcccugcugcuccaggcgaagcugccguccggcaagcugcagguccaccuccgcgggcugcacaaccugugcgccuacugcacccacauccucagccuguacuuccccugggacggcgccgaggugccgccccagcggcagacccccgccgggcccgagacggaggaggagcccuaccgccggcgcaaccagauccuguccgugcucgcgggccuggccgccauggugggguacgcccugcucagcggcaucguguccauccagcgggccacccccgcgcgcgccccgggcacccggacccuggggauggccgaggaggacgaggaggaguga

SEQ ID NO: 33211 - RNA, 792 nt, Artificial Sequence
  derived and/or modified sequence opt1 from MTX2__Homo_sapiens__NP_006545
augagccugguggccgaggccuucgucucccagaucgcggccgccgagcccuggccggagaacgccacccucuaccagcagcugaagggcgagcagauccugcucagcgacaacgccgcgucccuggccgugcaggccuuccugcagaugugcaaccuccccaucaagguggucugccgcgccaacgcggaguacaugagccccuccgggaaggugcccuucauccacgugggcaaccaggucgugagcgagcuggggccgaucgugcaguucgucaaggccaagggccacucccugagcgacgggcucgaggaggugcagaaggccgagaugaaggccuacauggagcuggugaacaacaugcugcucaccgccgagcuguaccugcaguggugcgacgaggcgacggucggcgagaucacccacgcccgguacggcucccccuaccccuggccccucaaccacauccuggccuaccagaagcagugggaggugaagcgcaagaugaaggccaucggguggggcaagaagacccuggaccaggugcucgaggacgucgaccagugcugccaggcccugagccagcggcuggggacccagccguacuucuucaacaagcagcccacggagcucgacgcgcugguguucggccaccuguacaccauccucaccacccagcugacgaacgacgagcuguccgagaaggugaagaacuacagcaaccuccuggccuucugccgccggaucgagcagcacuacuucgaggaccgcgggaagggccggcuguccuga

SEQ ID NO: 33212 - RNA, 16008 nt, Artificial Sequence
  derived and/or modified sequence opt1 from MUC12__Homo_sapiens__NP_001157934
augcuggugaucuggauccucacccuggcccugcgccucugcgccuccgucaccacggugacccccggguccaccgugaacaccagcaucgggggcaacacgaccuccgccagcaccccguccagcuccgaccccuucaccacguucagcgacuacggggucuccgugaccuucaucaccggcagcaccgccacgaagcacuuccuggacuccagcaccaacuccgggcacagcgaggaguccaccgugagccacuccggccccggcgccaccgggacgacccuguuccccagccacuccgccaccagcgucuucgugggcgagccgaagaccagccccaucacguccgccagcauggagaccaccgcccuccccggguccaccacgaccgccggccugagcgagaaguccaccaccuucuacagcagcccccggagcccggaccgcacgcugucccccgcccggaccaccagcuccggggugagcgagaaguccaccacgagccacucccgccccggccccacccacaccaucgccuucccggacagcaccacgaugcccggcgucucccaggagagcaccgcgucccacagcauccccgggagcaccgacaccacccucucccccggcacgaccaccccgagcucccuggggcccgagagcaccacguuccacuccagccccggcuacaccaagaccacccggcugcccgacaacacgaccaccuccggccuccuggaggccagcaccccggugcacuccagcacggggagcccccacaccacccugagccccuccagcuccaccacgcacgagggcgagcccaccaccuuccagagcuggccguccagcaaggacaccagccccgcccccuccgggacgaccagcgccuucgugaagcucuccaccaccuaccacagcucccccagcuccacgccgaccacccacuucagcgccuccagcaccacgcugggccacuccgaggagagcacccccguccacuccagccccguggcgaccgccaccacgccgccgcccgcccgcuccgccaccagcgggcacguggaggaguccaccgccuaccaccggagccccggcuccacccagacgaugcacuucccggagagcagcaccaccuccggccacagcgaggaguccgcgaccuuccacgggagcaccacgcacaccaaguccagcacccccuccaccacggccgcccuggcccacaccagcuaccacuccagccucggcuccaccgagaccacgcacuuccgcgacagcuccaccaucagcgggcgguccgaggagagcaaggccucccacagcucccccgacgcgauggccaccaccguccugcccgccggcagcacgccgagcgugcuggugggggacuccacccccagccccaucuccagcggcuccauggagaccaccgcccuccccggcagcacgaccaagccggggcuguccgagaaguccaccaccuucuacuccagcccccgcucccccgacacgacccaccuccccgccagcaugaccuccagcggcgucuccgaggagagcaccacgucccacagccggccgggguccacccacaccaccgcguuccccggcagcacgaccaugcccgggcucagccaggaguccaccgccagccacuccagccccggcccgaccgacacgacccugucccccggcagcaccaccgccuccagccuggggcccgaguacacgaccuuccacucccgccccggcagcaccgagaccacccuccugccggacaacacgaccgccuccgggcugcucgaggcgagcaugcccgugcacuccagcacccggagcccccacaccacgcugagcccggccggcuccaccacccgccagggcgagagcaccacguuccacuccuggcccagcagcaaggacacccggcccgcgccgcccaccaccacguccgccuucguggagcccagcaccaccucccacgggagccccuccagcauccccaccacgcacaucuccgcccgcagcaccaccuccggccuggucgaggagagcaccacguaccacuccagccccggguccacccagaccaugcacuuccccgagagcgacaccacguccggccgcggggaggagagcaccaccucccacagcuccaccacgcacaccaucagcagcgcgcccuccaccaccagcgcccucguggaggagcccacguccuaccacagcuccccgggcagcaccgccaccacccacuuccccgacuccagcacgaccuccggccgcagcgaggaguccaccgccagccacuccagccaggacgccaccgggacgaucgugcugcccgcgcgguccaccaccagcguccugcucggcgaguccaccaccagccccaucagcuccgggagcauggagacgaccgcccugccgggcuccaccaccacgcccgggcugagcgagcgcuccaccaccuuccacagcagcccccggagccccgccaccacgcucuccccggccagcaccaccuccagcggcguguccgaggagagcaccacgucccgcagccgccccggcuccacccacaccaccgccuuccccgacagcacgaccacccccgggcugucccggcacagcaccacgagccacuccagcccgggcuccaccgacaccacccugcuccccgcgagcacgaccaccuccgggcccagccaggaguccaccacgagccacuccagcuccggcagcaccgacaccgcccugucccccgggagcaccacggcccuguccuucggccaggagagcaccaccuuccacuccaacccgggcagcacccacacgacccucuuccccgacuccaccaccagcagcgggaucgucgaggccuccacccgcgugcacagcuccacgggcagcccccggaccacccuguccccggcgagcuccaccagccccgggcugcagggcgaguccacggccuuccagacccaccccgccagcacccacaccacgcccuccccgcccagcaccgccaccgcccccguggaggaguccaccacguaccaccgcagccccggguccaccccgaccacccacuuccccgcgagcuccacgaccagcggccacuccgagaaguccaccaucuuccacagcucccccgacgccagcggcaccacgcccuccagcgcccacuccaccaccagcgggcggggcgaguccaccacgagccgcaucuccccggggagcaccgagaucaccacccuccccggcuccacgaccacccccggccugagcgaggccuccaccacguucuacagcagcccccggagcccgaccaccacccugucccccgccagcaugacgucccugggggucggcgaggagagcaccaccagccgcucccagcccgggagcacccacuccaccgugagccccgcguccacgaccaccccgggccucagcgaggaguccaccacgguguacagcuccagccggggguccaccgagaccaccgucuucccccacagcacgaccaccuccgugcacggcgaggagcccaccacguuccacagccgccccgccuccacccacaccacccuguucacggaggacagcaccaccuccggccugaccgaggagagcacggccuucccggggucccccgccagcacccagaccggccuccccgccacccugacgaccgcggaccugggggaggagagcaccaccuuccccuccagcuccggcagcacggggaccaagcucuccccggcccggagcaccaccuccggccuggugggcgagagcacgcccucccgccugagccccuccagcaccgagaccaccacgcucccggggucccccaccacccccagccuguccgagaaguccaccaccuucuacacgagcccccggagcccggacgccacccugagccccgccaccaccacguccagcggcgucuccgaggagagcuccaccagccacucccagcccgggagcacccacaccacggcguuccccgacuccaccaccaccagcgaccucucccaggagccgacgaccagccacuccagccagggcuccaccgaggccacccugagccccggguccacgaccgccagcucccugggccagcagagcaccaccuuccacagcucccccggcgacacggagaccacccuccugcccgacgacaccaucacgagcgggcugguggaggccuccaccccgacccacagcuccaccggcagccuccacacgacccugacccccgccuccagcaccuccgcggggcugcaggaggagagcacgaccuuccaguccuggcccagcuccagcgacaccacccccuccccgcccggcacgaccgccgcccccguggaggucagcaccaccuaccacucccgccccagcuccaccccgacgacccacuucagcgccagcuccaccacccucggccggagcgaggaguccacgaccgugcacagcucccccggggccaccggcaccgcgcuguuccccacgcgcagcgccaccuccgugcuggucggggagcccaccaccagcccgaucuccagcggcuccacggagaccaccgcccuccccgggagcaccacgaccgccggccuguccgagaaguccaccaccuucuacuccagcccccgguccccggacacgacccugagccccgccuccaccaccagcagcggcguguccgaggagagcacgaccucccacagccgccccggguccacccacaccacggcguuccccggcagcaccaccaugccgggggugucccaggagagcaccgccucccacagcucccccggcagcacggacaccacccucucccccgggagcaccacggccuccagccugggccccgaguccaccaccuuccacagcuccccgggcagcaccgagacgacccugcuccccgacaacaccaccgccagcgggcugcuggaggccuccacccccguccacagcuccacgggcagcccccacaccacccucuccccggcggggagcaccacgcggcagggcgaguccaccaccuuccagagcuggcccuccagcaaggacaccaugcccgcgccgcccacgaccaccuccgccuucguggagcugagcaccacgucccacgggagccccuccagcacccccaccacccacuucuccgccagcuccacgacccugggccgcagcgaggagagcaccaccgugcacuccagccccgucgcgacggccaccacccccucccccgcccgcagcaccacguccggccucguggaggagagcaccgccuaccacuccagccccggguccacccagaccaugcacuuccccgagagcuccacggccagcggccgguccgaggagagccgcaccucccacagcuccaccacccacacgaucagcagcccgcccuccaccaccagcgcgcugguggaggagcccaccuccuaccacagcucccccgggagcacggccaccacccacuucccggacuccagcaccaccuccggccggagcgaggaguccacggccagccacuccagccaggacgccaccgggaccaucguccugcccgcccgcuccaccacgagcgugcuccugggcgaguccaccaccagccccaucuccagcggcagcauggagaccacggcgcugccgggguccaccaccacccccggccucagcgagaaguccacgaccuuccacagcagcccccggagccccgccaccacccuguccccggccagcacgaccuccagcgggguguccgaggagagcaccaccucccacagccgccccggcuccacgcacaccaccgccuuccccgacagcaccacgacccccggccugucccggcacagcaccaccucccacagcagcccgggguccacggacaccacccuccugcccgccagcaccacgaccuccggccccagccaggaguccaccaccagccacuccagccccggguccacggacaccgcgcugagcccgggcuccaccaccgcccucagcuucgggcaggaguccaccacguuccacagcucccccggcagcacccacaccacccuguuccccgacuccacgaccagcuccggcaucgucgaggccagcacccgcgugcacagcuccaccgggagcccccggacgacccuguccccggccagcuccaccagccccggccuccagggggaguccaccgcguuccagacgcaccccgccagcacccacaccacccccuccccgcccagcacggccaccgcccccguggaggaguccaccaccuaccaccgcagccccggcuccacgccgaccacccacuuccccgccagcuccaccacgagcgggcacuccgagaaguccaccaucuuccacagcagccccgacgcgagcggcaccacccccuccagcgcccacuccacgaccagcggccgcggggaguccaccaccagccgcaucuccccgggcagcacggagaucaccacccugcccggguccaccacgacccccggccugagcgaggccuccaccaccuucuacagcuccccgcggagccccaccacgacccucucccccgccagcaugaccucccugggggucggcgaggagagcaccacgucccgcagccagcccggcagcacccacuccaccgugagcccggccuccaccacgacccccgggcugagcgaggaguccaccaccguguacagcuccagccccggcuccacggagaccaccgucuucccccggaccccgacgaccagcgugcgcggggaggagcccaccaccuuccacucccggcccgcgagcacgcacaccacccucuucaccgaggacuccacgaccagcggccugaccgaggaguccaccgccuuccccgggagcccggccuccacgcagaccggccugcccgccacccucaccacggccgaccugggcgaggagagcaccaccuuccccagcuccagcggguccaccggcacgacccugagccccgcgcgcuccaccaccagcgggcucgugggcgaguccaccccgagccggcugucccccagcuccacggagaccaccacccugcccggcagccccacgaccccgucccucagcgagaaguccaccaccuucuacacgagcccccgcucccccgacgccacccugagccccgccaccaccacguccagcggggucagcgaggaguccagcaccucccacagccagccgggcuccacccacaccacggccuuccccgacagcaccaccacccccgggcugucccggcacagcacgaccucccacagcucccccggcagcaccgacaccacgcuccugccggcguccaccaccaccagcgggcccucccaggagagcacgaccucccacagcucccccggcagcaccgacaccgcccugagcccgggcuccacgaccgcccucagcuucgggcaggaguccaccaccuuccacagcucccccggcagcacgcacaccacccuguuccccgacuccaccaccagcuccgggaucguggaggccagcacgcgcgugcacuccagcaccggcagcccccggaccacccugagcccggccuccagcacgucccccgggcuccagggcgagagcaccaccuuccagacccaccccgcguccacgcacaccacccccagcccgcccagcaccgccacggcccccgucgaggaguccaccaccuaccaccggagccccggcuccaccccgacgacccacuuccccgccagcuccaccaccagcgggcacuccgagaaguccacgaucuuccacuccagccccgacgccuccggcaccacccccagcuccgcgcacagcaccacguccgggcgcggcgagagcaccaccucccggaucagcccgggguccaccgagaucacgacccugcccggcagcaccaccacgcccggccugagcgaggccuccaccaccuucuacagcagcccccggagcccgaccacgacccucucccccgccagcaugaccucccugggggugggcgaggagagcaccaccucccggagccagcccggguccacgcacagcaccgugucccccgccagcaccaccacgccgggccuguccgaggagagcaccaccgucuacuccagcucccccggcagcaccgagacgaccguguucccccgcagcaccaccacguccgugcgcggggaggagccgaccaccuuccacagccgccccgccuccacccacacgacccucuucaccgaggacagcaccacguccggccugaccgaggagagcaccgcguuccccgggucccccgccagcacccagacgggccugccggccacccucaccaccgccgaccugggggaggaguccacgaccuuccccagcuccagcggcuccaccggcaccacgcugagccccgcccgguccaccaccagcgggcucgucggcgaguccacccccagccgccugagcccguccagcacggagaccaccacccugcccgggucccccacgacccccagccucuccgagaaguccaccaccuucuacaccuccccgcggagccccgacgcgacgcugucccccgccaccaccaccagcuccggcgugagcgaggaguccagcacgucccacagccagcccggguccacccacaccaccgccuucccggacagcacgaccaccuccggccugagccaggagcccaccgccagccacuccagccagggcuccacggaggcgacccucagccccggguccaccaccgccagcucccugggccagcagagcacgaccuuccacuccagccccggggacaccgagaccacgcugcugccggacgacaccaucaccuccggccucguggaggccagcacccccacgcacuccagcaccgggucccugcacaccacccugacgcccgccagcuccaccagcgccggccuccaggaggaguccaccaccuuccagagcuggcccagcuccagcgacacgaccccgagcccgcccggcaccaccgcggcccccgucgaggugagcacgaccuaccacucccgcccgagcuccacccccaccacccacuucagcgccuccagcacgacccuggggcgguccgaggagagcaccaccgugcacuccagccccggcgccacggggaccgcccuguucccgacccgcuccgcgaccagcguccucgugggcgagcccacgaccucccccaucagcuccgggagcaccgagaccacggcccugcccggcagcaccaccaccgccggccuguccgagaaguccacgaccuucuacuccagcccgcggucccccgacaccacccucagccccgccuccacgaccagcuccggggucagcgaggaguccaccaccagccacucccgccccggcagcacgcacaccaccgccuucccgggguccaccacgaugcccggcgugagccaggaguccaccgcgagccacuccagccccggcagcaccgacaccacgcugucccccgggagcaccaccgccuccagccugggcccggaguccaccacguuccacagcgggcccggcuccaccgagaccacccuccugcccgacaacaccacggccagcgggcugcucgaggccuccacccccgugcacagcuccaccggcagcccgcacaccacgcugucccccgcgggcagcaccacccggcagggggaguccaccacguuccagagcuggcccaacuccaaggacaccacccccgccccgcccaccacgaccagcgccuucgucgagcuguccaccaccagccacggcagccccuccagcacgcccaccacccacuucuccgccagcuccaccacgcucgggcgcagcgaggaguccaccaccgugcacagcuccccgguggccaccgcgacgacccccagccccgcccgguccaccaccagcggccuggucgaggaguccacgaccuaccacagcucccccgggagcacccagaccaugcacuucccggaguccgacacgaccagcggccgcggcgaggagagcaccaccucccacagcuccacgacccacaccaucagcuccgcccccagcaccaccuccgcccugguggaggagcccacgagcuaccacuccagcccgggguccaccgccaccacccacuuccccgacagcuccacgaccagcggccgcuccgaggagagcaccgcgucccacagcucccaggacgccaccgggacgaucgugcuccccgcccggagcaccaccagcguccugcugggcgaguccaccacgagccccaucuccagcggguccauggagaccaccgcccucccgggcagcaccacgacccccggccuguccgagaaguccaccaccuuccacuccagcccccgcucccccgccacgacccugagcccggcguccaccaccagcuccggggugagcgaggaguccacgaccagccacucccggcccggcagcacccacaccacggccuuccccgacagcaccaccacccccgggcucucccgccacagcacgaccucccacagcuccccgggcagcaccgacaccacgcugcugcccgccuccaccaccaccagcggcuccagccaggaguccaccacgagccacuccagcuccgggagcaccgacaccgcccucucccccggcagcaccacggcgcuguccuucgggcaggagagcaccaccuuccacagcucccccggcagcacccacacgacccuguucccggacuccaccaccagcuccgggaucguggaggccagcacgcggguccacuccagcaccggcagcccccggaccacccucagccccgccuccagcacgucccccggccugcagggggagagcaccgccuuccagacccacccggccuccacccacacgacccccuccccgcccuccaccgcgaccgccccgguggaggagagcacgaccuaccaccggucccccggcagcacccccaccacgcacuucccggccagcuccaccaccagcgggcacuccgagaaguccaccaucuuccacuccagccccgacgccuccggcacgacccccagcuccgcccacagcaccaccuccgggcgcggcgagagcacgaccucccggaucagccccggcuccaccgagaucaccacccugccggggagcacgaccacccccggccucuccgaggcgagcaccacguucuacuccagcccccgcagccccaccaccacccuguccccggccagcaugacgucccugggggugggcgaggagagcaccaccucccggagccagcccggguccacccacagcacggucucccccgccagcaccaccacccccggccucuccgaggagagcacgaccguguacuccagcuccccgggcagcaccgagaccacgguguucccccgcuccaccaccaccagcguccggcgcgaggagcccacgaccuuccacagccggcccgccuccacccacaccacgcuguucaccgaggacagcaccaccuccgggcugacggaggagagcaccgccuucccgggcucccccgcgagcacccagaccgggcuccccgccacgcugaccaccgccgaccugggcgaggaguccaccacguuccccagcuccagcggguccaccggcaccaagcucagcccggcccgcuccaccaccagcggccuggugggggaguccacgcccagccggcugucccccagcuccaccgagaccaccacgcuccccggcagcccgaccacccccagccuguccgagaaguccaccacguucuacaccagcccccgcagccccgacgccacccuguccccggcgaccacgaccagcuccggggugagcgaggaguccagcaccucccacagccagcccggcuccacccacacgaccgccuuccccgacagcaccaccacguccggccucagccaggagccgaccaccucccacagcucccaggggagcaccgaggccacgcugagccccggcuccaccaccgccagcucccuggggcagcagagcaccacguuccacuccagccccggcgacaccgagaccacccuccugcccgacgacacgaucaccuccgggcuggucgaggcgagcaccccgacccacuccagcacgggcucccuccacaccacccugacccccgccagcuccaccagcacgggccugcaggaggaguccaccaccuuccagagcuggcccuccagcuccgacaccacgcccagcccgcccagcaccaccgccgugcccguggaggucuccaccacguaccacagccggcccuccagcaccccgaccacccacuucuccgccagcuccacgacccucgggcgcagcgaggaguccaccaccgugcacagcucccccggcgccacggggaccgcgcuguuccccacccggagcgccaccuccgugcuggucggcgagcccacgaccagcccgaucuccagcggguccaccgagaccacggcccuccccggcagcaccaccaccgccggccuguccgagaaguccacgaccuucuacagcagcccccgcagccccgacaccacccuguccccggccagcacgaccuccagcgggguguccgaggagagcaccaccucccacagccgccccggcuccaugcacacgaccgcguuccccagcuccaccaccaugcccggggugagccaggaguccaccgccagccacuccagcccgggcuccacggacaccacccucagccccgggagcaccacggccuccagccugggccccgaguccaccaccuuccacagcucccccggcagcaccgagacgacccugcucccggacaacaccaccgccuccgggcugcuggaggccagcacgcccguccacuccagcaccggcagcccccacaccacccucagcccggcgggguccacgacccggcagggcgagagcaccaccuuccaguccuggcccaacagcaaggacacgacccccgcgccgcccaccaccacguccgccuucguggagcugagcaccaccagccacggcucccccagcuccacccccacgacccacuucagcgccuccagcaccacccuggggcgcuccgaggagagcacgaccgugcacuccagccccgucgcgaccgccaccacgcccucccccgcccggagcaccaccuccggccucguggaggagagcaccaccuaccacuccagccccggguccacgcagaccaugcacuuccccgagagcaacaccaccuccggccgcggggaggagagcacgaccagccacuccagcaccacccacacgaucuccagcgccccguccaccaccagcgcccugguggaggagcccaccuccuaccacagcucccccggcagcacggcgaccacccacuuccccgacuccagcaccacguccggccggagcgaggaguccaccgccagccacuccagccaggacgccaccgggaccaucguccugccggcccgcuccacgaccagcgugcuccugggcgagagcaccaccucccccaucagcuccgggagcauggagacgaccgcccugcccggcuccaccaccacgcccgggcucagcgagaaguccaccaccuuccacagcuccccgagcuccacccccacgacccacuucagcgcguccagcaccacccugggccgguccgaggagagcacgaccgugcacuccagccccgucgccaccgccaccacccccuccccggcccgcagcacgaccagcggccugguggaggaguccaccgccuaccacagcucccccgggagcacccagacgaugcacuuccccgaguccagcaccgcguccggccggagcgaggagucccgcaccagccacuccagcaccacgcacaccaucuccagcccgcccuccaccaccagcgcccucguggaggagcccacguccuaccacagcucccccgggagcaucgccaccacccacuucccggagagcuccaccacgagcggccgguccgaggagagcaccgccucccacagcucccccgacaccaacgggaucacgccccugcccgcccacuucacgaccagcggccgcaucgcggaguccaccaccuucuacaucagcccgggcuccauggagacgacccuggccagcaccgccaccacgcccgggcucuccgccaagagcaccauccuguacuccagcucccggagccccgaccagacccugucccccgcgagcaugaccagcuccagcaucuccggcgagccgacgagccucuacucccaggccgagagcacccacaccaccgccuuccccgccuccacgaccaccagcgggcugucccaggagagcaccaccuuccacuccaagcccggcagcacggagaccacccugucccccgggagcaucaccacguccagcuucgcccaggaguucaccaccccgcacucccagcccggcagcgcgcucagcaccgucucccccgccagcacgaccgugcccggccuguccgaggagagcaccaccuucuacuccagcccgggguccacggagaccaccgccuucagccacuccaacaccaugagcauccacucccagcagagcacgcccuuccccgacucccccggcuucacccacaccgugcugccggccacccucacgaccaccgacaucgggcaggagagcaccgccuuccacuccagcuccgacgcgacgggcaccacgccccugcccgcccgcagcaccgccuccgaccuggucggcgagcccacgaccuucuacaucagcccgagccccaccuacaccacccuguuccccgccuccagcuccaccagcgggcugaccgaggaguccaccacguuccacaccagcccguccuucaccagcaccaucguguccacggagagccuggagacccuggcccccggccucugccaggaggggcagaucuggaacggcaagcagugcgugugcccccagggguacgucggcuaccagugccugagcccccuggagagcuucccgguggagacccccgagaagcucaacgcgacccugggcaugaccgugaaggucacguaccggaacuucaccgagaagaugaacgacgccuccagccaggaguaccagaacuucuccacccuguucaagaaccgcauggacgugguccucaagggggacaaccugccccaguaccggggcgugaacauccgccggcugcucaacgggagcaucguggucaagaacgacgugauccuggaggccgacuacacccuggaguacgaggagcuguucgagaaccucgccgagaucgugaaggcgaagaucaugaacgagacgcgcaccacccugcucgaccccgacuccugccgcaaggccauccugugcuacagcgaggaggacaccuucgucgacuccagcgugacgccgggcuucgacuuccaggagcagugcacccagaaggccgccgagggguacacccaguucuacuacguggacguccuggacggcaagcucgccugcgugaacaagugcaccaagggcaccaagucccagaugaacugcaaccuggggaccugccagcugcagcgguccggcccccgcugccucugccccaacaccaacacccacugguacuggggcgagacgugcgaguucaacaucgccaagucccugguguacggcaucgucggggccgugauggccgugcugcuccuggcccugaucauccucaucauccuguucucccugagccagcggaagcgccaccgggagcaguacgacgucccccaggaguggcgcaaggagggcaccccgggcaucuuccagaagaccgccaucugggaggaccagaaccuccgggagucccgcuucgggcuggagaacgcguacaacaacuuccggcccacccuggagacgguggacagcggcaccgagcuccacauccagcgccccgagaugguggccuccaccgucuga

SEQ ID NO: 33213 - RNA, 1539 nt, Artificial Sequence
  derived and/or modified sequence opt1 from MUC13__Homo_sapiens__NP_149038
augaaggccaucauccaccugacccuccuggcccugcucagcgugaacaccgcgacgaaccagggcaacuccgccgacgccgucaccaccaccgagacggccaccagcgggcccaccguggccgcggccgacaccacggagaccaacuucccggagaccgccuccaccacggccaacacccccagcuuccccaccgcgaccucccccgccccgcccaucaucagcacgcacuccagcuccaccauccccacccccgccccgcccaucaucagcacccacuccagcuccacgauccccauccccaccgccgccgacagcgaguccaccaccaacgugaacagccuggcgacguccgacaucaucaccgccagcuccccgaacgacggccugaucaccaugguccccagcgagacccagagcaacaacgagaugucccccacgaccgaggacaaccagagcuccgggcccccgaccggcaccgcccuccuggagacgagcacccugaacuccaccgggcccagcaaccccugccaggacgaccccugcgccgacaacucccucugcgugaagcugcacaacaccagcuucugccugugccucgagggcuacuacuacaacuccagcacgugcaagaagggcaagguguucccggggaagaucuccgucaccgugagcgagaccuucgaccccgaggagaagcacuccauggccuaccaggaccugcacagcgagaucaccucccuguucaaggacguguucggcaccagcgucuacgggcagacggugauccucaccguguccaccagccugagcccccgcuccgagaugcgggcggacgacaaguucgucaacgugaccaucgugacgauccuggccgagaccaccagcgacaacgagaagaccgucacggagaagaucaacaaggccauccgcuccagcuccagcaacuuccucaacuacgaccugacccugcggugcgacuacuacggcugcaaccagaccgccgacgacugccucaacgggcuggccugcgacugcaaguccgaccugcagcgccccaacccgcagagccccuucugcguggcguccagccucaagugccccgacgccugcaacgcccagcacaagcagugccugaucaagaaguccggcggcgcccccgagugcgccugcgugccgggguaccaggaggacgcgaacggcaacugccagaagugcgccuucggguacagcggccuggacugcaaggacaaguuccagcucauccugaccaucgucggcacgaucgccgggaucgugauccuguccaugaucaucgcccucaucgugaccgcgcggagcaacaacaagaccaagcacaucgaggaggagaaccugaucgacgaggacuuccagaaccugaagcuccgcuccaccggcuucacgaaccugggggccgagggcagcgucuuccccaaggugcggaucaccgccucccgcgacagccagaugcagaaccccuacucccggcacagcagcaugccgcgccccgacuacuga

SEQ ID NO: 33214 - RNA, 1086 nt, Artificial Sequence
  derived and/or modified sequence opt1 from MUC15__Homo_sapiens__NP_001128563
augggcaucauccagagcauccuggccaccucccgcgacugcuacagcuucaagaagaagcccauccccaagaagcccaccaugcucgcccuggcgaagauccugcucaucuccacgcuguucuacagccugcucuccgggagccacggcaaggagaaccaggacaucaacaccacccagaacaucgccgagguguucaagaccauggagaacaagcccaucucccuggagagcgaggccaaccugaacuccgacaaggagaacaucacgaccagcaaccucaaggccucccacagcccgccccugaaccugcccaacaacucccacgggaucaccgacuucagcuccaacagcuccgccgagcacagccucggcucccugaagcccaccagcacgaucagcaccuccccgccccugauccacagcuucgucuccaaggugcccuggaacgcgcccaucgccgacgaggaccuccugcccaucagcgcccacccgaacgccacccccgcgcuguccagcgagaacuucaccuggucccucgugaacgacacggucaagacccccgacaacagcuccaucaccgugagcauccuguccagcgagcccaccuccccgagcgugacgccccugaucgucgagcccuccggguggcucaccaccaacagcgacuccuucaccggcuucacgcccuaccaggagaagaccacccugcagccgacccugaaguucacgaacaacagcaagcuguuccccaacaccuccgacccccagaaggagaaccggaacaccggcaucguguucggggccauccucggcgccauccugggggugagccuccugacccuggucggcuaccuccugugcgggaagcgcaagacggacagcuucucccaccggcgccuguacgacgaccggaacgagcccgugcuccgccuggacaacgccccggagcccuacgacgugagcuucggcaacuccagcuacuacaaccccacccugaacgacuccgccaugcccgagagcgaggagaacgcgcgggacggcaucccgauggacgacaucccgccccuccgcaccuccgucuga

SEQ ID NO: 33215 - RNA, 13482 nt, Artificial Sequence
  derived and/or modified sequence opt1 from MUC17__Homo_sapiens__NP_001035194
augccccgcccgggcaccauggcccugugccuccugacccuggugcucagccugcugccgccccaggccgcggccgagcaggaccucagcgucaaccgggccgugugggacgggggcgggugcaucagccagggcgacgugcugaaccgccagugccagcagcugucccagcacguccggacggggagcgccgccaacaccgcgaccggcaccaccuccaccaacgugguggagccccgcauguaccucagcugcuccaccaacccggagaugaccagcaucgaguccagcgucaccuccgacacccccggcgugagcuccacccggaugacccccaccgagagccgcaccaccuccgagagcaccuccgacagcaccacccuguuccccuccagcaccgaggacaccagcuccccgaccacccccgaggggaccgacgugcccaugagcacccccuccgaggagagcaucuccagcaccauggccuucgucuccaccgccccgcugcccagcuucgaggccuacaccucccucaccuacaagguggacaugagcaccccgcugaccaccuccacccaggcgagcuccagccccaccacccccgaguccaccaccauccccaagagcaccaacuccgagggcagcacgccccugaccuccaugcccgccagcaccaugaagguggccagcuccgaggccaucacccuccugaccaccccggucgagaucagcacccccgugaccaucuccgcccaggcgagcuccagccccaccaccgccgaggggcccucccugagcaacuccgccccgagcggcggguccacgccccucacccggaugccccugagcgugaugcuggucguguccagcgaggccuccacccucagcaccacccccgccgcgaccaacaucccggugaucaccuccaccgaggccagcagcucccccaccaccgccgagggcaccagcauccccaccuccaccuacaccgagggcagcaccccgcugaccuccacccccgccagcaccaugcccgucgccaccuccgagaugagcacccuguccaucacccccguggacaccagcacccucgugaccaccuccaccgagccgagcucccugcccaccaccgcggaggccaccagcaugcugaccuccacccucagcgagggguccacgccccugaccaacaugcccgucagcaccauccugguggccuccagcgaggccagcaccaccuccaccaucccgguggacagcaagaccuucgucaccaccgccuccgaggcgagcuccagccccaccaccgccgaggacaccuccaucgccaccagcacccccuccgagggcagcacgccccucaccuccaugccggugagcaccacccccgucgccuccagcgaggcguccaaccugagcaccacccccguggacuccaagacccaggugaccaccagcaccgaggccuccagcuccccgcccaccgccgaggucaacuccaugcccaccagcacccccuccgaggggagcacgccccugaccuccaugagcguguccaccaugcccguggccagcuccgaggccagcacccucuccaccacccccgucgacaccagcacccccgugaccaccuccagcgaggcguccagcuccagcaccacccccgagggcaccuccaucccgaccagcacccccagcgagggcuccacgccccugaccaacaugccggugagcacccgccuggucguguccagcgaggccuccaccaccagcaccacccccgccgacuccaacaccuucgugaccaccagcuccgaggccagcuccagcuccaccaccgccgaggggaccagcaugcccaccuccaccuacagcgagcggggcaccaccaucaccuccaugagcgucuccaccacgcucguggcgagcagcgaggccuccacccugagcaccacccccguggacuccaacaccccggucaccaccagcaccgaggccaccuccagcuccaccaccgccgaggggaccagcaugcccaccuccaccuacaccgagggcagcacgccccugaccuccaugcccgugaacaccacccucguggccagcuccgaggcgagcacccuguccaccaccccggucgacaccagcacccccgugacgaccuccaccgaggccagcuccagccccaccaccgccgacggggccagcaugcccacguccaccccgagcgagggcuccacgccccugaccagcaugcccguguccaagacgcuccugaccagcuccgaggcgagcacccuguccaccacgccccucgacaccagcacccacaucaccacguccaccgaggccagcugcuccccgaccaccacggagggcaccagcaugcccaucuccacccccagcgaggggagcccccugcugaccagcaucccggucagcaucacgcccgugaccucccccgaggccagcacccucuccaccacgcccguggacagcaacuccccggucaccaccagcaccgagguguccagcucccccacgcccgccgagggcaccagcaugcccaccuccaccuacagcgaggggcgcacgccgcugaccuccaugcccgugagcaccacccuggucgccacguccgcgaucagcacccuguccaccacccccguggacaccagcacgccggugaccaacuccaccgaggcccggagcagccccaccacguccgagggcaccagcaugcccaccuccacccccggggagggcagcacgccgcucaccuccaugcccgacagcaccacccccgucguguccagcgaggcccgcacgcuguccgccacccccguggacaccagcaccccggucacgaccuccaccgaggccaccagcucccccacgaccgcggagggcaccagcauccccaccuccacgcccagcgaggggaccaccccgcugaccuccacgcccgugagccacacccucguggccaacuccgaggccagcacccugagcaccacgcccgucgacuccaacacgccccugaccaccagcacggaggccuccagcccgccgcccaccgccgagggcaccuccaugcccaccagcaccccguccgaggggagcacgccccucacccggaugcccguguccaccaccaugguggcgagcuccgagacgagcacccuguccaccacccccgccgacacgagcaccccggucaccaccuacucccaggccagcuccagcuccacgaccgccgacggcaccagcaugcccaccagcacguacuccgaggggagcacgccccugaccuccgugcccgugagcacccgccucgucguguccagcgaggcguccacgcugagcaccaccccgguggacaccuccauccccgucacgaccagcaccgaggccuccagcucccccaccacggccgagggcaccagcaucccgaccagcccgcccagcgagggcaccacgccccuggccuccaugccggugagcaccacccucguggucuccagcgaggccaacacccugagcacgacccccguggacuccaagacccagguggcgaccagcaccgaggccuccuccccgccgcccacggccgaggucaccuccaugcccaccagcacccccggggagcgguccacgccccugaccagcaugcccgugcgccacacccccgucgccuccagcgaggccuccacccucagcacgucccccguggacaccagcacccccgugaccacguccgcggagaccagcuccagcccgaccaccgccgagggcacgucccugcccaccagcaccaccagcgagggguccacgcugcucaccagcauccccgucuccaccacccuggugacgagccccgaggccuccacccugcucaccaccccgguggacacgaagggccccgucgugaccagcaacgagguguccagcucccccacccccgccgagggcaccagcaugccgacguccaccuacagcgaggggcggacgccccugaccuccauccccgucaacacgacccugguggccagcuccgcgaucagcauccucuccaccaccccgguggacaacagcacccccgucacgaccagcaccgaggccugcuccagccccaccacguccgagggcaccagcaugcccaacuccaacccgagcgaggggaccacgccccugacguccauccccgugagcaccacccccguggucuccagcgaggccuccacccugagcgccacgccgguggacaccuccacccccggcaccacgagcgccgaggcgaccuccagccccaccaccgccgaggggaucuccauccccacgagcaccccguccgagggcaagacgccccucaagagcauccccgugagcaacacccccgucgccaacuccgaggccagcacgcuguccaccaccccgguggacagcaacucccccguggucaccagcacggcgguguccagcucccccacccccgccgagggcaccagcaucgccaucuccaccccgagcgagggguccacggcccugaccagcauccccguguccaccaccacggucgccagcuccgagaucaacagccucuccaccacccccgcggugaccagcacgcccgugaccaccuacagccaggccuccagcuccccgaccaccgccgacggcacgagcaugcagaccuccaccuacagcgagggguccacgccccugacgagccugcccgucuccaccaugcucguggugagcuccgaggccaacacccugagcaccacgcccaucgacuccaagacccaggucaccgccagcaccgaggcguccagcuccacgaccgccgagggcagcuccaugaccaucagcaccccgagcgaggggagcccccugcucacgagcauccccguguccaccaccccgguggccagccccgaggccuccacccugagcacgacccccgucgacuccaacagccccgugaucaccuccaccgaggugagcuccagcccgacgcccgccgagggcaccuccaugcccaccagcaccuacacggagggccgcacgccccugaccuccaucaccguccggacgaccccgguggcgagcuccgccaucagcacccucuccaccacgcccguggacaacagcacccccgucaccaccagcaccgaggcccgcuccagccccacgaccuccgaggggaccagcaugccgaacuccacccccagcgagggcacgacgccccugaccuccauccccgugagcaccacgccggugcuguccagcgaggccuccacccucagcgcgacccccaucgacaccuccacgcccgucaccaccagcaccgaggccacguccagccccaccaccgccgaggggaccuccaucccgacgagcacccuguccgagggcaugacgccccugaccagcacgcccgugagccacacccucguggccaacuccgaggccagcacccuguccaccacgcccgucgacagcaacuccccgguggugaccagcaccgcggucuccagcucccccacccccgccgaggggacgagcaucgccaccuccacccccagcgagggcuccaccgcccugacgagcaucccgguguccaccaccaccguggccagcuccgagaccaacacgcucagcaccacccccgcggucaccagcacgcccgugaccaccuacgcccaggucuccagcuccccgaccacggccgacggcagcuccaugcccaccagcacgccccgggaggggcgcccgccccugaccuccauccccgugagcacgaccaccguggccuccagcgagaucaacacccuguccacgacccucgccgacacccgcacccccgucacgaccuacagccaggcguccagcucccccaccaccgccgacggcacgagcaugcccacccccgccuacuccgaggggagcacgccccugaccuccaugccccugagcacgacccucguggugagcuccgaggccagcacccuguccaccacgccggucgacaccagcacccccgcgaccacguccaccgagggcagcuccagccccaccaccgccgggggcaccuccauccagacgagcacccccuccgagcggaccaccccgcuggccggcaugcccgugagcacgacccucguggucuccagcgaggggaacacccuguccaccacgcccguggacagcaagacccaggugaccaacuccaccgaggccagcuccagcgccacggcggagggcagcuccaugaccaucagcgcccccuccgaggggagcccgcugcucaccuccaucccccugagcaccacgcccgucgccucccccgaggccagcacccuguccaccaccccgguggacagcaacucccccgugaucacgagcaccgaggucuccagcucccccauccccaccgagggcaccagcaugcagacguccaccuacagcgaccgccggaccccgcucaccuccaugcccgugagcacgaccguggucgccagcuccgcgaucagcacccuguccaccacgcccguggacaccagcaccccggugaccaacuccacggaggcccgcagcucccccaccaccagcgagggcaccuccaugcccaccagcacgcccuccgaggggagcaccccguucaccuccaugcccgucagcaccaugcccguggugacguccgaggccagcacccuguccgccacccccgucgacaccagcacgccggugaccaccuccaccgaggccacgagcagccccaccaccgcggagggcaccuccauccccacgagcacccucuccgaggggaccacgccccugacgagcaucccggugucccacacccuggucgccaacagcgagguguccacccucagcaccacgcccguggacuccaacacccccuucaccaccagcacggaggccuccuccccgccgcccaccgccgagggcaccuccaugcccaccagcacguccagcgaggggaacacgccccugacccggaugcccgucuccaccacgaugguggccagcuucgagaccuccacccugagcaccacccccgcggacacgagcacccccgugaccaccuacucccaggccggcagcucccccacgaccgccgacgacaccagcaugcccaccuccacguacagcgagggcuccacgccccucaccagcguccccguguccaccaugccgguggucagcuccgaggccagcacgcacuccaccacccccguggacaccagcacgcccgugaccaccuccaccgaggcgagcuccagccccacgaccgccgaggggaccagcaucccgaccagcccgcccagcgagggcacgacgccccuggccuccaugccggucagcaccacccccgugguguccagcgaggccgggacgcuguccaccacccccgucgacaccagcacgcccaugaccaccuccaccgaggccagcuccagcccgacgaccgcggaggacaucguggugcccaucuccaccgccagcgagggcuccacccuccugaccagcauccccgucuccacgacccccguggccagcccggaggccuccacccugagcaccacgcccguggacagcaacucccccgucgugaccagcaccgagaucuccagcuccgccaccagcgcggaggggacguccaugcccaccagcaccuacuccgagggcagcaccccgcuccgcuccaugcccgugagcacgaagccccuggccuccagcgaggccuccacccugagcaccacccccgucgacacguccaucccggugaccaccagcaccgagacguccagcagccccaccaccgccaaggacaccuccaugcccaucagcacgcccuccgaggucagcaccucccucaccagcauccugguguccaccaugccgguggccagcuccgaggcgagcacgcuguccaccacccccgucgacacccggacgcucgugaccaccagcaccggcacguccagcucccccaccaccgccgaggggagcuccaugccgaccagcacgcccggcgagcgcuccacgccccugaccaacauccuggugagcaccacccuccuggccaacagcgaggccuccacgcugagcaccacccccgucgacaccuccacgccggugaccaccagcgcggaggccuccagcucccccaccacggccgaggggaccagcaugcggaucuccacccccagcgacggcuccacgccccucacgagcauccugguguccacccugccggucgccagcuccgaggccagcaccguguccaccacggcgguggacaccagcauccccgucaccaccuccacggaggccagcagcucccccaccaccgccgaggugaccagcaugcccacguccaccccgagcgagaccuccacgccccucacgagcaugcccgugaaccacacccccgucgccuccagcgaggccgggacccuguccaccacgccgguggacaccagcacccccgugaccacguccaccaaggcgagcuccagccccaccaccgccgagggcaucgucgugcccaucuccaccgccagcgagggcuccacgcugcugaccagcaucccgguguccaccacccccgucgccagcagcgaggccuccacgcucagcaccacccccguggacaccuccauccccgugacgaccagcaccgagggguccagcuccccgaccacggcggagggcaccagcaugcccaucuccacccccagcgaggucuccacgccccugacgagcauccugguguccaccgugccggucgccgggagcgaggccuccacccucagcaccacgcccguggacacccgcacccccgugaccacguccgccgaggcgagcagcuccccgaccaccgccgagggcaccagcaugcccaucuccacgcccggcgagcggcgcacgccccugaccagcauguccgucagcaccaugccgguggccuccagcgaggccuccacgcugagccggacccccgccgacaccuccacccccgugacgaccagcaccgaggcguccagcucccccaccaccgccgaggggacgggcaucccgaucagcacccccuccgaggggagcacgccccucaccuccauccccgucagcacgaccccgguggccauccccgaggccagcacccuguccaccacgcccguggacagcaacucccccgucgugaccagcaccgagguguccagcuccccgacccccgccgagggcacgagcaugcccaucuccaccuacagcgagggguccacgccccugaccggcgucccggugagcacgacccccgugaccuccagcgcgaucuccacccucagcacgacccccgucgacaccuccacccccgugacgaccagcaccgaggcccacuccagcccgaccacgagcgagggcaccuccaugcccaccagcacccccuccgaggggagcacgccgcugaccuacaugcccguguccaccaugcuggucgugagcuccgaggacagcacccucuccgccacgcccguggacaccagcacccccgucaccaccuccacggaggccaccagcuccaccaccgccgagggcacgagcaucccgaccuccacccccagcgaggggaugacgccccugacguccgugcccgugagcaacaccccggucgcguccagcgaggccagcauccuguccaccacccccguggacagcaacacgccccucaccaccuccaccgaggccagcuccagcccgcccacggccgagggcaccuccaugcccaccagcacccccuccgaggggagcacgccccugaccuccaugcccgucagcaccaccacgguggccuccagcgagaccuccacccugagcaccacgcccgcggacaccuccacccccgugaccacguacagccaggccuccagcuccccgcccaucgccgacggcaccuccaugcccaccagcaccuacuccgagggcagcacgccccucaccaacauguccuucagcaccacccccgucguguccagcgaggccuccacccugagcacgacccccguggacaccuccacccccgucacgaccagcaccgaggcgucccugagccccaccacggccgaggggaccuccauccccaccagcuccccgagcgagggcaccacgccccucgccuccaugcccgugagcaccaccccgguggucagcuccgaggugaacacccugagcacgacccccguggacuccaacacccuggucaccacgagcaccgaggccuccagcucccccaccaucgccgaggggaccagccuccccacguccaccaccagcgagggcuccaccccgcugagcaucaugccccuguccacgacccccguggcgagcuccgaggccagcacccucuccaccacgcccguggacaccagcaccccggucaccacgagcucccccaccaacagcucccccaccaccgccgaggugaccagcaugcccacguccaccgccggggagggcagcaccccgcugaccaacaugcccguguccacgacccccgucgccagcuccgaggcgagcacccuguccaccacgcccguggacagcaacaccuucgugaccuccagcucccaggccagcuccagcccggccacccuccaggucacgaccaugcgcauguccacccccagcgagggcagcuccagccugaccacgaugcugcucuccagcaccuacgugaccuccagcgaggccuccacccccagcacgcccuccguggaccggagcaccccggucaccaccuccacgcagagcaacuccacccccacgccgcccgaggugaucacccugccgaugagcacgcccuccgaggugagcacgccccugaccaucaugcccgucuccaccacgagcgugaccaucuccgaggccgggaccgcgagcacccucccgguggacacgagcacccccgucaucaccuccacccaggugagcuccagccccgugacgccggagggcaccaccaugcccaucuggacccccuccgaggggagcacgccccugacgaccaugccggucuccaccacccgcgugacgagcuccgagggcagcacccuguccacccccagcguggucaccuccacgcccgugaccaccagcaccgaggccaucuccagcuccgccacgcucgacagcaccaccauguccgugagcaugcccauggagaucagcacccuggggacgaccauccuggucuccaccaccccggugacgcgguuccccgagagcuccacccccagcauccccuccguguacaccagcauguccaugaccacggccagcgagggcuccagcuccccgaccacccucgagggcaccacgaccaugcccaugagcaccaccuccgagcgcagcacgcugcugaccaccguccucaucucccccaucagcgugaugucccccagcgaggcguccacccugagcacgccgcccggggacaccagcacgccccugcucaccuccaccaaggccggcagcuucuccauccccgccgaggugacgaccauccggaucagcaucaccuccgagcgcagcaccccgcugacgacccugcucgucuccaccacccugcccacgagcuuccccggggccuccaucgccagcacgccgccccuggacaccuccaccacguucacccccagcaccgacaccgcguccacgcccaccauccccguggccaccaccaucagcguguccgucaucacggagggcagcacccccggcaccaccaucuucauccccuccacgcccgugaccagcuccaccgccgacguguucccggccaccacgggggccgucagcacccccgugaucaccagcaccgagcucaacacgcccuccaccagcuccagcuccaccaccacgagcuucuccaccaccaaggaguucaccacccccgcgaugacgaccgccgccccgcugaccuacgucaccaugagcacggcccccuccacgccccgcaccaccagccggggcugcaccaccuccgccagcacccuguccgcgaccagcacgccccacaccuccaccagcgugaccacgcgcccggugacccccuccagcgagagcucccggcccagcaccaucaccucccacacgaucccgccgaccuucccgcccgcccacagcuccacgccgcccaccacgagcgccuccagcaccaccgucaaccccgaggccgugaccacgaugaccacccgcaccaagcccuccacgcggaccaccagcuuccccaccgugacgaccaccgccguccccaccaacaccacgaucaaguccaaccccaccagcacccccaccgugccccgcacgacgaccugcuucggggacggcugccagaacaccgcgucccggugcaagaacgggggcacgugggacggccucaagugccagugcccgaaccuguacuacggggagcugugcgaggagguggucagcuccaucgacaucggcccgcccgagaccaucagcgcccagauggagcucaccgugaccgugacguccgucaaguucaccgaggagcugaagaaccacagcucccaggaguuccaggaguucaagcagaccuucaccgagcagaugaacaucguguacagcgggauccccgaguacgugggcgucaacaucacgaagcugcgccucgggagcgugguggucgagcacgacgugcugcugcggaccaaguacacccccgaguacaagaccgugcucgacaacgccacggaggucgugaaggagaagaucaccaaggugaccacccagcagaucaugaucaacgacaucugcuccgacaugaugugcuucaacacgaccggcacccagguccagaacaucaccgugacgcaguacgaccccgaggaggacugccgcaagauggccaaggaguacggcgacuacuucguggucgaguaccgggaccagaagcccuacugcaucagcccgugcgagcccggguucuccgugagcaagaacugcaaccugggcaagugccagaugucccugagcgggccccagugccucugcgugaccaccgagacccacugguacuccggcgagacgugcaaccaggggacccagaagucccuggucuacggccuggugggcgcgggggugguccucaugcugaucauccugguggcccuccugaugcugguguuccgcuccaagcgggaggucaagcgccagaaguaccggcucagccagcuguacaaguggcaggaggaggacuccggccccgccccggggaccuuccagaacaucggcuucgacaucugccaggacgacgacagcauccaccuggaguccaucuacagcaacuuccagcccucccuccgccacaucgaccccgagaccaagauccggauccagcgcccccaggugaugacgaccagcuucuga

SEQ ID NO: 33216 - RNA, 25155 nt, Artificial Sequence
  derived and/or modified sequence opt1 from MUC19__Homo_sapiens__NP_775871
augaagcugauccugugguaccuggugguggcccuguggugcuucuucaaggacguggaggcccugcuguaccgccagaaguccgacggcaagaucgccgccucccggagcgggggcuucuccuacgggagcuccagcuccggcgaccuggaccgcaagaagccccucuucagccuggaguucgggucccccggcgagaccgaggacaagagccggcagcgccaggacgccggcucccccaagagcgaggacacccccgccgggggcuucuucaacuccagcuccagcuccggggacagcgaccggaccaagcccuucuucucccugggccucggggcccccggcaaggcggaggacaagagcggcgacagccaggacgccgggggcuccaagagcgaggacacgccgcccgggggcuucuucuacggcuccagcuccagcggggacuccgacaagaagaagccccuguucagcuucgaguucggcgccaccggggaggacgaggacaagucccgcgagcggugggacgccggcaacagccgcuccgaggacagccccgcggacuccaccaacacccgguacggggccggcuucagcuccagcggcgccucccuggacgugggguucggcugggggaucagcgacgagaagggccucgagguguccaaggccgacgggcgcgagacccggggcagcggcagcgccgggggcgagaccaucguguucgggcccgacgcgggcuccagcguggggaccggcuccagcggccugaagcugggggccggcaagggggacgccgccuucggcuucgaggucuccgacagcaacuccuucggcgacaccgggaucagcuccaagaccguggagggcaaccagaccagcuccagcgggggcuccgugagcaucgaccucggggacaccuccuuccgcagcgagaaccaguucgucggcggcgggucccugaacagcaucagcaaccugugggacuccggccaggagggguucggcaucaacgagaucgggggcaacggcaugagcggguccgugagcgccgaggcgggcuucaagggguucggcuccgacagcuccagcuccggggacagcuccgcccggaacggcuucgagaacagcuccggcaucagcgaggacuccggggugauccucggcagcuccgaccagcacgaggucgagcugagccgcaccgggggcaaccggaagcgcuccagcgaccccgacgaggccgggaaccugagccccggcuccgacgugagcgacuccggcgggaacaccuggagcuccgacagcggcuccgggggcggcggggugaccagcuccagcgaguacuccaccagcggcccccucaacacccccgagaaggggucccacauccccgaggccacccccaaguacagcgagaccaacgccaucaucggcgagaucuccaccuggagcaagggggcguacaaguccuucaacggccggaucuucuucuucgagagcuccugccccuacaccuucugccgccacugcaucgagagcggcggggacuucaacaucgagaucaagcggaacaacgacagcgagaucgagaagaucaccguccugaucgacaacaacgacguguccaucuucggcgacaccauccuggugaacggggagagcguccagauccccuacaacaacaagcucauccacaucaagaaguacggcgagcacaacgugcugaacucccgccgggggauccugacccucaugugggacaagaacaacaagcugagccugacccuccacaagcaguacccgaccugcggccugugcggcaacuucaacuccacccccgggcaggacaucaacgagcacaucgccaacagcaagauccccggcgacugccccaacgccguggggaaguccuacgaggucugcgaggacggcauccagcacugcaacaagaucaucgggaccuacuucgagaagugcggcaagguggccgcccugagcaacgacuacaagaugaucugcaucgacgaguacugccagacccgcgacaagaccagcacgugcgacaccuacagcgagcucucccgccugugcgcgagcgacggccccgggaccuucgaguccuggcggagcgacuccgacguggucugcggcacccagcgcugccccgagcagcacaucuacaaggagugcgggccgagcaaccccgcgaccugcuccaacguggcccccuuccaggacagcgagugcgucuccggcugcacgugccccgagggcuaccugcucgacgacaucggggagaagggcaagugcgugcugaaggccgagugcccgugcgagagcagcgggaccguguaccagcccggcgagguccgggaggggcccugcggcucccagugcacgugccaggacgcgaaguggagcugcaccgaggcccugugcccgggccgcugcaagguggagggguccagccucaccaccuucgacggcgugaaguacaacuuccccgggaacugccacuuccuggccguccacaacgaggacugguccaucagcguggagcugcggcccugccccuccggccagacggggaccugccucaacagcgugacccugcugcucaacuccagcgucccgguggacaaguacguguucaacuccgacggcaccgucacgaacgacaagauccgcaaccagggcuacuacuacagcgacaagauccagaucuucaacgccuccagcuccuaccuccagguggagaccuacuuccacgugaagcugcagauccagaucguccccgugaugcagcucuacgugagcaugccgcccaaccaguucaccgacaccgucgggcugugcggcuccuacaacaacaaggccgaggacgacuucaugagcucccagaacauccuggagaagacgagccaggcguucgccaacagcugggagaugauguccugcccgaaggggaaccccagcuccugcaucagcaucgagaaggagaaguucgccgagcggcacugcggcauccugcucgacuccagcgggccccuggccuccugccaccccaucgugaacccgaagcccuaccacgaggagugcaagaaguacacgugcacgugcgagaacagccaggacugccugugcaccauccucggcaacuacgugaaggccugcgcggagaaggagacguacaucgucggcuggcgcaccgggcugugcgagcacuccugccccagcggccugguguucaaguacaacgugaaggccugcaacuccagcugccggucccucagcgagcgcgaccgguccugcgacgucgaggacgugcccguggacgggugcacgugcccggacgccauguaccagaacaacgagggcaacugcguccucaagagccagugcgacugcuacaucaacgacgaggugaugcagcccgggaagcugauccacaucgacgacaacaagugcgugugccgcgacggcauccugcugugccagauccccaucgaccugacccuccagaacugcuccggcggggccgaguacgucgacugcagcgaccccaaggcccagcggcgcacgaaccggaccugcuccacccgcaacaucccgguguucgacgagaaccugcccugcaagcggggcugcuucugccccgaggggauggugcgcaacagcaagggcaucugcgucuuccccaacgacugcccgugcagcuucggcgggcgggaguacgacgagggcuccgugaccagcguggggugcaacgagugcacgugcaucaagggcuccuggagcugcacccagaacgagugccagaccaucugccacaucuacggggagggccacguccgcaccuucgacggcaaguccuacagcuucgacgggcugugccaguacuccuuccucgaggacuacugcggccacgagaacgggacguuccgcauccugaccgagagcgugcccugcugcgaggacggccugaccugcucccggaagaucaucguggcguuccaggaccagaacaucguccuccaggacgggaaggugaccgccgugaaguccacggaguccaagaagugcgagcugaacgccaacgccuacagcauccacaccgucggccuguaccucauccugaaguuccagaacggcaucaucgugaucugggacaagaacacccgccuguccgugauccucgaccccaacuggaacgggaaggucugcggccugugcgggaacaacaacggcgaccugaaggacgacuucaccacgcgguacagcuccguggcgagcggggcccucgaguucggcaacuccuggaagaccagccaggagugcagcgacaccguggcccagaccuucccgugcgacuccaaccccuacugcaaggccugggccguccgcaagugcgagauccugcgggacagcacguuccgcgacugccacaacaagguggaccccuccgcguaccacgacgccugcaucgaggaggccugcgccugcgacauggagggcaaguaccugggguucugcaccgccguggcgauguacgccgaggccugcagcgccgucggcgugugcgucuccuggcggaagcccaaccucugcccgguguacugcgacuacuacaacgcccccggggagugccgcuggcacuacgagcccugcggcaccgugaccgcgaagaccugcaaggaccagcuggucgggcagaaguucagcucccugcucgagggcugcuacgccaagugccccgacagcgccccguaccuggacgagaacacgaugaagugcgugucccugagcgagugcuccugcuucuacaacgacgugauccccgccggcggggucaucgaggacaacugcggccggaccugcuacugcaucgcggggcagcucgagugcagcgagaccgcccccaccaacuccacguucgccgugagcaccaccaccgccacgaccauccuguccaccggcgccgcgaucacccuggugacgggcgggcccagcaccgccgccuccaucccggccaucaccaccagcuccagcgagacgaccggcaccacccucgggccccugacggagcccuucaccaccggcaucaccgagacgagcguccccaucaucuccaccagcgggaacgccggcaugaccggcgugguguccccgaccgucacgggggcgagcggcauggccgggaccaccggcgggguggacgccgccaccacgggcgccgcguccgagaacaccagcgagcgcgccggcacgccccggguguccggggagacccccgccgucggcgggggcagcacgcccggggaggccggcccgggcgccaccguguccgggagcaccggcguguccgcggggagcaucaccgccucccccggcgccagcgccaccuccagcgaguccagcaaguccggcacgaccgggcccagcgucggcgggaagaccggcgcgaccagcuccgaggccacgagcuccgaggggaugagcggcgugaccggccagucccuggggagcaccgccggcuccgacagcgagaucaccgccaagacguccuucaccgggagcagcccgcccggcaagcucacccgccccagccccgggucccccggccacuucagcggcgggaccacggaguggggcaacguggccaccaccggggcggccggcgagaacaccuccggggcccugggcagcacggagggcuccgucgaggccaccaccagcgccggguccggcaacaccgcggggacgagcggcaccggggacaccggccccggcaacaccgccgugagcgggacgcccguggucucccccggcgccaccccgggggcccccggcagcuccacccccggcgaggccgacaucgggaacaccagcuucggcaaguccgggacgcccaccgugagcgcggccuccaccaccagcuccccggugagcaagcacacggacgccgccuccgcgaccgccgucaccaucagcggcuccaagcccgggacccccggcacgcccggcggggccaccagcggcgggaagaucaccuccggcuggagcuccagcgggaccuccacgggcgccagcaacaccccgggcgccaccgggagcuccaccggccagaccgacacgagcgggcccuccgcgaaggugaccggcaacuacgggcagagcuccgagauccccggcaccaucaagagcuccagcgacguguccggcaccauggggcagagcgacacgaccuccggccccagcgucgccgugacccggaccuccgagcagagcuccggggugacggucgccagcgagccguccgugggcgugagcggcaccaccgggccccuggccgagaucuccggcaccacgcgcccccucgucagcgggcugcggaccaccggcagcuccgccgaggggagcggcaccacgggccccuccagccgcgaguccgugaccacccggccgcuggcggaggggagcggcaccuccgggcagagcgugacgggcucccgcgccaccgggcucagcgccaccgagcugggcaccacggucuccuucaccggcgggcugggcaccagccgguccagcgcccgcgagacccggacgaccgggcccuccgccgacggcagcgggaccaccggccccuccguggugcgcagcggcacgacccgccucagcgucggggugacccgggcgaccgaguccagccccggcgugacggggaccaccaccccguccgccgaggagagccgcaccacgggccccuccguccuggugaccgggaccaccggccagagcggccagggguccggcacgaccggcaagagcuucaucgaguccggccccagcguggucggcuccgggaccaccggccccacgagcgccgggcugggcaccaccgccccguccacccggcgcagcuccacgaccaagcccagcguggggcggaccggcaccacgggccaguccggggcggagagcggcaccaccgagcccuccgcccgcguggccggggucaccggcacgagcgccgaggugagcgggcggaucgagcccuccgccaccgagagcuccaccagccgcccgcucggcgagaccacgggcaccaccauccccuccauggaggggagcgaggcgaccggccccuccgucaucgggagcgagacgacccggcuguccgugaucggcagcgggaccaccggcacguccagcggcggguccggcgccacccgcagcuccgggggcggcauggggaccaccggccagagcacggcccgguccgagaccaccgggccgcuguucggccucaccgggaccuucggccagagcgccacggugaccggcaccuccagcaacagcgccggggucaccacgcccgagaagucccccggcguggcgaugaccaccgggcugcugguggagggcagcgccaccacgcagccccgcauccucgaguccgagaccaccgagagcuccgccggggucaucgugaccagcggccaguccgcccgggugacgggcgccaccgggccgagcgcgggcgagaccgggaccacggagcccuccaccgagggcagcgucgccgccgugcuguucgugaucggguccgagaccacccgcccccuggacaucggcagcggcacgaccgggacccucuccggcgggagcuccaccacgcggagcuccgacggcaccaccgggaccacgcgcaagagcaccgcccgguccgagaccaccggccugagcggccugacggggaccagcggccagcucgccggggucaccggcaccuccagcaaguccgcgggcgugacggugaccagcgagaaguccgccggggucgccgugaucaccggcagcuucguggagcgccccgucaccaccgggccgccccugcuggaguccgagacgacccggcccagcggcggggugaccgugaccuccggccagagcgcccgcgucacggagaccgugggcgcguccgccggggugaccggcaccacggggcccagcaccgagggcuccggggccaccggcccgagcgucgugggcuccgggaccacgcgcccccucgccggcgagagcgggaccaccgaguccagcgccggcgugaccgggacgcggcccuccagcagccgcgaguccgcgaccaccggccccagcgacgagggcuccgggaccacgggccugagcgccggggucaccgugaccuccggccagagcgugcggaagaccgggacgaccggcgccccggccggcgucaccgagaccacgcgccccuccguggucaagagcgggaccaccggccccuccgucaucgggacccggacgaccggcaccagcuccggcgggagcggcgccacccgcuccagcgggggcgagacggagaccaccgggcaguccgcggucaagagcggcaccaccgaguccuucacgcggcugacccgcaccagcggccaguccgccgggaugaccggcacgagcgcccagagcgccgggguggcccucaccucccccuucgucgagggccuggugaccaccgggagcuccacggugggccuggagaccacccggccgagcgcggucggcuccgggaagaccgggccgcccguggugaaggcccagacgaccgggcccagcgccggcgucaccgugaccuccgggcagagcgcccgcaugacgggcgcguccggcccgagcgugggggucaccggcaccaccgggcccgccuccaagggccucggcacgauccggcccagcgugguggggcuggagaccaccgagcuguccgccgagggcagcgggaccacgggcccgcccaucgucggggagaccaccgugcccuccgccggcgugaccgucacgagcggcuacuccgaccgcgugaccggggccaccgagccccucgcgggcgucaccgggacgaucaagccgagcguggccggcagcgugaccaccgggcccuccgucaccggcguggagacgaccgccaagaccaccagcggcgggcuguccacgaccaucagcuccgugggcgggaccggcaccaccgggcagagccccgagcgguccggcacgaccggccccuucaccgggcugaccggcacgagcgcccaguccgccggggucaccaugaccagcauccaguccgcgggcgugcucgugaccacggggcugaacgucgacggccugggcaccaccgggaaggcccucaucggcagcgggaccacgggccuguccgccgaggccaccggcaccaucgggccgagcaccgagggccuggagaagacggggcccuccaucaccggcagcgggaccacccgcccccucgugacggaguccuggaccgccggcaccagcuccggcgggcacagcaccacgagccccuccgugcggggcaccgagaccaccgggcagagcgcggccgaguccgucacgaccggcccggugaccggguacaccgagacgagcggccccuccgccggcgugaccgucacgccccggcagagccccaccgugacgcagaccaccggguccagcgccgcgguguccggcaccaccguccagagccugacgguguccgggaccacccggccgagcuccggccagaccgagaucacggggagcuccgugaaggagagcggcaccaccgaguccagcgccguccgcuccggcaccacggggcccaccgccggcgugaccgggaccaacggccccagcagcgccggcgugacggggaucaccggcuccagccccggggucaccggcaccacgggguccagcccgggcgugaccggcaccaccggguccagcgcccgguccggcacgagcauccccuccguggggaagaccggcaccacccgcacgagcgucgaggagucccggaccacccgccccagcgcggggaucaccggcacgaacggccuguccgccgaggugaccgggaccaccggcccccucgccggggugacgggcaccaccgggccgagcgccggcgucacccgcacgaccggccuguccgccggggagaccggcaccaccgggcugagccccggcgugacgcggaccacccgcuccagcgcggggcucaccggcaagacgggccuguccgccggggugaccggcaagaccgggcugagcgccgaggucaccggcacgacccggcugagcgccggcgugaccgggaccacgggccccucccccggggugaccggcaccaccgggacgccggccggcgucaccggcaccaccgagcucagcgcgggggugacgggcaagaccgggcuguccagcgaggugaccgagaccacgggccuguccuacggggucaagcgcaccaucggccucagcgccggcuccaccgggaccagcggccaguccgccgggguggccggcacgaccacccugagcgccgaggugaccgggacgacccggcccuccgcgggcgucaccggcaccacggggcugagcgccgaggugaccgagaucaccggcaucuccgccguggucaccgggaccacgggccccagcgccggcgugaccgagaccaccggguccagcgcgggcguggccgggacgacccgccucuccgccggcgucaccgggaucaccggccugagcgccggcgugacggggaccaccggccuguccaccgaggugacggggaccaccggcccgagcgccggggcgaccggcacgaccggccucagcgucggggugaccggcaucaccgggcuguccgacgucgugacggagaccaccggcagcuccgcccggagcgggaccggcauccccuccgugggcgagacgcgcaccaccagcaccuccgucgaggagagccggacgacccgccccuccgccgggaucaugggcaccaacgggcugcccgccgaggugaccggcacgaccgagccgcucgccgggggcaccggcaccacggggauccuggcgggcgugaccgggaccaccggccugagcgccggcgagaccgggaagaucggcuccagcgccggggucacgggcaagaccggguccagcgcccgggugaccggcaagaccggccccuccgccgaggugacggggaagaccggccucagcgcgggggucaccggcaccacggggcugucccccggcgugaccggcaccagcgggcuguccgccgaggugaccggcacgaccgggcccagcgccgaggccaccggccucccgggggucagcgcgggcgugaccggcacgaccgggucccuggccggcgggaccggcaccaucggccugagcgccggggugacgggcaccaccggguccagcgccggcgucaccgggacgaccggccucuccgccggcgugaccgggaucgcgggccugagcgccggggugaccggcaucacggggcccuccgccggcgucaccggcaccaccacggugagcgccggggugaccggcaccaccgggcuguccgccgaggcgacggagaucaccggccucagcgccggggucaccggcaccaccggccuguccgccggggugacggagaccauccgccugagcgccggcgugaccgggaccauccgguccagcgccggcgucacggggaucaccggccucuccgcgggcgugaccgggaccacgggccccagcgccggggugaccggcuccaccggccugcuggccggggucaccgagacgaccggccagagcgccaaggugaccgggaccacgggccagagcgugggggucaccggcaccacccgcuccagcggcggggugacgggcaucaccgggcucuccgccggcgugaccgggaccaacggccugagcgcggucacgggcaugaccgggcuguccgccgaggugaccggcaccacggggcucagcgugggcgucaccgggaucgccggccuguccgccggcgugaccgggaucaccggccccagcgcggggaucacgggcaccaccaccaucuccgccggggugacgggcaccagcggccuguccgccgaggccaccgggaucaccggccucagcgccggggucaccggcaagacgggccuguccgcgggggugaccgagaccaucggccugagcgccgaggccaccgggacgaucggcuccagcccgggggugaccggcaccaccggcuccagcacgggggucaccggcaucaccgggcucuccgccggcgugaccgggacgaccggccugagcaccgaggugaccggcacgaccgggcccagcgccggcgucacccggaccacggggcuguccgcgggcgugaccgggaucaccggccucagcgccaucgugaccgagacgaccggcuccagcgcccgcuccgggaccagcauccccuccgucggcgagaccgggacgacccggaccagcguggaggagucccgcaccacgcggcccagcgccggcaucaccggcaccaacgggcuguccgccgaggugaccggcacgaucgggccgcuggcgggcgggaccggcaccaccggccucagcgccggggucacgggcaccgugggguccagcgccgucgugaccggcaccaccgggcuguccgccggcgugacgggcaccaccgggcccagcgcggaggagaccggcgccacggggcccuccgccgaggucaccgagaccaccggccccagcgccggggugacgggcaccggccgccuguccgccgaggugaccgggaccacgggcccgagcgcggaggucaccgggcuccccggcgagagcgccgaggugaccgggaccaucggcucccccgccggcgugacggggaccacccagcugagcgccgucgugaccggcaucacggggcuguccgccgaggugaccggcaccaccggccucagcgcgggggucacgggcaucaccgggcuguccgccgaggugacccgcaccacgggccugagcgccggggugaccggcaccaucggccucuccgccggggucaccggcacgacccggcccagcgccggggugaccggcaccacggggcaguccgcggaggugaccggcaccaccgagccgagcgccggccugaccgagacgaccggguccagcaccggcgucaccggggccacgggcccccuggccggggugaccggcaccaccggcaucuccacggaggugaccgggaccaccggccccagcgcgcgcgucacggggaccaccgugcucuccgccggcgugaccggcaucacggggcugagcgccaucgucaccgagaccaccggcuccagcgcccgguccgggacgagcacccccagcgugggcgagaccgggaccacgcgcaccuccguggaggagagccgggccacccgcccguccgcgggcaucaccggcacgaacgggcagagcgccgaggucaccuggaucaccggcccccuggccggggugaccggcacgaccgggaucuccgccggcgugaccggcaccacggggcucagcgccggcgucaccgggaccaucggcuccagcgcgguggugaccgggaucaacggccuguccgccggcgucaccgggacgaccggccccagcgccgaggagaccggggccaccggcccguccgccgaggugacggggaccaccggccccagcgcggaggagaccggcgccacggggcccuccgccgaggugaccggcaccaccgggcccagcggcggcgucacggggaccaacggccuguccgccgaggugaccgggaccacgggcccgagcgccgaggugaccgggcuccccggcgucuccgcgggcgugaccgggaccaucggcagccccgccgccgugacggggaccauccggcccuccgccgucgugaccggcaucaccgggcugagcgcggaggugacgggcaccaccggccugagcgccugggucaccgggaucgccggccucuccgccggggugacggagaccaucggcagcuccgccggggugaccggcaccaacggccugagcgcggaggccacggggaccaccggcccguccgccggggucaccggcacgaccggccugagcgccggggugaccggcaccgccgggcucuccgcgcgcgugaccgagagcacgggccuguccgccggggucaccggcaccaccggccugagcgccggggugacgggcaccaccgggcccuccgccggcaucaccgggacgaacggccucagcgccgaggucaccggcaccaccgggccccuggcgggcgugacggggaccaucggccuguccgccggggugaccggcaucgccggccucagcgccggggucaccgaguccacgggccugagcgcgggggugaccggcaccauccgguccagcgccguggucaccgggaucaacggccuguccgccggcgugacggggaccaccggccccagcgccgaggagaccggggccacgggcccgagcgcggaggugaccggcaccaccgggcccuccggcggggucacgggcaccagcgggaucuccgccgaggugaccggcaccacgggccccagcgccgaggugaccgggcuccccggcgucuccgccggggugaccggcaccaucgggagcccggccgcggugacgggcaccacccgccccuccgccgucgugaccggcaucagcgggcuguccgccgaggugaccggcacgaccgggcugagcgccggcgucaccgagaccaucggguccagcgccggcgugacgggcaccaacgggcucuccgcggaggccaccgagaccacgggccccagcgccggggugaccggcaccaccgggcuguccgccggcgucacgggcaccaccgggcccagcgcgggcaucgccgggaccaacggccuguccgccggcgugacggggaccaccggccucagcgcccgggugaccgagagcacggggcuguccgccggcgucaccgggaccaucggcagcuccgcgguggugaccgagacgacccgccugagcuccggcgucaccgggaccaucggcccgagcgccgaggagacgggggccaccggccucuccgccgaggugaccgggaccacgggcagccuggccgaggugaccggcaccaccgggcuguccgcgggcgucacggggaccaucggcagcuccgccguggugaccgggaccaccggccucagcgccggcaucacggggaccaacggccuguccgccgaggucaccgggaccgccggcccccuggcgggcgugacggggaccaccggccucagcgccggggugaccggcacgaccgggcuguccgccggcgucaccgagaccacgggccagagcgccggggugaccgaguccaccggccugagccccggggugaccggcacgaucggguccagcgccgucgugaccggcaucaagggccucagcgcgggggugaccggcaccacggggcccuccgccgaggagaccggcgccaccgggccgagcgccgaggucaccggcacgaccggccccuccgggggcgugaccgggaccagcgugcuguccgucgaggugacgggcaccaccgggcccagcgcggaggugaccggccugcccggcgucuccgccgggcucacgggcaccaucgggagcccggccgccgugcggggcaccaccuggcccuccgccguggucacgggcaucagcgggcuguccggcgaggugaccgggaccaccggccugagcgcgggggucacgggcaucggcgggcuguccgccggcgugaccgggaccaucggcagcuccgccggggugaccggcaccaacgcccucagcgccgaggcgacgggcaccaccgggcccuccgccggcgucaccgggacgaccggccugagcgccggggugaccggcaccacgggccuguccgccggggugaccggcaccauccgcagcagcgccgucgugaccgagacgaccgggcucuccgcgggcgugaccggcaccacggggccgagcgccggcaucgccgggaccaacggccuguccgccgaggucaccgggaccacgggccugagcgcgggcaugaccgggaccaccggccucuccgcccgggugacggagagcaccgggcuguccgccggcgugaccgggaccaucggcagcuccgccgucgugacggagaccacccgccugagcgccggcgugaccgggacgaucggccccuccgcggaggagaccggggccaccggccucagcgccgaggucacccggacgaccgggucccuggccggcgugaccggcaccaccgggcccagcgccguggucacgggcaagaccgagcuguccgcggaggugaccgggaccacggagcucagcgccgaggugaccgagaagaccggccccuccgccgaggucaccgggaagacgggccugagcgccggcgugauggagaccaccgggccguccgccgaggugaccggcacgaccgggagcagcgcgggcgucaccggcaccacggggcccuccgccggcgugaccgggaccaccggccccagcgccgaggccacggggcugcccggcguguccgccggcgucaccgggaccaucggcagcccggcgggggugaccggcacggcccgccucuccgccguggucaccgggaucagcggccuguccgccgaggugaccggcaccacggggcugagcaccggcgugaccgggaucgcgggccacuccgccgccgucaccgggaucacgcggcccagcgccggcgugaccggcaccaccacgguguccgccggggucaccggcaccaucgggcucagcgcggaggccaccggcaucacccugcccuccgccggcgugacggagaccaccgggcugagcgccggcgugaccgagacgaucgggcucuccgccggcgucaccgggaccaucggcagcuccgcgggcgugaccgagaucacggggcugagcgccggcgugaccgggaccaccggccccuccgccggggucacgggcagcaccgugcugagcgccggcgugaccgccaccacggggcaguccgucggcgugaccgggaccaccggcccgagcgcgggggugacgggcaccaccggccucuccgccggggucaccggcaucgccgggcugagcgccggcgugacggggaucaccggccccuccgcgggcgugaccgggaccacgaccgucagcgccggcgugaccgggaccacgggccuguccgccgaggccaccgagaucaccggccucagcgccggggugaccggcacgaccgggcuguccgcgggcgucaccgggaucgccggccugagcgccggcgugaccgagaccaucggguccagcgccggcgucacggggaccaacggccucuccgccgaggcgaccgggaagaccggccccagcgccggcgugacggggaccaccggccuguccgccggggugaccggcacgaccgggcugagcgccggcgucaccgagaccaucggccucuccgccggggugacgggcaccaucgggagcuccgcgggcgugaagggcaccaccgggcagagcgccgaggucacgggcgccaccgggcagagcgugggcgugaccgggaccacgcgcuccagcggcggcgucaccgggaucaccggccuguccgccgggcugcggggcaccacggugagcuccgcgaaggccgggaccagcaucccccucaccggcaagaccggcacgacccgcaccuccguggaggagagcaccacgaccgggccguccgccggcaucaccgggaccaacggccugagcgccgagaugacggggaccaacgagcuguccgccggcgucaccggcaccaucgggagcuccgcgggcgugaccgggacgaccggccucagcguggaggccaccgucaccacggggcuguccgccggcgugaccggcaccaccgugccccuggccggggucacguggacccccggccccagcgccggggugaccggcaucgcggcccucuccgccggcgugaccggcaagagcggccugagcgccggggucacgggcaagaccgggcuguccgccggcgugaccggcaccacggggccgagcgcggaggccaccggcaagaccgggcucuccgccggcgugaccgggaucacgggccccuucgccgaggucaccggcaccaccgggcugagcgccggcgugaucgggacgaccggcuccagcgcggaggugaccgggaucaccggccuguccgccggcgucacggggaagacccgcagcuccgccggcgugaccgggaccacgggccucagcgccaaguccgggaccagcauccccuccgcgggcaagaccggcaccacgaagaccagcguggaggagucccggaccacccgccccagcgccgggaucaccgccacgaccggcgucccggccgccaccucccccggggcggagggcgagagcaucgccuccaccagcguggccacgggcgccaucccccggagcaccaucgccccgggguccaccaccacgggcaccaccggggugaccacgggcaccacccuggcgccccgcagcuucaacaucgggaccuccggcggcaucagcgggaagacgcugaagcccggcuccuacgucagcgaggccaccaccgccaccgggacgcccggcgccgggccguccggcggcaccaccaucagcucccccgaggugagcaccaucuccgaggugagcaacacggggaucaccggcgucggguccgagaccagcaucgagaccggcaucuccaacacggccaccaccgggguggcgcccggcaccacgcucgcccccggcagcuccagcaccgaggccaccaccuccaucgggggcagcgccagcacgcgcggcggcaucgcgaccgaggccaccggcuccacccgcggggugcggacgaccggcagcgaggccccggaggggaccuccggcgaguucagcgggaccaccaucuccagcggcggcuuccacacggaggccaccacccugaccgggggccgcggguccaucggcacggagagccgggccgaguccaccaccagccugccccaguccgcgaagacccgcgggggcauccucacggaggccaccagcuccaccggccggauccgcgccaccgggagcgaggcccccggcgggacgucccggaaguucagcggcaccaccaucuccagcgggggcucccacaccgaggccacgacccuggcgggcgggcgcgacagcaccgagagcgaguuccggaccgccacgaucggcgucgugcccgccaccaccguggccccgggguccagcaagaccgaggccacgaccuuccugggcgucuccgggaccaccagcgugggccgcgcgacgggcgccaccaccuccaucgccgggagcgacaccucccaggccgagcaccccggcgggacgagcggcgaguuccccggcaccaccaucaccuccggggacagccacacggaggcgaccgcccucaccggcucccgggggagcaucggcaccgaguccaccguggagacgaccaccuacaucggggagagcggcaccacgcgcggcgggcuggccaccgccaccaccggcgccuucuccgggaagacgcuggagcccggcaacgacaacaccgaggcgaccgggagcaccggcggcauccgggccacgcgcaccgaggcccccgggggcaccuccggggaguuccccggcaccacguucaccagcgggggcucccacaccgaggccaccacguucaccggcgggaagggcagcaccgggaccgagagccgcgccgcgacgacccgggccgcccccggcaccacccucguccccggcuccagcaacacgggggccaccgccuccccgggcgggagcgcgaccacccgcggccggaucacgaccgccaccaccggggccuucuccggcaagacgcuggagagcgagaacgacaacaccgaggccaccuccagcacccgcggcgugcggaccacgcgcuccgaggcccccgggggcaccagcggggaguuccccggcacccggaucaccuccgggggcagcuacacggcgaccacccgcgccgcccccggcaccacgcuggccccgggguccagcaacaccggcgcgaccgccucccucgggggcagcgccaugacccgggggcgcaucacgaccgccaccaccggcgccuucuccggcaagacgcuggagcccgggaacaacaacaccgaggcgaccagcuccacccggggcgugcgcacgacccggagcgaggcccccggggaggccaccacccugacgggcgaccgcagcuccaccgggagcgagucccggaccgccaccacgggcgucgcccccggcaccaccguggcgccggggagcuccaagaccgaggccacgaccuuccucggcgugagcgggaccaccaacaucggccgcgccacgggcgccaccaccuccaucgucgggagcgacaccucccaggccgagcggcccggcgggaccacgguggucagccccggcgcguccagcaccucccagagcucccgcccggggaccagcgugacccccgacuccagcgccagcgaguccgagacggugaccaccaaggaguucagcggcaccacggccaucucccggaccagccacaccggcacccccgccgcguccgggggccaggccacggggagccugaccgccaccaccggcgucgcccccgggacgaccguggccccgggcuccagcaacaccgaggcgaccacguccgugggcgagcgcgagaccaccaaggccgagaucaucaccggggacacgggcgagcugagcgggaccaccaucaucuccgagaacagcaccacggccggcaucaccgccgccaccgggaagcaggcgggcaccuccgaggucgcccccagcacgaccguggcccccggcuccuucagcaccgccgccaccacgucccccggggcgagcggcaccaccggggugaccaccacgaccaagaccaccacgucccucggcggcagcgggaccaccggcgccgagaucaagagcgccaccacgggggccccgggcucccggaccgggaccgcgggcguccccagcgccaccacggugucccccggcagcuccaacagcgaggccaccaccuccgugggggagagcggcaagaccggggccgagacgaucaccgaggccaccaccuccacggagggcaccgggaccagcggcaccggcuucaagacggggaccuccgaggucgcgcccgccaccaccguggccccgggcagcuucuccacggccgccaccaccagccccggggcguccggcaugaccggggugacgaccaccaccaagacgaccaccagccugggcggcuccgggaccacgggcgccaagaucaagcuggucgggaccaccaccaccgcccccgagagccgcacggccggcgugcccuccgggacccgcgugaccccgggcagcagcaacuccgaggccaccacgagcgucgaggagucccggaucacccgcgcggaggugaucaccgaggccaccacguucagcggcggguccggcgccacccgggccgggcucccccgcggcaccaccggcgaguucagcgggacgaacuucaucuccggcagcuccaacaccgaggccaccaccagcacggaggggaccggcaccuccgggaccggcuucaagaucgcgggcaucacgagcgcccccgggaagcaggccggcaccuccggggugagccuggccaccaccgucgcgcccggcuccuucagcacggccaccaccuccagcggggccuccggcaucacccgggccggcccgacgagcgagaccaccaccagccucgggggcuccgggacgaccggcgccgagaucaagagcgcggccgugcccuccgggaccaccguggcccccggcagcuccaacagcgaggccacgaccuccgucggcgagaacgggaagacccgcggcgagaucaucaccgacaccacggaggggaccagcggcaaggugcucgagcccggguccgcccacaccgaggcgaccacguucccgggcggcagcgggaccacccgggccgggccgcccgggggcaccacgggcgagcugucccgcaugaccaucauccccgggagcuccaacaccgaggccaccacgagcaccaagggcaccgggaccuccggcacgggguucaagaccggcaccagcuggguggccccgggcaccacggucucccccgggagcuucuccaccgccaccaucagccccggcgcgagccggaccacgggggccgccccggccgcggagaccaccaccucccuggagggcgggggcacgaccggcgccgagaucaagagcggggccaccuccggcgugcccgggagcaagaccggcacggccggggugcccuccgccaccaccaucgcgcccggcagcuccaacagcgaggccaccacgucccucggcgagagcgggaagacccgcgucgagaccaucaccggcaccacggaggggaagacccuggccgccggcuccgcccacaccgaggcgaccacguucagcggcggguccggcagcacccgggccgggccgcugggcggggccuccggcaccagcggcggguacgugcccggccgcgagaccgagcccacgaccuccaucgaggagaccgggaccagccggacgaucuucaagaccgugggcaucaccuccgcccccgggcgccaggccggcaccagcgucguggcgccgagcacgaccguggcccccggcuccuucagcaccgccgccaccacgucccccggggccagcggcaugaccgggguccggaccaccuccaagacgaccaccagccucggcgggaccggcacgacccgcaccgagaucaaguccggcgcgaccacgggggcccccggcaucaagaccgacaucaugggggagagcucccggaccaccauccugagcggcuccagcaacacggaggccaccaacuccaucgaggagaccgggaccagcggcaccggcuucaagacggccgggaucaccgcggccccgggcaagcaggccgggaccuccggcguggcccccggcaccacgguggcccccgggagcuucuccaccgcggccaccaccagccccggcgccagcggggucacgggcaccgggccgaccgccgagaccacgaccuuccugggcggcuccagcaccaccggggccgagaucaaguccggcgcgacgaccggggcccccggcagcaagaccgggaccgccaaggugcucuccggcacgaccguggccagcggcuccagcaacuccgaggccaccaccuucagcgggaucacggaggcggucaccgugcccuccaagaacggcagcaugaccaccgcccuggggucccagcugagcuccagccagacggugauccccggcuccagcgggaccaucucccacaccaccgucgccccgggcagcagcgugacgggcaccaccaccggggccuccgacgaccaggugacgggcagcaagaccgggaccaccggcgucgcgcucuccaccacgguggcccccggcagcuccagcaccgaggccaccaccuccacgggggugcaccgcaccaccgucgugggccagaagaccggggccacgacccggggcagcgccaagcaggggacccgcuccaccaucgaggcgacgaccagcuuccgcggcaccggcaccacgggguccggcaugaacaccgggaccaccggcgucgugagcgggaacacgaucucccccagcuccuucaacaccgaggccaccagcggcaccuccgagcggcccaacccgggcagcgagaucgggacgaccggcaucguguccgggaccaccgucgcccccggcagcagcaacacggaggccaccaccucccuggggaacggcggcaccacggaggccgggagcaagaucgugaccaccggcaucaccacggggaccaccaucgugcccggcuccuucaacaccaaggcgaccacgagcaccgacgucgggguggccaccggcgugggcauggccaccgggaucacgaacaucaucuccggccgcagccagccgaccggguccaagaccggcuacaccgucacgggcagcgggaccaccgcccugcccggcggguuccggaccggcaacacgcccggguccaccggcgugaccagcucccaggagggcaccacgguggucagcuccgggaucaccggcauccccgagaccagcaucuccgggccgagcaaggaggccuccgacaagaccacggcgcccgggccgcccaccaccgugaccgccagcacgggggugaaggagaccuccgagaccggcguccagaccggcagcacgcucgugaccgccggggugccgacccgcccccaggucagccagcccgagaccacggugguggccacccgggaggucgagaccgagaacaagaccgagugccuggcgucccugcccccggcccccgugugccacggcccccucggggaggagaagucccccggcgacaucuggacggccaacugccaccgcgggaccugcaccgacgccaagaccaucgacugcaagccggaggagugccccagcccgccgaccugcaagacgggcgagaagcuggugaaguuccagagcaacgacacgugcugcgagaucggcuacugcgagccgcggaccugccuguucaacaacaccgacuacgagaucggggccuccuucgacgaccccagcaaccccugcgucuccuacagcugcaaggacacgggcuucgcggccguggugcaggacugccccaagcagaccuggugcgccgaggccaaccgcaucuacgacuccaagaagugcugcuacacgugcaagaacaacugccggagcucccucgucaacgugaccgugaucuacagcgggugcaagaagcgcguccagauggccaagugcaccggcgagugcgagaagaccgcgaaguacaacuacgacauccugcugcuggagcacuccugccucugcugccgggaggagaacuacgagcugcgcgacaucgugcuggacugcccggacggcagcaccauccccuaccaguacaagcacaucaccacgugcuccugccucgacaucugccagcuguacaccaccuucauguacagcuga

SEQ ID NO: 33217 - RNA, 795 nt, Artificial Sequence
  derived and/or modified sequence opt1 from MUC1__Homo_sapiens__NP_001018016
augacccccggcacccagagcccguucuuccugcuccugcugcucacggugcugaccgccaccaccgcccccaagcccgcgacggucgugaccggguccggccacgccagcuccacccccgggggcgagaaggagaccagcgccacgcagcgcuccagcgugccguccagcaccgagaagaacgccuucaacuccagccuggaggaccccuccaccgacuacuaccaggagcuccagcgggacaucagcgagauguuccugcagaucuacaagcagggcggguuccugggccucuccaacaucaaguuccgccccgggagcgucguggugcagcugacccuggccuuccgggagggcacgaucaacguccacgacguggagacccaguucaaccaguacaagaccgaggcggccucccgcuacaaccucaccaucagcgacguguccgucagcgacgugcccuucccguucuccgcccagagcggggccggcgugcccggguggggcaucgcgcugcugguccucgugugcgugcuggucgcccuggccaucguguaccucaucgcccuggccgugugccagugccggcgcaagaacuacggccagcuggacaucuuccccgcgcgggacacguaccaccccaugagcgaguacccgaccuaccacacccacgggcgcuacgucccgcccuccagcaccgaccggucccccuacgagaaggugagcgccggcaacgggggcuccagccucuccuacacgaaccccgccguggccgccaccagcgcgaaccuguga

SEQ ID NO: 33218 - RNA, 2130 nt, Artificial Sequence
  derived and/or modified sequence opt1 from MUC20__Homo_sapiens__NP_001269435
augggcugccugugggggcucgcccugccccuguucuucuucugcugggaggugggcgucagcggguccagcgccggcccguccacccgccgggcggacaccgccaugacgaccgacgacaccgaggugcccgccaugacccucgcccccgggcacgccgcgcuggagacgcagacccugagcgccgagaccuccagccgcgccuccacccccgccggcccgauccccgaggcggagacgcggggcgccaagcgcaucagccccgcccgggagacccgcuccuucaccaagaccagccccaacuucauggugcucaucgccacguccgucgagaccagcgccgcguccgggagcccggagggcgccgggaugaccaccgugcagacgaucaccggcuccgacccccgggaggccaucuucgacacccugugcaccgacgacagcuccgaggaggccaagacgcugaccauggacauccucacccuggcccacaccagcacggaggcgaaggggcuguccagcgagagcuccgccagcuccgacagcccccaccccgugaucaccccgucccgcgccagcgaguccagcgccuccagcgacggcccccaccccgucaucacccccucccgggccagcgaguccagcgcguccagcgacggcccgcaccccgugaucacccccucccgcgccagcgaguccagcgccagcuccgacgggccccacccggugaucacgcccagccgggccuccgagagcuccgccagcuccgacggcccccaccccgucaucaccccgagccgcgcguccgagagcuccgccagcuccgacgggccccaccccgugaucacccccagccgggccuccgagagcuccgccagcagcgacggcccgcaccccgugaucacccccucccgcgcgagcgaguccagcgccuccagcgacggcccgcaccccgucaucacgcccucccgggccagcgaguccagcgccuccagcgacgggccccacccggugaucacccccucccgcgccagcgaguccagcgcguccagcgacggccuccaccccgugaucacccccucccgggccagcgagagcuccgccagcuccgacgggccgcaccccgucaucacccccagccgcgccuccgagagcuccgccagcuccgacggcccccacccggugaucacgcccagcuggucccccgggagcgacgugacccugcuggcggaggcccucgucaccgugaccaacaucgaggugaucaacugcuccaucaccgagaucgagacgaccaccagcuccauccccggcgccagcgacaccgaccugaucccgacggagggcgucaaggccuccagcaccuccgacccgcccgcccugcccgacagcaccgaggcgaagccccacaucaccgaggugacggccagcgccgagacccucuccaccgccgggaccacggagagcgcggcccccgacgccaccgugggcacgccccugcccaccaacuccgccaccgagcgggaggucaccgccccgggggcgaccacccugagcggcgcccucgugacggucucccgcaacccccuggaggagaccagcgcccuguccguggagacccccagcuacgugaaggucuccggggccgccccggugagcaucgaggcgggcuccgccgugggcaagaccacgagcuucgccggguccagcgccuccagcuacucccccagcgaggccgcgcucaagaacuucacccccuccgagacccccaccauggacaucgccacgaagggcccguuccccaccagccgggacccccugcccagcgucccgcccaccaccacgaacuccagccgcgggaccaacuccacccuggccaagaucaccacgagcgccaagaccaccaugaagccgcccaccgcgacccccacgaccgcccgcacccggcccaccacggacguguccgccggcgagaacgggggcuuccuccugcugcgccucagcguggccucccccgaggaccugaccgacccccgggucgccgagcgccugaugcagcagcuccaccgggagcugcacgcgcacgccccgcacuuccaggugagccugcuccgcgugcggcgcggcuga

SEQ ID NO: 33219 - RNA, 1701 nt, Artificial Sequence
  derived and/or modified sequence opt1 from MUC21__Homo_sapiens__NP_001010909
augaagaugcagaagggcaacgugcugcucauguucgggcugcugcuccaccuggaggccgccaccaacagcaacgagaccuccacgagcgcgaacaccggcuccagcgucaucuccagcggggccuccaccgccaccaacagcggcuccagcgugacguccagcgggguguccaccgccaccaucagcggcuccagcgucaccuccaacggcgugagcaucgugacgaacuccgaguuccacaccaccagcagcgggaucuccaccgccacgaacagcgaguucuccaccgucagcuccggcaucagcaucgcgaccaacuccgagagcuccaccacgagcuccggggccagcaccgccaccaacuccgagagcuccacccccagcuccggcgccagcacggcgaccaacuccgacagcagcaccaccuccagcggggccuccacggccaccaacagcgacuccagcaccaccuccagcgaggccuccacggccaccaacagcgaguccagcaccaccuccagcggcgcguccacggccaccaacagcgaguccagcaccgugagcucccgcgccagcaccgccacgaacuccgagagcuccaccaccagcuccggcgccagcaccgcgaccaacuccgagagccggacgaccuccaacggggccggcaccgccaccaacagcgaguccagcacgaccuccagcggggccuccaccgccaccaacagcgaguccagcacgccgagcuccggcgcgggcaccgccaccaacagcgaguccagcaccacguccagcggggccggcaccgccaccaacuccgagagcuccaccgugagcuccgggaucagcacggucaccaacuccgagagcuccacccccagcuccggcgccaacaccgcgacgaacagcgaguccagcaccaccagcuccggggccaacaccgccacgaacagcgacuccagcaccaccuccagcggcgccuccaccgcgacgaacagcgaguccagcaccaccuccagcggcgccuccaccgccacgaacagcgaguccagcaccaccuccagcggggccuccaccgccacgaacagcggcagcuccaccaccagcuccgggaccagcaccgcgacgaacuccgagagcuccaccgugagcuccggcgccagcaccgccaccacguccgagagcuccaccaccagcuccggggccagcaccgccacgaacuccgagagcuccaccgugagcagcggcgcguccaccgccaccaacagcgaguccagcacgaccuccagcggcgccaacaccgccaccaacuccgggagcuccgucacgagcgccggcuccgggaccgcggcccugaccggcaugcacaccacgagccacuccgccagcaccgccguguccgaggcgaagcccgggggcagccucgugcccugggagaucuuccugaucacccuggucuccgugguggccgccgucggccucuucgccgggcuguucuucugcgugcgcaacagccugucccuccggaacaccuucaacacggccguguaccacccgcacggccugaaccacgggcugggccccggccccgggggcaaccacggggcgccccaccgcccgcgguggagccccaacugguucuggcgccggcccgucagcuccaucgccauggagaugagcggccgcaacuccgggcccuga

SEQ ID NO: 33220 - RNA, 5322 nt, Artificial Sequence
  derived and/or modified sequence opt1 from MUC22__Homo_sapiens__NP_001185744
augcgccggggcaacaucagccccgccuucugguuccuguggcuccugcuguucgggcuccugggcccguccagcgagaacaccaccgccuucacgaagggguccgacaccaccaccgcgagcaucacgggcuccgagaccaccauggccagcaccauggccuccacgagcgcccugaccaccggguccaagaucaccacggacagcaccaccggcuccgagaccacgagcgccuccaccauggcgagcaccgccgccuucaccacgggcuccgagaccaacaccgccagcaccacggacuccgggaccaccaucgcgagcacccgcacguucaccaccggcuccgacaccacgaccgggagcaccgccggcagcgagaccaucguggccuccacgaccgucagcgggaccaccaccacguucaccaucgccuccaccaccgugcccgagacgaccauggccagcuccaccaccagcacggcgggcuccgagaagaccauggccagcuccaucaucagcgagaccaccauggccuccacgaccggcagcgagaccgccaccguguccacgaccgggagcgagaccaccacgaccuccaccgccagcuccgaggcgaccaaggucagcacgaccggcuccgagaccaccacggccagcaccgccgggagcgagaccaccacgaccuccaccagcauggccggcuccgaggccaccacgaccagcaccgcggacuccaaggugaucaccgccagcuccaugagcuccgagaccacgguggcccccgccgccggcagcaacaccaccaccgcguccacgaccgggagcgagaccaccacgauccucaucaaggccuccgagaccaccaccgccagcacggccggcuccgagaccaccacccccagcccgacggggucccagaccaccaucgucagcaucagcggcuccgagaucaccacgaccagcaccgcgggguccgagaacaccacggugagcuccgccggcagcggcaccaccaccgccuccauggccgggagcgagacgaccguguccaccgccggcagcgagaccacgaccgucuccaucaccgggaccgagacgaccauggugagcgcgaugggcuccgagaccaccaccaacagcacgaccuccagcgagaccaccgugacguccaccgccgggagcgagaccaccacggucuccaccgugggcagcgagaccaccacggccuacaccgccgacagcgagaccaccgccgcguccacgaccggcagcgagaugaccaccguguucacggccggguccgagaccaucacccccagcaccgccggcuccgagacgaccaccgucagcaccgccggguccgagacgaccaccgugagcaccacgggcuccgagaccaccaccgccagcacggcgcacuccgagaccaccgccgccagcaccaugggguccgagacgaccaaggugagcaccgccggcuccgagaccaccgucagcacggcgggcuccgagaccaccgccgccagcaccgaggacuccgagacgaacaccgccuucaccgaggacagcaagaccacgaccgccagcaccaccggguucgagacgaccgcggccuccaccaccggcagcgagcccacgauggccuccaccauggggagcgagaccaccauggccuccacgaucggccccgagaccaccaaggugagcaccgccuccagcgaggugacgaccgucuucgcggccggcuccgagaccauccgggccagcaccgugggguccgagacgaccaccgugagcaccacgggcuccgagaccaccaccgccagcaucaugggguccgagacgagcaccgacuccaccaccggcagcgagaccacgaccgccuccaccgaggggagcgagaccacgaccgcgagcaccgagggcuccgaggccaccacggucagcaccaccggcuccgagaccacgaccgugagcaucaccgacuccgagaccacgaccaccugcaccgaggggagcgagaugacggccgucuccaccaccguguucgagaccacgaccgccagcaccgagggcuccgagaucaccaucgcgagcacguccgacagcgagaccaccaccgccuccacggaggggagcgagaccaccaccgugacgaccgccggcuccgagaccaagaccgccuacaccacggggagcgagaccaccaccgccuccaacacgggccuggagaccaccaccgucuucacgaucggcagcgacaccaccaccgcguccacggaggggagcgagaccaccgccgugagcgccaccggcuccgagaugacgaccgugagcaccgagggguccgagaacaccacggucagcaccaccggcuccgagaccacgaccgugagcaccaccgggcuggagacgaccaccaccuccacggagggcagcgagaugaccaccguguccaccacgggcgccgagaccaccaccgacagcaccgagggguccggcacgaccgccgcgagcaccgccggguccgagaccacgaccgucagcaccgccgacuccgagaacaccacggccagcaccgccgacuccgagaccaccagcgcguccacgaccggcagcgagaccaccacggccagcaccaccuccagcgagaccacgaccgccuccaccgaggggagcgagaccacgaccguguccaccaccgacagcgagacgaccaugguguccaccaccggcagcgagcgcacgaucaccuccaccgagggcagcgagaccacgaccgucuccgccaccgggagcgagaccaccguguccacggagggcagcgggaccaccaccguguccaucacgggcagcgagaccaccaaggucuccaccacgggcagcgagaccaccaccacgagcaccgagggguccgagaucaccaccgccagcaucacgggcuccgagaccaccaccgcgagcacggagggguccgagaccaccaccgccagcacggagggcuccgagaccaccagcgccuccaccacggggagcgagaccaccaccgccuccacgaccagcuccgagaccaccauggcgagcaucaugggcuccgagacgaccauggccagcaccaucggcuccgagaccacgaaggugagcaccgccuccagcaagaugaccaccguguucaccgagaacagcgagacgaccaucgccuccaccaccgccagcgagacgaccaccgucuccaccgcggggagcgagacgaucccggccuccaccgccggcagcgagaccaccacgaccaccuccaccgaggggagcgagacgaccaccgccuccaccgagggcagcgagacgaccaccgccuccaccgagagcuccgagacgaccaccgcgaccacgaucgggagcgagaccaccaccgccuccacggagggcagcgagaccaccaccacguccaccgagggcagcgagaccaccaccgccuccacggaggggagcgagaucaccaccgugagcaccacgggcuccgagaccaccaccgccagcacggagggguccgagaccaccaccgccagcacggagggcuccgagcucaccaccgugagcaccacgggguccgagaccaucaccgucagcgcggagggcuccgagaccacgaccgugaccaccaugggcagcgagacgaccaccgccuccaccgccgggagcgagacgaccaccguguccaccgccggcagcgagacgaccaccgcguccaucgaggggagcgagaccacgaccgucuccagcaccggcuccgagaccaccacggugagcaccaccggcaccgagacgaccaucaccagcaccgagggguccgagacgaccaccgugaccacggccggcagcgagaccaccgccgucuacaccacgggguccgagaccaccaccacgagcaccgagggcuccgagaccaccacggugagcaccaccggguccgagaccacgaccgccagcaccgccgaccuggagaccacgaccguguccaccagcggcuccggcaccacgaccgcgagcaccgccggguccgagaccaccacggucuacaucaccggcagcaagaccaccacggccuccaccgaggggagcgaggccaccaccguguccacgaccagcuccgagaccaccacggccagcaccaccggcagcgagaugaccacgguguucaccaccgucuccgagaccacgaccgugagcaccaucggguccgaggcgaccacgagcuccgccgccggcagcgaggccaccaccaccuccacggagggcagcgagaccaccaccgccuccacggcggggagcgagaccaccaccgccuccacggccggcagcgagaccaccaccgccuccaccagcggguccgagacgaacaccgcgugcaccaccggcagcgagacguccacccccagcuccgccgggagcgagaccaacaccgccuucaucaucggcagcgaguccacgaucgccagcaccgccucccuggagcccaccgcgaccagccucacgggcuccgagaccaccaccgugagcaucacggccuccggggccaccgccgccagcaccaccgucuccagcacgaccuucgugcugaccaaggcgaccgacguguccauccagcccaucacgaacaccccgaugagcggcacccggaccacggggacccgccugaccgccuccagcuccgucaccauggcccccggcauggacuucacggccagcgccgcgucccacaccgugcccgggaucgugcucaacaccagcggccugggcaccagcacgaugggggccuccagcaccaccuccgcccacggcguccggaccaccacggggagcacccgcgagcccaccuccagcaccuuccaggagacgggcccgguguccaugggcaccaacaccgugagcaugucccacacccccacgaacgucaucaagcccagcggguaccugcagcccugggccaucauccucaucucccuggccgcggugguggccgccgucggccugagcguggggcucuccuucugccugcggaaccuguucuucccgcuccgcuacugcggcaucuacuacccccacgggcacagccacucccugggccuggaccucaaccugggccuggggagcggcaccuuccacucccucgggaacgcccuggugcacggcggggagcuggagaugggccacggcgggacccacggcuucggguacggcgucgggcacggccucagccacauccacggcgacggguacggcgugaaccacgggggccacuacgggcacggcggcgggcacuga

SEQ ID NO: 33221 - RNA, 15540 nt, Artificial Sequence
  derived and/or modified sequence opt1 from MUC2__Homo_sapiens__NP_002448
augggccugccccucgcccgccuggccgcggugugccuggcccucagccuggccgggggcuccgagcugcagaccgaggggcggacccgcaaccacggccacaacgucugcagcacgugggggaacuuccacuacaagaccuucgacggcgacguguuccgguucccgggccccugcgacuacaacuucgccuccgacugccgcgggagcuacaaggaguucgccgugcaccucaagcggggccccgggcaggcggaggcccccgccggcgucgaguccauccugcugaccaucaaggacgacaccaucuaccucacgcgccaccuggccgugcugaacggggcgguggucagcaccccgcacuacucccccggccuccugaucgagaagagcgacgccuacaccaagguguacucccgggccggccugacccucauguggaaccgcgaggacgcccugaugcuggagcucgacacgaaguuccggaaccacaccugcgggcugugcggcgacuacaacgggcugcagagcuacuccgaguuccucagcgacggcgugcuguucuccccccuggaguucggcaacaugcagaagaucaaccagcccgacgucgugugcgaggacccggaggaggagguggcccccgcgagcugcuccgagcaccgcgccgagugcgagcggcuccugaccgccgaggccuucgccgacugccaggaccuggucccccucgagcccuaccugcgcgcgugccagcaggaccggugccgcugcccggggggcgacaccugcgugugcagcacgguggccgaguucucccggcagugcagccacgccgggggccgccccgggaacuggcggaccgccacccugugccccaagaccugccccggcaaccucgucuaccuggaguccggcagcccgugcauggacacgugcagccaccuggagguguccagccucugcgaggagcaccgcauggacgggugcuucugccccgagggcaccguguacgacgacaucggggacuccggcugcguccccgugagccagugccacugccggcugcacgggcaccuguacacccccggccaggagaucaccaacgacugcgagcagugcgugugcaacgccggccgcugggucugcaaggaccucccgugccccgggacgugcgcgcuggagggcgggucccacaucaccaccuucgacggcaagaccuacacguuccacggggacugcuacuacgugcuggccaagggcgaccacaacgacagcuacgcccuccugggcgagcuggcccccugcggguccaccgacaagcagaccugccucaagaccgugguccugcuggccgacaagaagaagaacguggucguguucaagagcgacggcuccgugcuccugaacgagcugcaggucaaccucccccacgugacggcgagcuucuccguguuccggccgagcuccuaccacaucauggucagcauggccaucggggugcgccugcaggugcagcuggcccccgucaugcagcuguucgugacccucgaccaggccucccagggccaggugcagggccugugcgggaacuucaacggccuggagggggacgacuucaagaccgcgagcggccucgucgaggccaccggggccggcuucgccaacacguggaaggcccaguccaccugccacgacaagcuggacuggcuggacgaccccugcagccucaacaucgaguccgcgaacuacgccgagcacuggugcagccugcugaagaagaccgagacccccuucggccgcugccacagcgccguggacccggccgaguacuacaagcggugcaaguacgacacgugcaacugccagaacaacgaggacugccucugcgccgcgcuguccagcuacgcccgcgccugcaccgccaagggggugaugcuguggggcuggcgggagcacgucugcaacaaggacgugggguccugccccaacagccagguguuccucuacaaccugaccaccugccagcagaccugccgcucccugagcgaggccgacucccacugccucgagggcuucgcgcccgucgacgggugcggcugcccggaccacacguuccuggacgagaagggccggugcgugccccuggccaagugcagcugcuaccaccgcgggcucuaccuggaggccggcgacguggucgugcggcaggaggagcgcugcgugugccgggacgggcgccugcacugccggcagauccgccucaucggccaguccugcaccgcccccaagauccacauggacugcagcaaccugaccgcgcuggccaccuccaagccccgggcccucagcugccagacgcuggccgccggguacuaccacaccgagugcgucuccggcugcgugugcccggacggccugauggacgacgggcgcggcgggugcguggucgagaaggagugccccugcgugcacaacaacgaccucuacagcuccggcgcgaagaucaagguggacugcaacaccugcaccugcaagcgggggcgcugggucugcacgcaggccgugugccacggcaccugcagcaucuacggcuccgggcacuacaucaccuucgacggcaaguacuacgacuucgacgggcacugcagcuacguggccguccaggacuacugcggccagaacagcucccugggcagcuucuccaucaucaccgagaacgugcccugcgggacgaccggcgugaccugcagcaaggccaucaagaucuucauggggcggaccgagcugaagcucgaggacaagcaccgcgucgugauccagcgggacgagggccaccacguggccuacacgacccgcgaggucgggcaguaccuggugguggaguccagcaccggcaucaucgucaucugggacaagcgcaccacgguguucaucaagcuggcgcccuccuacaagggcaccgugugcgggcucugcggcaacuucgaccaccggagcaacaacgacuucaccacccgcgaccacauggucguguccagcgagcuggacuucgggaacuccuggaaggaggccccgacgugccccgacgugagcaccaaccccgagcccugcucccugaacccgcaccggcgcagcugggccgagaagcagugcuccauccucaagagcuccgucuucagcaucugccacuccaagguggaccccaagcccuucuacgaggccugcgugcacgacagcugcagcugcgacaccggcggggacugcgagugcuucugcuccgccgucgcgagcuacgcccaggagugcaccaaggagggcgccugcguguucuggcggacgcccgaccugugcccgaucuucugcgacuacuacaaccccccccacgagugcgaguggcacuacgagcccugcggcaaccgcuccuucgagaccugccggaccaucaacgggauccacagcaacaucuccgucagcuaccuggagggcugcuacccgcgcugccccaaggaccggcccaucuacgaggaggaccucaagaagugcgugaccgccgacaagugcgggugcuacguggaggacacgcacuaccccccgggcgcguccguccccaccgaggagaccugcaagagcugcgugugcaccaacuccagccagguggucugccgccccgaggaggggaagauccugaaccagacgcaggacggcgccuucugcuacugggagaucugcggcccgaacgggaccguggagaagcacuucaacaucugcuccaucaccacccggcccagcacccugacgaccuucaccaccaucacgcuccccaccacccccaccacguucaccaccaccacgaccaccaccacgccgaccuccagcaccgugcuguccaccacgcccaagcugugcugccucuggagcgacuggaucaacgaggaccaccccuccagcggcuccgacgacggggaccgcgagaccuucgacggcgucugcggcgcccccgaggacaucgagugccggagcgugaaggacccgcaccugagccuggagcagcucgggcagaaggugcagugcgacgucuccgugggcuucaucugcaagaacgaggaccaguucgggaacggccccuucgggcugugcuacgacuacaagauccgcgugaacugcugcuggcccauggacaagugcaucaccacccccagcccgcccacgaccacccccucccccccgcccaccagcacgaccacccugccccccaccacgaccccguccccccccaccaccacgaccaccacccccccgcccaccacgacccccagccccccgaucaccaccacgaccaccccccccccgaccacgacccccuccccccccaucagcaccaccacgaccccgccccccaccaccacgcccuccccgcccaccaccacccccagccccccgacgaccacccccuccccccccaccacgaccaccaccacgccgccccccaccaccacccccagcccgcccacgaccacccccaucacccccccggccuccacgaccacccucccccccaccacgacccccagcccgcccaccaccaccacgaccacccccccgcccaccacgacccccucccccccgaccaccacgcccaucaccccccccaccagcaccacgacccugccgcccaccaccacgcccucccccccgcccaccaccaccacgaccccccccccgaccaccacgcccagcccccccaccaccaccacgccguccccccccaccaucaccaccacgacccccccgcccaccaccacgcccagcccgcccaccaccaccaccacgaccccccccccgaccaccacgcccagcccccccaccaccaccccgaucacgccccccaccuccaccaccacgcugcccccgaccaccacccccagcccccccccgacgaccaccaccacgcccccccccaccaccaccccguccccccccacgaccaccacccccagcccgcccaucacgaccaccaccacgccccccccgaccaccacccccuccagccccaucacgaccaccccguccccccccaccaccacgaugaccacccccagcccgaccacgacccccuccagccccaucaccaccacgaccacccccuccagcaccacgaccccgucccccccccccaccaccaugacgaccccgagccccaccaccacgcccucccccccgaccaccaccaugacgacccucccccccaccaccacgagcuccccccugaccaccaccccgcugccccccagcaucacgcccccgaccuucucccccuucagcaccaccacgcccaccacccccugcgucccgcucugcaacuggaccggcuggcuggacagcggcaagcccaacuuccacaagcccgggggcgacaccgagcugaucggggacgugugcggcccggggugggccgcgaacaucuccugccgggccacgauguaccccgacgugcccaucggccagcucggccagaccgucgugugcgacgugagcgucgggcugaucugcaagaacgaggaccagaagcccggcggggugaucccgauggccuucugccugaacuacgagaucaacgugcagugcugcgagugcgucacccagcccaccacgaugaccaccaccacgaccgagaaccccacccccccgaccacgacccccaucaccaccacgaccaccgugacccccacgcccaccccgaccggcacccagacgcccaccaccacccccaucacgaccaccaccacggugacccccaccccgacccccacggggacccagacccccaccaccacgcccaucaccaccaccacgaccgucaccccgacccccacgcccaccggcacccagacccccacgaccaccccgaucaccacgaccaccaccgugacgcccacccccacccccaccggcacgcagaccccgaccaccacgcccaucaccaccaccacgaccgugacccccaccccgacgcccaccgggacccagacccccacgaccacccccaucaccaccacgaccaccgucaccccgacgcccacccccaccggcacccagacgcccaccaccaccccgaucacgaccaccaccacggugacccccacccccacccccacggggacccagaccccgaccacgacccccaucaccaccacgaccaccgugacccccacgcccaccccgaccggcacccagacgcccaccaccacccccaucaccacgaccaccaccgucacgcccaccccgacccccaccgggacgcagacccccaccaccacgcccaucaccaccaccacgaccgugaccccgacccccacgcccaccggcacccagaccccgacgaccacccccaucaccacgaccaccaccgugacgcccacccccaccccgaccggcacgcagacccccaccaccacccccaucacgaccaccaccacggucacccccaccccgacccccacggggacccagacccccaccacgacccccaucaccaccacgaccaccgugaccccgacgcccacccccaccggcacccagacgcccaccaccaccccgaucacgaccaccaccacggugacccccacccccacccccacggggacccagaccccgaccaccacgcccaucaccaccaccacgaccgucacccccacccccacgccgaccggcacccagacccccacgaccacccccaucaccacgaccaccaccgugacgcccaccccgacccccaccggcacgcagacccccaccaccacgccgaucaccaccaccacgaccgugacccccacccccacgcccaccgggacccagaccccgaccacgacccccaucaccaccacgaccaccgucacccccacgcccaccccgaccggcacccagacgcccaccaccacccccaucacgaccaccaccacggugacccccaccccgacccccacggggacccagacccccaccacgacccccaucaccaccacgaccaccgugaccccgacgcccacccccaccggcacccagacccccacgaccaccccgaucaccacgaccaccaccgucacgcccacccccacccccaccgggacgcagaccccgaccaccacgcccaucaccaccaccacgaccgugacccccacccccacgccgaccggcacccagacccccacgaccacccccaucaccacgaccaccaccgugacgccgacccccacccccaccggcacccagacgcccaccaccaccccgaucacgaccaccaccacggucacccccacccccacccccacggggacccagaccccgaccacgacccccaucaccaccacgaccaccgugacccccacgcccaccccgaccggcacccagacgcccaccaccacccccaucacgaccaccaccacggugacccccaccccgacccccacggggacccagacccccaccaccacgcccaucaccaccaccacgaccgucaccccgacccccacgcccaccggcacccagacccccacgaccaccccgaucaccacgaccaccaccgugacgcccacccccaccccgaccgggacgcagacccccaccaccacgcccaucaccaccaccacgaccgucacccccaccccgacgcccaccggcacccagacccccaccacgacccccaucaccaccacgaccaccgugaccccgacgcccacccccaccggcacccagacgcccaccaccaccccgaucacgaccaccaccacggugacccccacccccacccccacggggacccagaccccgaccacgacccccaucaccaccacgaccaccgucacccccacgcccaccccgaccggcacccagacccccacgaccacccccaucaccacgaccaccaccgugacgcccaccccgacccccaccgggacgcagacccccaccaccacgcccaucaccaccaccacgaccgugaccccgacccccacgcccaccggcacccagaccccgacgaccacccccaucaccacgaccaccaccgucacgcccacccccaccccgaccgggacccagacgcccaccaccacccccaucacgaccaccaccacggugacccccaccccgacccccacgggcacccagacccccaccacgacccccaucaccaccacgaccaccgugaccccgacgcccacccccaccggcacccagacgcccaccaccaccccgaucacgaccaccaccacggucacccccacccccacccccaccgggacgcagaccccgaccaccacgcccaucaccaccaccacgaccgugacccccacccccacgccgaccggcacccagacccccacgaccacccccaucaccacgaccaccaccgugacgcccaccccgacccccaccgggacgcagacccccaccaccacgccgaucaccaccaccacgaccgucacccccacccccacccccacgggcacccagaccccgaccacgacccccaucaccaccacgaccaccgugacccccacgcccaccccgaccgggacccagacgcccaccaccacccccaucacgaccaccaccacggugacccccaccccgacccccacgggcacccagacccccaccacgacccccaucaccaccacgaccaccgucaccccgacgcccacccccaccggcacccagacccccacgaccaccccgaucaccacgaccaccaccgugacgcccacccccacccccaccgggacgcagaccccgaccaccacgcccaucaccaccaccacgaccgugacccccaccccgacgcccaccggcacccagacccccacgaccacccccaucaccacgaccaccaccgucacgccgacccccacccccaccgggacccagacgcccaccaccaccccgaucacgaccaccaccacggugacccccacccccacccccacgggcacccagaccccgaccacgacccccaucaccaccacgaccaccgugacccccacgcccaccccgaccggcacccagacgcccaccaccacccccaucacgaccaccaccacggucacccccaccccgacccccaccgggacgcagacccccaccaccacgcccaucaccaccaccacgaccgugaccccgacccccacgcccaccggcacccagacccccacgaccaccccgaucaccacgaccaccaccgugacgcccacccccaccccgaccgggacgcagacccccaccaccacgcccaucaccaccaccacgaccgucacccccaccccgacccccacgggcacccagacccccaccacgacccccaucaccaccacgaccaccgugaccccgacgcccacccccaccgggacccagacgcccaccaccaccccgaucacgaccaccaccacggugacccccacccccacccccacgggcacccagaccccgaccacgacccccaucaccaccacgaccaccgucacccccacccccacgccgaccggcacccagacccccacgaccacccccaucaccacgaccaccaccgugacgcccaccccgacccccaccgggacgcagacccccaccaccacgcccaucaccaccaccacgaccgugaccccgacccccacgcccaccggcacccagaccccgacgaccacccccaucaccacgaccaccaccgucacccccacgcccaccccgaccgggacccagacgcccaccaccacccccaucacgaccaccaccacggugacccccaccccgacccccacgggcacccagacccccaccacgacccccaucaccaccacgaccaccgugaccccgacgcccacccccaccgggacccagacgcccaccaccaccccgaucacgaccaccaccacggucacccccacccccacccccaccggcacgcagaccccgaccaccacgcccaucaccaccaccacgaccgugacccccacccccacgccgaccggcacccagacccccacgaccacccccaucaccacgaccaccaccgugacgccgacccccacccccaccgggacgcagacccccaccaccacgccgaucaccaccaccacgaccgucacccccacccccacccccacgggcacccagaccccgaccacgacccccaucaccaccacgaccaccgugacccccacgcccaccccgaccgggacccagacgcccaccaccacccccaucacgaccaccaccacggugacccccaccccgacccccacgggcacccagacccccaccacgacccccaucaccaccacgaccaccgucaccccgacccccacgcccaccgggacccagacccccacgaccaccccgaucaccacgaccaccaccgugacgcccacccccacccccaccggcacgcagaccccgaccaccacgcccaucaccaccaccacgaccgugacccccaccccgacgcccaccggcacccagacccccacgaccacccccaucaccacgaccaccaccgucaccccgacgcccacccccaccgggacccagacgcccaccaccaccccgaucacgaccaccaccacggugacccccacccccacccccacgggcacccagaccccgaccacgacccccaucaccaccacgaccaccgugacccccacgcccaccccgaccgggacccagacgcccaccaccacccccaucacgaccaccaccaccgucacgcccaccccgacccccaccggcacgcagacccccaccaccacgcccaucaccaccaccacgaccgugaccccgacccccacgcccaccggcacccagacccccacgaccaccccgaucaccacgaccaccaccgugacgcccacccccaccccgaccgggacgcagacccccaccaccacgcccaucaccaccaccacgaccgucacccccaccccgacccccacgggcacccagacccccaccacgacccccaucaccaccacgaccaccgugaccccgacgcccacccccaccgggacccagacgcccaccaccaccccgaucacgaccaccaccacggugacccccacccccacccccacgggcacccagaccccgaccacgacccccaucaccaccacgaccaccgucacccccacccccacgccgaccgggacccagacccccacgaccacccccaucaccacgaccaccaccgugacgcccaccccgacccccaccggcacgcagacccccaccaccacgcccaucaccaccaccacgaccgucaccccgacccccacgcccaccggcacccagaccccgacgaccacccccaucaccacgaccaccaccgugacccccacgcccaccccgaccgggacccagacgcccaccaccacccccaucacgaccaccaccacggugacccccaccccgacccccacgggcacccagacccccaccacgacccccaucaccaccacgaccaccgucaccccgacgcccacccccaccgggacccagacgcccaccaccaccccgaucacgaccaccaccaccgugacgcccacccccacccccaccggcacgcagaccccgaccaccacgcccaucaccaccaccacgaccgugacccccacccccacgccgaccgggacccagacccccacgaccacccccaucaccacgaccaccaccgucacgccgacccccacccccaccggcacgcagacccccaccaccacgccgaucaccaccaccaccacggugacccccacccccacccccacgggcacccagaccccgaccacgacccccaucaccaccacgaccaccgugacccccacgcccaccccgaccgggacccagacgcccaccaccacccccaucacgaccaccaccacggucacccccaccccgacccccacgggcacccagacccccaccacgacccccaucaccaccaccacgaccgugaccccgacccccacgcccaccgggacccagacccccacgaccaccccgaucaccacgaccaccaccgugacgcccacccccacccccaccggcacgcagaccccgaccaccacgcccaucaccaccaccacgaccgucacccccaccccgacgcccaccgggacccagacccccacgaccacccccaucaccaccacgaccaccgugaccccgacgcccacccccaccggcacccagacgcccaccaccaccccgaucacgaccaccaccacggugacccccacccccacccccacgggcacccagaccccgaccacgacccccaucaccaccacgaccaccgucacccccacgcccaccccgaccgggacccagacgcccaccaccacccccaucacgaccaccaccaccgugacgcccaccccgacccccaccggcacgcagacccccaccaccacgcccaucaccaccaccacgaccgugaccccgacccccacgcccaccgggacccagacccccacgaccaccccgaucaccacgaccaccaccgucacgcccacccccaccccgaccggcacgcagaccgggccccccacccacaccuccacggcccccaucgccgagcucaccaccagcaacccgccccccgaguccagcaccccccagaccucccgcagcacguccagcccgcugaccgaguccaccacccugcucagcacgcugccccccgcgaucgagaugaccuccaccgcccccccgagcacccccacggcccccaccaccaccuccggcggccacacgcugagccccccgcccuccaccaccaccagcccccccgggacgccgacccggggcaccaccacgggguccagcagcgcccccacccccuccaccgugcagaccacgaccaccagcgccuggacccccacgccgaccccccucuccacccccagcaucauccgcaccacgggccugcggccguaccccuccagcgugcugaucugcugcguccucaacgacaccuacuacgcgcccggcgaggagguguacaacgggaccuacggcgacaccugcuacuucgugaacugcucccugagcugcacgcuggaguucuacaacugguccugccccagcaccccgucccccacccccacccccagcaaguccaccccgacgcccagcaagcccuccagcacccccuccaagccgacccccgggaccaagccccccgagugcccggacuucgaccccccccgccaggagaacgagacgugguggcucugcgacugcuucauggccaccugcaaguacaacaacaccgucgagaucgugaagguggagugcgagcccccgcccaugcccaccugcagcaacggccugcagcccguccggguggaggacccggacgggugcugcuggcacugggagugcgacugcuacugcacgggcuggggcgacccccacuacgugaccuucgacgggcuguacuacagcuaccagggcaacugcaccuacguccucguggaggagaucucccccagcguggacaacuucggggucuacaucgacaacuaccacugcgaccccaacgacaagguguccugcccgcgcacccugaucgugcgccacgagacgcaggagguccugaucaagaccgugcacaugaugcccaugcaggugcagguccaggugaaccggcaggccguggcccuccccuacaagaaguacggccuggaggucuaccagagcgggaucaacuacgugguggacaucccggagcugggcguccucguguccuacaacggccugagcuucuccgugcgccugcccuaccaccgguucgggaacaacaccaagggccagugcgggaccugcacgaacaccaccagcgacgacugcauccuccccuccggcgagaucgucagcaacugcgaggccgcggccgaccaguggcuggugaacgaccccuccaagccgcacugcccccacagcuccagcaccacgaagcgccccgccgugaccguccccgggggcggcaagaccaccccgcacaaggacugcacgcccuccccccugugccagcucaucaaggacagccuguucgcccagugccacgcgcuggugcccccgcagcacuacuacgacgccugcgucuucgacuccugcuucaugcccgggagcucccucgagugcgccagccugcaggccuacgccgcgcugugcgcccagcagaacaucugccuggacuggcggaaccacacccacggcgccugccucguggagugccccagccaccgcgaguaccaggccugcgggcccgccgaggagccgaccugcaaguccagcuccagccagcagaacaacaccgugcuggucgagggcugcuucugccccgagggcacgaugaacuacgcgcccggguucgacgugugcgugaagaccugcggcugcgucgggcccgacaacgugccgcgggaguucggcgagcacuucgaguucgacugcaagaacugcgugugccuggaggggggcuccggcaucaucugccagcccaagcgcugcagccagaagcccgucacccacugcguggaggacgggaccuaccucgccacggaggugaaccccgccgacaccugcugcaacaucaccgucugcaagugcaacaccucccugugcaaggagaagccgagcgugugcccccugggcuucgaggugaaguccaagaugguccccgggcggugcugccccuucuacuggugcgagagcaagggcgugugcgugcacgggaacgccgaguaccagccgggcucccccgucuacagcuccaagugccaggacugcgugugcacggacaagguggacaacaacacccuccugaacgucaucgccugcacccacgugcccugcaacaccagcugcuccccgggcuucgagcugauggaggcgcccggggagugcugcaagaagugcgagcagacccacugcaucaucaagcgccccgacaaccagcacgugauccucaagcccggcgacuucaagagcgacccgaagaacaacugcacguucuucuccugcgucaagauccacaaccagcugaucagcuccgugagcaacaucaccugccccaacuucgacgccagcaucugcauccccggguccaucaccuucaugcccaacggcugcugcaagaccugcacgccgcggaacgagacccgcgugcccugcagcaccguccccgugaccacggagguguccuacgccgggugcaccaagaccguccugaugaaccacugcagcggcuccugcggcaccuucgugauguacagcgccaaggcgcaggcccucgaccacuccugcagcugcugcaaggaggagaagacgucccagcgggaggugguccugagcugccccaacgggggcucccugacccacaccuacacccacaucgagagcugccagugccaggacacggugugcgggcucccgaccggcaccucccgccgggcccgccggagcccccgccaccugggguccggcuga

SEQ ID NO: 33222 - RNA, 9972 nt, Artificial Sequence
  derived and/or modified sequence opt1 from MUC3A__Homo_sapiens__NP_005951
augcagcugcucggccugcuggggcuccuguggaugcugaaggccucccccugggccaccggcacccucuccaccgcgaccuccaucucccagguccccuucccccgcgccgaggccgccagcgccguccuguccaacagcccccacucccgggaccuggcgggguggccccucggcgugccccagcuggccagccccgcccccgggcaccgcgagaacgcccccaugacccugaccaccagcccccacgacacccucaucuccgagacccugcugaacucccccgugagcuccaacaccagcaccacccccaccuccaaguucgcguucaaggucgagaccacgccgcccaccgugcucguguacagcgccaccaccgagugcgucuaccccacguccuucaucaucaccaucagccaccccaccuccaucugcgugaccacgacccagguggccuucaccagcagcuacaccuccacgcccgucacccagaagcccgugaccaccgugacgagcaccuacuccaugaccaccacggagaagggcaccagcgccaugaccuccagccccuccaccacgaccgcccgggagacccccaucgucaccgugacccccagcuccgugagcgcgacggacaccaccuuccacaccacgaucuccagcaccacccgcaccacggagcggacgccccugcccaccggcuccauccacaccaccaccagccccacccccgucuucaccacgcugaagaccgccgugaccuccaccagccccaucacguccagcaucaccuccaccaacaccgugacgagcaugaccaccaccgccagccagcccacggccaccaacacccucuccagccccacccgcacgauccuguccagcacccccguccuguccaccgagaccaucacgagcgggaucaccaacaccacgccccucuccacccuggugaccacccugcccaccaccaucagccgguccacgcccaccagcgagaccaccuacacgaccucccccaccagcaccgugacggacuccaccaccaagaucgccuacagcaccuccaugacgggcacccucagcaccgagaccucccugccgcccacgagcagcucccugcccaccaccgagaccgcgacgacccccaugaccaaccucgucaccacgaccaccgagaucagcucccacagcacccccuccuucagcuccagcacgaucuacuccaccgugagcaccuccaccacggccaucagcucccugccgcccaccagcgggaccauggugaccuccaccacgaugacccccagcucccugagcaccgacauccccuucaccacgcccaccaccaucacccaccacuccgucggcagcacgggguuccucaccaccgccaccgaccugacgagcaccuucaccguguccagcuccagcgccauguccaccagcgucauccccuccagccccuccauccagaacacggagaccagcucccuggugagcaugaccuccgccaccacgcccaacgugcgccccaccuucgucagcacccucuccacccccacgagcucccugcugaccaccuuccccgcgaccuacagcuucuccagcagcauguccgccagcuccgccggcacgacccacaccgagagcaucuccuccccgcccgccuccaccagcacgcuccacaccaccgccgaguccacccuggcgcccacgaccaccaccagcuucacgaccuccaccaccauggagccgcccagcaccacggccgccaccaccggcaccgggcagacgaccuucaccuccagcaccgccacguuccccgagaccaccacccccacgccgaccaccgacauguccaccgagagccugacgaccgcgaugaccagcccgcccaucaccagcuccgugacgagcaccaacaccgugaccagcaugacgaccaccaccuccccgcccacgaccaccaacagcuucaccucccucacgagcaugccccuguccagcacccccgucccguccaccgagguggugaccagcggcacgaucaacaccaucccgcccuccauccuggucaccacccuccccaccccgaacgccagcuccaugacgaccagcgagaccaccuaccccaacucccccacggggcccggcaccaacagcaccaccgagaucacguacccgaccaccaugaccgagacguccagcaccgccaccucccugccgcccaccagcccccugguguccacggccaagaccgccaagaccccgaccacgaaccucgugaccaccaccacgaagaccaccagccacagcaccacguccuucaccagcuccaccgucuacagcaccgcguccacguacaccaccgccaucaccagcgugcccacgacccugggcaccauggugaccuccaccagcaugaucuccagcacggucuccaccgggauccccaccagccagcccaccacgaucaccccguccagcgugggcaucuccgggagccugcccaugaugaccgaccucaccuccguguacacggucagcaacauguccgcccggcccaccaccgugauccccagcagcccgaccgugcagaacacggagaucuccaucagcgucuccaugaccagcgccaccacccccuccggcgggcccacguucaccagcaccgagaacacccccacgcgcucccugcugaccagcuucccgaugacccacuccuucagcuccagcauguccgagagcuccgccggcaccacgcacaccgagagcaucuccagcccccggggcaccaccagcacgcugcacaccaccguggaguccacccccagcccgacgaccaccaccuccuucacgaccagcaccaugauggagccgcccuccagcaccguguccaccacggggcgcggccagaccaccuuccccagcuccaccgcgacguucccggagaccaccacccucacgcccaccaccgacaucagcaccgucucccugacgaccgccaugaccuccccgccgcccguguccagcuccaucacccccacgaacaccaugaccagcaugcggaccacgaccuacuggcccaccgccaccaacacgcugagcccccucaccagcuccauccugagcagcacccccgugcccuccaccgagaugaucacgagccacaccaccaacaccacgccccuguccacccucgucaccacccugcugacgaccaucacccgcagcacccccaccuccgagacgaccuacccgaccagccccaccuccaucgugagcgacuccacgaccgagaucaccuacagcaccuccaucacggggacccucagcaccgccaccacgcugccgcccaccuccagcucccugccgaccaccgagacggccaccaugacccccaccacgacccucaucaccaccacgcccaacaccaccagccuguccacccccagcuucacguccagcaccaucuacagcaccguguccaccagcacgaccgcgaucuccagcgccuccccgaccagcggcaccauggucacguccaccaccaugacccccagcucccugagcacggacacccccuccaccacccccaccacgaucaccuacccgagcgugggguccaccggcuuccucaccacggccaccgaccugaccagcaccuucacgguguccagcuccagcgccauguccaccagcgucauccccagcucccccagcauccagaacaccgagaccuccagccugguguccaugacgagcgcgaccaccccgucccuccggcccaccaucacgagcaccgacuccacccugaccagcucccugcucacgaccuuccccagcaccuacuccuucagcuccagcauguccgccagcuccgccggcaccacgcacaccgagaccaucagcagccugcccgccuccaccaacacgauccacaccaccgccgagagcgcgcuggccccgaccacgaccaccuccuucaccacgagccccaccauggagccgcccuccaccaccguggccaccacggggaccggccagaccaccuucccgagcuccacggccaccuuccucgagaccaccacgcugacccccaccaccgacuucagcacggagucccugaccaccgccaugaccagcacgccgcccaucaccuccagcaucaccccgaccgacacgaugaccuccaugcgcaccaccacgagcuggcccaccgcgaccaacacccucagcccccucacgagcuccauccugagcuccacccccgucccgagcaccgaggugaccacgagccacaccaccaacaccaaccccguguccacgcucgucaccacccugcccaucaccaucacccggagcacgcugaccuccgagaccgccuaccccagcuccccgaccagcacggugaccgaguccaccaccgagaucacguaccccaccaccaugaccgagacgagcuccaccgccaccagccugccgcccaccuccagccugguguccacggccgagaccgccaagaccccgaccacgaaccuggucaccaccaccacgaagaccaccagccacuccaccacgagcuucaccuccagcaccaucuacagcaccgcguccacgcccaccaccgccaucaccagcgugcccacgacccucgggaccauggugaccuccaccagcaugaucccguccacggucagcaccggcauccccaccucccagcccaccacgaucacccccagcuccguggggaucagcggcucccugccgaugaugaccgaccugaccagcguguacacggucuccagcauguccgcccgccccaccagcgugauccccuccagccccaccgugcagaacaccgagacguccaucuucgucagcaugaugagcgccaccaccccguccggcgggcccaccuucacgagcaccgagaacacccccacccggucccuccugacgagcuuccccgugacccacuccuucagcuccagcauguccgcgagcuccgucggcaccacccacacgcagagcaucuccagcccgcccgccaucaccuccacccugcacaccacggccgagagcacccccucccccaccaccacgaugagcuucaccaccuucaccaagauggagacgccguccagcaccguggccaccaccgggaccggccagacgaccuucaccagcuccaccgccacgagccccaagaccaccacccucacgcccaccuccgacaucagcaccggcuccuucaagaccgcggugagcuccacgcccccgaucaccagcuccaucaccagcaccuacacggucaccuccaugaccaccacgacgccccuggggcccaccgccaccaacacgcugcccagcuucaccuccagcguguccagcuccaccccggugcccagcaccgaggccaucacguccggcaccaccaacaccacgccccucagcacccuggucaccaccuucagcaacuccgacacgagcuccacccccaccagcgagaccaccuacccgacgucccugaccagcgcccucaccgacuccaccacgcgcaccaccuacagcaccaacaugacggggacccuguccaccgugaccagccugcggcccacguccagcucccuccugaccaccgugaccgccacgguccccaccaccaaccuggugaccacgaccaccaagaucaccagccacuccacgccgagcuucaccuccagcaucgcgaccaccgagacgcccucccacagcacgccccgcuucaccagcuccaucaccacgaccgagacccccagccacuccaccccgcgcuucacgagcuccaucaccaacaccaagaccaccagccacuccagccccuccuucacgagcuccaucaccaccaccgagacgaccagccacaacacccccucccucaccagcuccaucacgaccaccaagaccacgagccacuccacccccagcuacaccucccugaucaccacgaccaccaccacgagccacagcaccccguccuucaccagcuccaucaccacgaccgagaccaccagccacaacacgcccucccugaccagcuccaucaccaccacggagaccaccagccacuccacccccagcuucacguccagcaucaccaccgagaccacgucccacagcacccccuccuucaccagccucaucaccaucaccgagaucacgucccacagcacccugagcuacaccaccuccaucacgaccaccgagaccccgagccacuccacgcugagcuucaccuccagcaucaccaccacggagaccaccucccacagcacccccuccuucacgagcuccaucaccaccagcgagaugcccucccacagcacccccuccuucacgagcuccaucaccaccaccgagaacgccacgcacagcaccccgaacuucaccuccagcaucaccacgaccgagaccaccagccacuccacgcccagcuucaccucccucaucaccaccacggagaccaccagccaccgguggggcaccaccgagacgaccuccuacagcacccccuccuucaccagcuccaacacgaucaccgagaccaccagccacuccacgcccagcuacaucaccuccaucaccaccacggagaccccgagcuccagcacccccuccuucagcuccagcaucaccacgaccgagaccaccagccacuccacgcccggguucaccagcuccaucaccaccacggagaccaccagccacuccacccccagcuucacguccagcaucaccaccaccgagacgaccucccacgacaccccgagcuucaccuccagcaucacgaccuccgagacccccagccacuccacccccagcuccaccagccugaucacgaccaccaagaccacgucccacagcacccccagcuucaccuccagcaucaccacgaccgagaccaccucccacagcgcccacuccuucacgagcuccaucaccaccaccgagacgaccagccacaacacccgcuccuucaccagcuccaucacgaccaccgagaccaacagccacuccacgaccagcuucaccuccagcaucaccacgaccgagaccaccucccacagcacgccguccuucagcagcuccaucaccaccaccgagacgccccugcacagcacccccggccucaccuccugggugaccaccacgaagaccaccagccacaucaccccgggccugacguccagcaucaccaccaccgagacgaccucccacagcacccccggguucaccuccagcaucacgaccaccgagaccacguccgagagcacccccucccugagcuccagcaccaucuacuccaccgucagcacguccaccaccgccaucaccagccacuucacgaccagcgagaccgccgugacccccacgccggugacccccuccagccucuccaccgacauccccaccacgagccugcggacccugacccccuccagcgucggcaccuccacgagccucaccaccaccaccgacuucccguccauccccacggacaucagcacccugcccacccgcacccacaucaucuccagcucccccagcauccaguccacggagaccagcucccugguggggaccaccagcccgacgaugagcaccgugcggaugacccuccgcaucaccgagaacacgcccaucuccagcuucuccaccagcaucgucgugauccccgagacccccacccagacgccgcccgugcugaccuccgcgaccggcacccagacgagccccgcccccaccaccgucaccuucggguccacggacagcuccaccagcacccugcacacccucacgccguccaccgcccugagcaccaucguguccaccagccaggugcccauccccuccacgcacagcuccacccugcagaccacccccagcacgccgucccuccagaccagccugaccagcaccuccgaguucaccacggagagcuucacccggggcuccaccagcaccaacgccauccugacguccuucagcaccaucaucugguccagcacccccaccaucaucauguccagcucccccagcuccgccagcaucacgcccgucuucuccaccaccauccacagcgugccguccagccccuacaucuucuccaccgagaacgugggcagcgcgagcaucacgggguuccccucccucagcuccagcgccaccaccuccaccagcuccacgagcuccagccugaccaccgcccugaccgagaucacgccguucuccuacaucagccuccccuccaccacccccugccccggcaccaucacgaucaccaucgucccggccagccccaccgaccccugcguggagauggaccccuccaccgaggcgacgagcccgcccaccacgccccugaccguguuccccuucacgaccgagauggugaccugcccgaccuccaucagcauccagacgacccugaccaccuacauggacacguccagcaugaugcccgagagcgaguccagcaucucccccaacgccagcuccagcaccgggaccggcaccgugcccaccaacacgguguucaccuccacccgccucccgaccagcgagacguggcuguccaacagcuccgucaucccccugccccuccccggggugagcaccaucccgcugaccaugaagcccuccagcucccugcccaccauccuccggacgagcuccaagagcacccaccccuccccgcccaccacccgcacgagcgagacccccguggccaccacccagacgccgaccacccugaccagccggcgcacgacccggaucaccucccagaugaccacgcagagcacccugaccaccacggccgggaccugcgacaacggcggcaccugggagcagggccagugcgccugccugcccggguucuccggcgaccgcugccagcuccagacccggugccagaacgggggccagugggacggccugaagugccagugccccagcacguucuacggguccagcugcgaguucgcggucgagcaggucgaccuggacgugguggagaccgaggugggcauggagguguccgucgaccagcaguucagccccgaccucaacgacaacaccucccaggccuaccgcgacuucaacaagaccuucuggaaccagaugcagaagaucuucgccgacaugcagggguucacguucaagggcguggagauccugagccugcggaacggcuccaucguggucgacuaccucgugcugcuggagaugccguucagcccccagcucgaguccgaguacgagcaggucaagaccacccugaaggaggggcugcagaacgccagccaggacgugaacuccugccaggacagccagacccucugcuucaagcccgacuccaucaaggugaacaacaacagcaagaccgagcugacgcccgccgcgaucugccgccgggccgccccgaccggcuacgaggaguucuacuucccccugguggaggccacccgccuccgcugcgucaccaagugcacguccgggguggacaacgccaucgacugccaccagggccagugcguccuggagaccagcgggccgaccugccggugcuacagcaccgacacgcacugguucuccggcccccgcugcgagguggcggugcacuggcgggcccuggucggcgggcucaccgccggcgccgcgcugcuggugcuccugcugcucgcccugggggugcgcgccguccggagcggcugguggggcgggcagcgccggggccgcuccugggaccaggaccggaagugguucgagaccugggacgaggaggugguggggaccuucagcaacuggggcuucgaggacgacgggacggacaaggacaccaacuucuacgucgcccuggagaacguggacaccaccaugaaggugcacaucaagcgcccggagaugacguccagcuccgucuga

SEQ ID NO: 33223 - RNA, 3531 nt, Artificial Sequence
  derived and/or modified sequence opt1 from MUC4__Homo_sapiens__NP_004523
augaagggcgcccgcuggcggcgcgugcccugggucagccuguccugccucugccugugccugcucccgcacguggugcccgggaugaccacccccagccugaagacggacggcgggcggcgcaccgccaccagcccgccgcccaccacgucccagaccaucaucuccaccauccccagcaccgcgaugcacacgcgguccaccgccgcccccauccccauccugcccgagcgcggcgucagccucuuccccuacggggccggcgccggcgaccuggaguucgugcggcgcaccguggacuucaccagcccccuguucaagccggcgacgggguucccccucggcuccucccugcgggacagccuguacuucaccgacaacgggcagaucaucuuccccgaguccgacuaccagaucuucagcuaccccaacccgcuccccaccggcuucaccgggcgcgaccccgucgcccugguggcccccuucugggacgacgccgacuucuccacgggccggggcaccaccuucuaccaggaguacgagaccuucuacggggagcacagccugcucgugcagcaggcggaguccuggauccgcaagaugacgaacaacggcggguacaaggcccggugggcccugaaggucaccugggugaacgcccacgccuacccggcgcaguggacccugggcagcaacaccuaccaggccauccucuccacggacggcagccgcagcuacgcccuguuccuguaccaguccgggggcaugcagugggacguggcccagcggagcgggaaccccguccucaugggcuucuccagcggggacggcuacuucgagaacagcccccugaugucccagcccgugugggagcgcuaccggccggaccgcuuccugaacuccaacagcggccuccaggggcugcaguucuaccggcugcaccgcgaggagcggcccaacuaccgccucgagugccugcaguggcugaagucccagccccgcuggcccagcuggggcuggaaccagguguccugcccgugcagcuggcagcaggggcggcgcgaccuccgguuccagcccgucuccaucggccgcugggggcugggcagccggcagcugugcuccuucaccagcuggcgcggcggggugugcugcuccuacggccccuggggcgaguuccgggagggguggcacgugcagcgcccguggcagcucgcccaggagcuggagccccagagcuggugcugccgguggaacgacaagcccuaccugugcgcgcucuaccagcagcgccggccccacgucgggugcgccaccuaccgcccgccccagcccgccuggauguucggcgacccccacaucaccacccuggacggcguguccuacaccuucaacgggcugggcgacuuccuccuggugggggcccaggacggcaacagcagcuuccugcuccagggccggaccgcccagaccggguccgcgcaggccacgaacuucaucgccuucgccgcccaguaccgcagcuccagccugggcccggucaccgugcaguggcugcucgagccccacgacgcgauccgggugcugcuggacaaccagaccgucaccuuccagcccgaccacgaggacgggggcgggcaggagacguucaacgccaccggcgugcuccugucccgcaacggcagcgaggucuccgccagcuucgacgggugggccaccguguccgugaucgcgcugagcaacauccugcacgccuccgccagccugcccccggaguaccagaaccggaccgagggccugcugggggucuggaacaacaaccccgaggacgacuuccgcaugcccaacggcuccaccaucccgcccgggagccccgaggagaugcuguuccacuucggcaugacguggcagaucaacggcaccgggcugcugggcaagcggaacgaccagcuccccuccaacuucacccccguguucuacagccagcugcagaagaacuccagcugggccgagcaccugaucagcaacugcgacggggacuccagcugcaucuacgacacccucgcccugcgcaacgcguccaucggccugcacacgcgcgaggugagcaagaacuacgagcaggccaacgccacccucaaccaguacccgcccuccaucaacgggggccgggucaucgaggccuacaagggccagaccacccugauccaguacacgagcaacgccgaggacgcgaacuucacccugcgcgacuccugcaccgaccucgagcuguucgagaacgggacccugcucuggacgcccaagagccuggagcccuucacccuggagauccucgcccgguccgccaagaucggccuggccagcgcccugcagccgcgcaccguggugugccacugcaacgcggagucccagugccucuacaaccagaccagccgggucgggaacuccagccuggagguggccggcugcaagugcgacgggggcacguucggccgcuacugcgagggguccgaggacgccugcgaggagcccugcuuccccagcgugcacugcgucccgggcaaggggugcgaggccugcccgcccaaccugaccggcgacggccggcacugcgcggcccucggguccagcuuccugugccagaaccaguccugccccgugaacuacugcuacaaccagggccacugcuacaucagccagacccuggggugccagcccaugugcacgugcccgcccgccuucaccgacagccgcugcuuccucgccggcaacaacuucucccccaccgugaaccuggagcugccccuccgggucauccagcugcugcucagcgaggaggagaacgccuccauggcggaggugaacgccagcguggccuaccgccuggggacccuggacaugcgggccuuccuccgcaacucccaggucgagcggaucgacagcgccgcgcccgccuccggcagccccauccagcacuggauggugaucuccgaguuccaguaccgcccccggggcccggugaucgacuuccugaacaaccagcugcucgccgccgucguggaggccuuccuguaccacgugccccgccggagcgaggagccccgcaacgacgucguguuccagcccaucuccggggaggacgugcgggacgucaccgcgcugaacgugagcacgcucaaggccuacuuccgcugcgacggcuacaagggguacgaccugguguacuccccgcagagcggcuucacgugcgucucccccugcagccggggguacugcgaccacggcggccagugccagcaccuccccuccgggccccgcugcagcugcguguccuucagcaucuacaccgccuggggcgagcacugcgagcaccucagcaugaagcuggacgccuucuucgggaucuucuucggcgcgcucgggggccuccugcugcucggcguggggaccuucgucgugcugcgcuucuggggcugcuccggggcccgguucagcuacuuccugaacuccgccgaggcccucccguga

SEQ ID NO: 33224 - RNA, 16965 nt, Artificial Sequence
  derived and/or modified sequence opt1 from MUC5AC__Homo_sapiens__NP_001291288
augagcgugggccgccggaagcuggcccuccugugggcccuggcgcucgcccuggccugcacccgccacaccgggcacgcccaggacggcuccagcgaguccagcuacaagcaccaccccgcccuguccccgaucgcgcgggggcccagcggcgucccccuccgcggggccacgguguuccccucccugcggaccaucccggugguccgcgccagcaaccccgcccacaacggccgggugugcuccaccuggggcagcuuccacuacaagaccuucgacggggacguguuccgcuuccccggccugugcaacuacgucuucuccgagcacugcggggcggccuacgaggacuucaacauccagcuccggcgcagccaggaguccgccgcccccacgcugagccgggugcugaugaagguggacggcgucgugauccagcucaccaagggguccgugcuggucaacggccacccggugcugcuccccuucagccaguccggcgugcugauccagcagagcuccagcuacaccaaggucgaggcccgccuggggcucgugcugauguggaaccacgacgacagccugcuccuggagcuggacaccaaguacgcgaacaagacgugcggccucugcggggacuucaacggcaugcccguggucuccgagcugcugagccacaacaccaagcucacccccauggaguucggcaaccugcagaagauggacgacccgaccgaccagugccaggaccccgugcccgagcccccgcggaacugcuccacgggguucggcaucugcgaggagcugcuccacgggcagcuguucagcggcugcguggcccuggucgacgugggguccuaccucgaggccugccgccaggaccugugcuucugcgaggacaccgaccugcucagcugcgugugccacacccuggccgaguacucccggcagugcacccacgccggcggccugccccaggacuggcgcgggcccgacuucugcccccagaagugcccgaacaacaugcaguaccacgagugccggagccccugcgcggacacgugcuccaaccaggagcacagccgcgccugcgaggaccacugcgucgccggcugcuucugccccgaggggaccgugcucgacgacaucggccagaccgggugcguccccguguccaagugcgccugcguguacaacggcgccgcguacgccccgggcgccaccuacagcacggacugcaccaacugcaccugcuccgggggccgguggagcugccaggagguccccugccccgggaccugcuccgugcugggcggggcccacuucagcacguucgacggcaagcaguacaccgugcacggcgacugcuccuacguccugaccaagcccugcgacagcuccgccuucaccgugcucgcggagcugcgccggugcgggcugacggacagcgagaccugccucaagagcgugacccugucccuggacggcgcccagaccgucguggugaucaaggccagcggggaggucuuccucaaccagaucuacacgcagcugccgaucuccgccgcgaacgugaccaucuuccgccccagcaccuucuucaucaucgcccagaccucccugggccugcagcucaaccugcagcuggugcccacgaugcagcucuucaugcagcuggccccgaagcugcgcggccagaccugcgggcucugcggcaacuucaacagcauccaggccgacgacuuccggacccuguccggggucguggaggccaccgcggccgccuucuucaacaccuucaagacgcaggccgccugccccaacauccgcaacagcuucgaggaccccugcucccugagcguggagaacgagaaguacgcgcagcacuggugcucccagcucaccgacgccgacggccccuucgggcggugccacgccgccgucaagccgggcaccuacuacagcaacugcauguucgacaccugcaacugcgagcgcuccgaggacugccugugcgccgcgcugagcuccuacgugcacgccugcgccgccaagggcgugcagcucgggggcuggcgggacggggucugcacgaagcccaugaccaccugccccaagagcaugaccuaccacuaccacguguccacgugccagcccaccugccgcagccugagcgagggcgacaucaccugcuccgugggguucaucccggucgacggcugcaucugccccaagggcaccuuccuggacgacacggggaagugcgugcaggcgagcaacugccccugcuaccaccggggcuccaugauccccaacggggagagcgugcacgacuccggcgccaucugcaccugcacccacgggaagcucagcugcaucggcggccaggccccggcccccgucugcgccgcgcccaugguguucuucgacugccgcaacgccacccccggggacacgggcgccgggugccagaaguccugccacacccuggacaugaccugcuacagcccgcagugcgugcccggcugcgucugccccgacgggcugguggccgacggcgagggcgggugcaucaccgccgaggacugccccugcgugcacaacgaggcguccuaccgggccggccagacgauccgcgucgggugcaacaccugcaccugcgacagccggauguggcgcugcaccgacgacccgugccucgccacgugcgccguguacggcgacggccacuaccugaccuucgacgggcaguccuacagcuucaacggcgacugcgaguacacccuggugcagaaccacugcgggggcaaggacuccacccaggacagcuuccgggucgugacggagaacgugcccugcgggaccaccggcaccacgugcuccaaggccaucaagaucuuccucggcggguucgagcugaagcugagccacggcaaggucgaggugaucgggaccgacgagucccaggaggugcccuacaccauccgccagaugggcaucuaccucgucguggacaccgacaucgggcuggugcugcucugggacaagaagacgagcaucuucaucaaccugucccccgaguucaagggccgggucugcggccugugcgggaacuucgacgacaucgcggugaacgacuucgccacccgcagccggagcguggucggcgacgugcucgaguucgggaacuccuggaagcugagcccguccugccccgacgcccuggcccccaaggacccgugcaccgcgaaccccuuccgcaagagcugggcccagaagcagugcuccauccuccacggccccaccuucgccgccugccacgcccacguggagcccgcgcgguacuacgaggccugcgucaacgacgccugcgccugcgacagcgggggcgacugcgagugcuucugcaccgccguggcggccuacgcccaggccugccacgaggucggccugugcguguccuggcgcacgccgagcaucugcccccuguucugcgacuacuacaaccccgaggggcagugcgaguggcacuaccagcccugcggcgugccgugccuccgcaccugccggaacccccgcggggacugccugcgggacguccgcggccuggagggcugcuaccccaagugccccccggaggcccccaucuucgacgaggacaagaugcagugcguggcgaccugccccacccccccgcuccccccccggugccacgugcacgggaaguccuaccgccccggcgccgucgugccgagcgacaagaacugccaguccugccugugcacggagcgggggguggagugcaccuacaaggccgaggccugcgucugcaccuacaacggccagcgcuuccaccccggggacgugaucuaccacaccacggacggcaccggcgggugcaucagcgcccggugcggcgcgaacgggaccaucgagcgccggguguaccccugcucccccaccacgccggucccccccaccaccuucagcuucuccacccccccgcugguggugagcuccacgcacacccccagcaacggccccuccagcgcccacaccgggccgcccagcuccgccuggcccaccacggccggcaccagcccccgcacccggcucccgaccgcguccgccagccugccccccgucugcggcgagaagugccuguggucccccuggauggacgugagccgcccggggcggggcacggacuccggggacuucgacacccucgagaaccugcgcgcccacggcuaccgggugugcgagagcccccgcuccgucgagugccgggccgaggacgcccccggggugccccugcgcgcgcucggccagcgggugcagugcagcccggacgucggccugaccugccgcaaccgcgagcaggccuccgggcugugcuacaacuaccagauccgggugcagugcugcaccccccuccccugcagcacguccagcucccccgcccagaccaccccgcccaccacgagcaagaccaccgagacccgcgccuccggcagcuccgcccccagcagcacgcccgggaccgugucccugagcaccgcgcggaccaccccggcccccggcacggccaccuccgucaagaagaccuucagcacccccucccccccgcccgugcccgccacgagcaccuccagcauguccaccaccgcccccgggacgagcguggucuccagcaagccgacccccaccgagcccuccaccagcuccugccugcaggagcucugcacguggaccgaguggaucgacggcagcuacccggcgcccggcaucaacgggggcgacuucgacaccuuccagaaccugcgcgacgagggguacaccuucugcgaguccccccggagcgugcagugccgcgccgaguccuuccccaacacgccgcuggccgaccucggccaggacgugaucugcagccacaccgagggccugaucugccugaacaagaaccagcucccccccaucugcuacaacuacgagauccggauccagugcugcgagaccgucaacgugugccgcgacaucacccggcugcccaagacgguggccaccacccgcccgaccccccaccccacgggggcgcagacccagaccaccuucacgacccacaugcccagcgccuccaccgagcagccgaccgccacgagccggggcgggcccaccgccaccuccgucacccagggcacgcacaccacccuggugacccgcaacugccacccccggugcacguggaccaagugguucgacguggacuuccccagcccggggccccacggcggcgacaaggagaccuacaacaacaucauccgcuccggggagaagaucugccggcgccccgaggagaucacccggcuccagugccgcgccaagagccaccccgaggucuccaucgagcaccugggccagguggugcagugcagccgggaggaggggcuggucugccgcaaccaggaccagcagggcccguucaagaugugccucaacuacgaggugcgcgugcugugcugcgagaccccccgggggugccacaugacguccacccccggcagcaccuccagcucccccgcgcagaccacgccgagcaccaccuccaagaccacggagacccaggccagcggcuccagcgcccccuccagcacccccgggaccgucagccuguccacggcccgcaccaccccggcccccggcaccgcgacgagcgugaagaagaccuucuccacccccagccccccgcccgugcccgccaccuccacgagcuccaugagcaccaccgcccccgggaccuccgucgugagcuccaagccgacgcccaccgagcccagcaccuccagcugccuccaggagcugugcaccuggacggaguggaucgacggcuccuaccccgccccggggaucaacggcggcgacuucgacaccuuccagaaccugcgggacgagggguacaccuucugcgagagcccccgcuccgugcagugccgggccgagagcuuccccaacaccccccucgcggaccugggccaggacgucaucugcagccacacggaggggcugaucugccucaacaagaaccagcugccgcccaucugcuacaacuacgagauccgcauccagugcugcgagaccgugaacgugugccgggacaucacccgcccccccaagaccgucgccacgacccggccgaccccccaccccaccggcgcccagacccagacgaccuucaccacccacaugcccuccgccagcacggagcagccgaccgcgaccucccgcgggggccccaccgccacgagcgugacccagggcacccacaccacgcccgucacccggaacugccacccccgcugcaccuggaccacgugguucgacguggacuucccgucccccgggccccacggcggggacaaggagaccuacaacaacaucauccggagcggcgagaagaucugccgccggccggaggagaucacccgccugcagugccgggccaagucccaccccgaggugagcaucgagcaccucggccaggucgugcagugcucccgcgaggaggggcuggugugccggaaccaggaccagcagggccccuucaagaugugccugaacuacgagguccgcgugcucugcugcgagacccccaaggggugcccggugacgagcacccccgucaccgcccccuccacccccagcggccgggccacguccccgacccagagcaccuccagcuggcagaagucccgcaccacgacccuggugaccaccagcacgaccuccaccccccagaccagcacgaccuacgcgcacaccaccagcaccacguccgcccccaccgcccgcaccaccagcgcccccacgacccggaccaccuccgccagcccggcguccacgaccagcgggcccggcaacacccccucccccgugccgaccacgagcaccaucuccgcccccaccaccagcaucacguccgcccccaccaccagcaccacguccgcccccaccagcuccaccaccagcggcccggggacgacccccucccccguccccaccaccagcaucacguccgccccgaccaccagcaccacgagcgcgcccaccaccuccaccacgagcgcccgcaccuccagcaccaccuccgccaccacgaccagccggaucuccggccccgagaccacccccagcccggugcccacgaccuccaccaccagcgccacgaccaccuccaccacgagcgcccccaccaccuccaccacgagcgcgccgaccuccagcaccaccuccagcccccagacguccaccaccagcgcccccaccacgagcaccaccuccgggcccggcaccacgccgagccccgugcccaccaccuccaccacgagcgcccccaccacccgcaccacguccgccccgaagagcuccaccaccagcgcggccaccaccuccacgaccagcgggcccgagaccaccccccggcccgucccgacgaccuccaccaccagcucccccacgaccagcaccaccuccgcccccacgaccagcaccaccuccgccagcacgaccuccaccaccagcggcgccggcacgacccccagcccggugcccaccaccuccacgaccagcgcgcccaccaccuccacgaccagcgcccccaucuccagcaccaccuccgccacgaccaccagcaccacguccgggccgggcaccacccccagccccgugcccaccacguccaccaccagcgccccgaccaccuccacgaccagcgggcccggcaccacccccuccgccguccccacgaccagcaucaccuccgcgccgaccacgagcaccaacuccgcccccaucagcagcaccaccuccgccacgaccaccagccgcaucuccgggcccgagaccacgccgagccccgugcccaccgccuccaccaccagcgccuccacgaccagcaccaccuccggccccggcacgaccccgagccccgugcccaccaccuccacgaucagcguccccaccaccuccaccacgagcgcguccaccaccagcaccacguccgccagcaccaccagcaccaccuccgggccgggcacgacccccagccccgugcccaccaccuccacgaccagcgccccgaccaccuccacgaccagcgcccccaccaccuccacgaucagcgcgcccaccaccuccaccacgagcgccaccaccaccuccacgaccagcgcccccaccccgcggcgcaccuccgcccccacgaccagcaccaucuccgccagcaccacguccaccaccagcgcgaccacgaccuccaccaccagcgccacgaccaccagcaccaucuccgcccccaccacgagcaccacccugucccccaccacgagcaccaccuccaccacgaucaccagcaccaccuccgccccgaucagcuccacgaccagcaccccccagaccuccacgaccagcgcccccaccaccuccacgaccagcgggcccggcaccaccuccagcccggugcccacgaccuccaccaccagcgcgcccacgaccuccaccaccagcgccccgacgacccggaccaccagcguccccacguccagcaccaccuccaccgccaccacgagcaccaccuccggccccgggaccacgcccagcccggugcccaccaccuccaccacgagcgcccccaccacccgcaccacguccgcccccaccaccagcaccacguccgcgccgaccaccagcaccacguccgcccccaccagcuccaccaccagcgccacgaccaccuccaccaucagcgugcccacgaccuccaccaccagcguccccggcacgaccccgagccccgugcccaccaccuccacgaucagcgugcccaccaccuccaccaccagcgccuccacgaccagcaccaccuccgggccgggcacgacccccagccccguccccaccaccuccacgaccagcgcgccgaccaccuccacgaccagcgcccccaccaccuccacgaucagcgcccccaccaccuccacccccagcgccccgacgaccuccaccacccucgcccccacgaccagcaccaccuccgcgcccacgaccagcaccaccagcacgcccaccuccagcaccaccuccagcccgcagacguccaccaccagcgccuccaccaccagcaucacguccgggcccggcaccacccccagcccggugcccaccacguccaccaccagcgcccccaccacguccaccaccagcgccgccaccacguccaccaucagcgcgcccaccaccuccacgaccagcgccccgaccaccuccacgaccagcgccagcaccgccuccaagaccagcggccuggggacgacccccucccccauccccaccaccagcacgaccuccccgcccaccaccagcacgaccuccgccagcaccgcguccaagaccagcggccccgggacgacccccuccccggugcccaccaccagcaccaucuucgccccccggacguccaccaccagcgccuccaccacgagcaccacccccggcccggggaccacgcccucccccguccccaccaccagcaccgccagcguguccaagacgagcaccucccacgugagcaucuccaagaccacccacagccagccggucacgcgcgacugccaccugcggugcaccuggaccaagugguucgacaucgacuuccccucccccggcccccacggcggggacaaggagaccuacaacaacaucauccgcagcggcgagaagaucugccggcgcccggaggagaucacgcggcuccagugccgcgccgagucccaccccgaggugagcaucgagcaccuggggcaggugguccagugcucccgggaggagggccuggugugccgcaaccaggaccagcaggggcccuucaagaugugccucaacuacgaggugcgcguccugugcugcgagacccccaagggcugcccggugaccagcacccccgugacggcgcccuccaccccgagcggccgggccaccucccccacccagagcacguccagcuggcagaagucccgcaccaccacccuggucacgaccagcaccaccagcacgccccagaccuccaccaccagcgcccccacgaccuccaccaccagcgccccgaccacguccaccaccagcgcgcccaccacguccaccaccagcaccccccagacguccaucagcuccgcccccaccagcuccaccaccagcgccccgacguccagcaccaucuccgcccggaccaccagcaucaucuccgcccccacgaccagcaccaccagcucccccacgaccagcaccaccuccgcgacgaccaccagcaccacguccgcccccaccagcuccaccaccagcacgccgcagaccuccaagaccagcgccgccaccuccagcacgaccuccgggagcggcaccacccccucccccgugaccacgaccagcaccgccuccgugagcaagaccuccacgagccacgucagcguguccaagaccacccacagccagcccgugacccgcgacugccacccgcggugcacguggaccaagugguucgacgucgacuuccccucccccgggccccacggcggggacaaggagaccuacaacaacaucauccgcagcggcgagaagaucugccggcgcccggaggagaucacccggcuccagugccgcgcgaagucccaccccgaggugagcaucgagcaccugggccaggucgugcagugcucccgggaggaggggcuggugugccgcaaccaggaccagcagggccccuucaagaugugccugaacuacgagguccgggugcucugcugcgagacgcccaaggggugcccggugaccagcaccuccgucaccgcccccagcacgcccuccggccgcgccaccagcccgacccaguccaccagcuccuggcagaagagccggacgaccacccuggugaccuccagcaucacguccaccacccagaccagcacgaccagcgcccccaccaccuccacgacccccgccagcauccccuccaccaccagcgcgccgacgaccuccaccaccagcgcccccaccacguccaccaccagcgcccccaccacguccaccaccagcaccccccagacgaccaccuccagcgccccgaccuccagcacgaccuccgcgcccaccaccagcacgaucuccgcccccaccaccagcaccaucuccgcccccacgaccagcaccaccagcgccccgacggccuccaccaccagcgcgcccaccuccacgagcuccgcccccaccaccaacaccacgagcgcccccaccaccuccaccacgagcgccccgaucaccuccaccaucagcgcccccaccaccuccacgaccagcaccccccagaccuccacgaucagcucccccaccaccagcaccacguccaccccgcagaccagcaccacgagcucccccaccaccagcaccacguccgcgcccaccaccagcaccacguccgcccccaccaccagcaccacguccaccccgcagaccagcaucuccagcgcccccaccuccagcacgaccuccgcccccaccgccagcaccaucuccgcgcccacgaccagcaccaccuccuuccacacgaccagcaccaccuccccgcccaccagcagcacguccagcaccccccagaccuccaagaccagcgccgccacguccagcaccaccuccggcagcgggaccacgccgucccccgugcccaccaccagcaccgccuccgucagcaagacguccaccagccacguguccgugagcaagaccacccacucccagcccgucacgcgcgacugccacccgcggugcaccuggaccaagugguucgacguggacuuccccagccccggcccccacgggggcgacaaggagaccuacaacaacaucauccgcuccggggagaagaucugccggcgcccggaggagaucacgcggcugcagugccgcgccgagagccaccccgaggugagcaucgagcaccucggccaggucgugcagugcucccgcgaggagggccuggugugccggaaccaggaccagcaggggcccuucaagaugugccugaacuacgagguccgcgugcucugcugcgagacccccaagggcugcccggugaccagcacccccgucacggcgcccuccacccccagcgggcgggccaccuccccgacccagagcacguccagcuggcagaagucccgcaccaccacccuggugacgaccagcaccaccuccacgccccagaccagcaccaccuccgcccccaccacgagcaccauccccgccuccaccccgagcaccacguccgcgcccaccaccagcaccacguccgcccccaccaccagcaccacgagcgcccccacccaccggaccaccuccggcccgacgaccagcaccacccuggcccccacgaccuccaccaccagcgcccccacgaccuccaccaacagcgcgcccaccacguccaccaucagcgccuccaccaccagcacgaucuccgccccgaccaccagcaccaucuccagccccacguccagcaccaccuccaccccccagacgagcaagaccuccgccgccaccagcagcaccaccuccgggagcggcacgaccccgucccccgugcccaccaccagcacgaccuccgcgagcaccaccuccacgaccagcgcccccaccaccuccacgaccagcggcccggggaccacccccucccccguccccagcacguccaccaccagcgccgccaccacguccaccaccagcgccccgaccacgcgcaccaccuccgcgcccaccagcuccaugacgagcggccccgggaccacccccagcccggugcccaccacguccaccaccagcgcccccaccacguccaccaccagcggccccgggaccaccccgucccccgugcccacgaccagcaccaccuccgcccccaucacgagcaccaccuccggcccgggcagcacccccucccccguccccacgaccagcaccaccuccgccccgacgaccagcaccaccuccgcgagcacggccuccaccaccagcgggcccggcaccacgcccagcccggugcccaccaccuccaccacgagcgcccccaccacccggaccacguccgccagcaccgccuccaccaccagcgggcccggcuccacgccgagccccgugcccaccaccuccaccacgagcgcgcccaccacccgcaccaccccggccuccacggccagcaccaccuccggccccgggaccacgcccagccccgucccgaccaccuccaccacgagcgccuccaccaccagcaccaucucccuccccacgaccagcaccaccagcgcccccaucacguccaugaccagcggccccgggaccaccccgucccccgugcccacgaccagcaccaccuccgcgcccacgaccagcaccaccuccgccagcacggccuccaccaccagcggcccggggaccacgcccucccccgugcccaccaccagcaccacguccgccccgaccaccagcaccaccuccgccagcacggcguccaccaccagcggccccggcaccucccugagccccguccccacgaccagcaccaccuccgccccgacgaccagcaccaccuccgggcccggcacgacccccagcccggugcccaccaccuccacgaccagcgcccccaccaccuccacgaccagcgggcccggcaccaccccgucccccgugcccacgaccagcaccacccccgucuccaagacgagcaccucccaccugagcguguccaagaccacccacagccagccggugacguccgacugccacccccucugcgccuggaccaagugguucgacgucgacuuccccagccccgggccgcacggcggcgacaaggagaccuacaacaacaucauccgguccggggagaagaucugccgccggcccgaggagaucacccgccugcagugccgggcggagagccaccccgaggugaacaucgagcaccugggccaggugguccagugcagccgcgaggaggggcucgugugccggaaccaggaccagcagggccccuucaagaugugccugaacuacgaggugcgcguccugugcugcgagacgccgcgggggugccccgugaccuccgugacccccuacggcaccagccccaccaacgcccucuacccgucccugagcacguccauggucagcgccuccguggccagcaccuccguggccagcuccagcgucgcguccagcuccguggccuacagcacccagaccugcuucugcaacgucgccgaccgccuguaccccgccggcuccacgaucuaccggcaccgcgaccucgccgggcacugcuacuacgcgcugugcagccaggacugccagguggugcgcggcgucgacuccgacugccccagcaccacccugcccccggcccccgccaccagccccuccaucagcacguccgagcccgugaccgagcucgggugcccgaacgccgugcccccccggaagaagggcgagaccugggccaccccgaacugcagcgaggcgacgugcgaggggaacaacgucaucucccugcgcccccggaccugcccccgcguggagaagcccaccugcgccaacggcuacccggccgugaaggucgccgaccaggacggcugcugccaccacuaccagugccagugcgugugcagcggguggggcgacccccacuacaucaccuucgacgggacguacuacaccuuccuggacaacugcaccuacgugcucguccagcagaucgugcccguguacggccacuuccggguccugguggacaacuacuucugcggcgccgaggacgggcuguccugcccccgcagcaucauccucgaguaccaccaggaccgggugguccugacccgcaagccggugcacggcgugaugacgaacgagaucaucuucaacaacaaggucgugucccccggguuccggaagaacggcaucguggucagccgcaucggggugaagauguacgcgaccauccccgagcugggcgugcaggucauguucuccggccucaucuucagcguggaggugcccuucuccaaguucgccaacaacaccgaggggcagugcggcaccugcacgaacgaccggaaggacgagugccgcaccccgcgggggaccgucguggccagcugcuccgagaugagcggccuguggaacguguccauccccgaccagcccgccugccaccgcccccacccgacccccacgaccgucgggcccaccaccgugggcagcacgaccgugggccccaccaccgucggguccacgaccgugggcccgaccaccccccccgcgcccugccugccgagccccaucugccagcucauccugagcaagguguucgagcccugccacaccgucaucccgccccugcucuucuacgaggggugcguguucgaccggugccacaugacggaccuggacguggucugcuccagccuggagcucuacgccgcccugugcgccucccacgacaucugcaucgacuggcgcggccggaccgggcacaugugccccuucaccugccccgccgacaagguguaccagccgugcggccccagcaaccccuccuacugcuacggcaacgacagcgcgucccugggggcccuccccgaggccggcccgaucaccgaggggugcuucugccccgagggcaugacgcuguucagcaccuccgcccaggugugcguccccaccggcugcccccgcugccuggggccgcacggcgagcccgugaagguggggcacaccgucggcauggacugccaggagugcacgugcgaggccgcgaccuggacccucaccugccggcccaagcugugcccccugccgcccgccugcccccuccccggguucgugccggugcccgccgccccccaggccggccagugcugcccccaguacagcugcgcgugcaacacgucccgcugcccggcccccgucggcugccccgagggggcccgggccauccccaccuaccaggagggcgcgugcugcccggugcagaacugcagcuggaccgucugcuccaucaacgggacccuguaccagcccggcgccguggugagcuccagccugugcgagacgugccgcugcgagcuccccgggggcccgcccuccgacgccuucgucgugagcugcgagacccagaucugcaacacccacugccccgugggcuucgaguaccaggagcagagcgggcagugcugcggcaccugcguccagguggccugcgugacgaacaccuccaagagccccgcccaccuguucuacccgggggagaccugguccgacgcgggcaaccacugcgucacccaccagugcgagaagcaccaggacgggcuggugguggucacgaccaagaaggccugccccccccucagcugcucccuggacgaggcccgcaugagcaaggacggcugcugccgguucugccccccgcccccccccccguaccagaaccaguccaccugcgccguguaccaccgcagccugaucauccagcagcagggcugcuccagcuccgagcccgugcggcucgccuacugccgcgggaacugcggcgacagcuccagcauguacucccuggaggggaacaccgucgagcaccggugccagugcugccaggagcugcgcacgagccuccggaacgugacccugcacugcaccgacggcuccagccgcgcguucuccuacaccgagguggaggagugcgggugcaugggccggcgcugccccgcccccggcgacacgcagcacagcgaggaggccgagccggagcccagccaggaggccgaguccgggagcugggagcggggcguccccgugucccccaugcacuga

SEQ ID NO: 33225 - RNA, 17289 nt, Artificial Sequence
  derived and/or modified sequence opt1 from MUC5B__Homo_sapiens__NP_002449
augggcgcccccuccgccugccggacccuggugcuggcccuggccgccaugcugguggugccccaggccgagacccaggggcccguggagcccuccugggagaacgccggccacaccauggacgggggcgcgcccaccuccucccccacccggcgcguguccuucgugccgcccgugaccgucuuccccucccucagcccccugaaccccgcccacaacgggcgggugugcuccaccuggggcgacuuccacuacaagaccuucgacggcgacguguuccgcuuccccgggcugugcaacuacgucuucuccgagcacugccgggccgccuacgaggacuucaacgugcagcuccgccggggccugguggggucccgccccgucgugacccggguggucaucaaggcccagggccuggugcucgaggccuccaacggguccgugcugaucaacggccagcgcgaggagcugcccuacucccggaccggccuccuggucgagcaguccggggacuacaucaagguguccauccgccuggugcucaccuuccuguggaacggcgaggacuccgcccugcucgagcuggaccccaaguacgccaaccagaccugcgggcugugcggcgacuucaacggccuccccgccuucaacgaguucuacgcccacaacgcccggcugacgccccuccaguucgggaaccuccagaagcuggacggccccaccgagcagugccccgacccccugccccuccccgccgggaacugcaccgacgaggagggcaucugccaccgcacccugcuggggcccgccuucgccgagugccacgcgcucgucgacagcaccgccuaccuggccgccugcgcccaggaccugugccggugcccgaccugccccugcgcgaccuucguggaguacucccgccagugcgcccacgccggcggccagccccggaacuggcgcugccccgagcucugcccccggaccugcccccugaacaugcagcaccaggagugcgggagccccugcaccgacacgugcuccaacccccagcgcgcccagcugugcgaggaccacugcguggacggcugcuucugcccgcccgggaccguccucgacgacaucacccacagcggcugccugccccuggggcagugccccugcacccacggcggccggaccuacagccccgggaccuccuucaacacgaccugcagcuccugcacgugcagcggcgggcucuggcagugccaggaccugcccugccccgggaccugcuccgugcagggcggggcccacaucagcaccuacgacgagaagcuguacgaccuccacggcgacugcuccuacguccugagcaagaagugcgcggacuccagcuucaccgugcuggccgagcuccgcaagugcgggcugaccgacaacgagaacugccugaaggccgugacccucucccuggacggcggggacaccgccauccgcguccaggcggacggcggcguguuccugaacagcaucuacacccagcugccccucuccgccgccaacaucacccuguucacccccagcuccuucuucaucgugguccagaccgggcugggccuccagcugcuggugcagcucgugccccugaugcaggucuucgugcggcuggaccccgcccaccaggggcagaugugcggccucugcgggaacuucaaccagaaccaggccgacgacuucaccgcgcugagcggcguggucgaggccaccggcgccgccuucgccaacaccuggaaggcgcaggccgccugcgccaacgcccgcaacuccuucgaggaccccugcagccuguccguggagaacgagaacuacgcgcggcacuggugcagccgccucaccgaccccaacagcgccuucucccggugccacagcaucaucaaccccaagcccuuccacuccaacugcauguucgacacgugcaacugcgagcgcagcgaggacugccugugcgccgcccuguccagcuacgugcacgcgugcgccgccaaggggguccagcucuccgacuggcgggacggcgugugcaccaaguacaugcagaacugccccaagagccagcgcuacgccuacguggucgacgccugccagcccacgugccgggggcuguccgaggcggacgugaccugcagcguguccuucguccccguggacggcugcacgugccccgccgggaccuuccugaacgacgccggcgccugcgugcccgcccaggagugccccugcuacgcgcacggcaccguccucgcccccggggagguggugcacgacgagggcgccgucugcagcugcaccggcgggaagcuguccugccugggggccagccuccagaaguccaccggcugcgccgcgcccaugguguaccuggacugcagcaacuccagcgccggcacccccggggccgagugccugcgcagcugccacacccucgacgugggcugcuucuccacccacugcgucagcgggugcgugugcccgcccggccugguguccgacgggagcggcggcugcaucgccgaggaggacugccccugcguccacaacgaggcgaccuacaagcccggggagaccauccggguggacugcaacacgugcacgugccgcaaccggcgcugggagugcucccaccggcugugccucgggaccugcguggccuacggggacggccacuucaucaccuucgacggcgaccgcuacagcuucgagggguccugcgaguacauccuggcccaggacuacugcggcgacaacaccacccacgggaccuuccggaucgucaccgagaacauccccugcggcaccaccgggacgaccugcagcaaggccaucaagcuguucguggaguccuacgagcucauccugcaggagggcaccuucaaggccguggcgcgcggccccgggggcgacccgcccuacaagauccgguacauggggaucuuccuggucaucgagacccacggcauggccgugagcugggaccgcaagaccuccguguucauccgccuccaccaggacuacaaggggcgggucugcggccugugcggcaacuucgacgacaacgccaucaacgacuucgccacccgcagccgguccguggugggggacgcccuggaguucggcaacagcuggaagcucucccccagcugccccgacgcgcuggcccccaaggaccccugcaccgccaaccccuuccgcaaguccugggcccagaagcagugcagcauccugcacgggcccaccuucgccgcgugccggucccaggucgacagcaccaaguacuacgaggccugcgugaacgacgccugcgccugcgacagcggcggggacugcgagugcuucugcaccgccguggcggccuacgcccaggccugccacgacgcgggccucugcgucuccuggcgcacccccgacacgugcccccuguucugcgacuucuacaacccgcacggcgggugcgaguggcacuaccagcccugcggcgcccccugccugaagaccugccggaaccccagcgggcacugccucguggaccugccgggccuggagggcugcuaccccaagugcccgcccucccagcccuucuucaacgaggaccagaugaagugcguggcccagugcgggugcuacgacaaggacggcaacuacuacgacgucggggcccgcgugcccaccgccgagaacugccagagcugcaacugcacccccuccggcauccagugcgcgcacagccucgaggccugcacgugcaccuacgaggaccggaccuacuccuaccaggacgucaucuacaacaccaccgacgggcugggcgccugccugaucgccaucugcggcagcaacgggaccaucauccgcaaggccguggcgugccccggcaccccggccaccacccccuucaccuucaccaccgccugggugccccacuccaccaccagccccgcccucccggucuccaccgugugcgugcgggaggucugccgcuggagcuccugguacaacgggcaccggcccgagcccggccucggcggcggggacuucgagaccuucgagaaccugcgccagcggggguaccaggugugcccggugcucgccgacaucgagugccgcgcggcccagcugcccgacaugccccuggaggagcucgggcagcaggucgacugcgaccggaugcgcgggcugaugugcgccaacagccagcagagcccgccccugugccacgacuacgagcuccgggugcugugcugcgaguacgugcccugcggccccagccccgcccccgggaccagcccccagcccagccuguccgcgagcacggagcccgccgucccgacccccacccagaccacggccaccgagaagaccacccucugggugacgcccagcauccgcuccaccgccgcccugaccagccagaccggcuccagcuccggccccgugacggucaccccgagcgcgcccgggaccaccacgugccagccccggugccaguggaccgagugguucgacgaggacuaccccaaguccgagcagcugggcggggacguggagagcuacgacaagauccgcgccgccggcgggcaccucugccagcagccgaaggacaucgagugccaggccgaguccuuccccaacuggacccuggcccaggugggccagaagguccacugcgacgugcacuucggccuggugugccgcaacugggagcaggagggggucuucaagaugugcuacaacuaccggauccgcgugcucugcugcagcgacgaccacugccggggccgcgcgaccacgccgccgcccaccaccgagcuggagaccgccaccacgaccaccacccaggcccuguucuccacgccccagcccaccagcucccccgggcucacccgggccccgcccgccagcaccacggcggugcccacccuguccgagggccugaccagcccccgcuacaccuccacgcucggcaccgccaccaccgggggccccacgacccccgccgggagcaccgagcccaccgucccgggcguggccacguccacccugcccacccggagcgcgcugcccgggaccacgggcagccucggcaccuggcgccccucccagccgcccacccuggcccccaccacgauggccaccagccgggcccgccccaccgggaccgccuccacggcgagcaaggagccgcugaccaccucccucgcccccacccugacgagcgagcuguccaccagccaggccgagaccuccacgccccggacggagaccaccaugagcccccucaccaacaccacgaccucccagggcaccacccgcugccagccgaagugcgaguggacggagugguucgacguggacuuccccaccagcggggucgccggcggggacauggagaccuucgagaacauccgggccgcgggcggcaagaugugcugggcccccaaguccaucgagugccgcgccgagaacuaccccgaggugagcaucgaccagguggggcagguccugaccugcucccuggagacgggccugaccugcaagaacgaggaccagaccgggcgguucaacaugugcuucaacuacaacgugcgcgugcugugcugcgacgacuacagccacugcccguccacccccgccacgagcuccaccgccacccccagcagcacccccggcacgaccuggauccugaccaagccgaccacgaccgcgaccaccacggccuccaccgggagcaccgccacccccaccuccacccuccggaccgcgcccccgcccaagguccugaccacgaccgccaccacccccacggugaccagcuccaaggcgacccccagcuccagccccggcaccgccaccgcccugcccgcccuccgcuccacggcgaccacccccaccgccacgagcgugacccccaucccguccagcucccugggcaccaccuggacgcggcugagccagaccaccacccccacggccaccauguccaccgccacccccagcuccacgcccgagaccgcccacaccagcaccguccucacggcgaccgccaccaccacgggcgccaccggcuccguggccaccccgagcagcacccccgggacggcccacaccaccaaggugcccaccacgaccaccaccggcuucacggcgacccccuccagcuccccggggaccgcccugacgccgcccgucuggaucagcaccacgaccacccccaccacgcgcggcuccaccgugaccccgagcuccauccccggcaccacgcacaccgccaccgugcugaccacgaccaccaccacggucgccaccgggagcauggccacccccuccagcuccacccagacgagcggcacgcccccgucccugaccaccaccgcgaccaccaucaccgccacggggagcaccaccaaccccuccagcacccccggcacgacccccaucccgcccgugcucaccaccacggccaccacccccgccgcgaccuccaacaccgugacgccgagcagcgcccugggcaccacccacacgccgcccguccccaacacgauggccaccacccacgggcgcucccugccgcccagcagcccccacaccgugcggacggccuggaccagcgccaccuccggcauccucgggaccacgcacaucaccgagcccagcaccgugaccucccacacgcuggcggccaccaccggcaccacgcagcacagcaccccggcccuguccagcccccaccccuccagccgcaccaccgagagcccgcccagccccgggacgaccacccccggccacaccacggccaccucccggaccaccgccacggcgacccccagcaagacccgcaccuccacgcuccugcccagcucccccaccagcgcccccaucaccaccgucgugaccaugggcugcgagccccagugcgccuggagcgaguggcuggacuacuccuacccgaugcccgggcccagcggcggggacuucgacacguacuccaacauccgggccgccggcggggcggugugcgagcagccccucggccuggagugccgcgcccaggcccagccgggcgucccccugcgggagcucggccagguggucgagugcagccuggacuucggccuggugugccgcaaccgggagcaggucgggaaguucaagaugugcuucaacuacgagauccgcgucuucugcugcaacuacggccacugccccuccacccccgccaccagcuccaccgcgaugccgagcuccacgcccgggaccaccuggauccucaccgagcugacgaccaccgccaccacgaccgagagcaccggcuccaccgccacgcccagcuccaccccgggcaccaccuggauccugacggagcccagcaccaccgccaccgugacggugcccaccggguccaccgccaccgcgagcuccacgcaggccaccgccggcacgccccacgucagcaccacggccaccaccccgaccgugacguccagcaaggccacccccuucagcucccccgggaccgcgaccgcccuccccgcccugcggagcacggccaccaccccgaccgccaccuccuucacggcgauccccagcuccagccugggcaccaccuggacccgccucucccagacgaccacccccaccgccacgaugagcaccgccacccccuccagcaccccggagacggugcacaccuccaccguccugaccacgaccgccaccaccacgggcgccaccgggagcguggcgacccccuccagcacccccggcacggcccacaccaccaaggugcugaccacgaccaccaccggguucacggccacccccuccagcuccccgggcaccgcccggacccuccccgucuggaucagcacgaccaccacccccaccacgcgcggguccaccgugacccccagcagcaucccgggcaccacgcacacccccaccgugcugaccacgaccaccaccacggucgcgaccggcuccauggccacccccagcuccagcacccagacguccgggacgccgcccagccugaccaccacggccaccaccaucaccgccacgggcuccaccaccaaccccagcuccacccccgggacgacccccaucccgcccgugcucaccaccacggccaccacccccgcggccaccagcuccacggugacccccagcuccgcccugggcaccacccacacgccgcccguccccaacacgaccgccaccacccacgggcggagccuguccccgagcagcccccacacggugcgcaccgccuggaccagcgcgaccuccggcacgcucggcaccacccacaucaccgagcccagcacggggaccagccacacccccgccgccaccacgggcaccacccagcacuccaccccggcccugagcagcccccaccccagcucccggacgaccgaguccccgcccucccccgggaccaccacgcccggccacacccgcgccaccagccggaccacggcgaccgccacccccuccaagacccgcacgagcacccugcuccccuccagccccaccuccgcccccaucaccacgguggucaccauggggugcgagccccagugcgccuggagcgaguggcuggacuacuccuacccgaugcccggccccagcggcggggacuucgacaccuacuccaacauccgggcggccggcggggccgugugcgagcagccccugggccucgagugccgcgcccaggcccagccgggggugccccugcgcgagcugggccaggucguggagugcagccucgacuucggccuggugugccggaaccgcgagcaggucgggaaguucaagaugugcuucaacuacgagauccggguguucugcugcaacuacggccacugccccuccaccccggcgaccagcagcacggccacccccuccagcacccccgggaccacguggauccugaccgagcagaccaccgccgccacgaccaccgccaccacgggcuccaccgcgauccccagcuccaccccgggcaccgcgccgccgcccaaggugcucacgagcaccgccaccaccccgacggccaccuccagcaaggccaccuccagcuccagcccccgcaccgcgacgacccugcccguccugaccuccaccgccaccaaguccaccgccaccuccuucacccccaucccgagcuucacgcucgggaccaccggcacccugcccgagcagacgaccacccccauggccaccauguccaccauccaccccagcagcacgccggagaccacccacaccuccacggugcugaccaccaaggccaccacgacccgggcgaccagcuccaugagcacccccuccagcacgcccgggaccaccuggauccucaccgagcugacgaccgccgccaccaccacggccgcgaccggccccaccgccaccccguccagcacgcccgggaccaccuggauccugaccgagcccuccacgaccgccaccgugaccguccccacgggcagcaccgccaccgccuccagcacccgcgcgacggccggcacccucaaggugcugaccuccaccgccaccacgccgaccgugaucagcucccgggccacccccagcuccagccccgggaccgccacggcgcugcccgcccuccgcuccaccgccaccaccccgacggccaccagcgucaccgccauccccagcuccagccugggcaccgcguggacgcggcugucccagaccaccacccccacggccaccaugagcaccgccaccccguccagcacgcccgagaccgugcacaccuccaccgugcucacgaccaccaccacgaccacccgcgccaccgggagcgucgcgacgcccuccagcacccccggcaccgcccacaccacgaaggugccgaccaccaccaccacgggguucaccgccacccccuccagcucccccggcaccgcccugacgcccccgguguggaucagcaccaccaccacgcccaccacccggggcuccaccgucacgcccagcuccauccccgggaccacccacaccgccacggugcugaccaccaccacgaccaccguggcgaccggcagcauggccacgccguccagcagcacccagaccuccgggacgccgcccagccucacgaccaccgccaccacgaucaccgccaccggcuccaccacgaaccccagcuccaccccggggaccacccccaucccgcccguccugacgaccaccgccaccaccccggcggccacgagcuccaccgugacccccagcuccgcccugggcaccacgcacacgccgcccgugccgaacaccaccgccacgacccacggccgcagccugccgcccuccagcccccacaccguccggaccgccuggacguccgcgaccagcgggauccugggcaccacccacaucacggagccguccaccgugaccagccacacccccgccgccacgaccuccaccacccagcacagcacgcccgcccuguccagcccgcaccccagcucccgcaccaccgaguccccgcccuccccggggaccacgacccccggccacacccggggcaccagccgcacgaccgcgaccgccacccccuccaagacgcggaccagcacccuccugcccuccagcccgaccuccgcccccaucaccacgguggucaccaccgggugcgagccccagugcgccuggagcgaguggcuggacuacuccuaccccaugccgggccccagcgggggcgacuucgacaccuacuccaacauccgcgccgccgggggcgcggugugcgagcagccccucggccuggagugccgggcccaggcccagcccggggucccgcugcgcgagcucggccaggugguggagugcagccuggacuucgggcuggucugccgcaaccgggagcaggucggcaaguucaagaugugcuucaacuacgagauccgcguguucugcugcaacuacgggcacugccccuccacgcccgccaccagcuccaccgcgacccccagcuccacgccgggcaccaccuggauccucaccaagcugacgaccaccgccaccacgaccgagagcaccggcagcaccgccacgcccuccagcacccccgggaccaccuggauccugacggagcccuccaccaccgccaccgucacggugccgaccggcagcaccgccaccgcguccagcacgcaggccaccgccgggacgccccacguguccaccacggccaccacccccaccgucaccagcuccaaggccacgccguucagcucccccggcaccgcgaccgcccuccccgcccugcggagcaccgccacgacccccaccgcgaccuccuucacggccaucccgagcuccagccuggggaccaccuggacccgccucucccagacgaccacccccaccgccacgaugagcaccgccacccccuccagcacccccgagacggcccacaccagcaccgugcugaccacgaccgcgaccaccacgcgggccaccggcuccguggccaccccgagcuccacccccggcacggcccacaccaccaagguccccaccacgaccaccaccggguucaccgugacgcccagcuccagcccgggcaccgcccgcacgccgcccguguggaucuccaccacgaccacccccaccacgagcggguccaccgucaccccgagcuccgugcccggcaccacgcacacccccaccgugcugaccacgaccaccaccacggucgcgaccgggagcauggccacccccuccagcuccacccagacgagcggcaccccgcccucccucaucaccaccgccacgaccaucaccgccaccggcagcacgaccaaccccagcuccacccccgggaccacgccgaucccgcccgugcugaccaccaccgccaccacgcccgcggccaccagcuccaccgugaccccgagcuccgcccugggcacgacccacacgccgcccgucccgaacaccacggccaccacccacgggcggagccucucccccagcagcccccacaccgugcgcacggcguggaccagcgccaccuccggcacccugggcacgacccacaucaccgagcccagcaccgggacgucccacaccccggccgccaccaccggcacgacccagcacagcacccccgcccuguccagcccccaccccuccagccggaccacggaguccccgcccagccccgggaccaccacccccggccacacgaccgcgaccagccgcaccacggccaccgccaccccguccaagacccggaccagcacgcuccugcccuccagccccaccuccgcccccaucaccaccguggucacgaccgggugcgagccgcagugcgccuggagcgaguggcuggacuacuccuaccccaugcccggccccagcggcggggacuucgacaccuacuccaacauccgcgcggccggcggggccgugugcgagcagccgcucggccuggagugccgggcccaggcccagcccggggugccccugggcgagcucggccaggucguggagugcagccuggacuucgggcuggugugccgcaaccgggagcaggucggcaaguucaagaugugcuucaacuacgagauccgcguguucugcugcaacuacgggcacugccccuccaccccggcgacgagcuccaccgccaugcccagcuccacccccggcaccacguggauccucaccgagcugaccaccacggccaccaccaccgccagcacgggguccaccgcgacccccagcuccaccccgggcacggcgccgccgcccaaggugcugaccagccccgccaccacccccacggccaccagcuccaaggccaccagcuccagcagcccccggaccgcgacgacccugcccguccucaccagcaccgccacgaaguccaccgccaccagcgugacccccauccccuccagcacgcugggcaccaccgggacccugcccgagcagaccacgaccccgguggccaccauguccaccauccaccccagcuccacgcccgagaccacccacaccagcacgguccucaccaccaaggccaccacgacccgcgcgaccuccagcaccuccacgcccagcuccaccccgggcaccaccuggauccugacggagcugaccaccgccgccaccacgaccgccgccaccgggcccaccgcgacgcccagcagcacccccggcaccaccuggauccucacggagcugaccaccaccgccacgaccaccgccuccaccggcagcaccgccacgccguccagcacccccgggaccaccuggauccugacggagcccuccaccaccgccaccgugacggugcccaccggcagcaccgcgaccgccuccagcacgcaggccaccgccgggaccccgcacgucuccaccacggcgaccacccccaccgugacgagcuccaaggccacccccagcuccagccccggcaccgccaccgcccucccggcccugcgguccacggcgaccacccccaccgccacgagcuucaccgccauccccuccagcucccuggggaccaccuggacgcgccucagccagaccaccaccccgacggccaccaugagcaccgccacccccuccagcacccccgagacggugcacaccuccaccguccugaccgcgacggccaccaccaccggcgccacgggcagcguggccacccccuccagcaccccggggaccgcccacacgaccaaggugcccaccaccacgaccaccggcuucaccgcgacgcccuccagcucccccgggaccgcccugaccccgcccgucuggaucagcaccacgaccacccccaccacgaccacccccaccacguccggcagcaccgugaccccguccagcauccccgggaccacgcacaccgcccgggugcucaccaccaccacgaccaccgucgccaccggcuccauggcgacgcccagcuccagcacccagaccuccggcacgccgcccagccugacgaccaccgccaccacgaucaccgccaccgggagcaccacgaaccccuccagcacccccggcaccacccccaucacgcccgugcugaccuccaccgccaccacgcccgccgcgaccagcuccaaggccaccagcuccagcagcccccggaccgccacgacccuccccgugcugaccagcaccgccacgaaguccaccgccaccagcuucaccccgauccccuccagcacgcuguggaccaccuggaccguccccgcgcagaccacgacccccauguccaccaugagcaccauccacacguccagcaccccggagaccacccacacgagcaccgugcucaccaccacggccaccaugacccgcgccaccaacuccacggccacccccagcuccacccuggggaccacgcggauccugaccgagcucaccaccacggccaccaccaccgcggccacgggcagcaccgccacccuguccagcacccccgggacgaccuggauccugaccgagccguccaccaucgccacggucauggugcccaccggcagcaccgccaccgcguccagcacccucggcacggcccacacccccaagguggucaccaccauggccacgaugcccaccgccaccgcguccaccgugccgagcuccagcacgguggggaccacccgcacccccgccguccugcccuccagccugcccacguucuccgugagcaccguguccagcagcguccucaccacccugcggccgacgggcuuccccuccagccacuucuccacccccugcuucugccgcgccuucgggcaguucuucagccccggcgaggugaucuacaacaagaccgaccgggccgggugccacuucuacgccgugugcaaccagcacugcgacaucgaccgcuuccagggcgcgugcccgaccagcccgccgcccgucagcuccgccccgcugagcucccccagccccgcccccggcugcgacaacgccaucccgcuccgccaggugaacgagacguggacccuggagaacugcaccguggcccgcugcgucggggacaaccggguggugcugcucgaccccaagcccgucgcgaacgugaccugcgugaacaagcaccuccccaucaaggucuccgacccgagccagcccugcgacuuccacuacgagugcgagugcaucugcuccauguggggcgggagccacuacuccacguucgacggcaccagcuacaccuuccgcggcaacugcaccuacgugcugaugcgggagauccacgcccgcuucgggaaccucucccuguaccuggacaaccacuacugcacggccagcgccaccgccgcggccgcccggugcccccgcgcccucuccauccacuacaagagcauggacaucgugcugaccgucaccauggugcacggcaaggaggaggggcugauccucuucgaccagauccccgugagcuccggcuucagcaagaacgggguccugguguccgugcugggcacgaccaccaugcgggucgacaucccggcgcucggcgugagcgugaccuucaacgggcaggucuuccaggcccgccugcccuacucccuguuccacaacaacacggagggccagugcgggaccugcaccaacaaccagcgggacgacugccuccagcgcgacggcaccacggccgccagcugcaaggacauggccaagaccuggcuggugcccgacucccggaaggacgggugcugggcgccgaccggcacgccgcccaccgccagccccgccgccccgguguccagcacgcccacccccacccccugcccgccccagccccugugcgaccucaugcugucccaggucuucgccgagugccacaaccuggugcccccgggccccuucuucaacgcgugcaucagcgaccacugccgcgggcgccucgaggugcccugccagucccuggaggccuacgccgagcugugccgggcccgcggcgucugcagcgacuggcgcggggccaccggcgggcucugcgaccugacgugcccgcccaccaagguguacaagcccugcggccccauccagcccgcgaccugcaacucccgcaaccagagcccccagcuggagggcauggccgaggggugcuucugccccgaggaccagauccucuucaacgcccacaugggcaucugcgugcaggccugccccugcgucgggcccgacggcuucccgaaguuccccggggagcgguggguguccaacugccagagcugcgugugcgacgagggcuccgucagcgugcagugcaagccccugccgugcgacgcgcagggccagccgccgcccugcaaccgcccgggguucgugaccgucacgcggccccgcgccgagaaccccugcugccccgagaccgugugcgugugcaacaccaccacgugcccgcagagccugcccgucugcccgcccggccaggaguccaucugcacccaggaggagggggacugcugcccgaccuuccggugccgcccccagcucugcagcuacaacggcaccuucuacggcgugggggccacguuccccggcgcccugcccugccacaugugcacgugccuguccggggacacccaggacccgaccguccagugccaggaggacgccugcaacaacacgaccugcccccagggcuucgaguacaagcggguggcggggcagugcugcggcgagugcgugcagaccgccugccucacccccgacggccagcccguccagcugaacgagacgugggugaacagccacguggacaacugcaccgucuaccugugcgaggccgagggcggcgugcaccuccugaccccgcagcccgccuccugccccgacgugagcuccugccgcgggagccugcggaagaccggcugcugcuacuccugcgaggaggacagcugccagguccgcaucaacacgaccauccucuggcaccaggggugcgagaccgaggugaacaucaccuucugcgagggcuccugccccggcgccagcaaguacuccgcggaggcccaggccaugcagcaccagugcacgugcugccaggagcggcgcgugcacgaggagaccgucccgcugcacugccccaacgggagcgccauccugcacaccuacacccacguggacgagugcggcugcacgcccuucugcgugcccgccccgauggcgccgccccacacccggggguucccggcccaggaggccaccgccgucuga

SEQ ID NO: 33226 - RNA, 7320 nt, Artificial Sequence
  derived and/or modified sequence opt1 from MUC6__Homo_sapiens__NP_005952
auggugcagcgcuggcugcuccugagcugcugcggcgcccugcucagcgccgggcuggccaacaccagcuacaccagccccggccugcagcgccucaaggacagcccccagaccgcccccgacaaggggcagugcuccaccuggggcgccgggcacuucagcaccuucgaccaccacgucuacgacuucuccgggaccugcaacuacaucuucgccgcgaccugcaaggacgccuuccccaccuucagcgugcagcugcgccggggccccgacggguccaucagccgcaucaucguggagcugggcgccuccgucgugaccgugagcgaggccaucaucuccgucaaggacaucggggugaucagccuccccuacaccuccaacggccugcagaucacccccuucgggcagagcgugcggcuggucgccaagcagcucgagcuggagcuggaggugguguggggccccgacucccaccucaugguccugguggagcgcaaguacaugggccagaugugcgggcugugcggcaacuucgacgggaaggugaccaacgaguucgucagcgaggagggcaaguuccucgagccccacaaguucgccgcccugcagaagcuggacgaccccggcgagaucugcaccuuccaggacauccccuccacccacgugcggcaggcccagcacgcccgcaucugcacccagcuccugacccugguggcccccgagugcagcgucagcaaggagcccuucgugcucuccugccaggccgacguggccgccgcgccccagcccgggccccagaacagcuccugcgccacccugagcgaguacucccggcagugcagcauggucggccagcccgugcgccgguggcgcucccccgggcugugcagcgugggccagugccccgccaaccaggucuaccaggagugcggguccgccugcgugaagaccugcagcaacccccagcacuccugcagcuccagcugcaccuucggcugcuucugccccgagggcaccguccucaacgaccuguccaacaaccacacgugcgugcccgugacccagugccccugcguccugcacggggccauguacgcccccggcgaggugaccaucgccgcgugccagaccugccggugcacccucgggcgcugggugugcaccgagcggcccugccccggccacugcagccuggagggcggcuccuucgucacgaccuucgacgcccgccccuaccgguuccacgggaccugcaccuacauccugcuccagagcccccagcugcccgaggacggggcccugauggccguguacgacaaguccggcgugagccacagcgagacgucccucgucgccgugguguaccugagccgccaggacaagaucgucaucucccaggacgagguggugaccaacaacggggaggcgaaguggcugccguacaagacccggaacaucaccgucuuccgccagacgagcacccaccuccagauggccaccuccuucggccuggagcugguggugcagcuccggcccaucuuccaggccuacgucaccguggggccccaguuccgcggccagacgcgcggccugugcgggaacuucaacggcgacaccaccgacgacuucaccaccagcauggggaucgccgagggcacggcgucccuguucguggacagcuggcgggccggcaacugcccggccgcccucgagcgcgagaccgaccccugcuccaugagccagcugaacaaggucugcgccgagacccacugcuccaugcugcuccggaccgggacgguguucgagcgcugccacgcgaccgugaaccccgcccccuucuacaagcggugcgucuaccaggccugcaacuacgaggagaccuucccgcacaucugcgccgcccugggcgacuacgugcacgcgugcagccugcgcggggugcugcucuggggcuggcgguccagcgucgacaacugcaccauccccugcacggggaacaccaccuucuccuacaacagccaggccugcgagcggaccugccugucccugagcgaccgggccacggagugccaccacagcgccgugcccguggacggcugcaacugccccgacggcaccuaccucaaccagaagggggagugcguccgcaaggcccagugcccgugcauccuggagggcuacaaguucauccuggcggagcaguccaccgugaucaacgggaucacgugccacugcaucaacggccggcucagcugcccccagcgcccccagauguuccuggccuccugccaggcccccaagacguucaagagcugcucccagagcuccgagaacaaguucggggccgcgugcgccccgaccugccagaugcuggccaccggcguggccugcguccccaccaagugcgagcccggcugcgugugcgccgaggggcucuacgagaacgcggacggccagugcgugcccccggaggagugccccugcgaguucagcggggucuccuaccccggcggggccgagcugcacacggacugccggaccugcagcugcucccgcggccggugggccugccagcagggcacccacugccccuccacgugcacccuguacggggagggccacgugaucaccuucgacgggcagcgcuucguguucgacggcaacugcgaguacauccucgccaccgacgucugcggggugaacgacucccagccgaccuucaagauccugacggagaacgugaucugcggcaacagcggcgugaccugcucccgggccaucaagaucuuccucggcggccucagcguggugcuggcggaccgcaacuacaccgucaccggggaggagccccacgugcagcugggcgugacgcccggcgcccucucccuggucguggacaucagcauccccgggcgguacaaccugacccucaucuggaaccgccacaugaccauccugauccgcaucgcccgggccucccaggacccgcugugcggccucugcgggaacuucaacggcaacaugaaggacgacuucgagacccgcagccgguacguggccagcuccgagcuggagcuggucaacagcuggaaggagagcccccugugcggggacgugagcuucgucacggaccccugcucccugaacgcguuccgccggagcugggccgagcgcaagugcuccgugaucaacagccagaccuucgcgaccugccacuccaagguguaccaccuccccuacuacgaggccugcguccgggacgcgugcggcugcgacagcggcggggacugcgagugccugugcgacgccguggccgccuacgcccaggcgugccuggacaagggcgugugcgucgacuggcgcacccccgccuucugccccaucuacugcggguucuacaacacccacacgcaggacggccacggggaguaccaguacacccaggaggccaacugcaccuggcacuaccagcccugccugugcccgucccagccccagagcgugcccggcuccaacaucgagggcugcuacaacugcagccaggacgaguacuucgaccacgaggagggggugugcguccccugcaugccgcccaccacgccccagcccccgaccacgccccagcuccccaccacgggcucccggcccacccagguguggccgaugaccgggaccagcacgaccaucggccugcuguccagcaccgggcccucccccagcagcaaccacacccccgccuccccgacgcagacgccccuccugcccgccacccugaccagcuccaagcccaccgcgagcuccggcgagccgccccgccccaccaccgccgugacgccccaggccacgagcggccucccgcccaccgccacccugcgguccaccgccacgaagcccaccgucacccaggcgaccacgcgcgccaccgccagcaccgccuccccggccaccacgagcaccgcgcaguccaccacccggaccacgaugacccugcccacccccgccaccagcgggacgucccccacccuccccaagagcaccaaccaggagcugcccggcaccacggccacccagaccaccgggccccgccccacgccggccuccaccaccggccccaccacgccccagcccggccagccgacccggcccaccgcgaccgagacgacccagacccgcaccacgaccgaguacaccacgccccagacgccccacaccacccacagcccgcccaccgccgggucccccgugcccagcacgggcccggugaccgccaccuccuuccacgccaccacgaccuaccccacccccagccaccccgagaccacgcugccgacccacgugccgcccuucagcaccucccucgugacccccagcacccacacggugaucaccccgacccacgcccagauggcgaccuccgccagcaaccacuccgcccccacggggaccaucccgccgcccaccacccugaaggccacgggcagcacccacaccgcgccgcccaucacccccacgaccuccgggaccagccaggcgcacuccagcuucuccaccaacaagacgcccaccagccugcacucccacaccagcuccacccaccaccccgaggucacgcccaccagcaccaccacgaucaccccgaaccccaccuccacccggacgcgcacccccguggcccacaccaacagcgccaccuccagccggcccccgccgcccuucacgacccacagcccgcccaccggcuccagccccuucuccagcaccggccccaugacggccaccuccuucaagaccaccaccacguaccccacccccagccacccccagaccacccuccccacgcacgugcccccguucuccaccagccuggucacccccuccacccacacggugaucacccccacccacgcccagauggcgaccagcgccuccauccacagcaugccgacggggaccaucccgccgcccaccacccugaaggccacgggcuccacccacaccgccccgaccaugacgcucaccaccagcgggaccucccaggcgcugagcucccugaacacggccaagaccagcaccucccuccacagccacaccagcuccacgcaccacgccgaggccaccagcaccuccaccacgaacaucacccccaaccccaccagcaccggcacgcccccgaugaccgugaccaccuccgggaccagccagucccgcagcuccuucagcacggccaagaccuccaccagccugcacucccacaccagcuccacgcaccaccccgaggucaccagcaccuccaccacgagcaucacccccaaccacaccagcaccggcacgcggacccccguggcgcacaccaccuccgccacgagcucccgccugccgacccccuucaccacccacuccccgcccacgggcaccaccccgaucuccagcaccgggcccgugacggccaccuccuuccagaccaccacgaccuaccccacccccagccacccgcacaccacgcuccccacccacguccccuccuucagcaccucccuggugacccccagcacgcacaccgugaucaucccgacccacacccagauggccaccuccgccagcauccacuccaugcccacgggcaccaucccgccgcccaccaccaucaaggcgacggggagcacccacaccgcgccgcccaugacccccacgaccuccggcaccagccagucccccagcagcuucuccaccgccaagacgagcaccucccugcccuaccacaccagcuccacccaccaccccgaggucacgccgaccagcaccaccaacaucacgcccaagcacaccuccaccgggacccgcacgcccguggcccacaccaccagcgccuccagcucccggcuccccaccccguucacgacccacuccccgcccaccggcuccagccccuucuccagcaccggcccgaugacggcgaccuccuuccagaccaccacgaccuaccccacccccagccacccccagaccacccugccgacgcacgugccgcccuucuccaccagccuggucacccccagcacccacacggugaucaucaccacccacacccagauggccacguccgccagcauccacuccaccccgaccgggaccgugccgccgcccacgacccucaaggccaccggcagcacccacacggcgccgcccaugaccgucaccaccuccgggacgagccagacccacuccagcuucuccaccgccaccgccagcuccagcuucaucuccagcuccagcuggcugccccagaacuccagcucccgcccgcccagcagccccaucacgacccagcugccccaccucuccagcgccaccacccccguguccacgaccaaccagcugagcuccagcuucucccccagccccuccgcccccagcaccguguccagcuacgucccguccagccacuccagcccccagaccuccagccccuccgugggcacgagcagcuccuucgugagcgcgcccguccacuccaccacccugagcuccgggagccacuccagccucuccacccacccgacgaccgccagcguguccgccagcccccuguuccccuccagccccgccgccuccaccaccauccgggcgacgcugccgcacaccaucagcucccccuucacccucagcgcccugcugcccaucuccaccgugaccgucagccccacgccgagcucccaccucgccagcuccaccaucgccuuccccagcacgccccgcaccacggccuccacccacaccgcgcccgccuucagcucccagagcaccacgucccggagcaccucccugaccacccgcgugccgacgagcggcuucgugucccugaccagcggcgucaccgggauccccaccucccccgugacgaaccucaccacccggcaccccggcccgacccugagccccacgacccgcuuccugaccuccagccucaccgcccacgggagcacgcccgccuccgcccccgugagcucccugggcaccccgacccccaccagccccggcgucugcuccgugcgggagcagcaggaggagaucacguucaaggggugcauggcgaacgucaccgugacccgcugcgagggcgccugcaucagcgccgccuccuucaacaucaucacccagcaggucgacgcgcggugcagcugcugccgcccgcugcacuccuacgagcagcagcucgagcugcccugccccgaccccagcacgccggggcggcgccugguccucacccugcaggucuucucccacugcgugugcagcuccgucgccugcggcgacuga

SEQ ID NO: 33227 - RNA, 1134 nt, Artificial Sequence
  derived and/or modified sequence opt1 from MUC7__Homo_sapiens__NP_001138479
augaagacccugccccucuucgugugcaucugcgcccugagcgccugcuucuccuucagcgagggccgcgagcgggaccacgagcugcgccaccggcgccaccaccaccaguccccgaagagccacuucgagcucccccacuaccccgggcugcuggcgcaccagaagcccuucauccggaaguccuacaagugccuccacaagcgcugccggccgaagcugccccccagccccaacaacccgcccaaguuccccaacccccaccagccgcccaagcaccccgacaagaacuccagcgucgugaaccccacccugguggccacgacccagaucccguccgucaccuuccccagcgccuccaccaagaucacgacccuccccaacgugaccuuccugccccagaacgccaccacgaucagcucccgcgagaacgugaacaccagcuccagcgucgccacccuggcgccggugaacucccccgccccccaggacaccacggccgcccccccgacccccagcgcgaccacccccgcccccccguccagcagcgccccccccgagacgaccgccgccccgcccacccccuccgcgaccacgcaggcccccccgagcuccagcgccccccccgagaccaccgccgcccccccgaccccccccgcgacgacccccgccccgcccuccagcuccgccccccccgagaccaccgccgccccgcccacgcccagcgcgaccacccccgccccgcucuccagcuccgccccccccgagaccacggccgugcccccgacccccagcgccaccacccuggaccccuccagcgcguccgccccgcccgagacgaccgccgccccccccaccccgagcgcgaccacccccgccccccccuccagcccggccccccaggagacgaccgccgcccccaucaccacccccaacuccagcccgacgacccuggcgcccgacaccagcgagaccuccgccgcccccacgcaccagaccaccaccagcgucacgacccagaccaccacgaccaagcagcccaccuccgccccgggccagaacaagaucagccgguuccuccuguacaugaagaaccugcucaaccgcaucaucgacgacaugguggagcaguga

SEQ ID NO: 33228 - RNA, 273 nt, Artificial Sequence
  derived and/or modified sequence opt1 from MUCL1__Homo_sapiens__XP_011536170
augaaguuccuggccgugcucguccugcugggcgugagcaucuuccucguguccgcccagaaccccaccaccgcggccccggccgacacguaccccgccaccgggcccgccgacgacgaggcgcccgacgccgagaccaccgccgccgcgacgaccgccaccaccgccgccccgacgaccgccaccaccgcggccagcacgaccgcccgcaaggacauccccguccugcccaagugggugggcgaccugcccaacgggcgggugugcccguga

SEQ ID NO: 33229 - RNA, 2136 nt, Artificial Sequence
  derived and/or modified sequence opt1 from MUM1__Homo_sapiens__NP_116242
augauggccgacgccaaguacgugcugugccgcugggagaagcggcucuggcccgcgaagguccuggcccgcaccgccaccagcacgaagaacaagcggcgcaaggaguacuuccuggccgugcagauccucucccuggaggagaagaucaaggucaagagcaccgagguggagauccuggagaagucccagaucgaggccaucgcgagcucccucgccagccagaacgaggugccggccgcgccccuggaggagcuggccuaccggcgcucccuccggguggcccuggacguccugagcgagggcuccaucuggagccaggaguccagcgccgggaccggccgcgccgaccggucccuccgcgggaagcccauggagcacgugagcucccccugcgacagcaacuccagcucccugccgcggggcgacgugcuggggagcagccgcccccaccggcgccggcccugcguccagcagucccucagcuccagcuucacgugcgagaaggaccccgagugcaagguggaccacaagaagggccugcgcaaguccgagaacccgcggggcccccuggugcuccccgccgggggcggggcgcaggacgagagcggcucccgcauccaccacaagaacuggacccuggccagcaagcggggcggcaacuccgcccagaaggccagccugugccucaacggcuccagccuguccgaggacgacaccgagcgcgacauggggagcaagggcggguccugggccgcgcccagccugccguccggcguccgggaggacgaccccugcgccaacgccgagggccacgaccccgggcucccccugggcagccugaccgccccgcccgcccccgagcccuccgcgugcagcgagccgggggagugccccgccaagaagcgcccccgccucgacggcagccagcggcccccggccgugcagcuggagcccauggccgccggggcggcccccucccccggcccgggccccgggccccgcgagagcgugaccccgcgguccacggcccgccuggggcccccgcccagccacgccuccgcggacgccacccggugccuccccugccccgacagccagaagcuggagaaggagugccaguccagcgaggaguccauggggagcaacuccaugcgcagcauccuggaggaggacgaggaggacgaggagccgccccggguccuccuguaccacgagccccgcuccuucgaggugggcaugcugguguggcacaagcacaagaaguaccccuucuggcccgccgucgucaagagcgugcggcagcgcgacaagaaggccuccgugcucuacaucgaggggcacaugaaccccaagaugaagggcuucaccgugagccugaagucccugaagcacuucgacugcaaggagaagcagacccuccugaaccaggcccgggaggacuucaaccaggacaucggcuggugcgugagccugaucacggacuaccgcguccggcucgggugcggcagcuucgcgggguccuuccuggaguacuacgccgccgacaucagcuacccggugcgcaaguccauccagcaggacguccugggcaccaagcucccccagcugagcaaggggucccccgaggagcccguggugggcugcccgcugggccagcggcagcccugccgcaagaugcuccccgaccggagccgcgccgcccgggaccgcgcgaaccagaagcuggucgaguacaucgugaaggccaagggggccgagucccaccuccgcgccauccucaagagccggaagcccucccgcuggcugcagaccuuccugagcuccagccaguacgugaccugcgucgagacguaccuggaggacgagggccagcuggaccugguggugaaguaccugcagggggucuaccaggaggugggcgccaaggugcuccagcggaccaacggcgaccgcauccgguucauccuggacguccugcucccggaggcgaucaucugcgccaucuccgccguggacgagguggacuacaagaccgccgaggagaaguacaucaaggggcccagccuguccuaccgcgagaaggagaucuucgacaaccagcugcucgaggagcggaaccgccggcgccgguga

SEQ ID NO: 33230 - RNA, 1095 nt, Artificial Sequence
  derived and/or modified sequence opt1 from MURC__Homo_sapiens__NP_001018126
auggagcacaacggcagcgccuccaacgccgacaagauccaccagaaccgccugagcuccgugaccgaggacgaggaccaggacgcggcccucaccaucgucacggugcuggacaagguggccagcaucgucgacuccgugcaggccagccagaagcggaucgaggagcgccaccgggagauggagaacgccaucaaguccgugcagaucgaccugcucaagcugagccagucccacagcaacaccgggcacaucaucaacaagcuguucgagaagacccgcaaggucuccgcgcacaucaaggacgugaaggcccggguggagaagcagcagauccacgucaagaagguggaggugaagcaggaggagaucaugaagaagaacaaguuccgcgucgugaucuuccaggagaaguuccggugccccaccagccucuccguggucaaggaccgcaaccugacggagaaccaggaggaggacgacgacgacaucuucgacccgcccguggaccugagcuccgacgaggaguacuacguggaggagagccgguccgcccgccuccgcaagagcggcaaggagcacaucgacaacaucaagaaggccuucuccaaggagaacaugcagaagacccggcagaaccuggacaagaaggucaaccggauccgcacccggaucgugacccccgagcgccgggagcgccugcggcagagcggggagcgccuccggcagagcggcgagcgccugcgccaguccggggagcgguucaagaaguccaucagcaacgcggcccccagcaaggaggccuucaagaugcgcucccugcggaagggcaaggaccgcacgguggccgagggcgaggagugcgcccgggagaugggggucgacaucaucgcgcgcagcgagucccucggcccgaucagcgagcuguacuccgacgagcugagcgagcccgagcacgaggccgcccggcccguguacccgccccacgaggggcgcgagauccccacccccgagccccucaaggugaccuucaagucccaggucaagguggaggacgacgagagccugcugcucgaccugaagcacuccagcuga

SEQ ID NO: 33231 - RNA, 1656 nt, Artificial Sequence
  derived and/or modified sequence opt1 from MUS81__Homo_sapiens__XP_011543572
auggccgcccccgugcgccugggccggaagcgcccgcuccccgcgugccccaacccccuguucguccgguggcugaccgaguggcgcgacgaggccacccggagccgccggcgcacgcgguucguguuccagaaggcccuccgcucccugcggcgcuacccgcugccccuccggagcgggaaggaggccaagauccugcagcacuucggcgacgggcugugccgcaugcucgacgagcggcugcagcgccaccggaccuccggcggggaccacgcccccgacagccccuccggcgagaacagcccggcgccccagggccgccuggccgaggugcaggacuccagcaugcccguccccgcccagccgaaggccgggggcuccgggagcuacuggcccgcgcggcacuccggcgcccgcgugauccuccuggugcuguaccgggagcaccucaaccccaacgggcaccacuuccugaccaaggaggagcugcuccagcgcugcgcccagaaguccccgcgcgucgcccccggcagcgcccggcccuggcccgcgcugcgcagccugcuccaccggaaccuggugcugcgcacccaccagcccgcccgguacucccucacgccggagggccuggagcuggcccagaagcucgccgagagcgaggggcugucccugcucaacgugggcaucgggcccaaggagccgcccggcgaggagaccgccguccccggcgcggccagcgccgagcuggccuccgaggccggggugcagcagcagccccuggagcuccgccccggcgaguaccgggugcugcugugcgucgacaucggggagacccgcggcgggggccaccggcccgagcuccugcgcgagcugcagcggcuccacgugacccacacggugcgcaagcugcacgucggcgacuucguguggguggcgcaggagaccaacccgcgggaccccgccaaccccggggagcugguccucgaccacaucguggagcgcaagcggcuggacgaccugugcagcagcaucaucgacggccgcuuccgggagcagaaguuccgccucaagcggugcgggcuggagcgccgcguguaccuggucgaggagcacggcuccgugcacaaccucagccugccggaguccacccugcugcaggccgugaccaacacgcaggucaucgacggguucuucgugaagcggaccgccgacaucaaggagagcgccgcguaccucgcccugcugacccgcggccuccagcggcuguaccagggccacacccugcgcucccggcccugggggacgcccggcaaccccgagagcggggccaugaccuccccgaacccccucugcagccugcugaccuucuccgacuucaacgccggcgcgaucaagaacaaggcccagagcguccgcgagguguucgcccggcagcucaugcagguccgcgggguguccggcgagaaggccgccgcgcugguggaccgguacagcacccccgccucccugcucgccgccuacgacgccugcgcgacgcccaaggagcaggagacccugcugagcaccaucaagugcggccgccuccagcggaaccuggggccggcccugucccgcacccucagccagcuguacugcuccuacggcccccugacguga

SEQ ID NO: 33232 - RNA, 2352 nt, Artificial Sequence
  derived and/or modified sequence opt1 from MUSK__Homo_sapiens__NP_001159752
augcgcgagcuggugaacaucccccucguccacauccugacccugguggccuucagcggcaccgagaagcucccgaaggcccccgugaucacgacgccccuggagaccgucgacgcgcugguggaggagguggccaccuucaugugcgccgucgaguccuacccccagccggagaucagcuggacccggaacaagauccucaucaagcuguucgacacccgcuacuccauccgggagaacgggcagcugcucaccauccugagcguggaggacuccgacgacggcaucuacugcugcaccgccaacaacggggugggcggggccgucgagagcugcggcgcgcuccaggugaagaugaagcccaagaucacgcgcccgcccaucaacgugaagaucaucgagggccugaaggccguccugcccugcaccaccauggggaaccccaagcccuccgugagcuggaucaagggcgacagcccccugcgggagaacucccgcaucgccgugcucgaguccgggagccugcggauccacaacguccagaaggaggacgccggccaguaccgcugcguggcgaagaacucccuggggaccgccuacagcaagguggucaagcucgagguggaggaggaguccgagccggagcaggacacgaagguguucgcccggauccugcgcgcccccgagagccacaacgucaccuucggcuccuucgugacccugcacugcaccgccacgggcauccccgugcccaccaucaccuggaucgagaacgggaacgcggucagcuccggcagcauccaggagagcgugaaggaccgggucaucgacucccgccuccagcuguucaucaccaagccggggcuguacacgugcaucgccaccaacaagcacggcgagaaguucagcaccgccaaggccgccgcgaccaucuccaucgccgaguggcgggaguacugccucgccgugaaggagcuguucugcgccaaggaguggcuggugauggaggagaagacgcaccgcggccucuaccggagcgagaugcaccuccuguccguccccgagugcagcaagcugcccuccaugcacugggaccccaccgccugcgcgcgccugccgcaccuggccuucccgcccaugaccagcuccaagcccagcguggacauccccaaccuccccuccagcuccagcuccagcuucuccgugagccccaccuacuccaugacggucaucaucagcaucaugagcuccuucgccaucuucgugcugcugaccaucaccacccucuacugcugccggcgccggaagcaguggaagaacaagaagcgcgagagcgccgccgugacgcugaccacccugcccuccgagcuccugcuggaccggcuccacccgaaccccauguaccagcgcaugccccugcugcucaacccgaagcugcugagccucgaguacccccgcaacaacaucgaguacguccgggacaucggggagggcgcguucgggcgcguguuccaggcccgggcccccggccugcugcccuacgagccguucaccaugguggccgucaagaugcugaaggaggaggcguccgccgacaugcaggccgacuuccagcgcgaggccgcccucauggcggaguucgacaaccccaacaucgugaagcugcugggggugugcgccgucggcaagcccaugugccuccuguucgaguacauggccuacggcgaccugaacgaguuccuccggagcaugagcccccacacggugugcucccugucccacagcgaccuguccaugcgcgcccaggugagcuccccggggcccccgccccucagcugcgccgagcagcugugcaucgcgcggcaggucgccgccggcauggccuaccuguccgagcgcaaguucgugcaccgggaccucgccacccgcaacugccuggugggggagaacauggucgugaagaucgcggacuucggccugagccggaacaucuacuccgccgacuacuacaaggccaacgagaacgacgccauccccauccgcuggaugccgcccgagagcaucuucuacaaccgguacaccaccgagagcgacgugugggcguacggggucgugcucugggagaucuucuccuacggccugcagcccuacuacggcauggcccacgaggaggugaucuacuacguccgcgacgggaacauccugagcugccccgagaacugccccguggagcucuacaaccugaugcggcugugcugguccaagcuccccgccgaccgccccagcuucaccuccauccaccggauccuggagcgcaugugcgagcgggccgagggcacggugagcgucuga

SEQ ID NO: 33233 - RNA, 2253 nt, Artificial Sequence
  derived and/or modified sequence opt1 from MUT__Homo_sapiens__NP_000246
augcugcgcgccaagaaccagcuguuccuccugagcccccacuaccuccgccaggugaaggaguccagcggcucccggcugauccagcagcggcugcuccaccagcagcagccgcugcaccccgagugggccgcgcuggccaagaagcagcucaaggggaagaaccccgaggaccugaucuggcacacccccgagggcaucagcaucaagccgcuguacuccaagcgcgacaccauggaccuccccgaggagcugcccggggucaagcccuucacgcggggcccguaccccaccauguacaccuuccgccccuggaccauccggcaguacgccggguucagcacgguggaggaguccaacaaguucuacaaggacaacaucaaggccggccagcagggccugagcguggccuucgaccucgcgacccaccgcggguacgacuccgacaacccccggguccgcggcgacguggggauggccggcguggccaucgacaccgucgaggacaccaagauccuguucgacgggaucccgcuggagaagaugagcguguccaugacgaugaacggcgccgugauccccguccucgcgaacuucaucgugaccggcgaggagcagggggugcccaaggagaagcugaccggcaccauccagaacgacauccugaaggaguucaugguccggaacacguacaucuucccgcccgagcccagcaugaagaucaucgccgacaucuucgaguacaccgccaagcacaugcccaaguucaacuccaucagcaucuccggguaccacaugcaggaggccggcgccgacgcgauccucgagcuggccuacacccuggccgacggccucgaguacagccgcaccgggcugcaggccggccugacgaucgacgaguucgcgccccggcucuccuucuucugggggaucggcaugaacuucuacauggagaucgccaagaugcgcgccgggcggcgccugugggcccaccugaucgagaagauguuccagccgaagaacagcaagucccuccugcugcgggcccacugccagaccagcggcuggagccucaccgagcaggaccccuacaacaacaucgugcgcaccgccaucgaggcgauggccgccguguucggcgggacgcagucccugcacaccaacagcuucgacgaggcccugggccuccccaccgucaaguccgcccggaucgcgcgcaacacccagaucaucauccaggaggagagcgggauccccaagguggccgacccguggggcggguccuacaugauggagugccugacgaacgacguguacgacgccgcccugaagcucaucaacgagaucgaggagaugggcggcauggcgaaggccgucgccgaggggauccccaagcugcggaucgaggagugcgccgcccgccgccaggcgcggaucgacagcggcuccgaggugaucgugggggucaacaaguaccagcuggagaaggaggacgccguggaggugcucgccaucgacaacaccagcguccgcaaccggcagaucgagaagcugaagaagaucaaguccagccgcgaccaggcccuggccgagcggugccucgcggcccugaccgagugcgccgccuccggcgacgggaacauccuggcccucgcgguggacgccagccgcgcccggugcaccgucggcgagaucacggacgcccugaagaagguguucggcgagcacaaggcgaacgaccgcaugguguccggggccuaccggcaggaguucggcgagagcaaggagaucaccuccgccaucaagcgcguccacaaguucauggagcgggaggggcgccggccccgccugcugguggccaagaugggccaggacggccacgaccgcggggccaaggugaucgcgaccggcuucgccgaccucggguucgacgucgacaucggcccccuguuccagaccccgcgggagguggcccagcaggccguggacgccgacguccacgcgguggggaucagcacgcuggccgccggccacaagacccucgugcccgagcugaucaaggagcugaacucccucggccggcccgacauccuggucaugugcgggggcgugaucccgccccaggacuacgaguuccuguucgaggugggggucagcaacguguucggccccgggacccgcauccccaaggccgccgugcagguccucgacgacaucgagaagugccuggagaagaagcagcaguccguguga

SEQ ID NO: 33234 - RNA, 1611 nt, Artificial Sequence
  derived and/or modified sequence opt1 from MUTYH__Homo_sapiens__NP_001280119
augacgccccuggugagccgccucucccggcugugggccaucaugcgcaagccgcgggccgcggugggcagcgggcaccgcaagcaggccgccucccaggagggccggcagaagcacgccaagaacaacagccaggccaagcccuccgcgugcgacgccgggcuggcccgccagcccgaggagguggugcuccaggccagcgucuccagcuaccaccuguuccgggacguggcggaggugaccgccuuccgcggcucccugcucagcugguacgaccaggagaagcgggaccugcccuggcgccggcgcgccgaggacgagauggaccuggaccggcgcgccuacgccgucuggguguccgaggugaugcuccagcagacccaggucgcgaccgugaucaacuacuacaccggguggaugcagaaguggccgacccugcaggaccuggccagcgccucccucgaggaggugaaccagcugugggccggccugggcuacuacagccgggggcgccggcuccaggagggcgcccgcaaggucguggaggagcucgggggccacaugccccggacggcggagacccugcagcagcugcugcccggggugggccgcuacaccgccggcgccaucgccuccaucgccuucgggcaggcgaccggcgucguggacgggaacguggcccggguccugugccgcgugcgcgccaucggcgccgaccccagcuccacgcucgugagccagcagcuguggggccuggcccagcagcucgucgacccggcgcggcccggggacuucaaccaggccgccauggagcugggcgccaccgugugcacgccccagcgcccccugugcucccagugcccgguggagagccucugccgggcgcgccagcgggucgagcaggagcagcugcuggccagcgggucccucagcggcucccccgacguggaggagugcgcccccaacaccgggcagugccaccugugccugcccccgagcgagcccugggaccagacccucggcgucgugaacuucccccgcaaggccucccggaagcccccgcgcgaggagagcuccgcgaccugcgugcuggagcagcccggcgcccugggggcccagauccuccugguccagcggcccaacagcggccugcucgccgggcugugggaguuccccuccgugaccugggagccgagcgagcagcugcagcgcaaggcccuccugcaggagcugcagcggugggccggcccccuccccgcgacccaccuccgccaccugggggaggugguccacacguucucccacaucaagcugaccuaccagguguacggccuggcccuggagggccagacccccgugaccacggucccgcccggggcccgguggcugacccaggaggaguuccacaccgccgccgugagcaccgcgaugaagaagguguuccgcgucuaccagggccagcagcccgggacgugcaugggcuccaagcggagccagguguccagcccgugcucccgcaagaagccccggauggggcagcagguccucgacaacuucuuccgcagccacaucuccaccgacgcccacagccugaacagcgccgcccaguga

SEQ ID NO: 33235 - RNA, 666 nt, Artificial Sequence
  derived and/or modified sequence opt1 from MVB12B__Homo_sapiens__NP_001011703
augcgcagcugcuucugcgugcggcgcucccgggacccgcccccgccccagcccccgcccccgccgccccagcgcggcaccgaccagagcaccaugcccgaggucaaggaccuguccgaggcccuccccgagacgagcauggaccccaucaccggggugggcguggucgccucccggaaccgcgcgcccaccggguacgacgugguggcccagaccgccgacggcgucgacgccgaccuguggaaggacgggcuguucaagagcaaggugacgcgguaccucugcuucacccgcuccuucagcaaggagaacucccaccugggcaacgugcuggucgacaugaagcucaucgacaucaaggacacccugcccgugggcuucauccccauccaggagaccguggacacgcaggaggucgccuuccggaagaagcgccugugcaucaaguucaucccccgggacagcaccgaggcggccaucugcgacauccgcaucauggggcggaccaagcaggccccgccccaguacaccuucaucggcgagcucaacuccauggggaucugguaccgcaugggccgggugccccgcaaccacgacagcucccagcccacgacccccagccaguccagcgccgcguccacccccgcccccaaccugccccgguga

SEQ ID NO: 33236 - RNA, 1203 nt, Artificial Sequence
  derived and/or modified sequence opt1 from MVD__Homo_sapiens__NP_002452
auggccagcgagaagccccuggccgcggugacgugcaccgccccggucaacaucgccgugaucaaguacuggggcaagcgcgacgaggagcucgugcugcccaucaacuccagccuguccgucacgcuccaccaggaccagcugaagaccaccaccacggccgugaucagcaaggacuucaccgaggaccggaucuggcugaacgggcgcgaggaggacgugggccagccccggcuccaggccugccugcgcgagauccggugccuggcgcgcaagcggcgcaacucccgggacggggacccccucccgagcucccugagcugcaagguccacguggccuccgugaacaacuuccccaccgccgccggccuggcgagcuccgccgccggguacgccugccucgccuacacccuggcgcgcgucuacggcguggagagcgaccuguccgagguggcccggcgcggcagcggguccgccugccggagccucuacggcggguucgucgaguggcagaugggcgagcaggccgacgggaaggacuccaucgcccgccagguggcgcccgagagccacuggcccgagcugcgggugcugauccucgucguguccgccgagaagaagcugacgggcagcaccgugggcaugcgcgccagcgucgagaccuccccgcugcuccgguuccgcgccgagagcguggugcccgcccggauggcggagauggcccgcugcauccgggagcgcgacuuccccuccuucgcccagcugaccaugaaggacagcaaccaguuccacgccacgugccuggacaccuucccgcccaucuccuaccucaacgccaucagcuggcgcaucauccaccugguccaccgguucaacgcgcaccacggggacaccaagguggccuacaccuucgacgccggccccaacgccgugaucuucacgcuggacgacaccgucgcggaguucguggccgccgucuggcacggguucccgcccggcuccaacggcgacaccuuccucaaggggcuccaggugcgccccgcgccccugagcgccgagcugcaggccgcccuggccauggagcccacccccggcggggugaaguacaucaucgucacccaggugggcccggggccccagauccuggacgaccccugcgcccaccuccugggccccgacggccugccgaagcccgccgcguga

SEQ ID NO: 33237 - RNA, 1035 nt, Artificial Sequence
  derived and/or modified sequence opt1 from MVK__Homo_sapiens__NP_001288111
augcugagcgaggugcuccuggucuccgcccccggcaaggugauccugcacggggagcacgccgugguccacggcaagguggcgcucgccgugagccugaaccugcgcaccuuccuccggcugcagccgcacuccaacgggaaggucgaccugagccuccccaacaucggcaucaagcgcgccugggacguggcccggcugcagucccuggacaccagcuuccucgagcagggggacgugacgacccccaccuccgagcaggucgagaagcugaaggagguggccggccugcccgacgacugcgcggugaccgagcgccucgccguccuggccuuccuguaccucuaccugagcaucugccggaagcagcgcuggacgaaggaggaccuggagcucaucaacaagugggccuuccagggcgagcggaugauccacgggaacccguccggcguggacaacgcggugagcaccuggggcggggcccugcgcuaccaccaggggaagaucuccagccugaagcggucccccgcccuccagauccugcugaccaacaccaaggucccccgcaacacgcgggcccucguggccggcgugcgcaaccggcugcugaaguuccccgagaucgucgcgccgcuccugaccagcaucgacgccaucucccuggagugcgagcgcgugcucggcgagaugggggaggcccccgcccccgagcaguaccuggugcuggaggagcucaucgacaugaaccagcaccaccugaacgcccugggcgucgggcacgcgagccucgaccagcugugccaggugacccgggcccgcggccugcacuccaagcucaccggcgccgggggcgggggcugcgggaucacgcugcugaagcccggccucgagcagccggagguggaggccaccaagcaggcccugaccagcugcggcuucgacugccuggagaccuccaucggggcgcccggcgucagcauccacagcgccacgucccucgacagccgggugcagcaggcccuggacgggcuguga

SEQ ID NO: 33238 - RNA, 2502 nt, Artificial Sequence
  derived and/or modified sequence opt1 from MVP__Homo_sapiens__NP_001280133
auggccaccgaggaguucaucauccgcaucccgcccuaccacuacauccacgugcuggaccagaacagcaacgucucccggguggaggugggccccaagaccuacauccgccaggacaacgagcggguccucuucgcccccaugcgcauggugacggugcccccgcggcacuacugcaccgucgcgaaccccgugagccgcgacgcccaggggcuggugcuguucgacgucaccggccaggugcggcuccgccacgccgaccuggagauccggcuggcccaggaccccuucccccucuacccgggggaggugcuggagaaggacaucacgccccugcaggucgugcuccccaacaccgcccugcaccugaaggcgcuccuggacuucgaggacaaggacggcgacaagguggucgccggggacgaguggcuguucgagggccccggcaccuacaucccgcgcaaggagguggagguggucgagaucauccaggccaccaucauccggcagaaccaggcccuccgccugcgggcgcgcaaggagugcugggaccgggacgggaaggagcgcgugaccggcgaggaguggcuggugacgaccgucggggccuaccuccccgccguguucgaggaggugcuggaccuggucgacgccgugauccucaccgagaagaccgcccugcaccuccgggcgcgccggaacuuccgcgacuuccggggcgucucccgccgcacgggggaggaguggcuggugaccgugcaggacaccgaggcccacguccccgacgugcacgaggaggugcugggcgucgugcccaucaccacgcugggcccgcacaacuacugcgugauccucgaccccgucgggcccgacggcaagaaccagcuggggcagaagcggguggugaagggcgagaaguccuucuuccugcagcccggcgagcagcucgagcaggggauccaggacgucuacgugcuguccgagcagcagggccugcuccugcgcgcccugcagccgcucgaggagggggaggacgaggagaaggugagccaccaggccggcgaccacuggcugauccgggggccccuggaguacguccccuccgccaagguggagguggucgaggagcgccaggcgaucccccucgacgagaacgagggcaucuacgugcaggacgugaagaccggcaagguccgggccgugaucgggagcaccuacaugcugacccaggacgaggugcugugggagaaggagcucccgcccggcgucgaggagcugcugaacaaggggcaggacccccucgccgaccgcggcgagaaggacacggccaagucccugcagccccuggccccgcggaacaagacccgcguggugagcuaccgggucccccacaacgcggccguccagguguacgacuaccgcgagaagcgggcccgcgugguguucgggcccgagcucgugucccugggcccggaggagcaguucaccguccugagccuguccgccggccggcccaagcgcccccacgcccggcgcgcgcucugccugcugcucgggcccgacuucuucaccgacgugaucacgaucgagaccgccgaccacgcccggcugcagcugcagcucgccuacaacuggcacuucgaggugaacgaccgcaaggacccgcaggagaccgcgaagcuguucagcguccccgacuucgugggcgacgccugcaaggccaucgccucccgggugcgcggggccgucgcgagcgugaccuucgacgacuuccacaagaacuccgcccgcaucauccggacggccguguucggcuucgagaccagcgaggccaaggggcccgacggcauggcccugccccgcccgcgggaccaggcggucuucccccagaacggccucgugguguccagcgucgacgugcagagcguggagcccgucgaccagcgcacccgggacgcccugcagcgcuccgugcagcuggccaucgagaucaccacgaacagccaggaggccgccgcgaagcacgaggcccagcggcucgagcaggaggcccgcgggcggcuggagcgccagaagauccuggaccaguccgaggccgagaaggcgcggaaggagcuccuggagcuggaggcccucagcauggccguggaguccaccggcaccgccaaggccgaggcggagagccgcgccgaggccgcccggaucgagggggagggcuccguccugcaggccaacaccauccgcgaccuggcgguggccggccccgagaugcaggucaagcuccugcagagccuggggcucaaguccacgcugaucaccgacggcagcaccccgaucaaccuguucaacaccgccuucgggcuccugggcauggggcccgagggccagccccugggccggcgcguggccuccgggcccagcccgggcgaggggaucagcccccagagcgcccaggcgccccaggcccccggcgacaaccacguggucccggugcuccgguga

SEQ ID NO: 33239 - RNA, 1989 nt, Artificial Sequence
  derived and/or modified sequence opt1 from MX1__Homo_sapiens__XP_005261039
augguggucagcgagguggacaucgccaaggccgaccccgcggccgccucccacccgcugcuccugaacggcgacgccaccguggcccagaagaaccccgggagcgucgcggagaacaaccugugcucccaguacgaggagaaggugcgccccugcaucgaccucaucgacagccugcgggcccugggcguggagcaggaccucgcccugcccgccaucgcggucaucggggaccaguccagcggcaaguccagcgugcuggaggcccucuccgggguggcccugccgcgcggcagcggcaucgucacccggugcccccuggugcucaagcugaagaagcuggugaacgaggacaaguggcgcgggaaggucuccuaccaggacuacgagaucgagaucagcgacgccuccgagguggagaaggagaucaacaaggcccagaacgcgaucgccggcgaggggaugggcaucagccacgagcucaucacgcuggagaucuccagccgggacgugcccgaccugacccucaucgaccugcccgggaucacccgcgucgccgugggcaaccagccggccgacaucggcuacaagaucaagacccugaucaagaaguacauccagcggcaggagacgaucucccucguggucgugcccagcaacguggacaucgccaccaccgaggcgcuguccauggcccaggaggucgaccccgagggggaccgcaccaucggcauccugacgaagcccgaccucguggacaaggggaccgaggacaagguggucgacgugguccggaaccugguguuccaccugaagaagggcuacaugaucgugaagugccgcggccagcaggagauccaggaccagcucagccugagcgaggcccugcagcgggagaagaucuucuucgagaaccacccguacuuccgcgaccuccuggaggaggggaaggccaccguccccugccuggccgagaagcucaccuccgagcugaucacgcacaucugcaagagccugccccuccuggagaaccagaucaaggagacccaccagcggaucaccgaggagcugcagaaguacggcguggacauccccgaggacgagaacgagaagauguucuuccucaucgacaaggugaacgcguucaaccaggacaucaccgcccugaugcagggggaggagacggucggcgaggaggacauccgccuguucacccggcuccgccacgaguuccacaagugguccaccaucaucgagaacaacuuccaggaggggcacaagauccugagccggaagauccagaaguucgagaaccaguaccgcggccgggagcugccgggcuucgugaacuaccgcaccuucgagacgaucgugaagcagcagaucaaggcccucgaggagcccgccgucgacaugcugcacaccgugaccgacauggugcggcuggccuucaccgacgucuccaucaagaacuucgaggaguucuucaaccuccaccgcacggccaagagcaagaucgaggacauccgcgcggagcaggagcgggagggggagaagcugauccgccugcacuuccagauggagcagaucguguacugccaggaccagguguaccggggcgcccugcagaagguccgcgagaaggagcucgaggaggagaagaagaagaaguccugggacuucggggccuuccagagcuccagcgcgaccgacuccagcauggaggagaucuuccagcaccugauggccuaccaccaggaggccuccaagcggaucagcucccacaucccccugaucauccaguucuucaugcuccagaccuacggccagcagcugcagaaggccaugcugcagcuccugcaggacaaggacaccuacagcuggcugcucaaggagcgcuccgacacgagcgacaagcggaaguuccugaaggagcgccuggcccggcucacccaggcgcgccggcgccuggcccaguuccccggguga

SEQ ID NO: 33240 - RNA, 2148 nt, Artificial Sequence
  derived and/or modified sequence opt1 from MX2__Homo_sapiens__XP_011527874
augagcaaggcccacaagcccuggccguaccgccggcgcucccaguucagcucccggaaguaccugaagaaggagaugaacagcuuccagcagcagcccccgcccuucggcaccgugccgccccagaugauguucccgcccaacuggcagggggccgagaaggacgcggccuuccucgccaaggacuucaacuuccugacccugaacaaccagcccccgcccggcaaccgcucccagccccgggccauggggcccgagaacaaccucuacagccaguacgagcagaagguccgccccugcaucgaccugaucgacucccugcgggcccucggcguggagcaggaccuggcgcugcccgccaucgccgugaucggggaccagagcuccggcaagagcuccguccucgaggcccugagcggcguggcgcugccccgcggguccggcaucgugacgcggugcccgcucguccugaagcugaagaagcagcccugcgaggccugggccgggcgcaucagcuaccggaacaccgagcucgagcugcaggaccccggccagguggagaaggagauccacaaggcccagaacgugauggccgggaacggccgcggcaucucccacgagcugaucagccucgagaucaccucccccgaggucccggaccugaccaucaucgaccugcccgggaucacgcggguggcgguggacaaccagccccgcgacaucggccuccagaucaaggcccugaucaagaaguacauccagcggcagcagaccaucaaccuggucguggugcccugcaacgucgacaucgccaccaccgaggcccucagcauggcccacgagguggaccccgagggggaccgcacgaucggcauccugaccaagcccgaccugauggaccggggcaccgagaaguccgugaugaacgucgugcgcaaccucaccuacccccugaagaagggguacaugaucgugaagugccggggccagcaggagaucacgaaccgccugagccucgcggaggccaccaagaaggagaucaccuucuuccagacccaccccuacuuccggguccugcuggaggaggggagcgccacggugccgcgccucgccgagcgccugaccaccgagcugaucaugcacauccagaagucccucccccugcuggagggccagauccgggagagccaccagaaggccaccgaggagcuccgccggugcggggcggacauccccucccaggaggccgacaagauguucuuccugaucgagaagaucaagauguucaaccaggacaucgagaagcugguggagggcgaggaggucgugcgcgagaacgagacgcggcucuacaacaagauccgcgaggacuucaagaacugggucggcauccuggccaccaacacccagaaggugaagaacaucauccacgaggagguggagaaguacgagaagcaguaccgggggaaggagcugcucggcuucgucaacuacaagaccuucgagaucaucgugcaccaguacauccagcagcugguggagccggcccugagcaugcuccagaaggccauggagaucauccagcaggcguucaucaacgucgccaagaagcacuucggggaguucuucaaccugaaccagacggugcaguccaccaucgaggacaucaaggugaagcacaccgccaaggccgagaacaugauccagcugcaguuccgcauggagcagauggucuucugccaggaccagaucuacagcguggugcugaagaagguccgggaggagaucuucaacccccucggcacccccucccagaacaugaagcugaacagccacuuccccuccaacgagagcuccgugagcuccuucacggagaucgggauccaccugaacgcguacuuccucgagaccagcaagcgccuggccaaccagaucccguucaucauccaguacuucaugcugcgggagaacggcgacucccuccagaaggccaugaugcagauccugcaggagaagaaccgcuacagcuggcugcuccaggagcaguccgagaccgccaccaagcggcgcauccugaaggagcggaucuaccgccugacgcaggcccggcacgcgcucugccaguucagcuccaaggagauccacuga

SEQ ID NO: 33241 - RNA, 636 nt, Artificial Sequence
  derived and/or modified sequence opt1 from MXD1__Homo_sapiens__NP_001189443
auggccgccgcggugcgcaugaacauccagaugcugcucgaggccgccgacuaccuggagcggcgcgagcgggaggccgagcacggcuacgccagcaugcugcccuacaacaacaaggaccgcgacgcgcucaagcggcgcaacaaguccaagaagaacaacagcuccagccggcgcgcccaccuccggcugugccuggagaagcugaaggggcuggucccgcucggccccgaguccagccgccacaccacccugucccugcucacgaaggccaagcugcacaucaagaagcuggaggacugcgaccggaaggccgugcaccagaucgaccagcuccagcgcgagcagcggcaccugaagcgccagcuggagaagcucgggaucgagcggauccgcauggacagcaucggcuccaccgugagcuccgagcggagcgacuccgaccgcgaggagaucgacgucgacguggagagcaccgacuaccugaccggggaccuggacugguccagcuccagcguguccgacagcgacgagcggggcagcaugcagucccucggcagcgacgagggguacuccagcacguccaucaagcgcaucaagcugcaggacagccacaaggcgugccugggccucuga

SEQ ID NO: 33242 - RNA, 582 nt, Artificial Sequence
  derived and/or modified sequence opt1 from MXD3__Homo_sapiens__NP_001136407
auggagccccuggccagcaacauccaggugcuccugcaggccgcggaguuccuggagcgccgggagcgcgaggccgagcacggcuacgccucccucugcccgcaccggagccccgggcccauccaccgccggaagaagcggcccccgcaggcccccggcgcccaggacuccgggcgcagcguccacaacgagcuggagaagcgccggcgcgcgcagcugaagcggugccucgagcgccugaagcagcagaugccccugggcgccgacugcgcccgguacaccacccucucccugcugcgccgggcccgcaugcacauccagaagcucgaggaccaggagcagcgggcgcgccagcugaaggagcggcugcgcagcaagcagcagucccuccagcggcagcuggagcagcugcgcgggcucgccggcgccgccgagcgcgagcggcugcgcgccgacagccuggacuccagcggccucuccagcgagcgguccgacagcgaccaggugcugcccaacgagaacgggggcacgccgaaccaccgccccaccgggcggggcaacaacaucuccagccaccacuga

SEQ ID NO: 33243 - RNA, 630 nt, Artificial Sequence
  derived and/or modified sequence opt1 from MXD4__Homo_sapiens__NP_006445
auggagcugaacagccuccugauccugcucgaggccgccgaguaccuggagcgccgggaccgcgaggcggagcacggcuacgccuccgugcugcccuucgacggggacuucgcccgggagaagaccaaggccgccggccucguccgcaaggcgccgaacaaccggagcucccacaacgagcuggagaagcaccgccgggccaagcugcgccucuaccuggagcagcugaagcagcucgugccccuggggcccgacagcacccggcacacgacccugucccuccugaagcgcgccaaggugcacaucaagaagcuggaggagcaggaccggcgcgcccucagcaucaaggagcagcugcagcaggagcaccgguuccugaagcgccggcucgagcagcuguccguccagagcguggagcgcgugcggaccgacuccaccggcagcgcggucuccacggacgacagcgagcaggagguggacaucgaggggauggaguucggccccggcgagcuggacuccguggggagcuccagcgacgccgacgaccacuacucccuccagagcggcaccgggggcgacuccggguucggcccgcacugccgccggcugggccgccccgcccugagcuga

SEQ ID NO: 33244 - RNA, 549 nt, Artificial Sequence
  derived and/or modified sequence opt1 from MXI1__Homo_sapiens__NP_001008541
augcccagcccgcgccugcagcacuccaagccgccccggcgccucagccgggcccagaagcacuccagcggcuccagcaacaccuccaccgccaaccgccgggcgcaccuccgccugugccuggagcggcugaaggugcugaucccccucgggcccgacugcacgcgccacaccacccugggccugcucaacaaggccaaggcccacaucaagaagcuggaggaggccgagcgcaagagccagcaccagcuggagaaccucgagcgggagcagcgguuccugaaguggcgccuggagcagcuccaggggccccaggagauggagcggauccgcauggacuccaucggcagcaccaucuccagcgaccgguccgacagcgagcgcgaggagaucgaggucgacguggaguccacggaguucagccacggggagguggacaacaucuccaccaccagcaucuccgacaucgacgaccacagcagccugcccuccaucggcagcgacgagggcuacuccagcgccuccgucaagcugagcuucaccuccuga

SEQ ID NO: 33245 - RNA, 8487 nt, Artificial Sequence
  derived and/or modified sequence opt1 from MXRA5__Homo_sapiens__NP_056234
augcccaagcgcgcccacuggggcgcccugagcguggugcucauccugcugugggggcacccccggguggcccucgccugcccccaccccugcgccugcuacgugcccuccgaggugcacugcaccuuccgcagccuggccuccgugcccgccggcaucgcgaagcacguggagcggaucaaccugggguucaacagcauccaggcccucuccgagaccagcuucgccggccugaccaagcuggagcuccugaugauccacgggaacgagauccccuccauccccgacggcgcccugcgcgaccucagcucccugcaggucuucaaguucagcuacaacaagcugcgggugaucaccggccagacccuccaggggcuguccaaccugaugcgccuccacaucgaccacaacaagaucgaguucauccacccccaggcguucaacggccugaccagccugcggcuccugcaccuggaggggaaccuccugcaccagcugcaccccuccaccuucagcaccuucaccuuccucgacuacuuccgccuguccaccauccggcaccuguaccucgccgagaacauggugcgcacccugcccgccagcaugcugcggaacaugccccuccuggagaaccuguaccuccagggcaaccccuggaccugcgacugcgagaugcgcugguuccuggagugggacgccaagucccgggggauccugaagugcaagaaggacaaggccuacgagggcggccagcucugcgcgaugugcuucagccccaagaagcuguacaagcacgagauccacaagcugaaggacaugaccugccucaagcccuccaucgagagcccccugcgccagaaccggagccgcuccaucgaggaggagcaggagcaggaggaggacgggggcagccagcugauccucgagaaguuccagcugccccagugguccaucagccugaacaugaccgacgagcacgggaacauggucaaccucgugugcgacaucaagaagcccauggacguguacaagauccaccugaaccagaccgacccgcccgacaucgacaucaacgccaccgucgcccuggacuucgagugccccaugacccgggagaacuacgagaagcuguggaagcucaucgccuacuacuccgaggugcccgugaagcugcaccgcgagcugaugcucagcaaggacccccgggucuccuaccaguaccgccaggacgccgacgaggaggcgcuguacuacaccggcgugcgggcccagauccuggccgagcccgagugggugaugcagcccagcaucgacauccagcucaaccgccgccaguccaccgccaagaagguccugcugagcuacuacacccaguacucccagaccaucagcaccaaggacacgcggcaggcccgcggccgguccugggugaugaucgagcccagcggggcggugcagcgcgaccagaccguccucgagggcgggcccugccagcuguccugcaacgugaaggccagcgagucccccagcaucuucugggugcugcccgacggcuccauccucaaggcccccauggacgaccccgacagcaaguucagcauccuguccagcggguggcugcggaucaaguccauggagcccagcgacuccggccucuaccagugcaucgcccagguccgcgacgagauggaccggaugguguaccgcguccuggugcagagcccguccacccagcccgccgagaaggacaccgugacgaucggcaagaaccccggggagagcgucacccugcccugcaacgcgcucgccaucccggaggcccaccuguccuggauccugcccaaccggcgcaucaucaacgaccucgccaacaccagccacguguacaugcugcccaacggcacccuguccauccccaaggugcaggucagcgacuccggguacuaccggugcguggcggugaaccagcagggcgccgaccacuucacggucgggaucaccgugaccaagaagggcagcggccucccguccaagcgcgggcggcgccccggcgccaaggcccugagccgggugcgcgaggacaucgucgaggacgagggcggguccgggaugggcgacgaggagaacaccagccggcgccugcuccaccccaaggaccaggagguguuccugaagacgaaggacgacgccaucaacggcgacaagaaggcgaagaaggggcggcgcaagcugaagcucuggaagcacagcgagaaggagcccgagaccaacguggccgagggccgccgggucuucgagucccgccggcgcaucaacauggccaacaagcagaucaacccggagcggugggccgacauccuggccaaggugcgcgggaagaaccugcccaagggcaccgaggugccgccccugaucaagaccacgagcccgcccucccugagccuggaggucacgccgcccuucccggcgaucagcccgcccagcgccucccccgugcagaccgugaccagcgccgaggaguccagcgccgacgucccgcuccugggcgaggaggagcacgugcuggggaccaucuccagcgccuccaugggccucgagcacaaccacaacggggugauccuggucgagcccgaggugacgagcacgccccucgaggagguggucgacgaccucuccgagaagaccgaggagaucaccagcacggagggcgaccugaaggggaccgcggccccgacccugaucuccgagcccuacgagcccagccccacccuccacacgcuggacaccguguacgagaagccgacccacgaggagaccgccacggagggcugguccgccgcggacgugggcagcagccccgagcccaccuccagcgaguacgagcccccgcuggacgccgucucccucgccgagagcgagcccaugcaguacuucgaccccgaccuggagaccaagucccagcccgacgaggacaagaugaaggaggacaccuucgcccaccugacgccgacccccaccaucugggugaacgacagcuccaccagccagcuguucgaggacuccacgaucggggagcccggcgugcccgggcagagccaccuccagggccugaccgacaacauccaccucgucaaguccagccuguccacccaggacacccugcucaucaagaaggggaugaaggagaugagccagacgcugcagggcggcaacaugcuggagggggacccgacccacucccggagcuccgagagcgagggccaggaguccaagagcaucacccuccccgacagcacccuggggaucauguccagcaugucccccgugaagaagcccgccgagacgaccgugggcacccugcucgacaaggacaccacgaccgcgaccaccacgccgcgccagaaggucgcccccagcuccaccaugagcacccaccccucccggcgccggcccaacgggcgccggcgccugcggccgaacaaguuccgccaccggcacaagcagacgccgcccaccacguucgcccccagcgagaccuucuccacccagccgacccaggcccccgacaucaagaucagcucccagguggagagcucccuggugcccacggccugggucgacaacaccgugaacaccccgaagcagcucgagauggagaagaacgcggagcccaccagcaagggcacgccccgccggaagcacggcaagcgccccaacaagcaccgguacaccccguccaccgugagcucccgcgccagcggguccaagcccagccccagccccgagaacaagcaccgcaacaucgucaccccguccagcgagacgauccugcugccccggaccgugucccucaagaccgagggccccuacgacagccuggacuacaugaccacgacccgcaagaucuacuccagcuaccccaaggugcaggagacccugccggucaccuacaagcccacguccgacgggaaggagaucaaggacgacguggccaccaacguggacaagcacaagagcgacauccucgucaccggcgaguccaucaccaacgccauccccacgagccggucccuggugagcaccaugggggaguucaaggaggaguccagccccgugggcuucccgggcacccccaccuggaaccccucccgcacggcccagcccgggcggcugcagaccggcaucccggucaccaccagcggggagaaccucacggacccgccccugcugaaggagcucgaggacguggacuucaccuccgaguuccugagcucccugaccgucagcacccccuuccaccaggaggaggcgggcagcuccacgacccucagcuccaucaagguggagguggccagcucccaggccgagaccaccacccuggaccaggaccaccuggagacgaccgucgccauccuccugagcgagacccgcccgcagaaccacacccccacggcggcccggaugaaggagcccgccuccagcucccccagcaccauccugaugucccucggccagaccaccacgaccaagccggcccugcccagcccccgcaucucccaggccagccgggacuccaaggagaacguguuccugaacuacguggggaacccggagaccgaggcgacccccgucaacaacgagggcacgcagcacaugagcgggcccaacgagcucuccacccccagcuccgaccaggacgccuucaaccugagcaccaagcuggagcucgagaagcaggucuucggcagccgcucccugccgcgggggcccgacagccagcgccaggacggccgggugcacgccucccaccagcugacccgcguccccgccaagcccauccugccgacggccaccgugcggcuccccgagaugagcacccaguccgcgagccgcuacuucgugaccucccagagcccccggcacuggacgaacaagcccgagaucaccaccuacccguccggcgcccugcccgagaacaagcaguucaccacgccccgccugagcuccaccaccaucccccucccgcugcacaugagcaagcccuccauccccagcaaguucaccgaccggcgcacggaccaguucaacggguacuccaaggucuucggcaacaacaacauccccgaggcccgcaacccgguggggaagccgcccagcccccggaucccgcacuacuccaacggccgccugcccuucuucaccaacaagacccucagcuucccccagcugggggugacccggcgcccgcagauccccacgagccccgcccccgucaugcgggagcgcaaggugaucccgggcuccuacaaccggauccacagccacuccaccuuccaccuggacuucgggccgcccgcgccgccccuccugcacacgccccagaccacggggagccccuccaccaaccugcagaacauccccauggugagcuccacccagagcuccaucagcuucaucaccuccagcguccaguccagcggcuccuuccaccagagcuccagcaaguucuucgccgggggcccgcccgccuccaaguucuggagccucggggagaagccccagauccugaccaagagcccccagaccguguccgugaccgccgagaccgacaccgucuuccccugcgaggccacgggcaagcccaagcccuucgugaccuggaccaagguguccaccggcgcccugaugacgcccaacacccgcauccagcgguucgagguccucaagaacgggacccuggugauccgcaaggugcagguccaggaccggggccaguacaugugcaccgcguccaaccugcacgggcucgaccgcaugguggugcugcugagcgucacggugcagcagccgcagauccucgccucccacuaccaggacgugaccgucuaccugggcgacaccaucgccauggagugccuggccaagggcacccccgcgccccagaucagcuggaucuuccccgaccggcgcguguggcagacgguguccccggucgaggggcggaucacccuccacgagaaccgcacccugagcaucaaggaggccuccuucagcgaccggggcguguacaagugcguggccuccaacgccgccggggcggacagccuggccauccgccuccacgucgccgcccugccgcccgugauccaccaggagaagcuggagaacaucucccucccgcccggccugagcauccacauccacugcaccgccaaggcggcgccccugcccuccgugcgguggguccucggggacggcacgcagauccgccccagccaguuccugcacggcaaccuguucguguuccccaacgggacccucuacauccggaaccuggcccccaaggacuccggccgcuacgagugcguggccgccaaccuggucgggagcgcgcgccggaccgugcagcucaacgugcagcgcgccgccgccaacgcgcggaucaccggcacgagcccccgccggaccgacguccgcuacgggggcacccugaagcuggacugcagcgccagcggcgacccguggccccggauccucuggcgccugcccuccaagcggaugaucgacgcccuguucagcuucgacucccgcaucaagguguucgccaacgggacccucguggucaagagcgugacggacaaggacgccggcgacuaccugugcgucgcgcggaacaaggugggggacgacuacgugguccugaagguggacguggucaugaagcccgccaagaucgagcacaaggaggagaacgaccacaagguguucuacggcggggaccucaagguggacugcgucgccaccggccugccgaaccccgagaucuccuggagccugcccgacggcucccucgugaacagcuucaugcaguccgacgacagcgggggccgcaccaagcgguacguggucuucaacaacgggacccuguacuucaacgaggugggcaugcgcgaggagggggacuacacgugcuucgccgagaaccaggugggcaaggacgagaugcggguccgcgugaagguggucaccgcccccgcgaccauccggaacaagaccuaccuggccguccaggugccguacggcgacgucgugacgguggccugcgaggccaagggggagcccaugcccaaggucaccuggcucucccccaccaacaaggugaucccgaccagcuccgagaaguaccagaucuaccaggacggcacgcugcugauccagaaggcccagcgcagcgacuccgggaacuacacgugccucgugcggaacagcgcgggcgaggaccgcaagaccgucuggauccacgugaacgugcagccgcccaagaucaacggcaaccccaacccgaucaccaccguccgcgagaucgccgccgggggcucccggaagcugaucgacugcaaggccgaggggauccccacgccccgcgugcugugggcguuccccgagggcgugguccucccggcccccuacuacgggaaccggaucaccgugcacggcaacggcagccuggacauccgcucccugcggaaguccgacagcgugcagcucgucugcauggcccgcaacgagggcggcgaggcccggcugauccugcagcucaccgugcuggagcccauggagaagcccaucuuccacgacccgaucuccgagaagaucaccgccauggcggggcacacgaucagccugaacugcuccgccgccggcacccccacccccagccucguguggguccugccgaacgggaccgaccugcaguccggccagcagcuccagcgcuucuaccacaaggccgacggcaugcugcacaucagcgggcuguccagcguggacgccggcgcguaccggugcguggcccgcaacgccgccgggcacacggagcggcucgucucccugaaggugggccugaagcccgaggccaacaagcaguaccacaaccucgugagcaucaucaacggggagacccugaagcugcccugcacgccgcccggcgcgggccaggggcgcuucuccuggacccuccccaacggcaugcaccuggaggggccccagacgcugggccgggucagccuccuggacaacgggacccugaccgugcgcgaggccuccguguucgaccggggcaccuacgucugccgcauggagacggaguacggccccagcgugaccuccauccccgugaucgucaucgccuacccgccccggaucaccagcgagcccaccccggugaucuacacgcgccccgggaacaccgucaagcucaacugcauggccaugggcauccccaaggccgacaucaccugggagcugcccgacaagucccaccugaaggcgggggugcaggcccggcucuacggcaaccgcuuccugcacccgcagggcagccugaccauccagcacgccacgcagcgggacgccggguucuacaagugcauggcgaagaacauccucggcuccgacagcaagaccaccuacauccacguguucuga

SEQ ID NO: 33246 - RNA, 969 nt, Artificial Sequence
  derived and/or modified sequence opt1 from MYADM__Homo_sapiens__NP_001277119
augcccgugaccgucacccgcacgaccaucaccaccacgaccaccagcuccagcggccugggguccccgaugaucgugggcagcccccgggcccucacccagccccuggggcugcuccgccugcugcagcucguguccacgugcgucgccuucagccugguggcguccgugggcgccuggaccgggagcaugggcaacugguccauguucaccuggugcuucugcuucagcgucacccugaucauccucaucguggagcugugcggccugcaggcccgguucccccucuccuggcgcaacuucccgaucacguucgccugcuacgccgcgcuguucugccugagcgccuccaucaucuaccccaccaccuacgugcaguuccucagccacgggcggucccgcgaccacgccaucgccgcgaccuucuucagcugcaucgccugcgucgccuacgccacggagguggccuggacccgggcgcgccccggcgagaucaccggguacauggccaccgugcccggccugcugaagguccucgagacguucguggccugcaucaucuucgccuucaucuccgacccgaaccuguaccagcaccagcccgcccuggaguggugcguggcggucuacgccaucugcuucauccucgccgccaucgccauccugcugaaccucggggagugcaccaacgugcugcccauccccuucccgagcuuccuguccggccucgcgcugcugagcgugcuccuguacgccaccgcccugguccucuggccccuguaccaguucgacgagaaguacggcgggcagccccggcgcagccgggacguguccugcagccgcucccacgccuacuacgugugcgccugggaccggcgccuggcggucgccauccucaccgccaucaaccugcuggccuacguggcggaccucgugcacagcgcccaccuggucuucgugaaggucuga

SEQ ID NO: 33247 - RNA, 3999 nt, Artificial Sequence
  derived and/or modified sequence opt1 from MYBBP1A__Homo_sapiens__NP_001099008
auggagagccgcgaccccgcccagcccaugucccccggcgaggccacccagagcggggcgcggcccgccgaccgcuacggccugcucaagcacucccgggaguuccuggacuucuucugggacaucgccaagcccgagcaggagacccgccuggccgccacggagaagcuccuggaguaccugcgggggcgcccgaagggcagcgagaugaaguacgcgcucaagcggcugaucaccgggcugggcgugggccgcgagaccgcccggcccugcuacucccucgcccuggcccagcugcuccagagcuucgaggaccugccccugugcuccauccuccagcagauccaggagaaguacgaccugcaccaggucaagaaggcgaugcugcgccccgcccucuucgccaaccuguucggggugcuggcccucuuccagagcggccggcuggugaaggaccaggaggcccugaugaaguccgucaagcuccugcaggcgcuggcccaguaccagaaccaccuccaggagcagccgcgcaaggcccugguggacauccugagcgagguguccaaggccacccuccaggagauccugcccgagguccugaaggccgaccucaacaucauccugagcucccccgagcagcuggagcuguuccugcuggcgcagcagaaggugcccagcaagcucaagaagcuggugggguccgucaaccuguucagcgacgagaacgugccgcggcucgugaacguccugaagauggccgccuccagcgugaagaaggaccgcaagcugcccgccaucgcccucgaccugcugcggcucgcgcugaaggaggacaaguucccccgcuucuggaaggagguggucgagcagggccugcugaagaugcaguucuggcccgccuccuaccucugcuuccggcugcugggggccgcccucccgcugcugacgaaggagcagcuccaccuggugaugcagggcgacgugauccgccacuacggcgagcacgucugcaccgccaagcugcccaagcaguucaaguucgcgcccgagauggacgacuacguggggaccuuccucgagggcugccaggacgaccccgagcggcagcuggccgugcuggucgccuucagcagcgugaccaaccaggggcucccggugacgcccaccuucuggcgcgucgugcgguuccuguccccgcccgcccugcagggcuacgucgcguggcuccgcgccauguuccugcagcccgaccuggacagccucguggacuucuccaccaacaaccagaagaaggcccaggacagcucccugcacaugcccgagcgcgccguguuccggcugcgcaaguggaucaucuuccggcucgucagcaucguggacucccugcaccuggagauggaggaggcccucaccgagcaggucgcgcgcuucugccuguuccacagcuucuucgugacgaagaagcccaccucccagauccccgagaccaagcacccguucagcuucccccuggagaaccaggcccgggaggccguguccagcgccuucuucucccuccugcagacccugagcacgcaguucaagcaggcccccggccagacccagggcgggcagccguggaccuaccaccucgugcaguucgcggaccugcugcucaaccacucccacaacgucaccacggugacccccuucaccgcccagcagcgccaggccugggaccggaugcugcagacccugaaggagcucgaggcccacagcgccgaggcgcgcgccgccgccuuccagcaccuccugcuccugguggggauccaccuccugaagucccccgcggagagcugcgaccugcugggcgacauccagacgugcauccggaagucccucggggagaagccccgccggagccgcaccaagaccaucgacccgcaggagccgcccugggucgaggugcugguggagauccugcucgcccugcuggcccagcccagccaccucaugcggcaggucgcccgcuccguguucggccacaucugcagccaccugacgccccgggcccugcagcucauccuggacgugcugaaccccgagaccuccgaggacgagaacgaccgcgucguggugaccgacgacagcgacgagcggcgccucaagggcgcggaggacaaguccgaggagggggaggacaaccggagcuccgagagcgaggaggaguccgagggcgaggagagcgaggaggaggagcgcgacggggacgucgaccagggcuuccgcgagcagcugaugaccgugcugcaggccgggaaggcccucggcggcgaggacuccgagaacgaggaggagcugggggacgaggccaugauggcccuggaccagagccucgcgucccuguucgccgagcagaagcugcggauccaggcccgccgggacgagaagaacaagcuccagaaggagaaggcccugcgccgggacuuccagauccgcgugcuggaccucgucgaggugcuggugaccaagcagcccgagaacgcccugguccucgagcugcuggagccccuccugagcaucauccggcgcucccugcggagcuccagcagcaagcaggagcaggaccuccugcacaagacggcgcgcaucuucacccaccaccugugccgggcccgccgguacugccacgaccucggcgagcgcgccggggcccugcacgcccagguggagcggcuggugcagcaggcgggccgccagccggacucccccaccgcccucuaccacuucaacgccagccuguaccugcuccggguccugaaggggaacaccgccgagggcugcgugcacgagacgcaggagaagcagaaggcgggcaccgaccccucccacaugcccaccgggccgcaggccgccagcugccuggaccucaaccuggugacccgcgucuacuccaccgcccugagcuccuuccucacgaagcggaacagcccccugaccgugcccauguuccugucccuguucagccgccaccccgugcucugccagucccugcugccgauccucguccagcacaucaccggccccgugcggccccgccaccaggccugccugcugcuccagaagacccugagcaugcgcgaggugcgguccugcuucgaggaccccgaguggaagcagcugauggggcagguccucgcgaaggugacggagaaccugcgcgugcugggcgaggcccagaccaaggcccagcaccagcaggcccucagcucccuggagcugcucaacguccuguuccggaccugcaagcacgagaagcugacccucgaccugacggugcugcucggcgugcugcaggggcagcagcagagccugcagcagggcgcccacuccaccgggagcucccgccuccacgaccuguacuggcaggcgaugaagacccugggcguccagcggccgaagcucgagaagaaggacgccaaggagauccccagcgccacccagagccccaucuccaagaagcgcaagaagaagggguuccugccggagacgaagaagcggaagaagcgcaagagcgaggacggcacccccgccgaggacggcacccccgccgcgaccgggggcucccagcccccgagcauggggcggaagaagcgcaaccggacgaaggccaaggugcccgcccaggccaacggcacccccaccaccaagucccccgcgccgggggcccccacgcgcagccccuccacccccgccaagagcccgaagcugcagaagaagaaccagaagcccucccaggugaacggcgcccccggcagccccaccgagccggccgggcagaagcagcaccagaaggcgcuccccaagaagggcguccuggggaaguccccgcugagcgcccucgcccggaagaaggcccgccugucccuggugauccggagccccucccuccugcagagcggcgccaagaagaaggcgcagacccugcgcuucacgaucuccagcuccaagaaguga

SEQ ID NO: 33248 - RNA, 1914 nt, Artificial Sequence
  derived and/or modified sequence opt1 from MYB__Homo_sapiens__NP_001123644
auggcccgccggccccgccacagcaucuacuccagcgacgaggacgacgaggacuucgagaugugcgaccacgacuacgacggccugcucccgaaguccgggaagcggcaccugggcaagacccgcuggacccgggaggaggacgagaagcugaagaagcucguggagcagaacgggacggacgacuggaaggucaucgccaacuaccugcccaaccgcaccgacgugcagugccagcaccgguggcagaaggugcugaaccccgagcucaucaagggccccuggaccaaggaggaggaccagcgcgucaucgagcuggugcagaaguacgggccgaagcgguggagcgugaucgcgaagcaccugaagggccgcaucggcaagcagugccgggagcgcuggcacaaccaccucaaccccgaggucaagaagaccuccuggacggaggaggaggaccggaucaucuaccaggcccacaagcgccuggggaaccggugggccgagaucgccaagcugcuccccggccgcaccgacaacgccaucaagaaccacuggaacagcaccaugcggcgcaagguggagcaggagggguaccugcaggaguccagcaaggcgucccagcccgccguggccaccagcuuccagaagaacucccaccugaugggcuucgcccaggcgccgcccacggcccagcuccccgccaccgggcagcccaccgucaacaacgacuacagcuacuaccacaucuccgaggcccagaacgugagcucccacgugccguaccccgucgcccugcacgugaacaucgugaacgucccccagcccgcggccgccgccauccagcggcacuacaacgacgaggacccggagaaggagaagcgcaucaaggagcuggagcuccugcugaugagcaccgagaacgagcucaagggccagcagacgcagaaccacacgugcuccuaccccggcuggcacagcaccaccaucgccgaccacacccggccccacggggacuccgcgcccgugagcugccugggcgagcaccacagcaccccgucccugcccgccgaccccgggagccuccccgaggaguccgccagcccggcccgcugcaugaucgugcaccagggcaccauccuggacaacgucaagaaccugcucgaguucgccgagacccugcaguucaucgacuccuuccugaacacgagcuccaaccacgagaacagcgaccucgagaugcccucccugaccagcacgccccugaucggccacaagcucaccgugaccacccccuuccaccgcgaccagaccgugaagacccagaaggagaacacggucuuccggaccccggcgaucaagcgcuccauccuggagagcagcccccggacccccaccccguucaagcacgcccuggccgcccaggagaucaaguacgggccccucaagaugcugccccagacgcccucccaccugguggaggaccuccaggacgugaucaagcaggaguccgacgagagcggcaucgucgccgaguuccaggagaacgggccgccccugcugaagaagaucaagcaggagguggagucccccaccgacaagagcggcaacuucuucugcucccaccacugggagggggacagccucaacacccagcuguucacccagacgagccccgucgcggacgccccgaacauccugaccuccagcgugcucauggcccccgccuccgaggacgaggacaacgugcugaaggcguucaccguccccaagaaccgcagccuggccagcccccuccagccgugcuccuccaccugggagcccgccagcugcggcaagauggaggagcagaugaccuccagcucccaggcccggaaguacgugaacgccuucagcgcgcgcacgcuggugauguga

SEQ ID NO: 33249 - RNA, 2259 nt, Artificial Sequence
  derived and/or modified sequence opt1 from MYBL1__Homo_sapiens__NP_001073885
auggccaagcgcagccgguccgaggacgaggacgacgaccugcaguacgccgaccacgacuacgaggugccccagcagaagggccucaagaagcuguggaaccgcgucaaguggacccgggacgaggacgacaagcugaagaagcucguggagcagcacgggaccgacgacuggacgcugaucgcgagccaccuccagaaccgcuccgacuuccagugccagcaccgguggcagaaggugcugaacccggagcugaucaagggccccuggaccaaggaggaggaccagcgcgucaucgagcuggugcagaaguacgggcccaagcgguggagccucaucgccaagcaccugaagggccgcaucgggaagcagugccgggagcgcuggcacaaccaccugaaccccgaggugaagaaguccagcuggaccgaggaggaggaccggaucaucuacgaggcccacaagcgccucggcaaccggugggccgagaucgccaagcugcugccgggccgcaccgacaacuccaucaagaaccacuggaacagcacgaugcggcgcaaggucgagcaggagggguaccuccaggacggcaucaaguccgagcggagcuccagcaagcugcagcacaagcccugcgcggccauggaccacaugcagacccagaaccaguucuacauccccgugcagauccccggguaccaguacguguccccggagggcaacugcaucgagcacguccagcccaccagcgccuucauccagcagcccuucaucgacgaggaccccgacaaggagaagaagaucaaggagcuggagaugcuccugauguccgccgagaacgaggugcgccggaagcgcaucccgagccagcccggguccuucagcuccuggagcggcagcuuccugauggacgacaacauguccaacacccucaacagccuggacgagcacacguccgaguucuacagcauggacgagaaccagcccguguccgcgcagcagaacagccccaccaaguuccuggccgucgaggccaacgccgugcucuccagccugcagaccaucccggaguucgccgagacccuggagcucaucgaguccgaccccguggcguggagcgacgucacguccuucgacaucagcgacgccgccgccucccccaucaagagcacccccgugaagcugaugcggauccagcacaacgagggcgccauggagugccaguucaacgugucccugguccucgaggggaagaagaacacgugcaacggcgggaacagcgaggcggugccgcugaccucccccaacaucgccaaguucagcaccccgcccgccauccugcgcaagaagcgcaagaugcgggugggccacucccccggcagcgagcuccgcgacgggagccugaacgacggcgggaacauggcccugaagcacacgccccucaagacccugcccuucucccccagccaguucuucaacacgugcccgggcaacgagcagcugaacaucgagaaccccuccuucaccagcacccccaucugcgggcagaaggcccucaucaccaccccgcugcacaaggagaccacccccaaggaccagaaggagaacgucggcuuccggacccccaccauccgccgguccauccugggcacgacgccccgcaccccgacccccuucaagaacgcgcucgccgcccaggagaagaaguacgggccccugaagaucgugagccagccccuggccuuccucgaggaggacauccgggaggugcugaaggaggagaccggcaccgaccuguuccucaaggaggaggacgagccggccuacaaguccugcaagcaggagaacaccgcgagcgggaagaagguccgcaagucccuggugcuggacaacugggagaaggaggagagcggcacccagcugcucacggaggacaucuccgacaugcagagcgagaaccgguucaccaccucccugcugaugaucccccuccuggagauccacgacaaccgcugcaaccugauccccgagaagcaggacaucaacagcaccaacaagaccuacacgcucaccaagaagaagcccaacccgaacaccuccaaggucgugaagcuggagaagaaccugcagagcaacugcgagugggagaccguggucuacgggaagacggaggaccagcucaucaugaccgagcaggcccggcgcuaccuguccaccuacaccgccacgagcagcaccucccgggcccugauccucuga

SEQ ID NO: 33250 - RNA, 2031 nt, Artificial Sequence
  derived and/or modified sequence opt1 from MYBL2__Homo_sapiens__NP_001265539
augagccgccggacccgcugcgaggaccuggacgagcuccacuaccaggacaccgacuccgacgugcccgagcagcgggacagcaagugcaaggucaaguggacgcacgaggagaaccgcaccgaccagcagugccaguaccgguggcugcgcgugcugaacccggaccucgugaagggccccuggaccaaggaggaggaccagaaggucaucgagcuggugaagaaguacgggaccaagcaguggacgcugaucgccaagcaccucaagggccggcuggggaagcagugccgcgagcgguggcacaaccaccugaaccccgaggugaagaaguccugcuggaccgaggaggaggaccgcaucaucugcgaggcccacaagguccucggcaaccggugggcggagaucgccaagaugcugcccgggcgcaccgacaacgccgugaagaaccacuggaacagcaccaucaagcggaagguggacacgggcggcuuccuguccgagagcaaggacugcaagccgcccgucuaccuccugcuggagcucgaggacaaggacgggcugcaguccgcccagcccaccgagggccaggggagccugcucaccaacuggcccuccgugccgcccaccaucaaggaggaggagaacagcgaggaggagcuggccgcggccacgaccuccaaggagcaggagcccaucggcaccgaccuggacgccgugcgcacccccgagccgcucgaggaguuccccaagcgggaggaccaggaggggagcccgcccgagacgucccugcccuacaagugggucguggaggccgcgaaccugcucauccccgccgugggcagcucccugagcgaggcccuggaccucaucgaguccgaccccgacgccuggugcgaccugagcaaguucgaccugcccgaggagccguccgccgaggacagcaucaacaacagccucguccagcugcaggcgucccaccagcagcagguccugccgccccgccagcccagcgcccucgugcccuccgugaccgaguaccggcuggacggccacaccaucagcgaccugucccgcagcucccgcggggagcucauccccaucagccccuccaccgaggugggcgggagcggcaucggcacgcccccguccgugcugaagcggcagcggaagcgccgcgucgcccugagccccgugaccgagaacuccaccagccucuccuuccuggacagcugcaacucccugacccccaagagcacgccggugaagacccuccccuucucccccagccaguuccugaacuucuggaacaagcaggacacccuggagcucgagagccccucccugaccagcacgccggucugcucccagaagguggucgugaccacgccccugcaccgggacaagacgccccuccaccagaagcacgccgccuucgugacccccgaccagaaguacagcauggacaacaccccgcacacccccacccccuucaagaacgcgcuggagaaguacgggccccugaagccgcugccccagacgccccaccucgaggaggaccugaaggagguccugcgcuccgaggccggcaucgagcucaucaucgaggacgacauccggcccgagaagcagaagcgcaagccggggcugcggcgcagccccaucaagaaggugcggaagucccuggcccucgacaucguggacgaggacgucaagcugaugaugagcacccugcccaagucccucagccugcccaccaccgccccguccaacagcuccagccugacccucuccggcaucaaggaggacaacagccugcugaaccagggguuccuccaggccaagcccgagaaggcggccguggcccagaagccccgcucccacuucaccacccccgccccgaugagcagcgccuggaagaccguggcgugcggcggcacccgggaccagcuguucaugcaggagaaggcccgccagcugcucgggcggcugaagcccucccacacgagccgcacccugauccucuccuga

SEQ ID NO: 33251 - RNA, 3522 nt, Artificial Sequence
  derived and/or modified sequence opt1 from MYBPC1__Homo_sapiens__NP_001241647
augcccgagccgaccaagaaggaggagaacgaggugcccgcccccgcgcccccgcccgaggagcccagcaaggagaaggaggccggcaccacgcccgccaaggacuggacccuggucgagaccccgcccggggaggagcaggccaagcagaacgccaacucccagcucagcauccuguucaucgagaagccccagggcgggaccgugaaggugggcgaggacaucacguucaucgccaaggucaaggcggaggaccugcuccgcaagcccaccaucaagugguucaaggggaaguggauggaccuggccuccaaggccggcaagcaccuccagcugaaggagaccuucgagcggcacagccgcguguacaccuucgagaugcagaucaucaaggccaaggacaacuucgcgggcaacuaccggugcgaggugacguacaaggacaaguucgacuccugcagcuucgaccuggagguccacgaguccaccgggaccaccccgaacaucgacauccgcagcgccuucaagcgguccggcgaggggcaggaggacgccggcgagcuggacuucagcgggcuccugaagcgccgggaggugaagcagcaggaggaggagccccagguggacgucugggagcugcucaagaacgccaagcccuccgaguacgagaagaucgccuuccaguacggcaucacggaccugcgcggcaugcugaagcggcucaagcgcaugcggcgcgaggagaagaaguccgcggccuucgccaagauccuggaccccgccuaccagguggacaagggcgggcgggugcgcuucgucguggagcuggccgacccgaagcucgaggugaagugguacaagaacgggcaggagauccggcccagcaccaaguacaucuucgagcacaagggcugccagcgcauccuguucaucaacaacugccagaugaccgacgacagcgaguacuacgucaccgcgggcgacgagaagugcuccacggagcuguucgugcgggagccgcccaucauggugaccaagcagcucgaggacaccaccgccuacugcggggagcgcgucgagcuggagugcgaggugagcgaggacgacgccaacgugaagugguucaagaacggcgaggagaucauccccgggcccaagucccgguaccgcauccgggucgagggcaagaagcacauccugaucaucgagggggccacgaaggccgacgcggccgaguacagcgugaugaccaccggcggccaguccagcgccaagcucagcguggaccugaagccccugaagauccucacgccccugaccgaccagaccgucaaccuggggaaggagaucugccucaagugcgagaucuccgagaacaucccgggcaaguggaccaagaacgggcugcccgugcaggagagcgaccgccugaaggucgugcacaagggccgcauccacaagcucgugaucgccaacgcccugaccgaggacgagggggacuacgucuucgcgcccgacgccuacaacgugacgcugcccgccaaggugcacgucaucgacccgcccaagaucauccucgacggccuggacgccgacaacaccgugaccgugaucgcgggcaacaagcugcggcucgagauccccaucuccggggagccgccgcccaaggccauguggagccgcggcgacaaggccaucauggagggguccggccggauccgcaccgagagcuaccccgacuccagcacgcuggucaucgacaucgccgagcgggacgacuccgggguguaccacaucaaccugaagaacgaggccggcgaggcgcacgccagcaucaaggugaaggucguggacuuccccgacccgcccguggcccccaccgucaccgaggugggcgacgacuggugcaucaugaacugggagccgcccgccuacgacgggggcucccccauccucggguacuucaucgagcgcaagaagaagcagagcucccgguggaugcgccugaacuucgaccugugcaaggagaccacguucgagcccaagaagaugaucgagggcguggccuacgagguccggaucuucgcggugaacgccaucggcaucagcaagcccuccaugcccagccgccccuucgugccccucgccgucaccuccccgcccacccugcugaccguggacagcgugaccgacacgaccgucaccaugcgguggcgcccgcccgaccacaucggggccgccggccucgacggguacgugcuggaguacugcuucgagggcuccaccagcgcgaagcagagcgacgagaacggggaggccgccuacgaccugcccgccgaggacuggaucguggcgaacaaggaccugaucgacaagacgaaguucaccaucaccggccuccccaccgacgccaagaucuucguccgggugaaggccgugaacgccgccggcgcguccgagcccaaguacuacagccagcccauccuggucaaggagaucaucgagccgcccaagauccgcaucccccggcaccugaagcagacguacauccgccgggugggggaggccgugaaccucgucaucccguuccagggcaagccccgccccgagcugaccuggaagaaggacggggccgagaucgacaagaaccagaucaacauccggaacuccgagaccgacaccaucaucuucauccgcaaggccgagcgcagccacuccggcaaguacgaccuccaggugaagguggacaaguucgucgagacggccagcaucgacauccagaucaucgaccggcccgggccgccccagaucgugaagaucgaggacguguggggcgagaacgucgcgcugaccuggaccccgcccaaggacgacggcaacgccgccaucaccggguacacgauccagaaggccgacaagaaguccauggagugguucaccgugaucgagcacuaccaccgcaccagcgccaccaucacggagcuggugaucggcaacgaguacuacuuccgggucuucuccgagaacaugugcgggcugagcgaggacgcgaccaugaccaaggaguccgccgugaucgcccgcgacggcaagaucuacaagaaccccguguacgaggacuucgacuucagcgaggcccccauguucacccagccccucgucaacacguacgcgaucgccggguacaacgccacccugaacugcuccgugcggggcaaccccaagccgaagaucaccuggaugaagaacaagguggccaucgucgacgacccccgcuaccggauguucagcaaccagggcgugugcacccuggagauccgcaagcccucccccuacgacgggggcacguacugcugcaaggccgugaacgaccucgggaccgucgagaucgagugcaagcuggaggugaaggucaucuaccagggcgugaacaccccggggcagcccguguuccuggagggccagcagcaggucggcagccccuccgcggacagcagcugcaaggccuaccuccagaccuga

SEQ ID NO: 33252 - RNA, 3426 nt, Artificial Sequence
  derived and/or modified sequence opt1 from MYBPC2__Homo_sapiens__NP_004524
augcccgaggccaagccggccgcgaagaaggcccccaagggcaaggacgcccccaagggggcccccaaggaggccccgcccaaggaggcgcccgccgaggcccccaaggaggccccgcccgaggaccagagccccaccgcggaggagcccaccggcguguuccugaagaagccggacuccgucagcguggagacggggaaggacgccguggucguggccaaggugaacggcaaggagcuccccgacaagcccaccaucaagugguucaaggggaaguggcuggagcugggcuccaagagcggcgcccgcuucuccuucaaggagagccacaacuccgccagcaacgucuacaccguggagcuccacaucgggaaggugguccugggcgaccggggguacuaccgccuggaggugaaggcgaaggacacgugcgacuccugcggcuucaacaucgacguggaggcgccccggcaggacgccagcgggcagucccucgagagcuucaagcgcaccuccgagaagaaguccgacaccgccggcgagcuggacuucagcggccugcucaagaagcgggaggucguggaggaggagaagaagaagaagaagaaggacgacgacgaccuggggaucccgcccgagaucugggagcugcucaagggcgccaagaaguccgaguacgagaagaucgcguuccaguacgggaucaccgaccugcgcggcaugcugaagcggcucaagaaggccaagguggaggucaagaaguccgccgccuucaccaagaagcuggaccccgccuaccagguggaccgcggcaacaagaucaagcugaugguggagaucagcgaccccgaccucacgcugaagugguucaagaacgggcaggagaucaagccgagcagcaaguacgucuucgagaacgugggcaagaagcggauccugaccaucaacaagugcacccucgcggacgacgccgccuacgagguggccgucaaggacgagaagugcuucaccgagcuguucgugaaggagccgcccgugcugaucgucacgccccucgaggaccagcaggucuucgugggggaccgcguggagauggccguggaggucagcgaggagggcgcccaggugauguggaugaaggacgggguggagcugacccgggaggacuccuucaaggcccgcuaccgguucaagaaggacggcaagcgccacauccugaucuucagcgacgucgugcaggaggaccggggccgcuaccaggugaucaccaacgggggccagugcgaggccgagcucaucgucgaggagaagcagcuggaggugcugcaggacaucgccgaccucaccgugaaggcguccgagcaggccgucuucaagugcgaggugagcgacgagaaggugacggggaagugguacaagaacggcgucgaggugcggcccuccaagcgcaucaccaucagccacguggggcgguuccacaagcuggucaucgacgacgugcgccccgaggacgagggcgacuacaccuucgugcccgacggcuacgcccugucccucagcgccaagcugaacuuccuggagaucaaggucgaguacgugcccaagcaggagccgcccaagauccaccucgacugcuccgggaagaccagcgagaacgccaucguggucguggcgggcaacaagcugcggcuggacguguccaucacgggggagcccccgcccgucgccaccuggcucaagggcgacgagguguucaccaccacggaggggcgcacccgcaucgagaagcggguggacugcagcuccuucgucaucgagagcgcccagcgcgaggacgagggccgguacaccaucaaggugaccaaccccgugggcgaggacgucgccuccaucuuccuccaggugguggacguccccgacccgcccgaggccgugcgcaucacgagcgugggggaggacugggcgauccuggucugggagccgcccauguacgacggcgggaagcccgugaccggcuaccugguggagcggaagaagaagggcucccagcgcuggaugaagcugaacuucgaggucuucaccgagaccacguacgagagcaccaagaugaucgaggggauccuguacgagaugcggguguucgccgugaacgccaucggcgucucccagcccagcaugaacaccaagcccuucaugcccaucgccccgaccagcgagccccuccaccugaucguggaggacgugacggacaccaccaccacccugaaguggcgcccgcccaaccggaucggggccggcgggaucgacggcuaccucgucgaguacugccuggagggcuccgaggagugggugcccgcgaacacggagcccguggagcgcugcggguucaccgucaagaaccugcccaccggcgcccggauccuguuccgcguggucggggugaacaucgccggccggagcgagcccgccacccucgcgcagccggugacgauccgcgagaucgccgagccgcccaagauccggcugccccgccaccuccggcagaccuacauccgcaaggucggggagcagcugaaccugguggugcccuuccagggcaagccccggccccaggucguguggaccaagggcggggccccgcuggacaccucccgcgugcacguccgcacgagcgacuucgacaccguguucuucgugcggcaggccgcccgcuccgacagcggcgaguacgagcucuccguccagaucgagaacaugaaggacaccgcgaccauccggauccgcgugguggagaaggccgggccgcccaucaacgucauggugaaggagguguggggcacgaacgcccuggucgaguggcaggcccccaaggacgacgggaacagcgagaucaugggcuacuucgugcagaaggccgacaagaagaccauggagugguucaacguguacgagcggaaccgccacaccuccugcaccgucagcgaccugaucgugggcaacgaguacuacuuccggguguacacggagaacaucugcgggcucuccgacagccccggcgucuccaagaacaccgcgcgcauccugaagaccgggaucaccuucaagcccuucgaguacaaggagcacgacuuccggauggcccccaaguuccugacgccccucaucgaccgcgugguggucgccggcuacagcgccgcccugaacugcgcggugcgggggcacccgaagcccaagguggucuggaugaagaacaagauggagauccgcgaggaccccaaguuccugaucaccaacuaccagggcgugcucacccugaacauccggcgccccuccccguucgacgccggcaccuacacgugccgggccgugaacgagcugggggaggcccucgcggagugcaagcuggagguccgcgugccccaguga

SEQ ID NO: 33253 - RNA, 3825 nt, Artificial Sequence
  derived and/or modified sequence opt1 from MYBPC3__Homo_sapiens__NP_000247
augcccgagccgggcaagaagcccgugagcgccuucuccaagaagccccgcagcgucgagguggccgcggggucccccgccguguucgaggccgagaccgagcgggccggcgucaaggugcgcuggcagcgcgggggcagcgacaucuccgccagcaacaaguacgggcuggcgaccgagggcacgcggcacacccucaccgugcgggaggucggcccggccgaccagggguccuacgccgugaucgccggcagcuccaaggugaaguucgaccugaaggucaucgaggcggagaaggccgagcccaugcuggcccccgcccccgccccggcggaggccaccggggcccccggcgaggcccccgcccccgcggccgagcucggggagagcgccccgucccccaagggcagcuccagcgccgcccugaacggccccacgcccggggcgccggacgaccccaucggccuguucgugaugcgcccccaggacggggaggugaccgucggcggcuccaucaccuucagcgcccggguggccggggccucccuccugaagcccccgguggucaagugguucaagggcaaguggguggaccugagcuccaagguggggcagcaccuccagcugcacgacagcuacgaccgcgccagcaaggucuaccuguucgagcuccacaucaccgacgcgcagcccgccuucacgggcuccuaccggugcgaggugagcaccaaggacaaguucgacugcuccaacuucaaccugaccgugcacgaggccauggggaccggcgaccuggaccuccugagcgccuuccgccggacgucccuggcgggcgggggccgccggaucagcgacucccacgaggacaccgggauccucgacuucagcucccugcugaagaagcgcgacagcuuccggacgccccgcgacuccaagcucgaggcccccgccgaggaggacgucugggagauccugcggcaggccccgcccagcgaguacgagcgcaucgccuuccaguacggcgugaccgaccugcgggggaugcucaagcgccugaagggcaugcggcgcgacgagaagaaguccaccgcguuccagaagaagcuggagcccgccuaccaggugagcaagggccacaagauccgccucaccgucgagcuggccgaccacgacgccgaggugaaguggcugaagaacgggcaggagauccagauguccggcagcaaguacaucuucgaguccaucggggccaagcggacccucaccaucagccagugcucccuggcggacgacgccgccuaccagugcgucgugggcggggagaagugcagcacggagcuguucgugaaggagcccccgguccucaucacccgcccccuggaggaccagcuggugauggugggccagcgggucgaguucgagugcgaggugagcgaggagggcgcccaggugaaguggcucaaggacggggucgagcugacccgcgaggagaccuucaaguaccgguucaagaaggacggccagcgccaccaccugaucaucaacgaggccaugcucgaggacgcggggcacuacgcccugugcacguccggcggccaggcccuggccgagcucaucgugcaggagaagaagcuggagguguaccagagcaucgcggaccugauggucggggccaaggaccaggccguguucaagugcgagguguccgacgagaacguccggggcguguggcucaagaacgggaaggagcuggugcccgacagccgcaucaaggucucccacaucggccgggugcacaagcugaccaucgacgacgugaccccggccgacgaggccgacuacagcuucguccccgagggguucgcgugcaaccucuccgccaagcugcacuucauggaggugaagaucgacuucgugccccgccaggagcccccgaagauccaccuggacugccccggccggauccccgacaccaucgucgugguggccggcaacaagcugcgccucgacguccccaucagcggggacccggcccccacggugaucuggcagaaggccaucacccagggcaacaaggcgcccgcccggcccgccccggacgcccccgaggacaccggggacuccgacgaguggguguucgacaagaagcugcugugcgagaccgagggccgcguccggguggagacgaccaaggaccgcagcaucuucaccguggagggggccgagaaggaggacgagggcgucuacaccgugacggugaagaaccccgucggcgaggaccaggugaaccucaccgugaaggucaucgacgugcccgacgcgccggccgcccccaagaucuccaacgugggggaggacagcugcaccguccagugggagccgcccgccuacgacggcgggcagcccauccugggcuacauccuggagcggaagaagaagaaguccuaccgcuggaugcggcucaacuucgaccugauccaggagcugagccacgaggcgcgccgcaugaucgagggggugguguacgagaugcgggucuacgccgugaacgccaucggcaugucccgccccagccccgccucccagcccuucaugccgaucggcccgcccagcgagcccacccaccucgccguggaggacgucagcgacaccacggugucccugaaguggcggccgcccgagcgcgugggggcgggcgggcuggacggcuacagcgucgaguacugccccgaggggugcuccgaguggguggccgcccuccagggccugaccgagcacaccagcauccuggucaaggaccuccccaccggcgcccggcugcuguuccgcgugcgggcccacaacauggcggggcccggcgcccccgugacgaccaccgagcccgucaccgugcaggagauccuccagcgcccgcggcugcagcugccccgccaccuccggcagacgauccagaagaaggugggggagcccgucaaccugcugauccccuuccagggcaagccgcgcccccaggugaccuggaccaaggagggccagccccucgccggggaggagguguccauccggaacagccccaccgacacgauccuguucauccgcgccgcccggcgcguccacuccggcaccuaccaggugaccgugcggaucgagaacauggaggacaaggcgacccugguccuccaggugguggacaagccgagcccgccccaggaccugcgcgucacggacgccugggggcugaacguggcccucgaguggaagccgccccaggacgugggcaacaccgagcuguggggguacaccguccagaaggccgacaagaagaccauggagugguucacggugcuggagcacuaccggcgcacccacugcgugguccccgagcucaucaucggcaacggcuacuacuuccggguguucucccagaacauggugggguucagcgaccgcgccgcgaccaccaaggagcccgucuucaucccccgccccggcaucacguacgagccgcccaacuacaaggcccuggacuucuccgaggcccccagcuucacccagccccuggugaaccgguccgugaucgccggguacaccgcgaugcucugcugcgccguccgcggcagccccaagcccaagaucuccugguucaagaacgggcuggaccugggcgaggacgcccgguuccgcauguucagcaagcagggcgugcucacccuggagauccggaagccgugccccuucgacgggggcaucuacgugugccgcgccacgaaccugcagggggaggcccggugcgagugccgccucgagguccgggugccccaguga

SEQ ID NO: 33254 - RNA, 1434 nt, Artificial Sequence
  derived and/or modified sequence opt1 from MYBPH__Homo_sapiens__NP_004988
augauggagaagaacaccagcgagggccccgccugcuccccggaggagaccgccagcgaguccgcgaaggugcccaccgccgagccgcccggggaggucgccgugagcgaguccacccgcgaggagcagguccccaagccccaggcccccgcgccccaggccccgaccgccagcaccgccacgaagcccgccccgcccuccgaggacgugcccagcgcgccccugcuccugacccuggacgacguguccagcuccagcgugaccgucuccugggagccgcccgagcggcucggccgccuggggcugcagggcuacgugcucgagcugugccgggagggggccagcgagugggugcccgucuccgcccgccccaugauggugacccagcagacggugcggaaccuggcccucggcgacaaguuccugcugcgcgucagcgccguguccagcgcgggcgccgggccgcccgccaugcucgaccagcccauccacauccgggagaacaucgaggcccccaagauccgcgugccccggcaccuccgccagaccuacauccggcaggucggcgagaccgugaaccugcagauccccuuccaggggaagccgaagccccaggccaccuggacgcacaacggccacgcgcuggacucccagcgcgugagcaugcggaccggggaccaggacagcauccuguucauccgcuccgcccagcggagcgacuccggccgcuacgagcugaccguccggguggaggaccucgaggccaaggccgugaucgacauccuggucaucgagaagcccgggcccccgagcuccauccgccugcucgacguguggggcugcaacgccgcgcugcaguggaccccgccccaggacacgggcaacaccgagcugcucggguacauggugcagaaggccgacaagaagaccggccagugguucaccguccuggagcgguaccaccccacgaccugcaccaucagcgaccugaucaucggcaacuccuacagcuuccgcguguucuccgagaaccucugcgggcugagcaccuccgccacggucaccaaggagcuggcccacauccagaaggccgacaucgcggccaagcccaagggcuucaucgagcgggacuucagcgaggcccccuccuucacccagccccucgccgaccacaccagcacgccgggguacuccacccagcuguucugcagcgugcgcgcgucccccaagcccaagaucaucuggaugaagaacaagauggagauccagggcaaccccaaguaccgcgcccugagcgagcagggggugugcacccucgagauccggaagccgucccccuucgacagcggcgucuacacgugcaaggccaucaacgugcugggcgaggccagcguggacugccgccuggaggucaaggccuccgcggcccacuga

SEQ ID NO: 33255 - RNA, 14037 nt, Artificial Sequence
  derived and/or modified sequence opt1 from MYCBP2__Homo_sapiens__NP_055872
augaugaugugcgccgccaccgccagccccgccgccgccagcagcggccucgggggcgacggguucuaccccgccgccaccuucagcagcagccccgcccccggcgcccuguucaugcccgugcccgacgggagcgucgccgcggccggccugggccuggggcuccccgccgccgacagccggggccacuaccagcugcugcugagcgggcgggcccuggcggaccgguaccggcggaucuacaccgccgcccugaacgaccgggaccagggcgggggcagcgccggccaccccgccagccgcaacaagaagauccucaacaagaagaagcugaagcggaagcagaaguccaagagcaaggugaagacccgcuccaagagcgagaaccuggagaacaccgugaucauccccgacaucaagcuccacuccaaccccagcgcguucaacaucuacugcaacgugcggcacugcgugcuggaguggcagaagaaggagaucucccuggccgccgccagcaagaacuccgugcagagcggggagagcgacuccgacgaggaggaggagagcaaggagccgcccaucaagcuccccaagaucaucgaggugggccugugcgagguguucgagcugaucaaggagacccgcuucucccaccccagccucugccugcggucccugcaggcccuccugaacgugcugcaggggcagcagcccgagggccuccagagcgagccgcccgaggugcuggagucccuguuccagcuccugcuggagaucaccgugcgcagcaccggcaugaacgacuccaccgggcagagccucaccgcgcuguccugcgccugccuguucagccucguggccuccuggggcgagaccgggcggacccugcaggccaucagcgccauccugaccaacaacggcucccacgcgugccagaccauccaggugcccacgauccucaacagccugcagcgcuccgugcaggccgugcugguggggaagauccagauccaggacugguucagcaacggcaucaagaaggccgcccucaugcacaaguggccccugaaggagaucuccguggacgaggacgaccagugccugcuccagaacgacggcuucuuccuguaccugcucugcaaggacgggcuguacaagaucggcagcggguacagcggcaccgugcgggggcacaucuacaacuccaccagccgcauccggaaccgcaaggagaagaaguccuggcugggcuacgcgcagggcuaccuccuguaccgggacgucaacaaccacagcaugaccgccauccgcaucucccccgagacgcuggagcaggacgggaccgugaugcugcccgacugccacaccgagggccagaacauccucuucaccgacggggaguacaucaaccagaucgccgccagccgggacgacggcuucgugguccgcaucuucgccacguccaccgagcccgugcugcagcaggagcugcagcucaagcuggcgcgcaagugccugcacgccugcgggaucagccucuucgaccuggagaaggaccugcacaucaucuccaccggcuucgacgaggagagcgccauccucggcgccgggcgggaguucgcccugaugaagaccgcgaacggcaagaucuacuacacggggaaguaccagucccugggcaucaagcagggcgggcccagcgccggcaaguggguggagcuccccaucaccaagucccccaagaucguccacuucagcguggggcacgacggcucccacgcccugcuggucgccgaggacgggagcaucuucuucaccggcuccgccagcaagggcgaggacggggagagcaccaagucccgccggcagagcaagcccuacaagcccaagaagaucaucaagauggagggcaagaucgugguguacacggcgugcaacaacggguccagcuccgucaucagcaaggacggcgagcucuacauguucgggaaggacgccaucuacuccgacagcuccagccuggugaccgaccugaagggccacuucgugacccaggucgccaugggcaaggcccacacgugcgugcucaugaagaacggggagguguggacguucggcgucaacaacaaggggcagugcggccgcgacaccggggcgaugaaccagggcggcaagggguucggcguggagaacauggccaccgccauggacgaggaccuggaggaggagcuggacgagaaggacgagaaguccaugaugugcccgcccgggaugcacaaguggaagcucgagcagugcauggugugcaccgucugcggcgacugcacgggguacggcgccagcugcguguccagcggccggcccgaccgcgugcccgggggcaucugcgggugcggcuccggcgagagcgggugcgccgucugcggcugcugcaaggcgugcgcccgggagcuggacgggcaggaggcccgccagcggggcauccuggacgccgugaaggagaugaucccccucgaccugcugcucgccgugcccguccccggggugaacaucgaggagcaccuccagcugcgccaggaggagaagcggcagcgcgugauccggcgccaccggcucgaggagggccgcggcccccuggucuucgcggggcccaucuucaugaaccaccgggagcaggcccuggcccgccuccggucccacccggcccagcugaagcacaagcgcgacaagcacaaggacggcagcggggagcgcggcgagaaggacgccuccaagaucaccaccuacccgcccgggagcgugcgguucgacugcgagcugcgcgcggugcaggucagcugcggcuuccaccacuccguggugcucauggagaacggcgacgucuacaccuucggguacggccagcacgggcagcugggccacggggacgugaacagccggggcugccccacccuggugcaggcccuccccggccccuccacgcaggucaccgccgggagcaaccacaccgccgugcugcugauggacggccagguguucaccuucggguccuucagcaagggccagcucggccgccccauccuggacguccccuacuggaacgcgaagccggcccccaugcccaacaucggguccaaguacggccggaaggccacguggaucggggccagcggcgaccagaccuuccugcgcaucgacgaggcccucaucaacucccacgugcuggcgaccagcgagaucuucgccuccaagcacaucaucgggcuggugcccgccagcaucuccgagccgccgcccuucaagugccuccugaucaacaaggucgacggcagcugcaagaccuucaacgacuccgagcaggaggaccugcagggcuucggggugugccucgaccccguguacgacgucaucuggcgguuccgcccgaacacgcgggagcuguggugcuacaacgccgugguggccgacgcgcgccugcccagcgccgccgacaugcagucccggugcagcauccucucccccgagcuggcccugcccaccggcagccgcgcccucaccacccggagccacgcggcccugcacauccuggggugccucgacacgcuggccgccaugcaggaccugaagaugggcgucgccuccaccgaggaggagacccaggcggugaugaagguguacagcaaggaggacuacuccgucgugaaccgcuucgagagccacgggggcggcuggggguacuccgcccacagcguggaggccauccgguucuccgccgacaccgacauccuccugggcgggcugggccucuucgggggccgcggcgaguacacggcgaagaucaagcuguucgagcuggggccggacggcggggaccacgagaccgacggcgaccuccuggccgagaccgacguccuggccuacgacugcgccgcccgggagaaguacgcgaugauguucgacgagcccgugcuccugcaggccggguggugguacguggccugggcccgcgucagcggccccuccagcgacugcggcucccacgggcaggccagcaucaccacggacgacggcguggucuuccaguucaaguccagcaagaaguccaacaacgggaccgacgugaacgcgggccagaucccgcagcugcucuaccggcugcccaccagcgacggcuccgccagcaaggggaagcagcagaccuccgagcccgugcacauccugaagcgcagcuucgcccggacggucagcguggagugcuucgagucccuccugagcauccugcacugguccuggaccacccucgugcugggcgucgaggagcugcgcgggcucaagggcuuccaguucaccgccacgcugcuggaccucgagcgccugcgguucguggggaccugcugccugcgccuccugcggguguacacgugcgagaucuaccccgucagcgccaccggcaaggcggugguggaggagacguccaagcuggccgagugcaucggcaagacccgcacccuccugcggaagauccugagcgagggggucgaccacugcauggugaagcuggacaacgacccgcagggcuaccucucccagccccugagccugcucgaggccgugcugcaggagugccacaacaccuucacggccugcuuccacuccuucuaccccacccccgcgcugcagugggccugccucugcgaccugcugaacugccucgaccaggacauccaggaggccaacuucaagaccagcuccagccgccugcuggccgccgucauguccgcgcucugccacaccagcgugaagcugaccuccaucuucccgaucgccuacgacggggaggugcugcuccggagcaucgucaagcaggucuccacggagaacgacagcacccuggugcaccgcuucccccugcucgucgcccacauggagaagcugucccagagcgaggagaacaucagcggcaugaccuccuuccgggaggugcuggagaagaugcucgugaucgucgugcugcccgugcgcaacagccugcggcgcgagaacgagcuguucuccagccaccuggucuccaacacgugcgggcugcucgccagcaucguguccgagcugacggccagcgcgcugggcuccgagguggacggccucaacagccugcacuccgucaaggccagcgccaaccgguucaccaagaccucccaggggcgcagcuggaacaccggcaacgggucccccgacgccaucugcuucagcguggacaagccgggcaucguggucgugggguucuccguguacggcggcgggggcauccacgaguacgagcuggagguccucguggacgacagcgagcacgccggggacuccacgcacagccaccgguggaccagccuggagcuggugaagggcaccuacaccacggacgacucccccagcgacaucgcggagauccgccucgacaaggucgugccccugaaggagaacgugaaguacgccguccggcugcgcaacuacgggucccggaccgccaacggcgacggcgggaugaccaccgugcagugccccgacggcgugacguucaccuucuccacgugcucccucagcuccaacgggaccaaccagacccgcggccagaucccgcagauccuguacuaccgcagcgaguucgacggcgaccugcagucccagcuccugagcaaggccaacgaggaggacaagaacugcucccgggcgcugagcgucguguccaccgugguccgcgccagcaaggaccuccugcaccgggcccuggccguggacgccgacgacauccccgagcuccuguccagcuccagccuguucagcaugcuccugccccugaucaucgcguacaucgggcccguggccgccgccaucccgaaggucgccguggaggucuucggccucgugcagcagcugcugcccuccguggcgauccucaaccagaaguacgcgccgcccgccuucaacccgaaccagagcaccgacuccaccacggggaaccagcccgagcagggccugagcgccugcaccaccuccagccacuacgccgucaucgaguccgagcaccccuacaagcccgcgugcgugaugcacuacaaggugaccuucccggagugcguccgcuggaugacgaucgaguucgacccccagugcgggaccgcccagagcgaggacgugcugcggcuccugauccccgugcgcaccguccagaacuccggcuacggcccgaagcugaccagcgugcacgagaaccucaacuccuggaucgagcugaagaaguucagcggguccagcggcuggcccacgauggugcugguccuccccgggaacgaggcccuguucucccuggagaccgccagcgacuacgugaaggacgacaaggccuccuucuacggcuucaagugcuucgcgaucggguacgaguucagccccggcccggacgagggcgugauccagcucgagaaggagcuggccaaccucgggggcgucugcgccgccgcgcucaugaagaaggaccuggcccugcccaucgggaacgagcucgaggaggaccuggagauccuggaggaggccgcccuccaggugugcaagacccacuccggcauccuggggaagggccuggcccucagccacagccccaccauccuggaggcgcuggagggcaaccucccccugcagauccaguccaacgagcagagcuuccuggacgacuucaucgccugcgugccgggguccagcggcgggcggcucgcccgcuggcugcagcccgacuccuacgccgacccccagaagacgagccugauccucaacaaggacgacauccggugcggcuggcccaccaccaucaccguccagaccaaggaccaguacggcgacguggugcacgucccgaacaugaagguggaggugaaggccguccccgugucccagaagaagaugagccugcagcaggaccaggcgaagaagccccagcgcauccccggguccccggccgugacggccgccagcuccaacaccgacaugaccuacggcgggcuggccagccccaagcucgacgucuccuacgagcccaugaucgugaaggaggcgcgguacaucgccaucaccaugaugaagguguacgagaacuacagcuucgaggagcugcgcuucgccucccccacgccgaagcggcccagcgagaacaugcugauccgcgucaacaacgacggcaccuacugcgccaacuggacccccggggcgaucggccucuacacccugcacgugacgaucgacggcaucgagaucgacgccgggcuggaggugaaggucaaggacccgcccaagggcaugaucccgcccgggacccagcucgugaagcccaaguccgagccccagcccaacaaggugcggaaguucgucgccaaggacagcgccggccugcgcauccggucccaccccagccugcagagcgagcagaucgggaucgugaaggugaacggcaccaucaccuucaucgacgagauccacaacgacgacggcgucuggcugcgccucaacgacgagacgaucaagaaguacgugccgaacaugaacggguacaccgaggccuggugccuguccuucaaccagcaccugggcaagagccuccuggugcccgucgacgaguccaagaccaacaccgacgacuucuucaaggacaucaacagcugcugcccccaggaggcgacgaugcaggagcaggacaugcccuuccugcgcgggggcccggggauguacaagguggugaagaccggccccuccggccacaacauccgcagcugccccaaccuccgggggauccccaucggcaugcugguccuggggaacaaggugaaggccgugggcgaggucaccaacuccgaggggaccugggugcagcucgaccagaacagcaugguggaguucugcgaguccgacgagggcgaggccuggagccuggcccgcgaccgcggcgggaaccaguaccugcggcacgaggacgagcaggcccuccuggaccagaacucccagacgccgccgcccagccccuucuccguccaggcguucaacaagggcgccagcugcuccgcccagggguucgacuacggccugggcaacagcaagggggaccgcggcaacaucuccaccagcuccaagccggccagcaccagcgggaaguccgagcucagcuccaagcacagccggucccugaagcccgacggccgcaugagccggaccacggccgaccagaagaagccccgcgggaccgagucccugagcgcguccgagagccucauccugaaguccgacgccgccaagcugcggagcgacucccacagccgcucccucagccccaaccacaacacccugcagacccugaaguccgacggccggaugccgagcuccagccgcgccgagagccccggccccgggucccggcucagcucccccaagccgaagacgcugcccgcgaaccgcagcucccccagcggcgccuccagcccccgguccagcuccccgcacgacaagaaccugccccagaaguccaccgcccccgugaagaccaagcucgacccgccccgcgagcgguccaagagcgacuccuacacccuggaccccgacacgcugcgcaagaagaagaugccccucaccgagccgcugcgggggcgcagcaccucccccaagcccaagagcguccccaaggacuccaccgacagcccgggcagcgagaaccgggcccccagcccccacguggugcaggagaaccugcacagcgaggucguggaggugugcacguccagcacccucaagaccaacucccugaccgacagcacgugcgacgacuccagcgaguucaaguccgucgacgaggggagcaacaaggugcacuucuccaucggcaaggcgccccugaaggacgagcaggagaugcgcgcgagcccgaagaucucccgcaagugcgccaaccggcacacccgccccaagaaggagaaguccuccuuccucuucaagggcgacgggagcaagccccuggagcccgccaagcaggccauguccccgagcguggccgagugcgcgcgggccgucuucgccagcuuccuguggcacgagggcaucgugcacgacgccauggccugcuccagcuuccucaaguuccaccccgagcuguccaaggagcacgcgcccauccgcagcucccugaacagccagcagcccaccgaggagaaggagaccaagcucaagaaccggcacucccuggagaucagcuccgcccugaacauguucaacaucgccccgcacgggcccgacaucagcaagaugggcuccaucaacaagaacaaggugcucagcaugcugaaggagccgccccugcacgagaagugcgaggacgggaagaccgagacgaccuucgagauguccaugcacaacaccaugaaguccaaguccccgcucccccugacccugcagcaccucgucgccuucugggaggacaucagccuggccacgaucaaggcggccucccagaacaugaucuuccccagccccggcuccugcgccgugcugaagaagaaggagugcgagaaggagaacaagaaguccaagaaggagaagaagaagaaggagaaggccgaggugcgcccgcggggcaaccucuucggggagauggcgcagcuggccgucggcgggcccgagaaggacaccaucugcgagcugugcggcgagagccaccccuacccggugaccuaccacaugcgccaggcccaccccggcugcgggcgguacgccggcgggcagggcuacaacuccaucgggcacuucugcggcggcugggccgggaacugcggcgacgggggcaucgggggcagcaccugguaccucgugugcgaccgcugccgggagaaguaccugcgcgagaagcaggcggccgcccgggagaaggucaagcagucccgccggaagcccaugcaggucaagacgccccgcgcccugccgaccauggaggcccaccaggugaucaaggcgaacgcccucuuccugcugagccucuccagcgccgccgagcccuccauccugugcuaccaccccgccaagcccuuccagagccagcugccguccgucaaggagggcaucagcgaggaccuccccgugaagaugcccugccuguaccugcagacccucgcgcggcaccaccacgagaacuucgugggguaccaggacgacaaccuguuccaggacgagaugcgcuaccugcgguccaccagcguccccgccccguacaucuccgugacgcccgacgccagccccaacguguucgaggagcccgaguccaacaugaaguccaugccgcccucccucgagaccagccccaucaccgacaccgaccuggccaagcgcacggucuuccagcgguccuacagcgugguggcgagcgaguacgacaagcagcacuccauccugcccgcccgcgucaaggccaucccgcgccggcgcgugaacagcggcgacaccgaggugggguccagccuccugcggcaccccucccccgagcugagccgccucaucuccgcccacagcucccugagcaagggcgagcggaacuuccaguggcccguccuggccuucgugauccagcaccacgaccucgaggggcuggagaucgcgaugaagcaggcccugcgcaaguccgccugccggguguucgccauggaggccuucaacuggcuccugugcaacgucauccagaccaccagccugcacgacauccucuggcacuucguggcgucccugacgccggcccccguggagcccgaggaggaggaggacgaggagaacaagaccagcaaggagaacuccgagcaggagaaggacacccgcgucugcgagcacccccugagcgacaucgugaucgccggcgaggccgcccacccgcucccccacaccuuccaccggcugcugcagacgaucuccgaccucaugaugagccugcccuccggcagcagccugcagcagauggcgcuccgcugcuggucccugaaguucaagcagagcgaccaccaguuccugcaccaguccaacguguuccaccacaucaacaacauccugagcaaguccgacgacggggacagcgaggaguccuucagcaucuccauccagagcggcuucgaggccaugucccaggagcucugcaucgucaugugccugaaggaccugaccagcaucguggacaucaagaccuccagccggccggccaugaucgggucccucaccgacggcagcacggagaccuucugggaguccggggacgaggacaagaacaagaccaagaacaucaccaucaacugcgugaagggcaucaacgcccgcuacgucagcgugcacguggacaacucccgggaccugggcaacaaggucacgagcaugaccuuccugaccgggaaggccguggaggaccucugccgcaucaagcaggucgaccuggacagccggcacaucggcugggucaccuccgagcugcccgggggcgacaaccacaucaucaagaucgagcucaagggccccgagaacacgcugcgcgugcggcaggucaaggugcugggguggaaggacggcgagagcaccaagaucgcggggcagaucuccgccagcguggcccagcagcgcaacugcgaggccgagacccuccgggucuuccgccugaucaccucccagguguucggcaagcugaucagcggggacgcggagcccaccccggagcaggaggagaaggcccuccuguccagccccgagggcgaggagaagguguacaacgccacguccgacgccgaccugaaggagcacauggucggcaucaucuucagccgcuccaagcucaccaaccugcagaagcaggucugcgcccacaucgugcaggcgauccggauggaggccacccgcguccgggaggagugggagcacgccaucagcuccaaggagaacgccaacagccagcccaacgacgaggacgccuccagcgacgcguacugcuucgagcugcucuccauggugcuggcccugagcggguccaacgugggccgccaguaccucgcccagcagcugacccugcuccaggaccuguucagccugcuccacacggccagcccccggguccagcgccaggugaccucccugcugcggcgcgugcucccggaggucacccccagccggcuggccuccaucaucggggucaagagccugccgcccgcggacaucuccgacaucauccacagcaccgagaagggcgacuggaacaagcucgggauccuggacauguuccugggcugcaucgccaaggcccucacggugcagcugaaggccaagggcaccaccaucaccgggacggcgggcaccaccgucgggaagggcgugaccacggugacccugccgaugaucuucaacuccagcuaccuccgccgcggggagucccacugguggaugaagggcagcacccccacccagaucuccgagaucaucaucaagcugaucaaggacauggccgccggccaccugagcgaggccuggucccgcgucacgaagaacgccaucgcggagaccaucaucgcccucaccaagauggaggaggaguuccggagccccgugcgcugcaucgccaccacgcggcuguggcuggcccucgccucccugugcgugcuggaccaggaccacgucgaccgccucagcuccgggcgguggaugggcaaggacgggcagcagaagcagaugcccaugugcgacaaccacgacgacggcgagaccgcggccaucauccugugcaacgugugcggcaaccugugcaccgacugcgaccgcuuccuccaccuccaccggcgcaccaagacgcaccagcgccagguguucaaggaggaggaggaggccaucaaggucgaccugcacgaggggugcggccgcaccaagcuguucuggcugauggcccuggccgacagcaagaccaugaaggcgaugguggaguuccgcgagcacaccgggaagccgacgaccagcuccagcgaggccugccgguucugcggcucccgcagcgggaccgagcucuccgccgugggcagcgucugcuccgacgccgacugccaggaguacgcgaagaucgccugcagcaagacccaccccugcggccaccccugcgggggcgugaagaacgaggagcacugccugcccugccugcacgggugcgacaaguccgccacgagccucaagcaggacgccgacgacaugugcaugaucugcuucaccgaggcccuguccgcggccccggccauccagcuggacugcagccacaucuuccaccuccagugcugccggcgcgugcuggagaaccgguggcugggcccccgcaucaccuucggguucaucuccugccccaucugcaagaacaagaucaaccacaucguccucaaggaccugcuggaccccaucaaggagcucuacgaggacgugcggcgcaaggcccugaugcggcuggaguacgagggccuccacaagagcgaggccaucaccaccccgggcgugcgcuucuacaacgaccccgcgggguacgccaugaaccgguacgccuacuacgucugcuacaagugccgcaaggccuacuucggcggggaggcccggugcgacgcggaggccggccgcggggacgacuacgacccccgggagcugaucugcggcgccugcuccgacgugagccgcgcccagaugugccccaagcacggcacggacuuccuggaguacaagugccgguacugcugcuccguggccgucuucuucugcuucgggaccacccacuucugcaacgcgugccacgacgacuuccagcgcaugaccagcaucccgaaggaggagcucccccacugccccgccggcccgaaggggaagcagcuggagggcacggagugcccccugcacguggugcacccgcccaccggggaggaguucgcccucggcugcggcgucugccggaacgcccacaccuucuga

SEQ ID NO: 33256 - RNA, 2955 nt, Artificial Sequence
  derived and/or modified sequence opt1 from MYCBPAP__Homo_sapiens__NP_115509
augcgcgcccccgcccggggcaccgggugcugcggccgcagcgggggccgguggcuggcgggggccgcccagccgcgcugccucugggccggcggcgccgggcagcgguucauggugcccggcgggaccaugaagucccugaagaaggacagccgccugcggaucacgcccacccgccuccuggaggcguccgagaacgucaaggagaagaagcgggccaagggccccgagcagccgacccccaccauccaggaggagcccgagcccgugagcaacgugcugcagggggacgacauccucgcccuggccaucaagaaggaggaccugaaggagcagcacaucccgcgccucacggagaaggaggacaagcgggucaucacccagaaguucaucauccgcaagcugaagcccauggacccccggcgcaaggugugccaccugguggcgcggcccgccaacccggacgaggccaccaagccccucgacuacuccggccccggcgacagcuucgacggguccgaccagauccugccccaccacauccugggcagccuccaggacuucaagcgcaucgcccuggcccgggggaacacccagcuggcggagcgcaucccgacgucccccugccucaugacccugaucagcgccgagggcgaguccaagcagaaggcccccaaggaggagaagcggcccccgugggccccgccgccccagcacaacuuccugaagaacuggcagcgcaacaccgcccuccggaagaagcagcaggaggcgcugagcgagcaccugaagaagcccgucuccgagcuccugaugcacaccggcgagacguaccgccgcauccaggaggagcgggagcugaucgacugcacccuccccacccgccgggaccgcaagagcugggagaacuccggguucuggagccggcuggaguaccugggcgacgagaugaccgggcucgugaugacgaagaccaagacccagcgcggccugauggagcccaucacccacauccggaagccccacuccauccgcguggagacggggcugcccgcccagcgggacgccagcuaccgcuacaccugggaccggucccucuuccugaucuaccgccggaaggagcugcagcgcaucauggaggagcucgacuucagccagcaggacaucgacggccuggaggucgugggcaagggguggcccuucagcgccgugaccgucgaggacuacaccguguucgagcggucccagggcagcuccagcgaggacacggccuaccuggggacccucgcguccagcuccgacgugagcaugcccauccugggcccgucccuccuguucugcgggaagcccgccugcuggauccgcggcagcaacccccaggacaagcggcaggucggcaucgccgcccaccugaccuucgagacccuggagggggagaagacguccagcgagcucaccguggugaacaacggcaccgucgccaucugguacgacuggcgccggcagcaccagcccgacaccuuccaggaccugaagaagaaccgcaugcagcgcuucuacuucgacaaccgggagggggugauccugccgggcgagaucaagacguucaccuucuucuucaagucccucaccgcggggguguuccgcgaguucugggaguuccggacccaccccacgcugcugggcggcgccauccugcaggucaaccuccacgccgugagccugacccaggacguguucgaggacgagcgcaagguccuggaguccaagcucaccgcccacgaggcggugaccgucgugcgggaggugcugcaggagcugcucauggggguccugacccccgagcgcacgcccagcccgguggacgccuaccugaccgaggaggaccucuuccggcaccgcaacccgccccugcacuacgagcaccaggugguccagucccugcaccagcucuggcggcaguacaugacccugcccgccaaggccgaggaggcccgccccggcgacaaggagcacgugagccccaucgcgaccgagaaggccuccgugaacgccgagcugcucccccgguuccgcagccccaucagcgagacgcaggucccgcggcccgagaacgaggcccugcgcgaguccgggagccagaaggcccgggugggcaccaagagcccccagcgcaagagcaucauggaggagauccugguggaggagucccccgacgucgacagcaccaaguccccgugggagcccgacggccucccccugcuggaguggaaccucugccuggaggacuuccggaaggcggugauggugcugcccgacgagaaccaccgcgaggacgcccucaugcggcugaacaaggccgcccuggagcucugccagaagccgcgcccccugcagagcaaccugcuccaccagaugugccugcagcuguggcgggacgucaucgacucccucguggggcacagcauguggcugcgcuccgugcugggccuccccgagaaggagaccaucuaccugaacgucccggaggagcaggaccagaaguccccgcccaucauggaggugaaggugcccgucgggaaggccggcaaggaggagcgcaagggggcggcccaggagaagaagcagcugggcaucaaggacaaggaggacaagaagggcgccaagcuccuggggaaggaggaccggcccaacuccaagaagcacaaggccaaggacgacaagaaggugaucaagagcgcgucccaggaccgcuucagccuggaggaccccacgcccgacaucauccucuccagccaggagcccaucgacccgcuggugaugggcaaguacacccagagccugcacuccgagguccgggggcuccuggacacccuggugaccgaccucauggugcuggccgacgagcugagccccaucaagaacgucgaggaggcccuccgccugugccgguga

SEQ ID NO: 33257 - RNA, 1365 nt, Artificial Sequence
  derived and/or modified sequence opt1 from MYC__Homo_sapiens__NP_002458
auggacuucuuccgcguggucgagaaccagcagcccccggccaccaugccccugaacgugagcuucaccaaccggaacuacgaccucgacuacgacuccgugcagcccuacuucuacugcgacgaggaggagaacuucuaccagcagcagcagcagagcgagcugcagcccccggcccccuccgaggacaucuggaagaaguucgagcugcuccccacgcccccgcugagccccucccgccggagcggccugugcucccccagcuacgucgcggugacccccuucucccuccgcggggacaacgacggcgggggcgggagcuucuccaccgccgaccagcuggagauggugaccgagcugcucggcggcgacauggucaaccagagcuucaucugcgacccggacgacgagacguucaucaagaacaucaucauccaggacugcaugugguccggguucagcgccgccgccaagcugguguccgagaagcuggcgagcuaccaggccgcccggaaggacuccggcagccccaaccccgcccgcgggcacuccgugugcagcaccagcucccucuaccugcaggaccugagcgcggccgccuccgagugcaucgaccccagcgucguguucccguacccccucaacgacuccagcucccccaagagcugcgccucccaggacagcuccgccuucagccccuccagcgacucccugcugagcuccaccgagagcuccccgcagggcagccccgagccccucgugcugcacgaggagacgcccccgaccaccagcuccgacagcgaggaggagcaggaggacgaggaggagaucgacgucguguccguggagaagcggcaggcgcccgggaagcgcagcgaguccggcagccccuccgccggcgggcacagcaagcccccgcacagcccccugguccucaagcggugccacguguccacccaccagcacaacuacgccgcgcccccguccacccgcaaggacuaccccgccgccaagcgggugaagcuggacagcguccgcgugcugcggcagaucuccaacaaccgcaagugcacgagcccccgguccagcgacaccgaggagaacgugaagcgccggacccacaacguccucgagcgccagcggcgcaacgagcugaagcgguccuucuucgcccugcgcgaccagauccccgagcucgagaacaacgagaaggccccgaagguggugauccugaagaaggccaccgccuacauccugagcguccaggcggaggagcagaagcucaucagcgaggaggaccugcugcgcaagcggcgcgagcagcucaagcacaagcuggagcagcugcggaacuccugcgccuga

SEQ ID NO: 33258 - RNA, 1395 nt, Artificial Sequence
  derived and/or modified sequence opt1 from MYCN__Homo_sapiens__NP_005369
augcccagcugcuccaccagcaccaugccgggcaugaucugcaagaaccccgaccuggaguucgacucccuccagcccugcuucuaccccgacgaggacgacuucuacuucgggggcccggacagcacgccgcccggggaggacaucuggaagaaguucgagcugcugcccaccccgccccucucccccagccgcggcuucgccgagcacuccagcgagcccccguccugggugaccgagaugcugcuggagaacgagcucugggggagccccgccgaggaggacgcguucggccugggcgggcugggcgggcucacccccaaccccgucauccugcaggacugcaugugguccggcuucagcgcccgcgagaagcuggagcgcgccguguccgagaagcuccagcacgggcggggcccgcccacggccggcagcaccgcccagucccccggggcgggcgccgccagccccgccgggcgcggccacggcggggcggccggcgccgggcgggccggcgccgcgcugccggccgagcuggcccaccccgccgccgagugcguggaccccgcggucguguuccccuucccggugaacaagcgcgagcccgcccccguccccgccgccccggccuccgcgcccgccgccgggcccgccguggccagcggcgcgggcaucgccgccccggccggggcgcccggcguggccccgccccggcccgggggccgccagaccuccgggggcgaccacaaggcccucagcaccagcggcgaggacacgcuguccgacagcgacgacgaggacgacgaggaggaggacgaggaggaggagaucgacgucgugaccguggagaagcggcgcuccagcuccaacaccaaggccgucaccacguucaccaucaccgugcggcccaagaacgccgcgcuggggcccggccgcgcccagagcuccgagcucauccugaagcggugccugcccauccaccagcagcacaacuacgccgcccccagccccuacguggaguccgaggacgccccgccccagaagaagaucaagagcgaggcgagcccccgcccccucaaguccgucaucccgcccaaggccaagucccugagcccccggaacuccgacagcgaggacuccgagcgccggcgcaaccacaacauccuggagcggcagcgccggaacgaccuccgcagcuccuuccugacccugcgcgaccacgugcccgagcucgugaagaacgagaaggccgccaaggucgugauccugaagaaggccacggaguacgugcacagccugcaggcggaggagcaccagcuccugcuggagaaggagaagcuccaggcccggcagcagcagcugcugaagaagaucgagcacgcccggaccugcuga

SEQ ID NO: 33259 - RNA, 708 nt, Artificial Sequence
  derived and/or modified sequence opt1 from MYCT1__Homo_sapiens__NP_079383
augcgcacccagguguacgagggccugugcaagaacuacuucagccucgccguccugcagcgggaccgcaucaagcuccuguucuucgacauccugguguuccuguccguguuccuccuguuccuccuguuccuggucgacaucauggccaacaacaccacgagccuggggucccccuggcccgagaacuucugggaggaccucaucaugagcuucaccguguccauggcgaucggccuggugcucgggggcuucaucugggccgucuucaucugccugagccggcgccggcgcgccuccgcccccaucagccagugguccagcucccggcgcagccgguccagcuacacccacgggcugaaccgcaccggcuucuaccggcacuccggcugcgagcgccggagcaaccugucccucgccagccugacguuccagcgccaggcgucccuggagcaggccaacagcuucccccgcaagagcuccuuccgggccagcaccuuccaccccuuccuccagugcccgccccugcccguggagaccgagucccagcuggugacccuccccagcuccaacaucagccccacgaucuccaccagccacucccugagccggcccgacuacugguccagcaacucccugcgcgucgggcucagcaccccgccgccgcccgccuacgaguccaucaucaaggcguuccccgacagcuga

SEQ ID NO: 33260 - RNA, 480 nt, Artificial Sequence
  derived and/or modified sequence opt1 from MYD88__Homo_sapiens__NP_001166037
augcgccccgaccgggccgaggccccgggcccgcccgcgauggccgccgggggccccggggccggcagcgccgcgcccguguccagcaccuccagccugccccucgccgcccugaacaugcgcguccggcgccggcugucccucuuccugaacgugcgcacccagguggccgcggacuggacggcccuggccgaggagauggacuucgaguaccucgagauccggcagcuggagacccaggccgaccccaccgggcgccugcucgacgccuggcagggccggcccggcgcgagcgucgggcgccugcuggagcuccugaccaagcugggccgggacgacgugcuccuggagcuggggccguccaucggcgccgccggguggugguggcucagccugaugaucacgugccgcgcccggaacgugaccucccgccccaaccugcacagcgccucccuccagguccccauccggagcgacuga

SEQ ID NO: 33261 - RNA, 522 nt, Artificial Sequence
  derived and/or modified sequence opt1 from MYDGF__Homo_sapiens__NP_061980
auggccgcccccagcggcggguggaacggcgugggggcgucccugugggccgcccuccugcugggcgccgucgcccuccgcccggcggaggccgugagcgagcccaccaccguggccuucgacguccggcccgggggcguggugcacuccuucagccacaacgucggccccggggacaaguacacgugcauguucaccuacgccucccagggcgggaccaacgagcaguggcagaugagccugggcaccuccgaggaccaccagcacuucacgugcaccaucuggcgcccgcaggggaaguccuaccuguacuucacccaguucaaggcggaggugcggggcgccgagaucgaguacgccauggccuacagcaaggccgcguucgagcgcgagagcgacgugccccucaagaccgaggaguucgaggucacgaagaccgccguggcccaccggcccggcgccuucaaggccgagcuguccaagcuggugaucgucgcgaaggccagccgcaccgagcucuga

SEQ ID NO: 33262 - RNA, 1731 nt, Artificial Sequence
  derived and/or modified sequence opt1 from MYEF2__Homo_sapiens__NP_001288139
auggccgacgccaacaaggcggaggugcccggcgccaccgggggcgacagcccgcaccuccagcccgccgagccgcccggggagccgcgccgggagccccaccccgccgaggccgagaagcagcagccccagcacuccagcuccagcaacggcgucaagauggagaacgacgaguccgcgaaggaggagaaguccgaccugaaggagaaguccaccgggagcaagaaggccaaccgcuuccacccguacagcaaggacaagaacagcggcacgggcgagaagaaggggcccaaccggaaccgcguguucaucuccaacauccccuacgacaugaaguggcaggccaucaaggaccugaugcgggagaaggugggcgaggucaccuacguggagcuguucaaggacgccgagggcaagagccgcgggugcgggguggucgaguucaaggacgaggaguucgugaagaaggcgcucgagaccaugaacaaguacgaccuguccggccggccccugaacaucaaggaggacccggacggcgagaacgcccgccgggcccuccagcgcaccgggggcagcuuccccgggggccacgugcccgacaugggcuccgggcugaugaaccugcccccgagcauccucaacaaccccaacaucccgcccgaggucaucuccaaccugcaggccggccggcuggggagcacgaucuucguggccaaccucgacuucaaggugggcuggaagaagcugaaggaggucuucuccaucgcggggaccgugaagcgcgccgacaucaaggaggacaaggacggcaagagccggggcauggggaccgugaccuucgagcaggccaucgaggccguccaggccaucagcauguucaacggccaguuccuguucgaccgccccaugcacgugaagauggacgacaaguccgugccccacgaggaguaccggagccacgacgggaagacgccccagcucccccgcggccucgggggcaucggcauggggcugggccccgggggccagcccaucuccgcgagccagcugaacaucgggggcgucaugggcaaccuggggcccggcgggaugggcauggacggccccggguucggcgggaugaaccggaucggcgggggcaucggcuucgggggccuggaggccaugaacuccaugggcggguucgggggcgugggccgcaugggggagcucuaccggggcgccaugaccagcuccauggagcgcgacuucgggcggggcgacaucgggaucaaccgcggcuucggcgacagcuucgggcgccugggcgggggcaugggguccaugaacagcgugaccggcggcauggggaugggccuggaccggauguccagcuccuucgaccgcauggggccgggcaucggcgccauccucgagcggagcaucgacauggaccgcggguuccuguccggccccauggggagcggcaugcgggagcgcaucggguccaagggcaaccagaucuucguccggaaccugcccuucgaccucaccuggcagaagcugaaggagaaguucagccagugcggccacgugauguucgccgagaucaagauggagaacgggaaguccaagggcugcgggacggugcgcuucgacagcccggagagcgcggagaaggccugccggaucaugaacggcaucaagaucuccgggcgcgagaucgacguccggcuggaccgcaacgccuga

SEQ ID NO: 33263 - RNA, 942 nt, Artificial Sequence
  derived and/or modified sequence opt1 from MYEOV__Homo_sapiens__NP_001280220
auggcccugcgcaucugcgugaccuacacccccgcccuccccaucggccugugcacgcggugcugccugugccucgagcagagccccuccuggugccacugccugcgcggggucagcuuccugaccuuccaccuccaccaguccgugccccugggcgaccgggacagccugcucauguucacccgccaggcggggcacuucguggagggcuccaaggccgggcggagccgcggccggcugugccugucccaggcccuccgcgucgccgugcggggcgccuucgugagccugugguucgcggccggggccggcgaccgcgagcggaacaagggggacaagggcgcccagaccggggcgggccugucccaggaggccgaggacgucgacgugagccgcgcccggcgcgugacggacgcgccccagggcacccucugcgggaccggcaaccggaacuccgggagccaguccgcccgcgucgugggcguggcccaccugggcgaggccuuccgggucgggguggagcaggccaucagcuccugcccggaggaggugcacggccgccacgggcugagcauggagaucaugugggcccggauggacgucgcccuccgcucccccggccgggggcugcuggcgggcgccggcgcccucugcaugacccuggccgagagcuccugccccgacuacgagcgcgggcgccgggccugccugacgcuccaccgccaccccaccccgcacugcagcaccuggggccugccccugcggguggcggggagcuggcucaccguggucacgguggaggcccugggcggguggcgcaugggcgugcggcgcaccggccaggucgggcccaccaugcacccgccgcccguguccggcgccagcccccugcuccugcaccaccuccugcugcugcuccugaucaucauccugaccugcuga

SEQ ID NO: 33264 - RNA, 768 nt, Artificial Sequence
  derived and/or modified sequence opt1 from MYF5__Homo_sapiens__NP_005584
auggacgugauggacggcugccaguucagccccuccgaguacuucuacgacgggagcugcaucccgucccccgagggcgaguucggggacgaguucgucccccgcguggccgccuucggcgcgcacaaggccgagcugcaggggagcgacgaggacgagcacgugcgggcccccaccggccaccaccaggccggccacugccucaugugggccugcaaggcgugcaagcgcaaguccaccacgauggaccggcgcaaggccgccaccaugcgggagcgccggcgccugaagaaggucaaccaggccuucgagacccugaagcggugcaccacgaccaacccgaaccagcgccuccccaagguggagauccugcggaacgcgauccgcuacaucgagagccugcaggagcuccugcgggagcaggucgagaacuacuacucccugcccgggcagagcugcuccgagcccaccagcccgaccuccaacugcagcgacggcaugcccgagugcaacucccccguguggagccgcaaguccagcacguucgacuccaucuacugccccgacgugagcaacguguacgccaccgacaagaacucccucagcagccuggacugccuguccaacaucgucgaccggaucaccagcuccgagcagccggggcucccccugcaggaccuggccagccucucccccguggccagcaccgacucccagcccgccacgccgggcgcgagcuccagccgccugaucuaccacgugcuguga

SEQ ID NO: 33265 - RNA, 729 nt, Artificial Sequence
  derived and/or modified sequence opt1 from MYF6__Homo_sapiens__NP_002460
augaugauggaccuguucgagaccggcagcuacuucuucuaccucgacggggagaacgugacccugcagccccuggaggucgccgagggcuccccgcucuaccccgggagcgacggcacgcugucccccugccaggaccagaugcccccggaggccgggagcgacuccagcggcgaggagcacgugcuggcgccgcccggccuccagccgccccacugccccgggcagugccugaucugggccugcaagaccugcaagcgcaaguccgcccccaccgaccggcgcaaggccgccacccugcgggagcgccggcgccucaagaagaucaacgaggcguucgaggcccugaagcggcgcacgguggccaaccccaaccagcggcugcccaaggucgagauccuccgcagcgccaucuccuacaucgagcggcugcaggaccugcuccaccgccuggaccagcaggagaagaugcaggagcugggcguggaccccuucagcuaccggcccaagcaggagaaccucgagggggcggacuuccugcggaccugcuccagccaguggcccuccgugagcgaccacucccgcggccuggucaucaccgccaaggagggcggggccagcaucgacuccagcgccuccagcagccuccgcugccuguccagcaucguggacuccaucagcuccgaggagcggaagcugccgugcguggaggaggucguggagaaguga

SEQ ID NO: 33266 - RNA, 6024 nt, Artificial Sequence
  derived and/or modified sequence opt1 from MYH10__Homo_sapiens__NP_001242941
auggcccagcgcaccggccuggaggaccccgagcgguaccucuucguggaccgcgccgucaucuacaacccggcgacccaggccgacuggacggccaagaagcugguguggauccccagcgagcggcacggguucgaggccgccuccaucaaggaggagcgcggcgacgaggugauggucgagcuggcggagaacgggaagaaggccauggugaacaaggacgacauccagaagaugaacccccccaaguucagcaagguggaggacauggccgagcucaccugccugaacgaggccuccguccugcacaaccucaaggaccgguacuacagcggccugaucuacaccuacuccgggcuguucugcguggugaucaacccguacaagaaccuccccaucuacagcgagaacaucaucgagauguaccgcggcaagaagcggcacgagaugcccccccacaucuacgcgaucuccgagagcgccuaccgcugcaugcugcaggaccgggaggaccaguccauccugugcaccggcgagagcggggccggcaagacggagaacaccaagaaggucauccaguaccucgcccacguggccuccagccacaaggggcgcaaggaccacaacaucccgcaggagucccccaagcccgugaagcaccagggcgagcuggagcggcagcugcuccaggcgaaccccauccuggagagcuucgggaacgccaagaccgucaagaacgacaacuccagccgcuucggcaaguucauccggaucaacuucgacgugaccggcuacaucgugggggccaacaucgagacguaccugcucgagaagucccgcgccguccggcaggccaaggacgagcgcaccuuccacaucuucuaccagcugcugagcggcgcgggggagcaccucaaguccgaccugcugcucgagggcuucaacaacuaccgguuccugagcaacggcuacaucccgauccccgggcagcaggacaaggacaacuuccaggagaccauggaggccaugcacaucaugggcuucagccacgaggagauccuguccaugcucaagguggugagcuccguccugcaguucgggaacaucagcuucaagaaggagcgcaacaccgaccaggccuccaugcccgagaacacgguggcccagaagcugugccaccuccugggcaugaacgugauggaguucacccgggccauccugaccccccgcaucaaggucgggcgggacuacgugcagaaggcgcagaccaaggagcaggccgacuucgccguggaggcccucgccaaggcgacguacgagcgccuguuccgcuggcugguccaccggaucaacaaggcccucgaccgcaccaagcggcagggcgccagcuucaucggcauccuggacaucgccggguucgagaucuucgagcugaacuccuucgagcagcucugcaucaacuacaccaacgagaagcugcagcagcuguucaaccacaccauguucauccucgagcaggaggaguaccagcgcgagggcaucgaguggaacuucaucgacuucgggcuggaccugcagccgugcaucgaccucaucgagcggcccgcgaacccccccggcgugcuggcccugcucgacgaggagugcugguucccgaaggccacggacaagaccuucgucgagaagcuggugcaggagcaggggagccacuccaaguuccagaagccccgccagcugaaggacaaggccgacuucugcaucauccacuacgccggcaagguggacuacaaggcggacgaguggcugaugaagaacauggacccccucaacgacaacgucgccacccugcugcaccagagcuccgaccgguucguggccgagcucuggaaggacgagauccagaacauccagcgcgccagcuucuacgacuccgugagcggccugcacgagcccccggucgaccggaucguggggcuggaccaggugaccggcaugacggagaccgccuucggguccgcguacaagaccaagaagggcauguuccgcaccgucgggcagcucuacaaggagagccugacgaagcugauggccacccuccggaacaccaaccccaacuucgugcgcugcaucauccccaaccacgagaagcgggccggcaagcuggacccccaccuggugcucgaccagcugcgcugcaacggcguccuggaggggauccggaucugccgccagggcuucccgaaccggaucguguuccaggaguuccgccagcgguacgagauccucacccccaacgccauccccaagggguucauggacggcaagcaggccugcgagcgcaugauccgcgcgcuggagcuggacccgaaccucuaccggaucggccaguccaagaucuucuuccgcgccggggugcuggcccaccuggaggaggagcgggaccucaagaucacggacaucaucaucuucuuccaggccgucugccgcggcuaccuggcgcggaaggccuucgccaagaagcagcagcagcugagcgcccucaaggugcugcagcgcaacugcgccgcguaccugaagcuccggcacuggcagugguggcgcguguucaccaaggucaagccccugcugcaggugacccggcaggaggaggagcuccaggccaaggacgaggagcugcugaaggugaaggagaagcagaccaaggucgagggggagcucgaggagauggagcgcaagcaccagcagcugcuggaggagaagaacauccucgccgagcagcugcaggccgagacggagcuguucgccgaggcggaggagaugcgggcccgccucgccgccaagaagcaggagcuggaggagauccugcacgaccucgagucccggguggaggaggaggaggagcgcaaccagauccugcagaacgagaagaagaagaugcaggcccacauccaggaccuggaggagcagcucgacgaggaggagggcgcgcggcagaagcugcagcuggagaaggugaccgccgaggccaagaucaagaagauggaggaggagauccuccugcuggaggaccagaacagcaaguucaucaaggagaagaagcucauggaggaccgcaucgccgagugcagcucccagcuggcggaggaggaggagaaggccaagaaccuggccaagauccggaacaagcaggaggucaugaucagcgaccucgaggagcgccugaagaaggaggagaagacccggcaggagcuggagaaggccaagcgcaagcucgacggggagaccaccgaccugcaggaccagaucgccgagcugcaggcgcagaucgacgagcucaagcugcagcuggccaagaaggaggaggagcuccagggcgcccuggcccggggcgacgacgagacgcugcacaagaacaacgcccucaagguggugcgcgagcugcaggcgcagaucgccgagcugcaggaggacuucgaguccgagaaggccagccgcaacaaggccgagaagcagaagcgggaccucuccgaggagcuggaggcccugaagaccgagcucgaggacacccuggacaccacggcggcccagcaggagcugcgcaccaagcgggagcaggaggucgccgagcucaagaaggcccuggaggaggagaccaagaaccacgaggcccagauccaggacaugcgccagcggcacgcgaccgcccuggaggagcucagcgagcagcuggagcaggccaagcgcuucaaggccaaccuggagaagaacaagcaggggcucgagacggacaacaaggagcuggcgugcgaggugaaggugcugcagcaggucaaggccgaguccgagcacaagcggaagaagcucgacgcccaggugcaggagcugcacgccaaggugagcgagggcgaccgccugcgggucgagcucgccgagaaggcguccaagcugcagaacgagcuggacaacgugagcacccuccuggaggaggccgagaagaaggggaucaaguucgccaaggacgccgccucccuggagagccagcuccaggacacccaggagcugcugcaggaggagacccgccagaagcugaaccucuccagccggauccgccagcuggaggaggagaagaacucccugcaggagcagcaggaggaggaggaggaggcgcggaagaaccucgagaagcaggugcuggcccugcagagccagcucgccgacacgaagaagaaggucgacgacgaccugggcaccaucgagucccuggaggaggccaagaagaagcuccugaaggacgccgaggcgcugagccagcgccucgaggagaaggcccuggccuacgacaagcuggagaagaccaagaaccggcuccagcaggagcuggacgaccugaccguggaccucgaccaccagcgccagguggccagcaaccuggagaagaagcagaagaaguucgaccagcugcucgcggaggagaaguccaucagcgcccgguacgccgaggagcgcgaccgggccgaggccgaggcgcgcgagaaggagacgaaggcccugucccuggcccgcgcccucgaggaggcccuggaggcgaaggaggaguucgagcggcagaacaagcagcugcgcgccgacauggaggaccucaugagcuccaaggacgacgucgggaagaacgugcacgagcuggagaagagcaagcgggcccuggagcagcagguggaggagaugcgcacccagcucgaggagcuggaggacgagcugcaggccaccgaggacgccaagcuccggcuggaggucaacaugcaggcgaugaaggcccaguucgagcgcgaccugcagacccgggacgagcagaacgaggagaagaagcgccuccugaucaagcaggugcgggagcuggaggccgagcucgaggacgagcgcaagcagcgggcccuggcgguggccuccaagaagaagauggagaucgaccugaaggaccucgaggcccagaucgaggccgccaacaaggcgcgcgacgaggucaucaagcagcugcggaagcugcaggcccagaugaaggacuaccagcgcgagcucgaggaggcccgggccagccgcgacgagaucuucgcccaguccaaggagagcgagaagaagcugaagucccuggaggcggagauccuccagcugcaggaggagcuggccagcuccgagcgggcccgccggcacgccgagcaggagcgcgacgagcucgccgacgagaucacgaacagcgcguccggcaagagcgcccugcuggacgagaagcggcgccucgaggcccgcaucgcccagcuggaggaggagcuggaggaggagcaguccaacauggagcuccugaacgaccgguuccgcaagaccacccugcagguggacacccucaacgccgagcuggcggccgagcggagcgccgcccagaaguccgacaacgcgcgccagcagcuggagcggcagaacaaggagcucaaggccaagcugcaggagcuggagggcgccgugaagagcaaguucaaggccacgaucagcgcccucgaggcgaagaucgggcagcuggaggagcagcuggagcaggaggccaaggagcgcgccgccgccaacaagcucguccggcgcaccgagaagaagcugaaggagaucuucaugcagguggaggacgagcggcgccacgcggaccaguacaaggagcagauggagaaggccaacgcccggaugaagcagcugaagcgccagcucgaggaggccgaggaggaggccacccgggcgaacgccucccgccggaagcugcagcgcgagcuggacgacgccaccgaggccaacgagggccucagccgggagguguccacgcugaagaaccgccugcggcgcgggggccccaucagcuucuccagcucccgcagcgggcggcgccagcuccaccuggagggcgcgucccuggagcucagcgacgacgacaccgaguccaagaccagcgacgucaacgagacccagcccccgcaguccgaguga

SEQ ID NO: 33267 - RNA, 5838 nt, Artificial Sequence
  derived and/or modified sequence opt1 from MYH11__Homo_sapiens__NP_001035202
auggcgcagaagggccagcugagcgacgacgagaaguuccucuucguggacaagaacuucaucaacagccccguggcccaggcggacugggccgccaagcggcuggugugggugcccagcgagaagcagggguucgaggccgccuccaucaaggaggagaagggcgacgaggucgugguggagcuggucgagaacgggaagaaggugaccgugggcaaggacgacauccagaagaugaacccgcccaaguucagcaaggucgaggacauggcggagcugaccugccugaacgaggccuccgugcugcacaaccuccgggagcgcuacuucagcgggcugaucuacacguacuccggccuguucugcguggucgugaaccccuacaagcaccuccccaucuacagcgagaagaucguggacauguacaagggcaagaagcggcacgagaugccgccccacaucuacgccaucgccgacaccgcguaccgcuccaugcugcaggaccgggaggaccagagcauccugugcaccggggaguccggcgccgggaagaccgagaacacgaagaaggucauccaguaccucgccgugguggccagcucccacaagggcaagaaggacaccagcaucacccaggggcccuccuucgccuacggcgagcuggagaagcagcugcuccaggcgaaccccauccuggaggccuucggcaacgccaagaccgucaagaacgacaacagcucccgcuucgggaaguucauccggaucaacuucgacgugacgggcuacaucgugggggccaacaucgagaccuaccugcucgagaagucccgcgccauccggcaggcgcgcgacgagcggaccuuccacaucuucuacuacaugaucgccggcgccaaggagaagaugcgcagcgaccugcugcucgagggcuucaacaacuacaccuuccugagcaacggguucguccccauccccgccgcccaggacgacgagauguuccaggagacgguggaggcgauggccaucaugggcuucagcgaggaggagcagcuguccauccucaagguggucagcuccgugcugcagcuggggaacaucgucuucaagaaggagcggaacaccgaccaggccagcaugcccgacaacaccgccgcccagaaggugugccaccucaugggcaucaacgugaccgacuucacgcgcuccauccugaccccgcggaucaaggucgggcgcgacguggugcagaaggcgcagaccaaggagcaggccgacuucgccgucgaggcccuggcgaaggccaccuacgagcgccuguuccgcuggauccugacgcgggugaacaaggcccuggacaagacccaccgccagggcgccagcuuccucggcauccuggacaucgccggguucgagaucuucgaggugaacuccuucgagcagcugugcaucaacuacaccaacgagaagcuccagcagcuguucaaccacaccauguucauccuggagcaggaggaguaccagcgggagggcaucgaguggaacuucaucgacuucgggcucgaccugcagcccugcaucgagcugaucgagcgccccaacaacccgcccggcguccucgcgcugcuggacgaggagugcugguuccccaaggccacggacaagagcuucguggagaagcucugcaccgagcaggggucccaccccaaguuccagaagcccaagcagcugaaggacaagaccgaguucagcaucauccacuacgccggcaagguggacuacaacgccuccgccuggcugaccaagaacauggacccgcucaacgacaacgucacgagccugcugaacgcguccagcgacaaguucguggccgaccuguggaaggacguggaccgcaucgucggccucgaccagauggccaagaugaccgaguccagccugcccuccgccagcaagaccaagaaggggauguuccggaccgugggccagcuguacaaggagcagcucgggaagcugaugacgacccugcgcaacaccacccccaacuucgugcggugcaucauccccaaccacgagaagcgcuccggcaagcucgacgccuuccugguccuggagcagcuccggugcaacggggugcuggagggcauccgcaucugccggcagggcuucccgaaccgcaucguguuccaggaguuccggcagcgcuacgagauccuggcggccaacgccauccccaagggguucauggacggcaagcaggccugcauccucaugaucaaggcgcuggagcuggaccccaaccucuaccggaucgggcagagcaagaucuucuuccgcacgggcguccuggcccaccuggaggaggagcgggaccucaagaucaccgacgugaucauggccuuccaggccaugugccgcggcuaccuggcccggaaggcguucgccaagcgccagcagcagcugaccgccaugaaggugauccagcggaacugcgccgccuaccucaagcugcgcaacuggcagugguggcggcuguucaccaaggucaagccccuccuccaggugacccgccaggaggaggagaugcaggcgaaggaggacgagcugcagaagacgaaggagcgccagcagaaggccgagaacgagcucaaggagcuggagcagaagcacagccagcugaccgaggagaagaaccuccugcaggagcagcugcaggccgagaccgagcucuacgccgaggccgaggagaugcgggugcgccuggcggccaagaagcaggagcuggaggagauccuccacgagauggaggcccggcuggaggaggaggaggaccgcgggcagcagcugcaggccgagcggaagaagauggcgcagcagaugcucgaccuggaggagcagcuggaggaggaggaggccgcccgccagaagcuccagcuggagaaggucaccgccgaggccaagaucaagaagcuggaggacgagauccucgugauggacgaccagaacaacaagcuguccaaggagcggaagcugcucgaggagcgcaucagcgaccugacgaccaaccuggcggaggaggaggagaaggccaagaaccucaccaagcugaagaacaagcacgaguccaugaucagcgagcuggaggugcggcucaagaaggaggagaagucccgccaggagcuggagaagcugaagcggaagcucgagggcgacgccagcgacuuccacgagcagaucgccgaccugcaggcccagaucgcggagcugaagaugcagcucgccaagaaggaggaggagcugcaggccgcccuggcccgccucgacgacgagaucgcgcagaagaacaacgcccugaagaagauccgggagcuggaggggcacaucuccgaccuccaggaggaccuggacagcgagcgcgccgcccggaacaaggccgagaagcagaagcgcgaccugggcgaggagcucgaggcgcugaagaccgagcuggaggacacgcucgacuccaccgccacccagcaggagcugcgggccaagcgcgagcaggaggucaccgugcugaagaaggcccucgacgaggagacgcggagccacgaggcccaggugcaggagaugcgccagaagcacgcccaggccgucgaggagcugaccgagcagcuggagcaguucaagcgggccaaggccaaccucgacaagaacaagcagacccuggagaaggagaacgcggaccuggccggggagcuccgcgugcugggccaggccaagcaggagguggagcacaagaagaagaagcuggaggcccagguccaggagcuccaguccaagugcagcgacggcgagcgcgcccgggcggagcugaacgacaaggugcacaagcugcagaacgagguggaguccgucaccgggaugcucaacgaggccgagggcaaggccaucaagcuggccaaggacguggccagccuguccagccagcuccaggacacgcaggagcugcugcaggaggagacccgccagaagcucaacguguccaccaagcugcggcagcuggaggaggagcgcaacagccugcaggaccagcucgacgaggagauggaggcgaagcagaaccuggagcggcacaucagcacccugaacauccagcucuccgacagcaagaagaagcugcaggacuucgccuccacggucgaggcccuggaggaggggaagaagcgcuuccagaaggagaucgagaaccucacccagcaguacgaggagaaggccgcggccuacgacaagcuggagaagaccaagaaccggcugcagcaggagcucgacgaccuggugguggaccuggacaaccagcgccagcucgucagcaaccuggagaagaagcagcggaaguucgaccagcugcucgccgaggagaagaacaucuccagcaaguacgccgacgagcgcgaccgggccgaggcggaggcccgcgagaaggagaccaaggcccugucccuggcccgggcccucgaggaggcgcuggaggccaaggaggagcuggagcgcacgaacaagaugcucaaggccgagauggaggaccuggugagcuccaaggacgacgugggcaagaacguccacgagcuggagaaguccaagcgggcccucgagacccagauggaggagaugaagacccagcuggaggagcuggaggacgagcuccaggccaccgaggacgcgaagcugcgccuggaggugaacaugcaggcccucaaggggcaguucgagcgggaccugcaggcccgcgacgagcagaacgaggagaagcggcgccagcugcagcgccagcuccacgaguacgagacggagcuggaggacgagcggaagcagcgcgcccuggcggccgccgccaagaagaagcucgagggcgaccugaaggaccuggagcuccaggccgacuccgcgaucaagggccgggaggaggccaucaagcagcugcgcaagcugcaggcccagaugaaggacuuccagcgggagcucgaggacgcccgcgccagccgggacgagaucuucgcgaccgccaaggagaacgagaagaaggccaagucccuggaggccgaccugaugcagcuccaggaggaccuggccgcggccgagcgcgcccggaagcaggccgaccuggagaaggaggagcucgccgaggagcuggcgagcucccugagcgggcgcaacgcccuccaggacgagaagcggcgccuggaggcccggaucgcccagcuggaggaggagcucgaggaggagcagggcaacauggaggcgauguccgaccgcgugcggaaggccacccagcaggccgagcagcugagcaacgagcuggccaccgagcgcuccacggcccagaagaacgagagcgcgcggcagcagcucgagcgccagaacaaggagcugcggagcaagcugcacgagauggagggggccgucaaguccaaguucaagagcaccaucgccgcccucgaggccaagaucgcgcagcuggaggagcaggucgagcaggaggcccgcgagaagcaggccgccaccaagucccugaagcagaaggacaagaagcucaaggagauccugcugcaggucgaggacgagcggaagauggccgagcaguacaaggagcaggcggagaagggcaacgcccgcgugaagcagcucaagcgccagcuggaggaggccgaggaggagagccagcggaucaacgccaaccgccggaagcugcagcgcgagcucgacgaggcgaccgaguccaacgaggccauggggcgggaggugaacgcccucaagagcaagcugcgcggcccgccgccccaggagacgucccaguga

SEQ ID NO: 33268 - RNA, 5817 nt, Artificial Sequence
  derived and/or modified sequence opt1 from MYH13__Homo_sapiens__NP_003793
augagcuccgacgccgagauggccaucuucggcgaggcggcccccuaccugcgcaagccggagaaggagcggaucgaggcccagaaccgccccuucgacagcaagaaggccugcuucguggccgacaacaaggagauguacgucaaggggaugauccagacccgggagaacgacaaggugaucgugaagacccucgacgaccgcaugcugacgcugaacaacgaccaggucuuccccaugaaccccccgaaguucgacaagaucgaggacauggcgaugaugacccaccuccacgagcccgccgugcuguacaaccugaaggagcgguacgccgccuggaugaucuacaccuacuccggccucuucugcgugaccgucaaccccuacaaguggcugcccguguacaagccggagguggucgcggccuaccgcgggaagaagcggcaggaggcccccccccacaucuucagcaucuccgacaacgccuaccaguucaugcugacggaccgcgacaaccagagcauccucaucaccggcgaguccggggccggcaagaccgugaacaccaagcgggugauccaguacuucgcgacgaucgccgucaccggcgacaagaagaaggagacccagcccgggaagaugcagggcacccuggaggaccagaucauccaggccaacccgcugcucgaggccuucgggaacgccaagacggugcgcaacgacaacagcucccgguucggcaaguucauccgcauccacuucggggcgaccggcaagcuggccagcgccgacaucgagaccuaccugcucgagaagucccgggugaccuuccagcugagcuccgagcgcagcuaccacaucuucuaccagaucauguccaacaagaagcccgagcugaucgaccuccugcugaucagcacgaaccccuucgacuuccccuucgucucccagggcgaggugaccguggccagcaucgacgacuccgaggagcuccuggccaccgacaacgcgaucgacauccugggguucagcagcgaggagaaggucggcaucuacaagcucaccggggccgugaugcacuacggcaacaugaaguucaagcagaagcagcgggaggagcaggccgagccggacggcacggagguggccgacaaggccggguaccugaugggccugaacuccgcggagaugcucaaggggcugugcugcccccgcgucaaggugggcaacgaguacgugaccaaggggcagaacguccagcaggugaccaacagcgucggcgcccuggccaaggccguguacgagaagauguuccucuggauggugacccggaucaaccagcagcuggacacgaagcagccccgccaguacuucaucggcguccuggacaucgcgggguucgagaucuucgacuucaacucccucgagcagcugugcaucaacuucaccaacgagaagcugcagcaguucuucaaccaccacauguucgugcucgagcaggaggaguacaagaaggagggcaucgagugggaguucaucgacuucgggauggaccuggccgccugcaucgagcugaucgagaagcccaugggcaucuucagcauccucgaggaggagugcauguucccgaaggccaccgacaccuccuucaagaacaagcuguacgaccagcaccuggggaagagcaacaacuuccagaagcccaagcccgccaagggcaaggcggaggcccacuucucccucgugcacuacgccggcacggucgacuacaacaucgccggguggcuggacaagaacaaggacccccugaacgagaccguggugggccucuaccagaagagcucccugaagcugcucagcuuccuguucuccaacuacgccggggcggagaccggcgacagcgggggcuccaagaagggcgggaagaagaagggcagcuccuuccagaccgucagcgccguguuccgggagaaccugaacaagcugaugacgaaccuccgcuccacccacccgcacuucgugcggugccugauccccaacgagaccaagacccccggggucauggaccacuaccuggugaugcaccagcuccgcugcaacggcgugcuggagggcauccgcaucugccggaagggguuccccagccgcauccuguacgccgacuucaagcagcgguaccgcauccucaacgccuccgccaucccggagggccaguucaucgacagcaagaacgcgagcgagaagcugcugaacuccaucgacgucgaccgggagcaguuccgcuucgggaacacgaagguguucuucaaggccggccuccuggggcugcucgaggagaugcgggacgagaagcuggugacccugaugaccagcacccaggccgucugccgcggcuaccucaugcggguggaguucaagaagaugauggagcgccgggacuccaucuucugcauccaguacaacauccgcagcuucaugaacgugaagcacuggcccuggaugaaccuguucuucaagaucaagccccugcucaaguccgccgaggcggagaaggagauggccaccaugaaggaggacuucgagcggacgaaggaggagcuggcccgcagcgaggcccggcgcaaggagcuggaggagaagauggucucccuccugcaggagaagaacgaccugcagcuccaggugcagagcgagaccgagaaccugauggacgccgaggagcggugcgagggccugaucaaguccaagauccuccuggaggcgaaggugaaggagcugaccgagcgccucgaggaggaggaggagaugaacagcgagcuggucgccaagaagcggaaccuggaggacaagugcuccagccucaagcgcgacaucgacgaccuggagcugacccucacgaagguggagaaggagaagcacgccaccgagaacaaggugaagaaccuguccgaggagaugaccgcccuggaggagaacaucagcaagcucaccaaggagaagaagucccugcaggaggcccaccagcagacgcuggacgaccuccaggucgaggaggacaaggugaacgggcugaucaagaucaacgcgaagcuggagcagcagaccgacgaccucgagggcagccuggagcaggagaagaagcugcgcgccgaccucgagcgggccaagcgcaagcuggagggggaccugaagaugucccaggagagcaucauggaccucgagaacgacaagcagcagaucgaggagaagcugaagaagaaggaguucgagcugagccagcuccaggccaagaucgacgacgagcaggugcacucccugcaguuccagaagaagaucaaggagcugcaggcccggaucgaggagcucgaggaggagaucgaggcggagcacacccugcgcgccaagaucgagaagcagcggagcgaccuggcccgcgagcucgaggagaucuccgagcggcuggaggaggccagcggcgcgaccuccgcccagaucgagaugaacaagaagcgcgaggccgaguuccagaagaugcggcgcgaccuggaggaggccacgcuccagcacgaggccaccgcggccacccugcggaagaagcaggccgacagcgucgccgagcugggggagcagaucgacaaccuccagcgcgugaagcagaagcuggagaaggagaaguccgagcugaagauggagaucgacgacauggccagcaacaucgaggcgcucuccaagagcaaguccaacaucgagcggaccugccgcacgguggaggaccaguucagcgagaucaaggccaaggacgagcagcagacccagcugauccacgaccugaacaugcagaaggcccggcuccagacccagaacggcgagcugucccaccgcgucgaggagaaggagagccugaucucccagcucaccaagagcaagcaggcccugacgcagcagcuggaggagcucaagcggcagauggaggaggagaccaaggccaagaacgcgauggcccacgcccugcaguccagccgccacgacugcgaccugcuccgggagcaguacgaggaggagcaggaggccaaggccgagcugcagcgcgcgcuguccaaggccaacagcgagguggcccaguggcggaccaaguacgagaccgacgccauccagcgcacggaggagcucgaggaggcgaagaagaagcuggcccagcgccugcaggaggccgaggagaacaccgagaccgccaacagcaagugcgccucccucgagaagaccaagcagcggcugcagggcgagguggaggaccugaugcgcgaccucgagcggagccacacggcgugcgccacccuggacaagaagcagcgcaacuucgacaagguccuggccgaguggaagcagaagcucgacgagucccaggccgagcuggaggccgcgcagaaggagagccggucccugagcaccgagcuguucaagaugcgcaacgccuacgaggaggugguggaccagcucgagacccugcggcgcgagaacaagaaccugcaggaggagaucuccgaccucacggagcagaucgccgagaccgggaagaaccugcaggaggccgagaagaccaagaagcuggucgagcaggagaagagcgaccuccagguggcccuggaggagguggagggcucccuggagcacgaggagagcaagauccuccggguccagcuggagcugucccaggugaagagcgagcucgaccgcaaggugaucgagaaggacgaggagaucgagcagcugaagcggaacucccagcgcgcggccgaggcccugcagagcguccucgacgccgagauccggucccgcaacgacgcgcugcggcugaagaagaagauggagggggaccucaacgagauggagauccagcugggccacagcaaccgccagauggccgagacccagaagcaccugcggacggugcaggggcagcucaaggacucccagcugcaccuggacgacgcccuccgcagcaacgaggaccugaaggagcagcuggccaucguggagcggcgcaacggccuccugcuggaggagcucgaggagaugaaggucgcccuggagcagaccgagcgcacccggcgccuguccgagcaggagcuccuggacgcgagcgaccgggugcagcugcuccacagccagaacaccucccugaucaacaccaagaagaagcuggaggccgacaucgcccagugccaggccgagguggagaacagcauccaggagucccgcaacgccgaggagaaggcgaagaaggccaucacggacgccgccaugauggccgaggagcucaagaaggagcaggacaccagcgcgcaccuggagcggaugaagaagaaccuggagcagaccgucaaggaccuccagcaccgccuggacgaggccgagcagcuggcccucaagggcgggaagaagcagauccagaagcuggagaaccgggugcgcgagcuggagaacgagcucgacgucgagcagaagcggggcgccgaggcgcugaagggggcccacaaguacgagcgcaaggugaaggagaugaccuaccaggccgaggaggaccacaagaacauccugcggcuccaggaccugguggacaagcugcaggccaaggucaaguccuacaagcgccaggccgaggaggcggaggagcaggccaacacgcagcucagccggugccgccgggugcagcacgagcuggaggaggccgccgagcgcgccgacaucgcggagucccaggugaacaagcugcgggccaagagccgcgacgucggcucccagaagauggaggaguga

SEQ ID NO: 33269 - RNA, 6111 nt, Artificial Sequence
  derived and/or modified sequence opt1 from MYH14__Homo_sapiens__NP_001139281
auggccgccgugaccauguccgugcccggccgcaaggcgccgccccggcccgggcccgugcccgaggccgcccagcccuuccuguucacgccccgcggccccuccgccgggggcgggcccggcagcggcaccagcccccagguggaguggaccgcccggcgccucgucugggugcccagcgagcugcacggguucgaggcggccgcccugcgggacgagggcgaggaggaggccgagguggagcucgcggaguccgggcgccggcugcgccugccccgggaccagauccagcgcaugaacccgcccaaguucagcaaggccgaggacauggccgagcugaccugccugaacgaggccuccguccugcacaaccuccgggagcgcuacuacagcggccugaucuacaccuacuccgggcuguucugcguggugaucaaccccuacaagcagcuccccaucuacaccgaggccaucgucgagauguaccggggcaagaagcgccacgaggugccgccccacguguacgcggucaccgagggcgccuaccggagcaugcugcaggaccgcgaggaccaguccauccugugcaccggggagagcggcgccgggaagaccgagaacacgaagaaggugauccaguaccucgcccacguggccuccagccccaagggccggaaggagcccggcguccccgcguccgugagcaccguguccuacggggagcuggagcgccagcugcuccaggccaaccccauccuggaggccuucggcaacgccaagaccgucaagaacgacaacagcucccgguucgggaaguucauccgcaucaacuucgacguggccggcuacaucgugggggcgaacaucgagaccuaccugcucgagaagucccgggccauccgccaggccaaggacgagugcagcuuccacaucuucuaccagcugcugggcggcgccggggagcagcucaaggccgaccugcugcucgagcccugcucccacuaccgcuuccugacgaacggccccagcuccagcccggggcaggagcgggagcuguuccaggagacccucgagucccugcgcguccugggcuucagccacgaggagaucaucuccaugcuccggauggugagcgcggugcugcaguucgggaacaucgcccugaagcgcgagcggaacaccgaccaggccaccaugcccgacaacacggccgcgcagaagcucugccgccugcugggccucggcgucaccgacuucucccgggcccugcugacgccccgcaucaagguggggcgggacuacguccagaaggcccagaccaaggagcaggccgacuucgcccucgaggcgcuggccaaggccacguacgagcgccuguuccgguggcucgugcugcgccugaaccgggcccucgaccgcagcccccggcagggcgccuccuuccuggggauccuggacaucgcgggcuucgagaucuuccagcugaacagcuucgagcagcucugcaucaacuacaccaacgagaagcugcagcagcuguucaaccacaccauguucgugcucgagcaggaggaguaccagcgcgaggggaucccguggaccuuccuggacuucggccuggaccuccagcccugcaucgaccugaucgagcggcccgccaacccgcccggccugcucgcccugcuggacgaggagugcugguuccccaaggccacggacaaguccuucgucgagaagguggcccaggagcagggcgggcaccccaaguuccagcgcccgcggcaccuccgcgaccaggcggacuucagcgugcugcacuacgccgggaaggucgacuacaaggccaacgaguggcugaugaagaacauggacccccucaacgacaacguggccgcgcugcugcaccaguccaccgaccgccucaccgccgagaucuggaaggacgagcacggcggcuuccagcaguucagcuuccugggguccuucccgcccagcccgcccggcuccgccgagcggugcagcagcgccaucagcccgcccgggguggagggcaucgucgggcuggagcaggucagcucccucggcgacggcccgcccgggggccgcccccggcgcgggauguuccggaccgugggccagcuguacaaggagagccugucccgccucauggccacgcugagcaacaccaaccccuccuucguccggugcaucgugccgaaccacgagaagcgcgcggggaagcuggagccccggcucgugcuggaccagcugcgcugcaacggcguccucgagggcauccggaucugccgccagggguuccccaaccggauccuguuccaggaguuccgccagcgguacgagauccugacccccaacgccaucccgaagggcuucauggacgggaagcaggccugcgagaagaugauccaggcccucgagcuggaccccaaccuguaccgcgugggccagagcaagaucuucuuccgggccggggugcucgcgcagcuggaggaggagcgcgaccugaaggucaccgacaucaucguguccuuccaggccgccgcccggggcuaccucgcccgccgggcguuccagaagcgccagcagcagcagagcgcccugcgcgugaugcagcggaacugcgccgccuaccugaagcuccgccacuggcagugguggcggcuguucacgaaggucaagccccugcuccaggugacccgccaggacgaggugcugcaggcgcgggcccaggagcugcagaagguccaggagcuccagcagcaguccgcccgcgaggugggcgagcugcaggggcggguggcccagcuggaggaggagcgcgcccggcucgcggagcagcugcgcgccgaggccgagcugugcgccgaggccgaggagacccggggccgccucgcggcccggaagcaggagcuggagcuggucgugagcgagcucgaggcccgcgugggggaggaggaggagugcucccggcagaugcagaccgagaagaagcgccugcagcagcacauccaggagcuggaggcccaccucgaggccgaggagggcgcgcggcagaagcugcagcuggagaaggucacgaccgaggccaagaugaagaaguucgaggaggaccuccugcugcucgaggaccagaacagcaagcuguccaaggagcgcaagcugcucgaggaccggcuggccgaguucagcucccaggccgccgaggaggaggagaaggucaagagccugaacaagcuccgccugaaguacgaggcgaccaucgccgacauggaggaccgccugcggaaggaggagaaggggcgccaggagcucgagaagcugaagcggcgccuggacggcgagagcuccgagcuccaggagcagaugguggagcagcagcagcgggccgaggagcugcgcgcccagcugggccggaaggaggaggagcuccaggcggcccuggcccgcgccgaggacgagggcggggcccgggcgcagcugcucaagagccugcgcgaggcccaggccgcccuggccgaggcgcaggaggaccucgaguccgagcggguggcccgcaccaaggccgagaagcagcggcgcgaccugggggaggagcuggaggcccuccggggcgagcuggaggacacccuggacagcacgaacgcccagcaggagcuccgcuccaagcgggagcaggaggugaccgagcugaagaagacccuggaggaggagacccgcauccacgaggcggccgugcaggagcugcggcagcgccacggccaggcccucggggagcuggccgagcagcuggagcaggcgcggcgcggcaagggggccugggagaagacgcgccucgcccuggaggccgaggucagcgagcugcgggccgagcucuccagccugcagaccgcgcgccaggagggcgagcagcggcgccggcgccuggagcuccagcugcaggaggugcaggggcgggccggcgacggcgagcgcgcccgggccgaggccgcggagaagcugcagcgcgcccaggccgagcucgagaacguguccggggcccugaacgaggccgagagcaagaccauccggcuguccaaggagcucagcuccaccgaggcgcagcugcacgacgcccaggagcugcuccaggaggagacgcgcgccaagcuggcccugggcagccggguccgcgcgauggaggccgaggccgccgggcuccgggagcagcuggaggaggaggccgcggcccgcgagcgggccggccgcgagcugcagaccgcccaggcccagcucuccgaguggcggcgccgccaggaggaggaggcgggggcccuggaggccggcgaggaggcccggcgccgggccgcgcgcgaggccgaggcccugacccagcggcucgccgagaagaccgagacgguggaccgccuggagcggggccgccggcgccugcagcaggagcucgacgacgccaccauggaccuggagcagcagcggcagcuggugagcacccucgagaagaagcagcgcaaguucgaccagcugcuggcggaggagaaggccgccguccuccgggccguggaggagcgcgagcgggcggaggccgaggggcgcgagcgggaggcccgcgcccugucccugacccgggcccucgaggaggagcaggaggcgcgcgaggagcuggagcggcagaaccgcgcccugcgcgccgagcucgaggcccugcugagcuccaaggacgacgugggcaagagcguccacgagcucgagcgggccugccgcguggcggagcaggccgccaacgaccugcgggcccaggugacggagcuggaggacgagcucaccgccgcggaggacgccaagcugcgccuggaggucaccgugcaggcccucaagacccagcacgagcgggaccugcaggggcgcgacgaggccggcgaggagcggcgccggcagcuggcgaagcagcuccgcgacgccgagguggagcgggacgaggagcgcaagcagcggacgcuggccgucgccgcccgcaagaagcuggagggggagcucgaggagcugaaggcgcagauggccagcgccggccagggcaaggaggaggccgugaagcagcugcggaagaugcaggcccagaugaaggagcucuggcgcgaggucgaggagacccggaccucccgcgaggagaucuucagccagaaccgggaguccgagaagcgccugaaggggcuggaggcggaggugcuccgccugcaggaggagcuggccgccagcgaccgggcccgccggcaggcccagcaggaccgcgacgagauggcggacgagguggccaacggcaaccucuccaaggccgccauccuggaggagaagcggcagcuggaggggcgccucggccagcuggaggaggagcuggaggaggagcagagcaacuccgagcuccugaacgaccgguaccgcaagcugcuccugcaggucgagagccugaccacggagcucuccgcggagcggagcuucuccgccaaggccgagagcggccgccagcagcuggagcggcagauccaggagcugcgcgggcggcucggcgaggaggacgccggggcccgcgcgcggcacaagaugaccaucgccgcccuggaguccaagcuggcccaggccgaggagcagcucgagcaggagacccgcgagcggauccugagcggcaagcuggugcgccgggcggagaagcgccucaaggaggugguccuccagguggaggaggagcggcgcguggccgaccagcugcgcgaccagcucgagaaggggaaccugcgggucaagcagcugaagcgccagcucgaggaggccgaggaggaggccucccgggcccaggcgggccgccggcgccugcagcgggagcuggaggacgugaccgagagcgccgaguccaugaaccgcgaggugacgacccuccggaaccgccugcggcgcggcccccugaccuucaccacgcggaccguccgccagguguuccggcucgaggaggggguggccagcgacgaggaggccgaggaggcccagccgggcuccgggcccagccccgagccggagggcagcccgcccgcgcacccccaguga

SEQ ID NO: 33270 - RNA, 5841 nt, Artificial Sequence
  derived and/or modified sequence opt1 from MYH15__Homo_sapiens__NP_055796
augguggagagcugccugcugacguuccgggccuucuucugguggaucgcccugaucaagauggaccugagcgaccucggcgaggcggccgccuuccugcggcgcagcgaggccgagcugcuccugcugcaggccaccgcgcucgacgggaagaagaagugcuggauccccgacggcgagaacgccuacaucgaggccgaggugaagggguccgaggacgacggcacggugaucguggagaccgccgacggggagagccuguccaucaaggaggacaagauccagcagaugaacccgcccgaguucgagaugaucgaggacauggcgaugcugacccaccucaacgaggccagcgugcugcacacccugaagcggcgcuacggccaguggaugaucuacacguacuccggccucuucugcgugaccaucaaccccuacaaguggcugcccguguaccagaaggaggugauggccgccuacaaggggaagcggcgcagcgaggccccgccccacaucuucgcgguggccaacaacgccuuccaggacaugcugcacaaccgggagaaccaguccauccucuucaccggcgagagcggggccggcaagaccgugaacuccaagcacaucauccaguacuucgccacgaucgcggccaugaucgagagccgcaagaagcagggggcccuggaggaccagaucaugcaggccaacaccauccuggaggccuucggcaacgcgaagacccuccggaacgacaacuccagccgcuucggcaaguucauccggaugcacuucggggcccgcggcaugcuguccagcgucgacaucgacaucuaccugcucgagaagucccgggugaucuuccagcaggccggggagcgcaacuaccacaucuucuaccagauccugagcggccagaaggagcugcacgaccuccugcugguguccgccaaccccagcgacuuccacuucugcagcugcggcgccgucaccguggagucccucgacgacgcggaggagcugcuggccacggagcaggccauggacauccucggguuccugcccgacgagaaguacggcugcuacaagcugaccggggccaucaugcacuucggcaacaugaaguucaagcagaagccgcgggaggagcagcucgaggcggacgggaccgagaacgccgacaaggccgccuuccugaugggcaucaacagcuccgagcuggugaagugccucauccacccccgcaucaaggucggcaacgaguacgugacccgggggcagacgaucgagcaggucacgugcgccgucggcgcgcugagcaaguccauguacgagcgcauguucaaguggcugguggcccggaucaaccgcgcccucgacgccaagcugagccggcaguucuucaucgggauccuggacaucaccggcuucgagauccucgaguacaacucccuggagcagcugugcaucaacuucaccaacgagaagcuccagcaguucuucaacuggcacauguucgugcuggagcaggaggaguacaagaaggagagcaucgagugggucuccaucggguucggccuggaccugcaggccugcaucgaccucaucgagaagcccaugggcauccugagcauccuggaggaggagugcauguuccccaaggcgaccgaccucaccuucaagaccaagcuguucgacaaccacuucgggaaguccgugcaccuccagaagccgaagcccgacaagaagaaguucgaggcccacuucgagcucgugcacuacgccggcgucgugcccuacaacaucagcggguggcuggagaagaacaaggaccugcucaacgagaccgucguggccguguuccagaaguccagcaaccgccugcuggccucccucuucgagaacuacaugagcacggacuccgcgauccccuucggcgagaagaagcgcaagaagggggccagcuuccagaccgucgccucccugcacaaggagaaccugaacaagcucaugaccaaccucaagagcaccgccccgcacuucgugcggugcaucaaccccaacgugaacaagauccccggcauccuggaccccuaccucguccugcagcagcugcgcugcaacggcgugcucgaggggacgcggaucugccgcgagggcuucccgaaccggcugcaguacgcggacuucaagcagcgcuacugcauccugaacccccggaccuuccccaagagcaaguucguguccagccgcaaggccgccgaggagcuccuggggucccuggagaucgaccacacccaguaccgguucggcaucaccaaggucuucuucaaggccggcuuccucgggcagcuggaggccauccgcgacgagcggcugagcaagguguucacccuguuccaggcgcgcgcccagggcaagcugaugcggaucaaguuccagaagauccuggaggagcgcgacgcccucauccugauccaguggaacauccgggccuucauggccgugaagaacuggcccuggaugcgccuguucuucaagaucaagccgcucgucaaguccagcgaggugggggaggagguggcgggccugaaggaggagugcgcccagcugcagaaggcccucgagaaguccgaguuccagcgggaggagcugaaggccaagcaggucagccugacccaggagaagaacgaccucauccugcagcugcaggccgagcaggagacccucgcgaacguggaggagcagugcgaguggcugaucaaguccaagauccagcuggaggcccgcgugaaggagcucagcgagcgggucgaggaggaggaggagaucaacuccgagcugaccgcccgcgggcgcaagcuggaggacgagugcuucgagcucaagaaggagaucgacgaccuggagacgaugcuggucaagagcgagaaggagaagcggaccaccgagcacaaggugaagaaccucaccgaggaggucgaguuccugaacgaggacaucuccaagcugaaccgcgccgcgaagguggugcaggaggcccaccagcagacccucgacgaccugcacauggaggaggagaagcugagcucccucagcaaggccaaccugaagcuggagcagcaggucgacgagcucgagggcgcccuggagcaggagcggaaggcccgcaugaacugcgagcgggagcugcacaagcucgagggcaaccugaagcugaaccgcgaguccauggagaaccucgagagcagccagcggcaccuggcggaggagcugcgcaagaaggagcucgagcugucccagaugaacagcaagguggagaacgagaaggggcugguggcccagcuccagaagacggucaaggagcugcagacccagaucaaggaccugaaggagaagcucgaggccgagcggaccacccgcgccaagauggagcgggagcgcgccgaccugacgcaggaccuggcggaccucaacgagcggcuggaggaggugggcggguccagccuggcccagcucgagaucaccaagaagcaggagaccaaguuccagaagcugcaccgcgacauggaggaggccacccugcacuucgagacgaccuccgccagccucaagaagcggcacgccgacucccuggcggagcuggagggccagguggagaaccuccagcaggucaagcagaagcuggagaaggacaagagcgaccugcagcucgagguggacgaccugcugacccgcguggagcagaugacccgggccaaggccaacgccgagaagcugugcacgcucuacgaggagcgccugcacgaggccaccgcgaagcuggacaaggucacccagcucgccaacgaccuggccgcccagaagaccaagcugugguccgagagcggggaguuccuccggcgccuggaggagaaggaggcgcugaucaaccagcucucccgggagaaguccaacuucacgcgccagaucgaggaccugcgcggccagcuggagaaggagaccaagucccagagcgcccucgcccacgcccugcagaaggcccagcgggacugcgaccugcuccgcgagcaguacgaggaggagcaggaggugaaggcggagcugcaccggacccuguccaaggugaacgccgagaugguccaguggcgcaugaaguacgagaacaacgugauccagcggaccgaggaccucgaggacgccaagaaggagcuggccauccgccugcaggaggccgcggaggccaugggcguggccaacgcccggaacgccagccucgagcgcgcgcggcaccagcugcagcuggagcucggggacgcccuguccgaccugggcaagguccgcagcgccgccgcgcggcucgaccagaagcagcugcaguccgggaaggcccuggccgacuggaagcagaagcacgaggagagccaggcccuccuggacgccagccagaaggaggugcaggcgcuguccacggagcuccugaagcugaagaacaccuacgaggagagcaucgugggccaggagacccuccgccgggagaacaagaaccugcaggaggagaucuccaaccugaccaaccagguccgcgaggggacgaagaaccucaccgagauggagaaggugaagaagcugaucgaggaggagaagaccgaggugcaggucacccuggaggagacggagggcgcccucgagcggaacgagagcaagauccugcacuuccagcuggagcuccuggaggccaaggccgagcuggagcgcaagcucuccgagaaggacgaggagaucgagaacuuccggcgcaagcagcagugcaccaucgacagccugcaguccagccuggacuccgaggccaagagccggaucgaggugacccgccucaagaagaagauggaggaggaccugaacgagauggagcugcagcucuccugcgcgaaccgccaggugagcgaggccaccaagucccugggccagcugcagauccagaucaaggaccuccagaugcagcuggacgacagcacgcagcugaacuccgaccucaaggagcaggucgccguggccgagcggcgcaacagccugcugcaguccgagcucgaggaccugcggagccugcaggagcagaccgagcgcgggcggcgccucuccgaggaggagcugcuggaggccaccgagcggaucaaccucuucuacacccagaacacgagccugcugagccagaagaagaagcucgaggcggacguggcccgcaugcagaaggaggccgaggaggucgugcaggagugccagaacgccgaggagaaggcgaagaaggccgccaucgaggccgccaaccuguccgaggagcugaagaagaagcaggacaccaucgcgcaccucgagcggacccgcgagaacauggagcagaccaucaccgaccugcagaagcggcuggccgaggccgagcagauggcccucaugggcagccgcaagcagauccagaagcuggagucccggguccgcgagcuggagggggagcucgagggcgagauccggcgcagcgccgaggcgcagcgcggggcccgccggcuggagcgcugcaucaaggagcugacguaccaggccgaggaggacaagaagaaccucucccggaugcagacccagauggacaagcugcagcugaaggugcagaacuacaagcagcaggucgaggucgccgagacccaggccaaccaguaccucagcaaguacaagaagcagcagcacgagcugaacgaggugaaggagcgcgcggagguggccgagucccaggucaacaagcugaagaucaaggcccgcgaguucggcaagaaggugcaggaggaguga

SEQ ID NO: 33271 - RNA, 5820 nt, Artificial Sequence
  derived and/or modified sequence opt1 from MYH1__Homo_sapiens__NP_005954
augagcagcgacagcgagauggcgaucuucggcgaggcggcgcccuuccugcgcaagagcgagcgggagcgcaucgaggcccagaacaagccguucgacgccaagaccagcguguucgugguggaccccaaggaguccuucgugaaggccaccgugcagagccgggagggcgggaaggugacggccaagaccgaggcgggggccaccgugaccgugaaggacgaccagguguuccccaugaacccgcccaaguacgacaagaucgaggacauggccaugaugacgcaccuccacgagcccgccgugcuguacaaccugaaggagcgcuacgcggccuggaugaucuacaccuacuccggccucuucugcgugaccgugaaccccuacaaguggcugcccguguacaacgccgaggucgugaccgccuaccgggggaagaagcgccaggaggccccgccccacaucuucagcaucuccgacaacgcguaccaguucaugcugacggaccgggagaaccagagcauccucaucaccggcgaguccggcgccgggaagaccgugaacaccaagcgcgucauccaguacuucgccacgaucgccgugaccggcgagaagaagaaggaggaggugaccagcgggaagaugcagggcacccuggaggaccagaucaucuccgccaacccccugcucgaggcguucgggaacgccaagacgguccggaacgacaacagcucccgcuucggcaaguucauccggauccacuucggcaccaccgggaagcuggccagcgccgacaucgagaccuaccugcucgagaagucccgcgugacguuccagcugaaggccgagcggagcuaccacaucuucuaccagaucauguccaacaagaagcccgaccugaucgagaugcuccugaucaccaccaacccguacgacuacgcguucgugagccagggcgagaucaccguccccagcaucgacgaccaggaggagcugauggccacggacuccgccaucgagauccucggguucaccagcgacgagcgcguguccaucuacaagcugaccggcgccgugaugcacuacggcaacaugaaguucaagcagaagcagcgggaggagcaggccgagcccgacgggaccgaggucgcggacaaggccgccuaccugcagaaccucaacagcgccgaccugcugaaggcgcucugcuacccccgcgugaaggucggcaacgaguacgugacgaaggggcagaccgugcagcaggucuacaacgccgugggcgcccuggccaaggccguguacgacaagauguuccuguggauggucacccggaucaaccagcagcucgacaccaagcagccgcgccaguacuucaucggggugcuggacaucgcgggcuucgagaucuucgacuucaacucccuggagcagcucugcaucaacuucacgaacgagaagcugcagcaguucuucaaccaccacauguucgugcuggagcaggaggaguacaagaaggagggcaucgaguggaccuucaucgacuucgggauggaccucgccgccugcaucgagcugaucgagaagcccaugggcaucuucagcauccuggaggaggagugcauguuccccaaggccaccgacaccuccuucaagaacaagcucuacgagcagcaccugggcaagagcaacaacuuccagaagcccaagccggccaagggcaagcccgaggcgcacuucucccugauccacuacgccgggacggucgacuacaacaucgccggcuggcucgacaagaacaaggacccccugaacgagaccguggugggccuguaccagaaguccgccaugaagacccucgcccugcuguucgucggggcgaccggcgccgaggccgaggccgggggcgggaagaagggcggcaagaagaagggguccagcuuccagaccguguccgcccuguuccgggagaaccugaacaagcugaugacgaaccuccgcagcacccacccccacuucgugcggugcaucaucccgaacgagaccaagacccccggcgccauggagcacgagcugguccugcaccagcugcgcugcaacggggugcucgagggcauccgcaucugccggaagggcuuccccucccgcauccuguacgccgacuucaagcagcgguacaaggugcugaacgccagcgccauccccgaggggcaguucaucgacuccaagaaggcgagcgagaagcuccugggcuccaucgacaucgaccacacgcaguacaaguucgggcacaccaaggucuucuucaaggccggccugcucgggcugcuggaggagaugcgcgacgagaagcucgcccagcugaucacccggacccaggccaugugccgcggcuuccuggcccggguggaguaccagaagaugguggagcgccgggagagcaucuucugcauccaguacaacguccgcgcguucaugaacgugaagcacuggccguggaugaagcucuacuucaagaucaagccccugcucaagagcgccgagacggagaaggagauggccaacaugaaggaggaguucgagaagaccaaggaggagcucgccaagaccgaggccaagcggaaggagcuggaggagaagauggugacccugaugcaggagaagaacgaccuccagcugcagguccaggcggaggccgacucccuggccgacgccgaggagcgcugcgaccagcucaucaagacgaagauccagcuggaggcgaagaucaaggaggugaccgagcgggccgaggacgaggaggagaucaacgccgagcugaccgccaagaagcgcaagcucgaggacgagugcagcgagcugaagaaggacaucgacgaccuggagcucacccuggccaagguggagaaggagaagcacgcgacggagaacaaggucaagaaccugaccgaggagauggccggccucgacgagaccaucgccaagcugaccaaggagaagaaggcccugcaggaggcccaccagcagacgcucgacgaccugcaggcggaggaggacaaggugaacacccugaccaaggccaagaucaagcucgagcagcaggucgacgaccuggaggggucccuggagcaggagaagaagauccggauggaccucgagcgcgccaagcggaagcuggagggcgaccugaagcucgcccaggagagcaccauggacaucgagaacgacaagcagcagcuggacgagaagcugaagaagaaggaguucgagauguccgggcuccagagcaagaucgaggacgagcaggcccugggcaugcagcugcagaagaagaucaaggagcuccaggcgcgcaucgaggagcuggaggaggagaucgaggccgagcgggccucccgcgccaaggccgagaagcagcgcagcgaccugucccgggagcucgaggagaucagcgagcgccuggaggaggccggcggggccacguccgcccagaucgagaugaacaagaagcgggaggccgaguuccagaagaugcgccgggaccuggaggaggcgacccuccagcacgaggccaccgccgccacccugcgcaagaagcacgccgacagcgucgcggagcugggggagcagaucgacaaccuccagcgggugaagcagaagcuggagaaggagaaguccgagaugaagauggagaucgacgaccuggccagcaacauggagacgguguccaaggccaaggggaaccucgagaagaugugccgcgcccuggaggaccagcugagcgagaucaagaccaaggaggaggagcagcagcggcucaucaacgaccugaccgcccagcgcgcgcggcugcagaccgaguccggcgaguacagccgccagcucgacgagaaggacacgcuggucagccagcugucccgggggaagcaggccuucacccagcagaucgaggagcucaagcgccagcuggaggaggagaucaaggccaagagcgcccuggcccacgcgcuccaguccagccggcacgacugcgaccugcugcgcgagcaguacgaggaggagcaggaggccaaggccgagcuccagcgggccauguccaaggcgaacagcgagguggcccaguggcgcaccaaguacgagaccgacgccauccagcggacggaggagcuggaggaggccaagaagaagcuggcccagcgccuccaggacgcggaggagcacguggaggccgucaacgccaagugcgccucccuggagaagaccaagcagcggcugcagaacgagguggaggaccucaugaucgacguggagcgcaccaacgccgcgugcgccgcccuggacaagaagcagcgcaacuucgacaagauccuggccgaguggaagcagaagugcgaggagacccacgccgagcucgaggcgagccagaaggagucccggagccuguccaccgagcuguucaagaucaagaacgccuacgaggagagccucgaccagcuggagacgcugaagcgcgagaacaagaaccuccagcaggagaucuccgaccugaccgagcagaucgccgagggcgggaagcggauccacgagcuggagaagaucaagaagcaggucgagcaggagaaguccgagcuccaggccgcgcuggaggaggccgaggccucccuggagcacgaggagggcaagauccugcgcauccagcucgagcugaaccaggucaagagcgagguggaccggaagaucgccgagaaggacgaggagaucgaccagaugaagcgcaaccacauccggaucgucgaguccaugcagagcacccuggacgccgagauccgcucccggaacgacgcgauccgccucaagaagaagauggagggcgaccugaacgagauggagauccagcugaaccacgccaaccggauggccgccgaggcccuccgcaacuaccggaacacccaggcgauccugaaggacacgcagcugcaccucgacgacgcccugcgcagccaggaggaccugaaggagcagcucgccaugguggagcggcgcgccaaccugcugcaggccgagaucgaggagcuccgggcgacccuggagcagaccgagcgcagccggaagaucgccgagcaggagcugcucgacgccuccgagcgcgugcagcugcugcacacccagaacacgagccucaucaacaccaagaagaagcuggagaccgacaucucccagauccagggggagauggaggacaucauccaggaggcccgcaacgccgaggagaaggcgaagaaggccaucaccgacgccgccaugauggcggaggagcugaagaaggagcaggacacgagcgcccaccucgagcggaugaagaagaaccuggagcagaccgucaaggaccugcagcaccgccucgacgaggccgagcagcuggcccugaagggcgggaagaagcagauccagaagcucgaggcccgggugcgcgagcuggagggcgagguggaguccgagcagaagcggaacgucgaggcggugaaggggcugcgcaagcacgagcggaaggugaaggagcucaccuaccagaccgaggaggaccgcaagaacauccugcggcugcaggaccucgucgacaagcugcaggccaaggucaagagcuacaagcgccaggccgaggaggccgaggagcaguccaacgucaaccugagcaaguuccggcgcauccagcacgagcucgaggaggccgaggagcgggcggacaucgccgagucccaggugaacaagcugcgcgucaagagccgggagguccacacgaagaucaucuccgaggaguga

SEQ ID NO: 33272 - RNA, 5826 nt, Artificial Sequence
  derived and/or modified sequence opt1 from MYH2__Homo_sapiens__NP_001093582
augagcuccgacagcgagcuggccguguucggggaggccgcgcccuuccugcgcaaguccgagcgggagcgcaucgaggcccagaaccggccguucgacgccaagaccagcguguucguggccgagcccaaggaguccuucgugaaggggaccauccagagccgcgagggcgggaaggugacggugaagaccgagggcggggccacccugaccgugaaggacgaccagguguuccccaugaacccgcccaaguacgacaagaucgaggacauggccaugaugacgcaccuccacgagcccgccgugcucuacaaccugaaggagcgguacgccgccuggaugaucuacaccuacuccggccuguucugcgugaccgugaaccccuacaaguggcuccccguguacaagcccgagguggucaccgcguaccgcggcaagaagcggcaggaggcgccgccccacaucuucagcaucuccgacaacgccuaccaguucaugcugacggaccgcgagaaccagagcauccugaucaccggggaguccggcgccgggaagaccgugaacaccaagcgggugauccaguacuucgccacgaucgcggucaccggcgagaagaagaaggaggagaucaccagcgggaagauccagggcacccucgaggaccagaucaucuccgccaacccccugcuggaggccuucggcaacgccaagacggugcgcaacgacaacagcucccgguucgggaaguucauccgcauccacuucggcaccaccgggaagcucgccagcgcggacaucgagaccuaccugcuggagaagucccggguggucuuccagcucaaggccgagcgcagcuaccacaucuucuaccagaucacguccaacaagaagccggagcugaucgagaugcugcucaucaccaccaaccccuacgacuaccccuucgugagccagggcgagaucagcguggccuccaucgacgaccaggaggagcugauggccaccgacagcgccaucgacauccugggcuucacgaacgaggagaaggucuccaucuacaagcucaccggggcggugaugcacuacggcaaccugaaguucaagcagaagcagcgggaggagcaggccgagcccgacgggaccgagguggccgacaaggccgccuaccugcagagccucaacuccgcggaccugcugaaggcccucugcuacccgcgcgucaaggugggcaacgaguacgucaccaaggggcagacgguggagcaggucagcaacgccgucggcgcccuggcgaaggccguguacgagaagauguuccuguggaugguggcccggaucaaccagcagcucgacaccaagcagccccgccaguacuucaucggcguccuggacaucgccggguucgagaucuucgacuucaacucccuggagcagcucugcaucaacuucaccaacgagaagcugcagcaguucuucaaccaccacauguucgugcuggagcaggaggaguacaagaaggagggcaucgaguggaccuucaucgacuucgggauggaccucgccgcgugcaucgagcugaucgagaagcccaugggcaucuucagcauccuggaggaggagugcauguuccccaaggccacggacaccuccuucaagaacaagcucuacgaccagcaccugggcaagagcgccaacuuccagaagccgaagguggucaagggcaaggccgaggcccacuucgcgcugauccacuacgccggcgugguggacuacaacaucaccggguggcucgagaagaacaaggacccccugaacgagaccgucgugggccuguaccagaaguccgccaugaagacgcucgcccagcuguucagcggggcccagaccgcggagggcgagggggccggcggcggggccaagaagggcgggaagaagaagggcuccagcuuccagaccguguccgcccuguuccgggagaaccucaacaagcugaugaccaaccugcgcagcacccacccccacuucguccggugcaucauccccaacgagacgaagaccccgggcgcgauggagcacgagcuggugcuccaccagcugcgcugcaacggggugcuggagggcauccgcaucugccggaagggguuccccucccgcauccucuacgccgacuucaagcagcgguacaagguccugaacgccagcgccauccccgagggccaguucaucgacuccaagaaggccagcgagaagcugcucgcgagcaucgacaucgaccacacccaguacaaguucgggcacaccaagguguucuucaaggccggccugcugggccuccuggaggagaugcgcgacgacaagcuggcccagcucaucacgcggacccaggcccgcugccggggguuccuggcccgcguggaguaccagcggauggucgagcgccgggaggcgaucuucugcauccaguacaacauccgcuccuucaugaacgugaagcacuggcccuggaugaagcuguucuucaagaucaagccgcuccucaagagcgccgagaccgagaaggagauggccaccaugaaggaggaguuccagaagaucaaggacgagcuggccaaguccgaggccaagcggaaggagcucgaggagaagauggugacgcugcugaaggagaagaacgaccuccagcugcagguccaggcggaggccgagggccuggccgacgccgaggagcgcugcgaccagcucaucaagaccaagauccagcuggaggcgaagaucaaggaggugaccgagcgggccgaggacgaggaggagaucaacgccgagcugaccgccaagaagcgcaagcucgaggacgagugcagcgagcugaagaaggacaucgacgaccuggagcucacgcuggccaagguggagaaggagaagcacgcgaccgagaacaaggucaagaaccugaccgaggagauggccgggcucgacgagaccaucgccaagcugacgaaggagaagaaggcccugcaggaggcccaccagcagacccucgacgaccugcaggcggaggaggacaaggugaacacccugaccaaggccaagaucaagcucgagcagcaggucgacgaccuggagggcucccuggagcaggagaagaagcuccggauggaccuggagcgcgccaagcggaagcuggagggggaccucaagcuggcccaggagagcaucauggacaucgagaacgagaagcagcagcuggacgagaagcucaagaagaaggaguucgagaucuccaaccugcagagcaagaucgaggacgagcaggcccugggcauccagcuccagaagaagaucaaggagcugcaggcgcgcaucgaggagcuggaggaggagaucgaggccgagcgcgccucccgggccaaggccgagaagcagcgcagcgaccucucccgggagcuggaggagaucagcgagcgccuggaggaggcgggcggggccacguccgcccagaucgagaugaacaagaagcgggaggccgaguuccagaagaugcgccgggaccucgaggaggcgacccugcagcacgaggccaccgccgccacccugcgcaagaagcacgccgacagcgucgcggagcucggcgagcagaucgacaaccugcagcgggugaagcagaagcuggagaaggagaaguccgagaugaagauggagaucgacgaccucgccagcaacguggagacggucuccaaggccaaggggaaccuggagaagaugugccgcacccuggaggaccagcucagcgagcucaagagcaaggaggaggagcagcagcggcugaucaacgaccugaccgcccagcgcggccggcugcagaccgaguccggggaguucagccgccagcuggacgagaaggaggcccucgugucccagcugagccggggcaagcaggcguucacgcagcagaucgaggagcugaagcgccagcucgaggaggagaucaaggccaagaacgcccuggcccacgcccugcaguccagccggcacgacugcgaccuccugcgcgagcaguacgaggaggagcaggaguccaaggcggagcugcagcgggcccucagcaaggccaacaccgagguggcccaguggcgcaccaaguacgagaccgacgcgauccagcggacggaggagcuggaggaggccaagaagaagcuggcccagcgccuccaggccgccgaggagcacgucgaggcggugaacgccaagugcgccucccuggagaagaccaagcagcgccugcagaacgagguggaggaccucaugcuggacgucgagcggaccaacgccgccugcgcggcccuggacaagaagcagcgcaacuucgacaagauccucgccgaguggaagcagaagugcgaggagacccacgccgagcuggaggccagccagaaggaggcgcggucccugggcacggagcuguucaagaucaagaacgccuacgaggagagccuggaccagcuggagacccugaagcgcgagaacaagaaccuccagcaggagaucuccgaccugaccgagcagaucgccgagggcgggaagcggauccacgagcuggagaagaucaagaagcaggucgagcaggagaagugcgagcuccaggccgcgcuggaggaggccgaggccagccuggagcacgaggaggggaagauccuccgcauccagcuggagcugaaccaggugaaguccgaggucgaccggaagaucgccgagaaggacgaggagaucgaccagcucaagcgcaaccacauccggaucguggagagcaugcaguccacccuggacgccgagauccgcagccggaacgacgcgauccgccugaagaagaagauggagggcgaccucaacgagauggagauccagcugaaccacgccaaccggauggccgccgaggcccugcgcaacuaccggaacacccaggggauccucaaggacacgcagauccaccuggacgacgcgcugcgcucccaggaggaccucaaggagcagcuggccaugguggagcggcgcgccaaccugcuccaggccgagaucgaggagcugcgggccacccuggagcagaccgagcgcagccgcaagaucgcggagcaggagcuccuggacgccagcgagcggguccagcugcuccacacccagaacacgucccugaucaacaccaagaagaagcuggagaccgacaucagccagaugcagggcgagauggaggacauccuccaggaggcccgcaacgccgaggagaaggccaagaaggcgaucaccgacgccgccaugauggccgaggagcugaagaaggagcaggacacguccgcgcaccuggagcggaugaagaagaacauggagcagaccgugaaggaccuccagcugcgccuggacgaggccgagcagcucgcccugaagggcgggaagaagcagauccagaagcuggaggcccgggugcgcgagcucgagggcgaggucgagagcgagcagaagcggaacgccgaggcggugaaggggcugcgcaagcacgagcggcgcgugaaggagcugaccuaccagaccgaggaggaccggaagaacauccuccgccugcaggaccuggucgacaagcuccaggccaaggugaaguccuacaagcggcaggccgaggaggccgaggagcagagcaacacgaaccuggccaaguuccgcaagcugcagcacgagcucgaggaggcggaggagcgggccgacaucgccgagucccaggucaacaagcugcgcgucaagagccgggaggugcacaccaaggucaucuccgaggaguga

SEQ ID NO: 33273 - RNA, 5823 nt, Artificial Sequence
  derived and/or modified sequence opt1 from MYH3__Homo_sapiens__XP_011522173
augagcagcgacaccgagauggagguguucgggaucgcggcccccuuccugcgcaagagcgagaaggagcggaucgaggcgcagaaccagccguucgacgccaagaccuacugcuucgugguggacagcaaggaggaguacgccaaggggaagaucaagagcagccaggacggcaaggugacggucgagaccgaggacaaccgcacccugguggugaagcccgaggacgucuacgccaugaacccgcccaaguucgaccggaucgaggacauggccaugcugacccaccugaacgagcccgcggugcucuacaaccugaaggaccgcuacacgagcuggaugaucuacaccuacagcgggcuguucugcgugaccgucaaccccuacaaguggcuccccguguacaaccccgagguggucgagggcuaccgggggaagaagcgccaggaggccccgccccacaucuucagcaucuccgacaacgccuaccaguucaugcugaccgaccgggagaaccagagcauccugaucacgggcgaguccggcgccgggaagaccgugaacaccaagcgcgugauccaguacuucgcgaccaucgccgccacgggcgaccucgccaagaagaaggacagcaagaugaaggggacccuggaggaccagaucaucuccgccaacccccugcucgaggcguucggcaacgccaagaccguccggaacgacaacagcucccgcuucgggaaguucauccggauccacuucggcaccacgggcaagcuggccagcgccgacaucgagaccuaccugcucgagaagucccgcgugaccuuccagcugaaggccgagcggagcuaccacaucuucuaccagauccuguccaacaagaagcccgagcucaucgagcugcugcucaucaccacgaacccguacgacuaccccuucaucagccagggggagauccugguggcgagcaucgacgacgccgaggagcugcucgccaccgacuccgccaucgacauccugggcuucacccccgaggagaaguccgggcuguacaagcucaccggcgccgucaugcacuacggcaacaugaaguucaagcagaagcagcgcgaggagcaggcggagcccgacgggacggagguggccgacaagaccgccuaccugaugggccugaacuccagcgaccuccugaaggcccugugcuucccgcgggugaaggucgggaacgaguacgugaccaagggccagaccguggaccagguccaccacgccgugaacgcgcucuccaagagcgucuacgagaagcuguuccuguggauggugacgcgcaucaaccagcagcucgacaccaagcugccccggcagcacuucaucggggugcuggacaucgccggcuucgagaucuucgaguacaacucccucgagcagcugugcaucaacuucaccaacgagaagcugcagcaguucuucaaccaccacauguucguccucgagcaggaggaguacaagaaggagggcaucgaguggaccuucaucgacuucgggauggaccuggccgccugcaucgagcugaucgagaagcccaugggcaucuucagcauccucgaggaggagugcauguuccccaaggcgacggacaccuccuucaagaacaagcuguacgaccagcaccugggcaagagcaacaacuuccagaagccgaagguggugaagggccgcgccgaggcccacuucucccucauccacuacgccgggaccgucgacuacagcguguccggcuggcuggagaagaacaaggacccccugaacgagaccguggucggccuguaccagaaguccuccaaccggcuccuggcccaccuguacgcgacguucgccaccgccgacgccgacagcgggaagaagaagguggccaagaagaagggcuccagcuuccagaccguguccgcccuguuccgcgagaaccugaacaagcugaugagcaaccuccggaccacccacccccacuucguccgcugcaucauccccaacgagacgaagaccccgggggccauggagcacagccuggugcugcaccagcuccgcugcaacggcgugcuggaggggauccggaucugccgcaagggcuuccccaaccggauccuguacggcgacuucaagcagcgcuaccggguccucaacgccuccgccauccccgaggggcaguucaucgacagcaagaaggccugcgagaagcugcuggcguccaucgacaucgaccacacccaguacaaguucggccacaccaagguguucuucaaggccgggcuccugggcacgcuggaggagaugcgcgacgaccggcucgccaagcugaucacccgcacccaggccgugugccggggcuuccugaugcgcgucgaguuccagaagauggugcagcggcgcgagagcaucuucugcauccaguacaacauccgguccuucaugaacgugaagcacuggcccuggaugaagcuguucuucaagaucaagccgcugcucaagagcgcggagaccgagaaggagauggccacgaugaaggaggaguuccagaagaccaaggacgagcucgccaaguccgaggccaagcgcaaggagcuggaggagaagcuggucacccucgugcaggagaagaacgaccugcagcuccaggugcaggccgagagcgagaaccuccuggacgcggaggagcggugcgaccagcugaucaaggccaaguuccagcucgaggccaagaucaaggaggucaccgagcgcgccgaggacgaggaggagaucaacgccgagcugacggcgaagaagcggaagcuggaggacgagugcuccgagcucaagaaggacaucgacgaccuggagcugacccucgccaagguggagaaggagaagcacgccaccgagaacaaggugaagaaccugaccgaggagcugagcgggcucgacgagacgaucgccaagcugacccgcgagaagaaggcccugcaggaggcgcaccagcaggcccucgacgaccugcaggccgaggaggacaaggucaacucccugaacaagaccaagagcaagcucgagcagcaggucgaggaccuggaguccagccuggagcaggagaagaagcuccggguggaccuggagcgcaacaagcgcaagcuggagggcgaccucaagcuggcccaggaguccauccuggaccucgagaacgacaagcagcagcuggacgagcggcugaagaagaaggacuucgaguacugccagcuccagagcaagguggaggacgagcagacccuggggcugcaguuccagaagaagaucaaggagcuccaggcgcgcaucgaggagcuggaggaggagaucgaggccgagcgggccacgcgcgccaagaccgagaagcagcgguccgacuacgcccgcgagcuggaggagcucagcgagcggcuggaggaggcgggcggggugaccagcacccagaucgagcugaacaagaagcgcgaggccgaguuccucaagcugcggcgcgaccuggaggaggccacgcuccagcacgaggccaugguggccgcgcugcggaagaagcacgccgacuccgucgccgagcugggcgagcagaucgacaaccuccagcgcgugaagcagaagcuggagaaggagaaguccgaguucaagcuggagaucgacgaccucuccagcuccauggagagcguguccaagagcaaggccaaccuggagaagaucugccggacccuggaggaccagcucuccgaggcccgcggcaagaacgaggagauccagcggagccuguccgagcugaccacccagaagucccgccuccagacggaggcgggggagcugucccggcagcuggaggagaaggagagcaucgucucccagcucagccgcuccaagcaggccuucacccagcagaccgaggagcugaagcggcagcuggaggaggagaacaaggccaagaacgcccucgcccacgcgcugcagagcucccgccacgacugcgaccugcuccgggagcaguacgaggaggagcaggagggcaaggccgagcugcagcgcgcccugagcaaggccaacagcgagguggcgcaguggcgcaccaaguacgagacggacgccauccagcggaccgaggagcuggaggaggccaagaagaagcucgcccagcgccugcaggacuccgaggagcaggucgaggccgucaacgcgaagugcgccagccuggagaagaccaagcagcggcuccagggggagguggaggaccugaugguggacgucgagcgcgccaacucccuggccgccgcgcucgacaagaagcagcggaacuucgacaaggugcuggccgaguggaagaccaagugcgaggagagccaggccgagcuggaggccucccucaaggagagccgcucccugagcacggagcuguucaagcucaagaacgccuacgaggaggcgcuggaccagcuggagaccgugaagcgggagaacaagaaccucgagcaggagaucgccgaccugaccgagcagaucgccgagaacggcaagaccauccacgagcuggagaagucccgcaagcagaucgagcucgagaaggccgacauccagcuggcgcuggaggaggccgaggccgcccucgagcacgaggaggccaagauccugcggauccagcuggagcucacccaggucaagagcgagaucgaccgcaagaucgcggagaaggacgaggagaucgagcagcugaagcggaacuaccagcgcacgguggagaccaugcaguccgcccuggacgccgaggugcggagccgcaacgaggccauccggcucaagaagaagauggagggggaccugaacgagaucgagauccagcugucccacgccaaccgccaggcggccgagacccucaagcaccuccggagcguccagggccagcugaaggacacccagcuccaccuggacgacgcccugcgcggccaggaggaccucaaggagcagcuggccaucguggagcggcgcgccaaccugcuccaggcggagguggaggagcugcgcgccacgcuggagcagaccgagcgggcccgcaagcucgccgagcaggagcugcuggacuccaacgagcggguccagcuccugcacacccagaacaccagccugauccacacgaagaagaagcucgagaccgaccugaugcagcugcaguccgagguggaggacgcgagccgcgacgcccggaacgccgaggagaaggccaagaaggccaucaccgacgcggccaugauggccgaggagcucaagaaggagcaggacaccuccgcccaccuggagcgcaugaagaagaaccuggagcagacggucaaggaccuccagcaccggcuggacgaggccgagcagcuggcgcucaagggcgggaagaagcagauccagaagcuggagacccgcauccgggagcuggaguucgagcucgagggggagcagaagaagaacaccgagagcgugaagggccugcgcaaguacgagcggcgcgugaaggagcugaccuaccagagcgaggaggaccggaagaacguccuccgccugcaggaccugguggacaagcuccaggugaaggucaaguccuacaagcggcaggccgaggaggccgacgagcaggccaacgcccaccugacgaaguuccgcaaggcgcagcacgagcuggaggaggccgaggagcgggccgacaucgccgagagccaggugaacaagcuccgcgccaagacccgggacuucaccuccagccgcauggugguccacgaguccgaggaguga

SEQ ID NO: 33274 - RNA, 5820 nt, Artificial Sequence
  derived and/or modified sequence opt1 from MYH4__Homo_sapiens__NP_060003
augagcagcgacagcgagauggccaucuucggcgaggccgcgcccuuccugcgcaagagcgagaaggagcggaucgaggcccagaacaagccguucgacgccaagaccagcguguucgugguggaccccaaggaguccuacgugaaggccaucguccagagccgcgagggcgggaaggugaccgccaagacggaggcgggggccaccgugaccgucaaggaggaccagguguucuccaugaacccgcccaaguacgacaagaucgaggacauggccaugaugacccaccuccacgagcccgccgugcuguacaaccugaaggagcgguacgcggccuggaugaucuacacguacagcggccuguucugcgucaccgugaaccccuacaaguggcugcccguguacaaccccgaggucgugaccgccuaccgcgggaagaagcggcaggaggccccgccccacaucuucuccaucagcgacaacgccuaccaguucaugcugaccgaccgcgagaaccaguccauccugaucacgggcgagagcggcgcggggaagaccgugaacaccaagcgggucauccaguacuucgccaccaucgccgugacgggcgagaagaagaaggaggagcccgccuccgggaagaugcagggcacccuggaggaccagaucaucagcgccaacccccugcucgaggcguucgggaacgccaagaccgugcgcaacgacaacuccagccgguucggcaaguucauccgcauccacuucggcgccaccgggaagcuggccuccgccgacaucgagacguaccugcucgagaagucccgggucaccuuccagcugaaggcggagcgcuccuaccacaucuucuaccagauccugagcaacaagaagccggagcucaucgagaugcugcugaucaccaccaaccccuacgacuucgccuucgugagccagggcgagaucacggugcccuccaucgacgaccaggaggagcucauggccaccgacagcgccgucgacauccugggguucaccgccgacgagaagguggcgaucuacaagcugaccggcgccgugaugcacuacggcaacaugaaguucaagcagaagcagcgggaggagcaggccgagcccgacgggacggaggucgccgacaaggcggccuaccucaccucccugaacagcgccgaccugcucaagucccugugcuacccgcgcgugaaggucggcaacgaguucgugaccaaggggcagaccgugcagcaggucuacaacgccgugggcgcccuggcgaaggccaucuacgagaagauguuccucuggauggugacgcggaucaaccagcagcuggacaccaagcagccccgccaguacuucaucgggguccuggacaucgccggcuucgagaucuucgacuucaacagccucgagcagcugugcaucaacuucaccaacgagaagcugcagcaguucuucaaccaccacauguucgugcucgagcaggaggaguacaagaaggagggcaucgagugggaguucaucgacuucgggauggaccuggccgccugcaucgagcugaucgagaagcccaugggcaucuucuccauccucgaggaggagugcauguuccccaaggcgaccgacacgagcuucaagaacaagcuguacgagcagcaccuggggaaguccaacaacuuccagaagccgaagcccgccaagggcaagcccgaggcccacuucagccucgugcacuacgccgggaccgucgacuacaacaucgccggcuggcuggacaagaacaaggacccccugaacgagaccguggugggccucuaccagaaguccgcgaugaagacccuggccuuccuguucagcggggcccagacggccgaggcggagggcgggggcgggaagaagggcggcaagaagaagggguccagcuuccagaccgucuccgcccucuuccgggagaaccugaacaagcugaugaccaaccuccgcagcacccacccgcacuucgugcggugcaucauccccaacgagaccaagacgcccggcgccauggagcacgagcuggugcugcaccagcugcgcugcaacgggguccucgagggcauccggaucugccgcaagggcuuccccucccgcauccuguacgccgacuucaagcagcgguacaaggugcugaacgccagcgcgaucccggaggggcaguucaucgacuccaagaaggccagcgagaagcuccugggcagcaucgagaucgaccacacccaguacaaguucgggcacaccaagguguucuucaaggccggccugcucgggacccuggaggagaugcgcgacgagaagcuggcccagcucaucacgcggacccaggccaucugccgcggcuuccugaugcgggucgaguuccgcaagaugauggagcggcgcgaguccaucuucugcauccaguacaacauccgggcguucaugaacgugaagcacuggcccuggaugaagcuguacuucaagaucaagccccuccucaagagcgccgagaccgagaaggagauggccaacaugaaggaggaguucgagaagaccaaggaggagcuggccaagacggaggccaagcgcaaggagcucgaggagaagauggugacccugaugcaggagaagaacgaccugcagcuccagguccaggcggaggccgacgcccuggccgacgcggaggagcggugcgaccagcugaucaagaccaagauccagcucgaggccaagaucaaggaggugaccgagcgcgccgaggacgaggaggagaucaacgccgagcugacggccaagaagcggaagcuggaggacgagugcuccgagcucaagaaggacaucgacgaccuggagcugacccucgcgaagguggagaaggagaagcacgccaccgagaacaaggucaagaaccugaccgaggagauggccggccuggacgagacgaucgccaagcucaccaaggagaagaaggcccugcaggaggcgcaccagcagacccuggacgaccuccagauggaggaggacaaggugaacacccugacgaaggccaagaccaagcuggagcagcaggucgacgaccucgaggggagccuggagcaggagaagaagcugugcauggaccucgagcgcgccaagcggaagcuggagggcgaccugaagcucgcccaggaguccaccauggacaccgagaacgacaagcagcagcugaacgagaagcugaagaagaaggaguucgagaugagcaaccuccaggggaagaucgaggacgagcaggcccuggcgauccagcugcagaagaagaucaaggagcuccaggcccgcaucgaggagcuggaggaggagaucgaggccgagcgggccucccgcgccaaggcggagaagcagcggagcgaccugucccgcgagcucgaggagaucagcgagcgccuggaggaggccggcggggccacguccgcccagaucgagaugaacaagaagcgggaggcggaguuccagaagaugcgccgggaccuggaggagagcacccuccagcacgaggccaccgccgccgcccugcgcaagaagcacgcggacuccgucgccgagcugggcgagcagaucgacagccuccagcgggugaagcagaagcuggagaaggagaaguccgagcugaagauggagaucaacgaccucgccagcaacauggagaccguguccaaggccaaggccaacuucgagaagaugugccgcacgcuggaggaccagcugagcgagaucaagaccaaggaggaggagcagcagcggcucaucaacgagcugagcgcgcagaaggcccgccugcacaccgaguccggcgaguucagccggcagcucgacgagaaggacgccauggucucccagcugagccgcgggaagcaggccuucacccagcagaucgaggagcugaagcggcagcucgaggaggagacgaaggccaaguccacccuggcgcacgcccugcagagcgcccgccacgacugcgaccuccugcgggagcaguacgaggaggagcaggaggccaaggcggagcugcagcgcggcauguccaaggccaacagcgagguggcccaguggcggaccaaguacgagaccgacgccauccagcgcacggaggagcucgaggaggccaagaagaagcuggcgcagcggcugcaggacgccgaggagcacguggaggccgucaacuccaagugcgccagccucgagaagaccaagcagcgccugcagaacgagguggaggaccugaugaucgacguggagcgguccaacgccgcgugcaucgcccucgacaagaagcagcgcaacuucgacaagguccuggccgaguggaagcagaaguacgaggagacccaggccgagcuggaggccagccagaaggagucccggagccucuccaccgagcuguucaaggugaagaacgcguacgaggagagccuggaccaccucgagacccugaagcgcgagaacaagaaccugcagcaggagaucuccgaccucacggagcagaucgccgagggcgggaagcacauccacgagcuggagaaggugaagaagcagcuggaccacgagaaguccgagcuccagaccucccuggaggaggccgaggccagccuggagcacgaggaggggaagauccugcgcauccagcucgagcugaaccaggucaagagcgagaucgaccggaagaucgcggagaaggacgaggagcuggaccagcucaagcgcaaccaccuccgggugguggaguccaugcagagcacccuggacgccgagauccgcucccggaacgacgcccuccgcaucaagaagaagauggagggcgaccugaacgagauggagauccagcugaaccacgccaaccggcaggccgcggaggcccuccgcaaccugcggaacacccagggcauccugaaggacacgcagcuccaccuggacgacgccauccgcgggcaggacgaccugaaggagcagcucgccauggucgagcggcgcgccaaccugaugcaggcggagguggaggagcugcgggccagccucgagcgcaccgagcggggccgcaagauggccgagcaggagcugcuggacgccuccgagcgggugcagcuccugcacacccagaacaccagccugaucaacacgaagaagaagcucgagaccgacaucucccagauccagggggagauggaggacaucguccaggaggcccgcaacgcggaggagaaggccaagaaggccaucaccgacgccgccaugauggcggaggagcugaagaaggagcaggacaccagcgcccaccuggagcggaugaagaagaacauggagcagacggugaaggaccuccagcugcgccuggacgaggccgagcagcucgcccugaagggcgggaagaagcagauccagaagcuggaggcgcgcgugcgggagcucgaguccgaggucgagagcgagcagaagcacaacguggaggccgugaagggccugcgcaagcacgagcggcgcgucaaggagcugaccuaccagaccgaggaggaccggaagaacauccuccgccugcaggaccugguggacaagcuccagaccaaggucaaggccuacaagcggcaggccgaggaggccgaggagcaguccaacgugaaccuggcgaaguuccgcaagcugcagcacgagcucgaggaggccaaggagcgggccgacaucgccgagagccaggugaacaagcugcgcgucaagucccgggaggugcacacgaaggugaucagcgaggaguga

SEQ ID NO: 33275 - RNA, 5820 nt, Artificial Sequence
  derived and/or modified sequence opt1 from MYH6__Homo_sapiens__NP_002462
augaccgacgcccagauggccgacuucggcgcggccgcccaguaccugcgcaagagcgagaaggagcggcucgaggcccagacccgccccuucgacauccggacggagugcuucgugccggacgacaaggaggaguucgucaaggccaagauccugucccgcgaggggggcaaggugaucgcggagaccgagaacgggaagaccgugaccgucaaggaggaccaggugcugcagcagaacccccccaaguucgacaagaucgaggacauggccaugcucacguuccugcacgagcccgccgugcuguucaaccucaaggagcgguacgccgcguggaugaucuacaccuacagcggccuguucugcgucaccgugaacccguacaaguggcugcccguguacaacgccgaggucguggccgccuaccgcgggaagaagcgguccgaggcccccccccacaucuucagcaucuccgacaacgcguaccaguacaugcucaccgaccgcgagaaccagagcauccugaucacgggcgaguccggcgccgggaagaccgugaacaccaagcgggucauccaguacuucgccagcaucgccgccaucggcgaccgcgggaagaaggacaacgcgaacgccaacaagggcacccuggaggaccagaucauccaggccaacccggcccucgaggccuucgggaacgcgaagacggugcggaacgacaacuccagccgcuucggcaaguucauccggauccacuucggcgccaccgggaagcuggccuccgccgacaucgagaccuaccugcucgagaagagccgcgugaucuuccagcugaaggccgagcggaacuaccacaucuucuaccagauccuguccaacaagaagcccgagcuccuggacaugcugcucgucaccaacaaccccuacgacuacgcguucgugagccagggcgagguguccgucgccagcaucgacgacuccgaggagcugauggccacggacagcgccuucgacgugcugggguucaccuccgaggagaaggcgggcguguacaagcucaccggcgccaucaugcacuacgggaacaugaaguucaagcagaagcagcgcgaggagcaggccgagcccgacggcaccgaggacgccgacaagagcgccuaccugauggggcugaacagcgcggaccuccugaagggccugugccacccgcgggucaagguggggaacgaguacgugacgaagggccaguccguccagcagguguacuacagcaucggcgcccucgccaaggccgucuacgagaagauguucaacuggauggugacccgcaucaacgccacccuggagaccaagcagccccggcaguacuucaucggggugcuggacaucgcgggcuucgagaucuucgacuucaacuccuucgagcagcucugcaucaacuucacgaacgagaagcugcagcaguucuucaaccaccacauguucguccuggagcaggaggaguacaagaaggaggggaucgaguggaccuucaucgacuucggcauggaccuccaggccugcaucgaccugaucgagaagcccauggggaucaugagcauccuggaggaggagugcauguuccccaaggccaccgacaugaccuucaaggccaagcucuacgacaaccaccugggcaaguccaacaacuuccagaagccgcgcaacaucaagggcaagcaggaggcccacuucagccugauccacuacgcggggacgguggacuacaacauccucggcuggcuggagaagaacaaggacccccugaacgagaccguggucgcccucuaccagaaguccagccugaagcugauggccacccucuucuccagcuacgccaccgcggacacgggggacuccggcaagagcaaggggggcaagaagaagggcuccagcuuccagaccguguccgcccugcaccgggagaaccugaacaagcugaugaccaaccuccgcaccacgcacccccacuucgugcgcugcaucauccccaacgagcggaaggccccgggggucauggacaacccccuggugaugcaccagcugcgcugcaacggcgugcucgaggggauccggaucugccgcaagggcuuccccaaccggauccuguacggcgacuuccgccagcgguaccgcauccugaaccccgucgccaucccggaggggcaguucaucgacagccggaagggcaccgagaagcuccuguccagccuggacaucgaccacaaccaguacaaguucgggcacaccaagguguucuucaaggccggccuccuggggcugcucgaggagaugcgcgacgagcggcugucccgcaucaucacccggaugcaggcgcaggcccgcggccagcugaugcggaucgaguucaagaagaucguggagcgccgggacgcccuccuggucauccaguggaacauccgcgccuucaugggcgugaagaacuggcccuggaugaagcuguacuucaagaucaagccccuccugaagagcgccgagaccgagaaggagauggcgacgaugaaggaggaguucgggcggaucaaggagacccuggagaagagcgaggcccgccgcaaggagcucgaggagaagauggugucccugcugcaggagaagaacgaccuccagcugcagguccaggccgagcaggacaaccugaacgacgccgaggagcggugcgaccagcucaucaagaacaagauccagcuggaggccaaggugaaggagaugaacgagcgccuggaggacgaggaggagaugaacgcggagcucaccgccaagaagcggaagcuggaggacgagugcagcgagcugaagaaggacaucgacgaccucgagcugacccuggccaagguggagaaggagaagcacgccacggagaacaaggucaagaaccucaccgaggagauggcgggccuggacgagaucaucgccaagcugaccaaggagaagaaggcccuccaggaggcccaccagcaggcccuggacgaccugcagguggaggaggacaaggugaacucccucagcaaguccaaggucaagcuggagcagcagguggacgaccuggaggggagccucgagcaggagaagaaggugcgcauggaccuggagcgggcgaagcgcaagcuggagggcgaccucaagcugacccaggaguccaucauggaccuggagaacgacaagcuccagcuggaggagaagcugaagaagaaggaguucgacaucaaccagcagaacagcaagaucgaggacgagcagguccucgcccugcagcugcagaagaagcucaaggagaaccaggcccggaucgaggagcuggaggaggagcuggaggccgagcgcacggcccgggcgaagguggagaagcuccgcuccgaccugagccgggagcuggaggagaucuccgagcgccucgaggaggccgggggcgccaccagcgugcagaucgagaugaacaagaagcgggaggccgaguuccagaagaugcgccgggaccuggaggaggccacccugcagcacgaggcgaccgccgccgcccuccgcaagaagcacgccgacuccgucgcggagcugggcgagcagaucgacaaccugcagcgggugaagcagaagcucgagaaggagaagagcgaguucaagcuggagcuggacgacgugacguccaacauggagcagaucaucaaggccaaggccaaccucgagaaggucagccgcacccuggaggaccaggccaacgaguaccgggugaagcuggaggaggcgcagcgcucccucaacgacuucaccacccagcgggccaagcugcagacggagaacggggagcuggcccgccagcucgaggagaaggaggcccugaucagccagcugacccgcggcaagcucagcuacacccagcagauggaggaccugaagcggcagcuggaggaggaggggaaggccaagaacgcgcucgcccacgcccugcaguccgcccgccacgacugcgaccugcuccgggagcaguacgaggaggagaccgaggccaaggcggagcugcagcgcgugcugagcaaggccaacuccgaggucgcccaguggcggacgaaguacgagaccgacgccauccagcgcaccgaggagcucgaggaggccaagaagaagcuggcgcagcggcugcaggacgccgaggaggccguggaggccgugaacgcgaagugcagcucccucgagaagaccaagcaccgccugcagaacgagaucgaggaccugauggucgacguggagcggagcaacgccgccgccgccgcgcuggacaagaagcagcgcaacuucgacaagauccucgccgaguggaagcagaaguacgaggagucccagagcgagcuggaguccagccagaaggaggcccggucccugagcacggagcucuucaagcugaagaacgccuacgaggagucccuggagcaccucgagaccuucaagcgcgagaacaagaaccugcaggaggagaucagcgaccugaccgagcagcucggcgaggggggcaagaacgugcacgagcuggagaagguccggaagcagcuggagguggagaagcucgagcugcaguccgcccuggaggaggcggaggccagccucgagcacgaggagggcaagauccugcgcgcccagcuggaguucaaccagaucaaggccgagaucgagcggaagcucgccgagaaggacgaggagauggagcaggcgaagcgcaaccaccagcggguggucgacucccugcagaccagccuggacgccgagacgcgcucccggaacgaggugcuccgcgugaagaagaagauggagggggaccugaacgagauggagauccagcugagccacgccaaccgcauggccgcggaggcccagaagcaggucaagagccuccagucccugcugaaggacacccagauccagcucgacgacgccgugcgggccaacgacgaccugaaggagaacaucgccaucguggagcgccggaacaaccugcuccaggcggagcuggaggagcugcgcgccgucguggagcagaccgagcggagccgcaagcucgccgagcaggagcugaucgagaccuccgagcggguccagcugcuccacagccagaacacgucccugaucaaccagaagaagaagauggagagcgaccugacccagcuccaguccgagguggaggaggccgugcaggagugccgcaacgccgaggagaaggcgaagaaggccaucaccgacgccgccaugauggccgaggagcugaagaaggagcaggacaccagcgcgcaccuggagcggaugaagaagaacauggagcagacgaucaaggaccuccagcaccgccuggacgaggccgagcagaucgcccugaagggcgggaagaagcagcuccagaagcuggaggcccggguccgcgagcuggagggcgagcucgaggccgagcagaagcggaacgcggaguccgugaaggggaugcgcaagagcgagcggcgcaucaaggagcugaccuaccagaccgaggaggacaagaagaaccugcuccggcugcaggaccugguggacaagcuccagcugaaggucaaggccuacaagcgccaggccgaggaggccgaggagcaggcgaacaccaaccuguccaaguuccggaaggugcagcacgagcucgacgaggccgaggagcgcgccgacaucgccgagagccaggugaacaagcugcgggccaagucccgcgacaucggcgcgaagcagaagaugcacgacgaggaguga

SEQ ID NO: 33276 - RNA, 5952 nt, Artificial Sequence
  derived and/or modified sequence opt1 from MYH7B__Homo_sapiens__NP_065935
augagcggcaacaagcgcgggucccgggccagcugcccccaccgcggcgccgagugccugcuccccugggcggcccugaaccugcagggguuccagcuccugcugcuccaccccuccgccacggccaugauggacgugagcgagcugggcgaguccgcccgguaccugcgccagggguaccaggagaugaccaaggugcacacgauccccugggacggcaagaagcgggugugggugcccgacgagcaggacgcguacguggaggccgaggucaagagcgaggccaccggcgggcgcgugaccguggagaccaaggaccagaaggugcucauggugcgggaggccgagcugcagccgaugaacccgccccgcuucgaccugcucgaggacauggcgaugaugacgcaccugaacgaggccuccgugcugcacaaccuccggcagcgcuacgcccgguggaugaucuacaccuacagcggccuguucugcgugaccaucaaccccuacaaguggcugcccguguacaccgccuccgucguggccgcguacaaggggaagcgccggagcgacagcccgccccacaucuacgccguggccgacaacgccuacaacgacaugcuccgcaaccgggacaaccagagcaugcugaucacgggcgaguccggggccggcaagaccgucaacaccaagcgcgugauccaguacuucgcgaucguggccgcccugggcgacgggcccggcaagaaggcccaguuccucgccaccaagaccgggggcacccuggaggaccagaucaucgaggcgaacccggccauggaggccuucggcaacgccaagacccugcggaacgacaacagcucccgcuucgggaaguucauccggauccacuucggccccagcgggaagcucgccuccgcggacaucgacagcuaccugcuggagaagucccgcgucaucuuccagcuccccggcgagcggagcuaccacguguacuaccagauccugagcgggcgcaagcccgagcugcaggacaugcuccugcuguccaugaacccguacgacuaccacuucugcagccagggcgugaucaccgucgacaacaugaacgacggcgaggagcucaucgccacggaccacgccauggacauccugggguucuccguggacgagaagugcgccugcuacaagaucgugggcgcgcugcuccacuucgggaacaugaaguucaagcagaagcagcgcgaggagcaggccgaggccgacggcaccgagagcgccgacaaggccgcguaccugaugggggucuccagcggcgaccugcucaagggccugcugcacccccgggugcgcgucgggaacgaguacgugaccaagggccaguccguggagcaggucguguucgccgugggggcccucgccaaggccaccuacgaccggcuguuccgcuggcuggucagccggaucaaccagacgcucgacaccaagcugccccgccaguucuucaucggcgugcuggacaucgcgggguucgagaucuucgaguucaacuccuucgagcagcucugcaucaacuucaccaacgagaagcugcagcaguucuucaaccagcacauguucgugcuggagcaggaggaguacaagcgggagggcaucgacugggucuucaucgacuucggccuggaccuccagcccugcaucgaccugaucgagaagccgcuggggauccucagcauccuggaggaggagugcauguuccccaaggccuccgacgccagcuuccgcgccaagcuguacgacaaccacgccggcaagucccccaacuuccagcagccccggccggacaagaagcgcaaguaccaggcgcacuucgagguggugcacuacgccggggucgugcccuacagcaucgugggcuggcucgagaagaacaaggacccccugaacgagaccgucgugcccaucuuccagaagucccagaaccggcugcucgccacgcuguacgagaacuacgccggcagcugcuccaccgagccgcccaagagcggggugaaggagaagcgcaagaaggcggccuccuuccagaccgucagccagcugcacaaggagaaccucaacaagcugaugaccaaccugcgggccacgcagccccacuucgugcgcugcaucgugccgaacgagaacaagacccccggcgucauggacgccuuccucgugcugcaccagcugcggugcaacggggugcucgagggcauccgcaucugccggcagggguuccccaaccgccugcuguacaccgacuuccggcagcgcuaccgcauccucaaccccagcgccaucccggacgacaccuucauggacucccggaaggcgacggagaagcugcugggcagccucgaccuggaccacacccaguaccaguucggccacaccaaggucuucuucaaggccgggcugcucggcgugcuggaggagcugcgcgaccagcggcucgccaaggugcugacccugcuccaggcccgcucccgggggcgccugaugcggcuggaguaccagcgccuccugggcgggcgggacgcccuguucacgauccaguggaacauccgcgcguucaacgccgucaagaacuggagcuggaugaagcuguucuucaagaugaagccccugcugcgguccgcccaggccgaggaggagcucgccgcgcugcgcgccgagcugcggggccuccgcggcgcccuggccgcggccgaggccaagcggcaggagcuggaggagacccacgugagcaucacccaggagaagaacgaccucgcccugcagcugcaggccgagcaggacaaccucgcggacgccgaggagcgcugccaccuccugaucaaguccaaggugcagcucgaggggaaggucaaggagcugagcgagcggcuggaggacgaggaggaggugaacgccgaccucgccgcccgccggcgcaagcuggaggacgagugcaccgagcugaagaaggacaucgacgaccucgagcugacccuggcgaaggccgagaaggagaagcaggccacggagaacaaggugaagaaccucaccgaggagauggccgcccuggacgaguccgucgcgcggcugaccaaggagaagaaggcccuccaggaggcccaccagcaggcccugggcgaccugcaggccgaggaggaccgcgugagcgcgcucaccaaggccaagcugcgccuggagcagcaggucgaggaccucgagugcucccuggagcaggagaagaagcugcggauggacacggagcgcgccaagcggaagcucgagggggaccugaagcugacccaggagagcgucgccgacgcggcccaggacaagcagcagcucgaggagaagcugaagaagaaggacuccgagcugagccagcucucccugcgcguggaggacgagcagcugcucggcgcccagaugcagaagaagaucaaggagcugcaggcccgggccgaggagcuggaggaggagcucgaggcggagcgcgccgcccgggcccgcguggagaagcagcgggccgaggcggcccgcgagcuggaggagcugagcgagcggcucgaggaggccgggggcgccuccgccggccagcgcgaggggugccggaagcgcgaggcggagcugggccggcugcgccgggagcucgaggaggccgcccugcgccacgaggccaccgucgcggcccugcggcgcaagcaggccgagggggccgccgagcugggcgagcaggucgacagccuccagcgcgugcggcagaagcuggagaaggagaaguccgagcugcgcauggaggucgacgaccucgcggccaacguggagacccugacgcgggccaaggccuccgccgagaagcugugccgcaccuacgaggaccagcucagcgaggcgaagaucaagguggaggagcugcagcggcagcuggccgacgccuccacccagcgcgggcggcuccagaccgagagcggcgagcugucccgccugcucgaggagaaggagugccugaucagccagcugucccggggcaaggcccucgccgcgcagagccuggaggagcugcgccggcagcucgaggaggaguccaaggccaagagcgcccuggcccacgcgguccaggcccugcgccacgacugcgaccuccugcgggagcagcacgaggaggaggccgaggcccaggccgagcugcagcgccuccuguccaaggcgaacgccgagguggcccaguggcggagcaaguacgaggccgacgccauccagcgcacggaggagcuggaggaggcgaagaagaagcucgcccugcggcugcaggaggccgaggaggggguggaggccgccaacgcgaagugcuccagccucgagaaggccaagcugcgccugcagaccgaguccgaggacgucacccucgagcuggagcgggccaccagcgccgccgcggcccuggacaagaagcagcgccaccucgagcgggcccuggaggagcgccgccggcaggaggaggagaugcagcgcgagcuggaggccgcgcagcgggagucccgcggccucgggacggagcuguuccggcugcgccacggccacgaggaggcccucgaggcccuggagacccugaagcgggagaacaagaaccuccaggaggagaucagcgaccugaccgaccaggugucccugagcggcaagagcauccaggagcucgagaagaccaagaaggcccuggagggggagaaguccgagauccaggccgcgcuggaggaggccgagggcgcccucgagcuggaggagacgaagacccugcgcauccagcucgagcugagccaggugaaggccgaggucgaccggaagcuggccgagaaggacgaggagugcgcgaaccuccgccggaaccaccagcgcgccguggagucccugcaggccagccuggacgccgagacccgggcccgcaacgaggcgcuccggcugaagaagaagauggagggggaccugaacgaccucgagcugcagcugggccacgccacccgccaggccacggaggcccaggcggccacccggcucaugcaggcccagcugaaggaggagcaggccgggcgcgacgaggagcagcggcuggccgcggagcuccacgagcaggcccaggcccuggagcgccgcgccucccugcucgccgcggagcuggaggagcugcgggccgcccucgagcagggcgagcgcagccggcgccuggccgagcaggagcugcucgaggccaccgagcggcugaaccugcuccacucccagaacaccggccugcugaaccagaagaagaagcucgaggcggaccuggcccagcugagcggggaggucgaggaggccgcccaggagcgccgggaggcggaggagaaggccaagaaggccaucacggacgccgccaugauggcggaggagcucaagaaggagcaggacaccuccgcccaccuggagcgcaugaagaagacccuggagcagaccgugcgggagcuccaggcccgccuggaggaggccgagcaggccgcgcugcggggcgggaagaagcagguccagaagcucgaggccaagguccgcgagcuggaggccgagcuggacgccgagcagaagaagcacgccgaggcgcucaagggcgugcggaagcacgagcgccgggugaaggagcuggccuaccaggccgaggaggaccgcaagaaccuggcccggaugcaggaccucgucgacaagcugcagagcaaggugaaguccuacaagcgccaguucgaggaggccgagcagcaggcgaacacgaaccuggccaaguaccggaaggcccagcacgagcuggacgacgccgaggagcgcgcggacauggccgagacccaggccaacaagcuccgggcccgcacccgcgacgcccuggggcccaagcacaaggaguga

SEQ ID NO: 33277 - RNA, 5808 nt, Artificial Sequence
  derived and/or modified sequence opt1 from MYH7__Homo_sapiens__NP_000248
augggcgacagcgagauggccguguucggggccgcggcccccuaccugcgcaagagcgagaaggagcggcucgaggcccagacgcgcccguucgaccugaagaaggacguguucgugcccgacgacaagcaggaguucgugaaggccaagaucgugagccgggagggcgggaaggugaccgccgagacggaguacggcaagaccgugaccgucaaggaggaccaggugaugcagcagaacccgcccaaguucgacaagaucgaggacauggcgaugcugaccuuccuccacgagcccgccgugcuguacaaccugaaggaccgcuacgggagcuggaugaucuacacguacagcggccucuucugcgucaccgugaaccccuacaaguggcugcccguguacacccccgaggucguggccgccuaccggggcaagaagcgcuccgaggcgccgccccacaucuucagcaucuccgacaacgccuaccaguacaugcugaccgaccgggagaaccagagcauccucaucacgggggaguccggcgccgggaagaccgugaacaccaagcgcgucauccaguacuucgccgugaucgccgcgaucggcgaccggagcaagaaggaccagucccccgggaagggcacccuggaggaccagaucauccaggccaaccccgcccuggaggccuucggcaacgccaagacggugcgcaacgacaacagcucccgguucgggaaguucauccgcauccacuucggcgcgaccgggaagcucgccagcgccgacaucgagaccuaccugcuggagaagucccgggucaucuuccagcucaaggccgagcgcgacuaccacaucuucuaccagauccugagcaacaagaagccggagcugcucgacaugcugcugaucaccaacaaccccuacgacuacgccuucaucucccagggcgagacgaccguggcgagcaucgacgacgccgaggagcucauggccaccgacaacgccuucgacgugcugggcuucaccuccgaggagaagaacagcauguacaagcugacgggggccaucaugcacuucggcaacaugaaguucaagcucaagcagcgggaggagcaggcggagcccgacgggaccgaggaggccgacaagagcgccuaccugaugggccugaacuccgccgaccuccugaaggggcugugccacccccgcgucaaggugggcaacgaguacgugaccaagggccagaacguccagcaggucaucuacgcgaccggggcccucgccaaggccgucuacgagcggauguucaacuggauggugacgcgcaucaacgccacccuggagaccaagcagccgcggcaguacuucaucggcgugcuggacaucgcgggguucgagaucuucgacuucaacagcuucgagcagcucugcaucaacuucaccaacgagaagcugcagcaguucuucaaccaccacauguucguccuggagcaggaggaguacaagaaggagggcaucgaguggacguucaucgacuucgggauggaccuccaggccugcaucgaccugaucgagaagcccaugggcaucauguccauccuggaggaggagugcauguuccccaaggccaccgacaugaccuucaaggccaagcuguucgacaaccaccugggcaagagcgccaacuuccagaagccccgcaacaucaaggggaagccggaggcgcacuucucccugauccacuacgccggcaucguggacuacaacaucaucggguggcuccagaagaacaaggacccccugaacgagaccguggucggccuguaccagaaguccucccucaagcugcugagcacccucuucgccaacuacgccggggccgacgcgcccaucgagaagggcaagggcaaggccaagaagggguccagcuuccagaccguguccgcccugcaccgggagaaccugaacaagcugaugaccaaccuccgcagcacccacccccacuucgugcgcugcaucaucccgaacgagacgaagucccccggcgucauggacaacccccuggugaugcaccagcugcggugcaacggggugcucgagggcauccgcaucugccggaagggcuuccccaaccgcauccuguacggggacuuccggcagcgcuaccggauccugaacccggccgcgauccccgagggccaguucaucgacagccgcaagggggccgagaagcuccuguccagccuggacaucgaccacaaccaguacaaguucggccacaccaaggucuucuucaaggccgggcuccugggccugcucgaggagaugcgggacgagcgccugucccggaucaucacccgcauccaggcccagagccggggcgugcuggcccgcauggaguacaagaagcuccuggagcggcgcgacucccugcucgugauccaguggaacauccgggcguucaugggggucaagaacuggcccuggaugaagcuguacuucaagaucaagccgcugcucaagagcgccgagcgcgagaaggagauggccagcaugaaggaggaguucacccggcugaaggaggcccuggagaaguccgaggcccgccgcaaggagcucgaggagaagauggugagccugcugcaggagaagaacgaccuccagcuccaggugcaggcggagcaggacaaccuggccgacgccgaggagcggugcgaccagcucaucaagaacaagauccagcuggaggccaaggucaaggagaugaacgagcgccuggaggacgaggaggagaugaacgccgagcucaccgcgaagaagcggaagcuggaggacgagugcuccgagcugaagcgcgacaucgacgaccucgagcugacgcuggccaagguggagaaggagaagcacgccaccgagaacaaggugaagaaccucaccgaggagauggccggccuggacgagaucaucgcgaagcugaccaaggagaagaaggcccuccaggaggcccaccagcaggcccuggacgaccugcaggccgaggaggacaaggucaacacgcucaccaaggcgaaggugaagcuggagcagcaggucgacgaccuggaggggagccucgagcaggagaagaagguccggauggaccuggagcgcgccaagcggaagcuggagggcgaccucaagcugacccaggaguccaucauggaccuggagaacgacaagcagcagcucgacgagcgccugaagaagaaggacuucgagcugaacgcccucaacgcccggaucgaggacgagcaggcccuggggagccagcugcagaagaagcucaaggagcugcaggcgcgcaucgaggagcuggaggaggagcucgaggccgagcggaccgcccgcgccaagguggagaagcugcgguccgaccugagccgcgagcucgaggagaucuccgagcggcuggaggaggccggcggcgcgacgagcgugcagaucgagaugaacaagaagcgcgaggccgaguuccagaagaugcggcgcgaccuggaggaggccacccuccagcacgaggccaccgccgcggcccugcggaagaagcacgccgacuccgucgccgagcugggggagcagaucgacaaccuccagcgcgugaagcagaagcuggagaaggagaaguccgaguucaagcuggagcucgacgacgugaccuccaacauggagcagaucaucaaggcgaaggccaaccuggagaagaugugccggacgcuggaggaccagaugaacgagcaccgcagcaaggccgaggagacccagcgcuccgucaacgaccucaccagccagcgggccaagcugcagaccgagaacggcgagcugucccgccagcucgacgagaaggaggcccugaucagccagcugacgcgggggaagcucaccuacacccagcagcuggaggaccugaagcgccagcucgaggaggaggugaaggcgaagaacgcccuggcccacgcccugcagagcgcccggcacgacugcgaccuccugcgcgagcaguacgaggaggagaccgaggcgaaggccgagcugcagcgggugcucuccaaggccaacagcgaggucgcccaguggcgcacgaaguacgagaccgacgccauccagcggaccgaggagcuggaggaggcgaagaagaagcuggcccagcgccugcaggaggccgaggaggccguggaggcggugaacgccaagugcuccagccucgagaagaccaagcaccggcugcagaacgagaucgaggaccugauggucgacguggagcgcuccaacgccgccgccgcggcccucgacaagaagcagcggaacuucgacaagauccuggccgaguggaagcagaaguacgaggagagccaguccgagcuggagagcucccagaaggaggcccgcagccucuccacggagcuguucaagcugaagaacgccuacgaggagagccucgagcaccuggagaccuucaagcgggagaacaagaaccugcaggaggagaucuccgaccucaccgagcagcugggcagcuccgggaagaccauccacgagcuggagaaggugcgcaagcagcucgaggcggagaagauggagcugcagagcgcccuggaggaggccgaggccucccucgagcacgaggagggcaagauccugcgggcccagcuggaguucaaccagaucaaggcggagaucgagcgcaagcucgccgagaaggacgaggagauggagcaggccaagcggaaccaccuccgggucguggacagccugcagacgucccuggacgccgagacccgcagccggaacgaggcgcugcgcgugaagaagaagauggagggcgaccugaacgagauggagauccagcucagccacgccaaccggauggccgccgaggcccagaagcaggucaagucccugcagagccugcucaaggacacccagauccagcuggacgacgcggugcgcgccaacgacgaccugaaggagaacaucgccaucguggagcggcgcaacaaccuccugcaggccgagcuggaggagcuccgggccgucguggagcagaccgagcgcucccggaagcuggcggagcaggagcugaucgagacgagcgagcgcgugcagcuccugcacucccagaacaccagccugaucaaccagaagaagaagauggacgccgaccucucccagcugcagaccgaggucgaggaggccgugcaggagugccggaacgccgaggagaaggccaagaaggcgaucaccgacgccgccaugauggccgaggagcugaagaaggagcaggacacgagcgcccaccucgagcgcaugaagaagaacauggagcagaccaucaaggaccugcagcaccggcuggacgaggcggagcagaucgcccucaagggcgggaagaagcagcugcagaagcuggaggcccgcgugcgggagcucgagaacgagcuggaggccgagcagaagcgcaacgcggaguccgucaaggggaugcgcaagagcgagcgccggaucaaggagcugaccuaccagaccgaggaggaccgcaagaaccuccugcggcugcaggaccucguggacaagcugcagcugaaggucaaggccuacaagcgccaggccgaggaggccgaggagcaggccaacaccaaccucuccaaguuccgcaaggugcagcacgagcuggacgaggcggaggagcgggccgacaucgccgagagccaggugaacaagcugcgcgccaagucccgggacaucggcacgaaggggcucaacgaggaguga

SEQ ID NO: 33278 - RNA, 5814 nt, Artificial Sequence
  derived and/or modified sequence opt1 from MYH8__Homo_sapiens__NP_002463
augagcgccagcagcgacgccgagauggcgguguucggcgaggccgcccccuaccugcgcaagagcgagaaggagcggaucgaggcccagaacaagccguucgacgccaagaccagcguguucguggcggagcccaaggaguccuacgucaagagcaccauccaguccaaggagggcgggaaggugacggugaagaccgagggcggggccacccugaccgugcgcgaggaccagguguuccccaugaacccgcccaaguacgacaagaucgaggacauggccaugaugacgcaccuccacgagcccggggugcuguacaaccugaaggagcgguacgccgcguggaugaucuacaccuacagcggccuguucugcgugaccgugaaccccuacaaguggcugcccguguacaagccggaggugguggccgccuaccgcggcaagaagcggcaggaggccccgccccacaucuucuccaucagcgacaacgccuaccaguucaugcucaccgaccgcgagaaccaguccauccugaucacgggggagagcggcgcggggaagaccgugaacaccaagcgggugauccaguacuucgccaccaucgccgucacgggcgagaagaagaaggacgaguccgggaagaugcagggcacccuggaggaccagaucaucagcgccaacccccuccuggaggccuucggcaacgcgaagaccgugcgcaacgacaacuccagccgguucgggaaguucauccgcauccacuucggcaccacggggaagcuggccuccgccgacaucgagaccuaccuccuggagaagucccgggugaccuuccagcugaaggccgagcgcuccuaccacaucuucuaccagaucaccagcaacaagaagcccgaccucaucgagaugcugcugaucacgaccaaccccuacgacuacgccuucgugagccagggcgagaucaccgugcccuccaucgacgaccaggaggagcucauggcgaccgacagcgccaucgacauccugggcuucacgcccgaggagaagguguccaucuacaagcugaccggggccgucaugcacuacggcaacaugaaguucaagcagaagcagcgggaggagcaggccgagccggacgggaccgagguggccgacaaggcggccuaccuccagagccugaacuccgccgaccugcucaaggcccugugcuacccccgcgugaaggucggcaacgaguacgugaccaaggggcagacgguccagcaggucuacaacgcggugggcgcccuggccaaggccgucuacgagaagauguuccucuggauggugacccggaucaaccagcagcuggacaccaagcagccccgccaguacuucaucggcgugcuggacaucgccggguucgagaucuucgacuucaacagccucgagcagcugugcaucaacuucaccaacgagaagcugcagcaguucuucaaccaccacauguucguccucgagcaggaggaguacaagaaggagggcaucgaguggacguucaucgacuucgggauggaccuggcggccugcaucgagcugaucgagaagccccucggcaucuucuccauccuggaggaggagugcauguucccgaaggccaccgacaccagcuucaagaacaagcuguacgaccagcaccucgggaaguccgccaacuuccagaagcccaagguggugaagggcaaggccgaggcgcacuucagccugauccacuacgccggcaccgucgacuacaacaucacgggguggcuggacaagaacaaggacccccucaacgacaccguggugggccuguaccagaaguccgccaugaagacccuggccagccucuucuccaccuacgccagcgcggaggccgacuccagcgccaagaagggggccaagaagaagggcuccagcuuccagaccgucuccgcgcuguuccgggagaaccugaacaagcucaugacgaaccugcgcagcacccacccccacuucgugcggugcaucaucccgaacgagaccaagacccccggggccauggagcacgagcuggugcugcaccagcuccgcugcaacggcguccuggagggcauccggaucugccgcaagggguuccccagccgcauccuguacggcgacuucaagcagcgguacaaggugcucaacgccuccgccauccccgaggggcaguucaucgacagcaagaaggccuccgagaagcugcuggcgagcaucgacaucgaccacacgcaguacaaguucggccacaccaagguguucuucaaggccggccuccuggggcugcucgaggagaugcgcgacgagaagcuggcccagaucaucacccggacccaggccgucugccgcggcuuccugaugcggguggaguaccagaagaugcuccagcgccgggaggcccuguucugcauccaguacaacgugcgcgcguucaugaacgucaagcacuggccguggaugaagcuguucuucaagaucaagccccuccugaaguccgccgagacggagaaggagauggccaccaugaaggaggaguuccagaagaccaaggacgagcuggccaagagcgaggccaagcggaaggagcucgaggagaagauggugacccugcugaaggagaagaacgaccuccagcuccaggugcaguccgaggcggacagccuggccgacgccgaggagcgcugcgagcagcucaucaagaacaagauccagcuggaggccaagaucaaggaggucacggagcgggcggaggaggaggaggagaucaacgccgagcugaccgccaagaagcgcaagcucgaggacgagugcuccgagcugaagaaggacaucgacgaccuggagcucacccuggccaagguggagaaggagaagcacgccaccgagaacaaggugaagaaccugacggaggagauggcggggcucgacgagaccaucgccaagcugagcaaggagaagaaggcccugcaggagacccaccagcagacccucgacgaccugcaggccgaggaggacaaggucaacauccugacgaaggccaagaccaagcucgagcagcaggucgacgaccuggagggcucccuggagcaggagaagaagcuccggauggaccuggagcgcgcgaagcggaagcuggagggggaccucaagcuggcccaggagagcaccauggacauggagaacgacaagcagcagcuggacgagaagcucgagaagaaggaguucgagaucuccaaccugaucagcaagaucgaggacgagcaggccguggagauccagcugcagaagaagaucaaggagcuccaggcccgcaucgaggagcugggcgaggagaucgaggccgagcgggcgucccgcgccaaggccgagaagcagcggagcgaccugucccgcgagcucgaggagaucagcgagcgccuggaggaggccggcggggccaccagcgcgcaggucgagcugaacaagaagcgggaggccgaguuccagaagcuccgccgggaccuggaggaggccacgcugcagcacgaggccaugguggcggcccuccgcaagaagcacgccgacuccauggccgagcugggcgagcagaucgacaaccugcagcgggugaagcagaagcucgagaaggagaaguccgagcugaagauggagaccgacgaccuguccagcaacgccgaggcgaucuccaaggccaaggggaaccucgagaagaugugccgcagccuggaggaccaggucuccgagcugaagaccaaggaggaggagcagcagcggcucaucaacgaccugaccgcccagcgcgcccggcugcagacggaggccggcgaguacagccgccagcucgacgagaaggacgcgcuggugucccagcugagccgguccaagcaggccagcacccagcagaucgaggagcucaagcaccagcuggaggaggagaccaaggccaagaacgcccuggcccacgcgcuccaguccagccgccacgacugcgaccugcugcgggagcaguacgaggaggagcaggaggggaaggccgagcuccagcgcgcccuguccaaggccaacagcgagguggcgcaguggcggaccaaguacgagacggacgccauccagcgcaccgaggagcuggaggaggccaagaagaagcucgcccagcggcugcaggaggccgaggagcacgucgaggcggugaacgccaagugcgccucccuggagaagaccaagcagcgccuccagaacgagguggaggaccugaugcuggacgucgagcggagcaacgccgccugcgcggcccucgacaagaagcagcgcaacuucgacaaggugcuguccgaguggaagcagaaguacgaggagacccaggccgagcuggaggccagccagaaggagagccggucccucagcacggagcuguucaaggugaagaacgucuacgaggagucccuggaccagcuggagacccuccgccgcgagaacaagaaccugcagcaggagaucagcgaccugaccgagcagaucgccgagggcggcaagcagauccacgagcucgagaagaucaagaagcaggucgagcaggagaagugcgagauccaggcggcccuggaggaggccgaggccucccuggagcacgaggaggggaagauccuccggauccagcuggagcugaaccaggucaagagcgaggucgaccgcaagaucgcggagaaggacgaggagaucgaccagcucaagcggaaccacacccgcgugguggagaccaugcaguccacgcuggacgccgagauccggagccgcaacgacgcccugcgggucaagaagaagauggagggcgaccucaacgagauggagauccagcugaaccacgccaaccgccuggccgcggagucccuccggaacuaccgcaacacccaggggauccugaaggagacccagcugcaccucgacgacgcccugcggggccaggaggaccugaaggagcagcucgccaucguggagcgccgggccaaccugcugcaggccgagaucgaggagcucugggcgacccuggagcagacggagcgcagccggaagaucgccgagcaggagcugcucgacgccuccgagcgcgugcagcugcugcacacccagaacaccagccucaucaacaccaagaagaagcuggagaacgacgucucccagcugcagagcgagguggaggaggucauccaggagucccggaacgccgaggagaaggccaagaaggcgaucacggacgccgccaugauggccgaggagcucaagaaggagcaggacaccagcgcccaccuggagcgcaugaagaagaaccuggagcagaccgugaaggaccuccagcaccggcuggacgaggcggagcagcuggcccucaagggcgggaagaagcagauccagaagcuggaggcccgcgugcgcgagcuggagggcgaggucgagaacgagcagaagcggaacgccgaggcggugaaggggcuccgcaagcacgagcggcgcgugaaggagcugaccuaccagacggaggaggaccggaagaacguccugcgccuccaggaccugguggacaagcugcaggccaaggugaaguccuacaagcggcaggccgaggaggccgaggagcagagcaacgccaaccucuccaaguuccgcaagcugcagcacgagcuggaggaggcggaggagcgggccgacaucgccgagagccaggucaacaagcuccgcgucaagagccgggaggugcacaccaagaucuccgccgaguga

SEQ ID NO: 33279 - RNA, 5883 nt, Artificial Sequence
  derived and/or modified sequence opt1 from MYH9__Homo_sapiens__NP_002464
auggcccagcaggccgcggacaaguaccuguacguggacaagaacuucaucaacaacccccucgcccaggccgacugggccgccaagaagcuggucugggugccgagcgacaaguccggcuucgagcccgcgagccugaaggaggaggugggggaggaggccaucgucgagcucguggagaacggcaagaaggugaaggucaacaaggacgacauccagaagaugaacccccccaaguucuccaagguggaggacauggccgagcugaccugccugaacgaggccagcgugcuccacaaccugaaggagcgcuacuacuccgggcugaucuacaccuacagcggccucuucugcgucgugaucaacccguacaagaaccugcccaucuacuccgaggagaucguggagauguacaaggggaagaagcggcacgagaugcccccccacaucuacgcgaucacggacaccgccuaccgcagcaugaugcaggaccgggaggaccaguccauccugugcaccggcgagagcggcgccgggaagaccgagaacacgaagaaggucauccaguaccucgccuacguggccuccagccacaaguccaagaaggaccagggcgagcuggagcgccagcugcuccaggcgaacccgauccuggaggccuucgggaacgccaagaccgugaagaacgacaacagcucccgguucggcaaguucauccgcaucaacuucgacgucaacggguacaucgugggcgccaacaucgagaccuaccugcucgagaagagccgggccauccgccaggcgaaggaggagcggaccuuccacaucuucuacuaccugcuguccggcgccggggagcaccucaagacggaccugcugcucgagcccuacaacaaguaccgcuuccugagcaacggccacgugaccauccccgggcagcaggacaaggacauguuccaggagaccauggaggccaugcggaucaugggcauccccgaggaggagcagaugggccugcuccgcgucaucuccggggugcugcagcugggcaacaucguguucaagaaggagcggaacaccgaccaggccagcaugccggacaacacggccgcgcagaaggucagccaccuccuggggaucaacgugaccgacuucacccgcggcauccugaccccccggaucaagguggggcgcgacuacguccagaaggcccagacgaaggagcaggccgacuucgccaucgaggcccucgcgaaggccaccuacgagcggauguuccgcuggcuggugcugcggaucaacaaggcccucgacaagaccaagcgccagggcgccuccuucaucggcauccuggacaucgcgggguucgagaucuucgaccugaacagcuucgagcagcucugcaucaacuacaccaacgagaagcugcagcagcuguucaaccacacgauguucauccucgagcaggaggaguaccagcgggagggcaucgaguggaacuucaucgacuucgggcuggaccugcagcccugcaucgaccucaucgagaagcccgccggcccgcccgggauccuggcccugcucgacgaggagugcugguuccccaaggccaccgacaaguccuucgucgagaaggugaugcaggagcagggcacccaccccaaguuccagaagccgaagcagcugaaggacaaggccgacuucugcaucauccacuacgcgggcaagguggacuacaaggccgacgaguggcugaugaagaacauggacccccugaacgacaacaucgccacccuccugcaccagagcuccgacaaguucgucagcgagcuguggaaggacguggaccgcaucaucgggcucgaccagguggccggcauguccgagacggcccugcccggggcguucaagacccgcaagggcauguuccggaccgucgggcagcuguacaaggagcagcucgccaagcugauggccacccugcgcaacacgaaccccaacuucgugcggugcaucaucccgaaccacgagaagaaggccggcaagcucgacccccaccuggugcuggaccagcuccgcugcaacggcguccuggaggggauccggaucugccgccagggcuuccccaaccgggugguguuccaggaguuccgccagcgguacgagauccugacccccaacagcaucccgaagggguucauggacggcaagcaggccugcguccucaugaucaaggcgcuggagcuggacuccaaccucuaccgcaucggccagagcaagguguucuuccgggccggggugcuggcccaccuggaggaggagcgcgaccucaagaucaccgacgucaucaucggcuuccaggccugcugccggggguaccuggcgcgcaaggccuucgccaagcggcagcagcagcugaccgccaugaaggugcuccagcgcaacugcgccgcguaccugaagcugcggaacuggcagugguggcgccucuucacgaaggugaagccccugcugcaggucucccggcaggaggaggagaugauggccaaggaggaggagcucgugaaggugcgcgagaagcagcuggccgccgagaaccgccugaccgagauggagacccuccagagccagcugauggccgagaagcugcagcuccaggagcagcugcaggcggagaccgagcugugcgccgaggccgaggagcuccgggcccgccugacggccaagaagcaggagcuggaggagaucugccacgaccucgaggcgcgggucgaggaggaggaggagcgcugccagcaccugcaggccgagaagaagaagaugcagcagaacauccaggagcuggaggagcagcucgaggaggaggaguccgcccggcagaagcugcagcuggagaaggugaccaccgaggccaagcucaagaagcuggaggaggagcagaucauccuggaggaccagaacugcaagcucgcgaaggagaagaagcugcuggaggaccgcaucgccgaguucaccaccaaccucacggaggaggaggagaagagcaagucccuggccaagcugaagaacaagcacgaggccaugaucaccgaccucgaggagcggcugcgccgggaggagaagcagcgccaggagcuggagaagacccggcgcaagcucgagggcgacagcaccgaccuguccgaccagaucgccgagcugcaggcgcagaucgccgagcucaagaugcagcuggccaagaaggaggaggagcugcaggccgcccucgcgcggguggaggaggaggccgcccagaagaacauggcccugaagaagauccgcgagcuggagagccagaucuccgagcuccaggaggaccuggagagcgagcgggccagccgcaacaaggcggagaagcagaagcgggaccugggggaggagcucgaggcccugaagacggagcuggaggacacccucgacuccaccgccgcccagcaggagcugcgcagcaagcgggagcaggaggucaacauccugaagaagacccucgaggaggaggccaagacgcacgaggcgcagauccaggagaugcgccagaagcacucccaggccguggaggagcuggccgagcagcuggagcagaccaagcgggugaaggccaaccucgagaaggcgaagcagacccuggagaacgagcgcggcgagcuggccaacgaggucaaggugcuccugcagggcaagggggacagcgagcacaagcgcaagaagguggaggcccagcugcaggagcuccaggucaaguucaacgagggcgagcgggugcgcaccgagcuggccgacaaggugacgaagcugcaggucgagcucgacaacgugaccgggcugcugucccagagcgacuccaagagcuccaagcucaccaaggacuucagcgcccuggagucccagcugcaggacacccaggagcugcuccaggaggagaaccggcagaagcugagccuguccacgaagcucaagcagguggaggacgagaagaacagcuuccgcgagcagcuggaggaggaggaggaggcgaagcacaaccuggagaagcagaucgccacccuccacgcccaggucgccgacaugaagaagaagauggaggacuccgugggcugccuggagaccgccgaggaggugaagcggaagcugcagaaggaccucgaggggcugagccagcgccacgaggagaaggucgcggccuacgacaagcuggagaagaccaagacgcggcuccagcaggagcuggacgaccugcucguggaccuggaccaccagcgccaguccgccugcaaccuggagaagaagcagaagaaguucgaccagcuccuggccgaggagaagaccaucagcgccaaguacgcggaggagcgggaccgcgccgaggccgaggcccgggagaaggagaccaaggcgcugagccucgcccgcgcccuggaggaggccauggagcagaaggccgagcuggagcggcucaacaagcaguuccgcaccgagauggaggaccugauguccagcaaggacgacgugggcaaguccguccacgagcuggagaagagcaagcgggcgcucgagcagcagguggaggagaugaagacgcagcuggaggagcuggaggacgagcuccaggccaccgaggacgccaagcugcgccuggaggugaaccuccaggccaugaaggcccaguucgagcgggaccugcagggccgcgacgagcaguccgaggagaagaagaagcagcugguccggcaggugcgcgagauggaggcggagcucgaggacgagcgcaagcagcggagcauggccguggccgcccgcaagaagcuggagauggaccugaaggaccucgaggcccacaucgacuccgcgaacaagaaccgggacgaggccaucaagcagcugcgcaagcugcaggcccagaugaaggacugcaugcgggagcucgacgacacccgcgccagccgggaggagauccuggcgcaggccaaggagaacgagaagaagcugaaguccauggaggccgagaugauccagcuccaggaggagcuggccgccgcggagcgcgccaagcggcaggcccagcaggagcgcgacgagcuggccgacgagaucgccaacagcuccgggaagggcgcgcucgcccuggaggagaagcggcgccuggaggcccggaucgcccagcucgaggaggagcuggaggaggagcaggggaacaccgagcugaucaacgaccgccucaagaaggccaaccugcagaucgaccagaucaacacggaccugaaccucgagcggagccacgcgcagaagaacgagaacgcccgccagcagcuggagcggcagaacaaggagcugaaggucaagcuccaggagauggagggcaccgugaaguccaaguacaaggccagcaucaccgcccuggaggccaagaucgcgcagcuggaggagcagcucgacaacgagaccaaggagcgccaggccgccugcaagcaggugcggcgcacggagaagaagcugaaggacguccugcuccagguggacgacgagcggcgcaacgccgagcaguacaaggaccaggcggacaaggccuccacccgccugaagcagcugaagcggcagcucgaggaggccgaggaggaggcccagcgcgccaacgcgagccggcgcaagcugcagcgggagcuggaggacgccaccgagaccgccgacgccaugaaccgcgaggucuccagccucaagaacaagcugcggcgcggggaccugcccuucguggugccgcggcgcauggcccggaagggcgcgggcgacggguccgacgaggaggucgacggcaaggccgacggggccgaggccaagcccgccgaguga

SEQ ID NO: 33280 - RNA, 516 nt, Artificial Sequence
  derived and/or modified sequence opt1 from MYL12A__Homo_sapiens__NP_001289977
augagcuccaagcgcaccaagaccaagacgaagaagcggccccagcgcgccaccagcaacguguucgccauguucgaccagucccagauccaggaguucaaggaggcguucaacaugaucgaccagaaccgggacggcuucaucgacaaggaggaccugcacgacaugcucgccagccuggggaagaacccgaccgacgaguaccuggacgccaugaugaacgaggcccccggccccaucaacuucaccauguuccucacgauguucggggagaagcugaacggcaccgaccccgaggacgucauccgcaacgccuucgcgugcuucgacgaggaggccaccgggaccauccaggaggacuaccugcgggagcuccugacgaccaugggcgaccgcuucaccgacgaggagguggacgagcuguaccgggaggccccgaucgacaagaagggcaacuucaacuacaucgaguucacccgcauccucaagcacggggccaaggacaaggacgacuga

SEQ ID NO: 33281 - RNA, 519 nt, Artificial Sequence
  derived and/or modified sequence opt1 from MYL12B__Homo_sapiens__NP_001138416
augagcuccaagaaggccaagaccaagaccacgaagaagcgcccccagcgggccaccagcaacguguucgcgauguucgaccagucccagauccaggaguucaaggaggccuucaacaugaucgaccagaaccgcgacggcuucaucgacaaggaggaccugcacgacaugcucgccagccuggggaagaacccgaccgacgccuaccuggacgccaugaugaacgaggcgcccggccccaucaacuucaccauguuccucacgauguucggggagaagcugaacggcaccgaccccgaggacgucauccggaacgccuucgccugcuucgacgaggaggccaccgggaccauccaggaggacuaccugcgcgagcuccugacgaccaugggcgaccgguucaccgacgaggagguggacgagcuguaccgcgaggcgccgaucgacaagaagggcaacuucaacuacaucgaguucacccggauccucaagcacggggccaaggacaaggacgacuga

SEQ ID NO: 33282 - RNA, 585 nt, Artificial Sequence
  derived and/or modified sequence opt1 from MYL1__Homo_sapiens__NP_524144
auggcccccaagaaggacgugaagaagccggucgccgcggccgccgccgcccccgcgcccgcccccgccccggcccccgcgcccgcccccgccaagccgaaggaggagaagaucgaccugagcgccaucaagaucgaguucuccaaggagcagcaggacgaguucaaggaggccuuccuccuguucgaccgcaccggcgacagcaagaucacccugucccaggugggggacgugcuccgggcgcugggcacgaaccccaccaacgccgagguccgcaaggugcuggggaaccccagcaacgaggagcucaacgccaagaagaucgaguucgagcaguuccugcccaugaugcaggccaucuccaacaacaaggaccaggccaccuacgaggacuucguggagggccugcgggucuucgacaaggaggggaacggcaccgugaugggcgcggagcuccgccacgugcuggccacgcugggggagaagaugaaggaggaggaggucgaggcccucauggccggccaggaggacagcaacgggugcaucaacuacgaggccuucgugaagcacaucauguccaucuga

SEQ ID NO: 33283 - RNA, 501 nt, Artificial Sequence
  derived and/or modified sequence opt1 from MYL2__Homo_sapiens__NP_000423
auggcccccaagaaggccaagaagcgcgcgggcggggccaacagcaacguguucuccauguucgagcagacccagauccaggaguucaaggaggccuucaccaucauggaccagaaccgggacggcuucaucgacaagaacgaccugcgcgacacguucgccgcccucgggcgggucaacgugaagaacgaggagaucgacgagaugaucaaggaggcgccgggccccaucaacuucaccguguuccugaccauguucggggagaagcugaagggcgccgaccccgaggagaccauccucaacgccuucaaggucuucgaccccgagggcaagggggugcugaaggccgacuacgugcgcgagaugcugacgacccaggcggagcgguucagcaaggaggaggucgaccagauguucgccgccuucccgcccgacgugaccggcaaccucgacuacaagaaccuggugcacaucaucacccacggggaggagaaggacuga

SEQ ID NO: 33284 - RNA, 588 nt, Artificial Sequence
  derived and/or modified sequence opt1 from MYL3__Homo_sapiens__NP_000249
auggcccccaagaagccggagcccaagaaggacgacgccaaggcggcccccaaggccgcccccgccccggcgcccccgcccgagcccgagcgccccaaggagguggaguucgacgccagcaagaucaagaucgaguucacccccgagcagaucgaggaguucaaggaggccuucaugcuguucgaccggacccccaagugcgagaugaagaucacguacggccagugcggggacguccuccgcgcccugggccagaacccgacccaggcggaggugcugcgggugcucgggaagccccgccaggaggagcugaacaccaagaugauggacuucgagaccuuccugcccaugcuccagcacaucuccaagaacaaggacacgggcaccuacgaggacuucgucgaggggcugcggguguucgacaaggagggcaacggcaccgugaugggggccgagcugcgccacguccucgccacccugggcgagcggcugacggaggacgagguggagaagcucauggccgggcaggaggacagcaacggcugcaucaacuacgaggccuucgugaagcacaucauguccagcuga

SEQ ID NO: 33285 - RNA, 594 nt, Artificial Sequence
  derived and/or modified sequence opt1 from MYL4__Homo_sapiens__NP_001002841
auggcccccaagaagccggagcccaagaaggaggccgcgaagcccgcccccgccccggcccccgcccccgcgcccgccccggcccccgcccccgaggcgcccaaggagccggccuucgaccccaagagcgugaagaucgacuucaccgccgaccagaucgaggaguucaaggaggccuucucccuguucgaccgcacccccacgggcgagaugaagaucaccuacgggcagugcggcgacguccuccgggcccuggggcagaaccccaccaacgcggaggugcugcgcgugcucggcaagccgaagcccgaggagaugaacgucaagaugcuggacuucgagaccuuccugcccauccuccagcacaucagccggaacaaggagcaggggacguacgaggacuucguggagggccugcgcguguucgacaaggaguccaacggcaccgucaugggggccgagcugcggcacgugcucgccacccugggcgagaagaugaccgaggccgagguggagcagcugcucgccgggcaggaggacgcgaacggcugcaucaacuacgaggccuucgucaagcacaucaugagcggguga

SEQ ID NO: 33286 - RNA, 456 nt, Artificial Sequence
  derived and/or modified sequence opt1 from MYL6__Homo_sapiens__NP_066299
augugcgacuucaccgaggaccagaccgccgaguucaaggaggccuuccagcuguucgaccgcacgggcgacgggaagauccucuacagccagugcggcgacgugaugcgggcgcuggggcagaaccccaccaacgccgagguccugaaggugcucggcaacccgaaguccgacgagaugaacgugaagguccuggacuucgagcacuuccugcccaugcuccagaccguggccaagaacaaggaccaggggaccuacgaggacuacguggagggccugcgcgucuucgacaaggagggcaacgggacggugaugggcgccgagauccggcacgugcuggucacccucggggagaagaugaccgaggaggagguggagaugcugguggccggccacgaggacagcaacgggugcaucaacuacgaggcguucguccgccacauccuguccggcuga

SEQ ID NO: 33287 - RNA, 528 nt, Artificial Sequence
  derived and/or modified sequence opt1 from MYL7__Homo_sapiens__NP_067046
auggccagccgcaaggccggcacccgggggaagguggcggccaccaagcaggcccagcgcggcuccagcaacgucuucuccauguucgagcaggcccagauccaggaguucaaggaggccuucagcugcaucgaccagaaccgggacgggaucaucugcaaggcggaccugcgcgagacguacucccagcucggcaaggugagcgugcccgaggaggagcuggacgccaugcugcaggaggggaagggcccgaucaacuucaccgucuuccucacccuguucggcgagaagcugaacgggaccgaccccgaggaggccauccucuccgccuuccggauguucgaccccagcggcaaggggguggugaacaaggacgaguucaagcagcugcugcucacgcaggcggacaaguucucccccgccgaggucgagcagauguucgcccugaccccgauggaccuggccggcaacaucgacuacaagagccucugcuacaucaucacccacggggacgagaaggaggaguga

SEQ ID NO: 33288 - RNA, 519 nt, Artificial Sequence
  derived and/or modified sequence opt1 from MYL9__Homo_sapiens__NP_006088
augagcuccaagcgcgccaaggccaagaccaccaagaagcggccccagcgcgcgacgagcaacguguucgccauguucgaccagucccagauccaggaguucaaggaggccuucaacaugaucgaccagaaccgggacggcuucaucgacaaggaggaccugcacgacaugcucgccagccuggggaagaacccgaccgacgaguaccuggagggcaugauguccgaggcccccgggcccaucaacuucaccauguuccucaccauguucggcgagaagcugaacgggacggaccccgaggacgucauccgcaacgcguucgccugcuucgacgaggaggccagcggcuucauccacgaggaccaccuccgggagcugcugaccaccaugggcgaccgcuucaccgacgaggagguggacgagauguaccgggaggccccgaucgacaagaaggggaacuucaacuacguggaguucacgcgcauccugaagcacggcgcgaaggacaaggacgacuga

SEQ ID NO: 33289 - RNA, 1338 nt, Artificial Sequence
  derived and/or modified sequence opt1 from MYLIP__Homo_sapiens__NP_037394
augcugugcuacgugacccgccccgacgccguccucauggagguggagguggaggccaaggcgaacggcgaggacugccugaaccaggucugccggcgccuggggaucaucgagguggacuacuucggccuccaguucaccgggagcaagggcgagucccuguggcugaaccuccggaaccgcaucagccagcagauggacgggcuggccccguaccggcugaagcuccgcgugaaguucuucgucgagccccaccugauccugcaggagcagacgcggcacaucuucuuccuccacaucaaggaggcccugcuggccggccaccuccugugcucccccgagcaggccguggagcugagcgcgcuccuggcccagaccaaguucggcgacuacaaccagaacaccgccaaguacaacuacgaggagcugugcgccaaggagcucuccagcgcgacccugaacuccaucguggccaagcacaaggagcuggaggggacgagccaggccuccgccgaguaccagguccuccagaucgugagcgccauggagaacuacggcaucgaguggcacuccgugcgcgacagcgaggggcagaagcugcugaucggcgucgggcccgagggcaucuccaucugcaaggacgacuucagcccgaucaaccggaucgcguaccccguggugcagauggccacccaguccggcaagaacgucuaccucaccgugaccaaggagagcgggaacuccaucgugcugcuguucaagaugaucagcacgcgcgccgccuccggccucuaccgggccaucaccgagacccacgcguucuaccgcugcgacaccgucacgagcgccgugaugaugcaguacagccgggaccugaaggggcaccuggccucccucuuccugaacgagaacaucaaccugggcaagaaguacguguucgacaucaagcgcaccagcaaggaggucuacgaccacgcccggcgcgcccucuacaacgcgggcgugguggaccuggucucccggaacaaccagagccccucccacagcccccugaaguccagcgaguccagcaugaacugcuccagcugcgaggggcucuccugccagcagacccgcgugcugcaggagaagcugcggaagcucaaggaggccaugcugugcauggucugcugcgaggaggagaucaacagcaccuucugcccgugcggccacacggugugcugcgaguccugcgccgcccagcugcagagcugccccgugugccgcucccgggucgagcacgugcagcacguguaccuccccacccacaccagccugcugaaccucaccgucaucuga

SEQ ID NO: 33290 - RNA, 1791 nt, Artificial Sequence
  derived and/or modified sequence opt1 from MYLK2__Homo_sapiens__NP_149109
auggccaccgagaacggcgccguggagcuggggauccagaaccccagcaccgacaaggcgccgaagggccccacgggggagcgcccccucgccgccggcaaggaccccgggccgcccgaccccaagaaggcccccgacccgcccacccugaagaaggacgccaaggcgcccgccuccgagaagggcgacggcacccuggcccagcccagcaccuccagccaggggccgaagggcgagggggaccggggcgggggccccgccgagggcuccgcggggccgcccgccgcccucccccagcagacggccacccccgagaccagcgucaagaagcccaaggccgagcagggcgcguccgggagccaggaccccggcaagccgcgcgugggcaagaaggccgccgaggggcaggccgccgcgcggcgcggcucccccgccuuccugcacagccccuccugccccgccaucaucagcuccagcgagaagcugcucgccaagaagccgcccuccgaggccagcgagcugaccuucgagggggugcccaugacgcacucccccaccgacccgcggcccgcgaaggccgaggagggcaagaacauccuggccgagagccagaaggaggucggggagaagacccccggccaggccggccaggccaagaugcagggggacaccucccgcggcaucgaguuccaggcggugccgagcgagaaguccgagguggggcaggcccucugccugacggcccgggaggaggacugcuuccagauccuggacgacugcccgccgccgcccgcccccuucccccaccgcauggucgagcuccggaccggcaacgugagcagcgaguucuccaugaacagcaaggaggcgcucgggggcggcaaguucggggccgugugcacgugcauggagaaggccaccggccugaagcuggccgccaaggucaucaagaagcagacccccaaggacaaggagauggugcugcuggagaucgaggugaugaaccagcucaaccaccgcaaccugauccagcuguacgcggccaucgagacgccccacgagaucguccucuucauggaguacaucgagggcggggagcuguucgagcggaucguggacgaggacuaccaccugaccgagguggacaccauggucuucgugcgccagaucugcgacgggauccucuucaugcacaagaugcgggugcugcaccuggaccucaagcccgagaacauccugugcgucaacaccaccggccaccuggugaagaucaucgacuucggccucgcccgccgguacaaccccaacgagaagcugaaggugaacuucgggacccccgaguuccugucccccgaggucgugaacuacgaccagaucagcgacaagaccgacaugugguccaugggcgugaucacguacaugcuccugagcgggcugucccccuuccucggcgacgacgacaccgagacccugaacaacguccugagcggcaacugguacuucgacgaggagaccuucgaggccguguccgacgaggccaaggacuucgucagcaaccucaucgugaaggaccagcgcgcgcggaugaacgccgcccagugccuggcccaccccuggcugaacaaccucgccgagaaggcgaagcgcugcaaccggcgccugaagucccagauccugcucaagaaguaccugaugaagcggcgcuggaagaagaacuucaucgccgugagcgccgccaaccgcuucaagaagaucuccagcuccggggcgcugauggcccucggcgucuga

SEQ ID NO: 33291 - RNA, 2460 nt, Artificial Sequence
  derived and/or modified sequence opt1 from MYLK3__Homo_sapiens__NP_872299
augagcggcaccuccaaggagagccuggggcacggcgggcuccccggccuggggaagaccugccugacgaccauggacaccaagcucaacaugcugaacgagaagguggaccagcugcuccacuuccaggaggacgucaccgagaagcugcaguccaugugccgcgacaugggccaccuggagcggggccuccaccgccuggaggccagccgggccccggggcccggcggggcggacggcgugccccacaucgacacgcaggccggguggcccgaggugcuggagcucguccgcgccaugcagcaggacgccgcccagcacggcgcgcggcuggaggcccuguuccgcaugguggccgccguggaccgggcgaucgcccucgucggcgccaccuuccagaaguccaagguggccgacuuccugaugcaggggcgcgugccguggcggcgcggcagccccggggacucccccgaggagaacaaggagcgggucgaggaggagggcggcaagcccaagcacgugcugagcaccuccggggugcagagcgacgcccgcgagccgggcgaggagucccagaaggcggacguccucgaggggaccgccgagcggcugccgcccauccgcgccagcggccugggggccgaccccgcccaggcgguggugucccccggccagggcgacgggguccccggccccgcccaggccuuccccgggcaccucccgcugcccacgaagguggaggccaaggcccccgagacccccagcgagaaccugcggaccggccucgagcuggcgccggcccccgggcgcgugaacgucgugucccccagccuggagguggcccccggcgccggccagggggccuccagcucccggccggaccccgagccccucgaggagggcacccgccugacgcccgggccgggcccccagugccccgggccgcccggccugcccgcgcaggcccgggccacccacagcggcggggagacgcccccgcgcaucagcauccacauccaggagauggacacccccggcgagaugcucaugaccgggcggggcucccugggccccacccugaccaccgaggcccccgcggccgcccagccggggaagcagggcccgcccgggacgggccgcugccuccaggcccccgggaccgagcccggcgagcagacccccgagggcgcccgcgagcugagcccccugcaggaguccagcucccccgggggcgucaaggcggaggaggagcagcgggccggggccgagccgggcacccgccccagccucgcccgguccgacgacaacgaccacgaggugggggcccugggccugcagcagggcaagagccccggggcgggcaaccccgagccggagcaggacugcgccgcccgcgcccccgugcgggccgaggcgguccgccggaugccgcccggggccgaggccggcuccgugguccucgacgacagccccgccccgcccgcgcccuucgagcaccgcgugguguccgucaaggagacgagcaucuccgccggguacgaggugugccagcacgaggugcugggcggcgggcgguucggccagguccaccgcugcaccgagaaguccaccgggcugccccucgccgccaagaucaucaaggucaagagcgccaaggaccgggaggacgugaagaacgagaucaacaucaugaaccagcugagccacgugaaccugauccagcucuacgacgcguucgaguccaagcacagcugcacccuggugauggaguacguggacggcggggagcuguucgaccgcaucacggacgagaaguaccaccucaccgagcuggacgucgugcuguucacccggcagaucugcgagggcgugcacuaccugcaccagcacuacauccuccaccuggaccugaagcccgagaacauccucugcgucaaccagaccggccaccagaucaagaucaucgacuucgggcuggcccgccgguacaagccccgcgagaagcugaaggugaacuucggcacgccggaguuccucgcccccgagguggucaacuacgaguucguguccuuccccaccgacauguggagcgugggggucaucaccuacaugcugcugagcggccucucccccuuccugggcgagaccgacgccgagacgaugaacuucaucgugaacugcagcugggacuucgacgccgacaccuucgaggggcuguccgaggaggcgaaggacuucgugagccggcuccuggucaaggagaaguccugccgcaugagcgccacccagugccugaagcacgaguggcucaacaaccugccggccaaggccucccggagcaagacccgccugaagucccagcuccugcugcagaaguacaucgcccagcgcaaguggaagaagcacuucuacguggugaccgcggccaaccggcuccgcaaguuccccacgagccccuga

SEQ ID NO: 33292 - RNA, 5745 nt, Artificial Sequence
  derived and/or modified sequence opt1 from MYLK__Homo_sapiens__NP_444253
augggggacgugaagcugguggccagcagccacaucagcaagaccagccucagcguggaccccagccggguggacagcaugccccugaccgaggcccccgccuucauccugccgccccggaaccucugcaucaaggagggggccaccgccaaguucgaggggcgcgugcggggguaccccgagccccaggugaccuggcaccgcaacggccagcccaucaccuccgggggccgguuccugcuggacugcggcauccgcgggaccuucagccucgugauccacgccguccacgaggaggaccggggcaaguacacgugcgaggccaccaacggguccggcgcgcgccaggugaccguggagcugaccgucgaggggagcuucgccaagcagcugggccagcccgugguguccaagacccucggcgaccgguucagcgcccccgccgucgagacccgccccuccaucuggggcgagugcccgcccaaguucgccaccaagcugggccgggugguggucaaggaggggcagaugggccgcuucagcugcaagaucaccggccggccccagccccaggugaccuggcugaaggggaacgugccccuccagcccuccgcccgcgucagcguguccgagaagaacggcaugcagguccuggagauccacggggucaaccaggacgacgugggcguguacacgugccuggucgugaacgggagcggcaaggccuccaugagcgccgagcucagcauccagggccuggacuccgccaaccggagcuucguccgcgagaccaaggccaccaacuccgacgugcggaaggaggugaccaacgucaucagcaaggaguccaagcuggacagccucgaggccgccgccaaguccaagaacugcagcuccccgcagcgcgggggcuccccgcccugggccgcgaacucccagccccagccgccccgggagagcaagcuggaguccugcaaggacagcccccgcaccgcgccccagacccccgugcugcagaagaccuccagcuccaucacgcuccaggccgcccgggugcagcccgagccccgcgcccccgggcugggcguccugagcccguccggggaggagcgcaagcggcccgcgcccccgcgccccgccaccuuccccacccggcagcccggccucggcagccaggacguggugagcaaggccgccaaccgccggaucccgauggaggggcagcgcgacuccgccuuccccaaguucgagagcaagccccagucccaggaggucaaggagaaccagaccgugaaguuccggugcgaggugagcggcauccccaagccggaggucgcgugguuccuggaggggacgcccgugcgccggcaggagggcuccaucgagguguacgaggacgccgggagccacuaccugugccuccugaaggcccgcacccgggacuccggcaccuacagcugcaccgccuccaacgcgcagggccagcugagcugcuccuggacgcuccaggucgagcgccuggccgugauggagguggcccccagcuucuccagcguccugaaggacugcgccgugaucgaggggcaggacuucgugcuccagugcuccguccggggcacccccgugccgcgcaucaccuggcugcugaacgggcagcccauccaguacgcccgguccacgugcgaggcgggcguggccgagcuccacauccaggacgcccugcccgaggaccacggcaccuacacgugccuggccgagaacgcccucgggcaggucuccugcagcgcgugggugaccgugcacgagaagaaguccucccgcaagagcgaguaccugcugcccgucgccccguccaagcccaccgcccccaucuuccuccagggccugagcgaccugaaggugauggacgggucccaggugacgaugaccguccaggugagcggcaacccgccgcccgaggugaucuggcuccacaacgggaacgagauccaggaguccgaggacuuccacuucgagcagcggggcacccagcacagccugugcauccaggaggucuuccccgaggacaccggcaccuacacgugcgaggccuggaacuccgccggggaggugcgcacccaggcggugcugaccguccaggagccccacgacggcacccagcccugguucaucagcaagccccgguccgugacggccagccucgggcaguccgugcugaucagcugcgccaucgccggcgaccccuucccgaccguccacuggcugcgcgacgggaaggcgcugugcaaggacaccggccacuucgaggugcuccagaacgaggacguguucacccugguccugaagaaggugcagcccuggcacgccggccaguacgagauccuccugaagaaccgcgugggggagugcuccugccaggucagccugaugcuccagaacuccagcgcccgggcccugccccgcggccgggagcccgccuccugcgaggaccugugcgggggcggggugggcgcggacggcgggggcagcgaccgcuacgggagccuccggccgggcuggcccgcccgcgggcagggcuggcuggaggaggaggacggcgaggacgugcgcggggugcugaagcgccggguggagacgcgccagcacaccgaggaggccauccggcagcaggagguggagcagcucgacuuccgcgaccugcugggcaagaaggucuccaccaagacccucagcgaggacgaccugaaggagauccccgccgagcagauggacuuccgggccaaccugcagcgccaggugaagcccaagacggucuccgaggaggagcggaaggugcacagcccgcagcaggucgacuuccgcuccguccucgcgaagaaggggaccagcaagacccccgugcccgagaaggugcccccgcccaagcccgccacccccgacuuccgguccguccugggcggcaagaagaagcugccggccgagaacgggagcuccagcgccgagacgcucaacgccaaggcgguggaguccagcaagccccuguccaacgcccagcccagcggcccccugaagccgguggggaacgccaagcccgccgagacccucaagcccaugggcaacgcgaagcccgccgagacccugaagccgauggggaacgccaagcccgacgagaaccugaaguccgccagcaaggaggagcucaagaaggacgucaagaacgacgugaacugcaagcgcggccacgccggcaccacggacaacgagaagcgguccgagagccaggggaccgcgcccgccuucaagcagaagcugcaggacgugcacgucgccgagggcaagaagcugcuccugcagugccagguguccagcgacccgcccgccaccaucaucuggacccugaacgggaagacgcucaagaccaccaaguucaucauccugagccaggagggcucccugugcagcguguccaucgagaaggcccuccccgaggaccgcgggcuguacaagugcgucgcgaagaacgacgccggccaggccgagugcagcugccaggugaccguggacgacgcccccgccuccgagaacacgaaggcgcccgagaugaagucccggcgccccaaguccagccugccgcccguccucggcaccgaguccgacgccaccgugaagaagaagccggcccccaagacgccgcccaaggccgccaugccgccccagaucauccaguuccccgaggaccagaaggugcgcgcgggggagagcgucgagcuguucggcaaggugacggggacccagcccaucacgugcaccuggaugaaguuccggaagcagauccaggaguccgagcacaugaagguggagaacagcgagaacggcuccaagcugacgauccucgccgcccgccaggagcacugcgggugcuacacccugcuggucgagaacaagcucggcagccggcaggcccaggugaaccugaccguggucgacaagccggacccgcccgcgggcacccccugcgccuccgacauccgcagcuccagccugacccucuccugguacgggagcagcuacgacggcggguccgccgugcagagcuacuccaucgagaucugggacagcgccaacaagacguggaaggagcuggcgaccugccgguccaccagcuucaacgugcaggaccugcucccggaccacgaguacaaguuccgcguccgggcgaucaacguguacggcaccuccgagcccagccaggaguccgagcugacgaccgugggcgagaagcccgaggagcccaaggacgaggucgaggugagcgacgacgacgagaaggagccggagguggacuaccgcaccgucaccaucaacacggagcagaagguguccgacuucuacgacaucgaggagcggcuggggagcggcaaguucggccagguguuccgccucgucgagaagaagacccggaaggugugggccggcaaguucuucaaggccuacuccgccaaggagaaggagaacauccgccaggagaucagcaucaugaacugccugcaccaccccaagcuggugcagugcgucgacgccuucgaggagaaggcgaacaucgugauggugcucgagaucgucuccgggggcgagcuguucgagcggaucaucgacgaggacuucgagcugaccgagcgcgagugcaucaaguacaugcggcagaucagcgagggcguggaguacauccacaagcaggggaucgugcaccucgaccugaagcccgagaacaucaugugcgucaacaagaccggcacgcgcaucaagcugaucgacuucgggcucgcccggcgccuggagaacgccggcucccugaagguccucuucgggacccccgaguucguggccccggaggucaucaacuacgagcccaucggcuacgccaccgacauguggagcaucggcgugaucugcuacauccuggucuccgggcugagccccuucaugggcgacaacgacaacgagacccucgcgaacgugacgagcgccaccugggacuucgacgacgaggccuucgacgagaucuccgacgacgccaaggacuucaucagcaaccugcugaagaaggacaugaagaaccggcucgacugcacccagugccugcagcaccccuggcugaugaaggacaccaagaacauggaggcgaagaagcucuccaaggaccgcaugaagaaguacauggcccgccggaaguggcagaagacggggaacgccgugcgcgccaucggccggcugagcuccauggccaugaucagcgggcuguccggccgcaagagcuccaccggcagcccgaccagcccccucaacgcggagaagcuggagagcgaggaggacgucucccaggccuuccuggaggccguggccgaggagaagccccacgugaagccguacuucagcaagaccauccgggaccucgaggucguggagggguccgccgcgcgcuucgacugcaagaucgagggcuaccccgaccccgagguggucugguucaaggacgaccagagcauccgggagucccgccacuuccagaucgacuacgacgaggacgggaacugcagccugaucaucuccgacgugugcggcgacgacgacgccaaguacacgugcaaggccgugaacagccugggggaggcgaccugcaccgccgagcucaucgucgagaccauggaggagggcgagggcgagggggaggaggaggaggaguga

SEQ ID NO: 33293 - RNA, 510 nt, Artificial Sequence
  derived and/or modified sequence opt1 from MYLPF__Homo_sapiens__NP_037424
auggcccccaagcgcgccaagcggcgcaccguggagggcgggagcuccagcgucuucuccauguucgaccagacccagauccaggaguucaaggaggcguucacggugaucgaccagaaccgggacggcaucaucgacaaggaggaccugcgcgacaccuucgccgccauggggcggcucaacgugaagaacgaggagcuggacgccaugaugaaggaggccagcggcccgaucaacuucaccgucuuccugaccauguucggggagaagcucaagggcgcggaccccgaggacgugaucacgggcgccuucaaggugcuggaccccgaggggaagggcaccaucaagaagaaguuccuggaggagcuccugaccacccagugcgaccgcuucucccaggaggagaucaagaacaugugggccgccuucccgcccgacgucgggggcaacguggacuacaagaacaucugcuacgugaucacgcacggggacgcgaaggaccaggaguga

SEQ ID NO: 33294 - RNA, 1746 nt, Artificial Sequence
  derived and/or modified sequence opt1 from MYNN__Homo_sapiens__NP_001172048
augcaguacagccaccacugcgagcaccuccuggagcgccugaacaagcagcgggaggccggcuuccugugcgacugcaccaucgugaucggggaguuccaguucaaggcccaccgcaacguccucgcguccuucagcgaguacuucggcgccaucuaccgguccaccagcgagaacaacguguuccuggaccagucccaggugaaggccgacggguuccagaagcugcucgaguucaucuacacgggcacccugaaccuggacagcuggaacgucaaggagauccaccaggccgccgacuaccucaagguggaggagguggucaccaagugcaagaucaagauggaggacuucgcguucaucgccaaccccuccagcaccgagaucuccagcaucacggggaacaucgagcugaaccagcagaccugccugcucacccugcgcgacuacaacaaccgggagaaguccgaggugagcaccgaccugauccaggccaacccgaagcagggcgcccucgcgaagaaguccagccagacgaagaagaagaagaaggccuucaacucccccaagaccggccagaacaagaccgugcaguaccccagcgacauccuggagaacgccuccgucgagcuguuccucgacgccaacaagcugcccaccccggugguggagcaggucgcccagaucaacgacaacagcgagcuggagcucacguccgugguggagaacaccuuccccgcgcaggacaucguccacaccgugaccgugaagcgcaagcggggcaagagccagcccaacugcgcccugaaggagcacagcauguccaacaucgccagcgucaagucccccuacgaggccgagaacagcggggaggagcuggaccagcgcuacuccaaggccaagccgaugugcaacacgugcgggaagguguucagcgaggcguccagccuccggcgccacaugcggauccacaagggcgugaagcccuacgucugccaccugugcgggaaggccuucacccagugcaaccagcugaagacccacgugcgcacccacacgggcgagaagcccuacaagugcgagcucugcgacaagggcuucgcccagaagugccagcugguguuccacucccggaugcaccacggggaggagaagcccuacaagugcgacgucugcaaccugcaguucgccaccagcuccaaccucaagauccacgcccgcaagcacagcggcgagaagccguacgugugcgaccggugcgggcagcgcuucgcgcaggccuccacccugaccuaccacguccggcgccacacgggcgagaagcccuacgugugcgacacgugcggcaaggccuucgccgugagcuccagccugaucacccacucccggaagcacaccggggagaagcccuacaucugcggcaucugcggcaagagcuucaucuccagcggggagcucaacaagcacuuccgcagccacaccggggccgacaagacccuggacuccagcgcggaggaccacacccuguccgagcaggacagcauccagaaguccccgcucagcgagaccauggacgucaagcccuccgacaugacgcugccccuggcccucccccugggcaccgaggaccaccacaugcugcuccccgugaccgacacccagagcccgacguccgacacccugcugcggagcaccgugaacggcuacuccgagccccagcucaucuuccugcagcagcuguacuga

SEQ ID NO: 33295 - RNA, 6177 nt, Artificial Sequence
  derived and/or modified sequence opt1 from MYO10__Homo_sapiens__NP_036466
auggacaacuucuucaccgagggcacccgcguguggcugcgggagaacgggcagcacuuccccagcacggucaacuccugcgccgagggcaucgugguguuccgcaccgacuacgggcaggucuucaccuacaagcagagcaccaucacgcaccagaaggugaccgccaugcacccgaccaacgaggagggcguggacgacauggcgucccucaccgagcugcacgggggcagcaucauguacaaccuguuccagcgguacaagcgcaaccagaucuacacguacaucggcuccauccucgccagcgucaaccccuaccagcccaucgccgggcuguacgagcccgccaccauggagcaguacucccggcgccaccugggcgagcucccgccccacaucuucgccaucgcgaacgagugcuaccggugccuguggaagcgccacgacaaccagugcauccugaucagcggggaguccggcgccgggaagaccgagagcaccaagcucauccugaaguuccuguccgugaucagccagcagucccucgagcugagccugaaggagaagacguccugcguggagcgggccauccucgagagcucccccaucauggaggccuucggcaacgcgaagaccgucuacaacaacaacagcucccgcuucggcaaguucgugcagcugaacaucugccagaaggggaacauccagggcgggcggaucguggacuaccugcucgagaagaaccgcgucgugcggcagaaccccggcgagcgcaacuaccacaucuucuacgcccugcuggccggccucgagcacgaggagcgggaggaguucuaccugagcaccccggagaacuaccacuaccugaaccagagcgggugcguggaggacaagaccaucuccgaccaggagagcuuccgcgaggucaucacggccauggacgugaugcaguucuccaaggaggaggugcgggaggucagccgccuccuggccggcauccugcaccucgggaacaucgaguucaucaccgcgggcggggcccagguguccuucaagaccgcccugggccggagcgccgagcugcucggccuggaccccacccagcugacggacgcccucacccagcgcuccauguuccugcggggggaggagauccugaccccccucaacgugcagcaggcggucgacagccgcgacucccuggccauggcccuguacgccugcugcuucgagugggugaucaagaagaucaacagccgcaucaagggcaacgaggacuucaaguccaucgggauccucgacaucuucggcuucgagaacuucgaggugaaccacuucgagcaguucaacaucaacuacgccaacgagaagcugcaggaguacuucaacaagcacaucuucagccuggagcagcucgaguacucccgggaggggcuggucugggaggacaucgacuggaucgacaacggcgagugccuggaccucaucgagaagaagcugggccugcucgcgcugaucaacgaggagagccacuucccccaggccaccgacuccacgcugcuggagaagcuccacagccagcacgccaacaaccacuucuacgugaagccgcgcgucgccgugaacaacuucggggugaagcacuacgccggcgagguccaguacgacgugcgggggauccuggagaagaaccgcgacaccuuccgggacgaccugcucaaccugcugcgcgagucccgguucgacuucaucuacgaccucuucgagcacgugagcucccgcaacaaccaggacacccugaagugcggcagcaagcaccggcgccccaccgucagcucccaguucaaggacagccugcacucccucauggcgacgcugagcuccagcaaccccuucuucgugcggugcaucaagcccaacaugcagaagaugccggaccaguucgaccaggccgugguccugaaccagcuccgcuacuccgggaugcuggagaccgugcggauccgcaaggccggcuacgccgugcggcgccccuuccaggacuucuacaagcgguacaagguccugaugcgcaaccucgcgcugcccgaggacgugcggggcaagugcaccagccugcuccagcuguacgacgccuccaacagcgaguggcagcuggggaagaccaagguguuccuccgcgagucccuggagcagaagcuggagaagcgccgggaggaggaggucagccacgccgccauggugauccgcgcccacgugcucggcuuccuggcgcggaagcaguaccgcaagguccuguacugcguggugaucauccagaagaacuaccgggccuuccuccugcgccggcgcuuccugcaccucaagaaggccgccaucgucuuccagaagcagcugcgggggcagaucgcccgccggguguaccgccagcugcucgcggagaagcgggagcaggaggagaagaagaagcaggaggaggaggagaagaagaagcgcgaggaggaggagcgggagcgcgagcgggagcgccgggaggccgagcugcgcgcccagcaggaggaggagacgcggaagcagcaggagcuggaggcccuccagaagucccagaaggaggccgagcugacccgcgagcuggagaagcagaaggagaacaagcagguggaggagauccuccgccuggagaaggagaucgaggaccugcagcggaugaaggagcagcaggagcucagccugaccgaggcgucccugcagaagcuccaggagcgccgggaccaggagcugcgccggcuggaggaggaggccugccgcgccgcccaggaguuccucgagagccugaacuucgacgagaucgacgagugcguccggaacaucgagcgcucccugagcgugggcagcgaguucuccagcgagcucgcggaguccgccugcgaggagaagcccaacuucaacuucagccagccguaccccgaggaggagguggacgagggcuucgaggccgacgacgacgccuucaaggacucccccaaccccagcgagcacgggcacuccgaccagcggaccagcggcauccgcacguccgacgacagcuccgaggaggacccguacaugaacgacaccgucgugcccaccagccccuccgccgacagcaccgugcugcuggcgcccuccguccaggacagcgggucccuccacaacagcuccagcggcgagagcaccuacugcaugccgcagaacgccggggaccugcccucccccgacggcgacuacgacuacgaccaggacgacuacgaggacggcgccaucacgagcggguccagcgugaccuucuccaacagcuacggcucccaguggagcccggacuaccggugcuccguggggaccuacaacagcuccggcgccuaccgcuucagcuccgagggggcccagagcuccuucgaggacagcgaggaggacuucgacucccgguucgacaccgacgacgagcugagcuaccgccgggacuccgucuacagcugcgugacgcuccccuacuuccacagcuuccuguacaugaagggcggccugaugaacuccuggaagcgccgguggugcgugcucaaggacgagaccuuccugugguuccgcagcaagcaggaggcgcugaagcagggguggcuccacaagaagggcgggggcuccagcacccugucccggcgcaacuggaagaagcgcugguucguccugcggcagagcaagcucauguacuucgagaacgacuccgaggagaagcugaaggggaccguggaggugcgcacggccaaggagaucaucgacaacaccaccaaggagaacggcaucgacaucaucauggccgaccggaccuuccaccugaucgccgagagccccgaggacgccucccagugguucagcguccucucccaggugcacgcgagcacggaccaggagauccaggagaugcacgacgagcaggccaacccccagaacgccgugggcacccuggacgucgggcugaucgacuccgugugcgccagcgacuccccggaccgccccaacagcuucgugaucaucaccgcgaaccggguccuccacugcaacgccgacacccccgaggagaugcaccacuggaucacgcugcugcagcgcuccaagggcgacacccggguggaggggcaggaguucaucgugcgcggcuggcuccacaaggaggucaagaacagccccaagauguccagccugaagcugaagaagcggugguucgugcucacccacaacagccuggacuacuacaaguccagcgagaagaacgcccugaagcucgggacccuggugcugaacucccucugcagcgucgugccgcccgacgagaagaucuucaaggagacgggcuacuggaacgucaccguguacggccgcaagcacugcuaccggcuguacaccaagcugcucaacgaggccacccgcugguccagcgccauccagaacgugacggacaccaaggcgcccaucgacacccccacccagcagcugauccaggacaucaaggagaacugccugaacuccgacgucguggagcagaucuacaagcggaacccgauccuccgcuacacgcaccacccccugcacagcccccugcucccccugccguacggggacaucaaccugaaccugcucaaggacaagggcuacaccacccugcaggacgaggccaucaagaucuucaacucccugcagcagcucgagagcauguccgaccccauccccaucauccaggggauccugcagaccggccacgaccugcggccccuccgcgacgagcuguacugccagcugaucaagcagacgaacaaggugccgcaccccggcagcgucgggaaccucuacuccuggcagauccugaccugccugagcugcaccuuccuccccucccggggcauccugaaguaccugaaguuccaccucaagcgcauccgggagcaguuccccgggagcgagauggagaaguacgcccuguucaccuacgagucccugaagaagacgaagugccgcgaguucgugccgagccgggacgagaucgaggcccucauccaccgccaggagaugaccuccaccguguacugccacggcgggggcagcugcaagaucaccaucaacagccacaccacggccggcgaggucguggagaagcugauccgcgggcuggcgauggaggacucccggaacauguucgcccucuucgaguacaacggccacguggacaaggccaucgagagccgcaccgucguggccgacgugcuggccaaguucgagaagcuggcggccaccuccgaggucggggaccuccccuggaaguucuacuucaagcuguacugcuuccuggacaccgacaacgugcccaaggacagcguggaguucgccuucauguucgagcaggcccacgaggccgucauccacggccaccacccggcgcccgaggagaaccuccaggugcuggccgcccugcggcuccaguaccugcagggggacuacacgcugcacgccgcgauccccccccucgaggagguguacucccugcagcgccugaaggcccggaucagccaguccaccaagaccuucaccccgugcgagcgccucgagaagcggcgcacgagcuuccuggagggcacccugcggcgcuccuuccggaccggcagcgucgugcgccagaagguggaggaggagcagaugcucgacauguggaucaaggaggaggucuccagcgcccgggccuccaucaucgacaaguggcgcaaguuccaggggaugaaccaggagcaggccauggcgaaguacauggcccugaucaaggaguggcccggcuacgggagcacccuguucgacguggagugcaaggagggcggguucccccaggagcucuggcugggcguguccgccgacgccgucagcguguacaagcggggcgaggggcgcccccuggagguguuccaguacgagcacauccucuccuucggcgccccgcuggcgaacacguacaagaucgucguggacgagcgggagcugcucuucgagaccagcgagguggucgacguggccaagcugaugaaggccuacaucuccaugaucgugaagaagcgcuacagcaccacccggagcgccuccagccagggguccagccgcuga

SEQ ID NO: 33296 - RNA, 10593 nt, Artificial Sequence
  derived and/or modified sequence opt1 from MYO15A__Homo_sapiens__NP_057323
auggccaaggaggaggacgaggagaagaaggccaagaagggcaagaaggggaagaaggcccccgagcccgagaagcccaagcgcagccugaagggcaccucccgccuguucaugggguuccgcgaccggacccccaagaucagcaagaagggccaguuccgcuccgccagcgccuucuucugggggcugcacaccggcccccagaagaccaagcggaagcgcaaggcccggaccgugcugaaguccaccagcaagcucaugacccagaugcgcaugggcaagaagaagcgggccaugaaggggaagaagccguccuucauggucauccgcuuccccggccggcgcggguacggccggcugcgcccccgggcccgcagccuguccaaggccagcaccgccaucaacuggcucaccaagaaguuccugcugaagaaggccgaggaguccgggagcgagcaggccaccguggacgccuggcuccagcgguccagcucccgcaugggcagccggaagcugcccuuccccuccggcgccgagauccugcgccccgggggccggcuccgccgcuucccccggagccgcuccaucuacgccagcggggagccccugggcuuccugcccuucgaggacgaggcccccuuccaccacagcggcucccggaagucccucuacgggcuggagggcuuccaggaccugggggaguacuacgacuaccaccgcgacggcgacgacuacuacgaccggcagucccuccaccgcuacgaggagcaggagcccuaccuggccgggcugggccccuacagccccgccuggccgccguacggcgaccacuacuacggguacccgcccgaggaccccuacgacuacuaccaccccgacuacuacggcgggcccuucgaccccggcuacaccuacggguacggcuacgacgacuacgagccgcccuacgcgccgcccuccggcuacagcucccccuacagcuaccacgacggguacgagggcgaggcccaccccuacggguacuaccucgaccccuacgcccccuacgacgcccccuacccgcccuacgaccugcccuaccacacccccuacgacgugcccuacuucgaccccuacggcgugcacuacaccgugcccuacgccgaggggguguacggcggcggggacgaggccaucuacccgcccgagguccccuacuucuaccccgaggaguccgccagcgccuucguguaccccugggugcccccgcccauccccagcccccacaaccccuacgcccacgccauggacgacaucgccgagcuggaggagcccgaggacgccggcgucgagcggcaggggaccagcuuccgccuccccuccgccgccuucuucgagcagcagggcauggacaagcccgcccggagcaagcugucccugauccgcaaguuccgccuguucccgcgcccccaggugaagcuguucggcaaggagaagcuggaggugccccucccgcccagccuggacaucccccugccccucggggacgccgacgaggaggaggacgaggaggagcugccgcccgucuccgccgugcccuacggccaccccuucuggggguuccugaccccgcggcagcgcaaccuccagcgggcccugagcgccuucggcgcccaccgcgggcugggcuucggccccgaguucgggcggcccgugccccgcccggccaccucccucgcccgguuccugaagaagacccugagcgagaagaagcccaucgcccgccuccgcggcagccagaaggcccgggccgggggccccgccguccgcgaggccgcguacaagcgguucggguacaagcuggccggcauggaccccgagaagccgggcacccccaucgugcugcgccgggcccagccccgcgcccgguccagcaacgacgcccgccggcccccggcgccccagcccgcgccccggacgcucucccacuggagcgcccugcuguccccgcccgugcccccgcggccgcccagcuccgggcccccgcccgcgccgccccucagcccggcgcuguccggccugccccgccccgccagccccuacgggucccugcggcgccacccgccgcccugggccgcccccgcccacgucccgcccgcgccccaggccagcuggugggccuucguggagcccccggccgugucccccgaggugccgcccgaccuccuggccuucccgggcccccggcccagcuuccgcgggucccggcgccggggcgcggccuucggcuuccccggggccagcccgcgcgccucccggcgccgcgccuggagcccccuggcgagcccccagcccucccuccggagcuccccgggccugggguacugcagcccccuggcgccgcccagcccccagcucagccugcgcaccggccccuuccagccgcccuuccugccgcccgcccggcgcccccggucccuccaggagagccccgcgccccggcgggcggccgggcgccuggggccgcccggcagcccccugcccgggagcccccggccgcccuccccgccccucggccugugccacagcccccgccgguccucccugaaccuccccucccgccugccccacaccuggcggcgccugagcgagccgcccacccgggccgugaagccccagguccgccuccccuuccaccggccgccccgcgccggggccuggcgggcgccccuggagcaccgcgagagcccccgggagcccgaggacagcgagacccccuggaccgugccgccccucgcccccuccugggacguggacaugccgcccacccagcggccgcccagccccuggcccggcggcgccgggagccgccggggcuucucccgcccgccgcccguccccgagaaccccuuccuccagcugcuggggcccgugcccagccccacccuccagcccgaggaccccgccgccgacaugacgcggguguuccugggccgccaccacgagcccgggcccggccagcugaccaaguccgcgggccccacccccgagaagccggaggaggaggccacccucggggacccccagcugcccgccgagacgaagccgcccacccccgcgccgcccaaggacgucacgccgcccaaggacaucacgccgcccaaggacgugcugcccgagcagaagacgcuccggcccagccuguccuacccccuggccgcgugcgaccagacccgcgccaccuggccgcccuggcaccgguggggcacccucccccaggccgccgcgccccucgcgcccauccgcgcccccgagccccugcccaagggcggggagcggcgccaggccgcccccgggcgguucgcgguggucaugccccgcgugcagaagcucagcuccuuccagcgggugggccccgccacgcugaagccccagguccagccgauccaggaccccaagccccgcgccugcagccugcggugguccugccucuggcugcgcgccgacgccuacggccccuggccgcgggugcacacccacccccagagcugccaccuggggcccggcgcggccugccucucccugcgcgggagcugggaggaggugggcccgcccuccuggcggaacaagaugcacagcauccgcaaccugcccuccaugcgcuuccgggagcagcacggggaggacggcgucgaggacaugacccagcucgaggaccugcaggagaccaccgugcugagcaaccucaagauccgcuucgagcggaaccugaucuacacguacaucggcuccauccuggugagcgucaaccccuaccagauguucgggaucuacggcccggagcagguccagcaguacaacgggcgcgcccucggcgagaacccgccccaccuguucgccguggccaaccuggcguucgccaagaugcucgacgccaagcagaaccagugcaucaucaucuccggcgagagcgggagcggcaagaccgaggccaccaagcugauccugcgguaccucgccgcgaugaaccagaagcgcgaggucaugcagcagaucaagauccuggaggccacgccccugcucgaguccuucgggaacgccaagacggugcggaacgacaacagcucccgcuucggcaaguucguggagaucuuccuggagggcggcgucaucagcggcgccaucaccucccaguaccugcucgagaagucccggaucguguuccaggcgaagaacgagcgcaacuaccacaucuucuacgagcugcuggccgggcucccggcccagcugcggcaggccuucucccugcaggaggccgagaccuacuacuaccucaaccagggcgggaacugcgagaucgcgggcaagagcgacgccgacgacuuccgccggcugcuggccgccauggaggugcucggguucuccagcgaggaccaggacuccaucuuccgcauccuggccagcauccugcaccucggcaacgucuacuucgagaaguacgagaccgacgcgcaggagguggccuccguggucagcgcccgggagauccaggccguggccgagcugcugcagaucucccccgagggccuccagaaggcgaucacguucaaggugaccgagaccaugcgcgagaagaucuucacgccccugacggucgagagcgccguggacgcccgggacgccaucgcgaaggugcuguacgcccuccuguucuccuggcugaucacccgcgucaacgcccucgugagcccccggcaggacacccuguccaucgccauccuggacaucuacggguucgaggaccucagcuucaacagcuucgagcagcugugcaucaacuacgccaacgagaaccugcaguaccucuucaacaagaucguguuccaggaggagcaggaggaguacauccgcgagcagaucgacuggcaggagaucaccuucgcggacaaccagccgugcaucaaccugaucucccugaagcccuacggcauccuccgcauccuggacgaccagugcugcuucccccaggccacggaccacaccuuccugcagaagugccacuaccaccacggggccaacccccuguacagcaagccgaagaugccccuccccgaguucaccaucaagcacuacgccggcaaggucaccuaccaggugcacaaguuccuggacaagaaccacgaccaggugcggcaggacguccuggaccucuucgugcgcucccggacgcgcguggucgcccaccuguucagcucccacgcgccccaggccgccccgcagcggcuggggaaguccuccagcgugacccgccucuacaaggcccacaccguggccgcgaaguuccagcagucccugcuggaccucgucgagaagauggagcggugcaacccccuguucaugcgcugccugaagcccaaccacaagaaggagcccggccucuucgagccggacguggugauggcccagcugcgguacagcggcguccuggagaccgugcgcauccggaaggagggguuccccgugcgccuccccuuccagggcuucaucgaccgguacugcugccuggucgcccugaagcacgaccuccccgccaacggggacaugugcguguccguccugagccgccugugcaaggugaugccgaacauguaccgggugggcgucuccaagcuguuccugaaggagcaccuguaccagcuccuggagagcaugcgcgagcacgugcugaaccucgccgcgcugacgcugcagcggugccuccgcggguucuucaucaagcggcgcuuccggucccugcgccacaagaucauccugcuccagagccgcgcccggggcuaccuggcccgccagcgguaccagcagaugcgccggucccuggugaaguuccgcagccucguccacgccuacgugucccggcgccgguaccugaagcugcgcgcggaguggcggugccagguggagggcgcccuccugugggagcaggaggagcugagcaagcgcgaggucguggccguggggcaccucgagguccccgccgagcuggccggccugcuccaggcgguggccgggcugggccuggcccaggugccccaggucgccccggugcggaccccgcgccuccaggccgagccccgggugacccugccccuggacaucaacaacuaccccauggcgaaguucguccagugccacuucaaggagcccgccuucggcaugcucaccgugccccugcgcacgccccugacccagcucccggccgagcaccacgccgaggccgugagcaucuucaagcugauccugcgguucaugggggacccccaccuccacggcgcgcgcgagaacaucuucgggaacuacaucguccagaagggccuggccgugcccgagcugcgggacgagauccucgcccagcuggccaaccagguguggcacaaccacaacgcgcacaacgccgagcgcggguggcugcuccuggccgccugccuguccggcuucgcccccagcccgugcuucaacaaguaccuccugaaguucgucuccgacuacggccgcaacggguuccaggcggugugccagcaccggcugaugcaggccaugggccgcgcccagcagcaggggagcggcgccgcccggacccugccgcccacccagcuggaguggacggcgaccuacgagaaggccuccauggcccuggacguggggugcuucaacggcgaccaguucagcugccccguccacuccuggagcaccggcgaggagguggccggggacauccuccgccaccggggccuggccgacggguggcgcggcuggaccguggcgaugaagaacgggguccagugggccgagcuggccggccacgacuacgugcucgaccugguguccgaccuggagcuccugcgggacuucccgcgccagaaguccuacuucaucgucggcacggaggggcccgccgcgucccggggcgggcccaaggugguguucggcaacagcugggacuccgacgaggacaugagcacccgcccccagccgcaggagcacaugcccaagguccuggacuccgacggguacagcucccacaaccaggacggcaccaacggcgagaccgaggcccagcgggggaccgccacgcaccaggagagcgacucccucggcgagcccgccgugccccacaaggggcuggacugcuaccuggacagccucuucgacccggugcugagcuacggcgacgccgaccuggagaagcccaccgcgaucgccuaccgcaugaagggcgggggccagcccgggggcggguccagcuccggcaccgaggacaccccgcggcgcccgcccgagcccaagcccauccccggccucgacgccagcacgcuggcccugcagcaggccuucauccacaagcaggcgguccuccuggcccgggagaugacccugcaggccaccgcccuccagcagcagccccuguccgccgcgcugcgcagccuccccgccgagaagccgcccgcccccgaggcccagcccaccuccguggggacgggcccgcccgccaagcccgugcugcugcgggcgacccccaagccgcucgcccccgcgccccuggccaaggcgccccgccugccgaucaagcccgucgccgcccccgugcuggcccaggaccaggccagccccgagaccaccuccccgagccccgagcucgugcgguacuccacgcugaacagcgagcacuucccccagcccacccagcagaucaagaacaucguccgccaguaccagcagccguuccgcgggggccgccccgaggcgcugcgcaaggacgggggcaagguguucaugaagcggcccgacccgcacgaggaggcccucaugauccugaagggccagaugacccaccuggccgccgcccccgggacccaggugucccgcgaggcggucgcccucgugaagcccgugacgagcgcgccccggccguccauggcccccaccagcgcccugcccucccgcagccuggagcccccggaggagcucacccagacccggcugcaccgccugaucaaccccaacuucuacggcuaccaggacgcgcccuggaagaucuuccuccggaaggaggucuucuaccccaaggacagcuacucccacccggugcagcuggaccuccucuuccgccagauccugcacgacacgcugagcgaggccugccuccggaucuccgaggacgagcgccugcggaugaaggcccuguucgcccagaaccagcucgacacccagaagccccuggucaccgagagcgugaagcgcgcgguggucuccaccgcccgggacacgugggagguguacuucagccgcaucuuccccgccaccggguccgugggcaccgggguccagcugcucgccgugagccacgugggcaucaagcugcugcggauggucaagggcgggcaggaggccggcgggcagcuccgcgugcugcgggcguacuccuucgccgacauccuguucgugaccaugcccagccagaacaugcucgaguucaaccuggccuccgagaaggucauccuguucagcgcccgcgcccaccaggugaagacgcucguggacgacuucauccuggagcugaagaaggacuccgacuacgucguggcggugcggaacuuccucccggaggaccccgcccugcuggccuuccacaagggcgacaucauccaccuccagccccuggagcccccgcgcgucggcuacagcgccgggugcguggugcgccggaaggucguguaccuggaggagcuccgccggcgcggccccgacuucggguggcgguucggcaccauccacgggcgcgugggccgguuccccuccgagcugguccagcccgccgcggccccggacuuccugcagcuccccaccgagcccggccgcgggcgggccgccgccguggcggccgccguggccagcgcggccgccgcccaggaggucggccgccggcgcgaggggcccccggugcgggcccgcuccgcggaccacggcgaggacgcccuggcccugccgcccuacaccaugcucgaguucgcccagaaguacuuccgggacccgcagcgccggccccaggacgggcugcgccucaagagcaaggagccccgggagucccgcacgcucgaggacaugcugugcuucaccaagacgccccugcaggagagccucaucgagcugagcgacuccagccuguccaagauggccaccgacauguuccucgcggugaugcgguucaugggcgacgccccgcugaagggccagagcgaccuggacguccucugcaaccugcugaagcucugcggggaccacgaggugaugcgcgacgagugcuacugccagguggucaagcagaucacggacaacaccuccagcaagcaggacuccugccagcgcggcuggcggcugcuguacaucgugaccgccuaccacagcugcuccgaggugcuccacccccaccugacccgcuuccugcaggacgucagccggacccccgggcuccccuuccagggcaucgccaaggccugcgagcagaaccugcagaagacgcugcgcuucgggggccggcucgagcugccguccagcaucgagcugcgcgcgaugcucgccggccgguccagcaagcgccagcuguuccugcuccccgggggccuggagcggcaccugaagaucaagaccugcaccguggcccucgacguggucgaggagaucugcgccgagauggcgcugacccgccccgaggccuucaacgaguacgugaucuucguggucacgaaccgggggcagcacgugugcccccugucccgccgggccuacauccucgacguggccagcgagauggagcaggucgacggcggguacaugcugugguuccgccgggugcugugggaccagccgcucaaguucgagaacgagcuguacgugaccaugcacuacaaccagguccugcccgacuaccucaagggccuguucuccagcgugcccgccucccgccccagcgagcagcugcuccagcaggucagcaagcuggcgucccugcagcaccgggccaaggaccacuucuaccucccgagcguccgcgaggugcaggaguacauccccgcccagcuguaccggaccaccgccggcuccacguggcugaaccuggucagccagcaccgccagcagacccaggcccucagcccccaccaggcgcgcgcccaguuccuggggcugcucagcgcccugcccauguucggcuccagcuucuucuucauccaguccugcagcaacaucgccgugccggcccccugcauccuggcgaucaaccacaacgggcucaacuuccuguccaccgagacccacgagcugauggugaaguucccccucaaggagauccagagcacgcggacccagcgccccaccgccaacuccagcuacccguacgucgagaucgcccugggcgacguggccgcgcagcggacccugcagcuccagcuggagcagggccuggagcucugccgcguggucgccgugcacguggagaaccugcuguccgcccacgagaagcggcucacgcugccgcccagcgagaucacccugcucuga

SEQ ID NO: 33297 - RNA, 5643 nt, Artificial Sequence
  derived and/or modified sequence opt1 from MYO16__Homo_sapiens__NP_001185879
augagccacuaccacuucaucaagugcugcugcuuccagcugugcaacguguuccggagccacgagauggagaucgaccagugccugcuggagagccugccccugggccagcggcagcgccuggugaagcggaugcgcugcgagcagaucaaggccuacuacgagcgggagaaggccuuccagaagcaggagggguuccugaagcgccucaagcacgcgaagaaccccaaggugcacuucaaccugaccgacaugcugcaggacgccaucauccaccacaacgacaaggaggugcuccggcugcugaaggagggcgccgacccccacacccucgucagcagcgggggcucccugcugcaccucugcgcccgcuacgacaacgccuucaucgcggagauccugaucgaccggggcgugaacgugaaccaccaggacgaggacuucuggacccccaugcacaucgccugcgccugcgacaaccccgacaucguccugcuccuggugcuggccggcgcgaacgugcuccugcaggacgucaacggcaacaucccccuggacuacgccguggaggggaccgagagcuccagcauccuccugaccuaccuggacgagaacggcguggaccucaccucccugcgccagaugaagcugcagcggcccaugagcaugcucaccgacgucaagcacuuccuguccagcgggggcaacgugaacgagaagaacgacgagggggugacccugcuccacauggccugcgccuccggcuacaaggaggucgugagccugauccuggagcacggcggggaccucaacaucguggacgaccaguacuggacgccccuccaccuggccgcgaaguacggccagaccaaccucgucaagcugcugcucaugcaccaggccaacccccaccuggugaacugcaacgaggagaaggccuccgacaucgccgccagcgaguucaucgaggagaugcugcucaaggcggagaucgccugggaggagaagaugaaggagccccuguccgccagcacccuggcccaggaggagcccuacgaggagaucauccacgaccuccccgugcuguccagcaagcugagcccccugguccuccccaucgccaagcaggacucccugcuggagaaggacaucauguucaaggacgcgaccaaggggcucugcaagcagcagagccaggacuccauccccgagaaccccaugaugagcggcuccaccaagcccgagcaggucaagcugaugccgcccgcccccaacgacgaccuggccacccucagcgagcugaacgacggcucccugcucuacgagauccagaagcgcuucgggaacaaccagaucuacacguucaucggcgacauccugcugcucgugaaccccuacaaggagcugcccaucuacagcuccauggucagccagcuguacuucuccagcuccgggaagcucugcagcucccugccgccccaccuguucagcugcguggagcgggccuuccaccagcuguuccgcgagcagcggccccagugcuucauccuguccggcgagcgcgggagcggcaaguccgaggccagcaagcagaucauccggcaccugaccugccgcgcgggcgccagccgggccacccucgacucccgcuucaagcacgucgugugcauccuggaggccuucgggcacgcgaagaccacgcugaacgaccucagcuccugcuucaucaaguacuucgagcugcaguucugcgagcggaagcagcagcugaccggcgcccgcaucuacaccuaccuccuggagaagucccgccuggugucccagccccucgggcagagcaacuuccugaucuucuaccugcucauggacggccuguccgccgaggagaaguacgggcugcaccucaacaaccugugcgcccaccgguaccugaaccagaccauccaggacgacgccagcacgggcgagcgcucccucaaccgggagaagcuggcgguccugaagcgcgcccucaacguggugggcuucagcucccuggaggucgagaaccuguucgugauccucgccgccauccugcaccugggggacauccgguucaccgcccucaacgagggcaacagcgcguucguguccgaccugcagcugcucgagcaggucgccgggaugcuccaggugagcaccgacgagcuggccuccgcccucaccacggacauccaguacuucaagggcgacaugaucauccgccggcacaccauccagaucgccgaguucuuccgcgaccugcuggccaagucccucuacucccggcuguucagcuuccuggugaacaccaugaacagcugccuccacucccaggacgagcagaaguccaugcagacccuggacaucgggauccuggacaucuucggcuucgaggaguuccagaagaacgaguucgagcagcucugcgucaacaugacgaacgagaagaugcaccacuacaucaacgaggugcuguuccugcacgagcaggucgagugcgugcaggagggcgugaccauggagaccgccuacucccccgggaaccagaacggcgugcucgacuucuucuuccagaagcccagcggguuccugacccugcucgacgaggagucccagaugaucuggagcgucgaguccaacuuccccaagaagcugcagagccugcucgaguccagcaacacgaacgccguguacucccccaugaaggacggcaacggcaacguggcccugaaggaccacgggaccgcguucaccaucaugcacuacgccggccgcgucauguacgacguggugggggccaucgagaagaacaaggacagccugucccagaaccuccuguucgucaugaagaccagcgagaacguggugaucaaccaccuguuccaguccaagcucagccagacgggcucccuggucagcgccuaccccuccuucaaguuccgggggcacaagagcgcccugcucagcaagaagaugaccgcguccagcaucaucggcgagaacaagaacuaccuggagcuguccaagcuccugaagaagaagggcaccagcaccuuccugcagcgccucgagcgcggggaccccgugaccaucgccucccagcugcgcaagagccugauggacaucaucggcaagcuccagaagugcacgccccacuucauccacugcauccggcccaacaacuccaagcugcccgacaccuucgacaacuucuacgugagcgcccagcugcaguacaucgggguccucgagauggugaagaucuuccgcuacggcuaccccgugcggcuguccuucagcgacuuccugucccgcuacaagccccuggccgacaccuuccuccgggagaagaaggagcagagcgccgcggagcgcugccgccugguccugcagcagugcaagcuccagggguggcagaugggcgugcggaagguguuccugaaguacuggcacgccgaccagcugaacgaccucugccugcagcugcagcgcaagaucaucacgugccagaaggucauccggggcuuccucgcccgccagcaccuccugcagcggaucuccauccgccagcaggaggugacgagcaucaacuccuuccuccagaacaccgaggacauggggcugaagaccuacgacgcccuggugauccagaacgccagcgacaucgcgcgggagaacgaccgccuccgguccgagaugaacgcccccuaccacaaggagaagcuggagguccgcaacaugcaggaggagggcagcaagcggaccgacgacaaguccgggccccgccacuuccaccccagcagcauguccgugugcgccgccguggacggccuggggcagugccucgucggcccgagcaucuggucccccagccugcacuccguguucagcauggacgacuccagcucccugcccagcccccggaagcagccgccgcccaagcccaagcgcgacccgaacacgcggcucuccgcgagcuacgaggccguguccgccugccugagcgccgcccgcgaggcggccaacgaggcccuggcccggccccgcccccacuccgacgacuacagcaccaugaagaagaucccgccccggaagcccaagcgcucccccaacaccaagcucagcggcuccuacgaggagaucagcgggagccggcccggcgacgcccgccccgcgggggcccccggcgccgccgcccgcguccugacccccgggacgccgcagugcgcgcugccgcccgccgcgccgcccggcgacgaggacgacuccgagcccguguacaucgagaugcucggccacgccgcccggcccgacagccccgaccccggggaguccguguacgaggagaugaagugcugccugcccgacgacggcgggcccggcgcgggcagcuuccugcuccacggggccagcccgccccugcugcaccgcgcccccgaggacgaggccgcggggccgcccggggacgccugcgacaucccgccgcccuuccccaaccuccugccgcaccggccgccccugcucgucuucccgcccacccccgugaccugcucccccgccuccgacgagagcccccugacgccccuggaggugaagaagcuccccguccuggagaccaaccugaaguaccccgugcagccggagggcuccagcccccucagcccccaguacagcaagucccagaagggggacggcgaccgccccgccagcccgggccuggcccuguucaacggguccggccgggcguccccgcccuccacgcccccgcccccgcccccgccgcccgggcccccgcccgcccccuaccgccccugcgcccaccucgccuucccgcccgagcccgcccccgucaacgcgggcaaggccgggcccagcgccgaggcccccaaggugcaccccaagcccaacuccgccccgguggcgggccccugcagcagcuuccccaagaucccguacucccccgucaaggccacccgggccgacgcccgcaaggcgggcagcuccgccuccccgcccgccccguacagcccgcccagcucccggccccugagcuccccgcuggacgagcucgccagccuguucaacuccgggcgcagcgugcugcggaaguccgccgcgggccgcaagauccgggaggccgagggguucgagaccaacaugaacaucagcucccgcgacgaccccagcacguccgagaucaccagcgagacccaggaccggaacgccaacaaccacggcauccagcucuccaacagccugagcuccgccaucaccgccgagaacgggaacagcaucuccaacggccugcccgaggaggacggcuacagccgccucuccaucagcgggacgggcaccuccaccuuccagcggcaccgcgacagccacaccacccaggugauccaccagcugcggcuguccgagaacgagagcgucgcgcuccaggagcugcuggacuggcgccgcaagcucugcgaggaggggcaggacuggcagcagauccugcaccacgccgagccccgggugccgccgccgccgcccugcaagaagcccucccugcucaagaagcccgagggcgccagcugcaaccgccugcccuccgagcugugggacacgaccaucuga

SEQ ID NO: 33298 - RNA, 7704 nt, Artificial Sequence
  derived and/or modified sequence opt1 from MYO18B__Homo_sapiens__NP_115997
auggccaucagcucccgccuggcccucugggagcagaagauccgggaggaggacaagagccccccgcccuccagcccccccccgcuguucuccgugauccccggcggguucaucaagcagcugguccgcggcaccgagaaggaggcgaaggaggcccggcagcgcaagcagcucgccguggccagccccgagcgggagauccccgagaucuccaucagccagccgaacuccaagagcuccagcgggacccgcuccggcagccagcagaucucccaggacgaccagagcuccagccccggguccagcgacauccugggcaaggagagcgagggcucccggagccccgaccccgagcagaugacguccaucaacggggagaaggcccaggagcugggcagcuccgcgaccccgaccaagaagaccgugcccuucaagcgcgggguccggcgcggcgacgugcuccugaugguggccaagcuggaccccgacagcgccaagcccgagaagacgcacccgcacgacgccccccccugcaagaccucccccccggcgaccgacaccgggaaggagaagaagggcgagacgagccggacccccugcggcucccaggccagcaccgagauccucgcccccaaggccgagaagacccgcacggggggccugggggaccccggccagggcaccgucgcccugaagaagggggaggagggccaguccaucguggggaagggccucgggaccccgaagaccacggagcugaaggaggcggagccccagggcaaggaccggcagggcacccgcccccaggcccaggggcccggcgagggggugcggccgggcaaggccgagaaggagggggccgagcccaccaacaccgucgagaagggcaacgugagcaaggacgugggcuccgaggggaagcacguccgcccccagaucccgggccggaagugggggggcuuccuggggcgccggagcaagugggacggcccccagaacaagaaggacaaggagggcgugcuccuguccaaggccgagaagacgggggagccccagacccagauggagaagaccagccaggugcagggcgagcugggggacgaccuccgcaugggcgagaaggcgggcgagcugcgguccaccacggggaaggccggcgagagcugggacaagaaggagaagauggggcagccccagggcaaguccgggaacgccggcgaggcccgcagccagaccgagaagggcugcgaggccccgaaggaggucagcaccaugguggagucccccgcggcccccgggaagggcggguggcccggcagccgcgggcaggaggccgaggagccgugcucccgggccggcgacggcgccggggcgcuggagaccgagcucgagggccccagccagcccgcccuggagaaggacgccgagcgcccccggauccgcaaggagaaccaggacgggccggccccccaggaggagggcaaggggggccagucccgggacagcgaccaggcgcccgaggaccgcugguacgaggccgagaagguguggcuggcccagaaggacggcuucacgcucgccaccguccugaagcccgacgaggggaccgccgaccugccggcgggccgggugcgccucuggaucgacgccgacaagaccaucacggagguggacgaggagcacguccaccgggccaacccccccgagcuggaccagguggaggaccuggccucccucaucagcgugaacgaguccagcguccugaacacccugcuccagcgcuacaaggcccagcugcugcacaccugcaccgggcccgaccucaucgugcugcagccgcggggccccuccguccccagcgcggggaaggugcccaagggccgccgggacggccugccggcccacaucggguccauggcccagcgcgccuacugggcccuccugaaccagcggcgcgaccagagcaucguggcgcugggcugguccggggccggcaagacgaccugcugcgagcagguccucgagcaccuggugggcauggccgggagcguggacggccgggucuccguggagaagauccgcgccaccuucaccgugcugcgggcguucgggagcgucagcauggcccacucccgcagcgccacccgcuucuccauggugaugagccucgacuucaacgccacgggccggaucaccgccgcgcagcugcagaccaugcugcucgagaagucccgcguggcccggcagcccgagggggagagcaacuuccuggucuucucccagaugcuggccggccuggaccucgaccugcgcaccgagcugaaccuccaccagauggccgacagcuccagcuucggcaugggggugugguccaagcccgaggacaagcagaaggccgcggccgccuucgcccagcugcagggcgccauggagaugcuggggaucagcgaguccgagcagcgggcgguguggcgcguccucgccgccaucuaccaccugggcgccgcgggggccugcaaggugggccggaagcaguucaugcgcuucgagugggccaacuacgccgccgaggcgcugggcugcgaguacgaggagcucaacacggccaccuucaagcaccaccugcggcagaucauccagcagaugaccuucgggccgagccgcuggggccuggaggacgaggagaccuccagcgggcucaagaugacgggcguggacugcgucgaggggauggccuccggccuguaccaggagcuguucgccgccguggugagccucaucaaccgguccuucagcagccaccaccuguccauggcgagcaucauggucguggacucccccggcuuccagaacccccgccaccaggggaaggaccgggccgccaccuucgaggagcugugccacaacuacgcccacgagcgccuccagcugcuguucuaccagcggaccuucgugagcacccuccagcgcuaccaggaggagggcguccccgugcaguucgaccugccggaccccucccccgggacgaccguggccgucguggaccagaaccccagccaggugcggcugccggcgggcggcggggcccaggacgcccgcggccucuucuggguccuggacgaggaggugcacguggagggguccagcgacuccgucgugcuggagcggcucugcgccgccuucgagaagaagggcgcggggaccgagggcagcuccgcccugcgcaccugcgagcagccccugcagugcgagaucuuccaccagcucggcugggaccccgugcgguacgaccugacgggguggcugcaccgcgccaagcccaaccucagcgcccuggacgcgccgcagguccugcaccaguccaagcgcgaggagcuccggagccuguuccaggcccgcgccaagcugccccccgugugccgggccguggccggccucgaggggaccucccagcaggcgcugcagcgcagccggaugguccgccggaccuucgccuccagccuggccgccgugcgccggaaggcccccugcucccagaucaagcuccagauggacgcgcugaccagcaugaucaagcgcagccggcugcacuucauccacugccucgugccgaaccccgucguggagucccgcagcggccaggaguccccccccccgccccagcccgggcgggacaagcccggcgccggcgggccgcuggcccuggacauccccgcccuccgcgugcagcuggccggcuuccacauccuggaggcgcuccggcugcaccgcacgggguacgccgaccacaugggccugacccgguuccgccggcaguuccagguccucgacgccccccugcugaagaagcucaugagcaccuccgaggggaucgacgagcgcaaggccguggaggagcugcuggagacccucgaccuggagaagaaggcgguggccgucggccacagccagguguuccugaaggccggcgugaucucccgccucgagaagcagcgggagaagcuggucagccaguccaucgugcuguuccaggccgccugcaagggguuccucagccgccaggaguucaagaagcugaagauccggcgccuggcggcccagugcauccagaagaacgucgccguguuccucgccgugaaggacuggcccugguggcagcugcugggcucccuccagccgcugcugagcgccacgaucgggaccgagcagcuccgggcgaaggaggaggagcugaccacccugcgccggaagcucgagaaguccgagaagcugcgcaacgagcugcggcagaacacggaccuccuggagagcaagaucgccgaccugaccuccgaccucgccgacgagcgcuucaagggcgacgucgccugccaggugcuggagagcgagcgggccgagcgccugcaggcguuccgggaggugcaggagcucaaguccaagcacgagcagguccagaagaagcugggggacgugaacaagcagcuggaggaggcccagcagaagauccagcucaacgaccuggagcgcaaccccaccggcggcgccgacgaguggcagaugcgguucgacugcgcccagauggagaacgaguuccugcgcaagcggcuccagcagugcgaggagcgccuggacagcgagcugaccgcgcggaaggagcuggagcagaagcucggggagcugcaguccgccuacgacggcgccaagaagauggcccaccagcugaagcgcaagugccaccaccucacgugcgaccuggaggacaccugcgugcugcucgagaaccagcagagccggaaccacgagcuggagaagaagcagaagaaguucgaccugcagcucgcccaggcgcugggggagagcgucuucgagaagggccugcgcgagaaggugacccaggagaacaccuccgugcgcugggagcucggccagcugcagcagcagcugaagcagaaggagcaggaggccagccagcucaagcagcaggucgagaugcugcaggaccacaagcgggagcugcucgggucccccagccugggcgagaacugcguggccgggcugaaggagcgccucuggaagcuggaguccagcgcccuggagcagcagaagauccagucccagcaggagaacacgaucaagcagcucgagcagcugcggcagcgcuucgagcuggagaucgagcggaugaagcagaugcaccagaaggaccgcgaggaccaggaggaggagcucgaggacgugcggcagagcugccagaagcgccugcaccagcuggagaugcagcucgagcaggaguacgaggagaagcagaugguccugcacgagaagcaggaccuggagggccucaucgggacccugugcgaccagaucggccaccgggacuucgacguggagaagcgccugcggcgcgaccuccggcgcacccacgcccugcuguccgacgugcagcuccugcugggcaccauggaggacgggaagaccagcgucuccaaggaggagcucgagaaggugcacagccagcuggagcaguccgaggcgaagugcgaggaggcccugaagacgcagaaggugcucaccgccgaccuggagagcaugcacuccgagcuggagaacaugacccggaacaagagccucgucgacgagcagcuguaccgccugcaguucgagaaggccgaccuccugaagcggaucgacgaggaccaggacgaccugaacgagcucaugcagaagcacaaggaccugaucgcccaguccgcggccgacaucggccagauccaggagcugcagcuccagcuggaggaggccaagaaggagaagcacaagcugcaggagcagcuccagguggcccagaugcgcaucgaguaccuggagcagagcaccguggaccgggccaucgucucccgccaggaggcggugaucugcgaccuggagaacaagacggaguuccagaaggugcagaucaagcgcuucgagguccucgugauccggcugcgcgacagccugaucaagaugggggaggagcucagccaggccgccaccuccgagagccagcagcgggaguccagccaguacuaccagcgccggcuggaggagcugaaggccgacauggaggagcucgugcagcgcgaggcggaggccucccggcgcugcauggagcuggagaaguacgucgaggagcuggccgccgugcggcagacccuccagaccgaccuggagacgagcauccgccggaucgccgaccugcaggcggcccucgaggagguggccuccagcgacuccgacaccgagagcguccagaccgccguggacugcggcuccagcgggcgcaaggagauggacaacguguccauccugagcucccagccggagggcagccugcaguccuggcucagcugcacccugucccuggccacggacaccaugcggacccccagccgccagagcgcgaccuccagccggauccucuccccccgcaucaacgaggaggccggcgacacggagcggacccagagcgcccuggcccugucccgcgcccggagcaccaacguccacuccaagaccagcggggacaagcccguguccccgcacuucgugcgccggcagaaguacugccacuucggcgacggggagguccucgcggugcagcgcaagagcacggagcgccuggagcccgccuccagcccccuggccucccggagcaccaacaccuccccccucagccgcgagaagcugccgucccccagcgccgcgcugagcgaguucguggagggccuccggcgcaagcgggcccagcgcgggcagggcuccacccugggccuggaggacuggcccacgcuccccaucuaccagaccaccggggccagcacccugcggcgcggccgggccggguccgacgagggcaaccugagccuccgcgucggggccaaguccccgcuggagaucgagggcgcggccggcgggcugcuccggagcacgucccugaagugcaucagcuccgacggcguggggggcaccacccugcugcccgagaagagcaagacccaguucuccagcugcgagucccuccuggagagccgccccuccaugggccggaagcugagcucccccacgaccccgcgcgacaugcuccugagccccacccugcggccccgccggcgcugccucgaguccagcguggacgacgccgggugccccgaccugggcaaggagccgcuggucuuccagaaccggcaguucgcccaccucauggaggagccccuggggagcgaccccuucuccuggaagcugcccagccucgacuacgagcgcaagaccaagguggacuucgacgacuuccugccggccauccgcaagccccagacgcccaccucccuggcgggcagcgccaaggggggccaggacggcucccagcggagcuccauccacuucgagaccgaggaggccaaccgcagcuuccucuccgggaucaagaccauccugaagaagagccccgagccgaaggaggaccccgcccaccuguccgacagcuccagcuccagcggcuccaucgugagcuucaaguccgccgacagcaucaagagccggcccgggaucccgcgccucgcgggcgacgggggcgagcggaccucccccgagcgccgggagcccggcacggggcgcaaggacgacgacgucgccagcaucaugaagaaguaccugcagaaguga

SEQ ID NO: 33299 - RNA, 3132 nt, Artificial Sequence
  derived and/or modified sequence opt1 from MYO1A__Homo_sapiens__NP_005370
augccccugcucgagggcagcgugggggucgaggaccuggugcugcucgagccgcugguggaggagucccugcucaagaaccugcagcugcgcuacgagaacaaggagaucuacaccuacaucggcaacgucgugaucagcgugaaccccuaccagcagcuccccaucuacgggcccgaguucaucgccaaguaccaggacuacaccuucuacgagcugaagccgcacaucuacgcccuggcgaacgucgccuaccagucccuccgggaccgcgaccgggaccagugcauccugaucacgggcgagagcggguccggcaagaccgaggccagcaagcuggugauguccuacguggccgccgucugcggcaagggggagcaggucaacagcgugaaggagcagcuccugcaguccaaccccgugcuggaggcguucggcaacgccaagaccauccgcaacaacaacagcucccgguucgggaaguacauggacaucgaguucgacuucaagggcagcccccucgggggcgugaucaccaacuaccugcuggagaagucccgccucgugaagcagcugaagggcgagcggaacuuccacaucuucuaccagcugcucgccggggccgacgagcagcugcugaaggcgcucaagcuggagcgcgacacgaccggcuacgccuaccugaaccacgaggucagccggguggacgggauggacgacgccuccagcuuccgcgccgugcaguccgccauggcggucaucggcuucagcgaggaggagauccgccaggugcucgaggugaccuccaugguccugaagcugggcaacgugcucguggccgacgaguuccaggccagcgggauccccgccagcggcauccgggacgggcggggcguccgcgagaucggggagauggugggccugaacuccgaggaggucgagcgggcccugugcagccgcaccauggagacggcgaaggagaagguggugaccgcccucaacgucaugcaggcccaguacgcccgggacgcccuggcgaagaacaucuacucccgccuguucgacuggaucgugaaccggaucaacgagagcaucaaggugggcaucggggagaagaagaaggucaugggcgugcucgacaucuacggguucgagauccuggaggacaacuccuucgagcaguucgugaucaacuacugcaacgagaagcugcagcaggucuucaucgagaugacccucaaggaggagcaggaggaguacaagcgcgagggcaucccguggaccaagguggacuacuucgacaacgggaucaucugcaagcugaucgagcacaaccagcggggcauccuggccaugcucgacgaggagugccugcgccccggcguggucagcgacuccacguuccuggccaagcucaaccagcuguucagcaagcacgggcacuacgaguccaaggugacccagaacgcccagcgccaguacgaccacaccaugggccugagcugcuuccggaucugccacuacgccgggaaggugaccuacaacgucacguccuucaucgacaagaacaacgaccuccucuuccgcgaccugcugcaggcgauguggaaggcccagcacccccuccugcggagccuguuccccgagggcaacccgaagcaggccucccucaagcgcccgcccaccgccggggcgcaguucaagagcuccguggccauccugaugaagaaccuguacagcaagucccccaacuacauccggugcaucaagcccaacgagcaccagcagcgcggccaguucagcuccgaccucguggccacccaggcccgguaccugggccugcucgagaacguccgcgugcggcgcgccggguacgcgcaccggcagggcuacgggcccuuccuggagcgcuaccggcugcucagccgcagcaccuggccccacuggaacggcggcgaccgggaggggguggagaagguccugggcgagcuguccaugagcuccggggagcucgccuucggcaagacgaagaucuucauccgcagccccaagacccuguucuaccuggaggagcagcggcgccuccggcugcagcagcuggccacccucauccagaagaucuaccgcggguggcgcugccggacccacuaccagcugaugcgcaagucccagauccugaucagcuccugguuccggggcaacaugcagaagaagugcuacggcaagaucaaggccagcgugcuccugauccaggccuucgugcgcggguggaaggcgcggaagaacuaccgcaaguacuuccgguccgaggccgcccugacgcucgccgacuucaucuacaagagcaugguccagaaguuccugcugggccucaagaacaaccugccguccaccaacgugcuggacaagaccuggcccgccgcgcccuacaagugccucagcaccgccaaccaggagcugcagcagcuguucuaccaguggaagugcaagcgcuuccgggaccagcucucccccaagcaggucgagauccugcgcgagaagcugugcgccagcgagcuguucaaggggaagaaggccuccuacccgcagagcgugcccauccccuucugcggcgacuacaucgggcugcagggcaaccccaagcugcagaagcucaagggcggggaggagggcccggugcugauggcggaggccgugaagaaggucaaccgggggaacggcaagacguccagccgcauccugcuccugaccaaggggcacgugauccugaccgacaccaagaagucccaggccaagaucgugaucggccucgacaacgucgccggcgugagcgugacgagccugaaggacgggcuguucucccuccaccugagcgagauguccagcgucggcuccaagggggacuuccugcucgugagcgagcacgugaucgagcugcugaccaagauguaccgggccguccucgacgcgacccagcgccagcugaccgugacggugaccgagaaguucuccguccgguucaaggagaacagcguggccgugaaggucgugcagggccccgccgggggcgacaacuccaagcugcgcuacaagaagaagggcagccacugccucgaggugaccguccaguga

SEQ ID NO: 33300 - RNA, 3237 nt, Artificial Sequence
  derived and/or modified sequence opt1 from MYO1B__Homo_sapiens__NP_036355
auggccaagauggaggugaagaccagccugcucgacaacaugaucggcgucggggacauggugcugcuggagccccucaacgaggagaccuucaucaacaaccugaagaagcgcuucgaccacuccgagaucuacacguacaucggcagcguggucaucuccgugaacccguaccggagccugcccaucuacucccccgagaagguggaggaguaccgcaaccggaacuucuacgagcucagcccccacaucuucgcccuguccgacgaggcguaccgcagccugcgggaccaggacaaggaccagugcauccucaucaccggggaguccggcgccgggaagaccgaggccagcaagcuggucauguccuacguggccgccgugugcggcaagggcgcggaggucaaccaggugaaggagcagcugcuccagagcaacccggugcuggaggccuucgggaacgccaagaccguccgcaacgacaacuccagccgguucggcaaguacauggacaucgaguucgacuucaagggggacccccugggcggggugaucuccaacuaccuccuggagaagucccgcguggucaagcagccccggggcgagcgcaacuuccacguguucuaccagcugcucagcggcgccagcgaggagcugcugaacaagcucaagcuggagcgggacuucucccgcuacaacuaccugagccucgacagcgcgaaggugaacggggucgacgacgccgccaacuuccggacggugcgcaacgccaugcagaucgugggcuucauggaccacgaggccgaguccguccuggcggugguggccgccguccugaagcucgggaacaucgaguucaagcccgagagccgggugaacggccuggacgaguccaagaucaaggacaagaacgagcugaaggagaucugcgagcucaccggcaucgaccagagcguccuggagcgcgccuucuccuuccggaccguggaggccaagcaggagaaggugagcaccacgcugaacgucgcgcaggccuacuacgcccgcgacgcccucgccaagaaccuguacucccggcuguucagcuggcucgugaaccgcaucaacgaguccaucaaggcgcagaccaaggugcggaagaaggucaugggggugcuggacaucuacggcuucgagaucuucgaggacaacagcuucgagcaguucaucaucaacuacugcaacgagaagcugcagcagaucuucaucgagcucacccugaaggaggagcaggaggaguacauccgcgaggacaucgaguggacccacaucgacuacuucaacaacgccaucaucugcgaccugaucgagaacaacacgaacgggauccucgccaugcuggacgaggagugccugcgcccgggcaccgugaccgacgagaccuuccucgagaagcugaaccaggucugcgccacgcaccagcacuucgagucccggaugagcaagugcucccgcuuccugaacgacaccagccucccccacuccugcuuccggauccagcacuacgccgggaaggugcuguaccagguggagggcuucgucgacaagaacaacgaccugcuguaccgcgaccucagccaggcgauguggaaggccucccacgcccugaucaagagccuguuccccgagggcaaccccgccaagaucaaccucaagcggccgcccaccgcggggucccaguucaaggccagcguggccacccugaugaagaaccugcagacgaagaaccccaacuacauccgcugcaucaagcccaacgacaagaaggccgcccacaucuucaacgaggcgcucgugugccaccagauccgguaccugggccugcucgagaacguccgcgugcggcgcgccggguacgccuuccggcaggccuacgagccgugccuggagcgcuacaagaugcugugcaagcagaccuggccccacuggaagggccccgcccggagcgggguggagguccucuucaacgagcuggagauccccguggaggaguacuccuucggccgcagcaagaucuucauccggaacccgcgcacccuguucaagcucgaggaccugcggaagcagcgccuggaggaccucgcgacccugauccagaagaucuaccggggcuggaagugccgcacgcacuuccugcucaugaagaagucccagaucgugaucgccgccugguaccgccgguacgcccagcagaagcgcuaccagcagaccaagagcuccgcccuggucauccagagcuacauccggggguggaaggcgcgcaagauccugcgggagcucaagcaccagaagcgcugcaaggaggccgugaccaccaucgccgccuacuggcacggcacccaggugcggcgcgaguaccggaaguucuuccgcgcgaacgccgggaagaagaucuacgaguucacccugcagcggaucguccagaaguacuuccuggagaugaagaacaagaugcccucccucagccccaucgacaagaacuggcccucccgcccguaccuguuccuggacagcacccacaaggagcucaagcggaucuuccaccuguggcgcugcaagaaguaccgggaccaguucaccgaccagcagaagcugaucuacgaggagaagcucgaggccuccgagcuguucaaggacaagaaggcccuguaccccagcuccgugggccagcccuuccagggggccuaccucgagaucaacaagaaccccaaguacaagaagcugaaggacgcgaucgaggagaagaucaucaucgccgagguggucaacaagaucaaccgcgccaacggcaagagcacgucccggaucuuccugcucaccaacaacaaccugcugcucgccgaccagaaguccggccagaucaagagcgaggugccgcugguggacgucaccaaggugagcaugagcucccagaacgacggguucuucgccgugcaccugaaggagggcagcgaggcggccuccaagggggacuuccucuucagcuccgaccaccugaucgagauggccaccaagcuguaccgcacgacccucagccagaccaagcagaagcugaacaucgagaucuccgacgaguuccugguccaguuccggcaggacaaggugugcgugaaguucauccagggcaaccagaagaacggcagcguccccacgugcaagcgcaagaacaaccggcuccuggagguggccgugcccuga

SEQ ID NO: 33301 - RNA, 3192 nt, Artificial Sequence
  derived and/or modified sequence opt1 from MYO1C__Homo_sapiens__NP_001074248
auggcccuccagguggagcucguccccaccggcgagaucauccgcguggugcacccgcaccggcccugcaagcuggcccuggggagcgacggcguccgcgugaccauggaguccgcgcucacggcccgggaccgcguggggguccaggacuucgugcugcuggagaacuucaccagcgaggccgccuucaucgagaaccuccggcgccgguuccgcgagaaccugaucuacaccuacaucggccccgugcuggucuccgugaaccccuaccgggaccuccagaucuacagccgccagcacauggagcgguaccgcgggguguccuucuacgaggucccgccccaccuguucgccguggcggacaccguguaccgggcccugcgcacggagcggcgcgaccaggccgucaugaucagcggcgaguccggcgccgggaagaccgaggcgaccaagcggcuccugcaguucuacgccgagaccugccccgcccccgagcgcggcggggccgugcgggaccgccugcuccagagcaacccggugcuggaggccuucggcaacgcgaagacgcugcggaacgacaacuccagccgcuucgggaaguacauggacguccaguucgacuucaagggcgcccccgugggcgggcacauccucuccuaccugcuggagaagucccgcgugguccaccagaaccacggcgagcggaacuuccacaucuucuaccagcuccuggagggcggggaggaggagacccugcgccggcucggccuggagcgcaacccccaguccuaccuguaccucgugaaggggcagugcgccaaggugagcuccaucaacgacaagagcgacuggaaggucgugcggaaggcccugaccgucaucgacuucaccgaggacgagguggaggaccugcucuccaucguggccagcguccugcaccugggcaacauccacuucgcggccaacgaggaguccaacgcccaggugacgaccgagaaccagcucaaguaccugacccgccugcucagcguggaggggagcacccugcgggaggcccugacgcaccgcaagaucaucgccaagggcgaggagcuccugagcccccugaaccucgagcaggcggccuacgcccgggacgcccuggccaaggcggucuacagccgcaccuucaccuggcugguggggaagaucaaccggucccucgccagcaaggacguggaguccccgagcuggcgcuccaccacgguccugggccugcucgacaucuacggcuucgagguguuccagcacaacagcuucgagcaguucugcaucaacuacugcaacgagaagcugcagcagcuguucaucgagcugacccucaaguccgagcaggaggaguacgaggccgaggggaucgccugggagcccgugcaguacuucaacaacaagaucaucugcgaccuggucgaggagaaguucaagggcaucaucagcauccuggacgaggagugccuccggcccggggaggcgaccgaccugaccuuccuggagaagcucgaggacacggugaagcaccacccccacuuccugacccacaagcuggccgaccagcgcacccggaagucccucggccgcggggaguuccggcugcugcacuacgccggcgaggugaccuacagcgucacgggcuuccucgacaagaacaacgaccugcuguuccgcaaccucaaggagaccaugugcuccagcaagaacccgaucaugucccagugcuucgaccggagcgagcuguccgacaagaagcgccccgagaccguggccacccaguucaagaugagccugcuccagcugguggagauccugcaguccaaggagcccgccuacguccgcugcaucaagcccaacgacgcgaagcagccggggcgguucgacgaggugcucauccgccaccaggugaaguaccugggccugcucgagaaccugcggguccgccgggccggguucgccuaccgccggaaguacgaggccuuccugcagcgcuacaagagccucugccccgagacguggcccaccugggccggccggccccaggacgggguggcggugcugguccgccaccugggcuacaagccggaggaguacaagaugggccggaccaagaucuucauccgcuuccccaagacccucuucgccacggaggacgcccuggaggugcggcgccagagccuggccaccaagauccaggccgcguggcggggguuccacuggcgccagaaguuccuccgggugaagcgcuccgccaucugcauccagagcugguggcggggcacccuggggcgccggaaggccgccaagcgcaagugggcggcccagaccauccgccggcugauccgcggcuucguccuccggcacgcgccccgcugccccgagaacgccuucuuccuggaccacgugcggaccuccuuccugcucaaccugcgccggcagcugccgcagaacgugcucgacacgagcuggcccacgcccccgcccgcccugcgcgaggccuccgagcugcuccgggagcugugcaucaagaacauggucuggaaguacugccgcagcaucucccccgaguggaagcagcagcugcagcagaaggccguggccagcgagaucuucaagggcaagaaggacaacuacccccaguccgugccgcggcuguucaucagcacccgccuggggaccgacgagaucagcccccggguccugcaggcccucggcuccgagcccauccaguacgccgugcccguggucaaguacgaccgcaagggguacaagccgcggucccgccagcugcugcucacccccaacgcgguggugaucgucgaggacgccaaggugaagcagcggaucgacuacgccaaccugaccggcaucagcguguccagccuguccgacagccucuucguccugcacgugcagcgcgccgacaacaagcagaagggggacgugguccugcagagcgaccacgugaucgagacccucaccaagacggcccuguccgcgaaccgggugaacagcaucaacaucaaccagggcuccaucaccuucgccggcgggcccggccgcgacgggaccaucgacuucacccccggcagcgagcugcucaucacgaaggccaagaacgggcaccuggccgucguggcgccgcgccugaacucccgguga

SEQ ID NO: 33302 - RNA, 3021 nt, Artificial Sequence
  derived and/or modified sequence opt1 from MYO1D__Homo_sapiens__NP_056009
auggccgagcaggagagccuggaguucggcaaggccgacuucgugcucauggacaccgucuccaugcccgaguucauggcgaaccugcgccugcgguucgagaaggggcgcaucuacaccuucaucggcgaggugguggucagcgugaacccguacaagcuccugaacaucuacgggcgggacacgaucgagcaguacaagggccgcgagcuguacgagcggccgccccaccucuucgccaucgccgacgccgccuacaaggcgaugaagcgccgguccaaggacacgugcaucgugaucagcggggaguccggcgccggcaagaccgaggccagcaaguacaucaugcaguacaucgccgcgaucaccaaccccucccagcgcgccgaggucgagcgggugaagaacaugcugcucaagagcaacugcgugcuggaggccuucgggaacgccaagaccaaccgcaacgacaacuccagccgguucggcaaguacauggacaucaacuucgacuucaagggggaccccaucggcgggcacaucaacaacuaccugcuggagaagucccgcgucaucgugcagcagcccggcgagcggagcuuccacuccuucuaccagcuccugcagggcgggagcgagcagaugcugcgcucccuccaccuccagaagucccugagcagcuacaacuacauccacgugggcgcccagcugaaguccagcaucaacgacgcggccgaguuccgggucguggccgacgccaugaaggugaucggguucaagcccgaggagauccagaccgucuacaagauccuggccgcgauccugcaccucggcaaccugaaguucgugguggacggcgacacgccccugaucgagaacgggaaggucgugagcaucaucgccgagcuccuguccaccaagaccgacaugguggagaaggcccugcucuaccgcaccgucgccaccggccgggacaucaucgacaagcagcacaccgagcaggaggccagcuacgggcgcgacgcguucgccaaggccaucuacgagcggcuguucugcuggaucgugacgcgcaucaacgacaucaucgaggugaagaacuacgacaccaccauccacggcaagaacaccgucaucggggugcuggacaucuacggcuucgagaucuucgacaacaacuccuucgagcaguucugcaucaacuacugcaacgagaagcuccagcagcuguucauccagcugguccucaagcaggagcaggaggaguaccagcgggagggcaucccguggaagcacaucgacuacuucaacaaccagaucaucguggaccugguggagcagcagcacaaggggaucaucgccauccuggacgacgccugcaugaacgucggcaaggugacggacgagauguuccucgaggcgcugaacagcaagcuggggaagcacgcccacuucuccagccgcaagcucugcgccuccgacaagauccuggaguucgaccgcgacuuccggauccgccacuacgccggcgacguggucuacagcgugaucggguucaucgacaagaacaaggacacccuguuccaggacuucaagcggcucauguacaacuccagcaaccccgugcugaagaacauguggcccgagggcaagcuguccaucaccgaggucaccaagcgcccccucacggcggccacccuguucaagaacagcaugaucgcccugguggacaaccucgccuccaaggagccguacuacgugcggugcaucaagcccaacgacaagaaguccccgcagaucuucgacgacgagcgcugccggcaccaggucgaguaccugggccugcuggagaacgugcgcgugcggcgcgccggguucgcguuccggcagaccuacgagaaguuccuccaccgcuacaagaugaucagcgaguucaccuggcccaaccacgaccugcccagcgacaaggaggccgucaagaagcugaucgagcggugcggcuuccaggacgacguggccuacgggaagacgaagaucuucauccgcacgccccggacccucuucacccuggaggagcugcgcgcccagaugcucauccggaucgugcuguuccugcagaaggucuggcgcggcacccucgcccggaugcgcuacaagcgcaccaaggcggcccugaccaucauccgguacuaccgccgguacaaggugaaguccuacauccacgagguggcccgccgguuccacggggucaagaccaugcgcgacuacggcaagcacgugaaguggcccagcccgcccaaggugcugcggcgcuucgaggaggcccuccagacgaucuucaaccgguggcgcgccucccagcugaucaagagcauccccgcgagcgaccugccccagguccgggccaagguggccgccguggagaugcucaagggccagcgcgcggaccuggggcugcagcgggccugggagggcaacuaccucgccuccaagcccgacaccccgcagaccagcgggaccuucguccccguggccaacgagcugaagcgcaaggacaaguacaugaacgugcuguucuccugccacguccggaaggugaaccgcuucagcaagguggaggaccgggccaucuucgucacggaccgccaccucuacaagauggaccccaccaagcaguacaaggugaugaagaccaucccccuguacaaccugaccggccucuccgugagcaacggcaaggaccagcuggucguguuccacaccaaggacaacaaggaccugaucgugugccucuucuccaagcagccgacgcacgagagccggaucggggagcuggucggcgugcuggugaaccacuucaaguccgagaagcgccaccuccaggucaacgugaccaaccccgugcagugcagccugcacgggaagaagugcaccgucuccguggagacccggcugaaccagccccagccggacuucacgaagaaccgcagcggcuucauccucuccgugcccgggaacuga

SEQ ID NO: 33303 - RNA, 3327 nt, Artificial Sequence
  derived and/or modified sequence opt1 from MYO1E__Homo_sapiens__NP_004989
augggcagcaaggggguguaccaguaccacuggcagucccacaacgucaagcacagcggcguggacgacauggugcugcucuccaagaucaccgagaacagcaucgucgagaaccugaagaagcgcuacauggacgacuacaucuucaccuacaucggguccgugcugaucagcgugaaccccuucaagcagaugccguacuucggcgagaaggagaucgagauguaccagggggccgcccaguacgagaaccccccccacaucuacgcgcucgccgacaacauguaccggaacaugaucaucgaccgcgagaaccagugcgucaucaucuccggcgagagcggcgccgggaagacgguggccgccaaguacaucauguccuacaucagccggguguccggcgggggcaccaagguccagcacgugaaggacaucauccugcagagcaacccccugcucgaggcguucgggaacgccaagaccgugcgcaacaacaacuccagccgguucggcaaguacuucgagauccaguucuccccgggcggggagcccgacggcgggaagaucagcaacuuccugcuggagaagucccgcgucgugaugcggaaccccggcgagcgcagcuuccacaucuucuaccagcucaucgagggcgccuccgccgagcagaagcacagccuggggaucaccagcauggacuacuacuacuaccugucccucagcggcuccuacaagguggacgacaucgacgaccggcgcgaguuccaggagacgcugcacgcgaugaacgucaucgggaucuucgccgaggagcagacccuggugcuccagaucguggccggcauccugcaccuggggaacaucagcuucaaggaggucggcaacuacgccgccguggaguccgaggaguuccucgcguuccccgccuaccugcugggcaucaaccaggaccggcucaaggagaagcugaccagccgccagauggacuccaagugggggggcaagagcgaguccauccacgugacccugaacgucgagcaggccugcuacacgcgggacgcccucgccaaggcgcugcacgcccgcguguucgacuuccugguggacagcaucaacaaggccauggagaaggaccacgaggaguacaacaucgggguccucgacaucuacggcuucgagaucuuccagaagaacggguucgagcaguucugcaucaacuucgugaacgagaagcugcagcagaucuucaucgagcugacccucaaggccgagcaggaggaguacguccaggagggcauccgguggaccccgaucgaguacuucaacaacaagaucgugugcgaccugaucgagaacaaggugaacccccccggcaucauguccauccuggacgacgucugcgccaccaugcacgcggugggggagggcgccgaccagacgcuccugcagaagcugcagaugcagaucgggagccacgagcacuucaacuccuggaaccagggcuucaucauccaccacuacgccgggaaggugagcuacgacauggacggcuucugcgagcgcaaccgggacguccucuucauggaccugaucgagcugaugcaguccagcgagcuccccuucaucaagucccuguucccggagaaccugcaggccgacaagaagggccgccccaccaccgccgggagcaagaucaagaagcaggcgaacgaccucguguccacccugaugaagugcacgccccacuacauccggugcaucaagcccaacgagaccaagaagccgcgcgacugggaggagagccgggugaagcaccaggucgaguaccugggccucaaggagaacauccgcgugcgccgggccggguacgccuaccgccggaucuuccagaaguuccugcagcgcuacgccauccugaccaaggcgaccuggcccagcuggcagggcgaggagaagcagggcgugcuccaccugcugcaguccgucaacauggacagcgaccaguuccagcuggggcgguccaagguguucaucaaggcccccgagagccucuuccugcuggaggagaugcgcgagcggaaguacgacggcuacgcccgcgugauccagaaguccuggcggaaguucgucgcccgcaagaaguacgugcagaugcgggaggaggccagcgaccuccugcugaacaagaaggagcgccggcgcaacuccaucaaccggaacuucaucggggacuacaucggcauggaggagcaccccgagcuccagcaguucguggggaagcgcgagaagaucgacuucgcggacacggucaccaaguacgaccggcgcuucaagggcgugaagcgggaccugcugcucaccccgaagugccuguaccugaucggccgcgagaaggugaagcaggggcccgacaagggccucgucaaggaggugcugaagcgcaagaucgagaucgagcggauccugagcgugucccucagcaccaugcaggacgacaucuucauccugcacgagcaggaguacgacucccugcucgagagcgucuucaagacggaguuccugucccugcucgccaagcgcuacgaggagaagacccagaagcagcugccccugaaguucagcaacacccucgagcugaagcugaagaaggagaacugggggcccugguccgccggcgggagccggcaggugcaguuccaccagggcuucggcgaccucgccgugcugaagccguccaacaagguccugcaggugagcaucgggcccggccuccccaagaacagccgccccacccggcgcaacacgacccagaacaccggguacuccagcggcacccagaacgccaacuacccggugcgggcggccccccccccgcccggguaccaccagaacggcgucauccgcaaccaguacgugcccuacccccacgccccgggcucccagcggagcaaccagaagucccuguacacgagcauggcccgccccccccugccccggcagcaguccaccagcuccgaccgcgugagccagaccccggagucccucgacuuccugaagguccccgaccagggggccgcgggcgugcggcgccagaccacgagccggccccccccggccgggggccgccccaagccccagcccaagccgaagccccaggugccccagugcaaggcccuguacgccuacgacgcgcaggacaccgacgagcucuccuucaacgccaacgacaucaucgacaucaucaaggaggaccccagcgggugguggaccggccggcugcgcggcaagcaggggcuguucccgaacaacuacgucaccaagaucuga

SEQ ID NO: 33304 - RNA, 3297 nt, Artificial Sequence
  derived and/or modified sequence opt1 from MYO1F__Homo_sapiens__NP_036467
augggcagcaaggagcgcuuccacuggcagucccacaacgugaagcagagcggggucgacgacauggugcugcucccccagaucaccgaggacgccaucgccgcgaaccugcggaagcgcuucauggacgacuacaucuucaccuacaucggcuccgugcugaucagcgucaacccguucaagcagaugcccuacuucacggaccgggagaucgaccucuaccagggggccgcccaguacgagaacccgccccacaucuacgcccugaccgacaacauguaccgcaacaugcugaucgacugcgagaaccagugcgugaucaucuccggcgagagcggggccggcaagaccguggcggccaaguacaucaugggcuacaucuccaaggucagcgggggcggggagaaggugcagcacgugaaggacaucauccuccaguccaacccccugcuggaggccuucggcaacgccaagaccguccggaacaacaacagcucccgcuucgggaaguacuucgagauccaguucagccggggcggcgagcccgacgggggcaagaucuccaacuuccuccuggagaagucccgcguggugaugcagaacgagaacgagcggaacuuccacaucuacuaccagcugcucgagggggcgucccaggagcagcgccagaaccugggccugaugacgcccgacuacuacuacuaccucaaccagagcgacaccuaccaggucgacggcaccgacgaccgguccgacuucggggagacccugagcgccaugcaggucaucggcaucccgcccuccauccagcagcuggugcuccagcuggucgccgggauccugcaccucggcaacaucagcuucugcgaggacgggaacuacgcccgcguggagagcguggaccugcuggccuuccccgcguaccuccugggcaucgacuccggccggcugcaggagaagcucacgagccgcaagauggacucccgguggggcgggcgcagcgaguccaucaacgucacccugaacguggagcaggccgccuacacccgggacgcccuggccaaggggcucuacgcgcgccuguucgacuuccugguggaggccaucaaccgggccaugcagaagccccaggaggaguacagcaucggcgugcucgacaucuacggguucgagaucuuccagaagaacggcuucgagcaguucugcaucaacuucgugaacgagaagcugcagcagaucuucaucgagcugacccucaaggccgagcaggaggaguacgugcaggagggcauccgcuggacgcccauccaguacuucaacaacaaggucgugugcgaccugaucgagaacaagcugagcccgcccgggaucaugagcguccucgacgacgugugcgccaccaugcacgcgaccggcgggggcgccgaccagacccugcugcagaagcuccaggccgccguggggacgcacgagcacuucaacuccuggagcgccggcuucgucauccaccacuacgcgggcaagguguccuacgacgugagcggguucugcgagcggaaccgcgacguccuguucuccgaccugaucgagcucaugcagaccagcgagcaggccuuccugcgcaugcuguuccccgagaagcucgacggcgacaagaaggggcggcccuccaccgccggcagcaagaucaagaagcaggccaacgaccugguggcgacccugaugcgcugcacgccgcacuacauccggugcaucaagcccaacgagaccaagcgcccccgggacugggaggagaaccgcgugaagcaccaggucgaguaccugggccucaaggagaacauccgggugcgccgggccggguucgccuaccgccggcaguucgccaaguuccugcagcgcuacgccauccugacccccgagaccuggccgcgguggcgcggcgacgagcggcagggggugcagcaccuccugcgcgcggucaacauggagcccgaccaguaccagaugggcuccacgaagguguucgugaagaaccccgagagccuguuccuccuggaggagguccgggagcgcaaguucgacggguucgcccggaccauccagaaggccuggcgccgccacguggccgugcggaaguacgaggagaugcgcgaggaggccuccaacauccugcucaacaagaaggagcggcgccggaacagcaucaaccgcaacuucgucggcgacuaccugggccuggaggagcggcccgagcuccgccaguuccuggggaagcgggagcgcguggacuucgcggacagcgugaccaaguacgaccggcgcuucaagccgaucaagcgggaccugauccucacccccaagugcgucuacgugaucggccgcgagaaggugaagaaggggcccgagaagggccaggucugcgaggugcugaagaagaagguggacauccaggcccugcgcggggucucccucagcacgcggcaggacgacuucuucauccugcaggaggacgccgccgacuccuuccuggagagcguguucaagaccgaguucgugucccuccugugcaagcgguucgaggaggccacccgccggccccugccgcucaccuucagcgacacgcugcaguuccgcgucaagaaggagggcuggggcgggggcgggacccgguccgugaccuucagccgcggcuucggggaccuggcggugcucaaggucggcggccgcacccugacgguguccgugggggacggccugcccaagagcuccaagcccacccggaaggggauggccaagggcaagccgcgccggagcucccaggcccccacccgcgccgcgcccgcgcccccgcgggggauggaccgcaacggcgucccgcccagcgcccggggcgggccccucccccuggagaucauguccggcgggggcacccaccgcccgccccggggcccgcccagcaccucccugggggccagccgccggccccgcgcccggccgcccagcgagcacaacacggaguuccucaacgugcccgaccagggcauggccgggaugcagcgcaagcgguccgugggccagcgccccguccccggggugggccggcccaagccccagccccgcacccacggcccccggugccgcgcccuguaccaguacguggggcaggacgucgacgagcugagcuucaacgugaacgaggugaucgagauccucauggaggaccccuccggcugguggaaggggcgccugcacggccaggaggggcuguucccgggcaacuacgucgagaagaucuga

SEQ ID NO: 33305 - RNA, 4851 nt, Artificial Sequence
  derived and/or modified sequence opt1 from MYO3A__Homo_sapiens__XP_011517803
auguucccccugaucggcaagaccaucaucuucgacaacuucccggaccccagcgacaccugggagaucacggagaccaucgggaagggcaccuacgggaagguguucaagguccucaacaagaagaacggccagaaggccgccgugaagauccuggaccccauccacgacaucgacgaggagaucgaggcggaguacaacauccugaaggcccucuccgaccaccccaacgugguccgcuucuacgggaucuacuucaagaaggacaaggugaacggcgacaagcuguggcuggugcucgagcugugcagcggcggguccgucaccgaccuggugaagggcuuccucaagcgcggggagcggaugagcgagccgcugaucgccuacauccugcacgaggcccucaugggccugcagcaccuccacaacaacaagacgauccaccgggacgugaaggggaacaacauccugcugaccaccgagggcggcgucaagcugguggacuucgggguguccgcccagcucaccagcacgcgccaccggcgcaacaccuccgucggcacccccuucuggauggcgcccgaggugaucgccugcgagcagcagcuggacaccacguacgacgcccggugcgacaccuggagccuggggaucaccgccaucgagcucggcgacggcgacccgccccuggcggaccugcaccccaugcgcgcccucuucaagaucccccggaacccgccgcccaagcugcgccagcccgagcugugguccgccgaguucaacgacuucaucagcaagugccucaccaaggacuacgagaagcggcccacgguguccgagcugcugcagcacaaguucaucacccagaucgaggggaaggacgucaugcuccagaagcagcugaccgaguucaucggcauccaccagugcaugggcgggaccgagaaggcccgccgggagcgcauccacacgaagaaggggaacuucaaccggccccugaucagcaaccucaaggacguggacgaccuggccacccuggagauccucgacgagaacaccguguccgagcagcuggagaagugcuacagccgcgaccagaucuacgucuacgugggcgacauccugaucgcgcucaaccccuuccagucccugggccuguacagcaccaagcacuccaagcucuacaucgggagcaagcggacggccuccccgccccacaucuucgccauggccgaccugggcuaccagagcaugaucaccuacaacagcgaccagugcaucgugaucuccggggagagcggcgccgggaagaccgagaacgcgcaccuccugguccagcagcugaccgugcugggcaaggccaacaaccgcacgcuccaggagaagauccuccaggugaacaaccuggucgaggccuucggcaacgccugcaccaucaucaacgacaacuccagccgguucgggaaguaccuggagaugaaguucaccuccagcggcgccguggucggggcgcagaucuccgaguaccugcuggagaagucccgcgugauccaccaggccaucggcgagaagaacuuccacaucuucuacuacaucuacgccgggcuggccgagaagaagaagcucgcccacuacaagcugcccgagaacaagccgccccgguaccugcagaacgaccaccuccgcaccgugcaggacaucaugaacaacagcuucuacaagagccaguacgagcugaucgagcagugcuucaaggucaucggcuucacgauggagcagcugggcuccaucuacagcauccucgcggccauccugaacguggggaacaucgaguucuccagcguggccaccgagcaccagaucgacaagucccacaucagcaaccacaccgcccuggagaacugcgcgucccuccugugcauccgcgccgacgagcugcaggaggcccucaccagccacugcgucgugacgcggggcgagaccaucauccgccccaacaccguggagaaggccaccgacguccgggacgccauggcgaagacccuguacgggcgccuguucuccuggaucgugaacugcaucaacagccuccugaagcacgacagcucccccagcggcaacggcgacgagcuguccaucgggauccucgacaucuucggcuucgagaacuucaagaagaacagcuucgagcagcugugcaucaacaucgccaacgagcagauccaguacuacuacaaccagcacguguucgccugggagcagaacgaguaccugaacgaggacgucgacgcccgggugaucgaguacgaggacaacuggccccuccuggacauguuccugcagaagcccauggggcuccugucccugcucgacgaggagagccgcuuccccaaggccacggaccagacccugguggagaaguucgagggcaaccugaagucccaguacuucuggcggccgaagcgcauggagcucagcuucgggauccaccacuacgcgggcaagguccuguacaacgccuccggcuuccuggccaagaaccgggacacccuccccaccgacaucgugcugcugcuccgcagcuccgacaacagcgugauccggcagcuggucaaccacccccugacgaagaccgggaaccucccgcacuccaagaccaagaacgugaucaacuaccagaugcgcaccagcgagaagcugaucaaccuggccaagggcgacacgggggaggccacccggcacgcgcgcgagaccaccaacaugaagacgcagaccguggccuccuacuuccgguacagccucauggaccugcuguccaagauggucgugggccagccccacuucgugcgcugcaucaagcccaacagcgagcggcaggcccgcaaguacgacaaggagaagguccuccugcagcugcgguacaccgggauccucgagaccgcccgcauccgccggcugggcuucagccaccgcauccuguucgcgaacuucaucaagcgguacuaccuccugugcuacaaguccagcgaggagccccgcauguccccggacacgugcgccaccauccuggagaaggccggccucgacaacugggcccuggggaagaccaagguguuccugaaguacuaccacguggagcagcucaaccugaugcggaaggaggccaucgacaagcugauccucauccaggcgugcguccgcgccuuccugugcagccggcgcuaccagaagauccaggagaagcggaaggaguccgccaucaucauccagagcgccgcccgcggccaccuggugcggaagcagcgcaaggagaucguggacaugaagaacaccgcggucacgaccauccagaccuccgaccaggaguucgacuacaagaagaacuucgagaacacccgggagagcuucgugaagaagcaggccgagaacgccaucuccgccaacgagcgcuucaucagcgcccccaacaacaagggguccgugagcgucgugaagacguccaccuucaagcccgaggaggagaccaccaacgcgguggagagcaacaaccgggucuaccagacgcccaagaagaugaacaacguguacgaggaggaggugaagcaggaguucuaccucgucggcccggaggugucccccaagcagaaguccgugaaggaccuggaggagaacagcaaccugcgcaaggucgagaaggaggaggccaugauccagagcuacuaccagcgguacaccgaggagcgcaacugcgaggaguccaaggccgccuaccucgagcggaaggcgaucagcgagcgccccagcuaccccgugccguggcuggccgagaacgagaccuccuucaagaagacccuggagcccacgcucagccagcgguccaucuaccagaacgccaacagcauggagaaggagaagaagaccuccguggucacccagcgcgcccccaucugcagccaggaggaggggcgcggccggcugcgccacgagaccgugaaggagcgccagguggagcccgucacgcaggcccaggaggaggaggacaaggcggccguguucauccaguccaaguaccggggcuacaagcggcgccagcagcugcggaaggacaagaugagcuccuucaagcaccagcgcaucgugaccaccccgaccgaggucgcccggaacacccacaaccucuacagcuaccccacgaagcacgaggagaucaacaacaucaagaagaaggacaacaaggacuccaaggccaccagcgagcgcgaggccugcgggcuggcgaucuucuccaagcagaucagcaagcuguccgaggaguacuucauccuccagaagaagcugaacgagaugauccugagccagcagcucaagucccuguaccugggcgugagccaccacaagcccaucaaccggcgcgucuccagccagcagugccucagcggggugugcaagggcgaggagcccaagauccugcggccgccccgccggccccgcaagcccaagacccugaacaacccggaggacuccaccuacuacuaccuccugcacaagagcauccaggaggagaagcggcgcccccggaaggacucccaggggaagcugcucgaccuggaggacuucuacuacaaggaguuccugcccagccgcuccggcccgaaggagcacagccccucccuccgcgagcggcgcccccagcaggagcugcagaaccagugcaucaaggccaacgagcggugcugggccgccgagagccccgagaaggaggaggagcgcgagccggccgcgaaccccuacgacuuccggcgccugcugcggaagacgucccagcgccggcgccucgugcagcagagcuga

SEQ ID NO: 33306 - RNA, 3945 nt, Artificial Sequence
  derived and/or modified sequence opt1 from MYO3B__Homo_sapiens__NP_001077084
augaagcaccuguacggccucuuccacuacaaccccaugaugcuggggcuggagagccucccggaccccaccgacaccugggagaucaucgagaccaucggcaaggggaccuacggcaagguguacaaggucaccaacaagcgcgacgggucccuggccgccgugaagauccuggaccccgugagcgacauggacgaggagaucgaggcggaguacaacauccuccaguuccugcccaaccacccgaacgucgugaaguucuacggcauguucuacaaggccgaccacugcgugggcgggcagcuguggcucguccuggagcugugcaacggcggguccgugaccgagcucgugaagggccugcugcggugcgggcagcgccucgacgaggccaugaucagcuacauccuguacggcgcccugcucggccugcagcaccuccacaacaaccggaucauccaccgcgacgucaaggggaacaacauccugcugacgaccgagggcggggugaagcugguggacuucggcgucuccgcccagcucaccagcacccggcugcgccggaacacguccgugggcacccccuucuggauggcgcccgaggugaucgccugcgagcagcaguacgacagcuccuacgacgcccgcugcgacgucuggagccuggggaucaccgccaucgagcucggcgacggggacccgccccuguucgacaugcaccccgugaagacccuguucaagaucccccggaacccgccgcccacgcuccugcaccccgagaaguggugcgaggaguucaaccacuucaucucccagugccugaucaaggacuucgagcgccggcccagcgugacccaccuccuggaccaccccuucaucaagggcguccacgggaaggugcuguuccuccagaagcagcuggcgaaggugcugcaggaccagaagcaccagaaccccgucgccaagacccgccacgagcggaugcacacccgccggcccuaccacguggaggacgccgagaaguacugccucgaggacgaccuggugaaccuggagguccucgacgaggacacgaucauccaccagcugcagaagcgcuacgccgaccugcucaucuacaccuacgugggcgacauccugaucgcccugaaccccuuccagaaccucuccaucuacagcccgcaguucucccggcuguaccacggcgucaagcgcgcgagcaacccgccccacaucuucgccuccgccgacgccgccuaccagugcauggugacccugagcaaggaccagugcaucgugaucuccggggagagcggcagcgggaagaccgaguccgcgcaccugaucguccagcaccucacguuccugggcaaggccaacaaccagacccugcgggagaagauccuccaggugaacagccugguggaggccuucgggaacuccugcaccgccaucaacgacaacagcucccgcuucggcaaguaccuggagaugauguucacccccacgggcgucgugaugggggcccggaucagcgaguaccuccuggagaagucccgcgugaucaagcaggcggcccgcgagaagaacuuccacaucuucuacuacaucuacgccggccugcaccaccagaagaagcucagcgacuuccggcugcccgaggagaagccgccccgcuacaucgccgacgagaccgggcgggucaugcacgacaucaccuccaaggagagcuaccgccggcaguucgaggccauccagcacugcuuccgcaucaucggcuucaccgacaaggaggugcacuccguguaccggauccuggcggggauccucaacaucggcaacaucgaguucgccgccaucagcucccagcaccagacggacaagagcgagguccccaacgccgaggcgcugcagaacgccgccuccgugcugugcaucagccccgaggagcuccaggaggcccugaccucccacugcguggucacccgcggcgagaccaucauccgggccaacacgguggaccgcgcggccgacgugcgggacgccaugagcaaggcccuguacgggcgccucuucuccuggaucgucaaccggaucaacacccugcugcagcccgacgagaacaucugcagcgccggcgggggcaugaacgugggcauccucgacaucuucggguucgagaacuuccagcgcaacagcuucgagcagcugugcaucaacaucgcgaacgagcagauccaguacuacuucaaccagcacguguucgcccuggagcagauggaguaccagaacgagggcaucgacgccguccccguggaguacgaggacaaccggccgcuccuggacauguuccugcagaagccccucgggcugcuggcccuccuggacgaggagucccgcuucccccaggccaccgaccagacccugguggacaaguucgaggacaaccuccggugcaaguacuucuggcgccccaagggcgucgagcugugcuucgggauccagcacuacgcgggcaaggugcuguacgacgccagcggcgugcucgagaagaaccgggacacgcugccggccgacgucguggugguccugcgcaccuccgagaacaagcuccugcagcagcuguucagcaucccccucaccaagaccgggaaccuggcccagacccgcgcgcggaucacgguggccuccagcucccugccgccccacuucagcgccggcaaggccaagguggacacccucgaggucauccgccaccccgaggagaccaccaacaugaagcggcagacgguggccuccuacuuccgcuacagccugauggaccugcucuccaagaugguggucgggcagccccacuucgugcggugcaucaagcccaacgacgaccgcgaggcgcugcaguucagccgggagcgcgugcuggcccagcuccgguccaccggcauccuggagaccgucagcauccgccggcagggguacucccaccgcauccuguucgaggaguucgugaagcgguacuacuaccucgccuucaccgcccaccagacgccccuggccagcaaggaguccugcguggcgauccuggagaagucccgccucgaccacuggguccugggcaagaccaagguguuccugaaguacuaccacguggagcagcucaaccugcugcuccgggaggucaucggccgcguggugguccugcaggccuacaccaagggguggcugggcgcccggcgcuacaagcgggugcgcgagaagcgggagaagggggccaucgccauccagagcggcgacaccagcaaccagagcuccgggccgcacagccccguggcggccggcacgcgcggcuccgccgagguccaggacugcagcgagcccggggaccacaaggugcuccgcggcuccguccaccggcgcagccacucccaggccgagagcaacaacgggcggacccagaccuccagcaacucccccgcggugaccgagaagaacggccacagccaggcccaguccagcccgaaggggugcgacaucuucgccggccacgccaacaagcacuccgugagcggcacggaccugcuguccagccgcaucugccaccccgcccccgaccagcaggggcucagccuguggggcgcgccccagaagccgggguccgagaacggccuggcccagaagcaccggacgccccgccggcgcugccagcagcccaagaugcucagcucccccgaggacaccauguacuacaaccagcugaacggcacccuggaguaccaggggagcaagcggaagccgcgcaagcucggccagaucaagguccuggacggggaggacgaguacuacaagucccugagccccguggacugcauccccgaggagaacaacuccgcccacccgagcuucuucuccagcuccagcaagggcgacuccuucgcccagcacuga

SEQ ID NO: 33307 - RNA, 5568 nt, Artificial Sequence
  derived and/or modified sequence opt1 from MYO5A__Homo_sapiens__NP_000250
auggccgccagcgagcuguacaccaaguucgcgcggguguggauccccgaccccgaggagguguggaaguccgccgagcuccugaaggacuacaagcccggcgacaaggugcugcuccugcaccuggaggaggggaaggaccucgaguaccaccuggaccccaagaccaaggagcugccccaccuccggaacccggacauccuggugggcgagaacgaccugaccgcccucagcuaccugcacgagcccgccgugcugcacaaccuccgcgugcgguucaucgacagcaagcugaucuacaccuacugcgggaucgugcuggucgccaucaaccccuacgagcagcuccccaucuacggcgaggacaucaucaacgcguacagcgggcagaacaugggcgacauggacccgcacaucuucgccguggccgaggaggccuacaagcagauggcgcgcgacgagcggaaccaguccaucaucgugagcggcgaguccggggccggcaagaccgucagcgccaaguacgccaugcgcuacuucgccaccguguccgggagcgcguccgaggccaacguggaggagaagguccuggccagcaaccccaucauggaguccaucggcaacgccaagacgacccggaacgacaacagcucccgcuucgggaaguacaucgagaucggcuucgacaagcgguaccgcaucaucggcgccaacaugcggaccuaccugcucgagaagucccgcgugguguuccaggcggaggaggagcggaacuaccacaucuucuaccagcugugcgccuccgccaagcugcccgaguucaagaugcuccgccuggggaacgccgacaacuucaacuacaccaagcagggcgggagccccgucaucgagggcguggacgacgccaaggagauggcgcacacgcggcaggccugcacccugcucggcaucuccgagagccaccagauggggaucuuccgcauccuggccggcauccugcaccucgggaacgugggcuucaccagccgggacgccgacuccugcaccaucccgcccaagcacgagccccugugcaucuucugcgaccugaugggggucgacuacgaggagaugugccacuggcucugccaccgcaagcuggccacggcgaccgagaccuacaucaagcccaucagcaagcugcaggccaccaacgcccgggacgcccucgcgaagcacaucuacgccaagcuguucaacuggaucguggacaacgugaaccaggcccugcacuccgccgucaagcagcacagcuucaucggcgugcucgacaucuacggcuucgagacguucgagaucaacuccuucgagcaguucugcaucaacuacgccaacgagaagcugcagcagcaguucaacaugcacguguucaagcuggagcaggaggaguacaugaaggagcagaucccguggacccucaucgacuucuacgacaaccagcccugcaucaaccugaucgagagcaagcuggggauccucgaccugcuggacgaggagugcaagaugcccaagggcaccgacgacaccugggcgcagaagcucuacaacacgcaccugaacaagugcgcccuguucgagaagccccgccuguccaacaaggccuucaucauccagcacuucgccgacaaggucgaguaccagugcgagggguuccucgagaagaacaaggacaccguguucgaggagcagaucaagguccucaagagcuccaaguucaagaugcugccggagcuguuccaggacgacgagaaggccaucagccccaccuccgcgaccagcuccggccggacgccccugacccgcacccccgccaagccgaccaaggggcgccccggccagauggccaaggagcacaagaagacggugggccaccaguuccggaacagccugcaccuccugauggagacccugaacgccaccacgccccacuacgugcgcugcaucaagcccaacgacuucaaguucccguucacguucgacgagaagcgggccguccagcagcuccgcgcgugcggggugcuggagaccauccggaucuccgccgccggcuuccccagccgcuggaccuaccaggaguucuucucccgguaccgcgugcugaugaagcagaaggacguccucagcgaccggaagcagaccugcaagaacgugcuggagaagcugauccucgacaaggacaaguaccaguucgggaagacgaagaucuucuuccgcgccggccagguggcguaccuggagaagcugcgggccgacaagcuccgcgccgccugcauccggauccagaagaccauccgcggguggcugcugcggaagaaguaccuccgcaugcggaaggccgcgaucaccaugcagcgcuacguccggggcuaccaggcccgcugcuacgccaaguuccugcgccggaccaaggccgccaccaucauccagaaguacuggcgcauguacguggugcggcgccgguacaagauccgccgggcggccacgaucguccugcaguccuaccuccgcggcuuccuggcccggaaccgcuaccggaagauccugcgcgagcacaaggccgugaucauccagaagcgggugcgcggguggcucgcccggacccacuacaagcgcagcaugcacgcgaucaucuaccugcagugcugcuuccggcgcaugauggccaagcgggagcugaagaagcucaagaucgaggcccgcagcgucgagcgguacaagaagcugcacaucggcauggagaacaagaucaugcagcugcagcgcaagguggacgagcagaacaaggacuacaagugccucguggagaagcugaccaaccuggaggggaucuacaacuccgagaccgagaagcuccgcagcgaccuggagcggcugcagcucuccgaggaggaggccaaggucgcgacgggccgcgugcugagccugcaggaggagaucgccaagcuccggaaggaccuggagcagacccgcuccgagaagaagugcaucgaggagcacgccgaccgguacaagcaggagaccgagcagcuggugagcaaccucaaggaggagaacacccugcugaagcaggagaaggaggcccucaaccaccgcaucguccagcaggccaaggagaugacggagaccauggagaagaagcugguggaggagaccaagcagcuggagcucgaccugaacgacgagcggcugcgcuaccagaaccuccugaacgaguucucccggcuggaggagcgcuacgacgaccucaaggaggagaugacccugauggugcacguccccaagccgggccacaagcggacggacagcacccacuccagcaacgaguccgaguacaucuucagcuccgagaucgcggagauggaggacauccccagccgcaccgaggagcccuccgagaagaaggugccccuggacaugagccucuuccugaagcugcagaagcgggugaccgagcucgagcaggagaagcaggucaugcaggacgagcuggaccgcaaggaggagcagguccugcgguccaaggccaaggaggaggagcgcccgcagauccgcggggccgagcucgaguacgagagccugaagcgccaggagcuggagagcgagaacaagaagcucaagaacgagcugaacgagcugcggaaggcccucuccgagaaguccgcccccgaggugacggcgcccggcgcccccgccuaccgcguccugauggagcagcugaccuccgugagcgaggagcucgacgugcgcaaggaggagguccugauccugcggucccagcucgugagccagaaggaggccauccagccgaaggacgacaagaacaccaugaccgacuccacgauccugcuggaggacgugcagaagaugaaggacaagggggagaucgcccaggcguacaucggccucaaggagaccaaccgcagcuccgcccuggacuaccacgagcugaacgaggacggggagcucuggcuggucuacgagggccugaagcaggccaaccggcuccuggagagccagcugcagucccagaagcgcagccacgagaacgaggccgaggcccuccggggcgagauccagucccugaaggaggagaacaaccgccagcagcagcugcucgcgcagaaccugcagcugccgcccgaggcccggaucgaggccagccugcagcacgagaucacccgccucaccaacgagaaccuggaccugauggagcagcucgagaagcaggacaagacggugcggaagcugaagaagcagcugaagguguucgccaagaagaucggggagcucgaggucggccagauggagaacaucucccccgggcagaucaucgacgagccgauccgccccgugaacaucccccggaaggagaaggacuuccagggcaugcuggaguacaagaaggaggacgagcagaagcuggugaagaaccucauccuggagcugaagccccgcggggucgcggugaaccucaucccgggccugcccgccuacauccuguucaugugcgugcggcacgccgacuaccucaacgacgaccagaagguccgcagccugcugaccuccaccaucaacagcaucaagaaggugcucaagaagcggggcgacgacuucgagaccguguccuucuggcugagcaacacgugccgcuuccugcacugccucaagcaguacagcggggaggagggcuucaugaagcacaacaccucccggcagaacgagcacugccugaccaacuucgaccuggccgaguaccgccagguccucagcgaccuggccauccagaucuaccagcagcuggugcgggugcucgagaacauccugcagcccaugaucgucuccgggaugcuggagcacgagaccauccagggcgugagcggggucaagcccacgggccuccgcaagcggaccuccagcaucgcggacgagggcaccuacacccuggacuccauccugcgccagcucaacagcuuccacuccgugaugugccagcacgggauggacccggagcugaucaagcaggucgucaagcagauguucuacaucaucggcgccaucacgcugaacaaccuccugcugcgcaaggacaugugcagcugguccaaggggaugcagauccgguacaacgugagccagcucgaggaguggcugcgcgacaagaaccugaugaacuccggcgccaaggagacccucgagccccugauccaggccgcccagcugcuccaggugaagaagaagaccgacgacgacgcggaggccaucugcagcaugugcaacgcccugaccaccgcccagaucgucaaggugcugaaccucuacacgcccgugaacgaguucgaggagcgggucuccgugagcuucauccgcaccauccagaugcggcugcgcgaccggaaggacagcccccagcugcucauggacgccaagcacaucuucccggugaccuuccccuucaaccccagcucccuggcgcuggagaccauccagaucccggccagccucgggcugggcuucaucagccgcgucuga

SEQ ID NO: 33308 - RNA, 5547 nt, Artificial Sequence
  derived and/or modified sequence opt1 from MYO5B__Homo_sapiens__NP_001073936
augagcgugggcgagcuguacucccagugcacccgcgucuggauccccgacccggacgagguguggcggagcgccgagcucaccaaggacuacaaggagggggacaagucccugcagcugcgccucgaggacgagacgauccuggaguaccccaucgacgugcagcggaaccagcugcccuuccuccgcaaccccgacauccuggucggcgagaacgaccugaccgcccucagcuaccugcacgagccggcggugcugcacaaccucaaggugcgguuccuggaguccaaccacaucuacaccuacugcgggaucguccugguggccaucaaccccuacgagcagcuccccaucuacggccaggacgugaucuacaccuacagcgggcagaacaugggcgacauggacccccacaucuucgccgucgccgaggaggccuacaagcagauggcgcgcgacgagaagaaccaguccaucaucgugagcggcgaguccggggccggcaagacggugagcgccaaguacgccaugcgguacuucgcgaccgucgggggcuccgccagcgagaccaacaucgaggagaaggugcuggccuccagcccgaucauggaggccaucgggaacgccaagaccacgcgcaacgacaacuccagccgguucggcaaguacauccagaucggcuucgacaagcgcuaccacaucaucggggcgaacaugcggaccuaccugcucgagaagucccgcguggucuuccaggccgacgacgagcggaacuaccacaucuucuaccagcugugcgccgccgccggccugcccgaguucaaggagcucgcgcugaccagcgccgaggacuucuucuacaccucccaggggggcgacacgagcaucgagggcguggacgacgccgaggacuucgagaagacccgccaggccuucacccugcucggggugaaggagagccaccagauguccaucuucaagaucaucgccagcauccugcaccugggcuccgucgcgauccaggccgagcgggacggggacagcugcuccaucagcccccaggacguguaccucuccaacuucugccgccugcugggcguggagcacagccagauggagcacuggcucugccaccggaagcuggucaccacguccgagaccuacgugaagaccaugagccugcagcaggugaucaacgcccgcaacgcccucgccaagcacaucuacgcgcagcuguucggguggaucgucgagcacaucaacaaggcccugcacaccucccucaagcagcacagcuucaucggcgugcuggacaucuacggcuucgagacguucgaggucaacuccuucgagcaguucugcaucaacuacgccaacgagaagcugcagcagcaguucaacagccacguguucaagcucgagcaggaggaguacaugaaggagcagauccccuggacccugaucgacuucuacgacaaccagccgugcaucgaccugaucgaggccaagcucgggauccuggaccugcucgacgaggagugcaaggugcccaagggcaccgaccagaacugggcgcagaagcuguacgaccggcacuccagcucccagcacuuccagaagccccgcaugagcaacaccgccuucaucaucguccacuucgccgacaagguggaguaccuguccgacggguuccucgagaagaaccgggacacgguguacgaggagcagaucaacauccugaaggccagcaaguucccccuggucgccgaccuguuccacgacgacaaggacccggugcccgcgaccacccccggcaaggggagcuccagcaagaucuccgugcgcagcgcccgccccccgaugaaggucuccaacaaggagcacaagaagaccgugggccaccaguuccggacgagccuccaccugcugauggagacccucaacgccaccaccccccacuacgugcgcugcaucaagcccaacgacgagaagcugcccuuccacuucgacccgaagcgggccguccagcagcugcgcgccugcggcgugcucgagacgauccggaucuccgcggccggguaccccagccgcugggccuaccacgacuucuucaaccgguaccgcgugcuggucaagaagcgggagcuggccaacaccgacaagaaggccaucugccgcuccgugcucgagaaccugaucaaggaccccgacaaguuccaguucggccggaccaagaucuucuuccgcgcggggcagguggccuaccuggagaagcuccgggccgacaaguuccgcaccgccacgaucaugauccagaagaccguccggggcuggcugcagaaggugaaguaccaccgccugaagggggcgacccucacccugcagcgguacugccgcggccaccuggcccggcgccucgccgagcaccugcgccggauccgcgccgccgugguccugcagaagcacuaccggaugcagcgcgcgcggcaggccuaccagcgcgugcggcgcgccgccguggucauccaggccuucacccgggcgauguucgugcgccggacguaccgccaggugcucauggagcacaaggccaccaccauccagaagcacguccggggcuggauggcccgccggcacuuccagcgccugcgggacgccgccaucgugauccagugcgcguuccgcaugcugaaggcccggcgcgagcucaaggcccugcggaucgaggcccgcagcgcggagcaccugaagcgccucaacguggggauggagaacaaggucgugcagcugcagcggaagaucgacgagcagaacaaggaguucaagacccuguccgagcagcucagcgugacgaccuccaccuacaccauggaggucgagcgccugaagaaggagcuggugcacuaccagcagagccccggcgaggacacgucccuccggcugcaggaggagguggagagccugcgcaccgagcuccagcgggcccacuccgagcgcaagauccuggaggacgcccacagccgggagaaggacgagcugcgcaagcgggucgccgaccucgagcaggagaacgcccugcugaaggacgagaaggagcagcucaacaaccagauccugugccagagcaaggacgaguucgcgcagaacuccgugaaggagaaccugaugaagaaggagcucgaggaggagcgcagccgguaccagaaccuggugaaggaguacucccagcuggagcagcgcuacgacaaccuccgggacgagaugaccaucaucaagcagaccccggggcaccgccggaaccccagcaaccaguccagccuggaguccgacagcaacuaccccuccaucagcacguccgagaucggcgacaccgaggacgcccugcagcaggucgaggagaucggccucgagaaggccgccauggacaugaccguguuccugaagcugcagaagcgcgugcgggagcucgagcaggagcgcaagaagcugcagguccagcuggagaagcgggagcagcaggacagcaagaaggugcaggccgagccgccccagaccgacaucgaccucgaccccaacgcggaccuggccuacaacucccugaagcgccaggagcucgagagcgagaacaagaagcugaagaacgaccugaacgagcuccgcaaggccguggccgaccaggccacgcagaacaacuccagccacgggucccccgacagcuacucccugcugcucaaccagcugaagcuggcgcacgaggagcucgagguccggaaggaggaggugcugauccugcgcacccagaucgugagcgccgaccagcggcgccucgccggccggaacgccgagccgaacaucaacgcccgcagcuccuggcccaacagcgagaagcacgucgaccaggaggacgcgaucgaggccuaccacggggugugccagaccaacuccaagaccgaggacuggggcuaccugaacgaggacggggagcugggccucgccuaccagggccugaagcagguggcccggcugcucgaggcgcagcugcaggcccagagccuggagcacgaggaggaggucgagcaccucaaggcccagcuggaggcccugaaggaggagauggacaagcagcagcagacguucugccagacccuccugcugucccccgaggcccagguggaguucgggguccagcaggagaucagccgccucaccaacgagaaccuggaccugaaggagcucguggagaagcuggagaagaacgagcggaagcugaagaagcagcucaagaucuacaugaagaaggcgcaggaccuggaggccgcccaggcccuggcccaguccgagcgcaagcggcacgagcugaaccgccaggugaccguccagcggaaggagaaggacuuccagggcaugcucgaguaccacaaggaggacgaggcgcugcugauccgcaaccucgugacggaccugaagccccagaugcugagcgggaccgugccgugccuccccgccuacauccuguacaugugcauccggcacgccgacuacaccaacgacgaccugaagguccacucccuccugaccagcacgaucaacggcaucaagaaggugcugaagaagcacaacgacgacuucgagaugaccuccuucuggcucagcaacaccugccgccugcugcacugccucaagcaguacuccggggacgagggcuucaugacccagaacacggccaagcagaacgagcacugccugaagaacuucgaccugaccgaguaccggcaggugcucagcgaccuguccauccagaucuaccagcagcugaucaagaucgccgagggcguccuccagcccaugaucgugagcgcgaugcuggagaacgaguccauccaggggcugagcggcgugaagcccaccggguaccgcaagcgguccagcagcauggccgacggcgacaacuccuacugccucgaggccaucauccgccagaugaacgccuuccacaccgucaugugcgaccaggggcuggacccggagaucauccugcagguguucaagcagcucuucuacaugaucaacgcggugacgcugaacaaccugcuccugcggaaggacgucugcagcugguccaccggcaugcagcugcgcuacaacaucagccagcucgaggaguggcugcgcggccggaaccugcaccaguccggggccgugcagaccauggagccccucauccaggccgcccagcugcugcagcucaagaagaagacccaggaggacgccgaggcgaucugcagccugugcaccucccugagcacgcagcagaucgugaagauccucaaccuguacaccccccugaacgaguucgaggagcgcgucaccguggccuucauccggaccauccaggcccagcuccaggagcgcaacgacccccagcagcugcugcucgacgccaagcacauguucccggugcuguuccccuucaaccccuccagccugacgauggacuccauccacauccccgccugccucaaccuggaguuccugaacgaggucuga

SEQ ID NO: 33309 - RNA, 5229 nt, Artificial Sequence
  derived and/or modified sequence opt1 from MYO5C__Homo_sapiens__NP_061198
auggccguggccgagcuguacacccaguacaaccgcgucuggauccccgacccggaggagguguggaagagcgcggagaucgccaaggacuaccgggugggcgacaagguccuccgccugcugcucgaggacgggaccgagcuggacuacuccgugaaccccgagagccugcccccccuccggaacccggacauccuggugggcgagaacgaccugacggcccucuccuaccugcacgagcccgccguccugcacaaccuccgcauccgguucgccgagagcaagcugaucuacaccuacuccgggaucauccugguggcgaugaaccccuacaagcagcuccccaucuacggcgacgccaucauccacgccuacagcgggcagaacaugggcgacauggacccgcacaucuucgccguggcggaggaggccuacaagcagauggcccgcaacaaccggaaccaguccaucaucgucagcggcgaguccggggccggcaagaccgugagcgcccgcuacgcgaugcgguacuucgccaccguguccaagagcggguccaacgcccacgucgaggacaaggugcuggccagcaaccccaucacggaggccgugggcaacgcgaagaccacccgcaacgacaacuccagccgguucgggaaguacaccgagaucuccuucgacgagcagaaccagaucaucggcgccaacaugagcacguaccugcucgagaagucccgcgucguguuccagagcgagaacgagcggaacuaccacaucuucuaccagcugugcgccagcgcccagcaguccgaguucaagcaccugaagcucggcagcgccgaggaguucaacuacacccgcauggggggcaacaccgugaucgagggggucaacgaccgggcggagaugguggagacccagaagacguucacccugcugggcuucaaggaggacuuccagauggacguguucaagauccucgccgccauccugcaccugggcaacguccagaucaccgccguggggaacgagcgcuccagcguguccgaggacgacagccaccucaaggucuucugcgagcugcugggccucgaguccgggcggguggcccaguggcugugcaaccgcaagaucgucaccagcuccgagacgguggugaagcccaugacccggccccaggcggucaacgcccgcgacgcccuggccaagaagaucuacgcgcaccucuucgacuucaucguggagcggaucaaccaggcccugcaguucagcggcaagcagcacaccuucaucggggugcuggacaucuacggcuucgagaccuucgacgucaacuccuucgagcaguucugcaucaacuacgccaacgagaagcuccagcagcaguucaacaugcacguguucaagcuggagcaggaggaguacaugaaggaggacaucccguggacgcugaucgacuucuacgacaaccagcccgugaucgaccucaucgaggccaagaugggcauccuggagcugcucgacgaggagugccugcugccccacgggaccgacgagaacuggcuccagaagcuguacaacaacuucgucaaccgcaacccccuguucgagaagccgcgcaugagcaacaccuccuucgugauccagcacuucgccgacaagguggaguacaagugcgagggcuuccucgagaagaaccgggacaccgucuacgacaugcugguggagauccugcgcgcgagcaaguuccaccugugcgccaacuucuuccaggagaaccccacgccccccuccccguucgggagcaugaucaccgugaaguccgccaagcaggucaucaagcccaacagcaagcacuuccggaccaccgugggcuccaaguuccgcagcagccucuaccugcugauggagacgcucaacgccaccaccccccacuacgugcggugcaucaagcccaacgacgagaagcugccguucgaguucgacuccaagcgcaucguccagcagcugcgggccugcggggugcucgagaccauccgcaucagcgcgcaguccuaccccagccgguggacguacaucgaguucuacucccgcuacggcauccugaugaccaagcaggagcugagcuucuccgacaagaaggaggugugcaaggucgugcuccaccggcugauccaggacagcaaccaguaccaguucggcaagaccaagaucuucuuccgcgccgggcagguggccuaccuggagaagcuccggcuggacaagcugcgccaguccugcgucauggugcagaagcacaugcggggcuggcuccagcgcaagaaguuccugcgggagcgccgggccgcccugaucauccagcaguacuuccgcgggcagcagaccgugcgcaaggcgaucacggccgucgcccucaaggaggccugggcggccaucaucauccagaagcacugccggggcuaccuggugcgcagccuguaccagcucauccggauggccaccaucaccaugcaggccuacucccgcggguuccuggcccggcgccgguaccgcaagaugcuggaggagcacaaggcggugauccuccagaaguacgcccgggccuggcuggcccgccggcgcuuccagagcauccggcgcuucguccugaacauccagcucaccuaccgggugcagcgccugcagaagaagcuggaggaccagaacaaggagaaccacggccucguggagaagcugaccucccuggccgcgcuccgggccggcgacgucgagaagauccagaagcuggaggccgagcuggagaaggccgccacgcaccgccggaacuacgaggagaaggggaagcgcuaccgggacgcgguggaggagaagcucgccaagcugcagaagcacaacagcgagcuggagacccagaaggagcagauccagcucaagcugcaggagaagaccgaggagcugaaggagaagauggacaaccucaccaagcagcuguucgacgacgugcagaaggaggagcgccagcgcaugcugcucgagaaguccuucgagcugaagacgcaggacuacgagaagcagauccagagccugaaggaggagaucaaggcccucaaggacgagaagaugcagcugcagcaccuggucgagggcgagcacgugaccuccgacgggcucaaggccgagguggcgcggcugagcaagcaggucaagaccaucagcgaguucgagaaggagaucgagcugcuccaggcccagaagaucgacguggagaagcacgugcagucccagaagcgcgagaugcgggagaagaugagcgagaucaccaagcagcugcuggaguccuacgacaucgaggacguccgcagccggcucuccguggaggaccuggagcaccugaacgaggacggcgagcucugguucgccuacgagggccugaagaaggccacgcgcgugcuggagagccacuuccagucccagaaggacugcuacgagaaggagaucgaggcccucaacuucaaggucgugcaccugagccaggagaucaaccaccugcagaagcucuuccgggaggagaacgacaucaacgaguccauccgccacgaggugacccggcugaccagcgagaacaugaugauccccgacuucaagcagcagaucuccgagcuggagaagcagaagcaggaccucgagauccgccugaacgagcaggcggagaagaugaaggggaagcuggaggagcucagcaaccagcugcaccggucccaggaggaggagggcacccagcgcaaggcccuggaggcccagaacgagauccacacgaaggagaaggagaagcucaucgacaagauccaggagaugcaggaggccagcgaccaccugaagaagcaguucgagaccgaguccgaggucaagugcaacuuccggcaggaggccagccgccugacccucgagaaccgggaccuggaggaggagcuggacaugaaggaccgcgugaucaagaagcuccaggaccaggugaagacccuguccaagacgaucgggaaggcgaacgacguccacagcuccagcggccccaaggaguaccuggggaugcuccaguacaagcgggaggacgaggccaagcugauccagaaccugauccucgaccugaagccgcgcggcguggucgugaacaugauccccggccugcccgcccacauccucuucaugugcgugcgguacgccgacagccugaacgacgccaacaugcugaagucccucaugaacagcaccaucaacgggaucaagcaggucgugaaggagcaccuggaggacuucgagaugcuguccuucuggcugagcaacaccugccacuuccucaacugccugaagcaguacuccggcgaggaggaguucaugaagcacaacagcccgcagcagaacaagaacugccugaacaacuucgaccucuccgaguaccgccagauccugagcgacguggcgauccgcaucuaccaccaguucaucaucaucauggagaagaacauccagcccaucaucguccccgggaugcuggaguacgagucccuccagggcaucagcgggcugaagcccaccggcuuccggaagcgcuccagcuccaucgacgacacggacggcuacaccaugaccagcgugcugcagcagcucuccuacuucuacaccacgaugugccagaacgggcuggacccggagcuggugcggcaggccgucaagcagcucuucuuccugaucggcgccgugacccugaacagccucuuccugcgcaaggacaugugcuccugccggaaggggaugcagauccgcugcaacaucagcuaccuggaggaguggcucaaggacaagaaccugcagaacucccuggccaaggagacccucgagccccugagccaggccgcguggcugcuccaggugaagaagaccacggacagcgacgccaaggagaucuacgagcggugcaccucccugagcgccguccagaucaucaagauccugaacuccuacacccccaucgacgacuucgagaagcgcgugacccccagcuucgugcggaagguccaggcccuccugaacucccgcgaggacagcucccagcugaugcucgacacgaaguaccuguuccaggugaccuucccguucacccccagcccccacgcgcuggagaugauccagauccccuccagcuucaagcucggcuuccugaaccggcuguga

SEQ ID NO: 33310 - RNA, 3789 nt, Artificial Sequence
  derived and/or modified sequence opt1 from MYO6__Homo_sapiens__NP_001287828
auggaggacggcaagcccgugugggccccgcaccccaccgacggguuccagaugggcaacaucgucgacaucgggcccgacagccugaccaucgagccccucaaccagaagggcaagacguuccuggcccugaucaaccagguguucccggcggaggaggacuccaagaaggacguggaggacaacugcagccucauguaccugaacgaggccacccugcuccacaacaucaagguccgcuacuccaaggaccggaucuacaccuacguggccaacauccugaucgccgugaaccccuacuucgacauccccaagaucuacagcuccgaggccaucaagagcuaccaggggaagucccugggcacccggcccccgcacgucuucgcgaucgccgacaaggccuuccgcgacaugaaggugcucaagaugagccaguccaucaucgugagcggcgaguccggggccggcaagacggagaacaccaaguucguccugcgcuaccugaccgagagcuacgggaccggccaggacaucgacgaccggaucguggaggcgaacccccuccuggaggccuucgggaacgccaagacggugcgcaacaacaacuccagccgguucggcaaguucgucgagauccacuucaacgagaaguccagcguggugggcggguucgucucccacuaccugcucgagaagucccgcaucugcgugcagggcaaggaggagcggaacuaccacaucuucuaccgccugugcgccggggccuccgaggacauccgggagaagcugcaccucagcagccccgacaacuuccgcuaccugaaccggggcugcacccgcuacuucgcgaacaaggagaccgacaagcagauccugcagaaccggaagucccccgaguaccucaaggccggcagcaugaaggacccgcugcuggacgaccacggggacuucauccgcaugugcaccgccaugaagaagaucggccucgacgacgaggagaagcuggaccuguuccggguggucgccggggugcuccaccugggcaacaucgacuucgaggaggccggguccacgagcggcggcugcaaccugaagaacaaguccgcgcagagccucgaguacugcgccgagcugcuggggcucgaccaggacgaccugcgcgugucccugaccacccgggucaugcucaccacggccggcgggaccaagggcaccgugaucaaggugccccugaaggucgagcaggccaacaacgcccgcgacgcgcuggccaagaccguguacagccaccucuucgaccacgucgugaaccgggugaaccagugcuuccccuucgagacguccagcuacuucaucgggguccuggacaucgccggcuucgaguacuucgagcacaacuccuucgagcaguucugcaucaacuacugcaacgagaagcugcagcaguucuucaacgagcgcauccucaaggaggagcaggagcuguaccagaaggagggccugggggugaacgaggugcacuacgucgacaaccaggacugcaucgaccucaucgaggccaagcuggugggcauccuggacauccucgacgaggagaaccgccugccccagccgagcgaccagcacuucaccuccgccgugcaccagaagcacaaggaccacuuccggcugaccaucccccgcaagagcaagcuggcgguccaccggaacauccgcgacgacgagggguucaucauccggcacuucgccggcgccgugugcuacgagaccacgcaguucguggagaagaacaacgacgcccuccacaugucccuggagagccugaucugcgagucccgcgacaaguucauccgggagcuguucgagagcuccaccaacaacaacaaggacaccaagcagaaggcggggaagcucagcuucaucagcgucggcaacaaguucaagacccagcugaaccuccugcuggacaagcuccgcuccacgggcgccagcuucauccggugcaucaagcccaaccugaagaugaccucccaccacuucgagggggcccagauccugagccagcuccagugcuccggcauggugagcgugcuggaccugaugcagggcggguaccccucccgcgccagcuuccacgagcucuacaacauguacaagaaguacaugccggacaagcuggcccggcuggacccccgccucuucugcaaggcgcuguucaaggcccugggccucaacgagaacgacuacaaguucgggcugaccaaggucuucuuccggcccggcaaguucgccgaguucgaccagaucaugaaguccgaccccgaccaccuggccgagcucgugaagcgcgugaaccacuggcugaccugcagccgguggaagaagguccaguggugcucccugagcgugaucaagcucaagaacaagaucaaguaccgcgccgaggcgugcaucaagaugcagaagacgauccggauguggcugugcaagcgccggcacaagccgcgcaucgacgggcuggugaaggucggcacccucaagaagcgccuggacaaguucaacgaggugguguccguccugaaggacgggaagcccgagaugaacaagcagaucaagaaccucgagaucagcaucgacacccugauggccaagaucaaguccaccaugaugacgcaggagcagauccagaaggaguacgacgcccuggucaagagcuccgaggagcuccugagcgcccugcagaagaagaagcagcaggaggaggaggccgagcggcuccgccggauccaggaggagauggagaaggagcgcaagcggcgcgaggaggacgagaagcggcgccggaaggaggaggaggagcgccggaugaagcuggagauggaggcgaagcgcaagcaggaggaggaggagcggaagaagcgcgaggacgacgagaagcggauccaggccgagguggaggcccagcuggcccgccagaaggaggaggagagccagcagcaggcggugcucgagcaggagcggcgcgaccgggagcuggcccugcgcaucgcccaguccgaggccgagcucaucagcgacgaggcccaggcggaccuggcccugcggcgcggccccgccgugcucgccaccaaggccgcggccggcaccaagaaguacgaccuguccaaguggaaguacgccgagcugcgcgacaccaucaacaccagcugcgacaucgagcuccuggccgccugccgggaggaguuccaccgccggcugaagguguaccacgcguggaaguccaagaacaagaagcgcaacacggagaccgagcagcgggcccccaagagcgucaccgacuacgacuucgccccguuccucaacaacagcccccagcagaaccccgccgcgcagaucccggcccgccagcgggagaucgagaugaaccgccagcagcgguucuuccgcauccccuucauccggcccgccgaccaguacaaggacccccagagcaagaagaagggguggugguacgcccacuucgacggcccguggaucgcccgccagauggagcugcaccccgacaagccgcccauccugcucguggcggggaaggacgacauggagaugugcgagcugaaccuggaggagaccggccucacgcggaagcgcggggccgagauccugccccggcaguucgaggagaucugggagcgcugcggcggcauccaguaccugcagaacgccaucgagucccggcaggcccgccccaccuacgccaccgcgaugcuccagagccugcugaaguga

SEQ ID NO: 33311 - RNA, 6648 nt, Artificial Sequence
  derived and/or modified sequence opt1 from MYO7A__Homo_sapiens__NP_000251
auggugauccugcagcagggcgaccacguguggauggaccuccgccuggggcaggaguucgacgugcccaucggcgccguggugaagcugugcgacagcggccagguccaggugguggacgacgaggacaacgagcacuggaucagcccccagaacgccacccacaucaagcccaugcaccccaccagcgugcacggcguggaggacaugauccgccucggggaccugaacgaggccggcauccugcgcaaccuccugauccgguaccgcgaccaccugaucuacacguacaccggcuccauccucgucgccgugaaccccuaccagcugcugagcaucuacucccccgagcacauccggcaguacaccaacaagaagaucggggagaugccgccccacaucuucgccaucgccgacaacugcuacuucaacaugaagcgcaacagccgggaccagugcugcaucaucuccggcgagagcggggccggcaagaccgaguccaccaagcucauccugcaguuccuggcggccaucagcgggcagcacuccuggaucgagcagcagguccucgaggccacccccauccuggaggccuucggcaacgcgaagaccauccgcaacgacaacagcucccgguucggcaaguacaucgacauccacuucaacaagcgcggggccaucgagggcgccaagaucgagcaguaccugcucgagaagucccgggucugccgccaggcccuggacgagcggaacuaccacguguucuacugcaugcuggaggggauguccgaggaccagaagaagaagcucggccugggccaggccagcgacuacaacuaccuggcgauggggaacugcaucacgugcgagggccgcguggacucccaggaguacgccaacauccggagcgccaugaagguccucauguucacggacaccgagaacugggagaucuccaagcugcuggccgccauccuccaccuggggaaccugcaguacgaggcgcgcaccuucgagaaccucgacgccugcgaggugcuguucagccccagccuggccaccgccgccucccuccuggaggugaacccgcccgaccugaugagcugccucacgucccggacccugaucacccgcggcgagaccgucagcacgccccugucccgggagcaggcgcucgacgugcgcgacgccuucgugaaggggaucuacggccggcuguucgucuggaucguggacaagaucaacgccgccaucuacaagccgcccagccaggacgugaagaacucccgccgcagcaucggccugcucgacaucuucggguucgagaacuucgccgucaacuccuucgagcagcugugcaucaacuucgcgaacgagcaccuccagcaguucuucgugcggcacgucuucaagcucgagcaggaggaguacgaccuggagagcaucgacuggcugcacaucgaguucaccgacaaccaggacgcccucgacaugaucgccaacaagcccaugaacaucaucucccugaucgacgaggagagcaaguuccccaagggcaccgacaccacgaugcugcacaagcugaacucccagcacaagcucaacgccaacuacaucccgcccaagaacaaccacgagacccaguucgggaucaaccacuucgcgggcaucguguacuacgagacccagggguuccuggagaagaaccgcgacacccugcacggcgacaucauccagcucgugcacagcucccggaacaaguucaucaagcagaucuuccaggccgacgucgccaugggcgccgagacgcgcaagcggagccccacccuguccagccaguucaagcgcucccuggagcuccugaugcggacccugggggccugccagcccuucuucgugcgcugcaucaagcccaacgaguucaagaagcccaugcuguucgaccggcaccugugcgugcgccagcugcgguacagcggcaugauggagaccauccgcauccggcgcgcgggguaccccauccgguacagcuucgucgaguucguggagcgcuaccgggugcuccugcccggcgucaagcccgccuacaagcagggggaccugcgcggcacgugccagcggauggccgaggccgugcucggcacccacgacgacuggcagaucgggaagaccaagaucuuccugaaggaccaccacgacaugcugcucgagguggagcgcgacaaggccaucaccgaccgcgucauccugcugcagaaggugauccggggcuucaaggaccgcuccaacuuccucaagcugaagaacgcggccacgcugauccagcggcacuggcgcgggcacaacugccggaagaacuacggccucaugcgccugggcuuccugcggcuccaggcccugcaccgcagccggaagcugcaccagcaguaccgccucgcccggcagcgcaucauccaguuccaggcccggugccgcgcguaccuggugcggaaggccuuccgccaccggcugugggccguccucaccgugcaggccuacgcgcgcgggaugaucgcccggcgccugcaccagcggcugcgcgccgaguaccucuggcgccuggaggccgagaagaugcggcuggccgaggaggagaagcuccgcaaggagauguccgcgaagaaggccaaggaggaggccgagcggaagcaccaggagcgccuggcccagcuggcccgggaggacgcggagcgcgagcucaaggagaaggaggccgcccggcgcaagaaggagcugcuggagcagauggagcgggcccgccacgagcccgugaaccacagcgacauggucgacaagauguucggcuuccucgggaccuccggcgggcugcccggccaggagggccaggcccccagcggguucgaggaccuggagcggggccgccgggagaugguggaggaggaccucgacgcggcccugccgcugcccgacgaggacgaggaggaccucuccgaguacaaguucgccaaguucgccgcgaccuacuuccaggggacgaccacccacagcuacacccgccggccccugaagcagccgcugcucuaccacgacgacgagggcgaccagcuggccgcccuggccguguggaucaccauccuccgcuucaugggggaccugcccgagcccaaguaccacacggccauguccgacggcagcgagaagauccccgucaugaccaagaucuacgagacccugggcaagaagaccuacaagcgggagcuccaggcgcugcagggggagggcgaggcccagcugccggaggggcagaagaaguccagcgugcgccacaagcucgugcaccugacgcugaagaagaaguccaagcucaccgaggaggucaccaagcggcugcacgacggcgagagcaccgugcaggggaacuccaugcuggaggaccgccccacgagcaaccucgagaagcugcacuucaucaucggcaacggcauccugcgccccgcccuccgggacgagaucuacugccagaucuccaagcagcugacccacaaccccagcaagagcuccuacgcccgcggguggauccuggugagccucugcgucggcugcuucgccccguccgagaaguucgugaaguaccugcggaacuucauccacggcgggccgcccggguacgcgcccuacugcgaggagcgccugcggcgcaccuucgugaacgggacccggacgcagccgcccagcuggcucgagcugcaggccaccaaguccaagaagcccaucaugcugcccgucaccuucauggacggcaccacgaagacccuccugaccgacagcgccaccacggccaaggagcugugcaacgcccucgcggacaagaucucccugaaggaccgcuucggguucagccuguacaucgcccucuucgacaagguguccagccugggcuccgggagcgaccacgugauggacgccaucucccagugcgagcaguacgccaaggagcagggcgcccaggagcggaacgcgccguggcgccuguucuuccggaaggaggucuucacccccuggcacagccccuccgaggacaacguggccaccaaccucaucuaccagcaggucgugcgcggcgugaaguucggggaguaccggugcgagaaggaggacgaccuggccgagcuggccagccagcaguacuucguggacuacggcuccgagaugauccucgagcgccugcugaaccugguccccaccuacaucccggaccgggagaucacgccccucaagacccuggagaagugggcgcagcuggccaucgccgcccacaagaaggggaucuacgcccagcgccggaccgacgcgcagaaggugaaggaggacguggucagcuacgcccgcuucaaguggccccuccuguucucccgguucuacgaggccuacaaguucagcggccccagccugccgaagaacgacgugaucguggccgucaacuggaccgggguguacuucguggacgagcaggagcagguccuccuggagcuguccuuccccgagaucauggccgugagcuccagccgcgagugccggguguggcucucccugggcugcagcgaccugggcugcgcggcgccccacuccgggugggccggccucacgccggccgggcccugcagccccugcugguccugccgcggcgccaagaccaccgcgcccagcuucacccuggccacgaucaagggggacgaguacaccuucaccuccagcaacgccgaggacauccgcgaccuggucgugaccuuccucgagggccugcggaagcgcuccaaguacgucguggcccugcaggacaacccgaaccccgcgggcgaggagagcggguuccucuccuucgccaagggcgaccugaucauccuggaccacgacacgggggagcaggucaugaacagcggcugggccaacgggaucaacgagcggaccaagcagcgcggcgacuuccccaccgacuccgucuacgugaugcccaccgugaccaugccgccccgggagaucgucgcccucgugacgaugacccccgaccagcgccaggacgugguccggcugcugcagcuccgcaccgccgagcccgaggugcgggcgaagccguacacccuggaggaguucagcuacgacuacuuccggccgccgcccaagcacacgcugucccgggugauggucagcaaggcccgcggcaaggaccggcucuggagccacacccgcgagccgcugaagcaggcccugcucaagaagcugcugggguccgaggagcucagccaggaggccugccuggccuucaucgcggugcugaaguacaugggcgacuaccccuccaagcggacccgcagcgugaacgagcucaccgaccagaucuucgaggggccccugaaggccgagccccugaaggacgaggccuacguccagauccucaagcagcugacggacaaccacauccgguacuccgaggagcgcggcugggagcugcucuggcugugcaccggccuguucccgcccagcaacauccuccugccccacgugcagcgguuccugcagucccgcaagcacugcccccucgccaucgacugccugcagcgccugcagaaggcccuccggaacgggagccgcaaguacccgccccaccugguggaggucgaggcgauccagcacaagaccacccagaucuuccacaagguguacuuccccgacgacacggacgaggccuucgagguggaguccagcaccaaggccaaggacuucugccagaacaucgccacccggcugcuccugaaguccagcgagggcuucucccuguucgucaagaucgcggacaaggugcucagcgugcccgagaacgacuucuucuucgacuucguccgccaccugaccgacuggaucaagaaggcccggccgaucaaggacgggaucgugcccucccugacguaccagguguucuucaugaagaagcucuggaccaccaccguccccggcaaggacccgauggccgacagcaucuuccacuacuaccaggagcugcccaaguaccugcgcggguaccacaagugcacgcgggaggaggugcuccagcugggcgcccugaucuaccgcgugaaguucgaggaggacaaguccuacuuccccagcauccccaagcuccugcgggagcuggucccgcaggaccucauccgccaggugucccccgacgacuggaagcggagcaucguggccuacuucaacaagcacgcgggcaagagcaaggaggaggccaagcuggccuuccugaagcucaucuucaaguggcccaccuucggguccgccuucuucgaggucaagcagaccaccgagcccaacuucccggagauccugcugaucgccaucaacaaguacggcgugagccucaucgaccccaagacgaaggacauccugaccacccaccccuucaccaagaucuccaacuggagcuccgggaacacguacuuccacaucaccaucggcaaccuggugcgcgggagcaagcuccugugcgagaccucccugggcuacaagauggacgaccuccugaccagcuacaucucccagaugcugacggcgaugagcaagcagcggggcucccgcagcgggaaguga

SEQ ID NO: 33312 - RNA, 6351 nt, Artificial Sequence
  derived and/or modified sequence opt1 from MYO7B__Homo_sapiens__NP_001073996
augagcggcuuccggcugggggaccacguguggcuggagccgcccagcacccacaagaccggcguggccaucgggggcaucaucaaggaggccaagcccgggaaggugcugguggaggacgacgagggcaaggagcacuggauccgggcggaggacuucggcgugcugagccccaugcaccccaacuccgugcaggggguggacgacaugauccggcucggcgaccugaacgaggccgggauggugcacaaccugcucauccgguaccagcagcacaagaucuacaccuacaccggcagcauccugguggccgugaaccccuuccaggugcugccccucuacacccuggagcagguccagcuguacuacucccgccacaugggggagcugccgccccacguguucgccaucgccaacaacugcuacuucagcaugaagcggaacaagcgcgaccagugcugcaucaucuccggcgagagcggcgcggggaagaccgagaccaccaagcugauccugcaguuccucgccaccaucuccggccagcacagcuggaucgagcagcagguccuggaggccaaccccauccuggaggccuucgggaacgcgaagaccauccggaacgacaacuccagccgcuucggcaaguacaucgacaucuacuucaaccccuccggcgugaucgagggggcccggaucgagcaguuccuccuggagaagucccgcgugugccggcaggcccccgaggagcgcaacuaccacaucuucuacugcaugcugaugggcguguccgccgaggacaagcagcuccugagccuggggacgcccuccgaguaccacuaccucaccaugggcaacugcaccagcugcgaggggcugaacgacgccaaggacuacgcgcacauccgguccgccaugaagauccugcaguucagcgacagcgaguccugggacgugaucaagcuccuggccgccauccugcaccucggcaacgugggcuucauggccagcgucuucgagaaccuggacgcguccgacgugauggagacccccgccuuccccacggugaugaagcugcucgagguccagcaccaggagcugcgcgacugccugaucaagcacaccauccucauccgcggggaguucgugacccgcagccugaacaucgcccaggccgccgaccggcgcgacgcguucgugaagggcaucuacgggcaccuguuccucuggaucgucaagaagaucaacgccgccaucuucacgccgcccgcccaggaccccaagaacgugcggcgcgccaucggccugcuggacaucuucggguucgagaacuucgagaacaacuccuucgagcagcucugcaucaacuucgcgaacgagcaccuccagcaguucuucguccagcacguguucacgauggagcaggaggaguaccggagcgagaacaucuccugggacuacauccacuacaccgacaaccgccccacccuggaccuccuggcccugaagcccaugagcaucaucucccuccuggacgaggagagccgcuucccccagggcaccgaccugacgaugcugcagaagcucaacuccgugcacgccaacaacaaggccuuccugcagccgaagaacauccacgacgcgcgguucggcaucgcccacuucgccggggaggucuacuaccaggccgagggcuuccuggagaagaaccgcgacgugcucagcaccgacauccugacccugguguacuccagcaagaacaaguuccuccgggagaucuucaaccuggagcuggccgagaccaagcucgggcacggcacgauccgccaggcgaaggccgggaaccaccuguucaaguccgccgacagcaacaagcggcccuccacccugggcagccaguucaagcagucccucgaccagcugaugaagauccugaccaacugccagcccuacuucauccgcugcaucaagcccaacgaguacaagaagccgcuccuguucgaccgggagcugugccuccgccagcugcgguacagcggcaugauggagaccguccacauccgcaagagcggguuccccauccgguacacguucgaggaguucucccagcgcuucggcgugcugcuccccaacgccaugcggaugcagcugcaggggaagcugcgccagaugacccucggcaucaccgacguguggcugcggaccgacaaggacuggaaggccggcaagacgaagaucuuccugcgcgaccaccaggacacccuccuggagguccagcggagccaggugcuggaccgcgcggcccucuccauccagaaggugcugcggggguaccgcuaccgcaaggaguuccugcggcagcgccgggccgccgucacccuccaggccugguggcgcggcuacugcaaccggcgcaacuucaagcugauccuggugggguucgagcggcuccaggcgaucgcccgcagccagccccuggcccggcaguaccaggccaugcgccagcggaccgugcagcugcaggcgcucugccgcggcuaccugguccggcagcagguccaggccaagcgccgggccguggucgugauccaggcccacgcccgcgggauggcggcccggcgcaacuuccagcagcggaaggccaacgccccgcuggugauccccgccgagggccagaagucccagggcgcgcuccccgccaagaagcgccggagcaucuacgacacggucaccgacaccgagaugguggagaagguguucggguuccugccggccaugaucggcgggcaggagggccaggccagcccccacuucgaggaccuggagagcaagacccagaagcuccuggaggucgaccuggacaccgugcccauggccgaggagcccgaggaggacguggacgggcucgcggaguacacguucccgaaguucgccgucaccuacuuccagaaguccgccagccacacccacauccgccgcccccugcgguacccccugcucuaccacgaggacgacaccgacugccuggccgcgcuggugaucuggaacgugauccuccgcuucaugggcgaccugcccgagccgguccuguacgcccgguccagccagcagggcuccagcgugaugcgccagauccacgacacgcucgggcgggagcacggcgcccaggugccccagcacucccgcagcgcccaggucgccucccagcugaacaucggggaggaggcgcuggagcccgacggccucggggccgaccggcccaugagcaaccuggagaaggugcacuucaucgugggcuacgccauccugcgcccgagccuccgggacgagaucuacugccagaucugcaagcagcuguccgagaacuucaagaccagcucccuggcccgcggcuggauccuccugagccugugccucgggugcuucccgcccuccgagcgguucaugaaguaccugcugaacuucaucggccaggggcccgccaccuacggcccguucugcgcggagcgccuccggcgcaccuacgccaacgggguccgggccgagccgcccacguggcuggagcugcaggccgucaagagcaagaagcacauccccauccaggugauccucgccaccggcgagucccugaccgucccgguggacagcgcguccaccagccgcgagaugugcaugcacaucgcccacaagcagggccuguccgaccaccucggguucagccuccagguggccgucuacgacaaguucuggucccugggcagcgggcgggaccacaugauggacgccaucgcccgcugcgagcagauggcgcaggagcggggcgagucccagcgccagagccccuggcgcaucuacuuccggaaggaguucuucacgcccuggcacgacucccgcgaggaccccgugagcaccgagcucaucuaccgccaggugcugcgcggcgucugguccggggaguacagcuucgagaaggaggaggagcugguggagcuccuggcccggcacugcuacgugcagcugggcgccagcgccgaguccaaggcgguccaggagcuccugccgagcugcaucccccacaagcuguaccgcaccaagcccccggaccggugggccucccucgugaccgccgccugcgccaaggcgcccuacacgcagaagcaggucacgccccuggccguccgcgagcaggucgucgacgccgcccggcugcaguggccccuccuguucagccgccuguucgaggugaucacccuguccgggccgcggcuccccaagacccagcugauccuggccgugaacuggaagggccucugcuuccuggaccagcaggagaagaugcugcucgagcugagcuuccccgaggucauggggcuggcgacgaaccgcgaggcccagggcggccagcggcuccugcuguccaccaugcacgaggaguacgaguucgugagccccuccagcguggccaucgccgagcucgucgcccuguuccuggaggggcucaaggagcgcuccaucuucgcgauggcccugcaggaccggaaggccaccgacgacaccacgcugcucgccuucaagaagggcgaccugcuggugcucaccaagaagcaggggcugcuggcgagcgagaacuggacccucggccagaacgaccgcaccgggaagacgggccuggugccgauggccugccuguacaccauccccaccgucaccaagcccuccgcccagcuccugagccugcucgccaugucccccgagaagcggaagcuggccgcgcaggagggccaguucacggagccgcgccccgaggagccgcccaaggagaagcugcacacccucgaggaguucagcuacgaguucuuccgggccccggagaaggacaugguguccauggccgugcugccccuggcccgcgcccgggggcaccucugggcguacagcugcgagccccugcgccagccccugcucaagcgcguccacgccaacguggaccugugggacaucgccugccagaucuucguggccauccugcgguacaugggcgacuacccgucccgccaggccuggcccacccucgagcugaccgaccagaucuucacgcuggcgcuccagcaccccgcccugcaggacgaggucuacugccagauccugaagcagcucacccacaacagcaaccggcacagcgaggagcgcggguggcagcugcuguggcucugcaccggccuguucccgcccuccaaggggcugcucccccacgcccagaaguucaucgacacccggcgcggcaagcugcuggcccccgacugcagccggcgcauccagaaggugcuccggaccggcccccgcaagcagccgccccaccagguggaggucgaggcggccgagcagaacgugucccggaucugccacaagaucuacuuccccaacgacacgagcgagaugcuggagguggucgccaacacccgcgugcgggacgugugcgacuccaucgccacccgccugcagcucgccagcugggaggggugcucccuguucaucaagaucagcgacaaggucaucucccagaaggagggcgacuucuucuucgacagccugcgggagguguccgacugggugaagaagaacaagccccagaaggagggggcgcccgucacccuccccuaccagguguacuucaugcgcaagcuguggcugaacaucagccccggcaaggacgugaacgccgacacgauccuccacuaccaccaggagcugccgaaguaccugcggggcuuccacaagugcucccgcgaggacgccauccaccucgccgggcugaucuacaaggcccaguucaacaacgaccggagccagcuggcguccguccccaagauccuccgcgagcuggugcccgagaaccugacccgccucaugagcuccgaggaguggaagaaguccauccugcuggccuacgacaagcacaaggacaagaccguggaggaggccaaggucgccuuccucaaguggaucugccgguggcccaccuucggcuccgccuucuucgaggugaagcagacgagcgagccgagcuaccccgacgugauccugaucgcgaucaaccgccacgggguccugcucauccaccccaagaccaaggaccugcugaccaccuaccccuucacgaagaucuccagcugguccagcggcuccaccuacuuccacauggcccucgggagccugggccggggcucccgccugcucugcgagaccagccugggguacaagauggacgaccugcucaccuccuacgugcagcagcugcugagcgccaugaacaagcagcggggcuccaaggccccggcccucgcgagcacguga

SEQ ID NO: 33313 - RNA, 7647 nt, Artificial Sequence
  derived and/or modified sequence opt1 from MYO9A__Homo_sapiens__NP_008832
augaacaucaacgacggcgggcgccggcgcuucgaggacaacgagcacacccugcggaucuaccccggggccaucagcgaggggaccaucuacugccccauccccgcccgcaagaacagcaccgcggccgaggugaucgagagccugaucaacaagcugcaccuggacaagaccaagugcuacgugcuggccgaggugaaggaguucggcggggaggaguggauccugaaccccaccgacugccccgugcagcggaugaugcuguggccgcgcauggcccuggagaaccggcugagcggcgaggacuaccgcuuccugcuccgggagaagaaccuggacggcagcauccacuacgggucccugcagagcuggcuccgcgucaccgaggagcggcgccggaugauggagcgcggcuuccugccccagccccagcagaaggacuucgacgaccugugcucccuccccgaccugaacgagaagacccugcucgagaaccugcggaaccgcuucaagcacgagaagaucuacaccuacguggggagcauccugaucgugaucaacccguucaaguuccuccccaucuacaaccccaaguacgucaagauguacgacaaccaccagcugggcaagcuggagccccacaucuacgccguggcggacguggccuaccacgccaugcuccagcggaagaagaaccagugcaucgucaucuccggggagagcggcuccggcaagacccagagcaccaacuuccugauccaccaccugaccgcccucucccagaagggguucgcgagcggcguggagcagaucauccugggggccggcccggugcuggaggccuucggcaacgccaagaccgcccacaacaacaacuccagccgcuucgggaaguucauccaggucaacuaccaggagaccggcaccgugcucggggcguacguggagaaguaccugcuggagaagucccggcucgucuaccaggagcacaacgagcgcaacuaccacguguucuacuaccugcuggccggcgccagcgaggacgagcgguccgccuuccaccucaagcagcccgaggaguaccacuaccugaaccagaucaccaagaagccccugcgccagagcugggacgacuacugcuacgacagcgagcccgacugcuucaccguggagggggaggaccuccgccacgacuucgagcggcugcagcuggccauggagauggucggcuuccucccgaagacccgccggcagaucuucucccugcugagcgcgauccuccaccugggcaacaucugcuacaagaagaagaccuaccgcgacgacuccaucgacaucugcaaccccgaggugcugcccaucgugagcgagcuccuggaggucaaggaggagaugcuguucgaggcccuggugacgcggaagaccgugaccgucggggagaagcucauccugcccuacaagcuggccgaggccgugaccguccgcaacuccauggccaagagccucuacuccgcgcuguucgacuggaucguguuccggaucaaccacgcccugcucaacagcaaggaccuggagcacaacacgaagacccuguccaucggcgugcucgacaucuucggguucgaggacuacgagaacaacagcuucgagcaguucugcaucaacuucgccaacgagcgccugcagcacuacuucaaccagcacaucuucaagcuggagcaggaggaguaccggaccgagggcaucuccuggcacaacaucgacuacaucgacaacacgugcugcaucaaccucaucagcaagaagccgacggggcugcugcaccuccuggacgaggaguccaacuucccccaggccaccaaccagacccugcucgacaaguucaagcaccagcacgaggacaacagcuacaucgaguuccccgccgucauggagcccgcguucaucaucaagcacuacgccggcaaggugaaguacggcgugaaggacuuccgcgagaagaacaccgaccacaugcggccggacaucgucgcccugcugcgcuccagcaagaacgccuucaucuccgggaugaucggcaucgaccccguggcgguguuccggugggccauccuccgcgccuucuuccgggccauggucgccuuccgcgaggcggggaagcggaacauccaccgcaagacgggccacgacgacaccgcccccugcgccauccugaaguccauggacuccuucagcuuccugcagcaccccgugcaccagcggagccucgagauccugcagcgcugcaaggaggagaaguacuccaucacccgcaagaacccgcggacgccccugagcgaccuccaggggaugaacgcccugaacgagaagaaccagcacgacacguucgacaucgccuggaacggccgcaccggcauccggcagucccgccugagcuccgggaccagccuccuggacaaggacggcaucuucgcgaacuccaccagcuccaagcugcucgagcgggcccacgggauccugacgcgcaacaagaacuucaagagcaagcccgcccugccgaagcaccuccuggaggugaacucccugaagcaccucacccggcugacccugcaggaccgcaucaccaagagccuccugcaccuccacaagaagaagaagccgcccuccaucagcgcccaguuccaggccucccucagcaagcugauggagacccugggccaggcggagcccuacuucgucaagugcauccgguccaacgccgagaagcucccgcugcgcuucagcgacgugcuggugcuccggcagcugcgcuacacgggcaugcuggagaccguccggauccgccagagcggguacuccagcaaguacuccuuccaggacuucgugagccacuuccacgugcuccugccccggaacaucauccccuccaaguucaacauccaggacuucuuccgcaagaucaaccugaaccccgacaacuaccaggucggcaagaccaugguguuccucaaggagcaggagcggcagcaccuccaggaccugcuccaccaggaggugcugcgccggaucauccugcuccagcgcugguuccggguccugcugugccgccagcacuuccuccaccuccgccaggccagcgugaucauccagcgguucuggcgcaacuaccugaaccagaagcagguccgggacgccgcgguccagaaggacgccuucgugauggccuccgccgccgcgcuccugcaggccagcuggcgcgcccaccuggagcggcagcgcuaccucgagcugcgggccgccgcgaucgugauccagcagaaguggcgcgacuacuaccggcgccggcacauggccgccaucugcauccaggcccgcuggaaggccuaccgggaguccaagcgcuaccaggagcagcggaagaagaucauccugcuccaguccacgugccgcggguuccgggcgcgccagcgguucaaggcccugaaggagcagcgccugcgcgagaccaagccggaggucggccucgugaacaucaagggguacggcucccuggagauccagggcagcgaccccuccgggugggaggacugcagcuucgacaaccggaucaaggccaucgaggagugcaaguccgugaucgagagcaaccgcaucucccgggagagcuccgucgacugccugaaggagagccccaacaagcagcaggagcgcgcccagagccaguccggcguggaccuccaggaggacgugcugguccgggagcgcccccggagccuggaggaccuccaccagaagaagguggggcgcgcgaagcgggagucccgccggaugcgcgagcuggagcaggccaucuucagccuggagcuccugaaggugcggucccugggcgggaucagcccguccgaggaccgccgguggagcaccgagcucguccccgagggccugcagagcccccgcggcacccccgacagcgaguccagccaggggucccuggagcuccugagcuacgaggagucccagaaguccaagcuggaguccgugaucagcgacgagggcgaccugcaguucccgucccccaagaucagcagcucccccaaguucgacagccgggacaacgcccucuccgccagcaacgagaccuccagcgccgagcaccugaaggacgggacgaugaaggagaugguggucugcuccagcgaguccaucacgugcaagccccagcugaaggacagcuucaucuccaacagccucccgaccuucuucuacaucccccagcaggacccccugaagaccaacucccagcuggacacgagcauccagcgcaacaagcuccuggagaacgaggacaccgcgggcgaggcccugacccucgacaucaaccgggagacccgccgguaccacugcuccgggaaggaccagaucgugcccagccugaacacggaguccagcaacccggugcugaagaagcucgagaagcugaacaccgagaaggaggagcgccagaagcagcugcagcagcagaacgagaaggagaugauggagcagauccgccagcagaccgacauccucgagaaggagcggaaggccuucaagaccaucgagaagccccgcaucggcgagugccuggucgcccccuccagcuaccagagcaagcagcggguggagcgcccguccagccugcucucccugaacacgagcaacaagggcgagcugaacgugcucgggucccugagccugaaggacgccgcgcucgcccagaaggacuccagcuccgcccaccucccgcccaaggaccggcccgucaccguguucuucgagcgcaagggcagcccgugccaguccagcaccgugaaggagcuguccaagaccgaccggauggggacgcagcucaacgucgccugcaagcugagcaacaaccgcaucuccaagcgggagcacuuccgccccacccagagcuacucccacaacagcgacgaccugucccgggagggcaacgcccgccccaucuucuucacccccaaggacaacaugagcaucccgcucgugagcaaggaggcgcugaacuccaagaacccccagcugcacaaggaggacgagcccgccuggaagcccgugaagcucgccgggccgggccagcgggagaccagccagcgcuucuccagcgucgacgagcaggccaagcugcacaagacgaugucccagggcgagaucaccaagcuggccgugcggcagaaggcgagcgacuccgacauccgcccccagcgggccaagaugcgcuucugggccaaggggaagcagggcgagaagaagaccacccgggucaagcccacgacccagagcgaggugagcccccuguucgccgggaccgacgugaucccggcgcaccaguuccccgacgagcuggccgccuaccaccccacgccgccccugagccccgagcuccccggcuccugccgcaaggaguucaaggagaacaaggagcccagccccaaggccaagcgcaagcgguccgucaagaucagcaacguggcccuggacuccaugcacuggcagaacgacagcgugcagaucaucgcguccgucagcgaccugaaguccauggacgaguuccuccugaagaaggugaacgaccuggacaacgaggacagcaagaaggacacgcucguggacgucguguucaagaaggcccugaaggaguuccgccagaacaucuucagcuucuacuccagcgcccuggccauggacgacggcaaguccauccgguacaaggaccucuacgcccuguucgagcagauccuggagaagaccaugcgccucgagcagcgggacagccugggggagucccccgugcgcgucugggugaacaccuucaagguguuccuggacgaguacaugaacgaguucaagaccagcgacugcaccgcgacgaagguccccaagaccgagcggaagaagcgccggaagaaggagaccgaccucguggaggagcacaacggccacaucuucaaggccacccaguacuccauccccacguacugcgaguacugcagcucccugaucuggaucauggaccgcgccagcgugugcaagcugugcaaguacgccugccacaagaagugcugccucaagaccaccgccaagugcuccaagaaguacgacccggagcugagcucccggcaguucggggucgagcugagccgccucaccuccgaggaccggacggugccccugguggucgagaagcugaucaacuacaucgagaugcacggccucuacaccgaggggaucuaccgcaagagcggcuccaccaacaagaucaaggagcugcggcagggccuggacaccgacgcggagagcgugaaccucgacgacuacaacauccacgugaucgccagcgucuucaagcaguggcugcgcgaccugcccaacccgcucaugacguucgagcuguacgaggaguuccugcgggccauggggcuccaggagcgcaaggagaccauccggggcguguacuccgugaucgaccagcugagccgcacccaccugaacacccucgagcggcugaucuuccaccugguccgcaucgcccuccaggaggacacgaaccgcauguccgcgaacgcccuggccaucguguucgcccccugcauccugcggugccccgacaccaccgacccccuccagagcgugcaggacaucuccaagaccacgaccugcgucgagcugaucgugguggagcagaugaacaaguacaaggcccgccugaaggacaucagcucccucgaguucgcggagaacaaggccaagacccggcugagccugauccgccgguccauggggaagggccgcauccggcgcgggaacuacccgggccccagcucccccgucguggugcggcuccccagcgucuccgacgugagcgaggagacccugacguccgaggccgccauggagaccgacaucaccgagcagcagcaggccgcgaugcagcaggaggagcgcgugcugaccgagcagaucgagaaccuccagaaggagaaggaggagcugacguucgagaugcugguccucgagccgcgggccagcgacgacgagacccuggaguccgaggccagcaucggcaccgccgacuccagcgagaaccugaacauggagagcgaguacgccaucuccgagaaguccgagcgcucccucgcgcugagcucccugaagaccgccggcaagagcgagcccuccagcaagcuccggaagcagcugaagaagcagcaggacucccuggacgugguggacagcuccgucagcucccugugccucagcaacacggccuccagccacggcacccgcaagcuguuccagaucuacuccaagagccccuucuaccgggccgcguccgggaacgaggcccugggcauggaggggccccucggccagaccaaguuccuggaggacaagccgcaguucaucagccgcggcaccuucaaccccgagaaggggaagcagaagcugaagaacgugaagaacagcccccagaagacgaaggagacccccgagggcaccgugauguccgggcggcgcaagaccgucgacccggacugcaccagcaaccagcagcucgcccuguucggcaacaacgaguucaugguguga

SEQ ID NO: 33314 - RNA, 6069 nt, Artificial Sequence
  derived and/or modified sequence opt1 from MYO9B__Homo_sapiens__NP_001123537
augagcgugaaggaggccggcuccagcgggcgccgggagcaggccgcguaccaccugcacaucuacccccagcucuccaccaccgagagccaggccuccugccgcgucacggccaccaaggacagcaccaccuccgacgugaucaaggacgccaucgccagccugcggcuggacggcacgaagugcuacgugcucgucgaggugaaggaguccgggggcgaggagugggugcuggacgcgaacgacagcccgguccaccgcgugcugcucuggccccggcgcgcccaggacgagcacccccaggaggacggguacuacuuccugcugcaggagcggaacgccgacggcaccaucaaguacgugcacaugcagcucgucgcccaggcgaccgccacccgccggcugguggagcgcggccugcucccccggcagcaggccgacuucgacgaccugugcaaccugccggagcucacggaggggaaccugcugaagaaccucaagcaccgcuuccugcagcagaagaucuacaccuacgccggcuccauccugguggccaucaaccccuucaaguuccuccccaucuacaaccccaaguacgucaagauguacgagaaccagcagcuggggaagcuggagccgcacguguucgcgcucgccgacguggccuacuacaccaugcugcggaagcgcgucaaccagugcaucgugaucagcggcgaguccgggagcggcaagacccaguccacgaacuuccugauccacugccucaccgcccugagccagaagggcuacgccuccgggguggagcggaccauccugggcgcggggcccguccucgaggccuucggcaacgccaagaccgcccacaacaacaacagcucccgcuucggcaaguucauccaggugagcuaccuggagagcgggaucgugcggggcgccgucguggagaaguaccugcucgagaagucccgccuggugagccaggagaaggacgagcggaacuaccacgucuucuacuaccugcuccuggggguguccgaggaggagcgccaggaguuccagcugaagcagcccgaggacuacuucuaccucaaccagcacaaccugaagaucgaggacggcgaggaccugaagcacgacuucgagcggcucaagcaggcgauggagauggucggguuccugcccgccacgaagaagcagaucuucgccgugcugagcgccauccucuaccugggcaacgugaccuacaagaagcgcgccaccggccgcgaggaggggcuggaggucggcccgcccgaggugcucgacacccugucccagcugcugaaggugaagcgggagauccucgucgaggugcugacgaagcgcaagaccgugaccgucaacgacaagcugauccuccccuacagccuguccgaggcgaucaccgcccgggacagcauggccaagucccuguacagcgcccucuucgacuggaucgugcugcgcaucaaccacgcgcugcucaacaagaaggacguggaggaggccgucuccugccugagcaucggggugcuggacaucuucggcuucgaggacuucgagcggaacuccuucgagcaguucugcaucaacuacgccaacgagcagcuccaguacuacuucaaccagcacaucuucaagcuggagcaggaggaguaccagggggagggcaucacguggcacaacaucggcuacaccgacaacguggggugcauccaccugaucagcaagaagcccaccggccucuucuaccugcuggacgaggaguccaacuucccgcacgccaccagccagacgcuccuggccaaguucaagcagcagcacgaggacaacaaguacuuccuggggacccccgucauggagcccgcguucaucauccagcacuucgccggcaaggugaaguaccagaucaaggacuuccgcgagaagaacauggacuacaugcggcccgacaucguggcccuccugcgcggguccgacagcuccuacguccgggagcugaucggcauggacccgguggccguguuccgcugggccguccuccgggcggccauccgcgccauggccgugcugcgggaggccggccgccugcgggcggagcgcgccgagaaggccgccgggaugagcagccccggcgcgcagucccaccccgaggagcucccccggggggccagcaccccguccgagaagcuguaccgcgaccugcacaaccagaugaucaagagcaucaagggccuccccuggcagggcgaggacccccggucccugcugcagagccucucccgccugcagaagccccgcgccuucauccugaagagcaaggggaucaagcagaagcagaucaucccgaagaaccuccuggacuccaagagccugaagcucaucaucuccaugacccugcacgaccggacgaccaagagccugcuccaccugcacaagaagaagaagccccccuccaucagcgcccaguuccagaccucccugaacaagcuccuggaggcccugggcaaggcggagccguucuucauccgcugcauccggagcaacgccgagaagaaggagcucugcuucgacgacgagcuggugcugcagcagcuccgcuacaccgggaugcuggagacgguccggauccgccgguccggcuacagcgccaaguacaccuuccaggacuucaccgagcaguuccaggugcugcuccccaaggacgcccagcccugccgcgaggugaucagcacccugcuggagaagaugaagaucgacaagcggaacuaccagaucgggaagaccaaggucuuccucaaggagacggagcgccaggcccugcaggagacccugcaccgggagguggugcgcaagauccuccugcugcaguccugguuccggaugguccucgagcgccggcacuuccugcagaugaagcgcgcggccgugaccauccaggccugcuggcggagcuaccgcgugcggcgcgcccuggagcggacccaggccgcggucuaccuccaggccuccuggcgcggcuacuggcagcgcaagcuguaccggcaccagaagcagagcaucauccgccugcagucccucugccggggccaccugcagcgcaagagcuucucccagaugaucagcgagaagcagaaggccgaggagaaggagcgggaggcccuggaggcggcccgcgccggggccgaggagggcgggcagggccaggccgcggggggccagcagguggccgagcagggccccgagccggccgaggacgggggccaccucgccuccgagcccgaggugcagcccagcgaccgguccccccuggagcacagcuccccggagaaggaggcccccagccccgagaagacgcugcccccgcagaagaccgucgcggccgagucccacgagaaggugcccagcucccgcgagaagcgggagagccgccggcagcgcgggcucgagcacgugaaguuccagaacaagcacauccaguccugcaaggaggagagcgcccugcgggagcccagccgccgggucacccaggagcagggcgugucccugcucgaggacaagaaggagagccgcgaggacgagacccugcugguggucgagacggaggccgagaacaccucccagaagcagcccaccgagcagccgcaggccauggcgguggggaaggugagcgaggagaccgagaagacgcuccccuccggcagcccccggcccggccagcuggagcgcccgaccucccuggcccucgacagccgggucuccccccccgcccccgggagcgccccggagacccccgaggacaaguccaagcccugcggcagcccgcgcgugcaggagaagcccgacucccccgggggcagcacccagauccagcgcuaccuggacgccgagcggcuggcguccgccguggagcucuggcgcgggaagaagcuggucgccgccgcgagccccuccgccaugcugagccagucccucgaccugagcgaccggcaccgcgccacgggcgccgcccugaccccgaccgaggagcggcgcaccagcuucuccacgagcgacguguccaagcuccugcccagccuggcgaaggcccagcccgccgccgagaccaccgacggcgagcgguccgccaagaagcccgcggugcagaagaagaagccgggggacgccagcucccugcccgacgccggccucagccccgggucccaggucgacagcaaguccaccuucaagcgccuguuccugcacaagacgaaggacaagaaguacagccucgagggcgccgaggagcuggagaacgccguguccggccacgucgugcuggaggcgaccaccaugaagaaggggcucgaggcccccagcggccagcagcaccggcacgccgccggggagaagcgcaccaaggagccgggcgggaagggcaagaagaaccggaacgugaagaucggcaagaucacggucuccgagaaguggcgcgagagcguguuccggcagaucaccaacgcgaacgagcugaaguaccuggacgaguuccuccugaacaagaucaacgaccugcgcucccagaagacccccaucgagagccucuucaucgaggccaccgagaaguuccgguccaacaucaagacgauguacagcgugcccaacgggaagauccacgucggcuacaaggaccugauggagaacuaccagaucguggugagcaaccuggccaccgagcgcgggcagaaggacaccaaccucguccugaaccuguuccagucccuccuggacgaguucacccggggcuacacgaagaacgacuucgagcccgugaagcagagcaaggcccagaagaagaagcgcaagcaggagcgggccgugcaggagcacaacgggcacgucuucgcguccuaccaggugagcaucccgcaguccugcgagcagugccugagcuacaucuggcucauggacaaggcccugcugugcuccgugugcaagaugaccugccacaagaagugcguccacaagauccagagccacugcuccuacaccuacggccgcaagggcgagcccgggguggagcccggccacuucggggugugcgucgacagccucaccuccgacaaggccagcgugcccaucgugcuggagaagcugcucgagcacgucgagaugcacggccuguacaccgaggggcuguaccggaaguccggcgccgccaaccgcacgcgcgagcuccggcaggcgcugcagaccgacccggccgccgugaagcuggagaacuuccccauccacgccaucaccggcgugcucaagcaguggcugcgcgagcugcccgagccccucaugaccuucgcccaguacggggacuuccugcgggcggucgagcugccggagaagcaggagcagcucgccgccaucuacgccgugcuggagcaccugcccgaggcgaaccacaacagccucgagcgccugaucuuccaccuggugaaggucgcccuccuggaggacgugaaccggaugucccccggcgcccuggccaucaucuucgcccccugccuccugcgcugcccggacaacagcgacccccugacguccaugaaggacgugcucaagaucaccaccugcgucgagaugcugaucaaggagcagaugcggaaguacaaggugaagauggaggagaucagccagcuggaggcggccgaguccaucgccuuccgccggcucagccugcugcgccagaacgcccccuggccgcucaagcugggguucagcucccccuacgagggcgugcugaacaagagccccaagacccgggacauccaggaggaggagcucgagguccugcuggaggaggaggccgcgggcggggacgaggaccgcgagaaggagauccucaucgagcggauccaguccaucaaggaggagaaggaggacaucacguaccgccugcccgagcuggacccgcggggcagcgacgaggagaaccucgacuccgagaccagcgccuccaccgagagccugcuggaggagcgcgccgggcggggcgccuccgaggggcaguacuga

SEQ ID NO: 33315 - RNA, 2961 nt, Artificial Sequence
  derived and/or modified sequence opt1 from MYOCD__Homo_sapiens__NP_001139784
augacccugcucggcagcgagcacucccugcugauccgcagcaaguuccgguccgugcuccagcugcgccugcagcagcggcgcacccaggagcagcucgccaaccaggggaucaucccgccccugaagcggcccgccgaguuccacgagcagcgcaagcaccuggacagcgacaaggcgaagaacucccucaagcggaaggcccgcaaccggugcaacagcgccgaccuggucaacaugcacauccugcaggccuccacggccgagcgcagcauccccaccgcgcagaugaagcucaagcgggcccgccuggccgacgaccugaacgagaagaucgcccuccggcccggcccgcuggagcugguggagaagaacauccuccccguggacuccgcggucaaggaggccaucaaggggaaccaggugagcuucuccaagagcaccgacgccuucgccuucgaggaggacuccagcuccgacggccugagccccgaccagacccgcuccgaggacccccagaacagcgccggguccccgcccgacgcgaaggccagcgacacgcccagcaccggcucccugggcaccaaccaggaccucgccagcggguccgagaacgaccggaacgacagcgccucccagcccagccaccaguccgacgccggcaagcaggggcugggcccgcccagcacccccaucgcggugcacgccgccgucaaguccaagagccugggggacuccaagaaccgccacaagaagcccaaggacccgaagcccaaggugaagaagcucaaguaccaccaguacaucccgcccgaccagaaggccgagaaguccccgccgcccauggacuccgccuacgcgcggcugcugcagcagcagcagcuguuccuccagcugcagauccucagccagcagcagcagcagcagcagcaccgcuucuccuaccugggcaugcaccaggcccagcugaaggagcccaacgagcagauggugcggaaccccaacagcuccagcacgccccucuccaacacgccccugagccccgucaagaacagcuucuccggccagaccggggugagcuccuucaagcccggcccccugcccccgaaccucgacgaccugaaggugagcgagcugcgccagcagcuccggauccgcgggcugcccgucuccggcaccaagaccgcccugauggaccgccuccggcccuuccaggacugcagcggcaaccccgugccgaacuucggggacaucaccaccgugaccuuccccgucacgcccaacacccugcccaacuaccaguccagcuccagcaccuccgcccugagcaacggcuucuaccacuucggguccaccagcuccagcccgcccaucucccccgccagcagcgaccucuccguggcgggcagccugcccgacacguucaacgacgccuccccgagcuucgggcugcaccccucccccgugcacgucugcaccgaggagagccucauguccagccugaacggcggcuccgugcccagcgagcuggacgggcuggacuccgagaaggacaagaugcucguggagaagcagaaggucaucaacgagcugaccuggaagcugcagcaggagcagcgccagguggaggagcuccggaugcagcugcagaagcagaagcgcaacaacugcagcgagaagaagccgcugcccuuccucgccgccuccaucaagcaggaggaggcggugagcuccugccccuucgccagccagguccccgugaagcggcaguccagcuccagcgagugccacccgcccgccugcgaggccgcccagcugcagccccugggcaacgcgcacugcgucgagagcuccgaccagaccaacgugcucagcuccacguuccugagcccccagugcuccccgcagcacagcccccugggggccgucaagagcccccagcacaucagccucccgcccucccccaacaacccccacuuccugccgagcuccagcggcgcccagggggagggccaccgcguguccagccccaucuccagccaggugugcaccgcccagaacuccggcgcccacgacgggcacccgcccagcuucagcccccacuccagcucccugcacccgcccuucagcggcgcgcaggccgacuccagccacggggccggcgggaaccccugccccaagucccccugcgugcagcagaagauggccggccuccacagcuccgacaaggucggccccaaguucagcauccccuccccgaccuucagcaaguccagcuccgccaucagcgaggugacccagccgcccuccuacgaggacgcggugaagcagcagaugacgcggagccagcagauggacgagcugcuggacguccucaucgaguccggggagaugcccgccgacgcccgcgaggaccacagcugccugcagaaggugcccaagaucccccgguccagccgcagccccaccgccgugcugaccaagcccuccgcgagcuucgagcaggccuccagcggcucccagaucccguucgaccccuacgccaccgacagcgacgagcaccucgagguccugcugaacucccagagcccccucgggaagauguccgacgugacgcugcugaagaucggcagcgaggagccccacuucgacggcaucauggacggguucuccggcaaggccgccgaggaccucuucaacgcgcacgagauccugccggggccccugagccccaugcagacccaguucuccccgagcuccguggacagcaacggccuccagcuguccuucaccgagagccccugggagaccauggaguggcuggaccucacgccgcccaacuccacccccggguucagcgcccugaccaccagcucccccagcaucuucaacaucgacuuccuggacgucaccgaccucaaccugaacuccagcauggaccugcaccuccagcagugguga

SEQ ID NO: 33316 - RNA, 1515 nt, Artificial Sequence
  derived and/or modified sequence opt1 from MYOC__Homo_sapiens__NP_000252
augcgcuucuucugcgcccggugcugcagcuucggccccgagaugccggccgugcagcugcuccugcuggcgugccucgucugggacgugggggcccgcaccgcccagcugcggaaggccaacgaccaguccggccgcugccaguacaccuucagcguggccucccccaacgagagcuccugccccgagcagagccaggcgauguccgucauccacaaccugcagcgggacagcuccacgcagcgccucgaccuggaggccaccaaggcccggcugagcucccucgagagccugcugcaccagcucacccuggaccaggccgcgcgcccccaggagacccaggaggggcugcagcgggagcucggcacgcugcgccgggagcgcgaccagcuggagacccagacccgggagcucgagaccgccuacuccaaccugcugcgcgacaagagcgugcucgaggaggagaagaagcggcugcgccaggagaacgagaaccuggcccggcgccucgaguccagcucccaggagguggcccggcugcgccgggggcagugcccgcagacgcgcgacaccgcccgcgcggucccgcccggcagccgggagguguccaccuggaaccuggacacccucgccuuccaggagcucaagagcgagcugacggaggugcccgccagccgcauccugaaggagucccccagcggcuaccugcgguccggggagggcgacaccgggugcggcgagcuggucugggugggggagccccucacccugcgcaccgccgagacgaucaccggcaaguacggcguguggaugcgggaccccaagcccaccuacccguacacccaggagacgaccuggcgcaucgacaccgucgggaccgacgugcgccagguguucgaguacgaccugaucagccaguucaugcagggcuaccccuccaagguccacauccucccccggccccuggagagcacgggggccgugguguacuccggcagccuguacuuccagggcgcggagucccggaccgucauccgcuacgagcucaacaccgagaccgugaaggccgagaaggagaucccgggggccggcuaccacgggcaguuccccuacagcuggggcggguacacggacaucgaccuggccguggacgaggccggccugugggucaucuacuccaccgacgaggcgaagggcgccaucgugcucagcaagcugaaccccgagaaccuggagcucgagcagaccugggagaccaacauccggaagcaguccguggccaacgccuucaucaucugcgggacgcuguacaccgucagcuccuacaccagcgccgacgcgaccgugaacuucgccuacgacacgggcaccgggaucuccaagacccugaccauccccuucaagaaccgcuacaaguacagcuccaugaucgacuacaacccgcucgagaagaagcuguucgccugggacaaccugaacauggucaccuacgacaucaagcugagcaagauguga

SEQ ID NO: 33317 - RNA, 963 nt, Artificial Sequence
  derived and/or modified sequence opt1 from MYOD1__Homo_sapiens__NP_002469
auggagcugcucagcccgccccugcgcgacguggaccugaccgcccccgacggcucccucugcagcuucgccaccacggacgacuucuacgacgaccccugcuucgacucccccgaccugcgguucuucgaggaccuggacccgcgccucaugcacgucggggcgcugcugaagcccgaggagcacagccacuuccccgccgccgugcaccccgccccgggcgcccgggaggacgagcacgugcgcgcgcccuccgggcaccaccaggccggccggugccuccugugggccugcaaggccugcaagcgcaagaccaccaacgcggaccggcgcaaggccgccaccaugcgggagcgccggcgccugagcaaggucaacgaggccuucgagacgcucaagcggugcaccuccagcaaccccaaccagcgccugcccaagguggagauccugcggaacgccauccgcuacaucgaggggcuccaggcgcugcugcgggaccaggacgccgccccgcccggcgccgccgcggccuucuacgcccccggcccccucccgcccgggcgcggcggggagcacuacuccggcgacagcgacgccuccagcccccgguccaacugcagcgacgggaugauggacuacuccgggcccccgagcggcgcccgccggcgcaacugcuacgagggcgcguacuacaacgaggcccccuccgagccccgccccggcaagagcgccgccguguccagccuggacugccugagcuccaucgucgagcggaucagcaccgaguccccggccgcgcccgcccuccugcuggccgacgugcccagcgaguccccgccccgccggcaggaggccgcggcccccagcgagggggaguccagcggcgaccccacccaguccccggacgccgcgccccagugccccgccggcgccaaccccaacccgaucuaccaggugcucuga

SEQ ID NO: 33318 - RNA, 6186 nt, Artificial Sequence
  derived and/or modified sequence opt1 from MYOF__Homo_sapiens__NP_038479
augcugcgcgugaucguggagagcgccagcaacauccccaagaccaaguucggcaagcccgaccccaucgugagcgugaucuucaaggacgagaagaagaagaccaagaaggucgacaacgagcucaaccccguguggaacgagauccuggaguucgaccugcgggggaucccccucgacuucagcagcucccugggcaucaucgugaaggacuucgagaccaucgggcagaacaagcugaucggcaccgccaccgucgcgcucaaggaccugaccggggaccagagccgcucccugcccuacaagcucaucagccugcugaacgagaagggccaggacaccggcgccaccaucgaccucgugaucggguacgacccgcccuccgcgccccaccccaacgaccugagcggccccuccgugcccgggaugggcggggacggcgaggaggacgagggcgacgaggaccggcuggacaacgccguccgcgggcccggccccaaggggcccgugggcaccgugagcgaggcccagcucgcccggcgccugaccaaggucaagaacucccggcgcaugcugagcaacaagccccaggacuuccagauccgggugcgcgugaucgagggccggcagcucuccgggaacaacauccgccccgucgugaaggugcacgucugcggccagacgcaccggacccgcaucaagcgggggaacaaccccuucuucgacgagcuguucuucuacaacgugaacaugacccccagcgagcugauggacgagaucaucuccauccgcguguacaacagccacucccuccgggccgacugccugaugggcgaguucaagaucgacgucggguucguguacgacgagcccggccacgccgugaugcgcaaguggcugcuccugaacgaccccgaggacaccagcagcggcuccaagggguacaugaaggucagcauguucgugcugggcacgggggacgagcccccgcccgagcggcgcgaccgggacaacgacuccgacgacgucgagagcaaccuccugcugcccgccggcaucgcccuccgcugggugaccuuccugcugaagaucuaccgcgccgaggacaucccgcagauggacgacgccuucucccagaccgugaaggagaucuucgggggcaacgccgacaagaagaaccucgucgaccccuucguggaggugagcuucgccggcaagaaggucugcaccaacaucaucgagaagaacgcgaaccccgaguggaaccagguggugaaccugcagaucaaguuccccuccgucugcgagaagaucaagcugacgaucuacgacugggaccggcucaccaagaacgacgugguggggaccaccuaccugcaccugagcaagaucgccgccuccggcggggaggucgaggacuucagcuccagcggcacgggggccgccuccuacaccgugaacaccggcgagaccgaggugggcuucguccccacguucgggcccugcuaccucaaccuguacggcagcccccgcgaguacaccggguucccggaccccuacgacgagcugaacaccggcaagggcgaggggguggcguaccggggccgcauccucguggagcuggccaccuuccuggagaagacgccgcccgacaagaagcucgagccgaucuccaacgacgaccugcuggucguggagaaguaccagcggcgccggaaguacagccucuccgccguguuccacagcgccaccaugcugcaggacgucggggaggccauccaguucgagguguccaucggcaacuacgggaacaaguucgacacgaccugcaagccccuggcgagcacgacccaguacagccgcgccguguucgacggcaacuacuacuacuaccugcccugggcccacaccaagcccgucgugacccucacguccuacugggaggacaucagccaccggcuggacgccgugaacacccugcucgccauggcggagcgccugcagaccaacaucgaggcccugaaguccggcauccaggggaagaucccggccaaccagcucgccgagcuguggcugaagcucaucgacgaggucaucgaggacacccgguacacccugccccugacggagggcaaggcgaacgugaccgugcucgacacccagauccgcaagcugcggagccgcucccugagccagauccacgaggccgccguccggaugcgcuccgaggccaccgacgucaagagcacgcucgccgagaucgaggacuggcuggacaagcugaugcagcucaccgaggagccccagaacuccaugcccgacaucaucaucuggaugauccggggcgagaagcgccuggcguacgcccggaucccggcccaccaggugcuguacagcaccuccggcgagaacgccagcgggaaguacugcggcaagacccagacgaucuuccucaaguacccccaggagaagaacaacggccccaagguccccguggagcugcgcgugaacaucuggcuggggcucuccgccgucgagaagaaguucaacagcuucgcggagggcaccuucaccguguucgccgagauguacgagaaccaggcccugauguucgggaaguggggcaccuccgggcuggugggccgccacaaguucagcgacgucacgggcaagaucaagcucaagcgggaguucuuccugccgcccaaggggugggagugggagggcgaguggaucguggaccccgagcgcucccugcucaccgaggccgacgccgggcacaccgaguucaccgacgagguguaccagaacgagagccgguaccccggcggggacuggaagccggcggaggacacguacaccgacgccaacggcgacaaggccgccagccccuccgagcugaccugcccgcccggcugggagugggaggacgacgcguggagcuacgacaucaaccgcgccgucgacgagaaggggugggaguacggcaucaccaucccgcccgaccacaagcccaaguccuggguggccgccgagaagauguaccacacgcaccggcgccggcgccuggugcggaagcgcaagaaggaccucacccagaccgccagcuccaccgcgcgggccauggaggagcugcaggaccaggaggggugggaguacgccagccugaucggcuggaaguuccacuggaagcagcgcuccagcgacacguuccggcgccggcgcuggcggcgcaagauggccccguccgagacccacggcgccgcggccaucuucaagcucgagggggcccugggcgccgacaccaccgaggacggggacgagaagucccuggagaagcagaagcacuccgccacgaccgucuucggcgcgaacacccccaucgugagcugcaacuucgaccggguguacaucuaccaccuccgcugcuacgucuaccaggcccggaaccugcuggcccucgacaaggacuccuucagcgaccccuacgcccacaucugcuuccugcaccgcuccaagaccacggagaucauccacagcacccugaaccccaccugggaccagaccaucaucuucgacgagguggagaucuacggggagccgcagacggugcuccagaacccgcccaaggucaucauggagcuguucgacaacgaccaggugggcaaggacgaguuccugggccgcuccaucuucagccccgucgugaagcucaacuccgagauggacaucaccccgaagcugcuguggcaccccgugaugaacggggacaaggcgugcggcgacguccucgugaccgccgagcugauccugcgggggaaggacggcagcaaccuccccauccugcccccgcagcgcgcccccaaccuguacauggugccccaggggauccggcccgucgugcagcucaccgccaucgagauccuggccuggggccugcgcaacaugaagaacuuccagauggcgagcaucaccuccccgagccucguggucgagugcggcggggagcggguggaguccguggucaucaagaaccugaagaagacgcccaacuuccccagcuccgugcuguucaugaagguguuccuccccaaggaggagcuguacaugccgccccuggucaucaaggugaucgaccaccgccaguucggccggaagcccguggucgggcagugcaccaucgagcgccucgaccgguuccgcugcgaccccuacgccggcaaggaggacaucgugccgcagcugaaggccagccugcucuccgcgccgcccugccgggacaucgugaucgagauggaggacaccaagccccugcuggccagcaagcucaccgagaaggaggaggagaucgucgacuggugguccaaguucuacgcgagcuccggggagcacgagaagugcggccaguacauccagaagggcuacagcaagcugaagaucuacaacugcgagcuggagaacguggccgaguucgaggggcucacggacuucuccgacaccuucaagcuguaccgcggcaagagcgacgagaacgaggacccguccguggucggggaguucaagggcagcuuccggaucuacccccugcccgacgacccguccgugcccgcgccgccccgccaguuccgggagcucccggacagcgugccccaggagugcaccguccgcaucuacaucgugcggggccuggagcugcagccccaggacaacaacgggcucugcgaccccuacaucaagaucacccugggcaagaaggugaucgaggaccgcgaccacuacaucccgaacacgcugaaccccgucuucgggcggauguacgagcucuccugcuaccugccccaggagaaggaccugaagaucagcguguacgacuacgacaccuucacccgcgacgagaaggugggcgagaccaucaucgaccucgagaaccgcuuccugagccgguucgggucccacugcggcauccccgaggaguacugcgucagcggcgugaacacguggcgcgaccagcugcggccgacccagcuccugcagaacguggcccgcuucaagggguucccccagcccauccuguccgaggacggcagccggauccgcuacgggggccgggacuacucccucgacgaguucgaggccaacaagauccugcaccagcaccugggggcgcccgaggagcgccuggcccuccacauccugcggacccagggccuggucccggagcacguggagacccgcacgcuccacagcaccuuccagcccaacaucucccagggcaagcugcagauguggguggacgucuuccccaagagccuggggcccccggggccgcccuucaacaucacgccccggaaggccaagaaguacuaccuccgcgugaucaucuggaacaccaaggacgugauccuggacgagaaguccaucacgggggaggagaugagcgacaucuacgucaagggcuggaucccggggaacgaggagaacaagcagaagaccgacgugcacuaccggucccuggacggcgagggcaacuucaacuggcgcuucguguuccccuucgacuaccuccccgccgagcagcugugcaucgucgccaagaaggagcacuucuggagcaucgaccagaccgaguuccggaucccgccccgccugaucauccagaucugggacaacgacaaguucucccucgacgacuaccugggguuccuggagcucgaccugcggcacaccaucauccccgccaagagccccgagaagugccgccuggacaugauccccgaccucaaggccaugaacccccugaaggccaagacggccucccuguucgagcagaaguccaugaagggcugguggcccugcuacgcggagaaggacggggcccgggugauggccggcaagguggagaugacccucgagauccugaacgagaaggaggccgacgagcgccccgccgggaagggccgggacgagccgaacaugaaccccaagcuggaccuccccaaccgccccgagaccuccuuccugugguucaccaacccgugcaagacgaugaaguucaucgucuggcgccgguucaagugggugaucaucggccuccuguuccugcugauccuccugcuguucguggcgguccuccuguacagccugcccaacuaccucuccaugaagaucgugaagcccaacgucuga

SEQ ID NO: 33319 - RNA, 675 nt, Artificial Sequence
  derived and/or modified sequence opt1 from MYOG__Homo_sapiens__NP_002470
auggagcuguacgagaccagccccuacuucuaccaggagccgcgcuucuacgacggcgagaacuaccuccccgugcaccuccagggguucgagccgcccggcuacgagcggaccgagcugacgcugucccccgaggcccccgggccccuggaggacaagggccuggggacccccgagcacugcccgggccagugccuccccugggccugcaaggucugcaagcgcaagagcguguccguggaccggcgccgggcggccacccugcgcgagaagcggcgccugaagaaggucaacgaggccuucgaggcccucaagcggagcacccugcugaaccccaaccagcgccuccccaagguggagauccugcgguccgccauccaguacaucgagcgccugcaggcgcuccugagcucccugaaccaggaggagcgggaccuccgcuaccggggcgggggcgggccgcagcccggcgugcccagcgagugcuccagccacuccgccagcugcucccccgagugggggagcgcccuggaguucuccgccaacccgggcgaccaccuccugacggcggaccccaccgacgcccacaaccugcacagccugaccuccaucgucgacagcaucaccguggaggacguguccgucgccuuccccgacgagacgaugcccaacuga

SEQ ID NO: 33320 - RNA, 5058 nt, Artificial Sequence
  derived and/or modified sequence opt1 from MYOM1__Homo_sapiens__NP_003794
augucccuccccuucuaccagcgcugccaccagcacuacgaccucuccuaccggaacaaggacgugcgcagcaccgucucccacuaccagcgggagaagaagcgcagcgccguguacacccagggguccacggccuacagcucccggagcuccgccgcccaccgccgggagagcgaggccuuccgccgggccuccgccagcuccagccagcagcaggccucccagcacgcccugagcuccgaggugagccgcaaggccgccuccgcguacgacuacgggagcagccacggccugaccgacuccagccuccugcuggacgacuacuccagcaagcucucccccaagcccaagcgggccaagcacagccugcuguccggggaggagaaggagaaccuccccagcgacuacaugguccccaucuucuccggccgccagaagcacgugagcgggaucaccgacaccgaggaggagcggaucaaggaggccgccgccuacaucgcgcagcgcaaccugcuggccuccgaggagggcaucaccaccagcaagcaguccaccgccagcaagcagaccacggccuccaagcagagcaccgccuccaagcagagcaccgcguccaagcagagcaccgccagccggcaguccacggccagccgccaguccguggucagcaagcaggccaccuccgcccuccagcaggaggagaccagcgagaagaagucccggaagguggugauccgcgagaaggcggagcggcugagccugcgcaagacccucgaggagacggagaccuaccacgccaagcugaacgaggaccaccuccuccacgcccccgaguucaucaucaagccccggucccacaccgucugggagaaggagaacgugaagcugcacugcagcaucgccggcuggcccgagccccgcgugaccugguacaagaaccagguccccaucaacgugcacgccaaccccgggaaguacaucaucgagucccgcuacggcaugcacacgcuggagaucaacgggugcgacuucgaggacaccgcgcaguaccgggccagcgccaugaacgugaagggcgagcucuccgccuacgcgagcgucguggugaagcgcuacaagggggaguucgacgagacccgguuccacgccggcgccuccaccaugccccugagcuucggcgucacgcccuacggguacgccucccgcuucgagauccacuucgacgacaaguucgacgugagcuucggccgggagggggagaccaugagccugggcugccgcguggucaucacccccgagaucaagcacuuccagcccgagauccagugguaccggaacggcgugccccucucccccagcaagugggugcagacccugugguccggggagcgcgccacgcugaccuucagccaccucaacaaggaggacgagggccuguacaccauccggguccgcaugggggaguacuacgagcaguacuccgcguacguguucguccgggacgccgacgccgagaucgagggcgccccggccgcgccccuggacgugaagugccucgaggccaacaaggacuacaucaucaucagcuggaagcagcccgccguggacgggggcucccccauccugggcuacuucaucgacaagugcgaggucgggaccgacagcuggucccagugcaacgacacgccggugaaguucgcccgcuuccccgugaccggccugaucgaggggcggagcuacaucuuccgcguccgggccgugaacaagaugggcaucggguuccccucccgcgugagcgagcccgucgcggcccucgacccggccgagaaggcccggcugaagucccgccccagcgcgcccuggaccggccagaucaucgugaccgaggaggagcccuccgagggcaucgugccggggccgcccacggaccugagcgucaccgaggccacccgguccuacguggugcucagcuggaagccgcccggccagcgcgggcacgagggcaucauguacuucgucgagaagugcgaggccgggaccgagaacuggcagcgcgugaacaccgagcugcccgucaagagcccccgguucgcccuguucgaccucgccgagggcaagagcuacugcuuccgcgugcggugcagcaacuccgcgggcgugggggagccgagcgaggccacggaggugaccgucgugggcgacaagcuggacauccccaaggcccccgggaagaucauccccucccgcaacaccgacaccagcguggucguguccugggaggagagcaaggacgccaaggagcuggugggcuacuacaucgaggccuccgucgcgggcagcgggaagugggagccgugcaacaacaaccccgugaagggcucccgguucacgugccacgggcucgugaccggccagagcuacaucuuccgcguccgggccgugaacgccgccgggcuguccgaguacagccaggacuccgaggccaucgaggugaaggcggccaucggcggcggggucagccccgacgugugccccgcccuguccgacgagccgggcgggcucaccgccagccgcggccgggugcacgaggcgagcccgcccaccuuccagaaggacgcccugcuggggagcaagcccaacaagccgucccuccccagcagcucccagaaccugggccagacggaggucagcaagguguccgagaccgugcaggaggagcugacgccgccgccccagaaggccgcgccccagggcaagagcaaguccgacccccugaagaagaagaccgaccgcgcgccgcccuccccgcccugcgacaucacgugccucgaguccuuccgggacagcaugguccugggguggaagcagcccgacaagaucggcggggcggagaucaccggcuacuacgugaacuaccgcgaggugaucgacgggguccccggcaaguggcgggaggccaacgugaaggccguguccgaggaggccuacaagaucagcaaccugaaggagaacauggucuaccaguuccagguggccgcgaugaacauggccggccucggggcccccuccgccgugagcgagugcuucaagugcgaggaguggaccaucgccguccccggcccgccccacucccugaagugcagcgaggugcgcaaggacucccuggugcuccaguggaagccgcccguccacagcgggcggacccccgugacgggcuacuucgucgaccugaaggaggcgaaggccaaggaggaccaguggcgcgggcugaacgaggccgccaucaagaacguguaccucaaggugcggggccugaaggagggcgucuccuacguguuccgcgugcgggccaucaaccaggcgggggucggcaagcccagcgaccuggccgggcccgugguggccgagacccgccccggcaccaaggaggucguggugaacgucgacgacgacggcgugaucucccucaacuucgagugcgacaagaugacccccaaguccgaguucagcugguccaaggacuacgugagcacggaggacagcccccggcuggaggucgagagcaaggggaacaagaccaagaugaccuucaaggaccugggcauggacgaccucgggaucuacuccugcgacgugaccgacacggacggcaucgccagcuccuaccugaucgacgaggaggagcugaagcgccuccuggcgcugagccacgagcacaaguuccccaccgugcccgucaaguccgagcucgccguggagauccuggagaagggccaggugcgcuucuggaugcaggccgagaagcugagcggcaacgccaaggucaacuacaucuucaacgagaaggagaucuucgagggcccgaaguacaagaugcacaucgaccggaacaccgggaucaucgagauguucauggagaagcuccaggacgaggacgagggcaccuacacguuccagcugcaggacgggaaggccaccaaccacuccaccguggugcuggucggcgacguguucaagaagcuccagaaggaggcggaguuccagcgccaggaguggauccggaagcaggggccccacuucguggaguaccugagcugggaggucaccggcgagugcaacgugcugcucaagugcaagguggccaacaucaagaaggagacgcacaucgucugguacaaggacgagcgcgagaucuccguggacgagaagcacgacuucaaggacggcaucugcacccugcugaucaccgaguucagcaagaaggacgccgggaucuacgaggugauccucaaggacgaccggggcaaggacaagucccgccugaagcuggucgacgaggccuucaaggagcucaugauggaggugugcaagaagaucgcccugagcgcgaccgaccugaagauccaguccacggccgaggggauccagcucuacagcuucgugaccuacuacgucgaggaccugaaggugaacuggucccacaacggcagcgccauccgguacagcgaccgcgugaagaccggggucaccggcgagcagaucuggcugcagaucaacgagcccacccccaacgacaagggcaaguacgugauggagcuguucgacgggaagacgggccaccagaagaccguggaccuguccgggcaggccuacgacgaggccuacgcggaguuccagcggcugaagcaggccgccaucgccgagaagaaccgcgcgcggguccucggcggccugccggacguggugaccauccaggaggggaaggcccugaaccugaccugcaacgucuggggcgacccgccgcccgaggugagcuggcugaagaacgagaaggcccuggccuccgacgaccacugcaaccucaaguucgaggccgggcgcacggcguacuucaccaucaacggcgugagcaccgccgacuccgggaaguacggccuggucgugaagaacaaguacggcagcgagaccuccgacuucacggugagcgucuucaucccggaggaggaggcccggauggccgcccuggagucccucaagggcgggaagaaggcgaaguga

SEQ ID NO: 33321 - RNA, 4398 nt, Artificial Sequence
  derived and/or modified sequence opt1 from MYOM2__Homo_sapiens__NP_003961
augagccuggugaccguccccuucuaccagaagcgccaccggcacuucgaccaguccuaccgcaacauccagacccgguaccuccuggacgaguacgccagcaagaagcgcgccuccacgcaggcgagcucccagaagucccugucccagcggagcuccagccagcgcgccuccagccagaccucccucggcgggaccaucugccgggugugcgccaagcgcgugagcacccaggaggacgaggagcaggagaaccggucccgcuaccagagccuggucgccgccuacggcgaggcgaagcggcagcgcuuccuguccgagcucgcccaccuggaggaggacgugcaccuggcccggagccaggcccgcgacaagcucgacaaguacgcgauccagcagaugauggaggacaagcuggccugggagcggcacacguucgaggagcgcaucucccgggccccggagauccuggugcgccuccggagccacaccgucugggagcgcaugagcgugaagcugugcuucaccgugcagggguuccccacccccgucgugcagugguacaaggacggcucccugaucugccaggccgccgagcccgggaaguaccggaucgagagcaacuacggcgugcacacgcucgagaucaaccgcgcggacuucgacgacaccgccaccuacuccgccgucgccaccaacgcccacggccaggugagcacgaacgcggccguggucgugcgccgguuccgcggggacgaggagccguuccgguccgugggccugcccaucgggcugccccucagcuccaugauccccuacacccacuucgacguccaguuccuggagaaguucggcgugaccuuccgccgggagggggagaccgugacgcugaagugcaccaugcucgucaccccggaccugaagcgcgugcagccccgggccgagugguaccgcgacgacgugcugcucaaggagagcaaguggaccaagauguucuucggcgagggccaggccucccugagcuucucccaccuccacaaggacgacgaggggcuguacacgcugcggaucgucagccgcggcgggguguccgaccacagcgccuuccuguucguccgggacgcggacccccucgugaccggcgcccccggcgccccgauggaccugcagugccacgacgccaaccgcgacuacgugaucgucaccuggaagccgcccaacaccacgaccgagucccccgugaugggguacuucguggaccggugcgaggucggcaccaacaacugggugcagugcaacgacgcccccgugaagaucugcaaguaccccgucaccgggcuguucgagggccgcagcuacaucuuccgggugcgcgcggugaacuccgccgggaucagccggcccucccgcgucagcgacgccguggccgcgcucgacccccuggaccugcggcgccuccaggccgugcaccuggagggcgagaaggagaucgccaucuaccaggacgaccuggagggcgacgcccaggucccggggccgcccacgggcgugcacgccagcgagaucucccgcaacuacgugguccucagcugggagccgcccacgccccgggggaaggacccccugauguacuucaucgagaaguccguggugggcagcggguccuggcagcgcgucaacgcgcagaccgccgugcggagcccccgcuacgccguguucgaccugauggagggcaaguccuacgucuuccgggugcucagcgccaaccgccacggccuguccgagcccagcgagaucaccucccccauccaggcccaggacgugaccgucgugcccagcgcgccggggcgggugcuggccucccgcaacaccaagaccagcgucguggugcagugggaccggcccaagcacgaggaggaccuccugggcuacuacgucgacugcugcguggccgggaccaaccugugggagcccugcaaccacaagcccaucggcuacaaccgcuucgugguccacgggcucacgaccggcgagcaguacaucuuccgggugaaggccgugaacgccgucggcauguccgagaacagccaggaguccgacgugaucaaggugcaggcggcccugaccgucccgagccaccccuacgggaucacccugcugaacugcgacggccacagcaugacccucggguggaaggugcccaaguucuccggcggcagccccauccugggguacuaccuggacaagcgcgaggugcaccacaagaacuggcacgaggucaacuccagcccguccaagcccacgauccucaccguggacggccugaccgaggggagccuguacgaguucaagaucgccgccgugaaccucgcgggcaucggggagcccuccgaccccagcgagcacuucaagugcgaggccuggaccaugccggagcccggccccgccuacgaccugacguucugcgagguccgggacaccucccuggugaugcucuggaaggcccccguguacagcggcuccagcccggucuccggguacuucguggacuuccgcgaggaggacgccggcgaguggaucaccgucaaccagaccacgaccgcgagccgguaccugaagguguccgaccugcagcaggggaagaccuacguguuccgcguccgggccgugaacgccaacggcguggggaagcccagcgacaccuccgagcccguccucguggaggcccgccccggcacgaaggagaucagcgccggcguggacgagcaggggaacaucuaccugggcuucgacugccaggagaugaccgacgcgucccaguucaccuggugcaagagcuacgaggagaucagcgacgacgagcgguucaagaucgagaccgucggggaccacuccaagcuguaccucaagaacccggacaaggaggaccugggcacguacagcguguccgugagcgacaccgacggggucuccagcuccuucgugcuggaccccgaggagcucgagcgccugauggcccugagcaacgagaucaagaaccccaccaucccccucaaguccgagcuggccuacgagaucuucgacaagggccgggugcgcuucuggcugcaggccgagcaccucagcccggacgccuccuaccgcuucaucaucaacgaccgggaggucagcgacuccgagauccaccgcaucaagugcgacaaggcgaccggcaucaucgagauggugauggaccgguucagcaucgagaacgaggggacguacaccgugcagauccacgacggcaaggccaagucccagagcucccugguccugaucggggacgccuucaagaccgugcucgaggaggccgaguuccagcgcaaggaguuccugcggaagcagggcccccacuucgcggaguaccugcacugggacgugaccgaggagugcgagguccgccucgugugcaagguggccaacacgaagaaggagaccgucuucaaguggcugaaggacgacgugcuguacgagaccgagacccuccccaaccuggagcgggggaucugcgagcugcucaucccgaagcugagcaagaaggaccacggcgaguacaaggccacgcugaaggacgaccgcggccaggacguguccauccucgagaucgccgggaaggucuacgacgacaugauccuggccaugagccgggugugcggcaagagcgcgagcccccugaaggugcucugcacccccgaggggauccgccugcagugcuucaugaaguacuucaccgacgagaugaaggucaacuggugccacaaggacgccaagaucagcuccagcgagcacaugcggaucggcggcuccgaggagauggccuggcugcagaucugcgagcccaccgagaaggacaaggggaaguacacguucgagaucuucgacggcaaggacaaccaccagcgcagccucgaccuguccgggcaggccuucgacgaggccuucgcggaguuccagcaguucaaggccgccgccuucgccgagaagaaccggggccgccugaucgggggccucccggacguggugaccaucauggagggcaagacccugaaccugaccugcacggucuucgggaaccccgaccccgaggugaucugguucaagaacgaccaggacauccagcucagcgagcacuucuccgugaaggucgagcaggcgaaguacgugagcaugaccaucaagggcgugaccuccgaggacagcgggaaguacuccaucaacaucaagaacaaguacggcggggagaagaucgacgucaccgugagcguguacaagcacggcgagaagauccccgacauggccccgccccagcaggccaagcccaagcugauccccgccuccgccagcgcggccggccaguga

SEQ ID NO: 33322 - RNA, 945 nt, Artificial Sequence
  derived and/or modified sequence opt1 from MYOT__Homo_sapiens__NP_001129412
auggcccgccggcugcucggcccccagaacgccgcggccguguuccaggcccaggacgacagcggggcccaggacucccagcagcacaacagcgagcacgcccgccugcaggucccgaccucccaggugcggagccgcuccaccagccggggcgacgugaacgaccaggacgcgauccaggagaaguucuacccgccccgcuucauccagguccccgagaacauguccaucgacgaggggcgguucugccgcauggacuucaaggugagcggccugcccgcccccgacguguccugguaccucaacgggcggacgguccagagcgacgaccugcacaagaugaucguguccgagaagggccugcacagccucaucuucgaggugguccgcgccuccgacgccggcgcguacgccugcguggccaagaaccgggccggggaggccaccuucaccgugcagcuggacguccuggcgaaggagcacaagcgcgcccccauguucaucuacaagccccagagcaagaaggugcucgagggcgacuccgugaagcuggagugccagaucagcgccaucccgccgcccaagcuguucuggaagcggaacaacgagaugguccaguucaacaccgaccgcaucucccucuaccaggacaacacggggcgggugacccugcugaucaaggacgugaacaagaaggacgccggcugguacaccgucagcgccgugaacgaggcgggggugaccacgugcaacacccgccucgacgucaccgcccggcccaaccagacccugcccgcccccaagcagcugcgcgugcggcccacguucuccaaguaccucgcccugaacggcaagggccugaacgugaagcaggccuucaaccccgagggggaguuccagcgccucgcggcccagagcggccuguacgagagcgaggagcuguga

SEQ ID NO: 33323 - RNA, 900 nt, Artificial Sequence
  derived and/or modified sequence opt1 from MYOZ1__Homo_sapiens__NP_067068
augccccugagcggcaccccggcccccaacaagaagcgcaaguccagcaagcucaucauggagcugaccgggggcgggcaggaguccagcggccugaaccucgggaagaagaucuccgugccccgggacgucaugcuggaggagcugagccuccugacgaaccgcggcuccaagauguucaagcugcggcagaugcgcguggagaaguucaucuacgagaaccaccccgacguguucagcgacuccagcauggaccacuuccagaaguuccucccgaccgucggcgggcagcugggcaccgccgggcagggcuucuccuacagcaaguccaacgggcggggcggcagccaggccgggggcuccgggagcgcgggccaguacggcuccgaccagcagcaccaccuggggagcggcuccggggccggcgggaccggcggccccgccgggcaggccggccgcgggggcgcggccgggacggccggcgugggcgagaccgggagcggcgaccaggccgggggcgaggggaagcacaucaccguguucaagaccuacaucagccccugggagcgggcgaugggcgucgacccccagcagaagauggagcucggcaucgaccugcuggccuacggggccaaggccgagcucccgaaguacaaguccuucaaccgcacggccaugcccuacggcggguacgagaaggcgagcaagcggaugaccuuccagaugcccaaguucgaccugggcccccugcucuccgagccgcuggugcuguacaaccagaaccucagcaaccgccccuccuucaaccggacccccauccccuggcugagcuccggcgagccgguggacuacaacgucgacaucgggaucccccuggacggcgagaccgaggagcucuga

SEQ ID NO: 33324 - RNA, 795 nt, Artificial Sequence
  derived and/or modified sequence opt1 from MYOZ2__Homo_sapiens__NP_057683
augcugagccacaacaccaugaugaagcagcgcaagcagcaggccaccgccaucaugaaggaggugcacggcaacgacgucgacgggauggaccucggcaagaagguguccaucccccgggacaucaugcuggaggagcugagccaccucuccaaccgcggggcgcggcuguucaagaugcgccagcggcgcagcgacaaguacacguucgagaacuuccaguaccagucccgggcccagaucaaccacagcaucgccaugcagaacggcaagguggacggguccaaccuggagggcggcagccagcaggccccgcucaccccgcccaacacccccgacccccgcuccccgcccaaccccgacaacaucgcccccggguacagcggcccccugaaggagaucccgcccgagaaguucaacaccacggcgguccccaaguacuaccagucccccugggagcaggccaucagcaacgaccccgagcugcucgaggcccuguaccccaagcuguucaagccggaggggaaggccgagcuccccgacuaccgguccuucaaccgcguggcgacccccuucggcggguucgagaaggccagccggauggugaaguucaagguccccgacuucgagcugcugcuccugaccgacccgcgcuucauguccuucgugaacccccugagcggccggcgcuccuucaaccggacccccaagggcuggaucagcgagaacauccccaucgugaucacgaccgagccgaccgacgacaccacgguccccgaguccgaggaccucuga

SEQ ID NO: 33325 - RNA, 756 nt, Artificial Sequence
  derived and/or modified sequence opt1 from MYOZ3__Homo_sapiens__XP_011536006
augauccccaaggagcagaagggcccggugauggccgccaugggggaccugaccgagcccguccccacccucgaccugggcaagaagcugagcgugccccaggaccucaugauggaggagcugucccugcgcaacaaccgggggagccuccuguuccagaagcgccagcggcgcgugcagaaguucacguucgagcuggcggccucccagcgggccaugcucgccggcagcgcccgccggaaggucaccgggaccgcggaguccggcaccguggccaacgccaacggcccggaggggcccaacuaccgcagcgagcugcacaucuuccccgccucccccggcgcgagccucgggggcccggagggggcccaccccgccgccgcccccgcgggcugcgugcccuccccgagcgcccuggcccccggcuacgccgagccccugaagggggugcccccggagaaguucaaccacacggccaucuccaagggcuaccggugccccuggcaggaguucgucagcuaccgcgacuaccaguccgacgggcggagccacacccccucccccaacgacuaccgcaacuucaacaagaccccggugcccuucggcggcccccuggucgggggcaccuucccccggccggggacgcccuucauccccgagccccucagcggccuggagcugcuccgccugcggccguccuucaaccgcguggcgcaggggugggugcggaaccugcccgagagcgaggagcucuga

SEQ ID NO: 33326 - RNA, 3963 nt, Artificial Sequence
  derived and/or modified sequence opt1 from MYPN__Homo_sapiens__NP_001243196
augcaggacgacuccaucgaggccuccaccagcaucucccagcugcuccgcgagagcuaccuggccgagacccggcaccgcggcaacaacgagcggucccgcgccgagcccagcuccaaccccugccacuucggcagccccuccggcgccgccgagggcgggggcgggcaggacgaccugcccgaccucagcgccuuccugucccaggaggagcuggacgagagcgugaaccucgcccggcuggcgaucaacuacgacccccuggagaaggccgacgagacccaggcccgcaagcggcucucccccgaccagaugaagcacagccccaaccuguccuucgagcccaacuucugccaggacaacccccgcagccccaccuccagcaaggagagcccccaggaggccaagcggccccaguacugcagcgagacccagagcaagaaggucuuccugaacaaggcggccgacuucaucgaggagcucuccagccuguucaagucccacagcuccaagcgcauccggccccgcgccugcaagaaccacaagagcaagcuggagucccagaacaaggugaugcaggagaacagcuccagcuucuccgaccucagcgagcggcgcgagcgguccagcgugcccauccccauccccgccgacacccgcgacaacgaggugaaccacgcccuggagcagcaggaggcgaagcggcgcgaggccgagcaggccgccuccgaggccgcgggcggggacaccacccccggcagcucccccagcucccuguacuacgaggagccccucgggcagccgccccgguucacccagaagcugcgcagccgggaggugcccgagggcacccgcgugcagcuggacugcaucgucguggggaucccgccgccccaggugcgcugguacugcgagggcaaggagcucgagaacagccccgacauccacaucguccaggccggcaaccugcacucccugaccaucgccgaggccuucgaggaggacaccgggcgguacagcugcuucgccuccaacaucuacggcaccgacagcaccuccgcggagaucuacaucgagggggugagcuccagcgacuccgagggcgaccccaacaaggaggagaugaaccgcauccagaagcccaacgaggugagcagcccgcccacgaccuccgccgucaucccgcccgccgugccccaggcccagcaccucguggcccagccccgggucgcgaccauccagcagugccagucccccaccaacuaccugcagggccuggacgggaagcccaucaucgccgcccccguguucaccaagaugcuccagaaccugagcgccuccgagggccagcugguggucuucgagugccgcgugaagggggcgcccagccccaagguggagugguaccgggagggcacccucaucgaggacucccccgacuuccgcauccugcagaagaagccgcggagcauggccgagcccgaggagaucugcacccuggucaucgccgagguguucgccgaggacagcgggugcuucacgugcacggccuccaacaaguacggcaccgugagcuccaucgcgcagcuccacguccgcggcaacgaggaccugagcaacaacgggucccugcacagcgccaacuccaccaccaaccucgccgccaucgagccccagcccagcccgccccacuccgagccgcccagcguggagcagccgcccaagcccaagcuggagggcguccuggugaaccacaacgagccccgguccagcucccgcaucgggcuccgggugcacuucaaccugccggaggacgacaagggcagcgaggccuccagcgaggcgggggucgugacgacccgccagacccggcccgacuccuuccaggagcgcuucaacggccaggccaccaagacgcccgagcccagcuccccggugaaggagccgccgcccguccuggccaagcccaagcucgacagcacccagcugcagcagcugcacaaccaggugcuccuggagcagcaccagcugcagaacccgccgcccagcucccccaaggaguuccccuucagcaugaccgugcucaacuccaacgcgccgcccgccgucaccacgagcuccaagcaggucaaggcgcccagcucccagaccuucagccuggcccggcccaaguacuucuuccccuccaccaacaccacggccgccaccguggcgcccagcuccagccccgucuucacccuguccagcacgccccagaccauccagcgcacgguguccaaggagagccugcucgugucccaccccagcguccagaccaagucccccggcgggcugagcauccagaacgagccccugccgcccggccccaccgagcccacgccgccgcccuucacguucagcauccccuccgggaaccaguuccagccccggugcgugagccccauccccgugucccccaccagccgcauccagaaccccgucgccuuccucuccagcgugcugccgucccugcccgccaucccgcccaccaacgccaugggccucccgcggagcgcccccuccaugcccagccaggggcuggcgaagaagaacaccaagagcccccagccggugaacgacgacaacauccgcgagacgaagaacgccgucauccgcgaccugggcaagaagaucaccuucagcgacgugcggcccaaccagcaggaguacaagaucuccagcuucgagcagcgccucaugaacgagaucgaguuccggcuggagcgcacccccguggacgaguccgacgacgagauccagcacgacgagauccccaccggcaagugcaucgccccgaucuucgacaagcggcugaagcacuuccgcgucacggaggggagccccgugaccuucacgugcaagaucgugggcauccccguccccaagguguacugguucaaggacgggaagcagaucuccaagcggaacgagcacugcaagaugcgccgggagggcgacgggaccugcagccuccacaucgaguccacgaccagcgacgacgacgggaacuacaccaucauggccgccaacccgcagggccgcaucagcugcuccgggcaccugauggugcagagccugcccauccggucccgccucaccagcgcgggccagucccaccgggggcgcagccggguccaggagcgcgacaaggagccccugcaggagcgguucuuccgcccccacuuccugcaggccccgggcgacaugguggcccacgagggccggcucugccgccuggacugcaagguguccgggcugccgccgcccgagcucacguggcugcugaacggccagccgguccuccccgacgccagccacaagaugcuggugcgggagaccggggugcacucccugcucaucgacccccugacccagcgcgacgccggcaccuacaagugcaucgcgacgaacaagaccgggcagaacagcuucucccuggagcucagcgucguggccaaggaggugaagaaggcccccgucauccuggagaagcugcagaacugcggcgugccggagggccaccccgugcgccucgagugccgggucaucgggaugcccccgcccguguucuacuggaagaaggacaacgagaccauccccugcacccgcgagcggaucuccaugcaccaggacacgaccggcuacgccugccugcugauccagcccgcgaagaaguccgacgccgggugguacacccucuccgccaagaacgaggccggcaucgugagcugcaccgcccgccuggacaucuacgcgcaguggcaccaccagaucccgccgcccauguccguccggcccagcgggucccgcuacggcagccugacgagcaagggccucgacaucuucuccgccuucagcuccauggagagcaccaugguguacuccugcagcucccggagcguggucgaguccgacgagcuguga

SEQ ID NO: 33327 - RNA, 3456 nt, Artificial Sequence
  derived and/or modified sequence opt1 from MYRF__Homo_sapiens__NP_001120864
auggagguggucgacgagaccgaggcccugcagcgcuucuucgagggccacgacaucaacggggcccucgagcccagcaacaucgacaccuccauccuggaggaguacaucagcaaggaggacgcguccgaccugugcuucccggacaucagcgcccccgccuccagcgccuccuacagccacggccagcccgccaugcccggguccagcggcgugcaccaccucuccccgcccgggggcggccccagccccgggcggcacggcccgcugcccccgcccggguacggcacgccccugaacugcaacaacaacaacgggaugggcgcggcccccaagcccuuccccggcgggaccggcccgcccaucaaggccgagcccaaggcccccuacgcgccggggacccuccccgacuccccgcccgacagcggcuccgaggccuacagcccccagcaggucaacgagccccaccuccugcgcaccaucacgcccgagacccucugccacgucggcgugcccucccggcuggagcacccgccgccgccgcccgcccaccuccccgggcccccgcccccgccgcccccgccgccccacuaccccgugcuccagcgcgaccuguacaugaaggccgagccgcccaucccccacuacgccgcgaugggccaggggcugguccccaccgaccuccaccacacccagcagagccagaugcugcaccagcugcuccagcagcacggcgccgagcugcccacgcaccccuccaagaagcggaagcacagcgaguccccgcccagcacccugaacgcccagaugcucaacgggaugaucaagcaggagcccggcaccgugaccgcccugccccugcaccccacgcgcgcccccagcccgcccuggccgccccagggcccccucucccccgggcccggcagccugccccuguccaucgcgcgggugcagaccccgcccuggcacccgcccggggcccccagccccggccuccugcaggacuccgacagccuguccgggagcuaccucgaccccaacuaccaguccaucaaguggcagccccaccagcagaacaagugggccacccuguacgacgccaacuacaaggagcugcccaugcucaccuaccgcgucgacgccgacaagggcuucaacuucagcgugggcgacgacgcguucgugugccagaagaagaaccacuuccaggugacgguguacaucgggaugcugggcgagcccaaguacgugaagacccccgaggggcugaagccccuggacugcuucuaccugaagcugcacggcgucaagcuggaggcccugaaccaguccaucaacaucgagcagagccaguccgaccggagcaagcgccccuucaaccccgugaccgugaaccugccgcccgagcaggucaccaaggugacgguggggcggcuccacuucuccgagaccaccgccaacaacaugcgcaagaagggcaagcccaaccccgaccagcgguacuucaugcuggucguggcccugcaggcccacgcgcagaaccagaacuacacccucgccgcccagaucagcgagcgcaucaucgugcgggccuccaaccccggccaguucgagagcgacagcgacguccuguggcagcgcgcccaggugcccgacacggucuuccaccacgggcgggugggcaucaacaccgaccgccccgacgaggcgcuggugguccacgggaacgugaaggugaugggcucccucaugcaccccagcgaccugcgggccaaggagcacguccaggagguggacaccaccgagcagcugaagcgcaucucccggaugcgccuggugcacuaccgcuacaagcccgaguucgccgccagcgcgggcaucgaggccacggcccccgagaccggggucaucgcccaggaggugaaggagauccuccccgaggccgugaaggacaccggcgacauggucuucgcgaacgggaagaccaucgagaacuuccugguggugaacaaggagcggaucuucauggagaacgucggcgccgugaaggagcugugcaagcucacggacaaccuggagacccgcaucgacgagcuggagcgguggucccacaagcucgccaagcugcgccggcuggacagccucaaguccaccgggagcuccggcgccuucagccacgccggcucccaguucagccgcgcgggguccgugccgcacaagaagcggccgcccaaggucgccagcaaguccagcuccguggugcccgaccaggccugcaucagccagcgcuuccugcagggcaccaucaucgcccuggucguggugauggcguucagcgucguguccaugagcacgcucuacgugcugucccugcggaccgaggaggaccucgucgacaccgacgggagcuucgccguguccaccagcugccugcuggcccuccugcgcccccagccgcccggcggguccgaggcccugugccccuggagcucccagagcuucggcaccacgcagcuccggcagagcccccugaccaccggccugcccgggauccagcccucccuccugcuggugaccacgucccucaccagcuccgcccccggcagcgcgguccgcacccuggacaugugcuccagccacccgugccccgugaucugcugcuccagccccaccacgaaccccaccaccgggccgagccugggccccuccuucaaccccgggcacgugcucagccccuccccgagccccuccaccaaccggagcggccccucccagauggcccugcugcccgucacgaacauccgcgccaagagcuggggccucuccgugaacgggaucggccacagcaagcaccacaagucccuggagccgcuggccagccccgccgugcccuuccccgggggccaggggaaggcgaagaacuccccgagccucggcuuccacggccgggcccgccgcggggcccugcaguccagcgucggccccgccgagcccaccugggcccaggggcaguccgcgagccugcucgccgagccggugcccucccugaccagcauccaggugcuggagaacagcauguccaucaccagccaguacugcgcccccggcgacgccugccggcccggcaacuucacguaccacaucccggucuccagcgggacgccccuccaccugucccugacccuccagaugaacagcuccagccccguguccgugguccugugcagccugcgguccaaggaggagcccugcgaggagggcagccucccgcagucccugcacacccaccaggacacccaggggaccagccaccgcuggcccaucaccauccuguccuuccgcgaguucaccuaccacuuccggguggcgcuccugggccaggccaacugcagcuccgaggcccuggcccagcccgccacggacuaccacuuccacuucuaccgccucugcgacuga

SEQ ID NO: 33328 - RNA, 2208 nt, Artificial Sequence
  derived and/or modified sequence opt1 from MYRFL__Homo_sapiens__XP_011537358
augaacuucaccgccaccacgcagaccgagaugaccagccgcucccggagcuccgaggugcaggaccccgacagcgagggccagaaccgcaugccgaccgaccagugcucccccgcccugaaguggcagcccugccacagcguccccuggcacucccuccugaacagccacuacgagaagcugccggacgugggguaccggguggucacggacaagggcuucaacuucucccccgcggacgaggccuucgugugccagaagaagaaccacuuccagaucaccauccacauccaggugugggggagccccaaguucgucgagaccgagaugggccucaagcccaucgagauguucuaccugaagguguucgggaccaagguggaggccacgaaccagaucaucgccaucgagcagucccaggccgaccgcagcaagaagaucuucaacccggucaagaucgaccugcucgcggaccaggugaccaaggugacccugggccggcugcacuucuccgagaccacggccaacaacaugcgcaagaagggcaagcccaaccccgaccagcgguacuucaugcucgucguggggcuguacgccgccaaccaggaccaguucuaccugcucagcgcgcacaucuccgagcgcaucaucgugcgggccagcaaccccggccaguucgagaacgacuccgacgcccuguggcagcgcgggcaggucccggagagcaucgugugccacggccggguggggaucaacaccgacgcccccgacgaggcccuggucgugugcggcaacaugaaggugaugggcaccaucaugcaccccuccgacagccgcgcgaagcagaacauccaggaggucgacaccaacgagcagcucaagcggaucgcccagaugcgcaucguggaguacgacuacaagcccgaguucgccagcgccauggggaucaacacggcccaccagaccggcaugaucgcgcaggaggugcaggagauccugccgcgggccguccgcgaggugggggacgugaccugcggcaacggcgagacccuggagaacuuccucauggucgacaaggaccagaucuucauggagaacgugggggccgucaagcagcugugcaagcugacgaacaaccucgaggagcggaucgaggagcuggagaucuggaaccgcaagcuggcccggcucaagcgccuguccagcuggaaguccagcgccuccgaggcgagcaccaucuccaagagcucccgggccgugagcgccuccagcccccgccgcgccgugcacaagaagaacaacaaggucuacuucuccggcaagcggcaggccugccccaacuggguguuccagacccuggugaucacccucaucgcggucauggccuucugcgcccugacgaucguggcccuguacauccucagccugaaggaccaggaccgccgggugcccaaccugccgcccuccaacaucaccagcucccaggagcccgcgcuccugcccaccgccagcuccagcgccccgaacaccagccuggucacgacccccgccucccuccaggugcccgagaucaccuucugcgagauccugcccugccaggagaccuacugcugcccgauccgcgggaugaaggaggugagcuccagccccguccagcggcaguccgaggagaaggaguuccaccagcgccgguggagcgaggacaaguccaagagcgugcuggcccgcaacgcgcucuccggccccgacugggagagcgacuggaucgacacgaccaucuccagcauccagaucauggagauccagcagaucaucgaccaccaguacugcauccagucccugcagugcgggagcggcaacuacaacuacaacaucccggugaacaagcacacccccaccaacgucaaguucucccuggagaucaacacgaccgagccccucaucguguuccagugcaaguucacccugggcaacaucugcuuccacagcaagcgggggaccaagggccuggagucccaccgcgagaucagccaggagaugacccagggguaccagcacaucuggagccuccccguggccccguucuccgacagcauguuccacuuccgggucgccgcccccgaccuggccgacugcuccacggaccccuacuucgcgggcaucuucuucaccgacuacuucuucuacuucuaccgccggugcgccuga

SEQ ID NO: 33329 - RNA, 2580 nt, Artificial Sequence
  derived and/or modified sequence opt1 from MYRIP__Homo_sapiens__NP_001271352
augggccgcaagcuggaccucagcgggcugaccgacgacgagaccgagcacgugcugcaggucgugcagcgggacuucaaccuccgcaagaaggaggaggagcggcuguccgagcugaagcagaagcucgacgaggagggcagcaagugcuccauccugagcaagcaccagcaguucguggagcacugcugcaugcgcugcugcucccccuucacguuccuggucaacaccaagcggcagugcggggacugcaaguucaacgugugcaagagcugcugcuccuaccagaagcacgagaaggccugggugugcugcgucugccagcaggcccgccuccugcgggcgcagagccuggagugguucuacaacaacgugaagucccgcuucaagcgguucggcagcgccaaggugcucaagaaccuguaccgcaagcaccggcuggaguccggggccugcuucgacauccucggcggcagccuguucgaguccaaccuggagaacgaggggagcaucuccggcagcgacuccaccuucuaccgccagagcgaggggcacuccgucauggacacccucgccguggcccugcggguggcggaggaggccaucgaggaggccaucagcaaggccgaggcguacggcgacagccuggacaagcagaacgaggccuccuaccuccgcgaccacaaggaggagcugacggaggagcuggccaccaccauccuccagaagaucauccggaagcagaaguccaaguccgagcagcaggucgaggaggagccgggguggccccacccccagagcugcuccaccaagguggccgacgagggcacgagcgccucccccggcggguaccgcgcgccggccgcccuguggcggagccaguccgccuucagcaucaccggcgaggaggcccugaagaccccgcccguggaggcgcccucccgccagccgcgggaccaggggcagcacccccgcgccgagagcgcccuccccuccuggaaguccgucgaccggcuggacgagaccaaccuggcccccgugcuccagagcccggacggcaacuggguggcccugaaggacggcgcgcccccgcccacgcgccugcucgccaagcccaagagcgggaccuuccaggcccuggaggucgccuccagcguggccuccgcguacgacgagaugggcagcgacagcgaggaggacuucgacugguccgaggcccugagcaagcucugcccccgcucccgggcccugccccgcaacccccagccccagcccacccaggcccagagcuccgaccaggggcccaucgcggccagccccuccagcgcccuguccccgaaccccgaggccaugugcagcgacuccgagaccagcuccgccggcagcucccgggagguggggcaccaggcgcgccucagcuggcugcagcggaaggccccgcgcaaccccgccgccgagaagaugcggcugcacggcgagcucgacgucaacuucaacccccagcuggccucccgcgagacgagcgacagcuccgagcccgaggaggcgccccacaccaccgaccggcgcgcccggcgcuggcggcgcgcccggcugggcagcgaggagccguccaaggagcccagcucccccagcgcccagcuccgcgaccuggacacccaccagguguccgacgaccugagcgagacggacaucuccaacgaggcccgggacccccagacccucaccgacaccacggaggagaagcgccggaaccgccuguacgagcuggcgaugaagaugagcgagaaggagaccuccagcggggaggaccaggaguccgagccgaagaccgagagcgagaaccagaaggagucccugagcuccgaggacaacagccaguccgugcaggaggagcucaagaagaaguucagcgccgucagccugugcaacaucuccaccgaggugcugaaggucaucaacgccacggaggagcucaucgccggcagcaccgggcccugggagagcccccaggugcccccggaccgccagaagggcauguucccccgggggaccgaccaggugcgccuggacgagcagcugaccagccucgaggagaacgucuaccuggcggccggcacgguguacggccuggagacccagcucaccgagcuggaggacgccgcccggugcauccacuccgggaccgacgagacgcaccuggccgaccucgaggaccagguggcgaccgccgccgcccagguccaccacgccgagcugcagaucagcgacaucgagucccgcaucagcgcgcugaccaucgccggccucaacaucgcccccugcgugcgguucacccgccggcgcgaccagaagcagcggacccaggugcagacgaucgacaccucccgccagcagcggcgcaagcugcccgccccgcccgucaaggccgagaagaucgagaccagcuccgugaccacgaucaagaccuucaaccacaacuucauccugcaggggagcuccaccaaccggaccaaggagcgcaagggcacgaccaaggaccucauggagcccgcgcuggagagcgccgugauguacuga

SEQ ID NO: 33330 - RNA, 3366 nt, Artificial Sequence
  derived and/or modified sequence opt1 from MYT1__Homo_sapiens__NP_004526
augagccuggagaacgaggacaagcgcgcccggacccgcuccaaggcccuccgggggcccccggagaccacggcggccgaccugagcugccccacccccggcugcaccggcuccgggcacgugcgcggcaaguacagccggcaccgcucccugcagagcugcccccucgccaagaagcggaagcuggagggggccgaggccgagcaccuggucuccaagcgcaagagccacccgcucaagcuggcgcuggacgagggcuacggcguggacuccgacgggagcgaggacaccgaggugaaggacgccuccgucagcgacgaguccgagggcacgcucgagggggccgaggccgagaccagcggccaggacgagauccaccggcccgagaccgcggaggggcgcucccccgucaagagccacuucggcuccaaccccaucggcagcgccaccgccuccagcaaggggagcuacuccagcuaccagggcaucaucgccacgucccugcugaaccucgggcagaucgccgaggagacccugguggaggaggaccugggccaggcggccaagccgggccccgggaucgugcaccuccugcaggaggccgccgagggcgccgcgagcgaggagggggagaagggccuguucauccagcccgaggacgccgaggaggugguggaggucaccaccgagcggucccaggaccucugcccccagagccuggaggacgccgccuccgaggagagcuccaagcagaaggggauccugagccacgaggaggaggacgaggaggaggaggaggaggaggaggaggaggaggaggacgaggaggaggaggaggaggaggaggaggaggaggaggaggaggaggaggaggaggaggaggaggaggaggaggaggaggaggaggaggaggaggaggccgcgccggacgugaucuuccaggaggacacgucccacaccagcgcccagaaggcccccgagcuccgcggccccgagucccccagcccgaagcccgaguacuccgugaucgucgaggugcggagcgacgacgacaaggacgaggacacccacucccgcaagagcaccgugacggacgaguccgagaugcaggacaugaugacccggggcaaccuggggcugcucgagcaggccaucgcccugaaggcggagcagguccgcaccgugugcgagcccggcugcccgcccgccgagcagagccagcuggggcucggcgagcccgggaaggccgccaagccccuggacaccgugcgcaagagcuacuacuccaaggaccccagccgggcggagaagcgggagaucaagugcccgacgcccggcugcgacggcaccgggcacgucaccggccuguacccccaccaccgcucccucagcgggugcccccacaaggaccggaucccgcccgagauccuggccaugcacgagaacgugcugaagugccccaccccgggcugcacggggcagggccacgugaacuccaaccgcaacacccaccgcagccucuccggcugccccaucgccgccgccgagaagcuggccaagagccacgagaagcagcagccccagaccggggaccccuccaagagcuccagcaacuccgaccggauccugcgcccgaugugcuucgucaagcagcucgaggugccgcccuacggcagcuaccggcccaacguggcgcccgccacgccccgcgccaaccuggccaaggagcuggagaaguucuccaaggucaccuucgacuacgcgagcuucgacgcccagguguucgggaagcggaugcucgcccccaagauccagaccuccgagaccagccccaaggccuuccagugcuucgacuacagccaggacgccgaggcggcccacauggccgccaccgcgauccugaaccuguccacgcgcugcugggagaugccggagaaccucagcaccaagccccaggaccugcccuccaagagcgucgacaucgagguggacgagaacggcacccuggaccucuccaugcacaagcaccggaagcgcgagaacgccuuccccagcuccagcuccugcagcuccagcccgggcgugaagucccccgacgccagccagcggcacuccagcaccuccgcccccagcuccagcaugacgagcccccaguccagccaggccucccgccaggacgagugggaccggccgcuggacuacaccaagcccagccgccugcgggaggaggagcccgaggaguccgagcccgcggcccacagcuucgccuccagcgaggccgacgaccaggaggucuccgaggagaacuucgaggagcgcaaguacccgggggaggugacccucaccaacuucaagcugaaguuccugagcaaggacaucaagaaggagcugcugaccugccccacgcccggcugcgacggguccggccacaucaccgggaacuacgccagccaccggucccucagcggcugcccgcuggcggacaagucccuccgcaaccugauggccgcccacagcgccgaccugaagugccccacccccggcugcgacggguccggccacaucaccgggaacuacgccagccaccggucccucagcggcugcccccgcgcgaagaaguccggggugaaggucgccccgacgaaggacgacaaggaggaccccgagcugaugaagugccccgugcccggcugcgugggccuggggcacaucagcggcaaguacgccagccaccgguccgccagcgggugcccgcucgcggcccgccgccagaaggagggcucccugaacgggagcuccuucagcuggaagucccugaagaacgagggcccgaccugccccacccccggcugcgacgggagcggccacgccaacggguccuuccucacccaccggagccuguccggcugcccccgcgccacguucgccgggaagaagggcaagcugagcggcgacgagguccucucccccaaguucaagaccagcgacgugcuggagaacgacgaggagaucaagcagcugaaccaggagauccgggaccucaacgaguccaacagcgagauggaggcggccauggugcagcugcagucccagaucagcagcauggagaagaaccugaagaacaucgaggaggagaacaagcucaucgaggagcagaacgaggcccuguuccuggagcucuccgggcugagccaggcccugauccagucccucgccaacauccgccugccccacauggagcccaucugcgagcagaacuucgacgcguacgucagcacccugaccgacauguacuccaaccaggacccggagaacaaggaccuccuggagagcaucaagcaggccgugcggggcauccagguguga

SEQ ID NO: 33331 - RNA, 3561 nt, Artificial Sequence
  derived and/or modified sequence opt1 from MYT1L__Homo_sapiens__NP_001289981
auggagguggacaccgaggagaagcgccaccggacccgcagcaagggcguccgggugcccguggagccggccauccaggagcuguucuccugccccacgcccgggugcgacggcagcgggcacgucuccggcaaguacgcccgccaccggagcguguacgggugcccccucgcgaagaagcgcaagacccaggacaagcagccgcaggagcccgcccccaagcggaagcccuucgccgugaaggccgacuccagcuccgucgacgagugcgacgacagcgacggcaccgaggacauggacgagaaggaggaggacgagggcgaggaguacuccgaggacaacgacgagccgggggacgaggacgaggaggacgaggagggcgaccgcgaggaggaggaggagaucgaggaggaggacgaggacgacgacgaggacggggaggacguggaggacgaggaggaggaggaggaggaggaggaggaggaggaggaggaggaggagaacgaggaccaccagaugaacugccacaacacccggaucaugcaggacacggagaaggacgacaacaacaacgacgaguacgacaacuacgacgagcugguggccaagagccugcucaaccugggcaagaucgcggaggacgccgccuaccgcgcccggaccgaguccgagaugaacagcaacaccuccaacagccuggaggacgacuccgacaagaacgagaaccucgggcgcaagagcgagcugucccuggaccucgacagcgacgucgugcgggagaccguggacucccugaagcugcucgcgcagggccacggcgucgugcugagcgagaacaugaacgaccgcaacuacgccgacagcaugucccagcaggacagccggaacaugaacuacgugaugcuggggaagcccaugaacaacggccucauggagaagauggucgaggaguccgacgaggaggugugccugagcucccuggagugccuccgcaaccagugcuucgaccuggcccggaagcugagcgagacgaacccccaggagcgcaacccccagcagaacaugaacauccggcagcacgugcgcccggaggaggacuuccccgggcggacccccgaccgcaacuacuccgacaugcucaaccugaugcgccuggaggagcagcucagcccccggucccgcgucuucgccagcugcgccaaggaggacggcugccacgagcgggacgacgacaccaccuccgugaacagcgaccgcuccgaggagguguucgacaugacgaagggcaaccugacccugcucgagaaggcgaucgcccuggagaccgagcgggccaaggccaugcgcgagaagauggccauggaggcggggcggcgcgacaacaugcggagcuacgaggaccaguccccgcgccagcugcccggcgaggaccggaagcccaagagcuccgacagccacgucaagaagcccuacuacgggaaggacccgucccgcaccgagaagaaggagagcaagugccccacgcccggcugcgacgggaccggccacgugaccggccucuacccccaccaccggagccuguccgggugcccgcacaaggaccgcgugccgcccgagauccuggccaugcacgagagcguccucaagugccccacccccggcugcacggggcggggccacgugaacuccaaccgcaacagccaccggucccugagcgggugccccaucgccgccgccgagaagcuggcgaaggcccaggagaagcaccaguccugcgacgucagcaaguccagccaggccuccgaccgcgugcuccggcccaugugcuucgugaagcagcuggagaucccgcaguacggcuaccgcaacaacguccccaccaccacgccccgcagcaaccuggccaaggagcucgagaaguacuccaagaccagcuucgaguacaacuccuacgacaaccacaccuacggcaagcgggccaucgcgcccaaggugcagacccgcgacaucagcccgaagggguacgacgacgccaagcgguacugcaaggaccccucccccagcagcuccagcaccuccagcuacgcccccuccagcuccagcaaccuguccugcggcgggggcagcuccgccagcuccacgugcagcaaguccagcuucgacuacacccacgacauggaggcggcccacauggccgccaccgccauccugaaccucuccacccgcugccgggagaugccgcagaaccugagcacgaagccccaggaccugugcgcgacccgcaaccccgacauggagguggacgagaacgggacccucgaccuguccaugaacaagcagcggccccgcgacagcugcugcccgauccugacgccccucgagcccaugagcccccagcagcaggccgucaugaacaaccggugcuuccagcugggcgagggcgacugcugggaccugccgguggacuacaccaagaugaagccccgccggaucgacgaggacgaguccaaggacaucacccccgaggaccuggaccccuuccaggaggcccucgaggagcgccgguacccgggggaggugaccauccccagccccaagcccaaguacccgcagugcaaggaguccaagaaggaccugaucacccugagcggcugcccccucgccgacaaguccauccgcagcaugcuggccaccuccagccaggagcugaagugccccacgccggggugcgacggcuccggccacaucaccgggaacuacgcgagccaccggucccucagcggcugcccccgcgccaagaaguccgggauccggaucgcccagagcaaggaggacaaggaggaccaggagcccauccgcugccccgucccgggcugcgacgggcagggccacaucaccggcaaguacgccucccaccggagcgccuccgggugcccccuggcggccaagcgccagaaggacggcuaccugaacgggagccaguucuccuggaaguccgugaagaccgagggcaugagcugccccacgcccgggugcgacggcagcggccacgugagcggguccuuccucacccaccggagccuguccggcugcccgcgcgccaccagcgccaugaagaaggcgaagcuguccggggagcagaugcucaccaucaagcagcgcgccagcaacggcaucgagaacgacgaggagaucaagcagcuggacgaggagaucaaggagcugaacgaguccaacagccagauggaggccgacaugaucaagcuccggacgcagaucaccaccauggaguccaaccugaagaccaucgaggaggagaacaaggucaucgagcagcagaacgagagccugcuccacgagcuggccaaccugucccagagccucauccacucccuggccaacauccagcugccccacauggaccccaucaacgagcagaacuucgacgcguacgugacgacccucaccgagauguacaccaaccaggaccgcuaccagagccccgagaacaaggcccugcuggagaacaucaagcaggccgugcgggggauccaggucuga

SEQ ID NO: 33332 - RNA, 1401 nt, Artificial Sequence
  derived and/or modified sequence opt1 from MYZAP__Homo_sapiens__NP_001018110
augcugcgcagcaccuccaccgugacgcuccugagcggcggggccgcccggacccccggcgcgccgucccgccgggccaacgucugccgccugcggcucaccgugccgcccgagagccccgugcccgagcagugcgagaagaagaucgagcgcaaggagcagcugcuggaccucuccaacggggagcccacccggaagcugccccagggcgucguguacggggugguccgccggagcgaccagaaccagcagaaggagauggugguguacggcugguccacgagccagcugaaggaggagaugaacuacaucaaggacguccgcgccacccucgagaaggugcggaagcgcauguacggcgacuacgacgagaugcggcagaagauccgccagcugacccaggagcuguccgugagccacgcccagcaggaguaccucgagaaccacauccagacccaguccagcgcccuggaccgguucaacgcgaugaacuccgcccuggccagcgacuccaucgggcuccagaagacgcuggucgacgugacccuggagaacagcaacaucaaggaccagauccgcaaccuccagcagaccuacgaggccuccauggacaagcugcgggagaagcagcgccagcuggagguggcgcaggucgagaaccagcuccugaagaugaagguggagagcucccaggaggccaacgccgaggugaugcgggagaugaccaagaagcuguacagccaguacgaggagaagcuccaggaggagcagcgcaagcacagcgccgagaaggaggcccugcuggaggagacgaacuccuuccucaaggcgaucgaggaggccaacaagaagaugcaggccgccgagaucagccuggaggagaaggaccagcggaucggcgagcuggaccgccucaucgagcgcauggagaaggagcggcaccagcugcagcugcagcuccuggagcacgagaccgagauguccggggagcugaccgacagcgacaaggagcgcuaccagcagcucgaggaggccuccgcgagccugcgggagcgcauccggcaccuggacgacaugguccacugccagcagaagaaggugaagcagaugguggaggagaucgagucccucaagaagaagcugcagcagaagcagcugcucauccugcagcugcucgagaagaucagcuuccuggagggcgagaacaacgagcugcagucccgccucgacuaccugaccgagacgcaggccaagaccgaggucgagacccgggagaucggggugggcugcgaccugcugcccagccagaccggccgcacgcgggagaucgugaugccgucccgcaacuacacccccuacacccggguccucgagcugaccaugaagaagacgcugaccuga

SEQ ID NO: 33333 - RNA, 570 nt, Artificial Sequence
  derived and/or modified sequence opt1 from MZB1__Homo_sapiens__NP_057543
augcgccugagccucccccugcugcuccugcugcucggcgccugggccauccccgggggccugggggaccgggcgccccugaccgccaccgccccgcagcucgacgacgaggagauguacuccgcccacaugcccgcccaccuccgcugcgacgcgugccgggccguggccuaccagauguggcagaaccuggccaaggcggagacgaagcugcacaccagcaacuccggcgggcgccgggagcugagcgagcuggucuacaccgacgugcucgaccgcuccugcagccggaacuggcaggacuacggcgugcgcgaggucgaccaggugaagcggcugaccggcccggggcuguccgagggccccgagcccagcaucuccgugauggucaccgggggccccuggccgacgcgccucagccggaccugccugcacuaccugggggaguucggcgaggaccagaucuacgaggcccaccagcagggccgcggggcccucgaggcccugcugugcggcgggccccagggcgccugcuccgagaaggugagcgcgacccgggaggagcucuga

SEQ ID NO: 33334 - RNA, 873 nt, Artificial Sequence
  derived and/or modified sequence opt1 from MZF1__Homo_sapiens__NP_001253962
augcgccccgccgugcugggcagcccggaccgggccccgcccgaggacgaggggcccgucauggugaagcucgaggacuccgaggaggagggcgaggcggcccugugggaccccgggcccgaggccgcccgccugcgguuccgcugcuuccgguacgaggaggccaccggcccccaggaggcgcucgcccagcugcgcgagcugugccggcaguggcuccgccccgaggugcggagcaaggagcagaugcuggagcugcucguccuggagcaguuccugggggcccucccgcccgagauccaggcccgcgugcagggccagcggcccggcucccccgaggaggcggccgcccugguggacgggcugcgccgggagccgggcgggccccgccggugggucaccguccaggugcagggccaggaggugcucagcgagaagauggagcccuccagcuuccagccccugccggagacggagccgcccacccccgagcccgggcccaagaccccgccccgcaccaugcaggagagcccccugggccuccaggugaaggaggaguccgaggugacggaggacuccgacuuccuggagagcggcccccuggccgccacccaggaguccguccccacccuccugcccgaggaggcgcagcggugcgggaccgugcuggaccagaucuucccgcacagcaagacgggccccgaggggcccuccuggcgcgagcacccgcgggcccucuggcacgaggaggccggcggcaucuucagccccggggccggcgccggggcggcccccgcccugggcgccggguggcugggcgccgcgguggccauguacgucgcccgcugcuccgccaacgccgcgaccugcuga

SEQ ID NO: 33335 - RNA, 2691 nt, Artificial Sequence
  derived and/or modified sequence opt1 from N4BP1__Homo_sapiens__NP_694574
auggccgcccgcgcggugcuggacgaguucaccgcccccgccgagaaggccgagcuccuggagcagagccggggccgcaucgaggggcuguucggcgucucccucgccgugcugggggcgcugggcgccgaggagccgcuccccgcccggaucuggcugcagcugugcggggcccaggaggcggugcacagcgccaaggaguacaucaagggcaucugcgagcccgagcucgaggagcgcgagugcuaccccaaggacaugcacugcaucuucgucggcgccgagucccuguuccucaagagccugauccaggacacgugcgccgaccugugcauccuggacaucgggcuccugggcauccggggguccgccgaggcgguggugauggcccgcagccacauccagcaguucgucaagcuguucgagaacaaggagaaccucccguccagccagaaggaguccgaggugaagcgggaguucaagcaguucguggaggcccacgccgacaacuacaccauggaccugcugauccuccccaccagccugaagaaggagcugcucacccugacccagggcgaggagaaccuguucgagacgggggacgacgaggucaucgagaugcgcgacucccagcagaccgaguucacccagaacgccgcgaccggccucaacaucagccgggacgagacggugcugcaggaggaggcccgcaacaaggccggcacccccguguccgagcugaccaagcagauggacaccguccucagcuccagccccgacgugcuguucgacccgaucaacgggcugacgcccgacgaggaggcccucuccaacgagcggaucugccagaagcgccgguucagcgacuccgaggagcgccacaccaagaagcaguucagccuggagaacgugcaggagggcgagauccugcacgacgccaagacccucgcggggaacgucaucgccgaccugagcgacuccagcgccgacuccgagaaccugagccccgacaucaaggagaccacggaggagauggaguacaacauccucgugaacuucuucaagaccaugggcuacucccaggagaucguggagaaggucaucaagguguacggccccagcaccgagccgcugcugcuccuggaggagaucgagaaggagaacaagcgguuccaggaggaccgcgaguucuccgccgggaccguguaccccgagacgaacaagaccaagaacaagggcgucuacagcuccaccaacgagcugaccacggacagcacccccaagaagacccaggcccacacccagcagaacaugguggagaaguucucccagcuccccuucaagguggaggcgaagccgugcacgagcaacugccggaucaacaccuuccgcaccguccccaucgagcagaagcacgagguguggggguccaaccagaacuacaucugcaacaccgaccccgagacggacggccugagccccuccgucgccagcccgucccccaaggaggugaacuucgugagccgcggggccuccagccaccagccccgggucccccuguucccggagaacggccuccaccagcagcccgagccccugcugcccaacaacaugaaguccgccugcgagaagcggcugggcugcugcuccagcccgcacuccaagcccaacugcagcacccucagcccgcccaugccccugccccagcugcuccccagcgugaccgacgcgcgcuccgccgggccgagcgaccacaucgacuccagcgugaccggcguccagcgcuuccgggacacgcugaagauccccuacaagcuggagcucaagaacgagcccgggcgcaccgaccugaagcacaucgugaucgacggcuccaacguggccaucacccacgggcugaagaaguucuucagcugccggggcaucgccaucgccgucgaguacuucuggaagcucggcaaccgcaacaucaccguguucgugccccaguggcggacccgccgggacccgaacgucacggagcagcacuuccugacccagcugcaggagcucgggauccugucccugacccccgcgcgcaugguguucggcgagcggaucgccagccacgacgaccgcuuccuccugcaccuggccgacaagaccgggggcaucaucgugacgaacgacaacuuccgggaguucgucaacgaguccgugagcuggcgcgagaucaucaccaagcggcuccugcaguacaccuucgugggggacaucuucaugguccccgacgacccccugggccgcuccggcccgcggcucgaggaguuccugcagaaggaggugugccugcgcgacaugcagccccuccugagcgcccugcccaacguggggauguucgaccccagcuuccgggucccgggcacccaggccgcguccacgagccaccagccgcccacccgcauccagggggcccccuccagccacuggcucccccagcagccccacuucccccugcugcccgcccucccgucccugcagcagaaccugcccaugcccgcccagcggagcuccgccgagaccaacgagcuccgcgaggcgcugcugaagaucuucccggacagcgagcagcgccucaagaucgaccagauccugguggcccaccccuacaugaaggaccugaacgcccucuccgccauggugcuggacuga

SEQ ID NO: 33336 - RNA, 522 nt, Artificial Sequence
  derived and/or modified sequence opt1 from N4BP2L1__Homo_sapiens__NP_001073159
auggaggacagcuuccugcaguccuucggccgccucagccugcagccccagcagcagcagcagcggcagcgcccgccccggcccccgccccgcgggaccccgccccggcgccacuccuuccggaagcaccuguaccuccugcgcggccugcccgggagcggcaagaccacgcucgcccggcagcugcagcacgacuucccccgcgcccugaucuucuccaccgacgacuucuucuuccgggaggacggggcguacgaguucaaccccgacuuccucgaggaggcccacgaguggaaccagaagcgcgcccggaaggccaugcgcaacggcaucagccccaucaucaucgacaacaccaaccugcacgccugggagaugaagcccuacgcggugauggucuuccagaccgagcagaagaaccuguuccggcucgagauggacauggugguguuccgccccgagaugaagaagcacuccuggugccugaagcggaagaacccgcccaacgagcgcacggucuga

SEQ ID NO: 33337 - RNA, 2214 nt, Artificial Sequence
  derived and/or modified sequence opt1 from N4BP2L2__Homo_sapiens__NP_001265361
auggcccugugcagcgcccucaugaccaucuucaccaucaagaugggcacggcgaagcaggccaucgaccaggggcgcucccccgugaucaucgacaacaccaacauccaggccugggagaugaagccguacgucgagguggccaucggcaagggguaccggguggaguuccacgagcccgagaccugguggaaguucgaccccgaggagcuggagaagcgcaacaagcacggcgucagccggaagaagaucgcccagaugcuggaccgcuacgaguaccagauguccaucagcaucgugaugaacuccguggagcccagccacaaguccacccagcggccgcccccgccccaggggcgccagcgggagcgcguccucaagaagacgggccaccggcugagcaagaccaagcagaagcgcaaccggaagcgcaacaagaagcagaacucccagaaccggaucauggaggagaacagccuggaguuccucuccgaccugacccccggcgaccaggaccccagccaguccgaggaggaggacaucgagaagacccgccgggagagcgaguaccccuucaucgacgggcugcagaacgaggugggcgacuucgugacgggguacaaggagaagcgcuggaagaacaaggaccccaaggacuccuuccagaacgucaugagcaucguggagcucgacaacaccccgaagaacuaccuguccaaggagggcgacaaccuguucgugagccuccugcugcggcccaacgagaucuccgugaccugccccauccucacccagaaccugagcugcgugacgaccgacgacugcagcgggaugaagguggagaagcacauccgcaaccggcacaccaucgcgcuggacacccaggaccucuccgccgagacgagcugccuguucaugaagaagcgcgagaucgucgacaagaaccugucccacgagcccauccucugccaccagcacggcauccggaugagcgacaaggugcugcgcgaggagcaggucuacaccaccaagaucaaccacugggccuucuucaccacgaaccuguccgacgaggaccuccagcugggcagcgaccgccagccguacuucggguccuggcccgccggcccccacaaguucaucugcgagcagcggcccaagaaggaccgcgcgugcaagcuggccgggccggacagccggggccaguggauccagaugaucuucaccuccgucgccgccagcgagcccggcaacaaccccgagauccucaccgacaagcugcugaucgggaacgaggacuucagcccgccgcccgagaccauggacuccuucaucgagacgaaccucuuccgcuccugccugccccagcccgacauccccaagaacgcccuggagagcaccaagaacaagaagcggcgcaagaagcggaucuucaaccucgugcccaacuucgaccugcugggccagucccgcaucggggugaaggagcgggagaagugcgaccuccugaccaagaaccacggccugaagaucacccucggggaggagaaggaccgcaucagcgagcggaacuccgaggaggagaacaagcagaagcugaugacguucgaccaccacccccugugguucuaccucgacaucaucaaggcgaccccgcugaacaucgacggccagcgcuacagccacugccuguccuucaaccggcuccgcugcagcgccagccuguacaagaacuacauccccuccuucguccugcacaaccucagcuccaucuggaagcccagcuucaccaacaagaagcuguuccugaccuucgagucccagacgcgggugggcaacaagcugaacgacgccggguucaucagccccgagauccuccacucccacccggacaccagcugcucccugggcgugaccagcgacuuccacuuccugaacgagcgcuucgaccggaagcucaagcgcugggaggagcccaaggagcugcccgccgaggacucccaggaccugaccagcacggacuaccggucccucgagcugccccugagccagggguucgccuuccagcucgucaagcuguucggcuccccgggggugcccauggagagccugcuccccgacgacuacgucgugccccuggacuggaagacccugaagaugaucuaccuccaguggaagauguccguggagaagcgccagaagaagaucggcuga

SEQ ID NO: 33338 - RNA, 663 nt, Artificial Sequence
  derived and/or modified sequence opt1 from NAA10__Homo_sapiens__NP_001243048
augaacauccgcaacgcccggcccgaggaccugaugaacaugcagcacugcaaccuccugugccugcccgagaacuaccagaugaaguacuacuucuaccacggccucagcuggccccagcuguccuacaucgccgaggacgagaacgggaagaucgugggcuacguccuggcgaagauggaggaggaccccgacgacgugccccacgggcacaucaccagccucgccgugaagcgcucccaccggcgccugggccuggcccagaagcucauggaccaggccagccgggccaugaucgagaacuucaacgcgaaguacgucucccugcacgugcgcaagcggaucagcgagguggagccgaaguacuacgccgacggggaggacgccuacgccaugaagcgcgaccugacccagauggcggacgagcuccggcgccaccuggagcugaaggagaagggccggcacgucgugcucggcgccaucgagaacaagguggaguccaaggggaacagcccgcccuccagcggcgaggccugccgcgaggagaaggggcuggccgccgaggacuccggcggggacagcaaggaccuguccgaggucagcgagacgaccgaguccaccgacgugaaggacagcuccgaggcgagcgacuccgccagcuga

SEQ ID NO: 33339 - RNA, 2601 nt, Artificial Sequence
  derived and/or modified sequence opt1 from NAA15__Homo_sapiens__NP_476516
augcccgccgugagccugccgcccaaggagaacgcccucuucaagcgcauccugcggugcuacgagcacaagcaguaccgcaacggccugaaguucugcaagcagauccucuccaaccccaaguucgcggagcacggggagacccuggccaugaagggccugacccucaacugccuggggaagaaggaggaggccuacgagcugguccggcgcggccuccggaacgaccucaagagccacgugugcuggcacguguacgggcugcuccagcgcuccgacaagaaguacgacgaggccaucaagugcuaccggaacgcccugaagugggacaaggacaaccugcagauccuccgcgaccugagccugcuccagauccagaugcgggaccuggagggcuaccgcgagacgcgguaccagcugcuccagcugcgccccgcgcagcgggccuccuggaucggcuacgccaucgccuaccaccuccuggaggacuacgagauggcggccaagauccuggaggaguuccgcaagacccagcagaccagcccggacaaggucgacuacgaguacuccgagcugcuccuguaccagaaccaggugcugcgggaggccgggcucuaccgcgaggcccuggagcaccugugcaccuacgagaagcagaucugcgacaagcucgccguggaggagacgaagggcgagcugcugcuccagcugugccggcuggaggacgcggccgacgucuaccgcgggcuccaggagcggaaccccgagaacugggccuacuacaagggccuggagaaggcccugaagcccgccaacaugcucgagcgccugaagaucuacgaggaggcguggaccaaguacccccgggggcuggugccgcgccgccucccccugaacuuccugagcggcgagaaguucaaggagugccucgacaaguuccugcggaugaacuucuccaagggcugcccgcccguguucaacacccugcgcagccuguacaaggacaaggagaaggucgccaucaucgaggagcucguggugggguacgagaccucccucaagagcugccggcuguucaaccccaacgacgacggcaaggaggagccgcccacgacccugcuguggguccaguacuaccuggcccagcacuacgacaagaucgggcagcccuccaucgcccucgaguacaucaacaccgccaucgagagcacccccacgcugaucgagcuguuccucgugaaggcgaagaucuacaagcacgccggcaacaucaaggaggccgcccgcuggauggacgaggcccaggcgcuggacaccgccgaccgguucaucaacuccaagugcgccaaguacaugcugaaggccaaccucaucaaggaggcggaggagaugugcagcaaguucacccgcgagggcaccuccgccguggagaaccugaacgagaugcagugcaugugguuccagacggagugcgcccaggccuacaaggccaugaacaaguucggggaggcgcugaagaagugccacgagaucgagcggcacuucaucgagaucaccgacgaccaguucgacuuccacaccuacugcaugcgcaagaucacccuccggagcuacgucgaccugcugaagcucgaggacgugcugcgccagcaccccuucuacuucaaggccgcccggaucgccaucgagaucuaccugaagcuccacgacaacccccugacggacgagaacaaggagcacgaggccgacaccgcgaacauguccgacaaggagcugaagaagcuccgcaacaagcagcggcgcgcccagaagaaggcccagaucgaggaggagaagaagaacgccgagaaggagaagcagcagcggaaccagaagaagaagaaggacgacgacgacgaggagaucggcgggcccaaggaggagcugaucccggagaagcuggccaagguggagacgccccucgaggaggcgaucaaguuccugacgccccugaagaaccucgucaagaacaagaucgagacccaccuguucgccuucgagaucuacuuccgcaaggagaaguuccugcucaugcugcagagcgugaagcgggccuucgccaucgacagcucccaccccuggcugcacgagugcaugauccgccucuucaacaccgcggugugcgagagcaaggaccuguccgacaccguccggaccgugcugaagcaggagaugaaccgccucuucggcgccaccaacccgaagaacuucaacgagaccuuccugaagcgcaacagcgacucccugccccaccggcucagcgccgccaagaugguguacuaccuggaccccuccagccagaagcgcgccaucgagcuggcgaccacccucgacgagucccugacgaaccggaaccugcagaccugcauggagguccucgaggcccuguacgacgggagccugggcgacugcaaggaggccgccgagaucuaccgcgccaacugccacaagcuguuccccuacgcgcuggccuucaugccgcccggcuacgaggaggacaugaagaucaccgugaacggggacuccagcgccgaggccgaggagcuggccaacgagaucuga

SEQ ID NO: 33340 - RNA, 1290 nt, Artificial Sequence
  derived and/or modified sequence opt1 from NAA16__Homo_sapiens__NP_001104268
augcccaacgugcugcucccgcccaaggagagcaaccuguucaagcgcauccugaagugcuacgagcagaagcaguacaagaacggccucaaguucugcaagaugauccuguccaaccccaaguucgccgagcacggggagacccuggccaugaagggccucacccugaacugccuggggaagaaggaggaggcguacgaguucgugcggaagggccuccgcaacgacgucaagagccacgugugcuggcacguguacgggcugcugcagcgguccgacaagaaguacgacgaggccaucaagugcuaccgcaacgcccucaagcuggacaaggacaaccugcagauccuccgggaccugagccugcuccagauccagaugcgcgaccuggagggcuaccgggagacgcgcuaccagcugcuccagcugcggcccacccagcgcgccuccuggaucggcuacgccaucgcguaccaccuccucaaggacuacgacauggcccugaagcugcucgaggaguuccggcagacccagcaggucccgcccaacaagaucgacuacgaguacagcgagcugauccuguaccagaaccaggugaugcgcgaggccgaccuccugcaggagucccuggagcacaucgagauguacgagaagcagaucugcgacaagcuccugguggaggagaucaagggggagauccugcucaagcugggccggcugaaggaggccagcgagguguucaagaaccucaucgaccgcaacgcggagaacuggugcuacuacgaggggcuggagaaggcccugcagaucuccacccucgaggagcggcugcagaucuacgaggagaucagcaagcagcaccccaaggccaucacgccccgccggcugccccucacccuggugcccggcgagcgcuuccgggagcugauggacaaguuccuccgcgucaacuucuccaaggggugcccgccccuguucaccacccucaagagccuguacuacaacacggagaagguguccaucauccaggagcuggugaccaacuacgaggccagccugaagaccugcgacuucuucucccccuacgagaacggcgagaaggagccgcccaccacgcugcucuggguccaguacuuccuggcccagcacuucgacaagcugggccaguacagccucgcgcuggacuacaucaacgccgccaucgccuccacccccacccugaucgagcuguucuacaugaaggccaagaucuacaaggucaagagcgaguccugcuuccugagcagcuga

SEQ ID NO: 33341 - RNA, 537 nt, Artificial Sequence
  derived and/or modified sequence opt1 from NAA20__Homo_sapiens__NP_057184
augaccacccugcgcgccuucacgugcgacgaccucuuccgguucaacaacaucaaccuggacccccugaccgagaccuacggcaucccguucuaccuccaguaccuggcccacuggcccgaguacuucaucguggcggaggcccccgggggcgagcugaugggguacaucaugggcaaggccgaggggagcgucgcccgcgaggaguggcacggccacgugaccgcccucagcguggcgcccgaguuccggcgccugggccuggccgccaagcucauggagcugcuggaggagaucagcgagcggaagggcggguucuucgucgaccucuucgugcgcguguccaaccaggucgccgugaacauguacaagcagcugggguacagcguguaccggacggucaucgaguacuacuccgcgagcaacggcgagccggacgaggacgccuacgacaugcgcaaggcccugucccgggacaccgagaagaaguccaucaucccccucccccaccccgugcgcccggaggacaucgaguga

SEQ ID NO: 33342 - RNA, 2919 nt, Artificial Sequence
  derived and/or modified sequence opt1 from NAA25__Homo_sapiens__NP_079229
auggccacccgcggccacgugcaggaccccaacgaccggcgccugcggccgaucuacgacuaccucgacaacgggaacaacaagauggccauccagcaggcggacaagcugcugaagaagcacaaggaccuccacugcgccaagguccugaaggccaucggccugcagcgcaccgggaagcaggaggaggccuucacgcucgcccaggagguggcggcccuggagcccaccgacgacaacagccugcaggcccucaccauccuguaccgggagaugcaccgccccgagcuggugaccaagcucuacgaggccgcggucaagaaggugcccaacuccgaggaguaccacagccaccuguucauggccuacgcccgggugggcgaguacaagaagaugcagcaggccgggauggcccuguacaagaucgucccgaagaaccccuacuacuucugguccgugaugagccucaucaugcaguccaucagcgcgcaggacgagaaccuguccaagacgauguuccugccccucgccgagcgcaugguggagaagauggucaaggaggacaagaucgaggccgaggccgagguggagcuguacuacaugauccuggagcggcucggcaaguaccaggaggcccuggacgugauccgcggcaagcugggggagaagcucaccagcgagauccagucccgggagaacaagugcauggcgauguacaagaagcugagccgcuggcccgagugcaacgcccugucccggcgccuccugcugaagaacagcgacgacuggcaguucuaccucaccuacuucgacuccgucuuccggcugaucgaggaggccuggagcccgcccgccgagggcgagcacucccuggagggggaggugcacuacagcgccgagaaggcggugaaguucaucgaggaccgcaucaccgaggaguccaagagcucccggcaccuccgcggcccccaccuggccaagcuggagcucauccggcgccugcggagccaggggugcaacgacgaguacaagcugggcgaccccgaggagcucauguuccaguacuucaagaaguucggcgacaagccgugcugcuucacggaccugaaggucuucguggaccugcuccccgccacccagugcaccaaguucaucaaccagcugcuggggguggucccccucagcacccccacggaggacaagcuggcccugccggccgacauccgcgcgcuccagcagcaccugugcguggugcagcugacccgccugcucggccuguaccacaccauggacaagaaccagaagcuguccgucgugcgggagcucaugcugcgcuaccagcacgggcuggaguucggcaagaccugccucaagacggagcugcaguucagcgacuacuacugccugcucgccgugcacgcccugaucgacgucuggcgggagaccggcgacgagaccaccguguggcaggcccugacgcuccuggaggaggggcugacccacucccccagcaacgcgcaguucaagcuccugcugguccgcaucuacugcaugcucggcgccuucgagcccgugguggaccuguacuccagccuggacgccaagcacauccagcacgacaccaucggguaccuccugacccgguacgccgagucccugggccaguacgccgcggccagccaguccugcaacuucgcccuccgcuucuuccacagcaaccagaaggacacguccgaguacaucauccaggccuacaaguacggggccuucgagaagauccccgaguucaucgcguuccggaaccgccugaacaacagccugcacuucgcccagguccggaccgagcgcaugcuccuggaccugcuccuggaggccaacaucuccaccagccuggccgaguccaucaagagcaugaaccuccggccggaggaggacgacauccccugggaggaccugcgcgacaaccgggaccugaacguguucuucuccugggaccccaaggaccgcgacgugagcgaggagcacaagaagcucucccuggaggaggagacccuguggcuccggauccgcagccugacgcugcggcucaucagcggccugcccucccugaaccacccggucgagcccaagaacagcgagaagaccgccgagaacggcguguccagccgcaucgacauccuccggcugcugcuccagcagcuggaggcgacccuggagaccgggaagcgcuucaucgagaaggacauccaguaccccuuccucggccccgugccgacgcgcaugggcggguucuucaacuccgggugcagccagugccagaucuccagcuucuaccuggucaacgacaucuacgagcuggacaccuccggccucgaggacaccauggagauccaggagcggaucgagaacagcuucaagucccugcuggaccagcucaaggacguguucagcaagugcaagggcgaccugcuggaggugaaggacgggaaccucaagacccaccccacgcugcuggagaaccucgucuucuucguggagaccaucuccgugauccugugggucagcuccuacugcgagagcgugcugcgccccuacaagcucaaccugcagaagaagaagaagaagaagaaggagaccuccaucaucaugccgcccguguucaccagcuuccaggacuacgucaccggccugcagacgcucaucagcaacgugguggaccacaucaaggggcuggagacccaccugaucgcccucaagcuggaggagcugauccucgaggacaccucccugagccccgaggagcggaaguucuccaagaccguccagggcaaggugcagagcuccuaccugcacagccuccuggagaugggggagcugcucaagaagcgccuggagacgaccaagaagcugaagaucuga

SEQ ID NO: 33343 - RNA, 1089 nt, Artificial Sequence
  derived and/or modified sequence opt1 from NAA30__Homo_sapiens__NP_001011713
auggccgaggugcccccgggccccagcucccugcugcccccgcccgccccgcccgcgcccgccgccgucgagccccgcugccccuuccccgccggggccgcgcuggccugcugcagcgaggacgaggaggacgacgaggagcacgagggcgggggcucccggagccccgccgggggcgaguccgccaccguggcggccaagggccacccgugccugcgcugcccccagccgccccaggagcagcagcagcucaacgggcugaucagccccgagcugcggcaccuccgcgccgccgccucccucaagagcaaggugcuguccgucgcggagguggccgccaccacggccacccccgacggcgggccccgggccaccgcgaccaagggcgccggggugcacagcggcgagcggcccccgcacucccucagcuccaacgcccgcacggccguccccagccccguggaggccgcggccgccuccgaccccgccgccgcgcgcaacggccuggccgaggggaccgagcaggaggaggaggaggaggacgagcagguccggcugcucagcuccagccugaccgccgacugcucccugcgcagcccgagcggccgggagguggagcccggggaggaccgcaccauccgguacgugcgcuacgaguccgagcuccagaugcccgacaucaugcggcugaucacgaaggaccugagcgagcccuacuccaucuacaccuaccgcuacuucauccacaacuggccgcagcucugcuuccuggccauggugggcgaggagugcgucggcgcgaucgugugcaagcuggacaugcacaagaagauguuccggcgcggguacaucgccaugcucgccguggacagcaaguaccggcgcaacggcaucgggaccaaccuggucaagaaggccaucuacgccaugguggagggcgacugcgacgaggugguccuggagaccgagaucacgaacaaguccgcgcucaagcuguacgagaaccugggguucgugcgggacaagcgccucuuccgcuacuaccugaacggcguggacgcccugcggcucaagcuguggcugcgcuga

SEQ ID NO: 33344 - RNA, 2178 nt, Artificial Sequence
  derived and/or modified sequence opt1 from NAA35__Homo_sapiens__NP_078911
auggugaugaaggccagcgucgacgacgacgacuccggcugggagcugagcaugcccgagaagauggagaaguccaacaccaacuggguggacaucacccaggacuucgaggaggccugccgcgagcucaagcugggggagcugcuccacgacaagcuguucggccuguucgaggcgaugagcgccaucgagaugauggacccgaagauggacgccgggaugaucggcaaccaggugaaccggaagguccucaacuucgagcaggccaucaaggacgggacgaucaagaucaaggaccugacccugcccgagcucaucggcaucauggacaccugcuucugcugccugaucaccuggcuggagggccacucccucgcccagacgguguucaccugccuguacauccacaaccccgacuucaucgaggaccccgcgaugaaggccuucgcccuggggauccucaagaucugcgacaucgcccgcgagaaggugaacaaggcggccgucuucgaggaggaggacuuccagagcaugaccuacggcuucaagauggccaacuccgugaccgaccugcgggugacggggaugcugaaggacgucgaggacgacaugcagcgccgggugaagagcacccgcucccggcagggcgaggagcgcgacccggagguggagcucgagcaccagcagugccuggccgucuucagccgggugaaguucacccgcgugcugcucaccguccugaucgccuucacgaagaaggagaccuccgcgguggccgaggcccagaagcugauggugcaggccgccgaccuccugagcgcgauccacaacucccugcaccacgggauccaggcccagaacgacaccaccaagggcgaccaccccaucaugaugggcuucgagccccucgucaaccagcggcugcugcccccgacguucccccgcuacgccaagaucaucaagcgggaggagauggugaacuacuucgcccgccucaucgaccggaucaagaccgugugcgaggucgugaaccugaccaaccugcacugcauccucgacuucuucugcgaguucagcgagcagucccccugcgugcugagccgcucccugcuccagaccacguuccuggucgacaacaagaagguguucgggacccaccugaugcaggacauggucaaggacgcccuccggagcuucgugucccccccggugcugagccccaagugcuaccuguacaacaaccaccaggcgaaggacugcaucgacagcuucgucacccacugcgugcgccccuucugcucccucauccagauccacggccacaaccgggcccgccagcgggacaagcuggggcacauccuggaggaguucgccacccuccaggacgaggccgagaagguggacgccgcgcugcacacgaugcugcucaagcaggagccccagcgccagcaccuggccugccugggcaccuggguccuguaccacaaccuccgcaucaugauccaguaccugcugagcggcuucgagcucgagcuguacuccaugcacgaguacuacuacaucuacugguaccugagcgaguuccucuacgccuggcugauguccacccugagccgggccgacgggucccagauggcggaggagcgcaucauggaggagcagcagaagggccggagcuccaagaagaccaagaagaagaagaaggugcgcccgcucagccgggagaucacgaugucccaggccuaccagaacaugugcgccgggauguucaagaccaugguggccuucgacauggacggcaagguccgcaagcccaaguucgagcuggacagcgagcaggugcgguacgagcaccgcuucgcccccuucaacuccgugaugacccccccgcccguccacuaccugcaguucaaggagaugagcgaccucaacaaguacuccccccccccgcagagccccgagcuguacguggcggccuccaagcacuuccagcaggccaagaugauccuggagaacauccccaaccccgaccacgaggugaaccggauccucaaggucgccaagccgaacuucguggugaugaagcugcuggccgggggccacaagaaggagagcaaggucccccccgaguucgacuucuccgcgcacaaguacuucccgguggugaagcucgucuga

SEQ ID NO: 33345 - RNA, 651 nt, Artificial Sequence
  derived and/or modified sequence opt1 from NAA40__Homo_sapiens__NP_001287729
auggacgccgugugcgccaaggucgacgcggccaaccgccugggcgacccccucgaggccuucccgguguucaagaaguacgaccggaacgggcugaacgugagcaucgagugcaagcgcgucuccggccuggagcccgccaccguggacugggccuucgaccucaccaagacgaacaugcagaccauguacgagcagagcgaguggggguggaaggaccgggagaagcgcgaggagaugaccgacgaccgggcgugguaccugaucgccugggagaacuccagcgugcccgucgccuucucccacuuccgcuucgacguggagugcggcgacgaggugcuguacugcuacgagguccagcucgagagcaaggugcggcgcaaggggcugggcaaguuccugauccagauccuccagcugauggccaacuccacccagaugaagaaggugaugcugacggucuucaagcacaaccacggcgcguaccaguucuuccgggaggcccuccaguucgagaucgacgacagcucccccagcauguccgggugcugcggcgaggacugcagcuacgagauccugucccgccggaccaaguucggggacagccaccacucccacgccggcgggcacugcggcggcugcugccacuga

SEQ ID NO: 33346 - RNA, 510 nt, Artificial Sequence
  derived and/or modified sequence opt1 from NAA50__Homo_sapiens__NP_079422
augaagggcagccgcaucgagcugggggacgugacgccccacaacaucaagcagcucaagcggcugaaccaggucaucuucccgguguccuacaacgacaaguucuacaaggacgugcuggaggucggcgagcucgccaagcuggccuacuucaacgacaucgcggugggggccgugugcugccgcgucgaccacagccagaaccagaagcggcuguacaucaugacccucggcugccuggcccccuaccgccggcuggggaucggcaccaagaugcucaaccacgugcugaacaucugcgagaaggacggcaccuucgacaacaucuaccugcacgugcagaucuccaacgagagcgccaucgacuucuaccgcaaguucggguucgagaucaucgagaccaagaagaacuacuacaagcggaucgagcccgccgacgcgcacguccuccagaagaaccugaaggugcccuccggccagaacgccgacgugcagaagaccgacaacuga

SEQ ID NO: 33347 - RNA, 729 nt, Artificial Sequence
  derived and/or modified sequence opt1 from NAA60__Homo_sapiens__NP_001077069
augaccgaggugguccccagcuccgcccugagcgaggugucccuccgccugcugugccacgacgacaucgacaccgugaagcaccucugcggcgacugguucccgaucgaguaccccgacagcugguaccgggacaucacguccaacaagaaguucuucagccuggccgcgaccuaccgcggggccaucgucggcaugaucguggccgagaucaagaaccggaccaagauccacaaggaggacggggacauccuggccuccaacuucagcguggacacccaggucgccuacauccucucccugggcguggugaaggaguuccgcaagcacgggaucggcagccugcuccuggagucccugaaggaccacaucagcacgaccgcgcaggaccacugcaaggccaucuaccuccacguccugaccaccaacaacacggccaucaacuucuacgagaaccgggacuucaagcagcaccacuaccugcccuacuacuacuccauccgcggcgugcucaaggacggguucaccuacgugcuguacaucaacggcgggcacccgcccuggaccauccuggacuacauccagcaccucggcagcgcccuggcgucccugagccccugcuccaucccccaccgggucuaccgccaggcccacagccuccugugcuccuuccugcccuggagcgggaucagcuccaagagcggcaucgaguacucccggaccauguga

SEQ ID NO: 33348 - RNA, 972 nt, Artificial Sequence
  derived and/or modified sequence opt1 from NAAA__Homo_sapiens__NP_001035861
augcgcaccgccgaccgggaggcccgccccggccugccgagccuccugcugcuccugcuggcgggggccggccucuccgccgccagcccgcccgccgcgccccgguucaacgugucccuggacagcguccccgagcugcgcuggcuccccgugcugcggcacuacgaccuggaccucgugcgcgccgccauggcccaggucaucggggaccgggugcccaagugggugcacguccugaucggcaagguggugcuggagcucgagcgcuuccugccccagccguucaccggggagauccggggcaugugcgacuucaugaaccugucccucgcggacugccugcuggucaaccucgccuacgagagcuccguguucugcacgagcaucguggcccaggacucccgcggccacaucuaccacgggcggaaccuggacuaccccuucggcaacguccugcgcaagcucaccguggacgugcaguuccugaagaacgggcagaucgccuucaccggcaccacguucaucggguacgucggccuguggaccggccagagcccccacaaguucaccguguccggggacgagcgggacaagggcugguggugggagaacgccaucgcggcccucuuccgccggcacauccccgugagcuggcugauccgcgccacccuguccgagagcgagaacuucgaggccgccgucgggaagcucgcgaagacgccgcugaucgccgacguguacuacaucgugggcggcaccagcccccgggagggggucgugaucacccgcaaccgggacggccccgccgacaucuggccccuggacccgcucaacggggccugguuccgcguggagaccaacuacgaccacuggaagcccgcccccaaggaggacgaccggcgcacguccgcgaucaaggcccugaacgccaccggccaggccaaccugucccucgaggcccuguuccaguga

SEQ ID NO: 33349 - RNA, 2328 nt, Artificial Sequence
  derived and/or modified sequence opt1 from NAALAD2__Homo_sapiens__XP_011540854
auggccuuccaggacugccgcugccggcugcagcgccggcagagcuaccucucccccgaggcccgcgagugcagccggcgcccgaagcugggcccccaggaggcgauggccgagucccgggggcgccuguaccucuggaugugccuggccgccgcccuggcgagcuuccucaugggcuucaugguggggugguucaucaagccccugaaggagaccaccacguccguccgguaccaccagagcauccgcuggaagcugguguccgagaugaaggccgagaacaucaagagcuuccuccgguccuucaccaagcugccccaccuggccggcaccgagcagaacuuccuccuggccaagaagauccagacccaguggaagaaguucgggcuggacagcgcgaagcucgugcacuacgacguccugcuguccuacccgaacgagacgaacgccaacuacaucagcaucguggacgagcacgagaccgagaucuucaagaccuccuaccucgagcccccgcccgacggcuacgagaacgugaccaacaucgucccgcccuacaacgccuucagcgcccagggcaugcccgagggggaccugguguacgugaacuacgcccgcacggaggacuucuucaagcuggagcgggagaugggcaucaacugcaccgggaagaucgucaucgcgcgcuacggcaagaucuuccgggggaacaaggugaagaacgccaugcucgccggcgccaucggcaucauccuguacuccgaccccgccgacuacuucgcgcccgaggugcagcccuaccccaagggguggaaccugcccggcaccgccgcccagcgcgggaacguccucaaccugaacggcgccggcgacccgcugacccccggguaccccgccaaggaguacacguuccggcucgacguggaggagggcguggggaucccccgcaucccgguccaccccaucggcuacaacgacgcggagauccugcugcgguaccucgggggcaucgccccgcccgacaagagcuggaagggcgcccugaacguguccuacagcaucgggcccggcuucaccggguccgacagcuuccgcaaggugcggaugcacgucuacaacaucaacaagaucacccgcaucuacaacguggugggcaccauccgcgggagcgucgagcccgaccgguacgugauccugggcggccaccgcgacuccuggguguucggggccaucgaccccacgagcggcgucgccgugcuccaggagaucgcgcgguccuucgggaagcugaugagcaagggcuggcgcccccggcgcaccaucaucuucgccuccugggacgccgaggaguucgggcugcucggcagcaccgagugggccgaggagaacgucaagauccugcaggagcgguccaucgcguacaucaacagcgacuccagcaucgagggcaacuacacccugcgcguggacugcacgccgcuccuguaccagcugguguacaagcucaccaaggagauccccucccccgacgacggguucgagagcaagucccuguacgagagcuggcuggagaaggacccgucccccgagaacaagaaccucccccggaucaacaagcugggcagcggguccgacuucgaggccuacuuccagcgccugggcaucgccagcggccgggcccgcuacaccaagaacaagaagaccgacaaguacuccagcuaccccgucuaccacacgaucuacgagaccuucgagcucguggagaaguucuacgacccgaccuucaagaagcagcugagcguggcccagcugcgcggggcgcuggucuacgagcucguggacuccaagaucauccccuucaacauccaggacuacgccgaggcccugaagaacuacgccgccagcaucuacaaccuguccaagaagcacgaccagcagcucaccgaccacggcgugagcuucgacucccuguucagcgcggucaagaacuucuccgaggccgccagcgacuuccacaagcggcugauccagguggaccucaacaaccccaucgccgugcggaugaugaacgaccagcugaugcugcucgagcgcgccuucaucgacccccuggggcugccgggcaagcuguucuaccggcacaucaucuucgcgcccuccagccacaacaaguacgccggggaguccuuccccggcaucuacgacgccaucuucgacaucgagaacaaggccaacagccgccucgcguggaaggaggucaagaagcacaucuccaucgccgccuucacgauccaggccgccgcgggcacccugaaggaggugcucuga

SEQ ID NO: 33350 - RNA, 2223 nt, Artificial Sequence
  derived and/or modified sequence opt1 from NAALADL1__Homo_sapiens__NP_005459
augcaguggaccaaggugcugggccucgggcugggcgccgccgcgcugcucgggcugggcaucauccuggggcacuucgccauccccaagaaggccaacagccucgccccgcaggaccuggaccuggagauccucgagaccgucaugggccagcuggacgcccaccgcauccgggagaaccugcgcgagcucucccgggagccccaccuggcgagcagcccccgcgacgaggaccuggugcagcuccugcugcagcgguggaaggaccccgaguccggccucgacuccgccgaggccagcacguacgaggugcugcuguccuucccgagccaggagcagcccaacgucguggacaucguggggcccaccggcgggaucauccacuccugccaccgcaccgaggagaacgucaccggcgagcagggcgggcccgacguggugcagccguacgccgcguacgcccccagcggcacgccccaggggcuccuggucuacgccaaccggggcgccgaggaggacuucaaggagcugcagacccaggggaucaagcucgagggcaccaucgcccugacccgcuacggcggggugggccgcggggcgaaggccgugaacgccgccaagcacggcgucgccggggugcugguguacacggaccccgcggacaucaacgacggccucuccagcccggacgagaccuuccccaacuccugguaccugccgcccagcggcgucgagcggggguccuacuacgaguacuucggcgacccccugacccccuaccuccccgccgugcccagcuccuuccggguggaccuggccaacgucagcggguucccgcccauccccacccagcccaucggcuuccaggacgcccgcgaccugcucugcaaccugaacgggacgcuggccccggcgaccuggcagggcgcccucggcugccacuaccggcuggggcccggcuuccgccccgacggggacuuccccgccgacucccaggugaacgugagcgucuacaaccggcuggagcuccgcaacagcuccaacgugcugggcaucauccgcggggccguggagccggaccgguacguccuguacggcaaccaccgggacagcugggugcacggcgccgucgaccccuccagcgggaccgcggugcuccuggagcugucccgcgugcucggcacccugcugaagaaggggacguggcggccccgccgcagcaucgucuucgccuccuggggcgccgaggaguucggccucaucgggagcaccgaguucaccgaggaguucuucaacaagcugcaggagcggaccguggccuacaucaacguggacaucuccgucuucgcgaacgccacgcugcgcgugcagggcaccccgcccgugcagagcgucguguucuccgccaccaaggagauccggagccccgggcccggcgaccuguccaucuacgacaacuggauccgcuacuucaaccggagcuccccgguguacgggcucguccccagccugggcucccugggcgccgggagcgacuacgcccccuucgugcacuuccucggcaucuccagcauggacaucgcguacaccuacgaccgcagcaagacguccgcccggaucuaccccaccuaccacaccgccuucgacaccuucgacuacguggacaaguuccuggacccgggguucagcucccaccaggccgucgcccgcacggcgggcagcgugauccugcggcucuccgacagcuucuuccugccccugaagguguccgacuacagcgagacccuccgcuccuuccugcaggccgcccagcaggaccugggggcccuccuggagcagcacagcaucucccugggcccccucgucaccgccguggagaaguucgaggcggaggccgccgcccugggccagcggaucagcacccugcagaaggggucccccgacccgcuccaggugcgcaugcugaacgaccagcugaugcuccuggagcggacguuccugaacccccgcgcguuccccgaggagcgguacuacagccacguccucugggcgccccgcaccggcuccguggugaccuucccggggcugagcaacgccugcucccgggcccgcgacaccgccagcggcagcgaggccugggccgagguccagcggcagcuguccaucguggugacggcccucgagggggccgccgcgacccugcgccccgucgccgaccuguga

SEQ ID NO: 33351 - RNA, 2388 nt, Artificial Sequence
  derived and/or modified sequence opt1 from NAALADL2__Homo_sapiens__NP_996898
augggcgagaacgaggccagccugcccaacaccucccuccaggggaagaagauggccuaccagaaggugcacgcggaccagcgcgccccgggccacagccaguaccuggacaacgacgaccugcaggccaccgcccucgaccuggagugggacauggagaaggagcuggaggaguccggguucgaccaguuccagcucgacggcgccgagaaccagaaccuggggcacagcgagacgaucgaccugaaccucgacuccauccagcccgcgaccagccccaagggccgguuccagcgccugcaggaggaguccgacuacaucacccacuacacccggagcgcccccaaguccaaccgcugcaacuucugccacguccugaagauccucugcacggccaccauccuguucaucuucggcauccugaucggguacuacgugcacaccaacugcccgagcgacgcccccuccagcggcaccguggacccccagcucuaccaggagauccugaagacgauccaggcggaggacaucaagaaguccuuccggaaccugguccagcucuacaagaacgaggacgacauggagaucagcaagaagaucaagacccaguggaccucccuggggcuggaggacgugcaguucgugaacuacagcguccuccuggaccugcccggcccgucccccagcaccgugacgcucuccagcagcgggcagugcuuccaccccaacggccagcccugcuccgaggaggcccgcaaggacagcucccaggaccugcuguacagcuacgccgccuacuccgccaagggcacccucaaggcggaggugaucgacgucagcuacgggauggccgacgaccugaagcggauccgcaagaucaagaacgugaccaaccagaucgcccugcucaagcugggcaagcugccgcuccuguacaagcuguccagccucgagaaggccggguucggcggcgugcugcuguacaucgaccccugcgaccuccccaagaccgucaaccccucccacgacacguucauggugagccugaaccccgggggcgaccccuccacccccggguaccccagcguggacgaguccuuccggcagagccgcuccaaccugaccagccuccugguccagccgaucuccgccccgcugguggcgaagcucaucagcucccccaaggcccggaccaagaacgaggccugcagcagccuggagcugcccaacaacgagauccgcguggucuccaugcagguccagacggugaccaagcucaagaccgugaccaacguggugggcuucgucauggggcugacgagcccggaccgguacaucaucgugggcucccaccaccacaccgcccacagcuacaacggccaggagugggccuccagcaccgcgaucaucaccgccuucauccgcgcccugauguccaaggucaagcggggguggcgccccgaccggacgaucguguucugcagcuggggcgggaccgccuucggcaacaucggguccuacgaguggggcgaggacuucaagaaggugcugcagaagaacgucguggccuacaucagccuccacucccccauccgcggcaacagcucccuguaccccguggcgagcccgucccugcagcagcucgucguggagaagaacaacuucaacugcacccggcgcgcccagugccccgagaccaacaucagcuccauccagauccagggggacgccgacuacuucaucaaccaccugggcgugcccaucguccaguucgccuacgaggacaucaagacgcuggaggggccgagcuuccucagcgaggcgcgguucuccacccgcgccaccaagaucgaggagauggaccccagcuucaaccugcacgagaccaucacgaagcuguccggcgaggugauccuccagaucgccaacgagcccgugcugcccuucaacgcccuggacaucgcccucgagguccagaacaaccugaagggggaccagccgaacacccaccagcugcucgcgauggcccugcgccugcgggagagcgccgagcuguuccaguccgacgagaugcgccccgccaacgaccccaaggagcgggcccccauccgcauccggaugcucaacgacauccugcaggacauggagaaguccuuccucgugaagcaggcgccgcccggcuucuaccgcaacauccuguaccaccuggacgagaagaccagccgguucagcauccucaucgaggccugggagcacugcaagccccuggccuccaacgagacccugcaggaggcccucagcgaggugcugaacuccaucaacagcgcccaggucuacuucaaggcgggccuggacguguucaaguccgugcucgacgggaagaacuga

SEQ ID NO: 33352 - RNA, 1464 nt, Artificial Sequence
  derived and/or modified sequence opt1 from NAB1__Homo_sapiens__NP_005957
auggccgccgcgcugccccgcacccucggcgagcugcagcuguaccggauccuccagaaggccaaccugcugagcuacuucgacgccuucauccagcagggcggggacgacgugcagcagcucugcgaggccggggaggaggaguuccuggagaucauggcccuggucggcauggcguccaagccgcuccacgugcgccggcugcagaaggcccugcgcgacugggugaccaaccccggccucuucaaccagccccugacgagccugcccgucuccagcaucccgaucuacaagcuccccgaggggucccccaccuggcugggcaucagcugcuccagcuacgagcgguccagcaacgcccgcgagccccaccugaagaucccgaagugcgccgcgacgaccugcgugcagucccucgggcagggcaagagcgacguggucgggucccuggcccugcagagcgugggcgagucccggcucuggcaggggcaccacgccaccgagagcgagcacucccugagccccgccgaccugggcucccccgccagccccaaggagagcuccgaggcgcucgacgccgccgccgcccugagcguggcggagugcgucgagcgcauggccccgacccugcccaaguccgaccucaacgaggugaaggagcugcugaagaccaacaagaagcucgccaagaugaucggccacaucuucgagaugaacgacgacgacccccacaaggaggaggagauccggaaguacagcgccaucuacgggcgcuucgacuccaagcggaaggacggcaagcaccugacccugcacgagcucacggugaacgaggccgcggcccagcugugcgucaaggacaacgcccugcucacccgccgggacgagcuguucgcccuggcccgccagaucagccgggaggugaccuacaaguacaccuaccgcacgaccaaguccaagugcggggagcgggacgagcucagccccaagcgcaucaagguggaggacggcuucccggacuuccaggacuccguccagacccuguuccagcaggcgcgggccaagagcgaggagcuggccgcccucuccagccagcagcccgagaaggugauggcgaagcagauggaguuccugugcaaccaggccggcuacgagcgccugcagcacgccgagcggcgccucuccgccgggcuguaccgccagagcuccgaggagcacagccccaacggccugaccuccgacaacagcgacgggcagggcgagcggccccucaaccugcgcaugccgaaccugcagaaccggcagccccaccacuucguggucgacggggagcugucccgccucuaccccagcgaggccaagagccacuccagcgagucccugggcauccugaaggacuacccccacagcgcguucacgcucgagaagaaggugaucaagaccgagccggaggacucccgguga

SEQ ID NO: 33353 - RNA, 1578 nt, Artificial Sequence
  derived and/or modified sequence opt1 from NAB2__Homo_sapiens__NP_005958
augcaccgcgcccccagccccaccgccgagcagccgcccggcgggggcgacuccgcgcggcgcacccugcagccccggcucaagcccagcgcccgcgccauggcccugccccggacgcugggggagcuccagcuguaccgcgugcugcagcgggccaaccuccuguccuacuacgagaccuucauccagcagggcggggacgacguccagcagcugugcgaggcgggcgaggaggaguuccucgagaucauggcccuggugggcauggccaccaagccccugcacgugcgccggcuccagaaggcccugcgcgagugggcgaccaaccccgggcuguucagccagccgguccccgccgugcccguguccagcaucccccucuucaagaucuccgagacggccggcacccggaaggggagcauguccaacggccacgggagcccgggcgagaaggccggcuccgcccgcagcuucucccccaagagcccccuggagcugggggagaagcucagcccccugccgggcgggcccggcgcgggcgacccccggaucuggcccgggcgcuccaccccggaguccgacgucggcgccgggggcgaggaggaggccgggagcccgcccuucagcccgcccgccggcggcggggugcccgagggcaccggggccggcgggcuggcggccggcggcaccgggggcgggcccgaccggcucgagcccgagauggugcgcauggucguggaguccguggagcggaucuuccgcagcuucccccggggcgacgccggggaggucacgucccugcugaagcucaacaagaagcuggcccgcagcgugggccacaucuucgagauggacgacaacgacucccagaaggaggaggagauccggaaguacagcaucaucuacggccgcuucgacuccaagcgccgggaggggaagcagcugagccuccacgagcugaccaucaacgaggccgcggcccaguucugcaugcgcgacaacacccugcuccugcggcgcguggagcuguucucccucagccggcaggucgcccgcgaguccacguaccugagcucccugaagggcagccggcuccaccccgaggagcugggcgggcccccgcugaagaagcucaagcaggaggugggggagcagucccaccccgagauccagcagccgccgcccggccccgagagcuacgugccgcccuaccgccccucccuggaggaggacagcgccucccugagcggcgagucccucgacgggcaccuccaggccgucggcagcugcccccggcugaccccgccgcccgcggaccugccccuggcccugcccgcccacgggcucuggagccgccacauccugcagcagacccugauggacgagggccugcggcucgcccgccuggugucccacgaccgggugggccgccugagccccugcguccccgcgaagccgccccucgccgaguucgaggaggggcugcuggaccggugccccgcccccggcccccaccccgcccucguggaggggcgccgguccagcgugaaggucgaggccgaggcgucccgccaguga

SEQ ID NO: 33354 - RNA, 615 nt, Artificial Sequence
  derived and/or modified sequence opt1 from NABP1__Homo_sapiens__NP_001026886
augaaccgcgugaacgacccccugaucuucauccgggacaucaagccgggccucaagaaccugaacgucguguucaucgugcuggagaucgggcgcgucaccaagaccaaggacggccacgaggugcggagcugcaagguggccgacaagacgggguccaucaccaucagcgucugggacgagaucggcgggcucauccagcccggcgacaucauccgccugacccggggcuacgccuccauguggaaggggugccugacccucuacacgggccgcgggggcgagcugcagaagaucggggaguucugcaugguguacagcgaggugcccaacuucuccgagcccaacccggacuaccggggccagcagaacaagggcgcgcagagcgagcagaagaacaacuccaugaacagcaacauggggaccggcaccuucgggcccgucggcaacggcgugcacaccgggcccgagucccgcgagcaccaguucagccacgccggccgguccaacgggcgcggccugaucaacccccagcuccaggggacggccagcaaccagaccgugaugaccaccaucuccaacggccgggacccgcgccgggccuucaagcgcuga

SEQ ID NO: 33355 - RNA, 636 nt, Artificial Sequence
  derived and/or modified sequence opt1 from NABP2__Homo_sapiens__NP_076973
augaccaccgagacguucgugaaggacaucaagcccggccugaagaaccucaaccugaucuucaucguccuggagaccgggcgcgugaccaagaccaaggacggccacgaggugcggacgugcaaggucgccgacaagaccgggagcaucaacaucuccgugugggacgacgugggcaaccucauccagcccggggacaucauccgccugaccaagggcuacgccagcgucuucaagggcugccugacccucuacacggggcggggcggggaccugcagaagaucggcgaguucugcaugguguacuccgaggugcccaacuucagcgagcccaaccccgaguacuccacccagcaggcgccgaacaaggccguccagaacgacagcaaccccuccgccagccagcccaccaccgggcccuccgccgccagcccggcguccgagaaccagaacggcaacggccugagcgccccgcccgggcccggcgggggcccccacccgccccacacgcccucccacccgcccagcacccgcaucacccggucccagcccaaccacacccccgccggcccgcccgggcccagcuccaaccccgugagcaacggcaaggagacgcgccgguccagcaagcgcuga

SEQ ID NO: 33356 - RNA, 2778 nt, Artificial Sequence
  derived and/or modified sequence opt1 from NACA__Homo_sapiens__NP_001106674
augcccggcgaggccaccgagaccgugccggccacggagcaggagcugccccagccccaggcggagaccgccguccuccccaugagcuccgcccugagcgugaccgccgcccuggggcagccgggccccacccucccgccgcccugcucccccgcgccccagcagugcccccugagcgccgccaaccaggccucccccuuccccagccccuccacgaucgcgagcacgccccuggaggugccguucccccaguccagcuccgggaccgcccucccccugggcaccgcccccgaggccccgaccuuccugcccaaccucaucgggccgcccaucagccccgccgcgcuggcccuggccucccccaugaucgcccccacccucaagggcacccccagcuccagcgccccgcuggcgcuggucgcccucgcgccccacuccgugcagaaguccuccgccuucccgcccaaccugcugaccagcccgcccagcguggccgucgccgaguccggcagcgugaucacgcucuccgcccccaucgcccccagcgagcccaagaccaaccugaacaaggugcccuccgaggucgugcccaacccgaaggggacccccagcccgcccugcaucguguccaccguccccuaccacugcgugacgcccauggccagcauccaguccggcguggccagccugccccagaccacccccaccacgacccucgcgaucgccuccccgcaggucaaggacaccaccaucagcuccgugcugaucagcccccagaaccccgggucccugagccucaagggccccguguccccgcccgccgcccugagccuguccacgcagagccuccccgucgugaccagcucccagaagaccgcggggcccaacaccccgcccgacuuccccaucagccugggcucccaccuggccccgcuccaccagagcagcuucggcagcgugcagcugcuggggcagacgggccccuccgcccucagcgaccccaccgucaagaccaucuccguggaccacagcuccaccggggccagcuaccccucccagcgcagcgugaucccgccccugcccucccggaacgaggucgugcccgccacggucgcggccuucccggugguggcccccagcgucgacaagggccccuccaccaucagcagcaucacgugcucccccagcggcucccugaacguggccaccagcuucucccucagcccgaccaccucccugauccucaagagcucccccaacgccaccuaccacuacccccugguggcgcagaugcccgucagcuccguggggaccaccccgcugguggucacgaaccccugcaccaucgccgccgcccccaccaccacguucgagguggcgaccugcgugagcccgcccauguccagcggccccaucuccaacaucgagcccaccagccccgccgcccuggucauggccccgguggcccccaaggagcccuccacccagguggcgacgacccuccgcauccccgucagcccgccccugcccgacccggaggaccugaagaaccuccccuccagcgugcuggugaaguuccccacccagaaggaccugcagaccguccccgccagccucgagggggccccguucucccccgcccaggccggccugacgaccaagaaggaccccaccgugcugccccuggugcaggcggccccgaagaacagccccuccuuccagagcaccuccagcucccccgagaucccccucagcccggaggccacgcuggccaagaagucccugggggagccccuccccaucgucgccgcguucccccuggagagcgccgacccggccggcguggcccccaccaccgccaaggcggccgccuucgagaaggugcugcccaagcccgaguccgccagcgucuccgcggccccgagcccgcccgugucccucccccuggcccccagccccgugcccacccugcccccgaagcagcaguuccuccccuccagccccggccugguccuggaguccccgagcaagccccucgcccccgccgacgaggacgagcugcugccccucaucccgcccgagcccaucagcgggggcgugcccuuccaguccgugcuggucaacaugccgacgcccaagagcgcggggauccccgugcccaccccguccgccaagcagcccgugaccaagaacaacaagggcagcgggaccgaguccgacagcgacgaguccguccccgagcuggaggagcaggacagcacgcaggccaccacccagcaggcccagcucgccgcggccgccgagaucgacgaggagcccguguccaaggccaagcagagccgguccgagaagaaggcccgcaaggcgaugagcaagcugggccugcgccaggugaccggcgucacgcgggugaccauccggaaguccaagaacauccucuucgugaucaccaagccggacgucuacaagagccccgccuccgacaccuacaucguguucggggaggccaagaucgaggaccugagccagcaggcccagcuggccgcggccgagaaguucaaggugcagggcgaggccgucuccaacauccaggagaacacgcagacccccaccgugcaggaggagagcgaggaggaggagguggacgagaccggggucgaggugaaggacaucgagcucgugaugucccaggccaacgucagccgcgcgaaggccgugcgggcccugaagaacaacagcaacgacaucgugaacgccaucauggagcugacgauguga

SEQ ID NO: 33357 - RNA, 1584 nt, Artificial Sequence
  derived and/or modified sequence opt1 from NACC1__Homo_sapiens__XP_005259778
auggcccagacccugcagauggagauccccaacuucggcaacagcauccucgagugccugaacgagcagcgccugcaggggcucuacugcgacguguccgucguggugaagggccacgccuucaaggcgcaccgggccguccuggccgccagcuccagcuacuuccgcgaccuguucaacaacucccggagcgccgugguggagcucccggcggccguccagccccaguccuuccagcagauccugagcuucugcuacaccgggcgccuguccaugaacgugggcgaccaguuccuccugauguacacggccggguuccugcagauccaggagaucauggagaagggcaccgaguucuuccucaaggugagcucccccagcugcgacucccagggccugcacgccgaggaggcgcccagcuccgagccgcagagccccgucgcccagaccuccggguggcccgccugcagcacgccccugccgcucgugucccgggugaagaccgagcagcaggagagcgacagcguccagugcaugcccguggccaagcgccugugggacuccggccagaaggaggccgggggcgggggcaacggcagccggaagauggcgaaguucuccacccccgaccuggccgccaaccgcccccaccagccgcccccgccccagcaggcccccguggucgccgcggcccagcccgccguggccgccggggcgggccagcccgccgggggcguggccgccgccggcggggucgugagcggccccuccaccagcgagcggaccuccccggggacgagcuccgcguacaccagcgacucccccggcagcuaccacaacgaggaggacgaggaggaggacgggggcgaggagggcauggacgagcaguaccgccagaucugcaacauguacaccauguacuccaugaugaacguggggcagaccgccgagaaggucgaggcccuccccgagcaggucgcccccgagagccggaaccgcauccgggugcgccaggaccuggcgucccugccggccgagcucaucaaccagaucggcaaccggugccaccccaagcuguacgacgagggggaccccagcgagaagcuggagcucgugacgggcaccaacguguacaucacccgcgcccagcugaugaacugccacgucuccgccgggacccggcacaaggugcugcuccgccggcugcuggccagcuucuucgaccgcaacacgcucgcgaacuccugcggcaccggcauccggagcagcaccaacgacccccgccgcaagccgcuggacucccgggugcugcacgccgucaaguacuacugccagaacuucgcccccaacuucaaggagagcgagaugaacgccaucgccgcggacaugugcaccaacgcccgccggguggugcgcaaguccuggaugcccaaggucaaggugcucaaggccgaggacgacgccuacacgaccuucaucagcgagaccgggaagaucgagccggacaugaugggcguggagcacggguucgagaccgccucccacgagggcgaggcggggcccagcgccgaggcccugcaguga

SEQ ID NO: 33358 - RNA, 1764 nt, Artificial Sequence
  derived and/or modified sequence opt1 from NACC2__Homo_sapiens__XP_011516523
augagccagaugcugcacaucgagauccccaacuucggcaacaccgugcucgggugccugaacgagcagcgccugcucggccuguacugcgacgucuccaucguggugaaggggcaggccuucaaggcccaccgggcgguccuggccgccagcucccucuacuuccgcgaccuguucagcggcaacuccaagagcgccuucgagcugccgggguccgugccgcccgccugcuuccagcagauccucagcuucugcuacaccggccggcugacgaugaccgcguccgagcagcugguggucauguacaccgccggcuuccuccagauccagcacaucguggagcgcgggaccgaccugauguucaaggugagcagcccccacugcgacucccagacggccgucaucgaggacgccggcuccgagccccagagccccugcaaccagcugcagcccgcggccgccgccgccgcgcccuacgugguguccccgagcguccccaucccccuccugacccgggugaagcacgaggccauggagcugcccccggccgggcccggccucgcccccaagcgcccccuggagaccgggccgcgggacggcguggccgucgcggccggcgccgccguggccgcggggaccgcgccccugaagcucccccgcguguccuacuacggcguccccagccuggccacgcugaucccggggauccagcagaugcccuacccccagggcgagcggaccucccccggcgccagcagccucccgaccaccgacucccccacgagcuaccacaacgaggaggacgaggaggacgacgaggccuacgacaccaugguggaggagcaguacgggcagauguacaucaaggccuccggcagcuacgccgugcaggagaagcccgagcccgucccgcuggagucccgcagcugcgugcugauccggcgcgaccucguggcccugcccgccucccugaucagccagaucggguaccggugccaccccaagcucuacuccgagggcgacccgggggagaagcuggagcuggucgcgggcagcggcguguacaucacccgcgggcagcucaugaacugccaccugugcgccggcgucaagcacaaggugcugcuccggcgccugcuggccaccuucuucgaccggaacacgcucgccaacuccugcgggaccggcauccgcagcuccaccagcgaccccucccggaagccccuggacagccgcgugcugaacgccgucaagcucuacugccagaacuucgcgcccuccuucaaggagagcgagaugaacgugaucgccgccgacaugugcaccaacgcccggcgcgugcgcaagcgguggcugccgaagaucaaguccaugcugcccgagggggucgagauguaccgcacggugaugggcagcgccgcggccagcgugccccucgaccccgaguucccgcccgccgccgcccaggucuucgagcagcggaucuacgcggagcgccggggcgacgccgccaccaucguggcccugcgcaccgacgcggugaacgucgaccuguccgccgccgccaaccccgccuucgacgcgggggaggagguggacggcgccgggagcgugauccaggaggucgccgcccccgagccgcuccccgccgacggccaguccccgccccagcccuucgagcagggcgggggcgggcccagccggccccagacccccgcggccgccgcccgccggccggagggcacguacgccgggacccuguga

SEQ ID NO: 33359 - RNA, 2121 nt, Artificial Sequence
  derived and/or modified sequence opt1 from NADSYN1__Homo_sapiens__NP_060631
augggccgcaaggugaccgucgcgaccugcgcccugaaccagugggcccucgacuucgaggggaaccugcagcggauccucaagagcaucgagaucgccaagaaccgcggcgcccgguaccgccuggggcccgagcuggagaucugcggcuacgggugcugggaccacuacuacgaguccgacacgcugcuccacagcuuccaggugcuggccgcccugguggaguccccggucacccaggacaucaucugcgacgugggcaugcccgugaugcaccggaacguccgcuacaacugccgggugaucuuccucaaccgcaagauccugcugauccggcccaagauggcgcucgccaacgagggcaacuaccgcgagcugcggugguucacccccuggagccgcucccggcacaccgaggaguacuuccugccgcgcaugauccaggaccucacgaagcaggagaccgugcccuucggggacgccguccuggugaccugggacacgugcaucggcagcgagaucugcgaggagcuguggacgccccacagcccccacaucgacauggggcucgacggcguggagaucaucaccaacgccuccgggucccaccagguccugcggaaggcgaacacccgcguggaccuggugaccauggucaccagcaagaacggcggcaucuaccuccuggccaaccagaaggggugcgacggcgaccggcuguacuacgacgggugcgccaugaucgccaugaacggcuccguguucgcccagggcagccaguucucccucgacgacguggagguccugaccgcgacccuggaccucgaggacgugcgcagcuaccgggccgagaucuccagccgcaaccuggccgccucccgggccagcccguacccccgcgugaaggucgacuucgcgcuguccugccacgaggaccuccuggcccccaucagcgagcccaucgaguggaaguaccacagcccggaggaggagaucucccuggggcccgccugcuggcucugggacuuccugcgccggagccagcaggccggcuuccugcucccccuguccgggggcguggacagcgccgcgaccgccugccugaucuacuccaugugcugccaggugugcgaggccguccgcagcgggaacgaggaggugcucgccgacguccggacgaucgugaaccagaucuccuacacgccccaggacccgcgcgaccugugcggccggauccugacgaccugcuacauggccagcaagaacuccagccaggagaccugcacccgcgcgcgggagcucgcccagcagaucggcucccaccacaucagccugaacaucgaccccgccgugaaggccgucauggggaucuucucccuggugaccggcaagagcccccucuucgcggcccacgggggcuccagccgcgagaaccuggcccugcagaacgugcaggcccggauccgcaugguccucgccuaccuguucgcgcagcugucccuguggagccgcggggugcacggcggccuccuggugcugggguccgccaacgucgacgagagccuccugggcuaccugaccaaguacgacugcagcuccgccgacaucaaccccaucgggggcaucagcaagaccgaccuccgggccuucgugcaguucugcauccagcgguuccagcugccggcccugcaguccauccuccuggcgcccgccaccgccgagcuggagccccucgccgacggccaggugagccagaccgacgaggaggacauggggaugaccuacgccgagcuguccgucuacggcaagcugcgcaagguggcgaagauggggcccuacagcauguucugcaagcuccugggcauguggcggcacaucugcacgccgcgccagguggccgacaaggucaagcgguucuucuccaaguacagcaugaaccgccacaagaugaccacccugacccccgccuaccacgccgagaacuacucccccgaggacaaccgguucgaccuccgccccuuccuguacaacacgagcuggccguggcaguuccgcugcaucgagaaccaggugcugcagcucgagcgggcggagccccagucccuggacgggguggacuga

SEQ ID NO: 33360 - RNA, 1587 nt, Artificial Sequence
  derived and/or modified sequence opt1 from NAE1__Homo_sapiens__NP_001018169
auggacgcccagcagaccaagaccaacgaggcccgccuguggggcgaccacgggcaggaggcgcucgagagcgcccacgugugccugaucaacgccacggccaccggcaccgagauccugaagaaccucguccugcccgggaucggcuccuucaccaucaucgacgggaaccaggugagcggcgaggacgccggcaacaacuucuuccugcagcgguccagcaucgggaagaaccgcgcggaggccgccauggaguuccuccaggagcugaacuccgacgugagcggcuccuucgucgaggagagcccggagaaccugcucgacaacgaccccuccuucuucugccgguucacggugguggucgccacccagcugcccgagagcaccucccugcgccucgcggacgugcuguggaacagccagaucccccugcucaucugccggaccuacgggcuggugggcuacaugcgcaucaucaucaaggagcacccggucaucgagucccaccccgacaacgcccuggaggaccuccggcuggacaagcccuuccccgagcugcgcgagcacuuccagagcuacgaccucgaccacauggagaagaaggaccacucccacacgccguggaucgugaucaucgccaaguaccuggcccagugguacagcgagaccaacgggcggauccccaagaccuacaaggagaaggaggacuuccgcgaccugauccggcagggcauccucaagaacgagaacggcgcccccgaggacgaggagaacuucgaggaggcgaucaagaacgugaacaccgcccugaacacgacccagauccccuccagcaucgaggacaucuucaacgacgaccgcugcaucaacaucaccaagcagaccccguccuucuggauccuggcccgggcccucaaggaguucgucgccaaggaggggcagggcaaccugcccgugcgcgggacgauccccgacaugaucgcggacagcggcaaguacaucaagcugcagaacguguaccgggagaaggccaagaaggacgccgccgccgucggcaaccacguggcgaagcuccugcagagcaucgggcaggcccccgaguccaucagcgagaaggagcugaagcuccugugcuccaacagcgccuuccugcgcgugguccggugccgcucccucgccgaggaguacggccuggacaccaucaacaaggacgagaucaucagcuccauggacaacccggacaacgagaucgugcuguaccucaugcugcgggccguggaccgcuuccacaagcagcaggggcgguaccccggcgucagcaacuaccagguggaggaggacaucgggaagcugaaguccugccucaccggcuuccugcaggaguacggccugagcgugauggucaaggacgacuacgugcacgaguucugccgcuacggggcggccgagccccacaccaucgccgccuuccucggcggggcggccgcccaggaggucaucaagaucaucacgaagcaguucgugaucuucaacaacaccuacaucuacuccggcaugagccagaccuccgccaccuuccagcuguga

SEQ ID NO: 33361 - RNA, 1170 nt, Artificial Sequence
  derived and/or modified sequence opt1 from NAF1__Homo_sapiens__NP_001122403
auggagguggucgaggccgccgcggcccagcuggagacccucaaguucaacggcaccgacuucggggugggcgaggggcccgccgccccgagccccggcuccgcccccgugcccgggacccagccgccccugcagagcuucgagggcucccccgacgcgggccagaccgucgaggugaagcccgccggggagcagccgcugcagcccgugcucaacgccgucgccgcgggcacccccgcgccccagccgcagccgcccgccgagagccccgccugcggggacugcgugaccucccccggcgccgccgagcccgcccgcgcccccgacagccuggagacguccgacagcgacuccgacagcgacuccgagaccgacagcgacuccagcuccagcuccagcuccagcagcuccagcuccagcuccagcuccagcuccugcaucagccugcccccggugcucuccgacggggacgacgaccugcagaucgagaaggagaacaagaacuucccccugaagaccaaggacgagcuccugcugaacgagcuccccagcgucgaggagcugaccaucauccugcccgaggacaucgagcucaagccgcugggcaugguguccagcaucaucgagcagcuggugaucaucgaguccaugacgaaccucccgcccgucaacgaggagaccgugaucuucaagagcgaccggcaggccgccggcaagaucuucgagaucuucgggcccguggcgcaccccuucuacguccugcgcuucaacuccagcgaccacaucgaguccaagggcaucaagaucaaggagaccauguacuucgcccccagcaugaaggacuucacccaguacaucuucacggagaagcugaagcaggacaaggggagcgacgccuccuggaagaacgaccaggagcccccgcccgaggcccucgacuucagcgacgacgagaaggagaaggaggccaagcagcggaagaagucccagauccagggccgcaagaagcucaagagcgaguucaacgagcccggcaccgggaucucccaccgguacugcggccuggggagccgcccccugcaguccagcgagucccacaagcuguucggcuuccagaugcacaucaaggugaccuucacgugcuacuucagccugcucuccaugcaguga

SEQ ID NO: 33362 - RNA, 1236 nt, Artificial Sequence
  derived and/or modified sequence opt1 from NAGA__Homo_sapiens__XP_005261673
augcugcucaagaccgugcugcugcucggccacgucgcccaggugcugaugcuggacaacgggcuccugcagacgcccccgaugggcuggcuggccugggagcgcuuccggugcaacaucaacugcgacgaggaccccaagaacugcaucagcgagcagcuguucauggagauggcggaccgcauggcccaggacggguggcgggacaugggcuacaccuaccucaacaucgacgacugcuggaucgggggccgcgacgccuccggccggcugaugcccgaccccaagcgcuucccgcacgggauccccuuccucgccgacuacgugcacagccugggccugaagcucgggaucuacgccgacaugggcaacuucacgugcaugggguaccccggcaccacccuggacaaggucgugcaggacgcgcagaccuucgccgaguggaagguggacaugcugaagcucgacggcugcuucuccacccccgaggagcgggcccagggguacccgaagauggccgcggcccugaacgccaccggccgccccaucgccuucagcugcuccuggcccgccuacgagggcgggcugcccccgcgggucaacuacagccuccuggcggacaucugcaaccuguggcgcaacuacgacgacauccaggacuccugguggagcgugcucuccauccugaacugguucguggagcaccaggacauccugcagcccgucgccggccccgggcacuggaacgaccccgacaugcuccugaucggcaacuucgggcugagccucgagcagucccgggcccagauggcccuguggaccgugcuggccgcgccgcuccugaugagcacggaccugcgcaccaucuccgcccagaacauggacauccuccagaacccccugaugaucaagaucaaccaggacccccugggcauccaggggcggcgcauccacaaggagaagucccucaucgagguguacaugcggccccugagcaacaaggccagcgcccuggucuucuucuccugccgcaccgacaugccguaccgguaccacagcucccucggccagcugaacuucaccggcagcgugaucuacgaggcccaggacguguacagcggggacaucaucuccggccugcgcgacgagacgaacuucaccgucaucaucaaccccagcgggguggugaugugguaccucuaccccaucaagaaccuggagaugucccagcaguga

SEQ ID NO: 33363 - RNA, 1173 nt, Artificial Sequence
  derived and/or modified sequence opt1 from NAGK__Homo_sapiens__NP_060037
augcgcacccggaccggcagccagcuggccgcccgcgaggugacgggguccggcgcggucccccggcagcucgaggggcgccggugccaggccggccgcgacgccaacgggggcaccagcuccgacggcagcuccagcauggccgccaucuacgggggcguggagggcggcgggacccgguccgaggugcugcuggucagcgaggacgggaagauccucgcggaggccgacggccuguccaccaaccacuggcugaucgggacggacaagugcguggagcgcaucaacgagauggugaaccgggccaagcgcaaggccggcgucgacccgcucgugccccugcggagccuggggcucucccugagcggcggcgaccaggaggacgcggggcgcauccugaucgaggagcuccgggaccgcuuccccuaccuguccgagagcuaccugaucaccaccgacgccgccggcuccaucgccaccgccacgcccgacgggggcgugguccucaucagcgggaccggcuccaacugccggcugaucaacccggacggcagcgaguccgggugcggcggguggggccacaugaugggggacgagggcagcgcguacuggaucgcccaccaggccgugaagaucguguucgacagcaucgacaaccuggaggccgcgccccacgacaucggcuacgucaagcaggccauguuccacuacuuccaggugcccgaccgccucgggauccugacccaccuguaccgggacuucgacaagugccgcuucgccggcuucugccggaagaucgccgagggggcccagcagggcgacccccucucccgcuacaucuuccggaaggccggggagaugcugggccgccacaucguggcgguccugccggagaucgaccccguccucuuccagggcaagaucgggcugcccauccugugcgugggcagcguguggaaguccugggagcuccugaaggagggguuccugcucgcccugacccagggccgcgagauccaggcccagaacuucuucagcuccuucacgcugaugaagcuccggcacagcuccgcccugggcggggccagccugggcgcgcgccacaucgggcaccuccugcccauggacuacuccgccaacgccaucgccuucuacagcuacaccuucuccuga

SEQ ID NO: 33364 - RNA, 2232 nt, Artificial Sequence
  derived and/or modified sequence opt1 from NAGLU__Homo_sapiens__NP_000254
auggaggccguggccgucgcggccgccgugggcgugcugcuccuggccggggccggcggggcggccggcgacgaggcccgcgaggccgcggccguccgggcccugguggcccgccuccuggggcccggcccggccgcggacuucagcguguccgucgagcgggcccuggccgccaagcccggccucgacaccuacagccucgggggcgggggcgccgcgcgcgugcgggugcgcggguccaccggcgucgccgccgccgccggccugcaccgguaccuccgcgacuucugcgggugccacguggcguggagcggcucccagcugcggcugccccgcccccucccggccgugcccggggagcugaccgaggccacccccaaccgguaccgcuacuaccagaacgucugcacccagagcuacuccuucguguggugggacugggcccggugggagcgcgagaucgacuggauggcccugaacggcaucaaccucgcgcuggccuggagcggccaggaggccaucuggcagcggguguaccuggcccucgggcugacccaggcggagaucaacgaguucuucacgggccccgccuuccuggccugggggcgcaugggcaaccuccacaccugggacgggccgcugccgcccuccuggcacaucaagcagcuguaccuccagcaccggguccuggaccagaugcgcagcuucggcaugacccccgugcugcccgccuucgccggccacgugcccgaggcggucacccggguguucccccaggugaacgucacgaagaugggguccuggggccacuucaacugcagcuacuccugcagcuuccuccuggcccccgaggacccgaucuuccccaucaucgggucccuguuccuccgcgagcugaucaaggaguucggcaccgaccacaucuacggggccgacaccuucaacgagaugcagccgcccagcuccgagcccagcuaccuggccgccgcgaccacggccguguacgaggccaugaccgccguggacaccgaggccgucuggcuccugcagggcuggcuguuccagcaccagccccaguucuggggccccgcgcagauccgggccgugcucggggccgucccccgcggccgccugcuggugcucgaccuguucgccgagucccagccgguguacacccggacggcgagcuuccaggggcagcccuucaucuggugcaugcugcacaacuucggcgggaaccacggccucuucggcgcccuggaggccgucaacgggggccccgaggccgcccgccuguuccccaacagcaccaugguggggaccggcauggcgccggagggcaucucccagaacgagguggucuacagccucauggccgagcugggguggcggaaggaccccgugcccgaccuggccgccugggugaccuccuucgccgcgcgccgguacggcgucagccacccggacgccggggccgccuggcgccuccugcugcgguccguguacaacugcagcggcgaggccugccgcgggcacaaccggagcccccuggugcgccggcccucccuccagaugaacacguccaucugguacaaccgcagcgacgucuucgaggcguggcggcugcugcucaccuccgcccccagccuggccaccuccccggccuuccgcuacgaccugcucgaccugacccggcaggcggugcaggagcuggugagccucuacuacgaggaggcccgcuccgccuaccugagcaaggagcuggccucccuccugcgggccggcggcguccuggcguacgagcuccugcccgcccuggacgaggugcucgccagcgacucccgcuuccugcuggggagcuggcucgagcaggcccgggccgcggccgugagcgaggccgaggccgacuucuacgagcagaacucccgcuaccagcugacgcuguggggccccgaggggaacauccucgacuacgccaacaagcagcuggcgggccuggucgccaacuacuacacgccccgcuggcggcuguuccuggaggcccugguggacagcguggcccaggggaucccguuccagcagcaccaguucgacaagaacgucuuccagcucgagcaggccuucgugcuguccaagcagcgcuaccccagccagccccggggcgacaccguggaccuggcgaagaagaucuuccucaaguacuacccccgcugggucgccggcuccugguga

SEQ ID NO: 33365 - RNA, 1548 nt, Artificial Sequence
  derived and/or modified sequence opt1 from NAGPA__Homo_sapiens__NP_057340
auggccaccagcaccggccgcuggcugcuccugcggcuggcccucuucggguuccugugggaggcguccggcgggcuggacagcggcgccucccgcgacgacgaccuccugcugcccuacccgcgggcccgcgcccggcucccccgcgacugcacgcgggugcgcgccgggaaccgggagcacgagagcuggccgcccccgcccgcgacccccggcgccggcgggcuggccguccgcaccuucgugucccacuuccgggaccgcgccguggcgggccaccugacccgggccgucgagccccuccgcacguucagcgugcuggagcccgggggccccgggggcugcgccgcccggcgccgggccaccguggaggagaccgcgcgcgccgccgacugccgggucgcccagaacggcggguucuuccgcaugaacuccggcgagugccuggggaacguggugagcgacgagcggcgcgucuccagcuccggcggccuccagaacgcccaguucgggauccgccgggacggcacccuggugacgggguaccugagcgaggaggaggugcucgacaccgagaaccccuucguccagcugcuguccggcgugguguggcucauccgcaacgggagcaucuacaucaacgagucccaggcgaccgagugcgacgagacccaggagacgggcagcuucuccaaguucgucaacgugaucagcgcccggaccgccaucggccacgaccgcaaggggcagcuggugcuguuccacgccgacggccagaccgagcagcgggggaucaaccucugggagauggccgaguuccugcugaagcaggacgucgugaacgcgaucaaccucgacggcgggggcuccgccaccuucgugcugaacggcacgcuggccagcuaccccagcgaccacugccaggacaacauguggcgcugcccgcggcaggucuccaccguggugugcguccacgagccccgcugccagccgcccgacugccacgggcacgggaccugcguggacggccacugccagugcaccggccacuucuggcgggggcccggcugcgacgagcucgacugcggccccagcaacugcucccagcacgggcugugcacggagaccggcugccgcugcgacgccggguggaccggcagcaacugcuccgaggagugcccccugggcuggcacgggcccggcugccagcggccgugcaagugcgagcaccacugccccugcgaccccaagaccgggaacugcagcgucucccgcgugaagcagugccuccagcccccggaggccacgcugcgggcgggcgagcugagcuucuucacccgcaccgccuggcucgcccugacccuggcccucgcguuccugcugcucaucuccacggccgccaaccugagccugcuccugucccgggccgagcgcaaccggcgccugcacggggacuacgccuaccacccccuccaggagaugaacggcgagccccuggcggccgagaaggagcagcccggcggggcccacaacccguucaaggacuga

SEQ ID NO: 33366 - RNA, 1605 nt, Artificial Sequence
  derived and/or modified sequence opt1 from NAGS__Homo_sapiens__NP_694551
auggccaccgcccugauggcggugguccuccgcgccgccgccguggcgccccggcugcgcggccgcgggggcaccgggggcgcccggcggcugagcugcggggcccgccggcgcgccgcccggggcacguccccgggccgccggcucagcaccgcguggucccagccccagcccccgcccgaggaguacgccggggccgacgacgugagccagucccccgucgccgaggagcccagcugggugcccuccccgcgcccgcccgugccccacgagagccccgagccgcccuccggccggagccugguccagcgcgacauccaggccuuccugaaccagugcggggcgucccccggcgaggcccggcacuggcucacccaguuccagaccugccaccacagcgccgacaagcccuucgccgugaucgagguggacgaggagguccugaagugccagcaggggguguccagccuggccuucgcgcucgccuuccugcagcgcauggacaugaagccccuggugguccucggccugcccgcccccacggccccguccggcugccugagcuucugggaggccaaggcgcagcucgccaaguccugcaaggugcugguggacgcccugcggcacaacgccgccgcggccguccccuucuucgggggcgggagcgugcuccgcgccgccgagcccgcgccccacgccuccuacggcggcaucgugagcgucgagaccgaccugcugcaguggugccucgagagcggguccaucccgauccugugccccaucggcgagaccgccgcccggcgcagcgugcugcucgacucccuggaggugaccgccagccuggcgaaggcccuccggcccacgaagaucaucuuccugaacaacaccgggggccugcgcgacuccagccacaagguccucuccaacgugaaccugcccgccgaccuggaccucgugugcaacgccgagugggucagcaccaaggagcgccagcagaugcggcugaucguggacguccugucccgccucccgcaccacagcuccgccgugaucaccgcggccagcacgcugcugaccgagcuguucuccaacaaggggagcggcacccuguucaagaacgccgagcggaugcugcgcgugcggucccucgacaagcuggaccagggccgccuggucgaccucgugaacgccagcuucgggaagaagcugcgggacgacuaccuggccucccuccgcccccggcugcacagcaucuacguguccgagggcuacaacgcggccgccauccugaccauggagcccguccucgggggcacgccguaccucgacaaguucguggugagcagcucccgccaggggcagggcagcggccagaugcugugggagugccugcggcgcgaccuccagacccuguucuggcggucccgcgucaccaaccccaucaaccccugguacuucaagcacagcgacggguccuucagcaacaagcaguggaucuucuucugguucggccuggccgacauccgggacuccuacgagcucgugaaccacgcgaaggggcugcccgacagcuuccacaagccggccuccgaccccggcagcuga

SEQ ID NO: 33367 - RNA, 4212 nt, Artificial Sequence
  derived and/or modified sequence opt1 from NAIP__Homo_sapiens__NP_004527
auggccacccagcagaaggccagcgacgagcgcaucucccaguucgaccacaaccugcuccccgagcugagcgcgcugcucggccuggacgccgugcagcuggccaaggagcucgaggaggaggagcagaaggagcgggccaagaugcagaagggguacaacucccagaugcgcagcgaggccaagcggcugaagaccuucgucacguacgagccguacuccagcuggaucccccaggagauggcggccgccggcuucuacuucaccggggugaaguccggcauccagugcuucugcugcagccugauccucuucggggccggccugacccgccugcccaucgaggaccacaagcgguuccaccccgacugcggcuuccuccugaacaaggacguggggaacaucgcgaaguacgacauccgcgucaagaaccugaagucccggcuccgcggcgggaagaugcgguaccaggaggaggaggcccgccuggccagcuuccggaacuggccguucuacgugcagggcaucucccccugcgugcugagcgaggccggguucgucuucaccggcaagcaggacacggugcagugcuucuccugcggcgggugccucggcaacugggaggagggggacgaccccuggaaggagcacgccaagugguuccccaagugcgaguuccugcgcagcaagaaguccagcgaggagaucacccaguacauccaguccuacaagggcuucguggacaucaccggcgagcacuucgucaacagcugggugcagcgggagcugccgauggcguccgccuacugcaacgacagcaucuucgccuacgaggagcuccgccuggacagcuucaaggacuggccccgggaguccgccgugggggucgccgcgcuggccaaggccggccucuucuacaccgggaucaaggacaucgugcagugcuucagcugcggcgggugccuggagaaguggcaggagggcgacgacccccuggacgaccacacgcgcugcuuccccaacugcccguuccuccagaacaugaaguccagcgccgaggugacccccgaccugcagucccggggcgagcugugcgagcuccuggagaccaccagcgaguccaaccuggaggacagcaucgccgucgggcccaucgugcccgagauggcgcagggcgaggcccagugguuccaggaggccaagaaccucaacgagcagcugcgcgccgccuacacguccgcgagcuuccggcacaugucccugcucgacaucagcuccgaccuggccaccgaccaccuccuggggugcgaccugagcaucgccuccaagcacaucagcaagccggugcaggagccccugguccuccccgagguguucggcaaccugaacuccgugaugugcgucgagggggaggccggcagcggcaagaccgugcugcucaagaagaucgcguuccugugggccuccgggugcugcccccugcucaaccgcuuccagcugguguucuaccugagccugagcuccacccggccggacgagggccucgccagcaucaucugcgaccagcugcuggagaaggagggguccgucacggagaugugcgugcgcaacaucauccagcagcucaagaaccagguccuguuccugcucgacgacuacaaggagaucugcagcaucccccaggugaucggcaagcugauccagaagaaccaccugucccggaccugccuccugaucgccgugcgcaccaaccgcgcccgggacauccgccgguaccuggagaccauccucgagaucaaggcguuccccuucuacaacacggucugcauccugcgcaagcuguucagccacaacaugacccggcuccgcaaguucaugguguacuucgggaagaaccagucccugcagaagauccagaagacgccccuguucguggccgccaucugcgcccacugguuccaguacccguucgaccccagcuucgacgacgucgccguguucaaguccuacauggagcggcucagccugcgcaacaaggcgaccgccgagauccugaaggccaccguguccagcugcggcgagcucgcccugaagggcuucuucuccugcugcuucgaguucaacgacgacgaccuggccgaggcgggggucgacgaggacgaggaccucaccaugugccugaugagcaaguucaccgcccagcggcugcgccccuucuaccgguuccucucccccgccuuccaggaguuccuggccggcaugcgccugaucgagcuccuggacagcgaccggcaggagcaccaggaccuggggcucuaccaccugaagcagaucaacuccccgaugaugaccgugagcgcguacaacaacuuccugaacuacgugagcucccuccccagcacgaaggccggccccaagaucgucucccaccuccugcaccugguggacaacaaggagagccuggagaacaucuccgagaacgacgacuaccugaagcaccagccggagaucagccuccagaugcagcugcugcgcggccucuggcagaucugcccccaggccuacuucuccauggugagcgagcaccuccugguccuggcccugaagaccgccuaccaguccaacaccguggcggccugcagccccuucgugcugcaguuccuccaggggcggacccugacgcugggcgcccucaaccugcaguacuucuucgaccaccccgagucccugagccuccugcgcuccauccacuucccgauccgggggaacaagaccagcccccgcgcccacuucuccguccuggagaccugcuucgacaagagccaggugcccaccaucgaccaggacuacgccuccgcguucgagcccaugaacgagugggagcgcaaccucgccgagaaggaggacaacgucaagagcuacauggacaugcagcggcgcgccuccccggaccugagcacgggcuacuggaagcugagccccaagcaguacaagauccccugccucgagguggacgugaacgacaucgacguggucgggcaggacaugcuggagauccugaugaccguguucuccgccagccagcggaucgagcuccaccugaaccacucccgcggcuucaucgagagcauccggcccgcccuggagcucuccaaggcgagcgugaccaagugcuccaucagcaagcuggagcuguccgccgccgagcaggagcuccugcugacccucccgagccuggagucccuggaggucagcggcaccauccagucccaggaccagaucuuccccaaccucgacaaguuccugugccugaaggagcucagcguggaccuggaggggaacaucaacguguucuccgucauccccgaggaguuccccaacuuccaccacauggagaagcugcucauccagaucagcgccgaguacgacccguccaagcuggugaagcugauccagaacagccccaaccuccacguguuccaccugaagugcaacuucuucuccgacuucggcagccugaugacgaugcucgucagcugcaagaagcugaccgagaucaaguucuccgacagcuucuuccaggcggugcccuucguggccucccugcccaacuucaucagccucaagauccugaaccuggaggggcagcaguucccggacgaggagaccuccgagaaguucgccuacauccugggcagccucuccaaccuggaggagcugauccuccccaccggggacggcaucuaccgcgucgccaagcugaucauccagcagugccagcagcugcacugccuccgggugcugagcuucuucaagacgcugaacgacgacuccguggucgagaucgccaagguggcgaucagcggcggguuccagaagcucgagaaccugaagcuguccaucaaccacaagaucaccgaggagggcuaccgcaacuucuuccaggcccucgacaacaugcccaaccugcaggagcuggacaucagccggcacuucaccgagugcaucaaggcccaggccaccacggugaagucccucagccagugcguccugcgccugccccggcucauccgccugaacaugcuguccuggcuccuggacgccgacgacaucgcgcugcucaacgugaugaaggagcggcacccgcagagcaaguaccugaccauccugcagaaguggauccuccccuucucccccaucauccagaaguga

SEQ ID NO: 33368 - RNA, 5274 nt, Artificial Sequence
  derived and/or modified sequence opt1 from NALCN__Homo_sapiens__XP_011519369
augcagagcgccgugcagaccgucgugcugugccugcugaccaaggccaaccugagcaugcucaagcggaagcagagcucccggguggaggcgcagcccgucaccgacuucggcccggacgagagccuguccgacaacgccgacauccuguggaucaacaagcccugggugcacagccuccugcgcaucugcgccaucaucuccgugaucagcgucugcaugaacacccccaugaccuucgagcacuacccgccccugcaguacgugaccuucacgcucgacacccugcugauguuccucuacaccgccgagaugaucgccaagaugcacauccgggggaucgugaagggcgacuccagcuacgucaaggaccgcuggugcguguucgacggguucaugguguucugccugugggucucccuggugcuccagguguucgagaucgcggacaucgucgaccagaugagccccuggggcaugcugcggaucccccgcccccugaucaugauccgggccuuccgcaucuacuuccgguucgagcucccgcgcacccggaucacgaacauccugaagcgcuccggggagcagaucuggagcguguccaucuuccuccuguucuuccugcugcucuacggcauccugggcgugcagauguucgggaccuucaccuaccacugcgucgugaacgacaccaagcccggcaacgugacguggaacagccuggccauccccgacacccacugcucccccgagcucgaggagggguaccagugcccgcccggcuucaagugcauggaccuggaggaccuggggcucagccggcaggagcugggcuacuccggcuucaacgagaucgggaccagcaucuucaccgucuacgaggccgcgagccaggagggcuggguguuccugauguaccgcgccaucgacuccuucccccgguggcgcagcuacuucuacuucaucacgcucaucuucuuccuggccuggcuggugaagaacgucuucaucgccgugaucaucgagaccuucgccgagauccggguccaguuccagcagaugugggggucccgcagcuccaccaccagcacggcgaccacccagauguuccacgaggacgccgccggcggcuggcagcucguggccguggacgucaacaagccccaggggcgggccccggcgugccugcagaagaugaugcgcuccagcguguuccacauguucauccuguccauggugaccgucgacgugaucguggccgccagcaacuacuacaagggcgagaacuuccggcgccaguacgacgaguucuaccucgccgaggucgccuucacggugcuguucgaccuggaggcgcuccugaagaucuggugccugggguucaccggcuacaucuccagcucccuccacaaguucgagcugcugcucgugaucgggaccacccugcacgucuaccccgaccuguaccacagccaguucacguacuuccaggugcugcgcgugguccggcucaucaagaucucccccgcccuggaggacuucguguacaagaucuucggccccggcaagaagcuggggagccucguggucuucaccgccucccugcugaucgugaugagcgccaucucccuccagauguucugcuucguggaggagcuggaccgcuucaccaccuucccgcgggccuucaugagcauguuccagauccugacgcaggagggcugggucgacgugauggaccagacccucaacgcgguggggcacaugugggcccccgucguggccaucuacuucauccuguaccaccuguucgccacccucauccugcugagccucuucguggcggucauccuggacaaccuggagcucgacgaggaccugaagaagcugaagcagcucaagcaguccgaggccaacgccgacaccaaggagaagcugccccugcgccuccggaucuucgagaaguuccccaaccgcccgcagauggugaagaucagcaagcugcccuccgacuucacggugcccaagauccgggagagcuucaugaagcaguucaucgaccgccagcagcaggacacgugcugccugcuccggucccugcccaccaccagcuccagcuccugcgaccacagcaagcgcuccgccaucgaggacaacaaguacaucgaccagaagcugcgcaagagcgucuucuccauccgcgcccggaaccuccuggagaaggagaccgcggugacgaagauccugcgcgccugcacccggcagcgcaugcucagcggcuccuucgaggggcagccggccaaggagcggagcauccuguccgugcagcaccacauccgccaggagcggcgcagccugcgccacggcagcaacucccagcggaucagccgcggcaagucccucgagacccugacccaggaccacagcaacacgguccgguaccgcaacgcccagcgggaggacuccgagaucaagaugauccaggagaagaaggagcaggccgagaugaagcgcaaggugcaggaggaggagcugcgggagaaccaccccuacuucgacaagccccucuucaucguggggcgcgagcaccgguuccgcaacuucugccgggucguggugcgcgcgcgguucaacgccagcaagaccgacccggucaccggcgccgugaagaacaccaaguaccaccagcuguacgaccugcucgggcuggugacguaccuggacugggucaugaucaucgugaccaucugcuccugcaucagcaugauguucgagucccccuuccgccgggugaugcacgcccccacccuccagaucgccgaguacgucuucgugaucuucaugagcaucgagcugaaccugaagaucauggcggacggccucuucuucacccccacggccgugauccgcgacuucgggggcgucauggacaucuucaucuaccuggugucccugaucuuccucugcuggaugccgcagaacgugcccgccgagagcggcgcccagcugcugaugguccuccggugccugcgcccccugcggaucuucaagcucgugccccagaugcgcaaggucgugcgggagcuguucuccggguucaaggagaucuuccuggugagcauccuccugcugacccucaugcuggucuucgcguccuucggcgugcagcuguucgccgggaagcucgccaagugcaacgacccgaacaucauccgccgcgaggacugcaacggcaucuuccggaucaacgugagcgucuccaagaaccugaaccugaagcuccgccccggcgagaagaagcccggguucugggugccccgggugugggccaacccgcgcaacuucaacuucgacaacgucggcaacgccaugcuggcgcuguucgaggugcucagccugaagggguggguggagguccgggacgugaucauccaccgcgugggccccauccacgggaucuacauccacgucuucguguuccugggcugcaugaucggccucacccuguucgugggggucgugaucgccaacuucaacgagaacaagggcaccgcccugcucacgguggaccagcggcgcugggaggaccugaagucccggcugaagaucgcccagccccuccaccucccgccccgccccgacaacgacggguuccgggccaagauguacgacaucacccagcaccccuucuucaagcgcaccaucgcgcugcucguccuggcccagagcgugcugcucagcgugaagugggacgucgaggaccccgugaccgugccgcuggccacgauguccgucguguucaccuucaucuucgugcuggaggucaccaugaagaucaucgccaugagccccgccggcuucuggcagucccggcgcaaccgguacgaccuccuggugaccagccuggggguggucuggguggugcuccacuucgcgcugcugaacgccuacacguacaugaugggcgccugcgucaucguguuccgcuucuucuccaucugcggcaagcacgugacccugaagaugcuccugcugaccgucguggugagcauguacaaguccuucuucaucaucgucgggauguuccuccugcugcucugcuacgccuucgcgggcguggugcuguucgggaccgucaaguacggcgagaacaucaaccggcacgccaacuucagcuccgccgggaaggccaucacggugcuguuccgcaucgugaccggcgaggacuggaacaagaucaugcacgacugcaugguccagccgcccuucugcaccccggacgaguucaccuacugggccacggacugcggcaacuacgcgggggcccucauguacuucugcagcuucuacgugaucaucgccuacaucaugcugaaccugcucguggccaucaucgucgagaacuucucccuguucuacagcaccgaggaggaccagcugcucuccuacaacgaccugcggcacuuccagaucaucuggaacaugguggacgacaagcgcgagggcgucauccccaccuuccgcgugaaguuccugcuccggcugcugcgcgggcggcucgagguggaccuggacaaggacaagcuccuguucaagcacaugugcuacgagauggagcgccugcacaacggcggggacgucaccuuccacgacgugcugagcaugcucuccuaccggagcguggacauccgcaagucccugcagcuggaggagcuccuggcccgggagcagcuggaguacacgaucgaggaggaggucgcgaagcagaccauccgcauguggcucaagaagugccugaagcggauccgcgccaagcagcagcagagcugcuccaucauccacagccugcgggagagccagcagcaggagcucucccgcuuccugaacccgcccagcaucgagaccacccagcccuccgaggacaccaacgccaacagccaggacaacuccaugcagcccgagacgagcucccagcagcagcugcucagccccacccuguccgaccggggcggcagccgccaggacgccgccgacgcggggaagccccagcggaaguucggccaguggcgccugcccuccgcccccaagcccaucagccacuccgugagcuccgugaaccuccgguucgggggccgcaccaccaugaaguccgucgugugcaagaugaacccgaugacggacgccgccuccugcggcagcgaggugaagaagugguggacccggcagcugaccgucgaguccgacgagagcggggacgaccugcucgacaucuga

SEQ ID NO: 33369 - RNA, 1476 nt, Artificial Sequence
  derived and/or modified sequence opt1 from NAMPT__Homo_sapiens__XP_005250157
augaaccccgccgccgaggcggaguucaacauccugcucgccaccgacagcuacaaggugacccacuacaagcaguacccgcccaacacguccaaggucuacagcuacuucgagugccgcgagaagaagaccgagaacuccaagcugcggaaggugaaguacgaggagaccguguucuacggccugcaguacauccucaacaaguaccugaaggggaaggucgugaccaaggagaagauccaggaggccaaggacguguacaaggagcacuuccaggacgacgucuucaacgagaagggcuggaacuacauccuggagaaguacgacgggcaccuccccaucgagaucaaggccgugcccgagggcuucgugaucccgcgcgggaacguccuguucacgguggagaacaccgaccccgagugcuacuggcugaccaacuggaucgagaccauccucgugcagagcugguaccccaucacggucgccaccaacucccgggagcagaagaagauccuggcgaaguaccugcucgagaccagcggcaaccuggacggccuggaguacaagcuccacgacuucggguaccgcggcguguccagccaggagaccgccgggaucggcgccuccgcccaccuggugaacuucaaggggacggacaccgucgcgggccuggcccucaucaagaaguacuacggcaccaaggaccccgugccgggguacagcgugcccgccgccgagcacuccaccaucacggccuggggcaaggaccacgagaaggacgcguucgagcacaucgucacccaguucagcuccgugcccgugagcgucguguccgacagcuacgacaucuacaacgccugcgagaagaucuggggcgaggaccugcggcaccugaucgugucccgcagcacccaggcgccccucaucauccggccggacuccgggaacccccuggacaccguccugaaggugcucgagauccugggcaagaaguuccccgucacggagaacagcaagggguacaagcugcugcccccguaccuccgcgugauccagggcgacgggguggacaucaacacccugcaggagaucgucgagggcaugaagcagaagauguggagcaucgagaacaucgccuucggguccggcggcgggcuccugcagaagcugacccgggaccuccugaacugcagcuucaagugcuccuacguggugaccaacggccuggggaucaacgucuucaaggaccccguggccgaccccaacaagcgcagcaagaagggccggcucucccugcaccgcacgcccgccgggaacuucgugacccuggaggagggcaagggcgaccucgaggaguacgggcaggaccugcugcacaccgucuucaagaacggcaaggugaccaagagcuacuccuucgacgagauccggaagaacgcccagcucaacaucgagcuggaggccgcccaccacuga

SEQ ID NO: 33370 - RNA, 870 nt, Artificial Sequence
  derived and/or modified sequence opt1 from NANOG__Homo_sapiens__NP_001284627
augagcguggaccccgccugcccgcagucccugcccugcuucgaggccagcgacugcaaggaguccagccccaugcccgucaucugcggcccggaggagaacuaccccucccuccagaugagcuccgcggagaugccccacaccgagaccgugagcccccugccguccagcauggaccugcucauccaggacucccccgacagcuccacgagccccaaggggaagcagcccaccuccgccgagaaguccguggccaagaaggaggacaaggucccggugaagaagcagaagacccgcaccguguucagcagcacgcagcugugcguccugaacgaccgguuccagcgccagaaguaccucucccugcagcagaugcaggagcugagcaacauccucaaccugagcuacaagcaggucaagaccugguuccagaaccagcggaugaaguccaagcgcuggcagaagaacaacuggcccaagaacagcaacggcgugacccaggggugccuggugaaccccaccggcaaccuccccaugugguccaaccagacguggaacaacagcaccugguccaaccagacccagaacauccagagcugguccaaccacagcuggaacacccagacguggugcacccaguccuggaacaaccaggccuggaacagcccguucuacaacugcggggaggagucccugcagagcugcaugcaguuccagcccaacucccccgccagcgaccuggaggcggcccucgaggccgccggcgagggccugaacgugauccagcagaccacccgguacuucuccacgccccagaccauggaccuguuccucaacuacagcaugaacaugcagccggaggacguguga

SEQ ID NO: 33371 - RNA, 879 nt, Artificial Sequence
  derived and/or modified sequence opt1 from NANOS1__Homo_sapiens__NP_955631
auggaggccuuccccugggcgccccggagcccccgccgcggccgggcgcccccgcccauggcccuggugcccuccgcccgcuacgucagcgcccccgggcccgcccacccgcagcccuucuccagcuggaacgacuaccucggccuggcgacccugaucaccaaggccguggacggggagccccgguucggcugcgcccgcgggggcaacggcgggggcgggagcccgcccuccuccagcuccagcuccugcugcagcccccacacgggcgccgggcccggcgcgcucggccccgcccuggggccgcccgacuacgacgaggacgacgacgacgacuccgacgagcccggcagccgggggcgcuaccugggcuccgcccucgagcugcgggcccuggagcucugcgccggccccgccgaggccgggcugcuggaggagcgcuucgccgagcucagccccuucgccggccgggccgcggccgugcugcuggggugcgcccccgccgccgcggccgccgccaccaccaccuccgaggccacgccccgcgaggagcgggcgcccgccugggccgccgagccgcgccuccacgcggccagcggcgccgccgccgcgcggcugcugaagcccgagcuccaggucugcguguucugccgcaacaacaaggaggccauggcccuguacaccacccacauccugaaggggcccgacggccgggugcucugccccguccugcgccgguacacgugcccgcugugcggcgccuccggggacaacgcccacaccaucaaguacugcccccucagcaaggugcccccgccgcccgcgcggcccccgccccgcagcgcccgcgacggcccgcccgggaagaagcugcgcuga

SEQ ID NO: 33372 - RNA, 417 nt, Artificial Sequence
  derived and/or modified sequence opt1 from NANOS2__Homo_sapiens__NP_001025032
augcagcugcccccguucgacauguggaaggacuacuucaaccucagccagguggucugggcccugaucgccucccgcggccagcggcuggagacccaggagaucgaggagcccagccccgggcccccgcucggccaggaccaggggcugggcgcgcccggggccaacggcggccuggggacccucugcaacuucugcaagcacaacggcgagucccgccacguguacagcucccaccagcugaagacgcccgacgggguggucgugugccccauccugcggcacuacgugugcccggucugcggcgccaccggggaccaggcccacacccucaaguacugcccccugaacggcggccagcagagccuguaccgccgguccgggcgcaacagcgccggccggcgcgugaagcgguga

SEQ ID NO: 33373 - RNA, 579 nt, Artificial Sequence
  derived and/or modified sequence opt1 from NANOS3__Homo_sapiens__NP_001092092
augggcaccuucgaccuguggaccgacuaccucgggcuggcccaccuggugcgcgcccucagcggcaaggaggggcccgagacgcggcuguccccgcagcccgagcccgagcccaugcuggagccggucagcgcgcucgagcccaugcccgcccccgaguccgugccggugcccggccccaaggaccagaagcgcagccuggaguccagccccgccccggagcggcugugcuccuucugcaagcacaacggggagagccgcgccaucuaccagucccacguccucaaggacgaggccggccgggugcugugccccauccugcgcgacuacgugugcccccagugcggcgcgacccgggagcgcgcccacacccggcgcuucugcccccucaccgggcagggcuacacgagcgucuacucccacaccacccggaacagcgccgggaagaagcuggugcgcccggacaaggccaagacccaggacacgggccaccggcgcgggggcggcgggggcgcgggguuccggggcgccggcaaguccgagcccagccccuccugcagccccuccaugagcaccuga

SEQ ID NO: 33374 - RNA, 1080 nt, Artificial Sequence
  derived and/or modified sequence opt1 from NANS__Homo_sapiens__NP_061819
augccccuggagcucgagcugugccccggccgcugggucgggggccagcaccccugcuucaucaucgccgagaucgggcagaaccaccagggcgaccuggacguggccaagcggaugauccgcauggcgaaggagugcggggccgacugcgccaaguuccagaaguccgagcucgaguucaaguucaaccggaaggcccuggagcgccccuacaccagcaagcacagcuggggcaagaccuacggcgagcacaagcggcaccuggaguucucccacgaccaguaccgcgagcuccagcgguacgccgaggagguggggaucuucuucacggcgagcggcauggacgagauggccguggaguuccugcacgagcugaacguccccuucuucaaggugggguccggcgacaccaacaacuucccguaccucgagaagaccgccaagaaggggcgccccauggugaucagcuccggcaugcagagcauggacaccaugaagcaggucuaccagaucgugaagccccugaaccccaacuucugcuuccugcagugcacguccgccuacccgcuccagcccgaggacgugaaccugcgggucaucagcgaguaccagaagcuguuccccgacauccccaucggcuacuccgggcacgagaccggcaucgcgaucagcguggccgccguggcccucggggccaagguccuggagcgccacaucacccuggacaagaccuggaagggcuccgaccacagcgcgucccucgagccgggcgagcuggccgagcuggugcggagcgugcgccucgucgagcgggcccuggggucccccacgaagcagcugcuccccugcgagauggccugcaacgagaagcugggcaagagcgugguggccaaggucaagauccccgaggggaccauccugaccauggacaugcucaccgugaaggugggcgagccgaagggguacccgcccgaggacaucuucaaccuggucggcaagaaggugcuggugacggucgaggaggacgacaccaucauggaggagcucguggacaaccacggcaagaagaucaaguccuga

SEQ ID NO: 33375 - RNA, 1176 nt, Artificial Sequence
  derived and/or modified sequence opt1 from NAP1L1__Homo_sapiens__NP_004528
auggccgacaucgacaacaaggagcagagcgagcuggaccaggaccucgacgacguggaggaggucgaggaggaggagaccggcgaggagaccaagcugaaggcccgccagcugacggugcagaugaugcagaacccccagauccucgcggcccugcaggagcggcuggacgggcucguggagaccccgaccggcuacaucgagucccugccccgcgucgugaagcggcgcgugaacgcccugaagaaccuccaggucaagugcgcccagaucgaggccaaguucuacgaggaggugcacgaccuggagcggaaguacgcggugcuguaccagccccucuucgacaagcgcuucgagaucaucaacgccaucuacgagcccaccgaggaggagugcgaguggaagccggacgaggaggacgagaucagcgaggagcugaaggagaaggccaagaucgaggacgagaagaaggacgaggagaaggaggaccccaaggggauccccgaguucuggcugacggucuucaagaacguggaccuccuguccgacauggugcaggagcacgacgagcccauccugaagcaccucaaggacaucaaggucaaguucagcgacgccggccagccgauguccuucgugcuggaguuccacuucgagcccaacgaguacuucaccaacgaggugcugaccaagaccuaccggaugcgcagcgagcccgacgacuccgaccccuucagcuucgacgggccggagaucaugggcugcacgggcugccagaucgacuggaagaaggggaagaacgucacccucaagaccaucaagaagaagcagaagcacaagggccgggggaccgugcgcacggugaccaagaccgucuccaacgacagcuucuucaacuucuucgcgccgcccgaggugcccgaguccggcgaccuggacgacgacgccgaggccauccuggccgccgacuucgagaucgggcacuuccuccgggagcgcaucaucccccggagcgugcuguacuucaccggcgaggcgaucgaggacgacgacgacgacuacgacgaggagggcgaggaggccgacgaggagggggaggaggagggcgacgaggagaacgaccccgacuacgaccccaagaaggaccagaaccccgccgagugcaagcagcaguga

SEQ ID NO: 33376 - RNA, 1521 nt, Artificial Sequence
  derived and/or modified sequence opt1 from NAP1L3__Homo_sapiens__NP_004529
auggccgaggccgacuucaagauggugagcgagcccgucgcgcacggcguggccgaggaggagauggccuccagcaccuccgacagcggggaggaguccgacagcuccagcuccagcuccagcaccuccgacagcuccagcuccagcuccacgagcggcagcuccagcggguccggcagcuccagcuccagcuccgggagcaccuccagccgcucccggcuguaccgcaagaagcgggugccggagcccagccgccgggcccgccgggcgccccugggcaccaacuucgucgaccgccugccccaggccgugcggaaccgcgugcaggcccugcggaacauccaggacgagugcgacaaggucgacacccucuuccugaaggccauccacgaccuggagcgcaaguacgccgagcucaacaagccgcuguacgaccggcgcuuccagaucaucaacgcggaguacgagcccacggaggaggagugcgaguggaacuccgaggacgaggaguucagcuccgacgaggaggugcaggacaacacccccagcgagaugcccccgcuggagggcgaggaggaggagaaccccaaggagaaccccgaggugaaggccgaggagaaggagguccccaaggagaucccggaggugaaggacgaggagaaggaggugcccaaggagauccccgaggucaaggccgaggagaaggccgacuccaaggacugcauggaggccacccccgaggugaaggaggacccgaaggaggugccccaggucaaggcggacgacaaggagcagcccaaggccaccgaggccaaggcccgggccgcggugcgcgagacgcacaagcgggugcccgaggagcgccuccaggacagcgucgaccugaagcgggcccgcaaggggaagccgaagcgggaggaccccaagggcauccccgacuacuggcugaucgugcucaagaacguggacaagcuggggcccaugauccagaaguacgacgagccgauccugaaguuccucagcgacgucucccugaaguucagcaagcccggccagcccguguccuacaccuucgaguuccacuuccugcccaacccguacuuccgcaacgaggugcucgucaagaccuacaucaucaaggccaagcccgaccacaacgaccccuucuucagcugggggugggagaucgaggacugcaagggcugcaagaucgacuggcgccggggcaaggacgugaccgucacgaccacccagucccgcaccacggccaccggggagaucgagauccagccgcggguggugcccaacgccagcuucuucaacuucuucuccccgcccgagauccccaugaucggcaagcuggagccccgcgaggacgcgauccuggacgaggacuucgagaucgggcagauccuccacgacaacgucauccucaagagcaucuacuacuacaccggcgaggugaacggcaccuacuaccaguucgggaagcacuacggcaacaagaaguaccggaaguga

SEQ ID NO: 33377 - RNA, 1128 nt, Artificial Sequence
  derived and/or modified sequence opt1 from NAP1L4__Homo_sapiens__NP_005960
auggccgaccacagcuucuccgacggcgugcccagcgacuccgucgaggccgcgaagaacgccagcaacaccgagaagcugaccgaccaggugaugcagaacccgcgcgugcucgccgcccugcaggagcggcuggacaacgucccccacacgcccuccagcuacaucgagacccuccccaaggccgugaagcgccggaucaacgcgcugaagcagcuccaggugcgcugcgcccacaucgaggccaaguucuacgaggagguccacgaccuggagcggaaguacgccgcgcuguaccagccgcuguucgacaagcgccgggaguucaucaccggggacguggagcccaccgacgccgaguccgaguggcacagcgagaacgaggaggaggagaagcucgccggcgacaugaaguccaagguggucgugacggagaaggccgccgcgaccgccgaggagcccgaccccaaggggaucccggaguucugguucaccaucuuccgcaacguggacaugcugagcgagcugguccaggaguacgacgagcccauccucaagcaccuccaggacaucaaggugaaguucuccgaccccggccagcccaugagcuucgugcuggaguuccacuucgagccgaacgacuacuucaccaacuccguccugacgaagaccuacaagaugaaguccgagcccgacaaggccgaccccuucagcuucgaggggcccgagaucguggacugcgacggcugcaccaucgacuggaagaagggcaagaacgugaccgucaagacgaucaagaagaagcagaagcacaaggggcggggcaccgugcgcaccaucaccaagcaggucccgaacgagagcuucuucaacuucuucaacccccugaaggccuccggggacggcgagagccuggacgaggacuccgaguucacgcucgccagcgacuucgagaucgggcacuucuuccgggagcgcaucgugccccgggcggugcuguacuucaccggcgaggccaucgaggacgacgacaacuucgaggagggcgaggagggggaggaggaggagcuggagggcgacgaggagggggaggacgaggacgacgccgagaucaaccccaagguguga

SEQ ID NO: 33378 - RNA, 549 nt, Artificial Sequence
  derived and/or modified sequence opt1 from NAP1L5__Homo_sapiens__NP_715638
auggccgacagcgagaaccagggccccgccgagccgucccaggcggccgccgccgccgaggcggccgccgaggaggugauggccgagggcggggcgcagggcggggacugcgacagcgccgccggggaccccgacuccgccgccggccagauggcggaggagccccagacccccgccgagaacgccccgaagcccaagaacgacuucaucgagagccugcccaacuccgucaagugccgcgugcucgcccugaagaagcugcagaagcggugcgacaagaucgaggccaaguucgacaaggaguuccaggcgcucgagaagaaguacaacgacaucuacaagccccugcuggccaagauccaggagcucaccggcgagauggaggggugcgccuggacgcuggagggcgaggaggaggaggaggaggaguacgaggacgacgaggaggagggggaggacgaggaggaggaggaggccgccgcggaggccgccgccggcgccaagcacgacgacgcgcacgccgagaugccggacgacgccaagaaguga

SEQ ID NO: 33379 - RNA, 888 nt, Artificial Sequence
  derived and/or modified sequence opt1 from NAPA__Homo_sapiens__NP_003818
auggacaacagcggcaaggaggccgaggccauggcgcugcucgccgaggccgagcgcaaggugaagaacucccagagcuucuucuccgggcuguucggcgggagcuccaagaucgaggaggccugcgagaucuacgcccgggcggccaacauguucaagauggccaagaacuggagcgccgcgggcaacgccuucugccaggccgcccagcugcaccuccagcugcaguccaagcacgacgccgcgaccugcuucgucgacgccgggaacgccuucaagaaggccgacccccaggaggccaucaacugccugaugcgcgcgaucgagaucuacaccgacaugggccgguucacgaucgccgccaagcaccacaucagcaucgccgagaucuacgagaccgagcucguggacaucgagaaggccaucgcgcacuacgagcaguccgccgacuacuacaagggcgaggagagcaacuccagcgccaacaagugccugcugaagguggccggguacgccgcgcuccuggagcaguaccagaaggccaucgacaucuacgagcaggucggcaccaacgccauggacuccccgcugcucaaguacagcgccaaggacuacuucuucaaggcggcccugugccacuucugcaucgacaugcugaacgccaagcucgccgugcagaaguacgaggagcuguuccccgccuucuccgacagccgcgagugcaagcugaugaagaagcuccuggaggcgcacgaggagcagaacguggacuccuacaccgagagcgucaaggaguacgacuccaucagccggcuggaccaguggcucacgaccaugcugcugcgcaucaagaagaccauccagggggacgaggaggaccuccgguga

SEQ ID NO: 33380 - RNA, 1182 nt, Artificial Sequence
  derived and/or modified sequence opt1 from NAPEPLD__Homo_sapiens__XP_006725119
auggacgagaacgagagcaaccagucccugaugaccagcucccaguaccccaaggaggccgugcgcaagcggcagaacagcgcccgcaacuccggcgcgagcgacuccagccgguucucccgcaagagcuucaagcucgacuaccggcuggaggaggacgucaccaaguccaagaaggggaaggacggccgcuucgugaacccguggcccacguggaagaaccccagcauccccaacgugcugcgguggcucaucauggagaaggaccacuccagcgucccguccagcaaggaggagcuggacaaggagcugcccgugcucaagcccuacuucaucaccaaccccgaggaggccggggugcgcgaggccggccugcgggucaccuggcuggggcacgccaccgugaugguggagauggacgagcucaucuuccugacggacccgaucuucuccagccgcgccucccccagccaguacaugggccccaagcgguuccgccggagccccugcaccaucuccgagcugccgcccaucgacgcgguccucaucagccacaaccacuacgaccaccuggacuacaacuccgugaucgcccugaacgagcgcuucggcaacgagcuccggugguucgugccccuggggcugcucgacuggaugcagaagugcggcugcgagaacgucaucgagcuggacuggugggaggagaacugcgugcccgggcacgacaaggugaccuucgucuucaccccgagccagcacuggugcaagcgcacgcugauggacgacaacaaggugcucuggggcuccuggagcgugcuggggcccuggaaccgguucuucuucgccggcgacaccggcuacugccccgccuucgaggagaucgggaagcgcuucggccccuucgaccuggcggccaucccgaucggggccuacgagccccggugguucaugaaguaccagcacgucgaccccgaggaggccgugcgcauccacaccgacgugcagaccaagaaguccauggccauccacuggggcacguucgcgcucgccaacgagcacuaccuggagcccccggucaagcugaacgaggcccucgagcgguacggccugaacgccgaggacuucuucgugcugaagcacggggagagccgcuaccucaacaacgacgacgagaacuucuga

SEQ ID NO: 33381 - RNA, 939 nt, Artificial Sequence
  derived and/or modified sequence opt1 from NAPG__Homo_sapiens__NP_003817
auggccgcccagaagaucaacgagggccuggagcaccucgcgaaggccgagaaguaccugaagaccggguuccugaaguggaagcccgacuacgacagcgccgccuccgaguacggcaaggccgcgguggccuucaagaacgccaagcaguucgagcaggccaaggacgcgugccuccgcgaggccgucgcccacgagaacaaccgggcccuguuccacgccgcgaaggccuacgagcaggccgggaugaugcugaaggagaugcagaagcucccggaggccgugcagcugaucgagaaggccagcaugauguaccuggagaacggcacccccgacacggcggccauggcccucgagcgcgccgggaagcugaucgagaacguggaccccgagaaggccguccagcuguaccagcagaccgcgaacguguucgagaacgaggagcggcuccgccaggccguggagcugcugggcaaggccucccggcuccugguccgcggccggcgcuucgacgaggccgcccugagcauccagaaggagaagaacaucuacaaggagaucgagaacuacccgaccugcuacaagaagaccaucgcccaggugcucgugcaccuccaccggaacgacuacgucgcggccgagcgcugcgugcgggaguccuacagcauccccggguucaacggcuccgaggacugcgccgcgcuggagcagcugcuggagggguacgaccagcaggaccaggaccaggugagcgacgucugcaacagcccccuguucaaguacauggacaacgacuacgccaagcucggccugucccugguggugcccgggggcggcaucaagaagaagucccccgccacgccgcaggccaagcccgacggggucaccgccaccgcggccgacgaggaggaggacgaguacagcggcgggcucugcuga

SEQ ID NO: 33382 - RNA, 1578 nt, Artificial Sequence
  derived and/or modified sequence opt1 from NAPRT__Homo_sapiens__NP_001273758
auggccgccgagcaggaccccgaggcgcgcgccgccgcccggccgcugcucaccgaccuguaccaggccaccauggcgcugggcuacuggcgcgccgggcgggcccgcgacgccgcggaguucgagcuguucuuccggcgcugccccuucggcggggccuucgcccuggccgccggccugcgggacugcgugcgcuuccuccgggcguuccgccugcgggacgccgacguccaguuccuggccagcgugcucccgcccgacacggaccccgccuucuucgagcaccuccgcgcccuggacugcuccgaggugaccguccgggcgcuccccgaggggagccuggccuuccccggcgugccccugcuccagguguccggcccgcugcuggucgugcagcuccuggagacgccccugcucugccuggugagcuacgccucccuggucgccaccaacgccgcgcgccuccggcugaucgccgggcccgagaagcgccugcucgagaugggccugcggcgcgcccaggggcccgacggcgggcugaccgccagcaccuacuccuaccucggcggcuucgacagcuccagcaacgugcuggccgggcagcugcggggcgugccggucgcggggacccucgcccacuccuucgugaccagcuucuccggcagcgaggugccgcccgaccccaugcuggcccccgccgcgggcgaggggcccggcgucgaccuggccgccaaggcccagguguggcucgagcaggucugcgcccaccuggggcugggcguccaggagccccaccccggggagcgcgcggccuucguggccuacgcccucgccuucccgcgggcguuccagggccugcuggacacguacuccguguggcgcagcggccuccccaacuuccuggccgucgcccuggcccucggggagcugggcuaccgcgccgugggggugcggcuggacuccggcgaccuccugcagcaggcgcaggagauccgcaaggucuuccgggccgccgccgcgcaguuccaggugcccuggcuggagagcguccugaucgugguguccaacaacaucgacgaggaggcccucgcccgccuggcccaggaggggagcgaggucaacgugaucggcaucggcaccagcguggugaccugcccccagcagccgucccucgggggcguguacaagcugguggccgucgggggccagccccggaugaagcugaccgaggaccccgagaagcagacgcugcccgggagcaaggcggccuuccgccuccugggcuccgacggcagcccgcugauggacaugcuccagcuggccgaggagcccgugccccaggccgggcaggagcugcggguguggccgcccggcgcccaggagcccugcaccguccgccccgcgcagcucugcgagccgcugcccucccuggccgagagccgggcccucgcccagcugucccugagccgccucucccccgagcaccggcgccugcggagccccgcccaguaccagguggugcuguccgagcgccuccaggcgcuggucaacagccugugcgccgggcaguccccguga

SEQ ID NO: 33383 - RNA, 1263 nt, Artificial Sequence
  derived and/or modified sequence opt1 from NAPSA__Homo_sapiens__XP_011525842
augagccccccgccccugcuccagccccugcugcuccugcugccccuccugaacguggagccguccggcgccacccugauccgcaucccccuccaccggguccagcccgggcgccggauccugaaccugcuccgcggcuggcgggagcccgccgagcugccgaagcugggggcgcccagccccggcgacaagcccaucuucgugccgcucuccaacuaccgcgacgugcaguacuucggggagaucggccugggcacccccccccagaacuucacggucgccuucgacaccgggagcuccaaccugugggugcccagccggcgcugccacuucuucuccgugccgugcuggcuccaccaccgguucgaccccaaggccagcuccagcuuccaggccaacggcaccaaguucgccauccaguacgggaccggccgcgucgacgggauccuguccgaggacaagcugacgaucggcggcaucaagggggcgagcgugaucuucggcgaggcccucugggagcccucccugguguucgccuucgcccacuucgacgggauccugggccucggcuuccccauccugagcgucgagggggugcggccgcccauggacgugcuggucgagcagggccuccuggacaagcccguguucuccuucuaccugaaccgcgaccccgaggagccggacgggggcgagcucgugcuggggggcagcgaccccgcgcacuacauccccccccugaccuucgucccggugaccgugcccgccuacuggcagauccacauggagcgggucaaggugggccccgggcucacccugugcgccaagggcugcgccgccauccuggacacggggaccucccucaucaccggcccgaccgaggagauccgcgcgcugcacgccgccaucgggggcaucccccugcucgccggcgaguacaucauccugugcagcgagauccccaagcugcccgccguguccuuccuccuggggggcgucugguucaaccugacggcgcacgacuacgugauccagaccacccggaacggggugcgccucugccugagcggcuuccaggcccuggacgucccgccccccgccgggcccuucuggauccucggcgacguguuccugggcaccuacgucgccguguucgaccggggggacaugaagagcuccgcccgcgugggccuggcgcgggcccgcacgcggggggccgaccugggcuggggcgagaccgcccaggcccaguucccgggguga

SEQ ID NO: 33384 - RNA, 1125 nt, Artificial Sequence
  derived and/or modified sequence opt1 from NARFL__Homo_sapiens__NP_001291728
auggccgcccccagccagcagcgccugguggucguguccgugagcccgcagucccgggcgagccucgccgcccgcuuccagcugaaccccaccgacaccgcccggaagcugacguccuucuucaagaagaucggcguccacuucguguucgacaccgccuucagccgccacuucucccuccuggagagccagcgggaguucgugcgccgguuccgcgggcaggcggacugccggcaggcccugccccuccuggccuccgccugccccggcuggaucugcuacgcggagaagacccacgggagcuucauccugccgcacaucuccaccgcccgcagcccccagcaggucaugggcucccucgugaaggacuucuucgcccagcagcagcaccugacgcccgacaagaucuaccacgugaccgucaugcccugcuacgacaagaagcuggaggccagccggccggacuucuucaaccaggagcaccagacccgcgacguggacugcgugcucaccacgggggaggucuuccggcugcuggaggaggagggcgugucccuccccgaccuggagcccgcgccccuggacagccucugcuccggcgccagcgccgaggagccgaccucccaccgcgggggcgggagcggcggguaccuggagcacguguuccggcacgccgcccgcgagcuguucggcauccacgucgccgaggugaccuacaagccccuccggaacaaggacuuccaggaggugacccuggagaaggagggccagguccugcuccacuucgcgauggccuacggguuccgcaacauccagaaccuggugcagcggcugaagcgcggccggugccccuaccacuacguggaggucauggccugccccagcgggugccucaacggcggcgggcagcugcaggccccggaccgccccucccgcgagcugcuccagcacguggagcggcuguacggcauggugcgcgccgaggcgcccgaggacgcccccgggguccaggagcuguacacgcacuggcuccagggcaccgacagcgagugcgccgggcggcugcugcacacccaguaccacgccguggagaaggccuccaccggccucggcauccgcugguga

SEQ ID NO: 33385 - RNA, 597 nt, Artificial Sequence
  derived and/or modified sequence opt1 from NARR__Homo_sapiens__NP_001243210
auggugggccagccccagccgcgcgacgacgucgggagcccccggccccgcgugaucgugggcaccauccggccccgcgucaucguggggaccauccggccgcgcgugaucgucggcuccgcccgggcccggcccccgcccgacgggacgccccgcccccagcuggcggccgaggagagcccccgcccccgggugaucuucggcaccccgcgcgcccgggugauccucggcagcccccgcccccgggucaucguguccucccccuggccggccguggucguggccagcccccgcccccggacccccgugggguccccguggccccgcgucguggugggcacgccccggccccgcgucaucguggggagcccgcgggcgcgcguggccgacgccgaccccgccuccgcgcccagccagggcgcccugcaggggcgccggcaggacgagcacuccggcacccgcgccgagggcagccggcccgggggcgccgccccgguccccgaggagggcgggcgcuucgcgcgggcccagcgccugcccccgccccggcaccuccgccugcccggcgcccccgaccggcaccgcgggcagaucuga

SEQ ID NO: 33386 - RNA, 1647 nt, Artificial Sequence
  derived and/or modified sequence opt1 from NARS__Homo_sapiens__NP_004530
auggugcuggccgagcucuacgucagcgaccgcgagggcuccgacgccaccggggacggcaccaaggagaagcccuucaagacggggcugaaggcgcugaugaccgugggcaaggagccguuccccaccaucuacguggacagccagaaggagaacgagcgguggaacgucaucuccaagagccagcucaagaacaucaagaagauguggcaccgcgagcagaugaaguccgagagccgggagaagaaggaggccgaggacucccugcgccgggagaagaaccuggaggaggccaagaagaucaccaucaagaacgaccccagccuccccgagccgaagugcgugaagaucggggcccuggagggcuaccgcggccagcgggugaaggucuucgggugggugcaccgccugcggcgccagggcaagaaccucauguuccuggugcugcgggacgggacgggcuaccuccagugcguccuggccgacgagcugugccagugcuacaacggggugcuccuguccaccgagagcuccguggcggucuacggcaugcugaaccucacccccaagggcaagcaggcccccgggggccacgagcugagcugcgacuucugggagcugaucgggcucgcccccgccggcggcgcggacaaccugaucaacgaggaguccgacguggacgugcagcugaacaaccgccacaugaugauccgcggggagaacaugagcaagauccucaaggcccgguccauggucacccggugcuuccgcgaccacuucuucgaccggggcuacuacgaggugacgccgcccacccuggugcagacccaggucgagggcggggccacccuguucaagcucgacuacuucggggaggaggccuuccugacgcagagcucccagcuguaccucgagaccugccugcccgcccugggcgacguguucugcaucgcgcagagcuaccgcgccgagcagucccggacccgccggcaccucgccgaguacacccacguggaggccgagugccccuuccugacguucgacgaccugcucaaccgccuggaggaccuggucugcgacgugguggaccgcauccucaagagcccggccggcagcaucguccacgagcugaaccccaacuuccagccgcccaagcggcccuucaagcgcaugaacuacuccgacgcgaucguguggcugaaggagcacgacgucaagaaggaggacgggaccuucuacgaguucggcgaggacauccccgaggcccccgagcggcucaugaccgacaccaucaacgagcccauccugcugugccgcuucccgguggagaucaagagcuucuacaugcagcggugccccgaggacucccgccucacggagagcguggacguccugaugcccaacgugggggagaucgugggcggguccaugcggaucuucgacagcgaggagauccuggccggcuacaagcgcgagggcaucgaccccaccccguacuacugguacaccgaccagcggaaguacgggaccugcccccacggcggguacggccucgggcuggagcgcuuccugacguggauccugaaccgguaccacauccgcgacgucugccucuacccccgguucgugcagcgcugcacccccuga

SEQ ID NO: 33387 - RNA, 3078 nt, Artificial Sequence
  derived and/or modified sequence opt1 from NAT10__Homo_sapiens__XP_011518499
augcaccgcaagaagguggacaaccggauccgcauccugaucgagaacggcgucgccgagcggcagcgcagccucuucgugguggucggggaccggggcaaggaccagguggugauccugcaccacaugcuguccaaggccaccgucaaggcgcgccccagcgugcucuggugcuacaagaaggagcugggguucuccagccaccggaagaagcgcaugcggcagcugcagaagaagaucaagaacggcacccucaacaucaagcaggacgacccguucgagcuguucaucgccgccaccaacauccgcuacugcuacuacaacgagacccacaagauccuggggaacaccuucggcaugugcgugcuccaggacuucgaggcccugacccccaaccugcucgcccggacggucgagaccguggagggcgggggccugguggucauccugcuccgcaccaugaacucccugaagcagcuguacaccgugacgauggacgugcacagccgguaccgcaccgaggcgcaccaggacgucguggggcgguucaacgagcgcuucauccucucccuggccagcugcaagaagugccuggugaucgacgaccagcucaacauccugcccaucuccagccacgucgccaccauggaggcccugcccccgcagacccccgacgagucccucggccccagcgaccuggagcugcgggagcucaaggagucccugcaggacacgcagcccgugggggugcuggucgacugcugcaagacccucgaccaggcgaaggccgugcugaaguucaucgagggcaucagcgagaagacccugcgcuccaccguggcccucacggccgcccggggccgcggcaagagcgcggcccuggggcuggccaucgccggggccgucgcguucggcuacuccaacaucuucgugaccagcccgucccccgacaaccuccacacccuguucgaguucgucuucaagggcuucgacgcccugcaguaccaggagcaccucgacuacgagaucauccagagccugaaccccgaguucaacaaggccgugauccgggugaacgucuuccgcgagcaccgccagaccauccaguacauccaccccgccgacgccgugaagcuggggcaggcggagcucguggucaucgacgaggccgccgccaucccgcugccccuggucaagagccuccugggccccuaccugguguucauggccuccacgaucaacggguacgagggcaccgggcggagccucucccugaagcugauccagcagcugcgccagcagagcgcgcagucccaggugagcaccaccgccgagaacaagacgaccaccaccgcccggcucgccuccgcgcgcacgcuguacgaggugagccugcaggaguccauccgguacgcccccggcgacgccguggagaaguggcucaacgaccugcugugccucgacugccugaacaucacccgcaucgucagcggcugcccgcugcccgaggccugcgagcucuacuacgugaaccgggacacccuguucugcuaccacaaggccuccgagguguuccugcagcgccucauggcgcuguacgucgccagccacuacaagaacucccccaacgaccugcagaugcucagcgacgcccccgcccaccaccuguucugccugcucccgcccgugccgcccacccagaacgcccugcccgaggugcuggcggucauccaggugugccucgagggggagaucucccggcagagcauccugaacucccugagccgcggcaagaaggccuccggggaccucauccccuggacggugagcgagcaguuccaggaccccgacuucggcgggcugagcggcggccgggucgugcgcaucgccgugcaccccgacuaccaggggaugggcuacgggucccgggcccugcagcuccugcagauguacuacgagggccgcuucccgugccuggaggagaagguccucgagacgccccaggagauccacaccgugagcuccgaggccgugagccugcuggaggaggucaucacgccccggaaggaccucccgccccugcugcucaagcugaacgagcgccccgcggagcggcuggacuaccucgggguguccuacggccugacgccccgccugcucaaguucuggaagcgggccggcuucgugccggucuaccugcgccagacccccaacgaccugaccggggagcacagcugcaucaugcucaagacccugaccgacgaggacgaggccgaccagggcggguggcuggccgcguucuggaaggacuuccgccggcgcuuccucgcccugcuguccuaccaguucagcaccuucucccccagccucgcccugaacaucauccagaaccggaacaugggcaagcccgcccagccggcccugucccgcgaggagcucgaggcgcuguuccugcccuacgaccucaagcggcuggagauguacagccgcaacaugguggacuaccaccugaucauggacaugauccccgccaucucccggaucuacuuccucaaccagcugggcgaccuggcccucagcgccgcccaguccgcgcugcugcucgggaucggccugcagcacaagagcguggaccagcuggagaaggagaucgagcuccccuccgggcagcugaugggccuguucaaccgcaucauccggaaggucgugaagcuguucaacgaggugcaggagaaggccaucgaggagcagauggucgccgccaaggacguggugauggagccgaccaugaagacccucagcgacgaccuggacgaggccgcgaaggaguuccaggagaagcacaagaaggaggucgggaagcucaagagcauggaccuguccgaguacaucauccgcggcgacgacgaggaguggaacgaggugcugaacaaggccggccccaacgccagcaucaucucccucaagagcgacaagaagcggaagcuggaggccaagcaggagcccaagcaguccaagaagcugaagaaccgcgagaccaagaacaagaaggacaugaagcucaagcggaagaaguga

SEQ ID NO: 33388 - RNA, 621 nt, Artificial Sequence
  derived and/or modified sequence opt1 from NAT14__Homo_sapiens__NP_065111
auggcccccagccaccuguccgugcgcgagaugcgggaggacgagaagccgcucguccuggagaugcugaaggccggcgugaaggacaccgagaaccgcguggcgcuccacgcccugacccggccgcccgcccugcuccugcuggccgccgcgagcuccgggcuccgcuucguccuggccagcuucgcccuggcccuccugcugcccguguuccucgcgguggccgccgucaagcugggccugcgggcccgcugggggucccugcccccgcccggcgggcucggcggccccuggguggccgugcgggggagcggcgacgucugcggggugcuggcgcucgcccccggcacgaacgccggggacggcgcccgcgugacccggcuguccgucagccgcuggcaccggcgccggggcguggggcgccggcugcucgccuucgcggaggcccgcgcccgggccugggccggcgggaugggcgagccccgcgcgcggcuggugguccccguggccguggccgccuggggcgucgggggcaugcuggaggggugcggcuaccaggccgagggcggguggggcugccucggguacacccuggugcgcgaguucuccaaggaccuguga

SEQ ID NO: 33389 - RNA, 873 nt, Artificial Sequence
  derived and/or modified sequence opt1 from NAT1__Homo_sapiens__NP_001153646
auggacaucgaggccuaccuggagcgcaucggcuacaagaagucccggaacaagcucgaccuggagacccugaccgacauccuccagcaccagauccgcgccgugcccuucgagaaccugaacauccacugcggggacgcgauggaccugggccucgaggccaucuucgaccaggucgugcggcgcaaccgcgggggcuggugccugcaggucaaccaccuccuguacugggcccugacgaccaucggguucgagaccaccaugcugggcggcuacguguacagcacgccggccaagaaguacagcaccgggaugauccaccuccugcuccaggugaccaucgacggccggaacuacaucguggacgccggguucggccgguccuaccagauguggcagccccuggagcugaucagcgggaaggaccagccccagguccccugcguguuccgccugaccgaggagaacggcuucugguaccucgaccagauccggcgcgagcaguacaucccgaacgaggaguuccugcacuccgaccugcucgaggacagcaaguaccggaagaucuacuccuucacgcugaagccccgcaccaucgaggacuucgagagcaugaacaccuaccugcagaccucccccagcuccguguucacgagcaaguccuucugcagccuccagacccccgacggcguccacugccuggugggguucacccugacccaccggcgcuucaacuacaaggacaacacggaccucaucgaguucaagacccuguccgaggaggagaucgagaaggugcugaagaacaucuucaacaucagccuccagcggaagcuggucccgaagcacggcgaccgcuucuucaccaucuga

SEQ ID NO: 33390 - RNA, 873 nt, Artificial Sequence
  derived and/or modified sequence opt1 from NAT2__Homo_sapiens__XP_011542660
auggacaucgaggccuacuucgagcgcaucggcuacaagaacagccggaacaagcuggaccucgagacccugaccgacauccuggagcaccagauccgcgccgugcccuucgagaaccucaacaugcacugcgggcaggcgauggagcugggccuggaggccaucuucgaccacaucguccggcgcaaccgcgggggcuggugccuccaggugaaccagcugcuguacugggcccucacgaccaucggguuccagaccaccaugcugggcggcuacuucuacaucccgcccgugaacaaguacuccacggggaugguccaccuccugcuccaggugaccaucgacggccggaacuacaucguggacgccgggagcggcuccagcucccagauguggcagccccuggagcugaucagcgggaaggaccagccccaggucccgugcaucuucugccugaccgaggagcggggcaucugguaccuggaccagauccgccgggagcaguacaucaccaacaaggaguuccucaacucccaccuccugcccaagaagaagcaccagaagaucuaccuguucacgcuggagccccgcaccaucgaggacuucgagagcaugaacaccuaccugcagaccucccccacgagcuccuucaucaccaccagcuucugcucccuccagaccccggagggcguguacugccuggugggguucauccugacguaccggaaguucaacuacaaggacaacaccgaccucgucgaguucaagacccugaccgaggaggagguggaggaggugcugcgcaacaucuucaagaucagccucggccggaaccugguccccaagcccggggacggcucccugacgaucuga

SEQ ID NO: 33391 - RNA, 861 nt, Artificial Sequence
  derived and/or modified sequence opt1 from NAT6__Homo_sapiens__NP_001186947
auggagcugauccucagcaccucccccgccgagcugacccuggaccccgccugccagcccaagcucccccuggacagcacgugccagcccgagaugaccuucaacccgggccccaccgagcugacccucgaccccgagcaccagcccgaggagacgccggcccccucccuggccgagcugacccucgagcccgugcaccgccggcccgagcugcuggacgccugcgccgaccucaucaacgaccaguggccgcgcagccggaccucccgccugcacagccuggggcaguccagcgacgccuucccccucugccugaugcugcucagcccccaccccacccuggaggcggccccggucguggugggccacgcccggcugucccgcguccucaaccagccccagucccugcugguggagacgguggucguggcccgggcgcuccgcgggcggggcuucgggcgccggcugauggagggccuggagguguucgcccgcgcccggggcuuccgcaagcuccaccugaccacccacgaccagguccacuucuacacccaccugggguaccagcucggcgagcccgugcaggggcugguguucacgagccggcgccugcccgccacccuccugaacgccuucccgaccgcgcccagcccccggcccccgcgcaaggcccccaaccugaccgcccaggccgcgccccggggccccaaggggccgccccugcccccgcccccgccccuccccgagugccugacgaucuccccgcccguccccuccggcccgcccagcaagucccuccuggagacccaguaccagaacgugcgcggccggcccaucuucuggauggagaaggacaucuga

SEQ ID NO: 33392 - RNA, 684 nt, Artificial Sequence
  derived and/or modified sequence opt1 from NAT8B__Homo_sapiens__NP_057431
auggcccccuaccacauccgcaaguaccaggagagcgaccggaaguccguggucggccugcucagccgcgggauggccgagcacgcgccggccaccuuccggcgccugcugaagcucccccggacccugauccugcuccugggcggggcccuggcccuccugcugguguccggcagcuggauccucgcccugguguucucccugagccuccugcccgcgcugugguuccucgccaagaagcccuggacgcgcuacgucgacaucgcccugcggaccgacauguccgacaucaccaagagcuaccuguccgagugcgggagcugcuucugggugggcgaguccgaggagaagguggucggcaccgugggggcccucccgguggacgaccccacgcugcgcgagaagcggcugcagcuguuccaccugagcgucgacaacgagcaccgcggccaggggaucgcgaaggcccuggugcggaccgugcuccaguucgcccgcgaccagggcuacuccgaggucgugcuggacaccagcaacauccagcuguccgccauggggcucuaccagagccugggcuucaagaagaccggccaguccuucuuccacgugugggcccggcuggucgaccuccacacggugcacuucaucuaccaccuccccagcgcgcaggccgggcgccuguga

SEQ ID NO: 33393 - RNA, 684 nt, Artificial Sequence
  derived and/or modified sequence opt1 from NAT8__Homo_sapiens__NP_003951
auggcccccugccacauccgcaaguaccaggagagcgaccggcaguggguggucggccugcucucccgcgggauggccgagcacgcgccggccaccuuccggcagcugcugaagcucccccgcacccugauccugcuccugggcgggccccuggcccuccugcuggugagcggcuccuggcuccuggcccugguguucagcaucucccucuuccccgcccugugguuccuggcgaagaagccguggacggaguacgucgacaugacccucugcaccgacaugagcgacaucaccaaguccuaccugagcgagcggggguccugcuucuggguggccgagagcgaggagaagguggucggcauggugggcgcccugcccguggacgaccccacgcuccgcgagaagcggcugcagcuguuccaccucuucgucgacuccgagcaccgccggcaggggaucgccaaggcgcuggugcgcaccgugcugcaguucgcccgggaccagggcuacagcgaggucauccucgacaccgggaccauccagcuguccgccauggcccuguaccagagcaugggcuucaagaagacggggcaguccuucuucugcgugugggcccgccucguggcgcugcacaccguccacuucaucuaccaccuccccagcuccaaggugggcagccuguga

SEQ ID NO: 33394 - RNA, 909 nt, Artificial Sequence
  derived and/or modified sequence opt1 from NAT8L__Homo_sapiens__NP_848652
augcacugcgggcccccggacauggugugcgagaccaagaucgucgccgccgaggaccacgaggcgcugcccggcgccaagaaggacgcccuccuggccgccgcgggcgccauguggccgccccugcccgccgcccccgggcccgcggccgcgcccccggcgcccccgcccgcccccguggcccagccccacggcggggccggcggcgccgggccgcccggcgggcgcggcgugugcauccgggaguuccgcgccgccgagcaggaggccgcccggcgcaucuucuacgacgggaucauggagcggauccccaacaccgccuuccgcggccuccggcagcacccccgcgcccagcugcuguacgcccuccuggcggcccugugcuucgccgucagccggucccuccugcugacgugccucgugcccgccgcccugcugggccuccgcuacuacuacagccggaaggugauccgcgcguaccuggagugcgcccugcacaccgacauggccgacaucgagcaguacuacaugaagcccccgggguccugcuucugggucgccgugcucgacggcaacguggucgggaucguggcggcccgggcccacgaggaggacaacaccguggagcugcugcgcaugagcgucgacucccgguuccgcggcaagggcaucgccaaggcccucgggcggaaggugcuggaguucgcggugguccacaacuacagcgccguggugcugggcaccacggccgucaagguggccgcccacaagcucuacgagucccugggguuccgccacaugggcgcgagcgaccacuacgugcugcccgggaugacccucucccuggccgagcggcuguucuuccagguccgcuaccaccgguaccgccuccagcugcgcgaggaguga

SEQ ID NO: 33395 - RNA, 4452 nt, Artificial Sequence
  derived and/or modified sequence opt1 from NAV1__Homo_sapiens__NP_001161210
augcugcaccucccccugccgcgcagcggccggaccgugaacuucccccgcuccugggacgagagcuccagcaucuccagcgggcuguccgacgccagcgacaaccucuccagcgaggaguucaacgccuccagcucccugaacagccugcccuccacccccacggcgagccggcgcaacuccaccaucguccuccggaccgacagcgagaagcgcucccuggccgagagcggccugagcugguucuccgagagcgaggagaaggccccgaagaagcucgaguacgacuccgggagccugaagauggagcccggcaccuccaaguggcggcgcgagcggcccgagagcugcgacgacuccagcaaggggggcgagcugaagaagcccaucucccucggccacccggggagccugaagaagggcaagacgccccccguggccgugaccucccccaucacccacaccgcccagagcgcgcugaaggucgccgggaagccggagggcaaggccacggacaaggggaagcucgccgugaagaacaccggccugcagcgcuccagcuccgacgcgggccgggaccgccugagcgacgccaagaagccccccuccgggaucgcccggcccagcaccuccggcagcuucggguacaagaagccgccccccgccaccggcacggccaccgugaugcagaccggcgggagcgcgacccucuccaagauccagaagagcuccggcauccccgucaagccggugaacgggcgcaagacgagccuggacguguccaacagcgccgagcccggcuuccuggcccccggggcccgguccaacauccaguaccgcagccucccccggccggccaaguccagcuccaugagcgucaccggcggccgcgggggcccccggcccguguccagcuccaucgaccccagccugcuguccaccaagcaggggggccucaccccgagccgccugaaggagcccacgaagguggcgagcgggcggaccacccccgccccggucaaccagaccgaccgcgagaaggagaaggccaaggccaaggccguggcgcuggacuccgacaacaucagccucaaguccaucggcagccccgaguccacgcccaagaaccaggccagccaccccaccgccaccaagcuggccgagcugccgcccaccccccuccgcgccacggcgaaguccuucgugaagcccccgagccuggccaaccuggacaaggucaacuccaacagccucgaccugcccuccagcuccgacaccacccacgccagcaaggugcccgaccugcacgccaccuccagcgcguccggcgggccccucccgagcugcuucacgcccucccccgcccccauccugaacaucaacagcgccagcuucucccagggccuggagcucaugagcggguucuccgugccgaaggagacccggauguaccccaagcugagcggccugcaccgcuccauggagagccuccagaugcccaugucccugcccagcgccuucccguccagcacccccguccccacccccccggccccccccgcggccccgacggaggaggagaccgaggagcugaccugguccgggagcccccgggccggccagcucgacuccaaccagcgcgaccggaacacccugcccaagaagggccugcgcuaccagcuccagagccaggaggagaccaaggagcggcgccacucccacacgaucgggggccugcccgagagcgacgaccaguccgagcugccgagcccccccgcccugcccaugucccucagcgccaaggggcagcugaccaacaucgugagcccgaccgcggccaccacgccccggaucacccgcuccaacagcauccccacccacgaggccgccuucgagcuguacuccggcagccagaugggcuccacccucagccuggccgagcggcccaaggggaugauccgcuccggcagcuuccgggacccgacggacgacgugcacggguccguccugagccucgcguccagcgccuccagcaccuacuccagcgccgaggagcgcaugcaguccgagcagauccggaagcugcgccgggagcuggagagcucccaggagaagguggccacccucaccagccagcugagcgcgaacgccaaccugguggccgccuucgagcagucccucgucaacaugacgagccgccugcggcaccuggccgagaccgcggaggagaaggacaccgagcuccuggaccugcgcgagaccaucgacuuccucaagaagaagaacuccgaggcccaggccgugauccagggcgcccugaacgccagcgagacgacccccaaggagcugcgcaucaagcggcagaacuccagcgacuccaucagcucccucaacagcaucaccucccacagcuccaucgggagcuccaaggacgcggacgccaagaagaagaagaagaagagcuggcugcgcuccagcuucaacaaggccuucuccaucaagaagggccccaagagcgccagcuccuacagcgacaucgaggagaucgccacccccgacuccagcgcgccguccagccccaagcugcagcacggcuccacggagaccgccagccccuccaucaagagcuccaccagcuccagcgucgggaccgacgugacggagggccccgcccacccggccccccacacccggcucuuccacgcgaacgaggaggaggagcccgagaagaaggagguguccgagcugcgcagcgagcugugggagaaggagaugaagcucaccgacauccggcuggaggcccugaacuccgcccaccagcucgaccagcugcgcgagaccaugcacaacaugcagcuggaggucgaccuccugaaggccgagaacgaccggcugaagguggcccccgggccgagcuccggcagcacgcccgggcaggugcccggcagcuccgcgcucagcuccccccgccggagccugggccuggcccucacccacuccuucgggccgagccuggccgacaccgaccugucccccauggacggcaucagcaccugcgggcccaaggaggaggucacgcuccgcguggugguccggaugccgccccagcacaucaucaagggcgaccugaagcagcaggaguucuuccuggggugcuccaaggugagcggcaagguggacuggaagaugcucgacgaggccgucuuccagguguucaaggacuacaucuccaagauggaccccgccagcacccugggccuguccaccgagagcauccacggguacuccaucagccacgugaagcgcguccucgacgcggagcccccggagaugccccccugccggcgcggcgugaacaacaucuccgugagccugaaggggcugaaggagaagugcgucgacagccucguguucgagacccugauccccaagccgaugaugcagcacuacaucucccugcuccugaagcaccggcgccuggugcucagcggccccuccgggacgggcaagaccuaccugaccaaccggcuggccgaguaccucgucgagcgcagcggccgggaggugaccgaggggaucguguccaccuucaacaugcaccagcagagcugcaaggaccugcagcuguaccucuccaaccuggccaaccagaucgaccgcgagacgggcaucggggacgucccccuggugauccuccuggacgaccugagcgaggccggcuccaucagcgagcucgugaacggcgcccugaccugcaaguaccacaagugccccuacaucaucgggaccaccaaccagccggucaagaugacgcccaaccacggccugcaccucuccuuccggaugcugaccuucagcaacaacguggagcccgcgaacggguuccuggugcgcuaccuccgccggaagcuggucgaguccgacagcgacaucaacgccaacaaggaggagcugcuccgcgugcuggacugggugcccaagcugugguaccaccuccacaccuuccuggagaagcacuccaccagcgacuuccugaucggcccgugcuucuuccucuccugccccaucgggaucgaggacuuccggacgugguucaucgaccuguggaacaacagcaucauccccuaccugcaggagggcgccaaggacggcaucaagguccacgggcagaaggccgccugggaggaccccguggagugggugcgcgacacccucccguggcccuccgcgcagcaggaccagagcaagcuguaccaccugccccccccgaccgucggcccccacagcaucgccuccccccccgaggaccggaccgugaaggacagcacgccguccagccucgacuccgacccccugauggccaugcugcucaagcugcaggaggccgcgaacuacaucgagagccccgaccgcgagaccauccuggacccgaaccugcaggccacccucuga

SEQ ID NO: 33396 - RNA, 7098 nt, Artificial Sequence
  derived and/or modified sequence opt1 from NAV2__Homo_sapiens__NP_001104488
auggagagcguguccgagagcucccagcagcagaagcggaagcccgugauccacggccuggaggaccagaagcggaucuacaccgacugggccaaccacuaccucgccaagagcgggcacaagcgccugauccgggaccugcagcaggacgugaccgacggcgugcuccuggcccagaucauccaggugguggccaacgagaagaucgaggacaucaacgggugccccaagaaccgcucccagaugaucgagaacaucgacgccugccugaacuuccucgccgccaagggcaucaacauccaggggcugagcgcggaggagauccggaacggcaaccugaaggccauccucggccuguucuucucccugagccgcuacaagcagcagcagcagcagccccagaagcagcaccucuccagcccccugccgcccgccgugucccaggucgccggggcgcccagccagugccaggccggcacgccccagcagcagguccccgugacgccccaggcccccugccagccccaccagcccgccccgcaccagcaguccaaggcccaggcggagaugcagagccggcugcccgggcccaccgcccgcgucuccgccgccggcagcgaggccaagacccgcgggggcuccaccaccgcgaacaaccgccggagccaguccuucaacaacuacgacaagagcaagcccgugaccagcccgccgccgccgcccuccagccacgagaaggagccccucgccuccagcgccuccagccaccccggcauguccgacaacgcccccgccagccuggaguccgggagcuccagcacccccaccaacugcuccaccagcuccgcgaucccccagcccggcgccgccaccaagcccuggcgcagcaagucccugagcgugaagcacuccgccaccgucagcaugcucagcgugaagccgcccgggcccgaggccccgcggcccacgcccgaggcgaugaagcccgccccgaacaaccagaaguccaugcuggagaagcugaagcuguucaacagcaagggcggcuccaaggccggggagggccccgggagccgcgacaccuccugcgagcggcuggagacccugcccagcuucgaggaguccgaggagcucgaggccgcgagccgcaugcugaccacggugggccccgccuccagcuccccgaagaucgcccugaaggggaucgcccagcggaccuucagccgcgcccucaccaacaagaaguccagccugaagggcaacgagaaggagaaggagaagcagcagcgggagaaggacaaggagaaguccaaggaccuggcgaagcgcgccagcgucaccgagcggcucgaccugaaggaggagcccaaggaggaccccuccggcgccgccgugcccgagaugccgaagaaguccagcaagaucgccuccuucauccccaagggcgggaagcugaacagcgcgaagaaggagcccauggcccccucccacagcgggaucccgaagcccggcaugaaguccaugcccgggaagucccccuccgccccggcccccagcaaggagggcgagcgcucccgcagcggcaagcucuccagcgggcugccccagcagaagccccagcuggacggccggcacuccagcuccagcuccagccucgccuccagcgaggggaagggccccgggggcacgacccugaaccacagcaucuccagccagaccguguccggcagcgucgggaccacgcagaccaccggcuccaacaccgugagcgugcagcugccccagccccagcagcaguacaaccacccgaacacggcgaccgucgcccccuuccucuaccgcucccagaccgacaccgaggggaacgugacggccgagagcuccagcaccggcguguccgucgagcccagccacuucaccaagaccggccagcccgcccuggaggagcugacgggggaggacccggaggcgcggcgccuccggaccgugaagaacaucgccgaccugcgccagaaccuggaggagaccauguccagccuccggggcacccaggucacccacuccacgcuggagaccaccuucgacaccaacgugacgaccgagaugagcgggcgcuccauccugagccucaccggccggcccacgccccuguccuggcgccuggggcagagcagcccccggcugcaggccggcgacgccccguccaugggcaacggguacccgccccgcgccaacgcgagccgguucaucaacaccgaguccggccgcuacguguacagcgcgccccuccggcgccagcuggccucccgggggagcuccgucugccacguggacgugagcgacaaggccggcgacgagauggaccuggaggggaucuccauggacgccccgggcuacaugagcgacggcgacguccucuccaagaacauccgcaccgacgacaucaccagcggguacaugaccgacggcgggcugggccuguacacgcggcgccucaaccgccugcccgacgggauggcgguggugcgggagacccugcagcgcaacaccucccucggccugggcgacgccgacagcugggacgacuccagcuccgucagcuccgggaucagcgacaccaucgacaaccugagcacggacgacaucaacaccuccagcuccaucagcuccuacgccaacacccccgccagcucccggaagaaccucgacgugcagaccgacgccgagaagcacagccagguggagcgcaacucccuguggagcggcgacgacgucaagaaguccgacgggggcagcgacuccgggaucaagauggagcccggcagcaaguggcggcgcaacccguccgacgugagcgacgaguccgacaagagcacguccggcaagaagaaccccgugaucagccagaccgggagcuggcggcgcggcaugaccgcgcaggucgggaucaccaugccccggacgaagcccuccgccccggccggcgcccugaagacccccggcaccgggaagaccgacgacgcgaaggugagcgagaagggccgccucucccccaaggccagccaggugaagcggucccccagcgacgccgggcgcuccagcggcgacgaguccaagaagccgcugcccagcuccagccggacgcccaccgccaacgccaacuccuucggguucaagaagcagagcggcuccgcggccggccuggccaugaucaccgccagcggggucaccgugacgucccgcagcgccacccucggcaagauccccaaguccagcgcgcuggugagccgguccgccgggcgcaagagcuccauggacggcgcccagaaccaggacgacggguaccuggcccucagcucccggaccaaccugcaguaccgcagccugccgcggcccuccaagagcaacucccgcaacggcgccggcaaccggagcuccaccagcuccaucgacagcaacaucuccagcaaguccgcggggcuccccgucccgaagcugcgcgagcccagcaagacggcccugggcagcucccuccccgggcuggugaaccagaccgacaaggagaagggcaucagcuccgacaacgagagcguggccuccugcaacagcgucaaggugaaccccgccgcccagccgguguccagccccgcgcagaccucccugcagcccggggccaaguaccccgacgucgccagcccgacccuccgccggcuguucggcggcaagcccaccaagcagguccccaucgccacggcggagaacaugaagaacuccguggucaucagcaacccccacgccaccaugacccagcaggggaaccuggacuccccgagcggcuccggggugcucagcuccggcagcuccagcccccuguacagcaagaacguggaccugaaccagagcccccucgccagcucccccagcuccgcccacagcgccccguccaacagccugaccuggggcacgaacgcguccagcuccagcgccgucuccaaggacgggcugggcuuccagagcguguccagccuccacaccuccugcgagagcaucgacaucucccugagcagcgggggcgugcccucccacaacagcuccaccgggcugaucgccagcuccaaggacgacagccucacccccuucguccgcacgaacuccgugaagaccacccugagcgagagcccccugagcuccccggccgccagccccaaguucugccgguccacccucccccgcaagcaggacagcgacccccaccuggaccggaacacgcugccgaagaagggccuccgcuacacccccaccucccagcugcggacccaggaggacgcgaaggaguggcugcgcagccacuccgccggcgggcuccaggacacggccgccaacagccccuucuccagcggcagcuccgugaccagccccuccgggacccgguucaacuucagccagcuggccuccccgaccacggucacccagaugagccuguccaaccccaccaugcuccgcacccacagccuguccaacgcggacggccaguacgaccccuacacggacagccgguuccgcaacuccagcaugucccuggacgagaagucccggaccaugagccgcagcggguccuuccgggacggcuucgaggaggugcacggcagcucccucagccuggugagcuccaccagcuccgucuacagcaccccggaggagaagugccaguccgagauccgcaagcugcggcgcgagcucgacgccagccaggagaagguguccgcccugacgacccagcugaccgccaacgcgcaccucguggccgccuucgagcagagccuggggaacaugaccauccggcugcagucccucacgaugaccgccgagcagaaggacagcgagcugaacgagcugcgcaagaccaucgagcuccugaagaagcagaacgccgcggcccaggccgccaucaacggcgucaucaacacccccgagcugaacugcaaggggaacggcacggcccaguccgcggaccuccgcauccggcgccagcacagcuccgacagcguguccagcaucaacuccgccaccagccacuccagcguggggagcaacaucgaguccgacagcaagaagaagaagcggaagaacuggcugcgcuccagcuucaagcaggccuucggcaagaagaagucccccaagagcgccuccagccacuccgacaucgaggagaugaccgacagcucccugcccagcuccccgaagcucccccacaacggcagcaccggguccacgccccugcugcggaacagccacuccaacagccucaucagcgagugcauggacuccgaggccgagacggucaugcagcugcgcaacgagcugcgggacaaggagaugaagcucaccgacauccgccuggaggcgcugagcuccgcccaccagcucgaccagcugcgggaggccaugaaccgcaugcagagcgagaucgagaagcugaaggccgagaacgaccggcucaaguccgagagccagggcuccgggugcagccgcgcgcccucccaggugagcaucuccgccagcccgcggcaguccaugggccugagccagcacucccugaaccucaccgagagcaccucccuggacaugcugcucgacgacacgggggagugcagcgcccgcaaggagggcggccggcacgugaagaucgucguguccuuccaggaggagaugaaguggaaggaggacagccgcccccaccuguuccugaucgggugcaucggcgucagcgggaagaccaagugggacgugcuggacggcgugguccggcgccucuucaaggaguacaucauccacguggaccccgugucccagcugggccugaacagcgacuccguccucggguacagcaucggcgagaucaagcgguccaacaccagcgagacccccgagcugcugccgugcggguaccucgugggcgagaacacgaccaucuccgugaccgucaaggggcuggccgagaacagccuggacucccucguguucgagagccugauccccaagcccauccugcagcgcuacgugucccuccugaucgagcaccggcgcaucauccugagcggccccuccggcaccgggaagacguaccucgccaaccgccugagcgaguacaucguccugcgggagggccgcgagcucaccgacggggugaucgcgaccuucaacguggaccacaaguccagcaaggagcugcggcaguaccuguccaaccucgccgaccagugcaacagcgagaacaacgccgucgacaugccgcuggugaucauccuggacaaccuccaccacguguccagccugggcgagaucuucaacgggcugcucaacugcaaguaccacaagugccccuacaucaucggcaccaugaaccaggccacgagcuccacccccaaccugcagcugcaccacaacuuccgcuggguccucugcgccaaccacaccgagcccgugaagggcuuccuggggcgguuccugcgccggaagcucauggagaccgagaucagcggccgcgugcggaacauggagcuggucaagaucaucgacuggaucccgaagguguggcaccaccugaaccgcuuccucgaggcgcacuccagcuccgacgugacgaucgggccccggcuguuccugagcugccccaucgacgucgacggcucccgcgugugguucaccgaccucuggaacuacagcaucauccccuaccugcuggaggccgugcgggaggggcuccagcuguacggccgccgggccccgugggaggaccccgccaagugggucauggacaccuaccccugggccgcguccccgcagcagcacgaguggccgccccuccuccagcugcgccccgaggacgugggcuucgacggguacagcaugccccgggagggcuccaccagcaagcagaugccgcccuccgacgccgagggggacccccugaugaacaugcucaugcgccugcaggaggccgccaacuacagcuccccgcagagcuacgacuccgacagcaacuccaacagccaccacgacgacauccuggacagcucccucgagagcacgcuguga

SEQ ID NO: 33397 - RNA, 7158 nt, Artificial Sequence
  derived and/or modified sequence opt1 from NAV3__Homo_sapiens__NP_001019554
augcccgugcugggggucgccagcaagcuccgccagcccgccguggggagcaagcccgugcacaccgcccugcccauccccaaccuggggaccacggggagccagcacugcagcagccgcccccucgagcugaccgagaccgagagcagcaugcugagcugccagcucgcccucaaguccacgugcgaguucggcgagaagaagccccugcaggggaaggccaaggagaaggaggacagcaagaucuacaccgacugggccaaccacuaccucgccaagagcggccacaagcgccugaucaaggaccugcagcaggacaucgccgacggcguccuccuggccgagaucauccagaucaucgccaacgagaagguggaggacaucaacgggugcccccggucccagagccagaugaucgagaacguggacgucugccuguccuuccucgccgcgcgcggcgugaacgugcaggggcugagcgccgaggagauccggaacggcaaccugaaggccauccucgggcuguucuucucccugagccgcuacaagcagcagcagcaccaccagcagcaguacuaccagucccucgucgagcugcagcagcgggugacccacgccuccccgcccuccgaggccagccaggcgaagacccagcaggacaugcagagcucccuggccgcccgcuacgccacccagagcaaccacuccggcaucgccacgagccagaagaagcccacccggcuccccggccccucccgcgugcccgcggccgggagcuccagcaagguccagggcgccuccaaccugaaccggcgcagccaguccuucaacagcaucgacaagaacaagccgcccaacuacgccaacgggaacgagaaggacuccagcaagggcccccaguccagcuccggcgugaacgggaacgugcagccgcccagcaccgccggccagccgcccgcguccgccaucccgagccccagcgccuccaagcccuggcggagcaaguccaugaacgucaagcacagcgccaccuccacgaugcugaccgugaagcagagcuccaccgccaccagccccacgccguccagcgaccgccucaagccgcccguguccgagggggucaagaccgcgcccagcggccagaaguccaugcuggagaaguucaagcuggugaacgcccggaccgcccuccgcccgccccagcccccgagcuccgggcccagcgacggcggcaaggacgacgacgccuucuccgagagcggggagauggagggcuucaacagcgggcugaacuccggcgggagcaccaacuccagccccaaggugucccccaagcuggcgccgcccaaggccggcagcaagaaccucuccaacaagaagucccugcugcagcccaaggagaaggaggagaagaaccgggacaagaacaaggucugcacggagaagcccgugaaggaggagaaggaccaggugaccgagauggccccgaagaagaccuccaagaucgccagccucauccccaagggcuccaagaccacggccgcgaagaaggagagccugauccccuccagcuccgggauccccaagccgggcagcaagguccccaccgugaagcagaccaucucccccgggagcaccgccuccaaggagagcgagaaguuccgcacgaccaagggcagccccucccagagccuguccaagccgaucaccauggagaaggccagcgccuccagcugccccgcgccccuggaggggcgggaggcgggccaggccucccccagcggcuccugcaccaugacggucgcccagagcuccgggcagagcaccggcaacggggccgugcagcugccgcagcagcagcagcacucccaccccaacaccgccaccguggcgcccuucaucuaccgcgcccacagcgagaacgagggcacggcccugcccuccgccgacagcugcaccuccccgaccaagauggaccucagcuacuccaagaccgcgaagcagugccuggaggagaucagcggcgaggaccccgagacccggcgcaugcgcacggucaagaacaucgccgaccugcggcagaaccucgaggagaccaugagcucccugcgcgggacccagaucagccacuccacccuggagacgaccuucgacagcaccgugaccacggaggugaacggccggaccauccccaaccucaccucccgcccgacccccaugacguggcggcuggggcaggccugcccccgccugcaggccggcgacgcccccagccugggggcgggcuacccgcgguccggcaccagccgcuucauccacaccgaccccucccgguucauguacaccacgccccuccgccgggccgccgucagccgccuggggaacaugucccagaucgacaugagcgagaaggccuccagcgaccuggacauguccagcgagguggacgugggcggguacauguccgacggcgacauccucggcaagagccugcggaccgacgacaucaacuccggcuacaugaccgacggcgggcugaaccucuacacccgcagccugaaccggauccccgacacggccaccagccgcgacaucauccagcggggcguccacgacgugaccguggacgcggacuccugggacgacagcuccagcgucuccagcgggcuguccgacacccucgacaacaucagcacggacgaccugaacaccaccuccagcguguccagcuacuccaacaucaccgugccgagccgcaagaacacgcagcugcggaccgacuccgagaagcgcagcaccaccgacgagacgugggacucccccgaggagcucaagaagcccgaggaggacuucgacagccacggcgacgccgggggcaaguggaagaccgucuccagcggccugcccgaggacccggagaaggccgggcagaaggccagccuguccgugagccagaccggcuccuggcgccgggggaugagcgcccagggcggggcgcccucccgccagaaggccggcaccagcgcccucaagacgcccggcaagaccgacgacgccaaggcguccgagaaggggaaggcgccccugaagggcagcucccugcagcggagcccguccgacgccggcaagagcuccggcgacgagggcaagaagccgcccagcgggaucggccgcuccaccgccaccagcuccuucggguucaagaagcccagcggcgugggguccagcgccaugaucaccagcuccggcgcgacgaucaccagcggcuccgccacccucgggaagauccccaagagcgccgccaucggcgggaaguccaacgccggccggaagaccagccuggacgggucccagaaccaggacgacgucgugcugcacgugagcuccaagacgacccuccaguaccgcagccugccccggcccuccaagagcuccaccagcggcauccccggccgcgggggccaccgguccagcaccuccagcaucgacagcaacgucuccagcaaguccgcgggggccacgaccagcaagcugcgcgagccgaccaagaucggcuccgggcggagcucccccgugaccgugaaccagacggacaaggagaaggagaaggucgccgugagcgacuccgagagcgugucccucagcggcucccccaagagcucccccaccagcgccuccgccugcggcgcgcaggggcugcgccagccgggcagcaaguaccccgacaucgccucccccaccuuccggcgccuguucggggccaaggccggcggcaagagcgccagcgcgccgaacaccgagggggucaaguccagcuccgugaugcccagccccuccacgacccucgcccggcagggcagccuggagucccccagcuccgggaccggcagcaugggguccgccggcggccugagcggguccagcagcccccucuucaacaagcccuccgaccugaccacggacgugaucucccugagccacucccucgccagcagccccgcguccguccacagcuucaccuccggcgggcuggugugggccgccaacaugagcuccagcuccgccggcagcaaggacacccccuccuaccagagcaugaccucccugcacacgagcuccgagagcaucgaccucccgcugucccaccacgggagccuguccggccucaccaccggcacccacgaggugcagagccugcugaugcgcacgggguccguccggagcacccucagcgaguccaugcagcuggaccgcaacacccugcccaagaagggccuccgguacacccccagcucccgccaggccaaccaggaggaggggaaggaguggcugcggagccacuccacgggcgggcugcaggacaccggcaaccagagcccccucguguccccgagcgcgauguccagcuccgccgccggcaaguaccacuucagcaaccuggugucccccaccaaccugagccaguucaaccuccccgggcccuccaugaugcgcagcaacuccaucccggcccaggacagcuccuucgaccuguacgacgacagccagcugugcggcagcgccaccucccucgaggagcgcccccgggcgaucagccacuccgggagcuuccgcgacuccauggaggagguccacggcagcucccugagccugguguccagcacguccagccucuacuccaccgccgaggagaaggcccacagcgagcagauccacaagcugcggcgcgagcugguggccucccaggagaaggucgccacccucaccagccagcuguccgcgaacgcccaccugguggccgccuucgagaagucccucgggaacaugaccggccggcugcagucccugacgaugaccgcggagcagaaggagagcgagcucaucgagcugcgcgagaccaucgagaugcugaaggcccagaacagcgccgcccaggccgcgauccagggcgcccucaacgggcccgaccacccgcccaaggaccugcggauccgccggcagcacuccagcgaguccgugagcuccaucaacagcgccaccucccacagcuccaucggcagcgggaacgacgccgacuccaagaagaagaagaagaagaacugggucaacagccgcggcuccgagcugcggagcuccuucaagcaggccuucggcaagaagaaguccacgaagccgcccuccagccacagcgacaucgaggagcucaccgacuccagccugcccgcgucccccaagcugccccacaacgccggggacugcggcagcgccuccaugaagcccagccaguccgccagcgccagcccccucguguggccgcccaagaagcgccagaacgggcccgugaucuacaagcaccggagccgcaucugcgagugcaccgaggcggaggccgagaucauccugcagcugaaguccgagcuccgggagaaggagcugaagcugaccgacauccgccucgaggcccugagcuccgcccaccaccuggaccagauccgggaggcgaugaaccgcaugcagaacgagaucgagauccucaaggccgagaacgaccggcugaaggccgagacgggcaacaccgccaagccgacccggccgcccagcgaguccagcuccagcaccuccagcagcuccagccgccagucccuggggcucagccugaacaaccugaacaucacggaggccgucuccagcgacauccuccuggacgacgcgggcgacgccaccggccacaaggacgggcgguccgugaagaucaucgugagcaucuccaagggcuacgggcgcgccaaggaccagaagucccaggccuaccugaucggcuccaucggggucagcggcaagaccaagugggacgugcucgacggcgugauccggcgccuguucaaggaguacgucuuccggaucgacaccuccacgagccuggggcuguccagcgacugcaucgccuccuacugcaucggcgaccucauccgcagccacaaccuggaggugcccgagcugcucccgugcggguaccuggucggcgacaacaacaucaucaccgugaaccugaaggggguggaggagaacucccucgacagcuucgucuucgacacccugauccccaagcccaucacccagcgguacuucaaccugcucauggagcaccaccgcaucauccugagcggccccuccggcacggggaagaccuaccuggcgaacaagcucgccgaguacgugaucaccaagagcggccggaagaagaccgaggacgccaucgccacguucaacguggaccacaaguccagcaaggagcugcagcaguaccuggccaaccucgcggagcagugcuccgccgacaacaacggggucgagcugccgguggugaucauccuggacaaccuccaccacgucggcagccuguccgacaucuucaacggguuccugaacugcaaguacaacaagugccccuacaucaucggcaccaugaaccagggcgugagcuccagccccaaccucgagcugcaccacaacuuccgcugggugcugugcgccaaccacaccgagcccgucaagggguuccucggccgguaccugcgccggaagcugaucgagaucgagaucgagcgcaacauccggaacaacgaccucgugaagaucaucgacuggaucccgaagaccuggcaccaccugaacuccuuccuggagacgcacagcuccagcgacgugaccaucgggccccgccucuuccugcccugccccauggacgucgagggcucccgggugugguucauggaccuguggaacuacagccucgugccguacauccuggaggccguccgcgagggccugcagauguacgggaagcggacccccugggaggaccccuccaagugggugcucgacaccuaccccuggagcuccgccacgcugccgcaggagagccccgcgcugcuccagcugcgccccgaggacgugggcuacgagagcugcaccuccaccaaggaggccaccacgagcaagcacaucccccagaccgacaccgagggggacccgcugaugaacaugcucaugaagcugcaggaggccgccaacuacuccagcacccaguccugcgacagcgaguccacgagccaccacgaggacauccuggacuccagccucgaguccacccuguga

SEQ ID NO: 33398 - RNA, 7116 nt, Artificial Sequence
  derived and/or modified sequence opt1 from NBAS__Homo_sapiens__NP_056993
auggccgcccccgaguccggcccggcgcugucccccgggaccgccgagggcgaggaggagaccauccuguacgaccugcuggugaacaccgaguggccgcccgagaccgaggugcagccgcgggggaaccagaagcacggcgccuccuucaucaucaccaaggccauccgggaccggcugcuguuccugcggcaguacaucugguacucccccgcccccuuccugcugcccgacgggcuggugcgccucgugaacaagcagaucaacuggcaccugguccuggcgagcaacggcaagcuccuggccgccgugcaggaccagugcguggagauccgguccgccaaggacgacuucaccuccaucaucggcaagugccaggucccgaaggaccccaagccccaguggcgccggguggcgugguccuacgacugcacgcugcucgccuacgccgaguccaccgggaccgugcgcgucuucgaccugaugggcuccgagcuguucgugaucagccccgccuccagcuucaucggggaccucuccuacgccaucgcgggccugaucuuccuggaguacaaggccagcgcccagugguccgccgagcuccuggugaucaacuaccgcggggagcugcgcagcuaccucgucuccgugggcaccaaccagagcuaccaggagucccacugcuucagcuucagcucccacuacccgcacggcaucaacacggccaucuaccaccccgggcaccggcugcugcucgugggcgggugcgagaccgcggaggucggcaugagcaaggccuccagcugcggccuguccgccuggcgcgugcugagcgggucccccuacuacaagcaggucaccaacggcggggacggcgucaccgccgugcccaagacgcucgggcugcugcggaugcucagcgugaaguucuacucccgccagggccaggagcaggacggcaucuucaagaugagccuguccccggacgggaugcugcucgccgcgauccacuucagcggcaagcuguccaucugggccauccccagccugaagcagcagggggaguggggccagaacgagcagcccggguacgacgaccucaaccccgacuggcggcuguccaccgagaagcgcaagaagaucaaggacaaggagagcuucuacccgcugaucgacgucaacuggugggccgacuccgccgugacccucgcccggugcagcggcgcgcugaccguguccagcgucaagacgcugaagaaccuccugggcaagagcugcgagugguucgagcccagcccccaggugaccgccacccacgacgggggcuuccugagccucgagugcgagaucaagcuggcccccaagcgcucccggcuggagacccgcgccggggaggaggacgagggcgaggaggacagcgacuccgacuacgagaucagcgcgaaggcccgguacuucggguacaucaagcagggccuguaccucgucacggagauggagcgcuucgccccgccccgcaagcggccccgcaccaucaccaagaacuaccggcuggugucccugcgcagcaccacgcccgaggagcucuaccagcggaagaucgaguccgaggaguacgaggaggcccugagccuggcccacaccuacggccucgacaccgaccugguguaccagcgccaguggcggaaguccgcggucaacguggccagcauccagaacuaccuguccaagaucaagaagcgcagcugggugcuccacgagugccuggagcgggucccggagaacguggacgccgccaaggagcugcuccaguacgggcugaagggcaccgaccuggaggcccuccuggcgaucgggaagggcgccgacgacggccgcuucacgcugcccggggagaucgacaucgacuccaucagcuacgaggagcucagcccgcccgacgaggagcccgccaagaacaagaaggagaaggagcugaagaagcggcaggagcugcucaagcuggugaacuucagcaagcugacccucgagcagaaggagcugugccgcugccggcgcaagcugcucaccuaccuggaccggcuggccaccuacgaggagauccucggcgucccccacgccagcgagcagcgcuacgacgcggaguucuucaagaaguuccggaaccagaacaucgugcuguccgcccgcacguacgcccaggagagcaacgugcaggcccuggagauccucuucaccuaccacggguccgaccugcugccccaccggcucgcgauccugagcaacuuccccgagaccaccagcccccacgaguacagcguccugcuccccgaggccugcuucaacggcgacucccugaugaucauccccuggcacgagcacaagcaccgcgccaaggacuggugcgaggagcuggccugccgcauggugguggagccgaaccuccaggacgagagcgaguuccuguacgccgcgcagcccgagcugcuccgguuccgcaugacgcagcugaccgucgagaaggugauggacugguaccagacccgggccgaggagaucgagcacuacgcccgccagguggacugcgcccugucccucauccggcuggggauggagcgcaacauccccggccugcucguccugugcgacaaccuggugacccucgagacccugguguacgaggcccggugcgacgucacgcugacccucaaggagcugcagcagaugaaggacaucgagaagcugcgccuccugaugaacagcugcuccgaggacaaguacgugaccagcgcguaccaguggauggugcccuuccugcaccggugcgagaagcaguccccgggcgucgccaacgagcuccugaaggaguaccuggugacccucgccaagggggaccugaaguucccccugaagaucuuccagcacagcaagcccgaccuccagcagaagaucauccccgaccaggaccagcugauggccaucgcccuggagugcaucuacacgugcgagcgcaacgaccagcucugccugugcuacgaccugcucgagugccugccggagcggggcuacggggacaagaccgaggcgaccaccaagcugcacgacaugguggaccagcucgagcagauccuguccgucagcgagcugcucgagaagcacggccuggagaagcccaucuccuucgugaagaacacgcagagcuccagcgaggaggcccgcaagcugauggugcggcucacccgccacaccgggcggaagcagccgcccgucagcgagucccacuggcgcacccugcugcaggacaugcucacgaugcagcagaacguguacacgugccuggacagcgacgccugcuacgagaucuucaccgagucccugcucugcagcucccggcuggagaacauccaccuggccggccagaugaugcacugcagcgcgugcuccgagaacccgcccgccggcaucgcccacaaggggaagccccacuaccgcgugagcuacgagaaguccaucgaccucguccuggccgccagccgggaguacuucaacuccagcaccaaccugacggacuccugcauggaccuggcgcgcugcugccuccagcugaucaccgaccggcccccggccauccaggaggagcuggaccucauccaggccgugggcugccuggaggaguucggggugaagauccugccccuccagguccgccugugccccgaccgcaucagccugaucaaggagugcaucucccagagcccgaccugcuacaagcaguccaccaagcuccugggccuggccgagcuccugcggguggccggggagaaccccgaggagcgccggggccaggugcugauccuccuggucgagcaggcgcugcgcuuccacgacuacaaggccgccagcaugcacugccaggagcucauggccacgggcuaccccaaguccugggacgugugcagccagcuggggcagagcgagggcuaccaggaccuggccacccggcaggagcucauggcguucgcccugacccacugcccgcccuccagcaucgagcugcuccuggccgccuccagcucccugcagaccgagauccucuaccagcgcgugaacuuccagauccaccacgagggcggggagaacaucagcgccagcccccugacgagcaaggcgguccaggaggacgaggugggggugcccggcuccaacagcgccgaccugcuccgguggaccaccgccaccacgaugaagguccuguccaacaccaccaccacgaccaaggccgugcugcaggcggugagcgacggccagugguggaagaagucccucaccuaccugcgcccccugcaggggcagaagugcggcggggccuaccagaucggcaccacggccaacgaggaccucgagaagcagggcugccaccccuucuacgagagcgucaucuccaaccccuucguggccgagagcgaggggaccuacgacaccuaccagcacgugcccgucgaguccuucgccgaggugcugcugcggaccggcaagcucgcggaggccaagaacaagggggaggucuuccccaccacggaggugcugcugcagcucgccagcgaggcccugccgaacgacaugacccuggcccucgcguaccugcuggcccucccccaggugcuggacgccaaccgcugcuucgagaagcagucccccagcgcccugagccuccagcuggccgcguacuacuacucccugcagaucuacgcccggcucgcccccugcuuccgcgacaagugccacccgcuguaccgggccgaccccaaggagcugaucaagauggucacccgccacgugacccggcacgagcacgaggcguggcccgaggaccucaucagccugacgaagcagcugcacugcuacaacgagcgccuccuggacuucacccaggcccagauccugcagggccuccggaaggggguggacguccagcgcuucaccgccgacgaccaguacaagcgggagaccauccugggccuggccgagacgcucgaggaguccguguacagcaucgccaucucccuggcgcagcgcuacagcgugucccgcugggaggucuucaugacccaccuggaguuccucuucaccgacagcggccuguccacccuggagaucgagaaccgggcccaggaccuccaccuguucgagacgcugaagaccgaccccgaggccuuccaccagcacauggugaaguacaucuacccgaccaucgggggcuucgaccacgagcgccuccaguacuacuucacccugcuggagaacugcgggugcgccgaccucggcaacugcgccaucaagcccgagacgcacauccggcugcugaagaaguucaagguggucgcgagcgggcucaacuacaagaagcugaccgacgagaacaugagcccccuggaggcccucgagcccgugcugagcucccagaacauccugagcaucuccaagcucgugccgaagauccccgagaaggacggccagaugcugagccccuccagccuguacaccaucuggcuccagaagcuguucuggaccggcgacccccaccugaucaagcaggucccgggguccagccccgaguggcuccacgccuacgacgugugcaugaaguacuucgaccgccugcaccccggcgaccugaucacgguggucgacgccgugaccuucagcccgaaggccgugaccaagcucuccgucgaggcgcggaaggagaugacccgcaaggccaucaagacggugaagcacuucaucgagaagccccggaagcgcaacagcgaggacgaggcccaggaggccaaggacuccaaggugaccuacgcggacacccugaaccaccuggagaagucccucgcccaccuggagacccugucccacagcuucauccugucccucaagaacagcgagcaggagacgcugcagaaguacucccaccuguacgaccucagccgguccgagaaggagaagcugcacgacgaggccgucgccaucugccuggacgggcagccccucgccaugauccagcagcugcuggagguggcggugggcccccucgacaucagcccgaaggacaucguccaguccgccaucaugaagaucaucagcgcccuguccgggggcagcgccgaccugggcgggccccgcgacccccucaaggugcuggagggcguggucgccgcggugcacgccuccguggacaagggggaggagcuggucagccccgaggaccuccuggaguggcugcggccguucugcgccgacgacgccuggcccgugcgcccccggauccacgugcuccagauccugggccaguccuuccaccugaccgaggaggacagcaagcuccuggucuucuuccgcaccgaggccauccugaaggcgagcuggccccagcgccagguggacaucgccgacaucgagaacgaggagaaccgcuacugccucuucauggagcugcuggaguccagccaccacgaggccgaguuccagcaccucgugcugcugcuccaggccuggccgcccaugaaguccgaguacgucaucaccaacaaccccugggugcggcuggccacggugaugcugacccgcugcaccauggagaacaaggagggccucgggaacgagguccugaagaugugccggagccuguacaacaccaagcagaugcuccccgcggagggcgugaaggagcugugccugcuccugcugaaccagucccuccugcugccgagccucaagcugcugcucgagucccgcgacgagcaccuccacgagauggcccuggagcagaucacggccgugaccaccgucaacgacagcaacugcgaccaggagcuccugucccugcuccuggacgccaagcugcucgugaagugcgugagcacccccuucuacccccggaucgucgaccaccuccuggcgucccuccagcaggggcgcugggacgccgaggagcugggccgccaccuccgggaggccgggcacgaggccgaggccggcagccuccugcuggcggugcgcggcacccaccaggccuuccggacguucuccaccgcccuccgcgccgcccagcacuggguguga

SEQ ID NO: 33399 - RNA, 2220 nt, Artificial Sequence
  derived and/or modified sequence opt1 from NBEA__Homo_sapiens__NP_001191126
auguucagcgagauccgcgccguguucucccggcgcuaccugcuccagaacaccgcccuggaggucuucauggcgaaccggaccagcgugauguucaacuuccccgaccaggccacggugaagaaggucguguacucccugccgcgcgugggcgucgggaccagcuacggccucccccaggcccggcgcaucucccuggccacgccccggcagcuguacaagagcuccaacaugacccagcgcuggcagcggcgcgagaucagcaacuucgaguaccucauguuccugaacaccaucgccgggcggaccuacaacgaccugaaccaguaccccguguucccgugggugcucaccaacuacgaguccgaggagcuggaccugacccuccccggcaacuuccgcgaccugagcaagcccaucggggcgcugaaccccaagcgggccgucuucuacgccgagcgcuacgagacgugggaggacgaccaguccccgcccuaccacuacaacacccacuacagcaccgccaccuccacgcucagcuggcuggugcggaucgagcccuucaccaccuucuuccugaacgcgaacgacggcaaguucgaccaccccgaccgcaccuucuccagcguggcccgguccuggcgcacgagccagcgggacaccuccgacgucaaggagcucaucccggaguucuacuaccugcccgagauguucgugaacagcaacggcuacaaccugggggugcgcgaggacgaggucguggugaacgacgucgaccucccgcccugggccaagaagcccgaggacuucgugcggaucaaccgcauggcccuggagagcgaguucguguccugccagcugcaccaguggaucgaccucaucuucggcuacaagcagcgcgggcccgaggccguccgggcgcugaacguguuccacuaccugaccuacgagggcagcgugaaccucgacuccaucaccgaccccguccugcgcgaggccauggaggcccagauccagaacuucgggcagacgcccagccagcugcucaucgagccgcacccgccccgguccagcgccaugcaccugugcuuccugccccagagcccccucauguucaaggaccagaugcagcaggacgugaucaugguccugaaguuccccuccaacucccccgugacccacguggccgcgaacacccugccccaccucaccaucccggccgucgugacggugaccugcagccgccuguucgccgucaaccgguggcacaacaccgugggccugcgcggcgcccccggguacucccucgaccaggcccaccaccuccccaucgagauggacccgcugaucgcgaacaacagcggcgugaacaagcggcagaucaccgaccuggucgaccaguccauccagaucaacgcccacugcuucguggugacggccgacaaccgcuacauccugaucugcggguucugggacaagagcuuccgggucuacuccaccgagaccggcaagcugacccagaucguguucggccacugggacguggucacgugccucgcccgcagcgaguccuacaucgggggcgacugcuacaucgugagcgggucccgggacgccacccugcugcucugguacuggagcggccgccaccacaucaucggggacaaccccaacagcuccgacuaccccgcgccccgggccgugcugaccggccacgaccacgaggucgugugcgugagcgucugcgccgagcugggccuggugaucuccggggccaaggagggcccgugccucgugcacaccaucacgggggaccugcugcgcgcgcucgagggccccgagaacugccuguucccccggcugaucagcgucuccagcgaggggcacugcaucaucuacuacgagcgcggccgguucuccaacuucagcaucaacggcaagcuccuggcccagauggagaucaacgacuccacccgcgccauccugcucagcuccgacgggcagaaccuggugaccggcggggacaacggcguggucgagguguggcaggccugcgacuucaagcagcuguacaucuaccccgggugcgacgccggcauccgggcgauggaccucagccacgaccagcgcacccugaucaccggcauggccuccgggagcaucguggccuucaacaucgacuucaaccgcuggcacuacgagcaccagaaccgguacuga

SEQ ID NO: 33400 - RNA, 8085 nt, Artificial Sequence
  derived and/or modified sequence opt1 from NBEAL1__Homo_sapiens__NP_001107604
auggccagccgcgagcggcuguucgagcucuggaugcuguacugcaccaagaaggaccccgacuaccugaagcucuggcuggacaccuucgugagcagcuacgagcaguuccuggacguggacuucgagaagcuccccacccgcguggacgacaugccgcccggcaucucccugcugcccgacaacauccuccaggugcugcggauccagcugcuccagugcgugcagaagauggccgacgggcuggaggagcagcagcaggcgcugagcauccuccuggugaaguucuucaucauccugugccgcaaccucuccaacguggaggagaucgggaccugcagcuacaucaacuacgugaucaccaugaccacccuguacauccagcagcugaaguccaagaagaaggagaaggagauggccgaccagaccugcaucgaggaguucgugauccacgcccucgccuucugcgagagccuguacgacccguaccggaacuggcgccaccggaucuccgggcgcauccugagcaccguggagaagucccggcagaaguacaagcccgccagccucaccguggaguucgugcccuucuucuaccagugcuuccaggaguccgagcaccugaaggagagccugaagugcugccuccugcaccuguucggcgcgaucguggccgggggccagcgcaacgcccuccaggccaucucccccgcgaccauggagguccugaugcgggugcuggccgacugcgacagcugggaggacggcgacccggaggagguggggcgcaaggccgagcucacccugaagugccugaccgaggucgugcacauccuccuguccagcaacuccgaccagcggcaggucgagaccagcacgauccuggagaacuacuucaagcuccugaacagcgaccacuccgcccugcccaaccagcgccggagccgccagugggagaaccgguucaucgcccuccagaucaagaugcugaacaccaucaccgcgaugcuggacugcaccgaccgccccguccuccaggccaucuuccugaacuccaacugcuucgagcaccugauccggcuccugcagaacugcaagguguuccagggccagcuggacugccuggccaucagcacgauccaggcccucaccgccgugaugaacaagucccccgcggccaaggaggucuucaaggagcgcaucggguacacccacaugcuggaggugcucaagucccucggccagccgccccuggagcugcucaaggagcugaugaacauggccguggagggggaccacaccuccgucggcauccugggcaucagcaacgugcagccccuccugcugcucauccaguggcugcccgagcugcagucccacgaccuccagaucuucaucagcgacuggcugaagcggaucugcugcaucaaccgccagucccgcacgaccugcgucaacgccaacauggggauccggaucaucgagacccuggaccuccacagcucccugcaccagaccugcgccgagaaccugaucgcgauccacggcagccucgggucccagagcguguccagcgaggagauccgccggcugcugcgccuccugcggguggacgaguccgagagcguccaccccuacgugacgcccgugacccgcgccauccugaccauggcccggaagcucagccuggaguccgcccugcaguacuucaaccucagccacuccauggccggcaucagcgugccgcccauccagaaguggccgggcuccgcguucagcuucuccgccugguucugccuggaccaggaccagcugacccucgggaucgccaacaagggcgggaagcgcaagcagcuguacagcuucuucacgggcuccgggaugggcuucgaggccuucaucacccacagcggcaugcuggugguggcggucugcaccaagcgggaguacgccaccgugaugcuccccgaccacuccuucugcgacagccuguggcacaacaucacggugguccacaugcccgggaagcgccccuucggccaguccuucguguacaucuacgacaacgggcagcagaaggugagcgccccgcugcgguuccccgccaugaacgagcccuucaccuccugcugcaucggcagcgccgggcagcgcaccaccacgcccccgcccucccagauccccgacccgcccuucagcagccccaucacgccccaccggaccuccuucggcggcauccucagcuccgcgagcuggggcgggaccaucgagaaguccaagcugaucaccaagcugaucagcgccgggacgcaggacuccgaguggggcugcccgaccagccucgaggggcagcugggcuccgucaucaucuucuacgagccccugcagccgccccaggugaaggcccucuaccuggccggcccgaacugccugagccccuggaagugccaggaguccgacauggccgaccuccccgggaacauccugcuguacuacaccgcgaaggccugcaagaacagcaucugccucgaccuguccaccaacugccugcacggccgccucacggggaacaagguggucaacugggacaucaaggacaucaucaacugcaucggcggccugaacgugcuguucccccuccuggagcagaucagccacuucuccgaggggcagaucccggaggagaagaacgagagcaccgugcccgaguccgucacccccguggagggcgacuggcugguguggaccagcacgaaggccuccgagagccggcucgagcgcaaccuggucgccaccuucauccugaucgugaagcacuucauccagcggcaccccaucaaccaggggaaccucauccacagccacggcguggccacccugggggcgcugcuccagaaggucccguccacccugauggacgugaacgugcugauggccguccagcuccugaucgagcaggucagccuggagaagaacaugcagcuccugcagcagauguaccaguaccuccuguucgacuuccgcaucuggaaccggggcgacuuccccuuccgcaucggccacauccaguaccuguccacgaucaucaaggacagccgccggguguuccgcaagaaguacgggguccaguuccugcucgacacccugcggaucuacuacggcaacgggugcaaguacaacgagcugucccucgacgacauccgcaccauccggaccagccuguacggccugaucaaguacuuccucugcaagggcggcucccacgaggagauccagagcaucaugggcuacaucgccgccacgaacgaggaggagcagcuguucgggauccuggacguccuguucucccugcugcgcaccagccccacccggggccagcuguuccugcuccuguucgagcccgggaacgcggacauccuguacgcccugcugcucaaccagaaguacuccgaccgccugcgggagaucaucuucaagaucauggagcagaugcugaagugcaccaacguguacgagcgcagcaagcagcacauccggcuccgcgaggucggcuacuccgggcugggccugcuccugaacgaggcccuggugaacacgagccucaucaagaaccugacccaccagaucaucaacaccgacccggugaucaacuucaaggaccugcucuccgucguguacaucagccaccgggcccacaucaacgugcgcgucgccaucugccggaaggugcugcagauccugcaguuccagcccgacgcggcccaccagaucucccagcaggucggcuggcaggacacccucguccgccuguuccugaaggccaaguucgagaacgggaacacgcuccacaagcacagccgggccgugcugaugaaggacaacgacaagaacauguccaccgaggacaccaagaagaacagcgacgagaagaccgacgaggagaagaucacgagcuucgccuccgcgaacgugagcuccgaccaguggagccuggaggaccgccacucccucgacagcaacacgccccucuuccccgaggacuccagcgucggcgagcuguccuucaagagcgagaaccaggaggaguucuggcacuccaacccgagccaccucucccuggaccugagcgggaucgacuccugcgagaugagcgacuccggcagccaggugcccgacucccuccccagcaccccgagccccguggaguccaccaagagcuucuccguccacagcgaccgggaguccagcaucacgaacgacaugggguucuccgacgacuucagccugcuggagucccaggagcgcugcgaggaggagcuccugcagcugcucacccacauccugaacuacgugaugugcaagggccuggagaaguccgacgacgacaccuggaucgagcggggccaggucuucuccgcccucagcaagcccgggaucuccagcgagcugcugcgccccuccgacgagaucaagcucacccugcugcagaagaugcucgagugggccaucagcgagaaccgcgaggccaagacgaacccggugaccgccgagaacgcguuccggcuggugcugaucauccaggacuuccuccaguccgagggccuggucaacagcaacauguggaccgagaagcugcucgaggacaugaugcugcuguucgacugccucuccgugugcuacagcgagagccccgugugggucaagcugucccagauccagauccagcugcuccugggguucaucggccgcggcaaccuccaggugugcgccauggccagcgccaagcucaacacccugcugcagaccaaggugaucgagaaccaggacgaggcgugcuacauccucgggaagcuggagcacguccugucccagagcaucaaggagcagacggagaucuacuccuuccucaucccccuggugcggacccuggugagcaagaucuacgagcuccuguucaugaaccugcaccuccccucccugccguucaccaacggcagcuccagcuucuucgaggacuuccaggaguacugcaacuccaacgaguggcaggucuacaucgagaaguacaucgugcccuacaugaagcaguacgaggcccacaccuucuacgacgggcacgagaacauggcccuguacuggaaggacugcuacgaggcccucauggugaacaugcacaagcgcgaccgggagggcggggagagcaagcugaaguuccaggagcuguucgucgagcccuucaaccgcaaggcccggcaggagaaccuccgcuacaacaacaugcugaagcagcuguccagccagcagcucgcgacgcugcggcgcuggaaggccauccagcuguaccugaccugcgagcggggccccugggccaagcgcaagcagaacccgauccacuggaagcuggccaacguggagaacuacucccggaugcgccugaagcucgugcccaacuacaacuucaagacccacgaggaggccagcgcgcugcgggacaaccugggcauccagcacucccagcccagcuccgacacccuccugcuggaggucgugaagcaggucaaggucagcgacaugguggaggacaagcucgaccugcccgaggaggacaucacggcccgcgugaacgucgacgagaaggaggagcaggaccagaaggagaagcuggugcucauggaggacugcgagcugaucaccaucaucgacgugaucccggggcggcuggagaucaccacccagcacaucuacuucuacgacggcagcaucgagaaggaggacggggucggcuucgacuucaaguggccccacucccagauccgcgagauccaccuccggcgcuacaaccugcgccggagcgcccuggagaucuuccacguggaccaguccaacuacuuccucaacuucaagaaggaggugcgcaacaagaucuacagccggcugcugucccugcacagccccaacuccuacuacgggagccgcagcccccaggagcuguucaaggccagcggccugacgcagaagugggucaaccgggagaucuccaacuucgacuaccugauccagaucaacaccauggccggccgcaccuacaacgaccucgcgcaguacccgguguuccccuggauccugcaggacuacaccagcgaggagcuggaccucaacaaccccgccguguuccgggaccuguccaagcccaucggggucgugaacgagaagaacgccaaggccaugcgcgagaaguacgagaacuucgaggacccgaugggcacgaucgacaaguuccacuacgggacccacuacagcaacuccgccggcgugaugcacuaccugauccgggucgagcccuucaccacccuccacauccagcugcagagcgggcgcuucgacugcgcggaccggcaguuccacuccauccccgccacguggcaggcccugauggacaaccccuacgacgugaaggagcucaucccggaguucuucuacuuccccgaguuccuggagaaccagaaccaguucaaccugggccgccuccagaucagcaaggagcuggugaacgacgucauccugcccaagugggccaagagcgcggaggacuucaucuacaagcaccggaaggcccucgaguccgaguacgugagcgcccaccuccacgaguggaucgaccugaucuucggcuacaagcagcgcgggccggccgccguggaggcgcugaacgucuucuacuacugcuccuacgagggcgccguggaccuggacgcccugaccgacgagaaggagcggaaggcccucgaggggaugaucaacaacuucggccagacccccugccagcugcugaaggagccccacccgccccgccucagcgccgaggaggcggugcagaagcccaccaagaucgacacguccacccugaaccuguuccagcaccuccccgagcucaagagcuucuucaucgagggcaucuccgacgggaucccccugcucaaggccaccauccccaagaaccaguaccggagcuucaugucccagggcagccccgagcugcugaucaccaucuccaugaacuacgucaucgggacgcacggcuggcuccccuacgaccgcaacaucagcaacuacuucaccuucaucaaggaccagaccgugaccaaccccaagacgcagcgguccaucaacgggagcuucgccccgggccuggagaucaccuccaagcuguucguggucagccacgacgccaagcuccuguucuccgccggcuacugggacaacagcauccaggugaugucccugaccaaggggaagaucaucagccacaucauccgccacauggacaucgugaccugccucgcgacggacuacugcggcauccaccugaucagcgggucccgggacacgaccugcaugaucuggcagaucacccagcagggcgggguccccgugggccuggccagcaagcccuuccagauccucuacggccacaccaacgagguccuguccguggggaucagcacggagcuggacauggccguguccggcagccgcgacgggaccgucaucauccacaccauccagaagggccaguacaugcgcacccuccggcccccgugcgaguccagccuguuccugacgauccccaaccucgccaucuccugggaggggcacaucgugguguacagcuccaccgaggagaagaccacccugaaggacaagaacgcgcugcaccucuucagcaucaacggcaaguaccugggcucccagauccugaaggagcaggucagcgacaucugcaucaucggggagcacaucgugacgggcuccauccagggguuccucagcauccgcgaccugcacucccugaaccucagcaucaacccccuggccaugcggcugcccauccacugcgugugcgucaccaaggaguacucccacauccucgugggccuggaggacgggaagcugaucguggucggcgugggcaagccggccgagaugcgcagcgggcagcucagccggaaguucuggggcuccagcaagcgccugucccagaucagcgccggggagaccgaguacaacacccaggacuccaaguga

SEQ ID NO: 33401 - RNA, 8265 nt, Artificial Sequence
  derived and/or modified sequence opt1 from NBEAL2__Homo_sapiens__NP_055990
auggccgccagcgagcgccuguacgagcucuggcugcuguacuacgcgcagaaggaccucggcuaccugcagcaguggcugaaggccuucgugggggccuucaagaaguccaucucccucuccagccuggagccccggcgccccgaggaggccggcgccgaggugccccugcucccccuggacgagcugcacgugcucgccgagcagcugcaccaggccgaccuggagcaggcccuccugcugcucaagcuguucaucauccugugccggaaccucgagaacaucgaggccgggcgcggccaggugcuggucccccgggugcuggcccuccugaccaagcugguggccgagcucaaggggugcccgccgccccagggccgcggcacccagcuggagaacgucgcccugcacgcccuccugcugugcgagggccuguucgaccccuaccagaccuggcggcgccagcgguccggcgaggugaucagcuccaaggagaaguccaaguacaaguucccgcccgccgcgcugccccaggaguucuccgccuucuuccaggagagccugcagaacgccgaccaccucccgcccauccugcugcugcgccugauccaccuguucugcgccgugcucgccgggggcaaggagaacgggcagauggcggucuccgacggcagcgugaagggccugcuguccgugguccggggguggagccgcggccccgcccccgaccccugccucgugccccuggcccuggaggcccucgugggggccguccacgugcugcacgcgucccgggcgccgccccgcggccccgagcugcgggcccugcucgagagcuacuuccacgugcugaacgccgacuggcccgccggccuguccagcgggcccgaggaggcgcucgucacccugcgcguguccaugcuggacgccauccccaugaugcucgccugcgaggaccggcccgugcugcaggccaccuuccugagcaacaacugcuucgagcaccucacccgccugauccagaacagcaagcuguaccuccagucccgggcgccgcccgagggcgacagcgaccuggccacgcgccugcucaccgagcccgacguccagaaggugcuggaccaggacaccgacgccaucgccgugcacgucgugcggguccugaccugcaucauguccgacagccccuccgccaaggagguguucaaggagcgcaucggguacccccaccuccaggaggugcugcagagccacgggccgcccacccaccgccugcuccaggagcugcugaacauggcggucgagggggaccacuccaugugcccgccgccgcccauccggaacgagcagcccgugcucgugcuggcccaguggcugcccagccuccccaccgccgagcugcgccuguuccucgcccagcggcugcgcuggcugugcgacuccugccccgccagccgggcgaccugcguccaggccggccucgugggcugccugcuggagacccucuccaccgggcuggcccuggaggcccgcugccaggagcagcuccuggcccugcuccaggcgcugggccgggugagcauccgccccauggagcugcggcaccuccugcgcccccggcccgggcuggacuccgagcccggcggggccgaggccggcaaggcccgccacgcgggcgccgucauccggacccucagcgggauggcccgccaccagggccccgcccgggcccugcgcuacuucgaccugacccccuccauggcggggaucauggugccgcccgugcagcgguggcccggccccggguucaccuuccacgccuggcucugccugcaccccauggacacggcccccacccccgcccccacccgcccccugcagcggaagcagcucuacagcuucuucaccuccagcggcuccggcuucgaggccuucuucacggcggccgggacccuggucguggccgugugcacccgcaaggaguaccugaccaugagccuccccgaggucagcuucgccgacuccgccuggcacugcguggcgaucgugcacguccccggccgccggcccuucagccagaaccuggugcacguguacaaggacgggcaccuggucaagacggcgccccugcgcugccccucccugagcgagcccuucuccagcugcugcaucggcuccgccggcuaccggaccaccaccacgaccaccgggcugcccacgccgcccgugcccgccacgcucgcguacacccaccccgcccugacccgcagccaguccgugcccgccagcaccggccugggguggggcuccgggcucgucgcgccccugcaggagggcagcaucgacuccacgcuggccggcacccaggacacccggugggggagccccaccucccucgagggcgagcugggggccguggccaucuuccacgaggcccugcaggccaccgcccuccgcacgcugugcacccugggccccaacgagaccgcgcccuucaagccggagggggagcuccacgagcugagcacccggcugcuccugcacuacagcccccaggccugcaagaacaacaucugccuggaccucagccccagccacggccuggacggccgccugacggggcaccggguggagaccugggacgucaaggacguggugaacugcgucggcgggaugggcgcccuccugccccugcucgagcgcguggccgcccagccgaaggaggcggaggccgggcccgccgagacccacgaccuggugggccccgagcugaccuccggccacaacacgcaggggcucguccugccccugggcaagagcuccgaggagcggauggagcgcaacgccguggccgcguuccuccugaugcugcggaacuuccugcaggggcacauggugaaccaggagagccucguccagugccagggcccggccaucaucggggcccugcugcgcaaggugcccuccugggccauggacaugaacgugcucaugagcgcgcagcugcugauggagcaggucgccgccgagggcuccggcccccuccuguaccugcucuaccagcaccuccuguucaacuuccaccucuggacccugagcgacuucgccgugcggcuggggcacauccaguacauguccagcaucgugcgcgagcaccggcagaagcuccgcaagaaguacggcguccaguucauccuggacgcccugcggacccacuacagcccccagcgcgagcggccgcucgcggccgacgaccugcgcaccgugcagacgagccugcucgggcuggcccgcgaguuccuggugcggucccucagcgccgacgacguccaggugacccagaccaugcuguccuuccuggccgcgaccggcgacgacggccaggccgugggggcccucgaccugcugcucgcccugcugcacggcagccucguccaggagucccuggccguguuccugcucgagcccgggaaccuggaggugcugcucgcgcugcugguccgccccggcagccucccccugcugccggaccgggugugcaagauccuccgccggcugcagcagaacgagcgccugcccgagcggucccgccagcggcuccgccugcgggagugcgggcugcagggccucgucgccugccugcccgagggcacggugagcccgcagcugugccaggggcucuacaagcuguuccugggcgccgacugccucaaccugagcgaccugcucgccgugguccagcugucccugcaggcggaccucagcgugcgccuggacaucugccggcagcuguuccaccucaucuacgggcagcccgacgugguccgccugcuggcccggcaggccggcuggcaggacgugcucacccgccuguacgugcuggaggccgccaccgcggggagcccgccgcccagcucccccgagagccccaccucccccaagcccgcgccgcccaagcccccgacggagagccccgccgagcccuccgacgucuuccuccccagcgaggccccgugccccgaccccgacggcuucuaccacgcccugucccccuucugcaccccguucgaccugggccucgagcggagcuccguggggagcggcaacaccgccgggggcgggggcuccagcggcacccugacgcccgccucccagcccgggacccccagcccgcuggacggcccccgccccuuccccgccgccccggggcggcacuccagcagccucuccaacgugcuggaggacggcagccugcccgagcccaccaucuccggcgacgacaccagcaacacguccaacccgcagcagaccagcgaggaggagcucugcaaccugcugaccaacguccucuucuccgugaccuggcgcgggguggagggcagcgacgaggccgcguggcgcgagcgggggcaggucuucuccgugcugacgcagcugggcgccagcgccacccucgugcggccgcccgacugcaucaagcggucccugcuggagaugaugcucgagagcgcccugaccgacaucaaggaggcgcccgucggggugcuggccucccucacccagcaggcccuguggcugcuccgccugcugcaggacuuccucugcgccgagggccacggcaaccaggagcuguggagcgagaagcuguucgagggggugugcucccugcucgaccggcugggcgccuggccgcaccuggcgaacgggacggccgaccuccgcgagauggcccagaucggccugcggcugguccucggguacauccugcuggaggacccccagcuccacgcccaggccuacgugcgccugcacaugcugcuccagaccgcggugcccgcccggcgcgaggaggccugcuacguccugagcaagcuggaggccgcccucggccgggugcugaacaccuccagccuggaguccgcgaccgacgaggccggcagcccccucgccgccgccgcggccgccgccgcggccgagcgcugcagcuggcuggugccgcugguccggacccuccuggaccgcgccuacgagccccuggggcuccaguggggccugcccucccugcccccgacgaacgggagccccaccuucuucgaggacuuccaggccuucugcgccacccccgaguggcggcacuucaucgacaagcagguccagcccaccaugucccaguucgagauggacacguacgccaagucccacgaccucauguccggcuucuggaacgccugcuacgacaugcugaugagcuccgggcagcgccggcagugggagcgcgcccagagccggcgcgccuuccaggagcuggugcucgagccggcccagcggcgcgcgcgccuggagggccugcgguacaccgccguccucaagcagcaggccacccagcacuccauggcccugcugcacuggggcgcccucuggcgccagcuggcgagccccugcggggccugggcccugcgggacacccccaucccccgcuggaagcucuccagcgccgagacguacucccggaugcgccugaagcuggugccgaaccaccacuucgacccccaccucgaggcgagcgcccugcgggacaaccugggcgaggugccccucacccccaccgaggaggccucccugccgcuggccgucaccaaggaggccaaggugagcacgccgcccgagcuccugcaggaggaccagcugggggaggacgagcucgcggagcuggagaccccgauggaggccgccgagcuggacgagcagcgcgagaagcucgugcuguccgccgagugccagcuggucaccgugguggccgucgugcccggccuccuggaggugaccacgcagaacgucuacuucuacgacgggagcaccgagcggguggagaccgaggagggcaucggcuacgacuuccgccggccccuggcgcagcuccgcgaggugcaccuccgccgcuucaaccugcggcgcuccgcccuggagcuguucuucaucgaccaggccaacuacuuccugaacuuccccugcaaggucgggaccacgccggugagcagccccucccagacgccccggccccagccgggccccaucccgccccacacccaggugcgcaaccaggucuacagcuggcuccugcggcugcgcccgcccucccagggguaccucagcucccgcagcccccaggagaugcugcgggccuccggccugacccagaagugggugcagcgcgagaucagcaacuucgaguaccucaugcagcugaacacgaucgccggccggaccuacaacgaccugucccaguaccccguguucccguggguccuccaggacuacgugagccccacccuggaccuguccaaccccgcggucuuccgcgaccucagcaagcccaucgggguggugaacccgaagcacgcccagcugguccgggagaaguacgaguccuucgaggaccccgccggcaccaucgacaaguuccacuacgggacgcacuacagcaacgccgcgggcgugaugcacuaccugauccgcguggagcccuucaccucccuccacguccagcugcagagcgggcgguucgacugcuccgaccgccaguuccacagcguggccgccgccuggcaggcccggcuggagucccccgcggacgugaaggagcucaucccggaguucuucuacuuccccgacuuccuggagaaccagaacggcuucgaccugggcugccuccagcugaccaacgagaaggucggggacguggugcugccgcccugggccagcagcccggaggacuucauccagcagcaccgccaggcccucgaguccgaguacgucagcgcccaccuccacgaguggaucgaccugaucuucggcuacaagcagcgggggcccgccgcggaggaggcccucaacguguucuacuacugcaccuacgagggcgccguggaccuggaccacgucacggacgagcgcgagcggaaggcccuggaggggaucaucuccaacuucggccagacccccugccagcuccugaaggagccgcaccccacccgccugagcgccgaggaggcggcccaccggcuggcccgccucgacaccaacucccccagcaucuuccagcaccuggacgagcugaaggccuucuucgccgaggugguguccgacggcgucccccucgugcuggcgcuggugccgcaccggcagccccacagcuucaucacgcaggggucccccgaccuccuggucaccgugagcgccuccggccugcucgggacccacagcuggcugcccuacgaccgcaacaucuccaacuacuucagcuucuccaaggacccgaccaugggcagccacaagacccagcggcugcucuccgggcccugggugcccggcagcggcgucagcgggcaggcccuggccguggcgcccgacggcaagcuccucuucuccgggggccacugggacgggagccugcgcgugacggcccugccgcggggcaagcuccugucccagcugagcugccaccucgacgucgugaccugccuggcccuggacacgugcggcaucuaccucaucuccgggagccgcgacaccacgugcaugguguggcgccugcugcaccagggcgggcucuccgucggccuggcccccaagcccguccaggugcuguacggccacggggccgcggugagcugcguggccaucuccaccgagcucgacauggccgugagcggcuccgaggacgggaccgucaucauccacaccgugcggcgcggccaguucguggccgcccugcggccccugggggcgacguucccgggccccaucuuccaccucgcccugggcagcgaggggcagaucgucgugcaguccagcgccugggagcgccccggcgcccaggugaccuacucccugcaccucuacagcgucaacgggaagcugcgggccucccugccccucgcggagcagccgaccgcccugaccgugacggaggacuucgugcugcucggcaccgcccagugcgcccugcacauccugcagcucaacacccugcugcccgcggcgccgccccucccgaugaaggucgccauccgcagcguggccgugaccaaggagcggucccacguccugguggggcuggaggacggcaagcucaucguggucguggccggccagcccagcgagguccgcagcucccaguucgcgcggaagcuguggcgcagcucccggcgcaucagccagguguccagcggggagacggaguacaaccccaccgaggcccgguga

SEQ ID NO: 33402 - RNA, 2265 nt, Artificial Sequence
  derived and/or modified sequence opt1 from NBN__Homo_sapiens__NP_002476
auguggaagcugcuccccgccgccggcccggccgggggcgagcccuaccgccugcugaccgggguggaguacgucgugggccggaagaacugcgcgauccucaucgagaacgaccagagcaucucccgcaaccacgccgugcugaccgccaacuucagcgucacgaaccugucccagaccgacgagauccccgugcucacccugaaggacaacagcaaguacgggaccuucgugaacgaggagaagaugcagaacggcuucucccggacgcucaagagcggcgacgggaucaccuucggcgucuucggguccaaguuccgcaucgaguacgagccccugguggccugcagcuccugccuggacgugagcggcaagaccgcgcugaaccaggccauccuccagcucgggggcuucaccgucaacaacuggacggaggagugcacccaccuggugaugguguccgucaaggugaccaucaagaccaucugcgcccugaucugcggccggccgaucgugaagcccgaguacuucacggaguuccugaaggccgucgagagcaagaagcagccgccccagaucgaguccuucuacccgccccuggacgagcccagcaucggguccaagaacguggaccucagcggccgccaggagcggaagcagaucuucaaggggaagaccuucaucuuccugaacgcgaagcagcacaagaagcuguccagcgccguggucuucggcggcggggaggcccgccucaucaccgaggagaacgaggaggagcacaacuucuuccuggcccccgggaccugcgugguggacacgggcaucaccaacucccagacccugauccccgacugccagaagaaguggauccagagcaucauggacaugcuccagcggcagggccugcgccccauccccgaggccgagaucgggcuggcggucaucuucaugaccacgaagaacuacugcgacccccagggccacccgagcaccggccucaagaccaccacgcccgggcccucccugagccagggcguguccguggacgagaagcugaugcccagcgccccggucaacaccaccaccuacguggccgacacggaguccgagcaggccgacaccugggaccucagcgagcggcccaaggagaucaaggucuccaagauggagcagaaguuccgcaugcugagccaggacgcccccaccgugaaggaguccugcaagaccagcuccaacaacaacagcaugguguccaacacgcuggcgaagaugcggauccccaacuaccagcucagcccgaccaagcugcccuccaucaacaagagcaaggaccgcgccucccagcagcagcagaccaacagcauccggaacuacuuccagcccuccaccaagaagcgcgagcgggacgaggagaaccaggagaugagcagcugcaaguccgcccgcaucgagacgagcugcucccugcucgagcagacccagcccgccaccccgagccuguggaagaacaaggagcagcaccuguccgagaacgagcccgucgacaccaacagcgacaacaaccucuucaccgacacggaccugaaguccaucgugaagaacagcgccuccaagagccacgcggccgagaagcugcgguccaacaagaagcgcgagauggacgacguggccaucgaggacgagguccucgagcagcuguucaaggacaccaagcccgagcuggagaucgacgugaaggugcagaagcaggaggaggacgucaacgugcggaagcgcccgcgcauggacaucgagaccaacgacaccuucagcgacgaggccgugcccgaguccagcaagaucucccaggagaacgagaucgggaagaagcgggagcucaaggaggacagccugugguccgccaaggagaucagcaacaacgacaagcugcaggacgacagcgagaugcuccccaagaagcugcugcugacggaguuccgcucccucgucaucaagaacagcaccucccggaaccccagcggcaucaacgacgacuacgggcagcugaagaacuucaagaaguucaagaaggugaccuacccgggcgcgggcaagcugccccacaucaucgggggcuccgaccucaucgcccaccacgcccgcaagaacaccgagcuggaggaguggcugcggcaggagauggaggugcagaaccagcacgccaaggaggagagccucgcggacgaccuguuccgcuacaaccccuaccugaagcggcgccgguga

SEQ ID NO: 33403 - RNA, 1734 nt, Artificial Sequence
  derived and/or modified sequence opt1 from NBPF3__Homo_sapiens__XP_011540583
augguggucagcgccggccccugguccggggagaaggccgagaugaacauccuggagaucaacaagaagucccgcccgcagcucgcggagaacaagcagcaguuccggaaccugaagcagaagugccuggugacccagguggccuacuuccucgccaaccgccagaacaacuacgacuacgaggacugcaaggaccugaucaagagcaugcugcgggacgagcgccuccugaccgaggagaagcuggccgaggagcucggccaggccgaggagcugcggcaguacaagguccuggugcacagccaggagcgcgagcucacgcagcugcgggagaagcugcaggaggggcgcgacgcgucccggagccucaaccagcaccuccaggcccugcugacccccgacgagcccgacaacucccagggccgcgaccugcgggagcagcuggccgaggggugccgccucgcccagcaccuggugcagaagcugagccccgagaacgacgacgacgaggacgaggacgucaagguggaggaggcggagaaggugcaggagcucuacgccccgcgggagguccagaaggccgaggagaaggaggugcccgaggacucccuggaggagugcgccaucacgugcagcaacucccaccaccccugcgagagcaaccagcccuacggcaacacccgcaucaccuucgaggaggaccagguggacuccacccugaucgacagcuccagccacgacgaguggcucgacgccgucugcaucaucccggagaacgaguccgaccacgagcaggaggaggagaagggccccgugagcccccggaaccugcaggaguccgaggaggaggaggcgccccaggagagcugggacgagggggacuggacccugagcaucccgcccgacauguccgccagcuaccaguccgaccgcagcaccuuccacuccguggaggagcagcaggucggccucgcccuggacaucgggcggcacuggugcgaccaggugaagaaggaggaccaggaggccacgagcccccgccugucccgggagcuccuggacgagaaggagcccgaggugcugcaggacagccucgaccgcuucuacuccaccccguucgaguaccuggagcugcccgaccucugccagcccuaccggagcgacuucuacucccugcaggagcagcaccugggccucgcccuggaccuggaccgcaugaagaaggaccaggaggaggaggaggaccaggggcccccgugcccccgccucagccgggagcugcccgaggucguggagcccgaggaccugcaggacucccucgaccgcugguacagcaccccguucuccuaccccgagcugcccgacagcugccagcccuacggcuccugcuucuacagccuggaggaggagcacgugggcuucucccuggacgucgacgagaucgagaaguaccaggagggggaggaggaccagaagccgcccugcccccggcucaacgaggugcugauggaggcggaggagccggaggugcugcaggacagccucgaccgcugcuacagcaccacguccaccuacuuccagcugcacgccagcuuccagcaguaccgguccgccuucuacagcuucgaggagcaggacgucucccuggcccucgacguggacaaccgcuucuucacccugaccgucauccggcaccaccuggccuuccagaugggcgugaucuucccccacuga

SEQ ID NO: 33404 - RNA, 2814 nt, Artificial Sequence
  derived and/or modified sequence opt1 from NBR1__Homo_sapiens__NP_001278500
auggagccccaggugacccugaacgucaccuucaagaacgagauccagagcuuccucguguccgacccggagaacacgaccugggccgacaucgaggccauggugaaggucagcuucgaccugaacaccauccagaucaaguaccuggacgaggagaacgaggagguguccaucaacagccagggcgaguacgaggaggcgcucaagauggccgugaagcaggggaaccagcugcagaugcagguccacgagggccaccacgugguggacgaggccccgccgcccgucgugggggccaagcgccuggccgcgcgggccggcaagaagccccucgcccacuacuccagccuggugcgcguccugggguccgacaugaagacccccgaggaccccgccgugcagagcuucccccucgugcccugcgacacggaccagccccaggacaagccgcccgacugguucaccuccuaccuggagaccuuccgggagcaggucgugaacgagaccguggagaagcuggagcagaagcuccacgagaagcugguccugcagaaccccagccucggcuccugccccagcgagguguccaugcccacgagcgaggagacccuguuccugcccgagaaccaguucuccuggcacaucgcgugcaacaacugccagcgccggaucgugggcguccgcuaccagugcagccucugcccguccuacaacaucugcgaggacugcgaggccgggcccuacggccacgacaccaaccacgugcugcugaagcuccggcgccccguggucgggagcuccgagcccuucugccacagcaaguacagcaccccgcggcugcccgccgcccuggagcagguccgccuccagaagcaggucgacaagaacuuccugaaggccgagaagcagcggcugcgcgcggagaagaagcagcggaaggccgaggugaaggagcucaagaagcagcugaagcugcaccgcaagauccaccucuggaacuccauccacggccugcagagccccaagagcccccuggggcggccggagucccuccugcaguccaacacgcugaugcucccccugcagcccugcaccagcgugaugcccaugcuguccgccgccuucguggacgagaaccucccggacggcacccaccuccagcccggcaccaaguucaucaagcacuggcgcaugaagaacacggggaacgugaaguggagcgccgacaccaagcugaaguucauguggggcaaccucacccuggcguccaccgagaagaaggacgugcugguccccugccucaaggccgggcacgugggcguggucagcguggaguucaucgccccggcccuggagggcacguacaccucccacuggcggcugagccacaaggggcagcaguucggcccccgcguguggugcuccaucaucgucgaccccuuccccagcgaggaguccccggacaacaucgagaaggggaugaucagcuccagcaagaccgacgaccugaccugccagcaggaggagacguuccugcuggccaaggaggagcggcagcugggcgaggugaccgagcagaccgaggggaccgcggccugcaucccccagaaggccaagaacguggccuccgagcgcgagcucuacauccccagcgucgaccugcugacggcccaggaccuccugagcuucgagcugcucgacaucaacaucgugcaggagcuggagcgggugccccacaacaccccggucgacgugacccccugcaugagcccccugccccacgacuccccgcucaucgagaagcccggccugggccagaucgaggaggagaacgagggggcgggcuucaaggcccugcccgacuccauggugagcgucaagcgcaaggccgagaacaucgccuccguggaggaggcggaggaggaccucagcgggacccaguucgugugcgagacggucauccgcucccugacccuggacgccgcccccgaccacaacccgcccugccggcagaagucccuccagaugaccuucgcccugcccgagggcccccuggggaacgagaaggaggagaucauccacaucgccgaggaggaggcggugauggaggaggaggaggacgaggaggacgaggaggaggaggacgagcucaaggacgaggugcagagccagagcuccgccagcuccgaggacuacaucaucauccugccggagugcuucgacaccagccgcccccugggcgacuccauguacagcuccgcccucagccagcccggccuggagcgcggggccgagggcaagcccggggucgaggccggccaggagccggcggaggccggggagcggcugcccggcggcgagaaccagccccaggagcacagcaucuccgacauccucacgaccagccagacccuggagaccgugccgcugauccccgagguggucgagcucccgcccucccugccccggagcucccccugcgugcaccaccacgggagccccggcguggaccugcccgucaccaucccggagguguccagcgugcccgaccagauccgcggggagccccggggcuccagcggccucgucaacucccgccagaaguccuacgaccacagccggcaccaccacgggagcuccaucgccggcgggcuggugaagggcgcccugagcguggccgcguccgccuacaaggcccucuucgccgggcccccggucacggcgcagggccuguggggccugcucagcuuccugcaccuggccaagaagugcuucuuccucaaggcccccuccgaggccuucagcugguucuga

SEQ ID NO: 33405 - RNA, 582 nt, Artificial Sequence
  derived and/or modified sequence opt1 from NCALD__Homo_sapiens__XP_011515637
augggcaagcagaacagcaagcugcgccccgaggugaugcaggaccuccuggaguccaccgacuucaccgagcacgagauccaggagugguacaagggguuccugcgggacugcccgagcggccaccucuccauggaggaguucaagaagaucuacgggaacuucuuccccuacggcgacgccagcaaguucgccgagcacgucuuccgcacguucgacgcgaacggggacggcaccaucgacuuccgggaguucaucaucgcccuguccgugaccagccgcggcaagcuggagcagaagcucaagugggccuucuccauguacgaccuggacgggaacggcuacaucagcaaggccgagaugcuggagaucgugcaggccaucuacaagauggucuccagcgugaugaagaugcccgaggacgaguccacccccgagaagcggacggagaagaucuuccgccagauggacaccaaccgggacgggaagcucagccuggaggaguucauccgcggcgcgaaguccgacccgagcaucgugcggcugcuccagugcgaccccuccagcgccgggcaguucuga

SEQ ID NO: 33406 - RNA, 2547 nt, Artificial Sequence
  derived and/or modified sequence opt1 from NCAM1__Homo_sapiens__NP_000606
augcugcagaccaaggaccucaucuggacccuguucuuccugggcacggccgugagccuccaggucgacaucgugcccucccagggggagaucagcgugggcgaguccaaguucuuccugugccaggucgccggggacgcgaaggacaaggacaucagcugguucuccccgaacggcgagaagcugacccccaaccagcagcgcaucagcgugguguggaacgacgacuccagcuccacccucaccaucuacaacgccaacaucgacgacgccgggaucuacaagugcgucgugacgggcgaggacggcagcgaguccgaggccaccgugaacgucaagaucuuccagaagcugauguucaagaacgcccccacgccccaggaguuccgggagggggaggacgcggugaucgugugcgacgucgugagcucccugccgcccaccaucaucuggaagcacaagggccgcgacgugauccucaagaaggacguccgguucaucgugcugagcaacaacuaccugcagauccgcgggaucaagaagaccgacgagggcaccuaccggugcgaggggcgcauccucgcccggggcgagaucaacuucaaggacauccaggugaucgucaacgugccgcccaccauccaggcccgccagaacaucgugaacgccaccgcgaaccugggccaguccgucacgcuggugugcgacgccgagggguuccccgagcccaccaugagcuggaccaaggacggcgagcagaucgagcaggaggaggacgacgagaaguacaucuucuccgacgacagcucccagcucaccaucaagaagguggacaagaacgacgaggccgaguacaucugcaucgccgagaacaaggccggggagcaggacgcgacgauccaccugaaggucuucgccaagcccaagaucaccuacguggagaaccagaccgccauggagcuggaggagcaggucacccucacgugcgaggccagcggcgaccccaucccgagcaucaccuggcggaccuccacccgcaacaucagcuccgaggagaagacgcuggacggccacaugguggugcggagccacgcccgcgucuccagccugacccucaaguccauccaguacaccgacgcgggggaguacaucugcaccgccagcaacacgaucggccaggacucccagagcauguaccuggaggugcaguacgcccccaagcugcaggggcccguggccgucuacaccugggagggcaaccaggugaacaucacgugcgagguguucgccuaccccuccgcgaccaucagcugguuccgggacgggcagcuccugccguccagcaacuacuccaacaucaagaucuacaacacccccagcgccuccuaccuggaggucacccccgacagcgagaacgacuucggcaacuacaacugcaccgccgugaaccgcaucggccaggagucccucgaguucauccuggugcaggccgacacccccagcagcccguccaucgaccaggucgagcccuacagcuccacggcccaggugcaguucgacgagcccgaggcgaccgggggcgugcccauccugaaguacaaggccgaguggcgggccgucggggaggagguguggcacagcaagugguacgacgccaaggaggcguccauggagggcaucgugaccaucgucgggcucaagccggagaccaccuacgccgugcgccuggccgcccugaacggcaagggccucggggagaucagcgccgcguccgaguucaagacgcagcccgugcagggcgagcccagcgcccccaagcuggaggggcagaugggcgaggacgggaacuccaucaaggucaaccugaucaagcaggacgacggcggcagcccgauccggcacuaccucgugcgcuaccgggcccuguccagcgaguggaagcccgagauccgccugcccuccgggagcgaccacgugaugcucaagucccuggacuggaacgccgaguacgaggucuacgugguggccgagaaccagcagggcaagagcaaggcggcccacuucgucuuccggaccuccgcccagccgaccgccauccccgccaacgggagccccaccagcggccuguccacgggcgcgaucguggggauccucaucgugaucuucguccugcugcucgugguggucgacaucacgugcuacuuccugaacaagugcggccuguucaugugcaucgccgugaaccucugcgggaaggccggccccggggccaagggcaaggacauggaggagggcaaggcggccuucagcaaggacgaguccaaggagccgaucguggagguccgcaccgaggaggagcgcacccccaaccacgacgggggcaagcacaccgagcccaacgagaccacgccccugaccgagccggagaaggggcccguggaggccaagcccgagugccaggagaccgagaccaagcccgccccggccgaggugaagaccguccccaacgacgcgacccagacgaaggagaacgagagcaaggccuga

SEQ ID NO: 33407 - RNA, 2514 nt, Artificial Sequence
  derived and/or modified sequence opt1 from NCAM2__Homo_sapiens__NP_004531
augagccugcuccuguccuucuaccugcucggccugcuggugagcuccgggcaggcccuccugcaggucaccaucagccuguccaagguggagcucagcgugggcgaguccaaguucuucacgugcaccgccaucggggagcccgagagcaucgacugguacaacccgcagggcgagaagaucaucuccacccagcgcgucguggugcagaaggaggggguccggagccgccugaccaucuacaacgcgaacaucgaggacgccggcaucuaccggugccaggccaccgacgccaagggccagacgcaggaggccaccguggugcuggagaucuaccagaagcucaccuuccgcgaggucgugagcccccaggaguucaagcagggggaggacgcggagguggucugccgggugagcuccagccccgcccccgccguguccuggcuguaccacaacgaggaggucaccacgaucagcgacaaccgcuucgccaugcuggcgaacaacaaccuccagauccugaacaucaacaaguccgacgagggcaucuaccggugcgaggggcgcguggaggcccggggcgagaucgacuuccgcgacaucaucgugaucgucaacgugccgcccgccaucagcaugccccagaaguccuucaacgccaccgccgagcgcggggaggagaugaccuucagcugccgggcgagcggcucccccgagccggccaucagcugguuccggaacggcaagcugaucgaggagaacgagaaguacauccucaagggguccaacaccgagcugacggugcgcaacaucaucaacagcgacggcgggcccuacgucugccgggccaccaacaaggccggcgaggacgagaagcaggccuuccuccagguguucgugcagccccacaucauccagcugaagaacgagaccaccuacgagaacggccaggucacgcuggugugcgacgcggagggggagcccaucccggagaucaccuggaagcgcgccgucgacggcuucaccuucaccgagggggacaagucccuggacggccggaucgaggugaaggggcagcacggcagcuccagccuccacaucaaggacgugaagcuguccgacagcggccgcuacgacugcgaggccgccucccggaucgggggccaccagaaguccauguaccuggacaucgaguacgcccccaaguucaucuccaaccagacgaucuacuacagcugggaggggaaccccaucaacaucuccugcgacgucaagagcaacccgcccgcguccauccacuggcgccgggacaagcucgugcugcccgccaagaacaccaccaaccugaagaccuacagcacgggccgcaagaugauccucgagaucgcccccaccuccgacaacgacuucgggcgcuacaacugcaccgccaccaaccacaucggcacgcgguuccaggaguacauccuggcccuggcggacgugcccagcagcccguacggcgucaagaucaucgagcucucccagaccaccgccaaggugagcuucaacaagcccgacucccacgggggcgugcccauccaccacuaccaggucgacgugaaggagguggccagcgagaucuggaagaucguccgcucccacggggugcagaccauggugguccugaacaaccuggagcccaacacgaccuacgagauccggguggccgcggugaacggcaaggggcagggcgacuacagcaagaucgagaucuuccagacccucccgguccgcgagcccuccccgcccagcauccacggccagcccuccagcgggaaguccuucaagcugagcaucaccaagcaggacgacggcggggcccccauccuggaguacaucgugaaguaccgguccaaggacaaggaggaccaguggcucgagaagaaggugcagggcaacaaggaccacaucauccuggagcaccuccaguggacgaugggcuacgagguccagaucaccgccgccaaccgccugggguacagcgagcccaccguguacgaguucuccaugccgcccaagcccaacaucaucaaggacacccuguucaacggccuggggcucggcgccgugaucgggcugggcgucgcggcccugcuccugauccugguggugaccgacgucagcugcuucuucauccggcagugcggccugcucaugugcaucacgcgccggaugugcgggaagaaguccggcagcagcgggaaguccaaggagcuggaggagggcaaggccgccuaccugaaggacgggagcaaggagcccaucguggagaugcgcaccgaggacgagcgggugaccaaccacgaggacggcuccccggucaacgagcccaacgagaccacgccccucaccgagcccgagaagcugccgcugaaggaggaggacggcaaggaggcccucaaccccgagaccaucgagaucaaggugagcaacgacaucauccaguccaaggaggacgacagcaaggcguga

SEQ ID NO: 33408 - RNA, 3966 nt, Artificial Sequence
  derived and/or modified sequence opt1 from NCAN__Homo_sapiens__NP_004377
augggcgcccccuucgugugggcccuggggcuccugaugcugcagaugcuccuguucgucgcgggcgagcaggggacccaggacaucaccgacgccagcgagcgcggccugcacaugcagaagcucggguccggcagcgugcaggccgcccuggccgagcugguggcgcucccgugccuguucacgcugcagccccggcccuccgccgcccgcgacgcgccccggaucaaguggaccaagguccgcaccgcgagcggccagcggcaggaccucccgauccugguggccaaggacaacgugguccgcguggccaaguccuggcaggggcgggugagccugcccuccuacccccgccggcgcgccaacgccacccuccugcugggcccccuccgggcgagcgacuccgggcuguaccgcugccaggucgugcggggcaucgaggacgagcaggaccuggugccgcucgaggucacgggggugguguuccacuaccgcagcgcccgggaccgcuacgcccugaccuucgccgaggcccaggaggcgugccggcuguccagcgccaucaucgccgcgccccgccaccuccaggccgccuucgaggacggcuucgacaacugcgacgccggcuggcuguccgaccggaccguccgcuaccccaucacccagagccggcccgggugcuacggcgaccgcuccagccugccgggggugcgcuccuacggccggcgcaacccccaggagcucuacgacguguacugcuucgcccgggagcugggcggggaggucuucuacgugggccccgcccgccggcugacgcucgccggggcgcgcgcccagugccggcgccagggcgccgcccuggcgagcguggggcagcugcaccucgccuggcacgagggccuggaccagugcgaccccggcuggcuggccgacggguccguccgguacccgauccagacgccccgccggcgcugcggcgggcccgcccccggcgugcggaccguguaccgcuucgccaaccggaccggguucccgagccccgcggagcgcuucgacgccuacugcuuccgggcccaccaccccaccagccagcacggcgaccucgagacccccuccagcggcgacgagggggagauccuguccgccgagggcccgcccguccgcgagcuggagcccacccucgaggaggaggagguggucacccccgacuuccaggagccgcuggugagcuccggggaggaggagacgcugauccucgaggagaagcaggagagccagcagacccugucccccacccccggcgacccgaugcuggccagcuggcccaccggggagguguggcucuccacggucgcgcccagccccuccgacaugggcgccggcaccgccgccagcucccacaccgagguggccccgaccgaccccaugccccggcgccgcgggcgguucaagggccugaacgggcgcuacuuccagcagcaggagcccgagccgggccugcagggcgggauggaggcgagcgcccagccgcccacguccgaggccgccgugaaccagauggagccgccccucgcgauggccgucaccgagaugcugggcagcgggcagucccggagccccugggccgaccugaccaacgagguggacaugcccggcgccggguccgccggcggcaagagcagccccgagcccuggcuguggccgcccaccauggugccgcccuccaucagcgggcacucccgcgcgcccguccucgagcuggagaaggccgagggccccagcgcccggcccgccacgcccgaccuguucuggagcccccucgaggccaccguguccgcgcccuccccggcccccugggaggccuuccccguggccaccagccccgaccugccgaugauggccaugcugcgcgggcccaaggaguggaugcucccccaccccaccccgaucuccacggaggcgaaccgggucgaggcccacggcgaggccaccgccaccgcgccgcccagccccgccgccgagaccaagguguacucccugccccugagccucacgcccaccgggcagggcggcgaggccaugcccaccacccccgaguccccgcgcgccgacuuccgggagaccggggagacgagccccgcccaggugaacaaggccgagcacuccagcuccagccccuggcccagcgucaaccgcaacguggccgugggcuucgucccgaccgagaccgccaccgagcccacggggcugcggggcauccccggguccgagagcggcguguucgacaccgccgagucccccaccagcggccugcaggcgaccguggacgagguccaggacccguggcccuccguguacagcaaggggcucgacgccuccagccccuccgcgccccugggcagcccggggguguuccugguccccaaggugacgcccaaccucgagccguggguggccaccgacgagggccccaccgucaaccccauggacuccaccgugacgcccgccccgagcgacgccuccgggaucugggagcccggcagccagguguucgaggaggccgaguccaccacccugagcccccaggucgcccuggacaccuccaucgugacgccccucaccacccuggagcagggcgacaaggugggggucccggccaugagcacccugggcuccagcagcucccagccccaccccgagcccgaggaccagguggagacgcaggggaccagcggcgccuccgugccgccccaccagagcagcccccucggcaagcccgcggucccgcccgggacccccaccgccgccuccgugggcgaguccgccagcguguccagcggggagcccacggucccgugggaccccuccagcacccugcugcccgugacccucggcaucgaggacuucgagcuggaggugcuggcggggucccccggcgucgagagcuucugggaggagguggccuccggcgaggagccggcccuccccgggacccccaugaacgccggcgccgaggaggugcacagcgaccccugcgagaacaacccgugccugcacgggggcacgugcaacgcgaacgggaccauguacggcugcuccugcgaccagggcuucgccggggagaacugcgagaucgacaucgacgacugccugugcagccccugcgagaacggcgggaccugcaucgacgaggucaacggcuucgugugccucugccugcccuccuacgggggcagcuucugcgagaaggacaccgagggcugcgaccgcggguggcacaaguuccagggccacugcuaccgguacuucgcccaccgccgggccugggaggacgccgagaaggacugccgccggcgcagcgggcaccugacguccgugcacagcccggaggagcacuccuucaucaacagcuucggccacgagaacaccuggaucggccucaacgaccggaucgucgagcgcgacuuccaguggaccgacaacaccgggcugcaguucgagaacuggcgggagaaccagcccgacaacuucuucgcgggcggggaggacugcguggugauggucgcccacgaguccggccgcuggaacgacgugcccugcaacuacaaccugcccuacgucugcaagaaggggacggugcucugcggcccgccgcccgccguggagaacgccagccugaucggcgcccgcaaggcgaaguacaacguccacgccaccgugcgguaccagugcaacgagggguucgcccagcaccacguggccaccauccgcugccgguccaacggcaagugggaccgcccccagaucgucugcaccaagccccggcgcagccaccggaugcgccggcaccaccaccaccaccagcaccaccaccagcaccaccaccacaagucccgcaaggagcggcgcaagcacaagaagcaccccaccgaggacugggagaaggacgaggggaacuucugcuga

SEQ ID NO: 33409 - RNA, 4206 nt, Artificial Sequence
  derived and/or modified sequence opt1 from NCAPD2__Homo_sapiens__NP_055680
auggcgccccagauguacgaguuccaccucccgcucagccccgaggagcugcugaaguccggcggggugaaccaguacgucgugcaggaggugcucagcaucaagcaccucccgccccagcugcgcgccuuccaggccgccuuccgggcccagggcccccuggccaugcugcagcacuucgacaccaucuacuccauccugcaccacuuccgcagcaucgaccccgggcucaaggaggacacccugcaguuccugaucaaggucgugucccggcacagccaggagcuccccgccauccuggacgacacgacccuguccggcagcgaccgcaacgcgcaccucaacgcccugaagaugaacugcuacgcccugauccggcuccuggaguccuucgagaccauggccagccagaccaaccugguggaccucgaccucgggggcaagggcaagaaggcgcgcacgaaggccgcccacggguucgacugggaggaggagcggcagcccauccugcagcugcugacccagcugcuccagcuggacauccgccaccuguggaaccacuccaucaucgaggaggaguucgucagccucgugaccggcugcugcuaccggcugcuggagaacccgaccaucaaccaccagaagaaccgccccacgcgggaggccaucacccaccuccuggggguggcccugacccgcuacaaccacaugcucuccgcgaccgucaagaucauccagaugcugcagcacuucgagcaccuggcccccgugcucguggccgccgucagccugugggccacggacuacggcaugaaguccaucgugggggagaucgugcgggagaucggccagaagugcccccaggagcugagccgcgacccguccggcaccaagggguucgcggccuuccucaccgagcuggccgagcggguccccgccauccugaugagcuccaugugcauccuccuggaccaccuggacggcgagaacuacaugaugcgcaacgccgugcucgcggccauggccgagauggugcugcagguccugagcggggaccagcuggaggccgccgcgcgggacacccgcgaccaguuccucgacacgcugcaggcccacggccacgacgugaacagcuucgugcggucccgcguccugcagcuguucacccggaucgugcagcagaaggcccugccccugacccgcuuccaggccguggucgcgcucgccgugggccgccuggccgacaagagcguccuggugugcaagaacgccauccagcuccuggccuccuuccuggcgaacaaccccuucagcugcaagcucuccgacgccgaccuggccgggccgcugcagaaggagacccagaagcuccaggagaugcgggcccagcgccggacggccgcggccagcgccgugcuggaccccgaggaggagugggaggccaugcugcccgagcucaaguccacccugcagcagcugcuccagcugccccagggcgaggaggagaucccggagcagaucgccaacaccgagaccacggaggacgucaaggggcgcaucuaccagcugcucgcgaaggccagcuacaagaaggccaucauccugacccgggaggccaccggccacuuccaggaguccgagcccuucagccacaucgaccccgaggaguccgaggagacccgccugcucaacauccuggggcugaucuucaagggccccgcggccagcacgcaggagaagaacccgcgggaguccaccggcaacauggugaccgggcagaccgugugcaagaacaagcccaacaugagcgaccccgaggagucccgcggcaacgacgagcucgucaagcaggagaugcuggugcaguaccugcaggacgccuacagcuucucccggaagaucacggaggccaucgggaucaucagcaagaugauguacgagaacaccaccaccgugguccaggaggugaucgaguucuucgugauggucuuccaguucggcgugccccaggcccucuucggggugcgccggaugcugccgcugaucugguccaaggagcccggcguccgcgaggcggugcucaacgccuaccggcagcuguaccugaaccccaagggcgacagcgcccgcgccaaggcccaggcgcucauccagaaccugagccugcuccugguggacgccuccgucgggacgauccagugccuggaggagauccucugcgaguucgugcagaaggacgagcugaagccggccgugacccagcugcucugggagcgggccaccgagaaggucgccugcugcccccuggagcgcugcagcuccgugaugcugcucggcaugauggcgcgggggaagcccgagaucgugggcagcaaccuggacacccuggucuccaucgggcucgacgagaaguucccccaggacuaccgccuggcccagcaggucugccacgccaucgccaacaucagcgaccggcgcaagccgucccugggcaagcgccacccgcccuuccggcucccccaggagcaccgccuguucgagcggcugcgcgagaccgugacgaagggcuucgugcaccccgacccccucuggauccccuucaaggagguggcggugacccugaucuaccagcuggccgaggggcccgaggucaucugcgcccagauccuccagggcugcgccaagcaggcccuggagaagcuggaggagaagcggaccagccaggaggacccgaaggagucccccgcgaugcuccccaccuuccugcugaugaaccuccugagccuggccggggacguggcccuccagcagcuggugcaccuggagcaggccgucuccggcgagcucugccgccggcgcgugcugcgggaggagcaggagcacaagacgaaggaccccaaggagaagaacaccagcuccgagaccaccauggaggaggagcugggccucgugggggccacggcggacgacaccgaggccgagcugauccgcggcaucugcgagauggagcugcucgacgggaagcagacccuggccgccuucgucccgcugcuccugaaggugugcaacaaccccggccuguacagcaaccccgaccucuccgccgcggccagccuggcccuggggaaguucugcaugaucuccgccaccuucugcgacagccagcuccggcugcuguucacgaugcucgagaaguccccgcugcccaucgugcgcagcaaccugauggucgccaccggcgaccuggcgauccgguuccccaaccucguggaccccuggacgccccaccuguacgcccgccugcgggacccggcccagcagguccgcaagaccgccggccucgugaugacccaccugauccugaaggacauggugaaggugaaggggcaggucagcgagauggcggugcuccugaucgaccccgagccccagaucgccgcccuggccaagaacuucuucaacgagcucucccacaagggcaacgccaucuacaaccugcugccggacaucaucagccggcucuccgaccccgagcuggggguggaggaggagcccuuccacaccaucaugaagcagcugcucagcuacaucaccaaggacaagcagaccgagucccuggucgagaagcugugccagcgcuuccggacgagccgcaccgagcggcagcagcgcgaccucgcguacugcgugucccagcugccccugaccgagcgcggccuccggaagaugcuggacaacuucgacugcuucggggacaagcugagcgacgaguccaucuucagcgccuuccucuccguggucggcaagcugcgccggggcgccaagccggaggggaaggccaucaucgacgaguucgagcagaagcugcgcgccugccacacccggggccucgacgggaucaaggagcuggagaucggccaggcggggagccagcgcgcccccuccgccaagaagcccagcacgggcucccgguaccagccccuggccagcaccgccuccgacaacgacuucgugaccccggagccccgccggaccacgcgccggcaccccaacacccagcagcgcgcgagcaagaagaagcccaaggucguguucagcuccgacgagagcuccgaggaggaccucagcgccgagaugaccgaggacgagaccccgaagaagacgacccccauccugcgggccuccgcccgccggcaccgcagcuga

SEQ ID NO: 33410 - RNA, 4497 nt, Artificial Sequence
  derived and/or modified sequence opt1 from NCAPD3__Homo_sapiens__NP_056076
augguggcccugcgcggccucgggagcggccugcagcccuggugcccgcuggaccuccggcuggagugggucgacaccgugugggagcuggacuucaccgagacggagccccucgaccccuccaucgaggccgagaucaucgagaccgggcuggcggccuucaccaagcuguacgagagccuccugcccuucgccaccggcgagcacggguccauggagagcaucuggacguucuucaucgagaacaacgugucccacagcacccuggucgcccucuucuaccacuucgugcagaucgugcacaagaagaacgucuccgugcaguaccgcgaguacggccugcacgccgcgggccuguacuuccuccugcuggaggugccggggagcgucgccaaccagguguuccaccccgugauguucgacaagugcauccagacccucaagaaguccuggccccaggagagcaaccugaaccggaagcgcaagaaggagcagcccaaguccagccaggccaacccgggccggcaccgcaagcgggggaagccgccccgccgggaggacaucgagauggacgagaucaucgaggagcaggaggacgagaacaucugcuucuccgcccgcgaccugagccagauccggaacgcgaucuuccaccuccugaagaacuuccugcgccuccugcccaaguucucccugaaggagaagccccagugcguccagaacugcaucgagguguucgugagccucaccaacuucgagcccguccugcacgagugccacgugacgcaggcccgggcccugaaccaggccaaguacauccccgagcucgccuacuacggccuguaccugcucugcucccccauccacggggagggcgacaaggugaucagcugcgucuuccaccagaugcuguccgugauccugaugcucgaggugggcgaggggagccaccgcgcgccgcuggccgucaccagccaggugaucaacugccggaaccaggccgugcaguucaucuccgcccuggucgacgagcucaaggagagcaucuuccccgugguccgcauccugcugcagcacaucugcgccaaggugguggacaaguccgaguaccggaccuucgcggcccagagccucguccagcugcuguccaagcuccccugcggcgaguacgccauguucaucgccuggcuguacaaguacagccgcuccagcaagaucccccaccggguguucacccuggacgugguccucgcccugcuggagcugccggagcgcgagguggacaacacgcucucccuggagcaccagaaguuccugaagcacaaguuccucgugcaggagaucauguucgaccggugccuggacaaggcgcccaccguccgcagcaaggcccuguccagcuucgcccacugccucgagcugaccgugaccuccgccagcgaguccauccuggagcuccugaucaacagccccacguucuccgugaucgagagccaccccgggacccugcuccgcaacuccagcgccuucagcuaccagcggcagaccuccaaccgcagcgagccguccggcgagaucaacaucgacagcuccggcgagaccgucgggagcggcgagcggugcgugauggcgaugcugcgccggcgcauccgggacgagaagacgaacgugcgcaaguccgcccugcagguccucgugagcauccugaagcacugcgacguguccgggaugaaggaggaccuguggauccuccaggaccagugccgggaccccgccgucagcgugcgcaagcaggcccugcagucccugaccgagcuccugauggcgcagccccggugcgugcagauccagaaggccuggcugcgcggcgucgugcccguggucauggacugcgagagcaccgugcaggagaaggcccucgaguuccuggaccagcugcuccugcagaacauccggcaccacucccacuuccacagcggggacgacucccaggugcuggccugggcccuccugacccugcucacgaccgagagccaggagcugucccgcuaccugaacaaggcguuccacaucuggagcaagaaggagaaguucagcccgaccuucaucaacaacgucaucucccacaccggcacggagcacagcgcccccgccuggaugcuccuguccaagaucgccggcagcagcccccggcuggacuacagccgcaucauccaguccugggagaagaucagcucccagcagaacccgaacagcaacacccucgggcacauccugugcgugaucggccacaucgccaagcaccuccccaaguccacccgggacaaggugaccgacgcggucaagugcaagcugaacggguuccaguggagccuggaggugaucuccagcgccguggacgcccugcagcgccucugccgggccuccgccgagacgcccgcggaggagcaggagcugcugacccaggucugcggcgacgugcucagcacgugcgagcaccgccuguccaacaucgugcugaaggagaacgggaccggcaacauggacgaggaccuccuggucaaguacaucuucacccugggcgacaucgcccagcucugccccgcccgcguggagaagcggaucuuccugcugauccagagcgugcucgccuccagcgcggacgccgaccacagcccguccagccagggguccagcgaggcccccgccucccagcccccgccccagguccgcggcagcgugaugcccuccgugauccgggcccacgcgaucaucacccuggggaagcugugccuccagcacgaggaccuggccaagaaguccauccccgcccugguccgcgagcucgaggugugcgaggacguggccguccggaacaacgugaucaucgugaugugcgaccugugcauccgcuacaccaucauggucgacaaguacauccccaacaucuccaugugccugaaggacagcgacccguucauccggaagcagacccucauccugcugaccaaccuccugcaggaggaguucgugaaguggaagggcucccuguucuuccgcuucgugagcacgcucaucgacucccaccccgacaucgccagcuucggggaguucugccuggcgcaccuccugcugaagcggaaccccgucauguucuuccagcacuucaucgagugcaucuuccacuucaacaacuacgagaagcacgagaaguacaacaaguucccccaguccgagcgcgagaagcggcuguucagccucaagggcaaguccaacaaggagcgccggaugaagaucuacaaguuccugcuggagcacuucaccgacgagcagcgcuucaacaucaccagcaagaucugccucuccauccuggccugcuucgccgacggcauccugccgcucgaccuggacgccagcgagcugcucagcgacaccuucgaggugcuguccagcaaggagaucaagcugcucgccaugcgguccaagcccgacaaggaccugcugauggaggaggacgacauggcgcucgccaacgucgugaugcaggaggcccagaagaagcugaucagccaggugcagaagcgcaacuucaucgagaacaucauccccaucaucaucucccugaagacgguccuggagaagaacaagauccccgcccuccgggagcugaugcacuaccugcgcgaggugaugcaggacuaccgggacgagcucaaggacuucuucgcgguggacaagcagcuggccagcgagcuggaguacgacaugaagaaguaccaggagcagcucguccaggagcaggagcuggccaagcacgccgacguggccgggaccgcgggcggggccgagguggccccggucgcccagguggcccugugccucgagaccgugcccguccccgcgggccaggagaaccccgccauguccccggccgugagccagcccugcacgccccgcgccuccgccggccacguggcggucagcuccccgacccccgagaccgggccccugcagcggcugcuccccaaggcccgcccgaugagccuguccaccaucgccauccugaacagcgugaagaaggccguggaguccaagagccgccaccggucccgcagccucggcguccugcccuucacccugaacuccgggagccccgagaagacgugcagccagguguccagcuacucccucgagcaggagagcaacggcgagaucgagcacgugaccaagcgggccaucuccacccccgagaaguccaucagcgacgucaccuucggggcgggcgugagcuacaucggcacgccgcgcacccccuccagcgccaaggagaagaucgaggggcggucccagggcaacgacauccugugccugagccuccccgacaagcccccgccccagccccagcaguggaacgugcgcucccccgcccggaacaaggacaccccggccugcagccgccggucccugcgcaagacgccccugaagaccgcgaacuga

SEQ ID NO: 33411 - RNA, 3432 nt, Artificial Sequence
  derived and/or modified sequence opt1 from NCAPG2__Homo_sapiens__NP_001268861
auggagaagcgcgagaccuucgugcaggccgucagcaaggagcuggugggcgaguuccuccaguucgugcagcuggacaaggaggccuccgaccccuucagccugaacgagcuccuggacgagcugucccggaagcagaaggaggagcucuggcagcgccugaagaaccugcucaccgacguccugcuggagagccccguggacggguggcaggucguggaggcgcagggcgaggacaacauggagacggagcacggguccaagaugcgcaagagcaucgagaucaucuacgccaucaccuccgugauccucgccagcguguccgucaucaacgagagcgagaacuacgaggcccugcuggagugcgugaucauccucaacggcauccuguacgcccugcccgaguccgagcggaagcuccagagcuccauccaggaccugugcgugaccuggugggagaaggggcugcccgcgaaggaggacaccggcaagacggccuucgucaugcuccugcggcgcagccuggagaccaagaccggcgccgacgugugccggcucuggcgcauccaccaggcccuguacugcuucgacuacgaccuggaggaguccggggagaucaaggacaugcuccuggagugcuucaucaacaucaacuacaucaagaaggaggagggccggcgcuuccugagcugccucuucaacuggaacaucaacuucaucaagaugauccacgggaccaucaagaaccagcugcagggccugcagaagucccucaugguguacaucgcggagaucuacuuccgggccuggaagaaggccagcgggaagauccuggaggccaucgagaacgacugcauccaggacuucauguuccacggcauccaccucccccgccgguccccgguccacagcaaggugcgcgaggugcucagcuacuuccaccaccagaagaagguccggcagggcguggaggagaugcuguaccgccuguacaagcccauccucuggcgggggcugaaggcccgcaacuccgaggugcggagcaacgcggcccugcuguucgucgaggccuuccccauccgcgaccccaaccugcacgccaucgagauggacuccgagauccagaagcaguucgaggagcuguacagccuccuggaggacccguaccccauggugcgguccacgggcauccugggggugugcaagaucaccagcaaguacugggagaugaugccgcccaccauccucaucgaccugcugaagaaggucaccggcgagcuggccuucgacacguccagcgcggacgugcgcugcuccgucuucaagugccuccccaugauccuggacaacaagcugagccacccccuccuggagcagcugcuccccgcccugcgcuacucccugcacgacaacagcgagaaggugcggguggccuucgucgacaugcuccugaagaucaaggccgugcgcgccgcgaaguucuggaagaucugccccauggagcacauccuggugcggcucgagaccgacucccgcccggucagccggcgccuggugucccugaucuucaacagcuuccuccccgugaaccagcccgaggaggucuggugcgagcggugcgugacccuggugcagaugaaccacgccgccgcccgccgguucuaccaguacgcccacgagcacaccgcgugcacgaacaucgccaagcugauccacgucauccgccacugccucaacgccugcauccagcgggccgugcgcgagcccccggaggacgaggaggaggaggacggccgggagaaggagaacgugaccguccuggacaagacccuguccgugaacgacguggcgugcauggccgggcuccuggagaucaucgucauccuguggaaguccaucgaccgcagcauggagaacaacaaggaggccaagcucuacaccaucaacaaguucgccagcgugcugcccgaguaccugaagguguucaaggacgaccggugcaagaucccccucuucaugcugaugagcuucaugcccgccuccgcggucccgcccuucagcugcggcgugaucuccacgcugcgcagccgggaggagggggccguggacaaguccuacugcacccuccuggacugccugugcagcuggggccaggucgggcacauccucgagcugguggacaacuggcugcccaccgagcacgcccaggccaaguccaacaccgccagcaagggccgcgugcagauccacgacacgcggcccgucaagccggagcucgcgcugguguacaucgaguaccugcucacccaccccaagaaccgcgagugccugcuguccgcgccccgcaagaagcucaaccaccuccugaaggcccuggagaccagcaaggccgaccuggagucccugcuccagaccccgggcgggaagccccggggcuucagcgaggccgccgcgccccgcgccuucgggcugcacugccggcuguccauccaccuccagcacaaguucugcagcgagggcaagguguaccuguccaugcuggaggacacgggguucuggcucgagagcaagauccuguccuucauccaggaccaggaggaggacuaccugaagcuccaccgcgucaucuaccagcagaucauccagaccuaccugaccgugugcaaggacguggucauggugggccugggcgaccaccaguuccagaugcagcuccugcagcggagccuggggaucaugcagaccgugaagggcuucuucuacgucagccuccugcuggacauccucaaggagaucacgggguccagccugauccagaagaccgacuccgacgaggagguggccaugcugcucgacaccgugcagaaggucuuccagaagaugcuggagugcaucgcccgcagcuuccggaagcagcccgaggagggccugcgccuccuguacuccgugcagcggccgcugcacgaguucaucaccgccgugcagagccgccacacggacacccccguccaccgcggggugcucuccacccugaucgccggccccguggucgagaucagccaccagcugcggaagguguccgacguggaggagcucacgcccccggagcaccugagcgaccugccgcccuucucccggugccucaucggcaucaucaucaagagcuccaacgucgugcgcagcuuccuggacgagcugaaggccugcguggccuccaacgacaucgaggggaucgucugccucaccgcggccgugcacaucauccuggucaucaacgccggcaagcacaagagcuccaaggugcgggagguggccgccaccguccaccgcaagcugaagaccuucauggagaucacccucgaggaggacagcaucgagcgguuccuguacgaguccagcagccgcacccugggggagcuccugaacuccuga

SEQ ID NO: 33412 - RNA, 3048 nt, Artificial Sequence
  derived and/or modified sequence opt1 from NCAPG__Homo_sapiens__NP_071741
augggcgccgagcgccggcugcucagcaucaaggaggccuuccgccuggcgcagcagccccaccagaaccaggccaagcugguggucgcccucucccggaccuaccgcaccauggacgacaagacgguguuccacgaggaguucauccacuaccugaaguacgugauggucguguacaagcgggagccggccguggagcgcgucaucgaguucgccgcgaaguucgugaccagcuuccaccaguccgacauggaggacgacgaggaggaggaggacgggggccugcucaacuaccuguucaccuuccugcucaagagccacgaggccaacuccaacgccgugcgguuccgcgucugccugcugaucaacaagcuccuggggagcaugcccgagaacgcccagaucgacgacgacguguucgacaagaucaacaaggcgaugcugauccggcucaaggacaagauccccaacgugcgcauccaggccguccuggcccugucccggcuccaggaccccaaggacgacgagugcccgguggugaacgccuacgccacccugaucgagaacgacagcaaccccgagguccgccgggcggugcuguccugcaucgcccccagcgccaagacgcuccccaagaucgugggccgcaccaaggacgucaaggaggccgugcggaagcuggccuaccaggugcuggcggagaagguccacaugcgcgccauguccaucgcccagcgggugaugcuccugcagcaggggcugaacgaccgcagcgacgccgugaagcaggccaugcagaagcaccuccugcagggcuggcugcgguucuccgagggcaacauccucgagcugcugcaccgccucgacgucgagaacagcuccgagguggcggucagcgugcugaacgcccuguucuccaucaccccgcucagcgagcugguggggcugugcaagaacaacgacggccggaagcucauccccgucgagacccugacgcccgagaucgcccuguacuggugcgcccucugcgaguaccugaaguccaagggggacgagggcgaggaguuccuggagcagauccuccccgagccggugguguacgccgacuaccugcugagcuacauccagagcauccccgucgugaacgaggagcaccgcggggacuucuccuacaucggcaaccucaugaccaaggaguucaucggccagcagcugauccugaucaucaagagccuggacaccuccgaggagggcgggcgcaagaagcuccuggcggugcugcaggagauccucauccugcccaccauccccaucagccuggucuccuuccucguggagcggcugcugcacaucaucaucgacgacaacaagcgcacgcagaucgugaccgagaucaucagcgagauccgggccccgaucgucaccgugggggugaacaacgaccccgccgacguccgcaagaaggagcucaagauggccgagaucaaggugaagcugaucgaggcgaaggaggcccuggagaacugcaucacccuccaggacuucaaccgggccuccgagcugaaggaggagaucaaggcccuggaggacgcccgcaucaaccuccugaaggagacggagcagcuggagaucaaggaggugcacaucgagaagaacgacgcggagacccuccagaagugccugauccugugcuacgagcuccugaagcagaugagcaucuccaccggccugagcgccaccaugaacggcaucaucgagucccucauccugcccgggaucaucagcauccaccccgucgugcggaaccuggccgugcucugccugggcugcugcgggcugcagaaccaggacuucgcccgcaagcacuucguccuccugcuccaggugcugcagaucgacgacgugacgaucaagaucuccgcccugaaggcgaucuucgaccagcugaugaccuucggcaucgagccguucaagaccaagaagaucaagacccuccacugcgaggggacggagaucaacagcgacgacgagcaggaguccaaggaggucgaggagaccgccaccgccaagaacgugcugaagcugcucagcgacuuccuggacuccgaggugagcgagcugcggaccggcgccgccgagggccucgcgaagcugauguucuccgggcugcucgucagcagccgcauccugucccggcugauccuccugugguacaaccccgugacggaggaggacgugcagcugcgccacugccucggcgucuucuuccccguguucgccuacgccagccggaccaaccaggagugcuucgaggaggccuuccugcccacccugcagacccucgcgaacgccccggccuccagcccccuggccgagaucgacaucacgaacguggccgagcugcucgucgaccugacccgccccuccgggcugaacccccaggcgaagaccagccaggacuaccaggcccucaccgugcacgacaaccuggccaugaagaucugcaacgagauccugacguccccgugcagccccgagauccggguguacaccaaggcccucuccagccuggagcuguccagccaccucgccaaggaccugcugguccuccugaacgagauccuggagcaggucaaggaccggaccugccuccgcgcgcuggagaagaucaagauccagcuggagaagggcaacaaggaguucggggaccaggccgaggccgcccaggacgccacccucaccacgaccaccuuccagaacgaggacgagaagaacaaggagguguacaugacgccccugcgcggcgugaaggcgacccaggccuccaagagcacccagcugaagaccaaccggggccagcgcaaggugaccguguccgcccgcacgaaccggcgcugccagaccgccgaggcggacagcgaguccgaccacgaggucccggagcccgagagcgagaugaagaugcggcucccccgccgggccaagaccgccgcccuggagaaguccaagcugaaccucgcccaguuccugaacgaggaccugagcuga

SEQ ID NO: 33413 - RNA, 312 nt, Artificial Sequence
  derived and/or modified sequence opt1 from NCBP2__Homo_sapiens__NP_001036005
augagcggcgggcugcucaaggcccugcgcuccgacagcuacguggagcugucccaguaccgggaccagcacuuccgcggcgacaacgaggagcaggagaagcuccugaagaaguccuacgccgagaacgcgaugcgguacaucaacgggacccgccuggacgaccggaucauccgcaccgacugggacgccggcuucaaggaggggcggcaguacggccgcggccggagcgggggccagguccgcgacgaguaccggcaggacuacgacgccgggcgcggcggguacggcaagcucgcccagaaccaguga

SEQ ID NO: 33414 - RNA, 1347 nt, Artificial Sequence
  derived and/or modified sequence opt1 from NCEH1__Homo_sapiens__NP_001139748
augagcuccugccgcggccagaagguggccgggggccugcgggucgugagccccuucccgcucugccagcccgccggggagcccucccagggcaagaugcgcagcuccugcgugcugcugaccgcgcucgucgcccuggccgccuacuacguguacaucccccugccggggagcguguccgaccccuggaagcucaugcugcuggacgccaccuuccggggcgcgcagcaggucagcaaccucauccacuaccugggccugucccaccaccuccuggcccugaacuucaucaucgugagcuucgggaagaaguccgccuggagcuccgcccaggugaaggucacggacaccgacuucgacggcguggaggugcgcgucuucgaggggccgcccaagcccgaggagccccucaagcggagcgugguguacauccacggcgggggcugggcgcuggccuccgccagcgccuccuggagccccuccgacgagauccgcuacuacgacgagcugugcaccgccauggcggaggagcucaacgccgucaucgugagcaucgaguaccggcuggugcccaaggucuacuucccggagcagauccacgacguggugcgcgccaccaaguacuuccugaagcccgagguccuccagaaguacaugguggaccccggccggaucugcaucagcggggacuccgccggcgggaaccuggccgcggcccugggccagcaguucacgcaggacgccagccucaagaacaagcugaagcugcaggcccucaucuaccccgugcugcaggcccuggacuucaacaccccguccuaccagcagaacgucaacacccccauccucccccgcuacgugauggucaaguacuggguggacuacuucaagggcaacuacgacuucgugcaggcgaugaucgucaacaaccacaccagccuggacguggaggaggccgccgccgugcgggcccgccugaacuggacgucccuccugcccgcgagcuucaccaagaacuacaagccggucgugcagaccaccgggaacgcccggaucgugcaggagcugccccagcuccuggacgcccgcuccgcgccccugaucgccgaccaggccguccuccagcugcugcccaagacguacauccugaccugcgagcacgacgugcuccgggacgacggcaucauguacgccaagcgccuggagagcgccgggguggaggucacccucgaccacuucgaggacggcuuccacgggugcaugaucuucaccuccuggccgacgaacuucagcgugggcauccggacccgcaacuccuacaucaaguggcuggaccagaaccuguga

SEQ ID NO: 33415 - RNA, 1173 nt, Artificial Sequence
  derived and/or modified sequence opt1 from NCF1__Homo_sapiens__NP_000256
augggcgacaccuucauccgccacaucgcccugcucggguucgagaagcgguucgugcccagccagcacuacgucuacauguuccuggugaaguggcaggaccuguccgagaagguggucuaccgccgguucaccgagaucuacgaguuccacaagacgcucaaggagauguucccgaucgaggccggcgcgaucaaccccgagaaccgcaucaucccccaccuccccgccccgaagugguucgacgggcagcgggccgccgagaaccgccagggcacccugaccgaguacugcagcacccugaugucccugcccacgaagaucagccggugcccccaccuccuggacuucuucaaggugcgccccgacgaccugaagcugccgaccgacaaccagaccaagaagcccgagaccuaccucaugcccaaggacgggaaguccacggccaccgacaucaccggccccaucauccugcagaccuaccgggcgaucgccaacuacgagaagacgagcggcuccgagauggcccugagcaccggggacguggucgaggugguggagaaguccgagagcggcuggugguucugccagaugaaggccaagcgcggguggaucccggcguccuuccucgagccccuggacagccccgacgagaccgaggaccccgagccgaacuacgccggcgagcccuacgucgccaucaaggccuacaccgccguggagggggacgaggugucccugcucgagggcgaggcggucgaggugauccacaagcugcuggacggcuggugggugauccggaaggacgacgucacgggguacuuccccagcauguaccuccagaaguccggccaggacgugagccaggcccagcgccagaucaagcgcggggcgcccccgcggcgguccagcauccgcaacgcccacuccauccaccagcggagccgcaagcggcugagccaggacgccuaccgccggaacuccgugcgcuuccugcagcagcgccggcgccaggcccggcccggcccccagagccccggcuccccgcucgaggaggagcgccagacccagcggagcaagccccagcccgccgugcccccgcgccccuccgccgaccugauccugaaccggugcagcgaguccaccaagcgcaagcucgccagcgccgucuga

SEQ ID NO: 33416 - RNA, 1338 nt, Artificial Sequence
  derived and/or modified sequence opt1 from NCF2__Homo_sapiens__NP_001177718
augagccugguggaggccaucucccucuggaacgagggcguccuggccgcggacaagaaggacuggaagggggcccuggacgccuucagcgccgugcaggacccccacucccgcaucugcuucaacaucggcugcauguacaccauccucaagaacaugaccgaggccgagaaggcguucacgcggagcaucaaccgcgacaagcaccuggccguggccuacuuccagcgggggaugcuguacuaccagaccgagaaguacgaccucgccaucaaggaccugaaggaggcgcugauccagcuccgcggcaaccagcugaucgacuacaagauccuggggcuccaguucaagcuguucgccugcgaggucguggccuccguggucgaccaggacagcuucuccggcuucgccccgcugcagccccaggccgcggagcccccgccccggcccaagacccccgagaucuuccgcgcccucgagggcgaggcccaccgggugcuguucggguucgugcccgagaccaaggaggagcugcaggucaugccgggcaacaucguguucgugcucaagaaggggaacgacaacugggccacggucauguucaacggccagaaggggcuggugcccugcaacuaccuggagcccguggagcuccgcauccacccccagcagcagccgcaggaggagagcagcccccaguccgacauccccgcgcccccguccagcaaggcccccggccggccccagcugucccccggccagaagcagaaggaggagccgaaggaggucaagcugagcgugcccaugcccuacacccucaaggugcacuacaaguacaccgucgugaugaagacccagcccgggcugccguacucccaggugcgcgacauggucagcaagaagcuggagcuccggcuggagcacacgaagcuguccuaccgcccccgggacagcaacgagcucgugccccuguccgaggacagcaugaaggacgccuggggccaggugaagaacuacugccugacccucuggugcgagaacaccgucggggaccagggcuuccccgacgagccgaaggagagcgagaaggccgacgccaacaaccagaccacggagccccagcugaagaagggcucccagguggaggcccuguucagcuacgaggcgacccagcccgaggaccucgaguuccaggagggggacaucauccugguccuguccaaggugaacgaggaguggcucgagggcgagugcaaggggaaggugggcaucuucccgaaggucuucguggaggacugcgccaccaccgaccuggagagcacgcgccgggagguguga

SEQ ID NO: 33417 - RNA, 1020 nt, Artificial Sequence
  derived and/or modified sequence opt1 from NCF4__Homo_sapiens__NP_000622
auggccguggcccagcagcugcgcgcggagagcgacuucgagcagcuccccgacgacgucgccaucuccgccaacaucgccgacaucgaggagaagcggggcuucaccagccacuucguguucgugaucgaggucaagaccaagggcggguccaaguaccugaucuaccgccgguaccgccaguuccacgcccugcagagcaagcucgaggagcgguucgggccggacuccaagagcuccgcgcuggccugcacgcugcccacccuccccgccaagguguacgugggcgucaagcaggagaucgccgagaugcgcauccccgcgcugaacgccuacaugaagucccugcucagccugccggugugggugcugauggacgaggacguccggaucuucuucuaccagagccccuacgacuccgagcaggucccccaggcccuccgccggcugcgcccccggacccgcaaggucaagagcguguccccgcaggggaacagcguggaccggauggccgcgccccgcgccgaggcccuguucgacuucaccggcaacuccaagcucgagcugaacuucaaggccggcgacgugaucuuccugcucagccggaucaacaaggacuggcuggaggggacggugcgcggcgccaccgggaucuucccccuguccuucgugaagauccucaaggacuuccccgaggaggacgacccgaccaacuggcugcggugcuacuacuacgaggacaccaucagcacgaucaaggacaucgccguggaggaggaccuguccagcacgccccuccugaaggaccugcucgagcugacccgccgggaguuccagcgcgaggacaucgcgcugaacuaccgggacgccgagggcgaccucguccgccugcugagcgacgaggacguggcccucauggugcgccaggcccgggggcugcccucccagaagcgccuguuccccuggaagcuccacaucacccagaaggacaacuaccgggucuacaacaccaugccguga

SEQ ID NO: 33418 - RNA, 942 nt, Artificial Sequence
  derived and/or modified sequence opt1 from NCK1__Homo_sapiens__NP_001177725
auggacuggcugaacguguucaaggacuucuucagcaucggcaaggucaagcgcaagcccuccgugccggacagcgccucccccgccgacgacagcuucguggaccccggggagcggcucuacgaccugaacaugcccgcguacgucaaguucaacuacauggccgagcgcgaggacgagcugucccucaucaagggcaccaaggugaucgugauggagaagugcagcgacgggugguggcggggcuccuacaacgggcaggucggcugguucccgagcaacuacgugaccgaggagggcgacagcccccugggggaccacgugggcucccuguccgagaagcucgccgccgucgugaacaaccugaacacgggccaggugcugcacgucgugcaggcccucuaccccuucagcuccagcaacgacgaggagcugaacuucgagaagggggacgugauggacgucaucgagaagcccgagaacgacccggagugguggaagugccgcaagaucaacgggauggugggccuggugcccaagaacuacgucaccgugaugcagaacaacccccucaccuccggccuggagcccagcccgccccagugcgacuacauccggcccucccugaccgggaaguucgcgggcaaccccugguacuacgggaaggugacgcgccaccaggccgagauggcccucaacgagcggggccacgagggcgacuuccugauccgcgacagcgaguccagcccgaacgacuucagcgucucccugaaggcccaggggaagaacaagcacuucaaggugcagcucaaggagaccguguacugcaucggccagcggaaguucagcaccauggaggagcuggucgagcacuacaagaaggcgcccaucuucaccuccgagcagggggagaagcuguaccucgugaagcaccugagcuga

SEQ ID NO: 33419 - RNA, 252 nt, Artificial Sequence
  derived and/or modified sequence opt1 from NCK2__Homo_sapiens__NP_001004722
augaccgaggaggugaucgucaucgccaagugggacuacaccgcccagcaggaccaggagcuggacaucaagaagaacgagcgccucuggcugcuggacgacagcaagacgugguggcgggugcgcaacgcggccaaccggaccggcuacgugcccuccaacuacgucgagcgcaagaacagccucaagaaggggucccuggugaagaaccugaaggacacccucgcccagcggcugcugcgcgugccguga

SEQ ID NO: 33420 - RNA, 3387 nt, Artificial Sequence
  derived and/or modified sequence opt1 from NCKAP1__Homo_sapiens__NP_038464
augagccgcuccgugcugcagcccagccagcagaagcucgccgagaagcugaccauccugaacgaccggggcgucgggaugcucacccgccuguacaacaucaagaaggccugcggcgacccgaaggcgaagcccuccuaccugaucgacaagaaccucgagagcgccgugaaguucaucgugcggaaguuccccgccgucgagacgcgcaacaacaaccagcagcuggcccagcugcagaaggagaaguccgagauccucaagaaccuggcccuguacuacuucaccuucguggacgugauggaguucaaggaccacgucugcgagcuccugaacaccaucgacgugugccagguguucuucgacaucaccgucaacuucgaccugacgaagaacuaccucgaccugaucaucaccuacaccacccugaugauccuccugagccggaucgaggagcgcaaggcgaucaucgggcuguacaacuacgcccacgagaugacgcacggcgccuccgaccgggaguacccccgccucgggcagaugaucguggacuacgagaacccgcugaagaagaugauggaggaguucgugccccacagcaagucccugagcgacgcccucaucucccugcagauggucuacccccggcgcaaccugagcgcggaccaguggcggaacgcccagcuccugucccugaucagcgcccccuccaccaugcucaacccggcccagagcgacaccaugcccugcgaguaccugucccuggacgccauggagaaguggaucaucuucggcuucauccucugccacggcauccugaacaccgacgcgacggcccugaaccucuggaagcuggcccugcagagcuccagcugccucagccuguuccgcgacgagguguuccacauccacaaggccgccgaggaccuguucgugaacauccggggguacaacaagcgcaucaacgacauccgggagugcaaggaggcggccgucucccacgccggcagcaugcaccgcgagcggcgcaaguuccuccgguccgcccugaaggagcuggccaccgugcucagcgaccagcccgggcugcugggccccaaggcccucuucguguucauggcgcuguccuucgcccgcgacgagaucaucuggcugcugcggcacgccgacaacaugccgaagaaguccgccgacgacuucaucgacaagcacaucgcggagcucaucuucuacauggaggagcugcgcgcccacguccgcaaguacgggcccgugaugcagcgguacuacgugcaguaccugagcggcuucgacgccgucgugcucaacgagcuggugcagaaccugagcgucugccccgaggacgaguccaucaucaugagcuccuucgugaacaccaugaccagccucuccgucaagcaggucgaggacggcgagguguucgacuuccgcgggaugcggcuggacugguuccgccugcaggccuacacgagcguguccaaggcgagccucggccuggccgaccaccgggagcuggggaagaugaugaacaccaucaucuuccacaccaagaugguggacucccucguggagaugcuggucgagaccagcgaccuguccaucuucugcuucuacagccgcgccuucgagaagauguuccagcagugccucgagcugcccagccagucccgguacagcaucgccuucccgcugcucugcacgcacuucauguccugcacccacgagcugugccccgaggagcgccaccacaucggcgaccggagccugucccucugcaacauguuccuggacgagauggccaagcaggcgcgcaaccugaucaccgacaucugcaccgagcagugcacgcucagcgaccagcugcugcccaagcacugcgccaagaccaucucccaggccgugaacaagaaguccaagaagcagaccggcaagaagggggagcccgagcgggagaagccgggcguggagagcaugcgcaagaaccggcucgucgugaccaaccuggacaagcugcacacggcccucagcgagcugugcuucuccaucaacuacgugcccaacauggucgugugggagcacaccuucacgccccgcgaguaccugaccagccaccucgagauccgguucaccaaguccaucguggggaugaccauguacaaccaggccacccaggagaucgcgaagcccagcgagcugcugaccuccguccgcgccuacaugacggugcuccagagcaucgagaacuacgugcagaucgacaucacccgggucuucaacaacgugcugcugcagcagacccagcaccucgacucccacggcgagccgaccaucaccagccuguacacgaacugguaccuggagacccuccugcgccaggugagcaacgggcacaucgccuacuuccccgccaugaaggccuucgucaaccugcccaccgagaacgagcucaccuucaacgcggaggaguacuccgacaucagcgagaugcggucccugagcgagcugcucggccccuacggcaugaaguuccuguccgagagccugauguggcacaucuccagccagguggccgagcucaagaagcugguggucgagaacguggacgugcugacgcagaugcgcaccuccuucgacaagccggaccagauggccgcccucuucaagcgccugagcuccgucgacagcgugcugaagcggaugaccaucaucggggugauccucuccuuccgcagccuggcgcaggaggcccugcgggacguccucuccuaccacauccccuuccuggugagcuccaucgaggacuucaaggaccacaucccccgcgagaccgacaugaagguggccaugaacgucuacgagcugagcuccgccgccggccucccgugcgagaucgaccccgcgcuggugguggcccugagcagccagaaguccgagaacaucagccccgaggaggaguacaagaucgccugccuccugauggucuucguggccgugucccugcccacgcucgccagcaacgucaugucccaguacagcccggcgaucgaggggcacugcaacaacauccacugccuggccaaggccaucaaccagaucgccgccgcgcuguucaccauccacaagggcuccaucgaggaccggcucaaggaguuccuggcccuggccagcuccagccuccugaagaucgggcaggagaccgacaagaccacgacccgcaaccgggaguccguguaccugcuccuggacaugaucgugcaggagagccccuuccugaccauggaccuccuggaguccugcuuccccuacguccugcuccgcaacgccuaccacgcgguguacaagcagagcgugaccuccagcgccuga

SEQ ID NO: 33421 - RNA, 3234 nt, Artificial Sequence
  derived and/or modified sequence opt1 from NCKAP1L__Homo_sapiens__NP_001171905
auggagcccagccugaaguacaucaacaagaaguucccgaacaucgacgugcgcaacuccacccagcaccucggccccguccaccgggagaaggccgagaucauccgcuuccugaccaacuacuaccagagcuucguggacgugauggaguuccgggaccacgucuacgagcugcucaacacgaucgacgccugccagugccacuucgacaucaaccugaacuucgacuucacccgcuccuaccuggaccucaucgugaccuacaccagcgugauccugcugcucucccggaucgaggaccgccggauccugaucgggauguacaacugcgcgcacgagaugcugcacggccacggggaccccagcuucgcccgccucggccagaugguccuggaguacgaccacccccugaagaagcucacggaggaguucgggccgcacaccaaggccguguccggcgcccugcugagccuccacuuccuguucgugcggcgcaaccagggcgccgagcaguggcgguccgcgcagcugcucagccugaucuccaacccgcccgccaugaucaaccccgccaacagcgacaccauggccugcgaguaccuguccgucgaggugauggagcgcuggaucaucaucggguuccuccugugccacggcugccugaacagcaacucccagugccagaagcucuggaagcugugccugcaggggagccucuacaucacccugauccgggaggacgugcugcagguccacaaggugacggaggaccucuucuccagccugaagggcuacgggaagcgcguggcggacaucaaggaguccaaggagcacgucaucgccaacagcggccaguuccacugccagcggcgccaguuccugcggauggccgugaaggagcucgagaccgugcuggccgacgagcccggccugcucgggcccaaggcccuguucgcguucauggcccugagcuucauccgcgacgaggucaccuggcucgugcggcacaccgagaacgugacgaagaccaagacccccgaggacuacgccgacuccagcaucgccgagcugcuguuccuccuggagggcauccgcucccugguccggcgccacaucaaggugauccagcaguaccaccuccaguaccuggcccgcuucgacgcgcuggugcugagcgacaucauccagaaccucuccgucugccccgaggaggagagcaucaucauguccagcuucguguccauccugagcucccugaaccucaagcaggucgacaacggggagaaguucgaguucagcggccugcggcuggacugguuccgccuccaggccuacaccuccguggccaaggccccgcugcaccuccacgagaaccccgaccuggccaaggugaugaaccugaucgucuuccacagccggaugcuggacuccguggagaagcuccugguggagacgagcgaccuguccaccuucugcuuccaccuccgcaucuucgagaagauguucgcgaugacccuggaggagagcgccaugcugcgguacgccaucgccuucccccucaucugcgcccacuucguccacugcacccacgagaugugccccgaggaguacccgcaccugaagaaccacggccugcaccacugcaacuccuuccucgaggagcuggcgaagcagacgagcaacugcgugcuggagaucugcgccgagcagcgcaaccucagcgagcagcugcugcccaagcacugcgccaccaccaucuccaaggccaagaacaagaagacccggaagcagcgccagacgccccggaagggggagcccgagcgcgacaagccgggcgcggagagccaccggaagaaccgcuccaucgugaccaacauggacaagcuccaccugaaccugaccgagcucgcccugaccaugaaccacgucuacagcuucuccguguucgagcacacgaucuuccccagcgaguaccuguccagccaccucgaggcccggcugaaccgcgccaucguguggcuggccggguacaacgcgaccacccaggagaucguccggcccuccgagcuccuggccggcgugaaggccuacaucggguucauccagagccuggcccaguuccucggcgccgacgcgucccgcgugauccggaacgcccugcugcagcagacccagccccucgacagcugcggcgagcagacgaucaccacccuguacaccaacugguaccuggagucccuccugcgccaggccagcuccgggacgaucauccugagcccggccaugcaggccuucgucucccucccccgggagggcgagcagaacuucagcgcggaggaguucagcgacaucuccgagaugcgcgcccuggccgagcugcucgggcccuacggcaugaaguuccugagcgagaaccugauguggcacgugaccucccagaucguggagcucaagaagcuggucguggagaacauggacauccuggugcagauccgcagcaacuucuccaagcccgaccucauggccagccugcugccgcagcucaccggggcggagaacguccugaagcggaugaccaucaucggcgugauccuguccuuccgcgccauggcccaggagggccuccgggagguguucagcucccacugccccuuccugauggggcccaucgagugccugaaggaguucgucaccccggacacggacaucaaggugacccucagcaucuucgagcuggccuccgccgcgggcguggggugcgacaucgaccccgcccuggucgccgccaucgccaaccucaaggcggacaccagcucccccgaggaggaguacaagguggccugccugcugcucaucuuccuggccgugagccugccccuccuggccaccgacccguccagcuucuacuccaucgagaaggacggcuacaacaacaacauccacugccugacgaaggccaucauccaggucagcgcggcccucuucacccuguacaacaagaacaucgagacccaccugaaggaguuccucgugguggccuccgucagccugcugcagcucgggcaggagaccgacaagcugaagacgcgcaaccgggagagcaucucccugcucaugcgccuggugguggaggagagcuccuuccugacccucgacaugcuggagagcugcuuccccuacguccugcuccggaacgccuaccgcgaggugucccgggcguuccaccugaacuga

SEQ ID NO: 33422 - RNA, 5730 nt, Artificial Sequence
  derived and/or modified sequence opt1 from NCKAP5__Homo_sapiens__NP_997246
auggagggcaagcgccagcuggagaagcgggacuucgggaagcgccugagccuggacagcagccugguggaguacauggacuccaacaaguacaucgagcaccuccugacccagcuggaggagcagcaccggagccucuggcgcgagaagcuggccguggcccggcugcagcgcgagguggcccagcggaccuccgagggcgccaugcacgagaagcucauccacgagcuggaggaggagcgccaccuccggcuccagagcgagaagcgccugcaggaggugacccuggaguccgagcggaaccgcauccagaugcggagccuccagcagcaguucucccgcauggaggagaccguccggaaccugcugcagagccaggggucccccgagcagaagaaggaggagaccgugaacaucaugguguaccaggagaagcucagcgaggaggagcgcaagcacaaggaggcccuggaggaccugcacauggucguggacgaggacucccggagcgaguccagcuccaccgacgagggcaaggagaagacgaagcuccugcuggagcgccucaaggcccuggaggccgagaacagcgcgcuggcccucgagaacgagaaccagcgggagcaguacgagcgcugccuggacgagguggccaaccaggucgugcaggcccugcucacccagaaggaccugcgggaggagugcgugaagcugaagacccgcgucuucgaccucgagcagcagaaccgcacccuguccauccuguuccagcagcgggugcgccccaccagcgaccuccugcugcagaagcuccacagccggcugcuggaccucuccagcggggaccugcuguccgagguggagcgcaaccggagccucacccagucccgcaccgacgcggagguccacgagcaccagcugaacaccaagagcgcccugaagugccccggccucggcgccgugauccccgggcaccugugcccccggaacuccuacagcuccagcuccgagcugagccuguccagcacgugcuccgaguacagcuccggcagcuccuacaccuggcacgacgggaagaaccuccgcaagcggcagagcagccagaacugggacaagcgccuguccaucgacagcucccugccgagcggcuucgccucccccaccaacgagcugccgcccacccggaucaaggagagccacauccuggaggggcugcgcaagcuccagaagcggaaggugcugcuggagccgcccuccgucaucacgaaguggggcuacaaggacugcaugaacagcaacgagggcaucuacucccccgggaucaagagcuccagccucaaggaguacccgcccugcaagaccgccgaccugggcucccccugcaaggagccccacaagaccuucguguacgaccuggacagccacguggacgcggacgacgaccccuccacccucgcccugcugcaggccguccccaaccagagcugccgcccccacggguccaagcucacgcacagcgugagcgacucccuguucggcugggagaccaaccggaagcacuuccuggagggcaccagcuccguguaccccaaggagcgccccgagaagcucaccagcugcgccuccagcugcccccuggagaugaagcugugccccuccguccagacgccccaggugcagcgggagcgcgggccccagggccaggggcacggccggauggcccucaaccugcagcugagcgacaccgacgacaacgagaccuucgacgagcuccacaucgaguccagcgacgagaagucccccagcgacgucucccuggcggccgacaccgacaagagcguggagaaccuggacgugcucgucggguucggcaagucccugugcggcagccccgaggaggaggagaagcagguccccauccccuccgagacgcgcccgaagaccuucagcuucaucaagcagcagcgcguggucaagcggaccuccagcgaggagugcgugaccgugaucuucgacgccgaggacggggagcccaucgaguucagcucccaccagacgggcgucgugaccgugacccgcaacgagaucagcaucaacuccacccccgccgggccgaaggccgagcacacggagcugcucccccagggcaucgcgugccugcagccccgggccgccgcccgcgacuacaccuucuucaagcggagcgaggaggacaccgagaagaacauccccaaggacaacgucgacaacgugccgcgcguguccaccgagagcuucuccagccggaccgucacgcagaacccccagcagcagaagcuggugaagcccacccacaacaucuccugccagagcaacucccgcagcuccgcccccauggggaucuaccagaagcagaaccucaccaagaucccgccccggggcaagagcagcccccagaaguccaagcugauggagcccgaggcgaccacgcugcucccguccagcggccuggugacccuggagaagucccccgcccucgcccccgggaagcugagccgcuucaugaagaccgagagcuccggcccccuguucgagcuccggagcgacccgcacauccccaagcacuccgcccagcugccccacagcucccgcaugcccagccggcgcgacuggguccagugcccgaagucccagacccccgggagccggucccgccccgcgaucgagagcuccgacagcggcgagcccccgacgcgggacgagcacugcggguccggccccgaggccggcgugaagucccccuccccgccgccgccgcccgggcgcagcgugucccugcucgcccggcccagcuacgacuacucccccgcccccagcagcaccaaguccgagacccgcguccccagcgagaccgcccggacgcccuucaagagcccccugcugaagggcaucagcgcgcccgugaucuccagcaacccggccaccaccgaggugcagcgcaagaagcccuccgucgccuucaagaagcccaucuucacccaccccaugccgagccccgaggccgugauccagacgcgcugccccgcccacgcgcccuccagcuccuucaccgugauggcccucgggccgcccaaggucagccccaagcggggcgugcccaagaccuccccgcgccagacccugggcacgccccagcgggacaucgggcugcagacgccccgcaucagccccuccacccacgagccgcucgagaugaccagcuccaagagcgugucccccggccggaaggggcagcugaacgacagcgccagcacgcccccgaagcccuccuuccugggcgucaacgagagccccuccagccagguguccagcuccagcuccagcuccagccccgccaagucccacaacagcccgcacgggugccaguccgcccacgagaagggccucaagacccgccugcccgugggccugaagguccucaugaaguccccgcagcugcugcggaaguccagcaccgugcccgggaagcacgagaaggacucccucaacgaggcgagcaagagcuccguggccgucaacaagagcaagcccgaggacuccaagaaccccgccagcauggagaucaccgccggcgagcgcaacgugacgcugcccgacucccaggcgcaggggagccuggccgacggccucccccuggagaccgcccugcaggagccgcucgaguccagcauccccggguccgacggccgggacggcguggacaaccgcagcaugcggcgcucccugagcuccagcaagccccaccugaagcccgcccucgggaugaacggcgccaaggcgcggucccacagcuucuccacccacagcggggacaagccgagcacgccgcccaucgagggcuccgggaagguccgcacgcagaucaucaccaacaccgccgagcggggcaacagccugacccgccagaacuccagcacggaguccagccccaacaaggccccguccgcccccaugcuggagagccuccccuccgugggccggcccagcgggcacccguccagcggcaaggggucccugggcagcuccgggagcuucuccagccagcacggcucccccagcaagcugccccuccgcaucccgcccaagagcgagggccugcugaucccgcccgggaaggaggaccagcaggccuucacccagggcgagugccccuccgcgaacguggccguccucggggagcccggcagcgaccggcgcuccugcccgcccaccccgaccgacugccccgaggcccugcagagccccggccgcacccagcaccccuccacguucgagaccagcuccaccagcaagcuggagaccuccgggcggcacccggacgccagcgccacggcgaccgacgccguguccagcgaggcgccccugucccccaccaucgaggagaaggugaugcugugcauccaggagaacgucgagaagggccaggugcagaccaagcccacgagcguggaggccaagcagaagccggggcccuccuucgcgagcugguucggcuuccgcaagucccggcugcccgcccucagcucccgcaagauggacaucagcaagaccaaggucgagaagaaggacgccaaggugcugggguucggcaaccggcagcucaagagcgagcgcaagaaggagaagaagaagcccgagcuccagugcgagaccgagaacgagcugaucaaggacaccaaguccgccgacaacccggacggcgggcugcagagcaagaacaaccggcgcacgccccaggacaucuacaaccagcucaagaucgagccccggaaccgccacucccccguggccugcagcaccaaggacaccuucaugaccgagcugcugaaccgggucgacaagaaggcggccccgcagacggaguccggcagcuccaacgccagcugccgcaacgugcucaagggguccagccagggcuccugccugaucgggagcuccaucagcacccagggcaaccacaagaagaacaugaagaucaaggccgacauggagguccccaaggacucccuggugaaggaggccaacgagaaccugcaggaggacgaggacgacgcgguggccgacagcgucuuccagucccacaucaucgagagcaacugccagaugcggacccucgacuccggcaucgggaccuucccccugcccgacagcggcaaccgcagcacggggcgguaccugugccagccggacucccccgaggacgccgagccccuccugccgcugcagagcgcccucuccgccgugagcuccaugcgcgcgcagacccuggagcgggaggugcccagcuccaccgacggccagcgccccgccgacagcgccaucguccacuccaccagcgaccccaucaugacggcccgggggaugcgcccgcugcagucccggcuccccaagcccgccagcuccggcaaggugagcucccagaagcagaacgaggcggagccccgcccgcagaccugcagcuccuucggcuacgccgaggaccccauggccagccagccccugcccgacuggggguccgagguggccgcgaccggcacccaggacaaggccccgcgcaugugcacguacagcgccagcgggggcuccaacagcgacuccgaccuggacuacggcgacaacggguucggcgccgggcggggccagcucgucaaggcccucaagagcgcggcccccgagaucgagaccaccuga

SEQ ID NO: 33423 - RNA, 2169 nt, Artificial Sequence
  derived and/or modified sequence opt1 from NCKIPSD__Homo_sapiens__NP_057537
auguaccgcgcccuguacgccuuccggagcgcggagcccaacgcccucgccuucgccgccggcgagaccuuccuggugcuggagcgcuccagcgcgcacugguggcucgccgcccgggcccgcuccggggagaccggcuacgucccgcccgcguaccugcggcgccugcaggggcucgagcaggacgugcugcaggccaucgaccgggccaucgaggccgugcacaacacggccaugcgcgacggcgggaaguacagccuggagcagcggggcguccuccagaagcugauccaccaccgcaaggagacccugucccggcgcggccccagcgcguccagcguggccgugaugaccuccagcaccuccgaccaccaccucgacgccgccgccgcgcggcagcccaacggggucugccgcgccggcuucgagcggcagcacagccugccguccagcgagcaccugggggccgacggcgggcucuaccagaucccccugcccuccagccagaucccgccccagccccgccgggccgcccccacgacgcccccgccgcccgugaagcgccgggaccgcgaggcgcugauggccuccggcagcggcgggcacaacaccaugcccuccggcgggaacagcgugagcuccggcagcuccgucagcuccaccagccucgacacccuguacaccuccagcucccccagcgagcccggcuccagcugcucccccacgcccccgcccgugccccggcgcgggacccacaccaccgugagccagguccagcccccgcccuccaaggccagcgcccccgagcccccggccgaggaggagguggcgaccggcaccacguccgccagcgacgaccuggaggcccucgggacccugucccugggcaccaccgaggagaaggccgcggccgaggccgccgugccccgcacgaucggggccgagcucauggagcugguccggcgcaacaccggccugagccacgagcucugccggguggcgaucggcaucaucguggggcacauccaggccagcguccccgccuccagcccggugauggagcagguccugcugucccucguggagggcaaggaccugagcauggcccugcccuccggccaggugugccacgaccagcagcgccucgaggugaucuucgccgaccuggcgcggcgcaaggacgacgcccagcagcggagcugggcccuguacgaggacgagggggucauccgcugcuaccucgaggagcugcugcacauccucaccgacgccgaccccgaggugugcaagaagaugugcaagcggaacgaguucgaguccguccuggcccugguggcguacuaccagauggagcaccgcgccagccuccggcugcugcuccugaagugcuucggggccaugugcucccuggacgccgcgaucaucagcacccucguguccagcguccugcccguggagcuggcccgcgacaugcagacggacacccaggaccaccagaagcugugcuacuccgcccucauccuggccaugguguucagcaugggcgaggccgucccguacgcgcacuacgagcaccugggcacccccuucgcccaguuccuccugaacaucguggaggacgggcugccccucgacaccacggagcagcugcccgaccugugcgugaaccuccugcuggcccucaaccugcaccucccggccgccgaccagaacgucaucauggcggcccuguccaagcacgccaacgugaagaucuucagcgagaagcugcugcuccugcugaaccggggcgacgaccccgugcgcaucuucaagcacgagccccagcccccgcacuccguccucaaguuccugcaggacguguucgggagccccgccaccgccgcgaucuucuaccacaccgacaugauggcccugaucgacaucaccgugcggcacaucgccgaccucagccccggcgacaagcugcgcauggaguaccugucccucaugcacgccaucguccggacgacccccuaccugcagcaccgccaccggcugccggaccuccaggcgauccugcgccgcauccugaacgaggaggagaccagcccccagugccagauggaccggaugaucgugcgcgagaugugcaaggaguuccucgugcugggggaggcccccuccuga

SEQ ID NO: 33424 - RNA, 2133 nt, Artificial Sequence
  derived and/or modified sequence opt1 from NCL__Homo_sapiens__NP_005372
auggugaagcuggccaaggccggcaagaaccagggggaccccaagaagauggcgccgccgcccaaggaggucgaggaggacagcgaggacgaggagauguccgaggacgaggaggacgacagcuccggcgaggagguggugaucccccagaagaaggggaagaaggccgccgccaccagcgccaagaaggucguggugucccccaccaagaaggucgcgguggccacgcccgccaagaaggccgcggugacccccggcaagaaggccgccgccacccccgccaagaagaccgucacgccggcgaaggccgugaccacccccgggaagaagggcgccacccccggcaaggcccucguggccacgcccgggaagaagggcgcggccaucccggccaagggggccaagaacggcaagaacgccaagaaggaggacagcgacgaggaggaggacgacgacuccgaggaggacgaggaggacgacgaggacgaggacgaggacgaggacgagaucgagcccgcggccaugaaggccgccgccgcggcccccgccagcgaggacgaggacgacgaggacgacgaggacgacgaggacgacgacgacgacgaggaggacgacuccgaggaggaggccauggagaccacccccgcgaaggggaagaaggccgccaaggucgugccggugaaggccaagaacgucgccgaggacgaggacgaggaggaggacgacgaggacgaggacgacgacgacgacgaggacgacgaggacgacgacgacgaggacgacgaggaggaggaggaggaggaggaggaggagcccgugaaggaggcgcccggcaagcgcaagaaggagauggccaagcagaaggccgcccccgaggccaagaagcagaagguggagggcaccgagccgacgaccgcguucaaccuguucgucgggaaccugaacuucaacaagagcgcccccgagcucaagaccggcaucuccgacguguucgccaagaacgaccuggccguggucgacgugcggaucgggaugacccgcaaguucggcuacguggacuucgagagcgccgaggaccuggagaaggcgcucgagcugacgggccugaaggucuucgggaacgagaucaagcucgagaagcccaagggcaaggacuccaagaaggagcgggacgcccgcacccugcuggccaagaaccuccccuacaaggugacccaggacgagcugaaggaggucuucgaggacgccgcggagauccggcuggugagcaaggacgggaaguccaagggcaucgccuacaucgaguucaagaccgaggccgacgccgagaagacguucgaggagaagcaggggaccgagaucgacggccgcagcaucucccucuacuacaccggcgagaaggggcagaaccaggacuaccggggcgggaagaacagcaccugguccggcgagagcaagacgcuggugcugagcaaccucuccuacagcgccaccgaggagacccugcaggaggucuucgagaaggcgaccuucaucaaggugccgcagaaccagaacgggaaguccaagggcuacgccuucaucgaguucgccagcuucgaggacgccaaggaggcccugaacuccugcaacaagcgcgagaucgagggccgggcgauccgccucgagcugcaggggccccggggcagccccaacgcccgcucccagcccagcaagacgcuguucgugaaggggcucuccgaggacaccaccgaggagacccugaaggagagcuucgacggcuccguccgggcccgcaucgugacggaccgggagaccgggagcuccaagggcuucggcuucguggacuucaacagcgaggaggacgccaaggccgcgaaggaggccauggaggacggggagaucgacggcaacaaggucacccuggacugggccaagccgaagggggagggcggcuucgggggccgcgggggcgggcggggcggcuucgggggccgcgggggcgggcggggcggccgcgggggcuucgggggccgggggcgcggcggcuucgggggccgcgggggcuuccgcgggggccggggcgggggcggggaccacaagccccagggcaagaagaccaaguucgaguga

SEQ ID NO: 33425 - RNA, 4326 nt, Artificial Sequence
  derived and/or modified sequence opt1 from NCOA1__Homo_sapiens__XP_005264682
augagcggccugggggacuccagcuccgaccccgccaacccggacagccacaagcgcaagggcucccccugcgacacccucgccagcuccaccgagaagcggcgccgggagcaggagaacaaguaccuggaggagcuggcggagcuccugagcgccaacaucuccgacaucgacagccuguccgugaagcccgacaagugcaagauccucaagaagacggucgaccagauccagcugaugaagcgcauggagcaggagaagagcaccaccgacgacgacgugcagaaguccgacaucagcuccagcucccagggggugaucgagaaggagagccugggcccccuccugcuggaggcccucgacggguucuucuucgucgugaacugcgagggccggaucguguucgucuccgagaacgugaccagcuaccugggcuacaaccaggaggagcugaugaacacgagcguguacuccauccuccacgucggggaccacgccgaguucgugaagaaccugcugccgaagagccucgugaacggcguccccuggccccaggaggccacccgccggaacucccacaccuucaacugccgcaugcugauccaccccccggacgagcccgggaccgagaaccaggaggcgugccagcgguacgaggugaugcagugcuucacggugagccagcccaaguccauccaggaggacggcgaggacuuccagagcugccugaucugcaucgcccgccggcucccccgcccgcccgccaucaccggggucgaguccuucaugaccaagcaggacaccacgggcaagaucaucagcaucgacaccuccagccugcgggccgcgggccgcaccgggugggaggaccuggugcggaagugcaucuacgccuucuuccagccccagggccgcgagcccuccuacgcccggcagcucuuccaggaggugaugacccgcgggacggccagcuccccgagcuaccgguucauccugaacgacggcaccaugcuguccgcccacaccaagugcaagcucugcuacccccagagccccgacaugcagcccuucaucaugggcauccacaucaucgaccgcgagcacuccgggcugagcccgcaggacgacaccaacuccggcaugagcaucccccgggucaaccccagcgugaaccccuccaucagcccggcgcacgggguggcccgcuccagcacgcugccccccuccaacagcaacauggucuccacccgcaucaaccggcagcagagcuccgaccuccacagcuccagccacuccaacagcuccaacagccagggcuccuucgggugcagccccggcagccagaucguggccaacguggcccugaaccagggccaggccuccagccaguccagcaacccgucccugaaccucaacaacagccccauggaggggaccggcaucucccuggcgcaguucaugagcccccgccggcaggucaccuccgggcuggccacgcgcccgcggaugcccaacaacagcuucccccccaacaucuccacccucagcuccccggugggcaugaccagcuccgccugcaacaacaacaaccgcagcuacuccaacauccccgucaccagccugcaggggaugaacgagggccccaacaacuccgugggcuucagcgccagcucccccgugcugcggcagaugagcucccagaacagcccgucccgccucaacauccagcccgccaaggcggagagcaaggacaacaaggagaucgccuccauccugaacgagaugauccagagcgacaacuccagcuccgacgggaagccccuggacagcggccuccugcacaacaacgaccggcuguccgacggggacagcaaguacucccagacgagccacaagcucguccagcugcugaccaccaccgccgagcagcagcuccgccacgccgacaucgacacguccugcaaggacgugcugagcugcaccggcaccuccaacagcgccagcgcgaacuccagcgggggcuccugccccagcucccacagcucccugaccgagcggcacaagauccugcaccgccuccugcaggagggcagcccguccgacaucacgacccugagcguggagcccgacaagaaggacuccgccagcaccuccgucagcgugaccgggcaggugcagggcaacuccagcaucaagcucgagcuggacgccuccaagaagaaggagagcaaggaccaccagcugcuccgguaccugcuggacaaggacgagaaggaccuccgcuccacccccaaccugagccuggacgacgucaaggugaagguggagaagaaggagcagauggaccccugcaacacgaacccgacccccaugaccaagcccacccccgaggagaucaagcucgaggcccagagccaguucacggcggaccuggaccaguucgaccagcugcucccgacccuggagaaggccgcccagcugcccgggcucugcgagaccgaccggauggacggcgccgucaccuccgugacgaucaagagcgagauccugcccgccucccugcagagcgcgaccgcccgccccaccucccggcucaaccgccugccggagcuggagcucgaggccaucgacaaccaguucggccagcccgggaccggcgaccagauccccuggacgaacaacaccgugaccgccaucaaccagagcaaguccgaggaccagugcaucagcucccagcuggacgagcugcucugcccgcccaccacggucgaggggcggaacgacgagaaggcccugcuggagcagcucgugagcuuccuguccggcaaggacgagaccgagcuggcggagcucgaccgcgcccuggggaucgacaagcuggugcagggcggcgggcucgacguccugagcgagcgcuuccccccccagcaggccaccccgccccugaucauggaggagcggcccaaccucuacucccagcccuacagcuccccgagccccaccgccaaccugcccucccccuuccagggcauggugcgccagaagccgagccuggggacgaugcccgugcaggucacccccccccggggcgccuucuccccggggaugggcaugcagccccgccagacccucaaccggccccccgcggccccgaaccagcugcgccugcagcuccagcagcggcugcagggccagcagcagcugauccaccagaaccgccaggccauccucaaccaguucgccgcgaccgcccccguggggaucaacaugcggagcggcaugcagcagcagaucacgccccagcccccgcugaacgcccagaugcuggcccagcgccagcgggagcucuacagccagcagcaccgccagcggcagcugauccagcagcagcgcgccaugcugaugcggcagcaguccuucgggaacaaccucccccccagcuccggccugcccgugcagauggggaacccgcgccugccccagggcgcgccccagcaguucccguacccccccaacuacggcaccaaccccgggaccccgcccgccagcaccucccccuucagccagcucgccgccaaccccgaggccucccuggcgaaccggaacagcauggucucccgcggcaugacggggaacaucggcgggcaguucggcaccggcaucaacccgcagaugcagcagaacguguuccaguaccccggggccggcauggugccccagggggaggccaacuucgcccccagccuguccccgggcagcuccaugguccccaugcccauccccccgccccagagcucccuccugcagcagaccccccccgccagcggcuaccaguccccggacaugaaggcguggcagcagggggccaucggcaacaacaacguguucagccaggccgugcagaaccagcccacccccgcccagcccggggucuacaacaacauguccaucacggugagcauggcgggcgggaacaccaacgugcagaacaugaacccgaugauggcccagaugcagaugagcucccugcagaugcccggcaugaacaccgucugccccgagcagaucaacgaccccgcccuccggcacaccggccuguacugcaaccagcugagcuccacggaccuccugaagaccgaggccgacgggacccagcaggugcagcaggugcaggucuucgccgacgugcagugcaccgugaaccuggucggcggggacccguaccucaaccagcccggcccccuggggacccagaagccgacgagcggcccccagaccccccaggcgcagcagaagucccugcuccagcagcugcugaccgaguga

SEQ ID NO: 33426 - RNA, 4395 nt, Artificial Sequence
  derived and/or modified sequence opt1 from NCOA2__Homo_sapiens__XP_005251188
augagcggcaugggggagaacaccuccgaccccagccgcgccgagacccggaagcgcaaggagugcccggaccagcugggccccucccccaagcggaacacggagaagcgcaaccgggagcaggagaacaaguacaucgaggagcucgccgagcugaucuucgcgaacuucaacgacaucgacaacuucaacuucaagcccgacaagugcgccauccugaaggagaccgugaagcagauccgccagaucaaggagcaggagaaggccgccgccgcgaacaucgacgagguccagaagagcgacguguccagcaccgggcagggcgugaucgacaaggacgcccucgggccgaugaugcuggaggcccuggacggcuucuucuucgucgugaaccucgagggcaacguggucuucguguccgagaacgugacccaguaccugcgguacaaccaggaggagcugaugaacaagagcgucuacuccauccuccacgugggggaccacacggaguucgugaagaaccugcugcccaagagcaucgucaacggcggguccuggagcggcgagcccccccgccggaacucccacaccuucaacugccgcaugcucgugaagccgcugcccgacagcgaggaggaggggcacgacaaccaggaggcccaccagaaguacgagaccaugcagugcuucgcggugucccagcccaagagcaucaaggaggagggcgaggaccugcaguccugccucaucugcgucgcccggcgcgugcccaugaaggagcggccggugcugcccagcuccgagagcuucaccacgcgccaggaccugcagggcaagaucaccagccucgacaccuccaccaugcgggccgccaugaagcccgggugggaggaccugguccgccggugcauccagaaguuccacgcccagcacgagggcgagagcguguccuacgcgaagcgccaccaccacgaggugcugcggcaggggcucgccuucagccagaucuaccgcuucucccugagcgacggcacgcuggucgccgcccagaccaaguccaagcucauccggagccagaccaccaacgagccccagcuggugaucucccugcacaugcuccaccgcgagcagaacgugugcgucaugaacccggaccugacgggccagaccauggggaagccccugaaccccaucagcuccaacagccccgcccaccaggcgcucugcuccggcaacccggggcaggacaugacccugagcuccaacaucaacuuccccaucaacggccccaaggagcagauggggaugcccaugggccgcuucggcgggagcggcgggaugaaccacguguccggcaugcaggccaccacgccgcaggggagcaacuacgcccugaagaugaacucccccagccagagcucccccggcaugaaccccggccagccgaccagcaugcucuccccccggcaccgcaugagccccggggucgccggcuccccgcggaucccccccagccaguucucccccgccgggagccugcacuccccggugggcgugugcagcuccaccgggaacagccacuccuacaccaacagcucccugaacgcgcuccaggcccugagcgagggccacggcgucucccuggggagcagccucgccucccccgaccugaagaugggcaaccugcagaacagccccgugaacaugaaccccccgccccucuccaagauggggagccuggacuccaaggacugcuucggccuguacggcgagcccagcgaggggacgaccggccaggccgaguccagcugccaccccggggagcagaaggagaccaacgacccgaaccucccccccgccguguccagcgagcgcgcggacggccagucccggcugcacgacagcaaggggcagaccaagcugcuccagcugcugacgaccaaguccgaccagauggagcccagcccgcuggccuccagccucuccgacaccaacaaggacagcaccggcucccugcccggcagcgggagcacgcacggcaccucccugaaggagaagcacaagauccuccaccgccugcugcaggacagcuccagccccgucgaccucgccaagcugaccgccgaggcgaccgggaaggaccugucccaggagagcuccagcacggcccccggcuccgaggugaccaucaagcaggagccggugagccccaagaagaaggagaacgcccuccugcgguaccugcucgacaaggacgacaccaaggacaucgggcugcccgagaucacccccaagcuggagcgccucgacuccaagaccgacccggccagcaacacgaagcugaucgccaugaagaccgagaaggaggagauguccuucgagcccggcgaccagcccggcagcgagcuggacaaccucgaggagauccuggacgaccugcagaacucccagcucccgcagcuguuccccgacacccggcccggggcgcccgccggcagcgucgacaagcaggccaucaucaacgaccugaugcagcucaccgccgagaacuccccggugacgcccgugggggcccagaagaccgcgcugcgcaucagccaguccaccuucaacaacccccggcccggccagcuggggcgccuccugccgaaccagaaccugccccucgacaucacccugcagagccccacgggcgccggccccuucccgcccauccggaacagcucccccuacagcgucaucccccagccggggaugaugggcaaccaggggaugaucggcaaccaggggaaccugggcaacuccagcaccggcaugaucgggaacuccgccagccgccccaccaugcccuccggcgagugggccccccagagcuccgccgugcgggugaccugcgcggccacgaccagcgccaugaaccgcccgguccaggggggcaugauccggaaccccgccgcguccauccccaugcgccccagcucccagccgggccagcggcagacccuccagagccaggugaugaacaucgggcccuccgagcuggagaugaacaugggcgggccccaguacagccagcagcaggcccccccgaaccagaccgcccccuggcccgaguccauccugccgaucgaccaggccagcuucgccucccagaaccgccagcccuucggcagcagccccgacgaccuccugugcccccacccggcggccgagucccccagcgacgagggggcccugcucgaccagcuguaccuggcccuccgcaacuucgacggccuggaggagaucgaccgggcccugggcauccccgagcucgugucccagagccaggcggucgaccccgagcaguucuccagccaggacuccaacaucaugcuggagcagaaggccccgguguucccccagcaguacgccagccaggcccagauggcccagggguccuacagccccaugcaggaccccaacuuccacacgaugggccagcgcccguccuacgcgacccugcggaugcagccccgccccgggcuccggcccaccggccuggugcagaaccagccgaaccagcugcgccuccagcugcagcaccggcugcaggcccagcagaaccgccagccccucaugaaccagaucagcaacgucuccaacgugaaccugacccugcggcccggggugcccacgcaggccccgaucaacgcccagaugcucgcgcagcgccagcgggagauccugaaccagcaccugcgccagcggcagaugcaccagcagcagcagguccagcagcgcacccucaugaugcggggccagggccugaacaugacccccagcaugguggcccccuccgggaugcccgccaccaugagcaacccgcgcaucccccaggccaacgcccagcaguuccccuuccccccgaacuacggcaucucccagcagcccgaccccggguucacgggcgcgaccaccccgcagagcccccugauguccccccggauggcccacacccagagccccaugaugcagcagagccaggccaacccggccuaccaggcccccuccgacaucaacgggugggcgcagggcaacaugggcgggaacagcauguucucccagcagagccccccccacuucggccagcaggccaacacguccauguacagcaacaacaugaacaucaacguguccauggccaccaacaccgggggcaugagcuccaugaaccagaugaccggccagaucagcaugacguccgucaccagcgugccgaccuccgggcucagcuccaugggccccgagcaggugaacgaccccgcccugcgcgggggcaaccuguuccccaaccagcucccggggauggacaugaucaagcaggagggcgacaccacgcggaaguacugcuga

SEQ ID NO: 33427 - RNA, 4248 nt, Artificial Sequence
  derived and/or modified sequence opt1 from NCOA3__Homo_sapiens__NP_001167559
augagcggccugggggagaaccucgacccccuggccuccgacagccgcaagcggaagcugccgugcgacacccccggccaggggcucaccugcuccggcgagaagcgccggcgcgagcaggagagcaaguacaucgaggagcuggccgagcugaucuccgcgaaccucagcgacaucgacaacuucaacgugaagcccgacaagugcgccauccugaaggagacgguccggcagauccgccagaucaaggagcaggggaagaccaucuccaacgacgacgacgugcagaaggccgacgugagcuccaccggccagggcgucaucgacaaggacagccuggggccccuccugcugcaggcccucgacggcuuccuguucguggugaaccgggacgggaacaucgucuucguguccgagaacgugacccaguaccugcaguacaagcaggaggaccucgucaacacgagcguguacaacauccugcacgaggaggaccgcaaggacuuccugaagaaccucccgaaguccaccgugaacggcgucagcuggaccaacgagacccagcggcagaagucccacacguucaacugccgcaugcugaugaagaccccccacgacauccuggaggacaucaacgccagccccgagaugcggcagcgcuacgagaccaugcagugcuucgcgcucucccagccccgggccaugauggaggagggggaggaccugcagagcugcaugaucugcguggcccgccggaucaccacgggcgagcgcaccuucccguccaaccccgagagcuucaucacccggcacgaccugagcggcaagguggucaacaucgacaccaacucccuccgcagcuccaugcggcccggguucgaggacaucauccgccggugcauccagcgcuucuucagccugaacgacggccaguccuggagccagaagcgccacuaccaggaggugacguccgacgggaucuucagccccaccgccuaccugaacggccacgcggagaccccgguguaccgguucucccucgccgacggcaccaucgucacggcccagaccaagagcaagcuguuccgcaaccccgugaccaacgaccggcacggguucguguccacccacuuccugcagcgcgagcagaacggcuaccggcccaaccccaacccggucgggcagggcauccgcccccccauggccgggugcaacagcuccgugggcggcaugagcaugucccccaaccaggggcuccagaugccgagcucccgggccuacggccuggcggaccccagcacgaccgggcagauguccggcgcccgcuacgggggcagcagcaacaucgccucccugacccccggccccgggaugcagagcccguccagcuaccagaacaacaacuacggccucaacauguccagccccccccacgggucccccggccuggccccgaaccagcagaacaucaugaucagcccccggaaccgcgggucccccaagaucgccagccaccaguucuccccgguggcgggcguccacagccccauggccuccagcggcaacaccgggaaccacuccuucagcuccagcagccuguccgcccuccaggccaucagcgagggcguggggacgucccugcugagcacccucuccagccccggccccaagcuggacaacuccccgaacaugaacaucacccagcccagcaaggucuccaaccaggacagcaaguccccccugggcuucuacugcgaccagaaccccguggagagcuccaugugccagagcaacucccgggaccaccucagcgacaaggaguccaaggagagcuccguggagggggccgagaaccagcgcggcccgcuggagagcaaggggcacaagaagcugcuccagcugcugaccugcagcuccgacgaccggggccacagcucccucacgaacagcccccuggacuccagcugcaaggaguccagcgucuccgugaccagccccuccggggugagcuccagcaccuccggcggcgucagcuccaccagcaacaugcacgggucccugcugcaggagaagcaccgcauccuccacaagcugcugcagaacggcaacagccccgcggagguggccaagaucacggccgaggccaccgggaaggacaccagcuccaucaccagcugcggcgacgggaacguggucaagcaggagcagcucuccccgaagaagaaggagaacaacgcccugcugcgguaccuccuggaccgcgacgaccccagcgacgcgcuguccaaggagcuccagccccagguggagggcguggacaacaagaugagccagugcaccuccagcacgauccccuccagcucccaggagaaggacccgaagaucaagaccgagaccagcgaggagggcuccggggaccuggacaaccuggacgccauccucggcgaccugaccagcuccgacuucuacaacaacagcaucuccagcaacgggucccaccugggcacgaagcagcaggucuuccaggggaccaacagccucggccugaagagcucccagagcgugcaguccauccggccccccuacaaccgcgccgugagccuggacucccccgucagcgugggcuccagcccgcccgugaagaacaucuccgccuuccccaugcuccccaagcagccgaugcuggggggcaacccccggaugauggacagccaggagaacuacggguccagcaugggcgacugggggcugcccaacuccaaggcgggccgcauggagccgaugaacagcaacuccaugggccgccccgggggcgacuacaacaccagccucccccggcccgcccuggggggcuccaucccgacccugccccuccgcagcaacuccauccccggcgcccggcccguccugcagcagcagcagcagaugcugcagaugcgcccgggggagauccccaugggcaugggggccaaccccuacggccaggccgcggccagcaaccagcucgggagcuggcccgacggcaugcuguccauggagcaggugagccacggcacgcagaaccggccgcugcuccgcaacucccuggacgaccugguggggccccccagcaaccucgagggccaguccgacgagcgggcccugcuggaccagcuccacacccugcugagcaacaccgacgccaccgggcucgaggagaucgaccgcgcccugggcauccccgagcuggucaaccaggggcaggcgcucgagccgaagcaggacgccuuccagggccaggaggccgccgugaugauggaccagaaggccggccuguacgggcagacguaccccgcgcagggcccccccaugcaggggggcuuccaccugcaggggcaguccccgagcuucaacuccaugaugaaccagaugaaccagcagggcaacuucccccuccagggcaugcacccccgggccaacaucaugcgcccccggaccaacaccccgaagcagcugcgcaugcagcugcagcagcggcuccaggggcagcaguuccugaaccagagccgccaggcccuggagcucaagauggagaaccccaccgccggcggggcggccgugaugcggcccaugaugcagccccagcagggcuuccugaacgcccagauggucgcccagcgcucccgggagcugcucagccaccacuuccgccagcagcggguggccaugaugaugcagcagcagcagcagcagcagcagcagcagcagcagcagcagcagcagcagcagcagcagcagcagcagcagcagcagcagcagcagacgcaggcguucuccccgccccccaacgugaccgccagcccguccauggacggccugcuggccgggcccaccaugccccaggcccccccgcagcaguuccccuaccagcccaacuacggcauggggcagcagcccgacccggccuucggccgcgucagcuccccccccaacgcgaugaugagcucccggauggggcccagccagaacccgaugaugcagcacccccaggccgccagcaucuaccaguccagcgagaugaagggcuggcccuccggcaaccucgcccgcaacagcuccuucagccagcagcaguucgcccaccaggggaaccccgcgguguacuccauggugcacaugaacggcagcuccgggcacaugggccagaugaacaugaacccgaugcccaugagcgggaugcccaugggccccgaccagaaguacugcuga

SEQ ID NO: 33428 - RNA, 1953 nt, Artificial Sequence
  derived and/or modified sequence opt1 from NCOA4__Homo_sapiens__NP_001138732
augggcgcccagcugaccaccuucgcccucgcgggggccgugcgccggaugaacaccuuccaggaccagagcggcuccagcuccaaccgcgagccccugcugcggugcagcgacgcccgccgggaccucgagcuggccaucgggggcguccugcgcgccgagcagcagaucaaggacaaccuccgggaggugaaggcgcagauccacuccugcaucagccgccaccuggagugccugcggucccgcgagguguggcucuacgagcaggucgaccugaucuaccagcugaaggaggagacccuccagcagcaggcccagcagcuguacagccugcucgggcaguucaacugccugacccaccagcuggagugcacccagaacaaggaccucgccaaccagguguccgugugccuggagcggcugggcagccucacgcugaagccggaggacuccaccguccuccuguucgaggccgacaccaucacccugcgccagacgaucaccaccuucggcagccugaagaccauccagauccccgagcaccucauggcgcacgccuccagcgccaacaucgggcccuuccuggagaagcggggcugcaucuccaugcccgagcagaaguccgccagcgggaucguggccgugccguucagcgaguggcugcucggcuccaagcccgcgagcggguaccaggcccccuacauccccagcacggacccgcaggacuggcugacccagaagcagacccuggagaacucccagaccagcucccgcgccugcaacuucuucaacaacgucggcggcaaccucaaggggcuggagaacuggcugcucaagagcgagaaguccagcuaccagaagugcaacucccacagcacgaccuccagcuucuccaucgagauggagaaggugggcgaccaggagcugcccgaccaggacgagauggaccugagcgacuggcucgugacgccccaggagucccacaagcugcggaagcccgagaacgggagccgcgagaccuccgagaaguucaagcuccuguuccagagcuacaacgucaacgacuggcuggugaagaccgacuccugcaccaacugccagggcaaccagccgaagggcguggagaucgagaaccuggggaaccucaagugccugaacgaccaccuggaggccaagaagccccucagcacccccuccauggucaccgaggacuggcuggugcagaaccaccaggaccccugcaagguggaggaggucugccgggccaacgagccgugcacgagcuucgcggagugcgugugcgacgagaacugcgagaaggaggcccuguacaaguggcugcucaagaaggagggcaaggacaagaacgggaugcccguggagcccaagcccgagccggagaagcacaaggacagccugaacauguggcugugcccccgcaaggaggucaucgagcagaccaaggcccccaaggccaugacccccucccggaucgccgacagcuuccaggugaucaagaacuccccgcucagcgaguggcugauccgcccgcccuacaaggagggcucccccaaggaggugcccgggaccgaggaccgggcgggcaagcagaaguucaagagccccaugaacacguccuggugcagcuucaacaccgccgacuggguccugcccggcaagaagauggggaaccucucccagcugagcuccggcgaggacaaguggcugcuccgcaagaaggcccaggaggugcugcugaacagcccgcuccaggaggagcacaacuucccgcccgaccacuacgggcugcccgccgucugcgaccuguucgccugcaugcagcucaagguggacaaggagaaguggcuguaccgcacgccccugcaggcguacuucaagaugaacuuccaggacgugaccgucggcaacuuccagauccccugcggguucuga

SEQ ID NO: 33429 - RNA, 1740 nt, Artificial Sequence
  derived and/or modified sequence opt1 from NCOA5__Homo_sapiens__NP_066018
augaacaccgcccccagccgcccgucccccacccggcgcgaccccuacggcuucggggacagccgggacucccgccgggaccgcagccccauccggggcuccccgcgccgggagccccgcgacgggcggaacggccgcgacgcccgggacagccgcgacauccgggacccccgcgaccugcgggaccaccgccacucccgggaccuccgcgaccaccgggacagccgcuccgugcgcgacguccgggacgugcgcgaccugcgggacuuccgcgaccugcgggacagccgcgacuuccgggaccagcgcgaccccauguacgaccgguaccgcgacaugcgggacucccgcgacccgauguaccggcgcgaggggagcuacgaccgguaccuccgcauggacgacuacugccggcgcaaggacgacuccuacuucgaccgguaccgcgacagcuucgacggccgcggcccgcccgggcccgagucccagagccgggcgaaggagcgccugaagcgggaggagcgccggcgcgaggagcuguaccggcaguacuucgaggagauccagcgccgguucgacgccgagcgccccguggacugcuccgucaucguggugaacaagcagacgaaggacuacgccgagagcgucggccggaaggugcgcgaccucgggaugguggucgaccugaucuuccugaacaccgaggugucccucagccaggcccuggaggacgugagccggggcgggucccccuucgccaucgucaucacccagcagcaccagauccaccgcagcugcaccgugaacaucauguucggcacgccccaggagcaccggaacaugccccaggcggacgccauggugcuggucgcccgcaacuacgagcgguacaagaacgagugccgcgagaaggagcgggaggagaucgcccgccaggcggccaagauggccgacgaggccauccuccaggagcgggagcgcggcgggccggaggagggcgugcgcgggggccacccgcccgccauccagucccugaucaaccugcucgcggacaaccgguaccugaccgccgaggagaccgacaagaucaucaacuaccugcgcgagcggaaggagcgccucaugcggagcuccaccgacagccugcccggccccaucucccgccagccccugggggccacgagcggcgccucccucaagacccagcccagcucccagccccugcagagcggccaggugcugccguccgccacccccacccccagcgcgcccccgacgucccagcaggagcuccaggccaagauccugagccuguucaacuccgggaccgucaccgccaacagcuccagcgccagccccuccguggccgcggggaacacccccaaccagaacuucagcacggccgccaacucccagccgcagcagcggagccaggccuccggcaaccagccgcccagcauccucggccagggcggguccgcccagaacauggggccccgccccggcgcgcccagccaggggcuguucggccagcccuccagccggcuggcccccgccuccaacaugaccagccagcgcccgguguccagcaccggcaucaacuucgacaaccccuccguccagaaggcccucgacacccugauccagagcgggcccgcgcugucccaccucgugagccagacgaccgcccagaugggccagccccaggccccgauggggagcuaccagcggcacuacuga

SEQ ID NO: 33430 - RNA, 3213 nt, Artificial Sequence
  derived and/or modified sequence opt1 from NCOA6__Homo_sapiens__NP_001229468
auggugcuggacgaccuccccaaccuggaggacaucuacaccagccugugcagcagcaccauggaggacagcgagauggacuucgacagcggccucgaggacgacgacaccaaguccgacagcauccuggaggacuccaccaucuucgucgccuucaaggggaacaucgacgacaaggacuucaaguggaagcuggacgccauccucaagaacgugcccaaccugcugcacauggagagcuccaagcucaaggugcagaaggucgagcccuggaacagcgugcgcgugaccuucaacaucccccgcgaggcggccgagcgccugcggauccuggcccaguccaacaaccagcagcuccgcgaccugggcauccugagcguccagaucgagggggagggcgccaucaaccucgcccuggcccagaaccggucccaggacgugcgcaugaacgggcccaugggcgccggcaacagcgugcggauggaggccggguuccccauggccuccggccccgggaucauccgcaugaacaaccccgcgaccgucaugaucccgcccggcgggaacgugagcuccagcaugauggcccccggccccaaccccgagcugcagccccggacgccccgccccgccucccagagcgacgccauggacccccuccugagcggccugcacauccagcagcagucccaccccagcgggucccucgcgccgccccaccaccccaugcagcccgugagcgucaaccggcagaugaaccccgcgaacuucccccagcugcagcagcagcagcagcagcagcagcagcagcagcagcagcagcagcagcagcagcagcagcagcagcagcagcagcugcaggcccgcccgccccagcagcaccagcagcagcagccccagggcauccggccccaguucaccgcccccacccaggugcccgugccgcccggguggaaccagcuccccuccggcgcccugcagcccccgcccgcccagggcagccuggggaccaugaccgcgaaccagggcuggaagaaggcgccccuccccgggcccaugcagcagcagcugcaggcccgccccucccuggccaccguccagacccccagccacccgccgccgcccuaccccuucggcucccagcaggccagccaggcccacaccaacuucccccagauguccaaccccgggcaguucacggcgccccagaugaagucccuccagggcggccccucccgggugcccacgccccuccagcagccccaccugaccaacaagagccccgccuccagccccuccagcuuccagcaggggucccccgccagcagccccaccgugaaccagacgcagcagcagaugggcccccgcccgccccagaacaacccccucccccagggguuccagcagcccgucuccagccccggccggaaccccauggugcagcaggggaacgugccgcccaacuucauggucaugcagcagcagccgcccaaccagggcccccagucccugcaccccggccugggcgggaugccgaagcgccugccgcccggguucagcgccggccaggccaaccccaacuucaugcagggccaggugccguccaccaccgccaccacgcccggcaacagcggcgcgccccagcugcaggccaaccagaacgugcagcacgccggcggccagggggccggcccgccccagaaccagaugcaggucucccacgggccgcccaacaugaugcagcccagccugauggggauccacggcaacaugaacaaccagcaggccgggaccuccggcgugccccaggucaaccucagcaacaugcaggggcagccccagcaggggccgcccucccagcugaugggcaugcaccagcagaucgugccgagccaggggcagauggugcagcagcagggcacccugaacccccagaaccccaugauccucucccgggcccagcugaugccgcaggggcagaugauggucaacccgcccagccagaaccugggccccuccccgcagcgcaugacgccgcccaagcagaugcucagccagcaggggccccagaugauggccccgcacaaccagaugaugggcccccagggccaggugcugcugcagcagaaccccaugaucgagcagaucaugacgaaccagaugcaggggaacaagcagcaguucaacacccagaaccaguccaacgugaugcccggcccggcgcagaucaugcgggggcccacccccaacaugcagggcaacaugguccaguucaccgggcagaugagcggccagaugcucccccagcagggcccggugaacaacagccccucccaggugauggggauccagggccagguccugcggccgcccgggccgagcccccacauggcccagcagcacggcgaccccgccacgaccgccaacaacgacgugucccugagccagaugaugcccgacguguccauccagcagaccaacauggucccgccccacgugcaggccaugcaggggaacagcgcguccggcaaccacuucagcggccacgggauguccuucaacgcccccuucagcggcgcccccaacgggaaccagauguccugcggccagaacccgggcuuccccgugaacaaggacgucacccugacgagcccccuccuggugaaccugcuccaguccgacaucagcgccgggcacuucggcgugaacaacaagcagaacaacaccaacgccaacaagccgaagaagaagaagccgccccgcaagaagaagaacucccagcaggaccugaacacccccgacacccggccggcggggcuggaggaggccgaccagccgccccuccccggcgagcaggggaucaaccuggacaacagcggccccaagcugcccgaguucuccaaccggccgcccgccccgagccagaaccucgucuccaaggagacgagcaccaccgcccugcaggcgagcguggcccggcccgagcuggaggugaacgccgccaucgucuccggccagagcuccgagcccaaggagaucguggagaaguccaagauccccgggcgccggaacucccgcaccgaggagccgaccguggccagcgaguccgucgagaacggccaccggaagcgcagcucccggcccgcgagcgccuccagcuccacgaaggacaucaccagcgccgugcaguccaagcgccgcaagagcaaguga

SEQ ID NO: 33431 - RNA, 2796 nt, Artificial Sequence
  derived and/or modified sequence opt1 from NCOA7__Homo_sapiens__NP_001116314
auggacaccaaggaggagaagaaggagcgcaagcagagcuacuucgcccggcugaagaagaagaagcaggccaagcagaacgcggagaccgccuccgccguggccacgcgcacccacaccggcaaggaggacaacaacaccgucgugcucgagcccgacaagugcaacaucgccguggaggaggaguacaugacggacgagaagaagaagcgcaagagcaaccagcugaaggagauccggcggaccgagcugaagcgcuacuacuccaucgacgacaaccagaacaagacccacgacaagaaggagaagaagauggucgugcagaagccgcacgggaccauggaguacacggcgggcaaccaggacacccucaacagcaucgcccugaaguucaacaucacccccaacaagcugguggagcucaacaagcuguucacccacacgaucguccccggccaggugcuguucgugcccgacgccaacuccccgagcuccacccuccggcugagcuccagcucccccggggccaccgucagccccuccagcuccgacgcggaguacgacaagcugcccgacgccgaccucgcccgcaaggcccugaagccgaucgagcgggugcugagcuccaccagcgaggaggacgagcccgggguggucaaguuccucaagaugaacugccgcuacuucacggacggcaagggcguggucgggggcgugaugaucgugacccccaacaacaucauguucgacccccacaaguccgacccgcuggugaucgagaacgggugcgaggaguacggccugaucugccccauggaggaggucgugagcaucgcccucuacaacgacaucagccacaugaagaucaaggacgcgcugcccucccccggggagugggaggaccuggccagcgagaaggacaucaacccguucuccaaguucaagagcaucaacaaggagaagcggcagcagaacggcgagaagaucaugaccuccgacagccgccccaucgugccccucgagaaguccaccggccacacgcccaccaagccgagcggguccagcgucuccgagaagcugaagaagcuggacagcucccgggagaccagccacggcucccccaccgugacgaagcucagcaaggagcccuccgacaccagcuccgccuucgagagcaccgccaaggagaacuuccugggggaggacgacgacuucguggaccuggaggagcucagcucccagaccggcggcgggaugcacaagaaggacacgcugaaggagugccugagccucgaccccgaggagcgcaagaaggccgagucccagaucaacaacagcgcggucgagaugcagguccaguccgcccuggccuuccugggcaccgagaacgacguggagcucaagggggcccuggaccuggagaccugcgagaagcaggacaucaugccggagguggacaagcagagcggcucccccgagagccggguggagaacacccucaacauccacgaggaccuggacaaggucaagcugaucgaguacuaccucacgaagaacaaggaggggccccagguguccgagaaccugcagaagaccgagcugagcgacggcaaguccaucgagcccggcgggaucgacaucacccucagcuccagccugucccaggccggcgacccgaucaccgaggggaacaaggagcccgacaagacgugggugaagaagggcgagccccugccggucaagcucaacagcuccaccgaggcgaacgugaucaaggaggcccuggacagcagccuggaguccacccucgacaacagcugccagggggcccagauggacaacaaguccgaggugcagcuguggcugcugaagcgcauccagguccccaucgaggacauccuccccagcaaggaggagaaguccaagacgcccccgauguuccugugcaucaaggugggcaagcccaugcgcaagagcuucgccacccacaccgccgcgauggugcagcaguacggcaagcggcggaagcagcccgaguacugguucgccgucccccgcgagcggguggaccaccuguacaccuucuucgugcagugguccccggacgucuacgggaaggacgccaaggagcagggcuucgugguggucgagaaggaggagcucaacaugaucgacaacuucuucagcgagcccaccaccaaguccugggagaucaucacgguggaggaggccaagcgccgcaagagcacgugcuccuacuacgaggacgaggacgaggaggugcugcccguccugcggccccacagcgcgcuccuggagaacaugcacaucgagcagcuggcccgccggcucccggcccgcgugcagggguaccccuggcggcuggccuacuccacccuggagcacggcaccagccucaagacccuguaccgcaaguccgccagccuggacucccccgugcuccuggucaucaaggacauggacaaccagaucuucggggcguacgccacccaccccuucaaguucagcgaccacuacuacggcaccggcgagaccuuccuguacacguucuccccgcacuucaagguguucaaguggagcggggagaacagcuacuucaucaacggcgacaucuccagccucgagcucgggggcggcgggggccgguucgggcuguggcuggacgccgaccuguaccacggccgcuccaacagcugcuccaccuucaacaacgacauccugagcaagaaggaggacuucaucgugcaggaccucgaggucugggccuucgacuga

SEQ ID NO: 33432 - RNA, 2745 nt, Artificial Sequence
  derived and/or modified sequence opt1 from NCOR1__Homo_sapiens__NP_001177367
augagcuccagcggcuacccgcccaaccagggggccuucuccaccgagcagagccgcuacccgccccacuccgugcaguacaccuuccccaacacgcggcaccagcaggaccccgccuucggcgggaagcacgaggcgcccagcucccccaucagcggccagcccugcggggacgaccagaacgccuccccgagcaagcuguccaaggaggagcucauccagagcauggaccgcgucgaccgggagaucgccaagguggagcagcagauccugaagcugaagaagaagcagcagcagcucgaggaggaggccgccaagccgcccgagcccgagaagcccguguccccgccgcccgucgagcagaagcaccgcagcaucgugcagaucaucuacgacgagaaccggaagaaggcggaggaggcccacaagaucuucgagggccugggccccaagguggagcugccccucuacaaccagcccuccgacaccaaggucuaccacgagaacaucaagaccaaccaggugaugcgcaagaagcugauccuguucuucaagcggcgcaaccacgcccggaagcagcgcgagcagaagaucugccagcgguacgaccagcucauggaggccugggagaagaagguggaccgcaucgagaacaacccccggcgcaaggcgaaggagagcaagacccgggaguacuacgagaagcaguuccccgagauccgcaagcagcgggagcagcaggagcgcuuccagcgggucgggcagcgcggcgccgggcuguccgccacgaucgcccggagcgagcacgagaucuccgagaucaucgacggccugagcgagcaggagaacaacgagaagcagaugcgccagcucagcgugaucccgcccaugauguucgacgccgagcagcgccgggugaaguucaucaacaugaacgggcugauggaggaccccaugaaggucuacaaggaccgccaguucaugaacguguggaccgaccacgagaaggagaucuucaaggacaaguucauccagcaccccaagaacuucggccugaucgcguccuaccucgagcgcaagagcgugcccgacugcguccuguacuacuaccugaccaagaagaacgagaacuacaaggcccucgugcggcggaacuacggcaagcgccgggggcgcaaccagcagaucgcccggcccucccaggaggagaagguggaggagaaggaggaggacaaggccgagaagaccgagaagaaggaggaggagaagaaggacgaggaggagaaggacgagaaggaggacagcaaggagaacacgaaggagaaggacaagaucgacggcaccgccgaggagaccgaggagcgcgagcaggcgacgccccgggggcgcaagaccgccaacucccagggccggcgcaagggccggaucacccgcagcaugaccaacgaggccgccgccgcguccgccgccgccgccgcggccaccgaggagccgccgccgccccugcccccgccgcccgagcccaucagcacggagcccgucgagaccucccgguggaccgaggaggagauggagguggccaagaaggggcugguggagcacggccgcaacugggccgcgaucgccaagauggucgggaccaagagcgaggcccagugcaagaacuucuacuucaacuacaagcggcgccacaaccucgacaaccugcugcagcagcacaagcagaagacgucccgcaagccccgggaggagcgcgacgugagccagugcgaguccguggccagcaccgucuccgcccaggaggacgaggacaucgaggcgagcaacgaggaggagaaccccgaggacuccgagggcgccgagaacagcuccgacaccgagagcgcccccagccccucccccguggaggccgucaagcccagcgaggacucccccgagaacgccaccagccgggggaacacggagcccgcgguggagcucgagcccaccaccgagaccgccccguccacgagccccucccuggccgugcccagcaccaagcccgccgaggacgaguccgucgagacccaggugaacgacagcaucuccgccgagaccgcggagcagauggacguggaccagcaggagcacagcgccgaggagggcuccgucugcgacccgccgcccgccacgaaggccgacagcguggacguggagguccgcgugcccgagaaccacgcguccaagguggagggcgacaacaccaaggagcgggaccuggaccgcgccagcgagaaggucgagccccgggacgaggaccucgugguggcccagcagaucaacgcccagcgccccgagccccaguccgacaacgacagcagcgcgaccugcuccgccgacgaggacgucgacggggagccggagcggcagcgcauguuccccauggacagcaagcccucccugcugaaccccaccggcagcauccucguguccagcccgcugaagcccaacccccuggaccucccccagcugcagcaccgggccgccgugaucccgcccauggucuccugcacgcccugcaacauccccaucgggaccccggugagcggcuacgcccuguaccagcgccacaucaaggccaugcacgaguccgcgcuccuggaggagcagcggcagcgccaggagcagaucgaccuggagugccggagcuccaccagccccugcgggaccuccaagagccccaaccgcgagugggagggccgguga

SEQ ID NO: 33433 - RNA, 7377 nt, Artificial Sequence
  derived and/or modified sequence opt1 from NCOR2__Homo_sapiens__NP_001070729
augagcggcuccacccagcccguggcccagaccuggcgcgccacggagccgcgguaccccccccacagccuguccuaccccguccagaucgcgcgcacccacaccgacguggggcuccuggaguaccagcaccacagccgggacuacgccucccaccugagcccgggcuccaucauccagccccagcgccggcgccccagccuccuguccgaguuccagcccgggaacgagcggagccaggagcugcaccuccgcccggagucccacagcuaccugcccgagcugggcaaguccgagauggaguucaucgagagcaagcggccccgccucgagcugcugcccgacccgcuccugcggcccuccccccugcucgccaccgggcagcccgccggcagcgaggaccugacgaaggaccgcucccugaccggcaagcucgagccggugagcccccccucccccccgcacaccgaccccgagcuggagcugguccccccccggcucagcaaggaggagcugauccagaacauggaccgcguggaccgggagaucaccaugguggagcagcagaucagcaagcugaagaagaagcagcagcagcucgaggaggaggccgcgaagccgcccgagcccgagaagcccgucuccccgccccccaucgagagcaagcaccgcucccuggugcagaucaucuacgacgagaaccggaagaaggccgaggccgcccaccgcauccuggaggggcucggcccgcagguggagcugccccuguacaaccagcccagcgacacgcggcaguaccacgagaacaucaagaucaaccaggcgaugcgcaagaagcucauccuguacuucaagcggcgcaaccacgcccgcaagcagugggagcagaaguucugccagcgguacgaccagcugauggaggccugggagaagaaggucgagcgcaucgagaacaacccccggcgccgggccaaggaguccaaggugcgcgaguacuacgagaagcaguucccggagauccggaagcagcgcgagcuccaggagcggaugcagcgcguggggcagcggggcagcgggcuguccaugagcgccgcgcgcuccgagcacgaggucagcgagaucaucgacggccuguccgagcaggagaaccucgagaagcagaugcggcagcuggccgugaucccccccaugcuguacgacgccgaccagcagcgcaucaaguucaucaacaugaacggccucauggccgaccccaugaagguguacaaggaccggcaggucaugaacauguggagcgagcaggagaaggagaccuuccgcgagaaguucaugcagcacccgaagaacuucgggcugaucgccuccuuccuggagcggaagaccguggcggagugcgugcucuacuacuaccugaccaagaagaacgagaacuacaagagccugguccgccgguccuaccgccgccggggcaagagccagcagcagcagcagcagcagcagcagcagcagcagcagcagcagcagcagcccaugccccgcuccagccaggaggagaaggacgagaaggagaaggagaaggaggccgagaaggaggaggagaagcccgagguggagaacgacaaggaggaccuccugaaggagaagacggacgacaccuccggggaggacaacgacgagaaggaggccguggccagcaagggccggaagaccgccaacagccagggccgccggaaggggcgcaucacccgguccauggcgaacgaggccaacagcgaggaggccaucacgccgcagcaguccgccgagcuggccagcauggagcucaacgaguccagccgcuggaccgaggaggagauggagaccgcgaagaagggccugcuggagcacgggcggaacugguccgccaucgcccgcauggucggcagcaagaccgugucccagugcaagaacuucuacuucaacuacaagaagcggcagaaccuggacgagauccuccagcagcacaagcugaagauggagaaggagcgcaacgcccggcgcaagaagaagaaggcgcccgccgccgccagcgaggaggccgcguucccccccguggucgaggacgaggagauggaggccuccggggugagcggcaacgaggaggagauggucgaggaggccgaggccacggugaacaacuccagcgacaccgaguccaucccgagcccccacaccgaggccgcgaaggacaccggccagaacgggcccaagcccccggccacgcugggcgccgacgggcccccccccggcccgcccacccccccgcccgaggacauccccgcccccaccgagccgacccccgccuccgaggcgacgggggcccccacccccccgcccgccccccccagcccgagcgcccccccccccguggucccgaaggaggagaaggaggaggagaccgcggccgccccccccguggaggagggcgaggagcagaagcccccggccgccgaggagcucgcgguggacaccggcaaggccgaggagcccgucaaguccgagugcacggaggaggccgaggaggggcccgccaagggcaaggacgccgaggcggccgaggccaccgccgagggggcccugaaggcggagaagaaggagggcgggagcggccgggccaccaccgccaaguccagcggcgccccccaggacuccgacagcuccgcgacgugcagcgccgacgagguggacgaggccgaggggggcgacaagaaccgccugcucuccccgcggcccagccugcugacccccaccggggacccccgcgccaacgccuccccgcagaagccccucgaccugaagcagcugaagcagcgggcggccgccauccccccgauccaggugaccaagguccacgagcccccccgcgaggacgccgcccccaccaagccggcgccccccgcccccccgcccccccagaaccuccagcccgagagcgacgccccgcagcagcccggcuccagcccccggggcaagucccgcagccccgccccgcccgccgacaaggaggcggagaagcccguguucuuccccgccuucgccgccgaggcccagaagcugccgggggacccccccugcuggacguccggccugcccuucccggugcccccccgcgaggucaucaaggcgagcccccacgccccggaccccuccgccuucagcuacgcccccccggggcacccccucccccugggccugcacgacaccgcgcggcccgugcucccgcgcccccccaccaucagcaaccccccgccccugaucuccagcgccaagcaccccuccgugcuggagcggcagaucggggccaucagccagggcauguccguccagcuccacgugcccuacagcgagcacgccaaggccccggugggccccgucaccauggggcugccccugcccauggacccgaagaagcucgcgcccuucuccggcgugaagcaggagcagcugagcccccgcgggcaggccggccccccggagucccugggggugcccacggcccaggaggccagcguccuccggggcaccgcccugggcuccgugcccgggggcagcaucaccaaggggauccccuccacccgcgugccgagcgacuccgcgaucacguaccggggcagcaucacccacgggacccccgccgacguccuguacaagggcaccaucacgcgcaucaucggcgaggacucccccagccggcucgaccgcgggcgggaggacucccugccgaagggccacgugaucuacgaggggaagaagggccacgugcugagcuacgaggggggcaugagcgucacccagugcuccaaggaggacggccgcagcuccagcgggcccccccacgagaccgccgcccccaagcggaccuacgacaugauggagggccgcguggggcgggccaucuccagcgcguccaucgagggccucaugggccgcgccaucccgcccgagcggcacagcccccaccaccugaaggagcagcaccacauccgcggguccaucacgcagggcaucccccggagcuacguggaggcccaggaggacuaccugcgccgcgaggccaagcuccugaagcgggaggggaccccgcccccccccccgcccucccgcgaccugaccgaggcguacaagacccaggcccucggcccccugaagcugaagcccgcccacgaggggcucgucgccacggugaaggaggccggccggagcauccacgagaucccgcgcgaggagcugcggcacacccccgagcugccccucgcgccccgcccgcugaaggagggcuccaucacccaggggaccccccugaaguacgacacgggcgccagcaccaccggguccaagaagcacgacgugcggagccucaucggcucccccgggcgcaccuuccccccgguccacccccuggacgugauggccgacgcccgggcccuggagcgcgcgugcuacgaggagagccucaagucccggcccggcacggccagcagcuccggcgggagcaucgcccgcggcgcccccgugaucgucccggagcuggggaagccccggcaguccccccugaccuacgaggaccacggcgccccguucgcggggcaccucccccgcggcagccccgugaccacccgggagcccacgccgcgccugcaggagggcucccugagcuccagcaaggccucccaggaccggaagcucaccagcaccccccgcgagaucgccaaguccccccacagcaccgugcccgagcaccacccgcaccccaucucccccuacgagcaccugcugcggggggucagcggcguggaccucuaccgcucccacaucccccuggccuucgacccgacgagcaucccccgggggaucccccuggacgcggccgccgccuacuaccucccccgccaccuggccccgaaccccaccuacccccaccuguaccccccguaccucauccgcggcuaccccgacaccgcggcccuggagaaccggcagaccaucaucaacgacuacaucaccucccagcagaugcaccacaacgccgccacggccauggcgcagcgcgccgacaugcugcggggccucagcccccgcgaguccagccuggcccugaacuacgccgccgggccccggggcaucaucgaccucagccaggugccgcaccugcccguccuggugccccccaccccggggacccccgcgaccgccauggaccgccucgccuaccugcccacggccccgcagcccuucuccagccggcacuccagcuccccccugagccccggcgggccgacccaccucaccaagcccaccacgaccuccagcuccgagcgcgagcgggaccgcgaccgggagcgcgaccgggaccgcgagcgggagaagagcauccugaccuccaccacgaccguggagcacgcccccaucuggcgccccggcaccgagcagagcuccggcagcuccgggggcgggggcgggagcuccagccggccggcgucccacagccacgcccaccagcacagccccaucuccccccgcacccaggacgcccugcagcagcggcccagcguccuccacaacacgggcaugaagggcaucaucaccgccguggagccguccacccccaccgugcugcgcagcacguccaccagcucccccguccgccccgcggccaccuucccgcccgccacccacugcccccuggggggcacgcucgacgggguguaccccacccugauggagccggugcugcuccccaaggaggccccccgggucgcccgccccgagcggccgcgcgcggacaccggccacgccuuccuggccaagccccccgcccggagcgggcuggagcccgccuccagcccguccaagggcagcgagccccgcccccucgugccgcccgucuccggccacgcgaccaucgcccggacgcccgccaagaaccuggccccccaccacgccagcccggacccccccgcgcccccggccuccgccagcgacccccaccgcgagaagacccaguccaagcccuucagcauccaggagcuggagcuccggagccugggguaccacggcuccagcuacucccccgaggggguggagccggugagccccgucuccagccccucccugacccacgacaagggccugcccaagcaccucgaggagcuggacaagagccaccuggagggggagcuccgcccgaagcagcccggccccgugaagcugggcggggaggccgcgcaccugccccaccuccggccgcugcccgagucccagcccagcuccagcccccugcuccagaccgccccgggcgugaaggggcaccagcgcgucgugacgcuggcccagcacaucuccgaggugaucacccaggacuacacccggcaccacccccagcagcugagcgccccccucccggccccccuguacuccuuccccggcgcgagcugccccguccuggaccuccgccggccgcccuccgaccuguaccugccccccccggaccacggcgcccccgcccgcgggagcccccacuccgagggcgggaagcggagccccgagccgaacaagaccagcgugcucggcgggggcgaggacggcaucgagcccguguccccccccgaggggaugacggagccgggccacagccgcuccgccgucuacccccugcuguaccgggacggggagcagaccgagcccagccgcaugggcuccaagagccccgggaacaccucccagccgcccgccuucuucagcaagcucaccgaguccaacagcgcgauggugaaguccaagaagcaggagaucaacaagaagcugaacacccacaaccggaacgagcccgaguacaacaucagccagcccggcacggagaucuucaacaugccggccaucaccggcaccgggcugaugaccuaccgcucccaggccgugcaggagcacgccagcacgaacaugggccucgaggccaucauccgcaaggcgcugauggggggcgggggcaaggccaaggucuccggccggcccagcucccgcaaggccaagagccccgcccccgggcuggcguccggcgaccggccgcccagcgugagcuccgugcacagcgagggggacugcaaccgccggaccccccucaccaaccgcgucugggaggaccggccguccagcgccggcuccacccccuuccccuacaacccccugaucaugcgccugcaggccggggugauggccagcccgcccccccccggccucccggccggcuccgggccccuggcgggcccccaccacgccugggacgaggagcccaagccgcugcucugcagccaguacgagacgcuguccgacagcgaguga

SEQ ID NO: 33434 - RNA, 912 nt, Artificial Sequence
  derived and/or modified sequence opt1 from NCR1__Homo_sapiens__NP_001138929
augagcuccacccugcccgcccuccugugcgugggccugugccucagccagcgcaucuccgcccagcagcagacccugccgaagcccuucaucugggcggagccccacuucaugguccccaaggagaagcaggucacgaucugcugccaggggaacuacggcgccguggaguaccagcugcacuucgaggggagccucuucgccguggaccggccgaagccgcccgagcgcaucaacaaggugcaguucuacauccccgacaugaacucccggauggccggccaguacagcugcaucuaccgcgugggggagcugugguccgagcccagcaaccugcucgaccuggucgugaccgagauguacgacacccccacccuguccgugcaccccggccccgaggucaucagcggcgagaaggugacguucuacugccggcucgacaccgccaccuccauguuccugcugcucaaggaggggcgcagcucccacgugcagcggggcuacgggaagguccaggcggaguucccgcugggccccgugaccacggcccaccgcgggaccuaccggugcuucggcagcuacaacaaccacgccugguccuuccccagcgagcccgugaagcugcucgucaccggcgacaucgagaacaccucccuggccccggaggaccccacguuccccgacaccugggggaccuaccugcucaccacggagaccggccugcagaaggaccacgcgcugugggaccacaccgcccagaaccuccugcgcauggggcuggccuuccucgugcugguggcccuggucugguuccucguggaggacuggcugagccggaagcgcacccgggagcgcgccucccgggcgagcacgugggagggccgccggcgccugaacacccagacccucuga

SEQ ID NO: 33435 - RNA, 813 nt, Artificial Sequence
  derived and/or modified sequence opt1 from NCR2__Homo_sapiens__NP_001186438
auggccuggcgcgcccugcacccccuccugcugcuccugcuccuguucccgggcagccaggcgcaguccaaggcccaggugcugcagagcgucgccgggcagacccugaccgugcggugccaguacccgcccacgggcucccucuacgagaagaagggguggugcaaggaggccagcgcccuggugugcauccgccuggucaccuccagcaagccccggaccauggcguggaccucccgcuucacgaucugggacgacccggacgccggcuucuucaccgugaccaugaccgaccuccgggaggaggacagcgggcacuacuggugccgcaucuaccggcccuccgacaacagcguguccaagagcguccgcuucuaccugguggugucccccgccagcgccuccacgcagaccagcuggacgccccgggaccuggucuccagccagacccagacccaguccugcgugccgcccaccgcgggcgcccgccaggcccccgagagccccagcaccaucccggugcccucccaccccagcagcccccucccggucccccugcccucccggccccagaacuccacccugcgcccgggccccgccgcccccaucgcgcucgugcccguguucugcgggcugcuggucgccaagagccucgugcuguccgcccugcucgugugguggguccugcggaaccgccacaugcagcaccagggccggagccugcuccacccggcccagccccgcccccaggcccaccggcacuucccccugucccaccgcgcgcccgggggcacguacgggggcaagcccuga

SEQ ID NO: 33436 - RNA, 534 nt, Artificial Sequence
  derived and/or modified sequence opt1 from NCR3__Homo_sapiens__NP_001138938
auggccuggaugcugcuccugauccugaucauggugcaccccggcagcugcgcccucugggucucccagccgcccgagauccgcacccuggaggggagcuccgcguuccugcccugcagcuucaacgccucccagggccggcucgccaucgggagcgugaccugguuccgcgacgaggugguccccggcaaggaggugcggaacgggacgccggaguuccgcggccggcuggcgccccuggccuccagccgcuuccuccacgaccaccaggccgagcugcacauccgggacgugcgcggccacgacgccuccaucuacgucugccggguggaggugcuggggcucggcgucgggaccggcaacgggacccgccuggugguggagaaggagcacccccagcugggcgccggcaccguccuccugcugcgggccggguucuacgcggugagcuuccucuccguggccgucggcagcacgguguacuaccaggggaaguacgccaaguccacccugagcggcuucccccagcuguga

SEQ ID NO: 33437 - RNA, 1365 nt, Artificial Sequence
  derived and/or modified sequence opt1 from NCR3LG1__Homo_sapiens__NP_001189368
augaccuggcgcgccgccgcgagcacgugcgccgcccugcucauccugcugugggcccucaccaccgagggggaccugaagguggagaugauggccgggggcacccagaucacgccccugaacgacaacgucaccaucuucugcaacaucuucuacucccagccgcucaacaucaccagcauggggaucaccugguucuggaagucccugaccuucgacaaggaggugaagguguucgaguucuucggcgaccaccaggaggcguuccggcccggggccaucgucagccccuggcgccugaaguccggcgacgccagccuccggcugcccggcauccagcuggaggaggccggggaguaccgcugcgaggugguggucacgccgcucaaggcgcagggcaccgugcagcuggagguggucgccucccccgccagccggcugcuccuggaccagguggggaugaaggagaacgaggacaaguacaugugcgaguccagcggcuucuaccccgaggccaucaacaucaccugggagaagcagacccagaaguucccccacccgaucgagaucuccgaggacgugaucacggggcccaccaucaagaacauggacggcaccuucaacgucaccagcugccugaagcucaacuccagccaggaggaccccggcacgguguaccagugcgugguccgccacgccucccugcacacgccccugcggagcaacuucacccucaccgcggcccgccacucccugagcgagaccgagaagaccgacaacuucuccauccacugguggccgaucagcuucaucggggugggccuggugcuccugaucguccugauccccuggaagaagaucugcaacaagagcuccagcgccuacacgccccucaagugcauccugaagcacuggaacuccuucgacacccagacccugaagaaggagcaccucaucuucuucugcacccgggccuggcccagcuaccagcugcaggacggggaggccuggccgcccgagggcuccgugaacaucaacaccauccagcagcuggacguguucugccgccaggagggcaaguggagcgagguccccuacgugcaggcguucuucgcccuccgggacaaccccgaccugugccagugcugccgcaucgacccggcccugcucaccgugacguccggcaagagcaucgacgacaacuccaccaagagcgagaagcagacgccccgggagcacuccgacgccguccccgacgcccccauccugccggugagccccaucugggagcccccgcccgcgaccaccuccaccacccccguccugagcucccagcccccgacccuccugcugccccuccaguga

SEQ ID NO: 33438 - RNA, 519 nt, Artificial Sequence
  derived and/or modified sequence opt1 from NCS1__Homo_sapiens__NP_001122298
auggccaccaucaccgagaaggaggugcagcagugguacaagggcuucaucaaggacugccccagcgggcagcuggacgccgcgggcuuccagaagaucuacaagcaguucuucccguucggggaccccacgaaguucgccaccuucgucuucaacguguucgacgagaacaaggacggccgcaucgaguucuccgaguucauccaggcccucagcgugaccucccgggggacccuggacgagaagcugcgcugggccuucaagcucuacgaccuggacaacgacggcuacaucacgcggaacgagaugcuggacaucgucgacgccaucuaccagauggugggcaacaccguggagcuccccgaggaggagaacacccccgagaagcgcgucgaccggaucuucgcgaugauggacaagaacgccgacgggaagcugacccugcaggaguuccaggagggcagcaaggccgacccguccaucgugcaggcccucagccuguacgacgggcugguguga

SEQ ID NO: 33439 - RNA, 2070 nt, Artificial Sequence
  derived and/or modified sequence opt1 from NCSTN__Homo_sapiens__NP_001277113
auggacuucaaccugauccucgagagccugugccgcggcaacuccguggagcggaagaucuacaucccccugaacaagaccgccccgugcguccgccuccugaacgccacccaccagaucgggugccagagcuccaucagcggcgacacgggggugauccacguggucgagaaggaggaggaccugcagugggugcucaccgacggccccaacccgcccuacauggugcugcuggaguccaagcacuucacccgggaccucauggagaagcugaaggggcgcaccagccggaucgcgggccuggccgucucccucacgaagcccagccccgccuccggcuucagccccuccgugcagugccccaacgacggguucggcguguacagcaacuccuacgggccggaguucgcccacugccgcgagauccaguggaacagccugggcaacgggcuggccuacgaggacuucuccuuccccaucuuccuccuggaggacgagaacgagaccaaggucaucaagcagugcuaccaggaccacaaccugagccagaacggcuccgcgcccaccuucccccucugcgccaugcagcuguucagccacaugcacgccgugaucuccaccgccacgugcaugcggcgcagcagcauccaguccaccuucagcaucaacccggagaucgugugcgacccccuguccgacuacaacgucuggagcaugcucaagcccaucaacaccaccggcacgcugaagcccgacgaccgggugguggucgcggccacccgccuggacucccggagcuucuucuggaacguggccccgggggccgaguccgccguggcgagcuucgucacccagcucgccgccgccgaggcccugcagaaggcgcccgacgugaccacgcugccccgcaacgugauguucgucuucuuccagggcgagaccuucgacuacaucggguccagccggaugguguacgacauggagaagggcaaguuccccgugcagcucgagaacgucgacuccuucguggagcugggccaggucgcccugcgcaccagccucgagcuguggaugcacaccgacccggugucccagaagaacgagagcgugcggaaccaggucgaggaccugcucgccacgcuggagaaguccggggccggcgugcccgccgugauccugcgccggcccaaccagagccagccccucccgcccuccagccugcagcgcuuccugcgggcgcgcaacaucuccggggucgugcucgccgaccacagcggcgccuuccacaacaaguacuaccagagcaucuacgacaccgccgagaacaucaacguguccuaccccgaguggcugagccccgaggaggaccugaacuucgucaccgacaccgccaaggcgcucgccgacguggccacggugcuggggcgggcccuguacgagcucgcgggcggcaccaacuucuccgacaccguccaggccgacccgcagaccgugacgcgccugcuguacggguuccucaucaaggccaacaacagcugguuccaguccauccugcgccaggaccugcggagcuaccugggcgacgggccccuccagcacuacaucgccguguccagccccaccaacaccaccuacgucgugcaguacgcccuggcgaaccugacgggcaccguggucaaccucacccgcgagcagugccaggacccguccaaggugcccagcgagaacaaggaccuguacgaguacuccugggugcaggggccccugcacagcaacgagaccgaccggcucccccgcugcguccgguccacggcccgccuggcccgggcccugagcccggccuucgagcucucccaguggagcuccaccgaguacagcaccuggaccgagagccgcuggaaggacauccgggcgcgcaucuuccugaucgccuccaaggagcuggagcucaucacccugacggugggcuucggcauccugaucuucagccucaucgugaccuacugcaucaacgccaaggccgacguccuguucaucgcgccccgggagcccggggccguguccuacuga

SEQ ID NO: 33440 - RNA, 1929 nt, Artificial Sequence
  derived and/or modified sequence opt1 from NDC80__Homo_sapiens__NP_006092
augaagcgcagcuccgugagcuccggcggggccggccggcugagcaugcaggagcuccgcucccaggacgucaacaagcaggggcuguacacgccccagaccaaggagaagccgaccuucggcaagcugagcaucaacaagcccaccuccgagcggaaggugagccucuucgggaagcgcaccuccggccacggcagccggaacucccagcuggggaucuucagcuccagcgagaagaucaaggacccccgcccccugaacgacaaggccuucauccagcagugcauccggcagcucugcgaguuccugaccgagaacggcuacgcgcacaacguguccaugaagucccugcaggccccgagcgucaaggacuuccucaagaucuucacguuccuguacggguuccugugccccagcuacgagcuccccgacaccaaguucgaggaggaggugccccgcaucuucaaggaccugggcuacccguucgcccuguccaagagcagcauguacaccgugggggcgccccacaccuggccccacaucgucgccgcccucguguggcugaucgacugcaucaagauccacacggccaugaaggaguccagcccccuguucgacgacggccagccguggggcgaggagaccgaggacgggaucaugcacaacaagcuguuccuggacuacaccaucaagugcuacgaguccuucaugagcggcgccgacuccuucgacgagaugaacgccgagcugcagagcaagcucaaggaccuguucaacguggacgcguucaagcuggagucccucgaggccaagaaccgggcccugaacgagcagaucgcccgccuggagcaggagcgggagaaggagcccaaccgccucgagagccugcggaagcugaaggccucccuccagggggacguccagaaguaccaggcguacaugagcaaccuggagucccacagcgccauccuggaccagaagcucaacggccugaacgaggagaucgcccgcguggagcuggagugcgagaccaucaagcaggagaacacgcggcuccagaacaucaucgacaaccagaaguacuccguggccgacaucgagcgcaucaaccacgagcggaacgagcugcagcagaccaucaacaagcugaccaaggaccucgaggccgagcagcagaagcuguggaacgaggagcugaaguacgcgcgcggcaaggaggccaucgagacccagcucgccgaguaccacaagcuggcccggaagcugaagcucauccccaagggggccgagaacagcaagggcuacgacuucgagaucaaguucaaccccgaggcgggggccaacugccuggucaaguaccgcgcccagguguacgugccgcugaaggagcuccugaacgagacggaggaggagaucaacaaggcccugaacaagaagaugggccuggaggacacccucgagcagcugaacgccaugaucaccgaguccaagcggagcguccgcacccugaaggaggaggugcagaagcucgacgaccuguaccagcagaagaucaaggaggcggaggaggaggacgagaagugcgccuccgagcuggagagccucgagaagcacaagcaccuccuggaguccacggugaaccaggggcucagcgaggccaugaacgagcuggacgccguccagcgcgaguaccagcugguggugcagaccaccaccgaggagcggcgcaaggucggcaacaaccuccagcggcugcuggagaugguggcgacgcacgugggcagcgucgagaagcaccucgaggagcagaucgccaagguggaccgcgaguacgaggagugcauguccgaggaccugagcgagaacaucaaggagauccgggacaaguacgagaagaaggccacccugaucaaguccagcgaggaguga

SEQ ID NO: 33441 - RNA, 1008 nt, Artificial Sequence
  derived and/or modified sequence opt1 from NDE1__Homo_sapiens__NP_060138
auggaggacagcggcaagaccuucuccagcgaggaggaggaggccaacuacuggaaggaccuggccaugaccuacaagcagcgcgcggagaacacgcaggaggagcuccgggaguuccaggaggggucccgcgaguacgaggccgagcuggagacccagcugcagcagaucgagacccggaaccgcgaccuccugagcgagaacaaccggcugcgcauggagcucgagaccaucaaggagaaguucgaggugcagcacuccgagggcuaccggcagaucagcgcccuggaggacgaccuggcccagacgaaggccaucaaggaccagcuccagaaguacauccgcgagcuggagcaggcgaacgacgaccuggagcgggccaagcgcgccaccaucaugucccucgaggacuucgagcagcggcugaaccaggccaucgagcgcaacgcguuccuggagagcgagcucgacgagaaggagaaccugcuggaguccguccagcggcucaaggacgaggcccgcgaccugcggcaggagcuggccgugcagcagaagcaggagaagccccgcaccccgaugcccagcuccguggaggccgagcggaccgacacggccguccaggcgaccgggagcgugcccuccacccccaucgcccaccgcggcccgagcuccagccucaacacccccggguccuuccggcgcggccuggacgacagcacgggcgggacgccccugacccccgccgcccggaucuccgcccucaacaucgugggcgaccugcugcgcaaggucggggcgcucgagagcaagcuggccagcugccgcaaccugguguacgaccaguccccgaaccggaccggcgggcccgccagcggccgcuccagcaagaaccgggacggcggggagcgccggcccuccagcaccuccgugccccucggcgacaaggggcuggacaccagcugccgcuggcuguccaagagcaccacccgguccagcuccagcugcuga

SEQ ID NO: 33442 - RNA, 987 nt, Artificial Sequence
  derived and/or modified sequence opt1 from NDEL1__Homo_sapiens__NP_001020750
auggacggcgaggacauccccgacuucagcucccugaaggaggagaccgccuacuggaaggagcucagccugaaguacaagcaguccuuccaggaggcccgcgacgagcugguggaguuccaggaggggagccgggagcucgaggcggagcuggaggcccagcugguccaggccgagcagcgcaaccgggaccuccaggccgacaaccagcgccugaaguacgagguggaggcccugaaggagaagcucgagcaccaguacgcgcaguccuacaagcaggucagcgugcuggaggacgaccugucccagacccgggccaucaaggagcagcuccacaaguacgugcgcgagcuggagcaggccaacgacgaccuggagcgggccaagcgcgcgacgaucgugagccucgaggacuucgagcagcggcugaaccaggccaucgagcgcaacgccuuccuggaguccgagcucgacgagaaggagagccugcuggucuccgugcagcggcucaaggacgaggcccgcgaccugcggcaggagcuggccgugcgcgagcggcagcaggaggucacccgcaagagcgcgccguccagccccacccucgacugcgagaagauggacuccgccgugcaggccagccugucccugcccgccacccccgugggcaaggggacggagaacaccuucccgagccccaaggccauccccaacggcuucgggaccagcccccucaccccguccgcgcggaucagcgcccugaacaucgucggcgaccugcuccgcaaggugggcgcccuggaguccaagcuggccgccugccggaacuucgcgaaggaccaggccagccgcaaguccuacaucagcgggaacgugaacugcggcguccucaacgggaacggcacgaaguucucccggagcgggcacaccuccuucuucgacaagggccaggagaaggugaucuuccccacccuguucaugggccaguga

SEQ ID NO: 33443 - RNA, 666 nt, Artificial Sequence
  derived and/or modified sequence opt1 from NDFIP1__Homo_sapiens__NP_085048
auggcccuggcccucgcggcccuggccgccguggagcccgccugcggcagccgcuaccagcagcugcagaacgaggaggaguccggggagccggagcaggcggccggcgacgccccgccgcccuacagcuccaucagcgccgaguccgcggccuacuucgacuacaaggacgagagcggguuccccaagccgcccuccuacaacgucgccaccacccuccccagcuacgacgaggccgagcggacgaaggccgaggcgaccaucccccuggugcccggccgcgacgaggacuucguggggcgggacgacuucgacgacgccgaccagcugcgcaucggcaacgacggcaucuucaugcucaccuucuucauggccuuccuguucaacuggaucggguucuuccuguccuucugccucaccacgagcgccgccggccgguacggggcgaucuccggcuucgggcugagccugaucaaguggauccucaucguccgcuucuccaccuacuuccccggcuacuucgacggccaguacuggcugugguggguguuccuggugcucggguuccugcuguuccuccggggcuucaucaacuacgccaagguccgcaagaugcccgagaccuucagcaaccugccccggacccgcgugcuguucaucuacuga

SEQ ID NO: 33444 - RNA, 1011 nt, Artificial Sequence
  derived and/or modified sequence opt1 from NDFIP2__Homo_sapiens__NP_061953
auggcccgccggcgcagccagcgggugugcgccuccggccccagcaugcugaacuccgcgcgcggggcccccgagcuccugcggggcaccgccaccaacgccgaggucagcgccgcggccgccggggccacgggcuccgaggagcugccgcccggggaccgcggcugccggaacggcgggggccgcgggcccgcggccaccaccagcuccaccggcguggccgugggggccgagcacggcgaggacagccucucccggaagcccgaccccgagcccggccgcauggaccaccaccagcccgggacgggccgguaccagguccugcugaacgaggaggacaacagcgaguccagcgccaucgagcagccgcccaccuccaaccccgcgccccagaucgugcaggccgccagcuccgcccccgcccucgagaccgacagcagcccgccgcccuacuccuccaucaccguggagguccccacgaccagcgacaccgagguguacggggaguucuaccccgugcccccgcccuacagcgucgcgaccucccugcccacguacgacgaggccgagaaggccaaggccgccgcgauggccgccgccgccgcggagaccagccagcgcauccaggaggaggagugcccgccccgggacgacuucuccgacgccgaccagcugcgcgugggcaacgacggcaucuucaugcucgccuucuucauggccuucaucuucaacuggcugggguucugccugagcuucugcaucaccaacaccaucgcgggccgguacggggccaucugcggcuucgggcucucccugaucaaguggauccugaucgugcgcuucagcgacuacuucacgggcuacuucaacggccaguacuggcucugguggaucuuccugguccuggggcuccugcuguucuuccggggcuucgugaacuaccucaaggugcgcaacauguccgagagcauggccgccgcccaccggacccgcuacuucuuccugcuguga

SEQ ID NO: 33445 - RNA, 1707 nt, Artificial Sequence
  derived and/or modified sequence opt1 from NDNF__Homo_sapiens__NP_078850
auggugcugcuccacuggugccugcuguggcuccuguucccccugagcucccgcacccagaagcucccgacccgggacgaggagcuguuccagaugcagauccgcgacaaggccuucuuccacgacagcuccgucauccccgacggcgccgagaucagcuccuaccuguuccgggacacgcccaagcgcuacuucuucgugguggaggaggacaacacgccccucagcgucaccgugaccccgugcgacgcgccccuggaguggaagcugucccuccaggagcugcccgaggaccggagcggggagggcuccggggaccuggagccccucgagcagcagaagcagcagaucaucaacgaggagggcaccgagcuguucagcuacaaggggaacgacguggaguacuucaucuccagcuccagcccguccggccuguaccagcucgaccugcugagcaccgagaaggacacccacuucaaggucuacgccaccacgacccccgaguccgaccagcccuaccccgagcucccguacgacccccgcguggacgugaccagccugggccggaccacggucacccuggccuggaagcccucccccaccgccagccuccugaagcagccgauccaguacugcguggugaucaacaaggagcacaacuucaagagccugugcgccgucgaggcgaagcucuccgccgacgacgccuucaugauggcccccaagcccgggcuggacuucagccccuucgacuucgcgcacuucggcuucccguccgacaacagcgggaaggagcgcuccuuccaggccaagcccagccccaagcugggccggcacguguacucccgccccaagguggacauccagaagaucugcaucgggaacaagaacaucuucaccgucagcgaccucaagccggacacgcaguacuacuucgacguguucguggucaacaucaacuccaacaugagcaccgccuacgugggcaccuucgcccggaccaaggaggaggccaagcagaagacgguggagcugaaggacggcaagaucaccgacgucuucgugaagcgcaagggggcgaaguuccugcgguucgcccccguguccagccaccagaaggucaccuucuucauccacuccugccucgacgccgugcagauccagguccgccgggacggcaagcugcugcucagccagaacguggaggggauccagcaguuccagcugcgcggcaagcccaaggccaaguaccuggugcggcucaagggcaacaagaagggggccuccaugcugaagauccuggcgaccacgcgccccaccaagcagagcuucccgucccuccccgaggacacccggaucaaggccuucgacaagcugcggaccugcagcuccgccacggucgccuggcugggcacccaggagcgcaacaaguucugcaucuacaagaaggagguggacgacaacuacaacgaggaccagaagaagcgcgagcagaaccagugccucgggcccgacauccgcaagaaguccgagaaggugcugugcaaguacuuccacagccagaaccugcagaaggccgucaccaccgagacgaucaagggccuccagccgggcaagagcuaccugcuggacguguacgugaucgggcacggcgggcacagcgucaaguaccaguccaagguggugaagacccggaaguucugcuga

SEQ ID NO: 33446 - RNA, 966 nt, Artificial Sequence
  derived and/or modified sequence opt1 from NDN__Homo_sapiens__NP_002478
augagcgagcaguccaaggaccugagcgaccccaacuucgccgccgaggcgccgaacuccgaggugcacagcucccccggcgucagcgagggggugccgcccuccgccacccucgccgagccccagagcccgccccugggccccaccgccgcgccccaggccgccccgccgccccaggcccccaacgacgagggggaccccaaggcccugcagcaggcggccgaggagggccgcgcccaccaggcccccuccgccgcgcagcccgggcccgccccgcccgcccccgcccagcucgugcagaaggcccacgagcugaugugguacguccuggugaaggaccagaagaagaugaucaucugguuccccgacauggugaaggacgucaucggcagcuacaagaaguggugccgguccauccuccgccggacgagccugauccuggcgcgcguguucggccuccaccuccggcugaccucccugcacaccauggaguucgcccuggugaaggcccuggagcccgaggagcucgaccgcgucgcccugagcaaccggaugcccaugaccgggcugcuccugaugauccugucccucaucuacgugaagggccgcggggcccgggagagcgcgguguggaacguccugcgcauccugggccuccggcccuggaagaagcacuccacguucggggacgugcgcaagcugaucaccgaggaguucgugcagaugaacuaccugaaguaccagcgggucccguacguggagccgcccgaguacgaguucuucuggggcagccgcgccucccgggagaucaccaagaugcagaucauggaguuccucgcccgcguguucaagaaggacccccaggccuggcccagccgguaccgcgaggcccuggaggaggcgcgggcccugcgcgaggccaaccccaccgcccacuacccccggagcuccgucagcgaggacuga

SEQ ID NO: 33447 - RNA, 402 nt, Artificial Sequence
  derived and/or modified sequence opt1 from NDP__Homo_sapiens__NP_000257
augcgcaagcacgugcuggccgccagcuucuccaugcucagccugcuggucaucaugggcgacaccgacuccaagaccgacagcuccuucaucauggacagcgacccccggcgcugcaugcggcaccacuacguggacuccaucagccacccgcucuacaagugcuccagcaagauggugcugcuggcgcgcugcgaggggcacugcucccaggccagccgguccgagccccucgucagcuucuccacggugcugaagcagcccuuccgcagcuccugccacugcugccggccccagaccagcaagcugaaggcccuccgccugcggugcuccggcgggaugcgccugaccgccaccuaccgguacauccucagcugccacugcgaggagugcaacagcuga

SEQ ID NO: 33448 - RNA, 1185 nt, Artificial Sequence
  derived and/or modified sequence opt1 from NDRG1__Homo_sapiens__NP_001128714
augagccgcgagaugcaggacguggaccuggccgaggucaagccccucguggagaagggcgagaccaucaccgggcugcugcaggaguucgacgugcaggagcaggacaucgagacgcuccacggcuccguccacgugacccugugcgggaccccgaagggcaaccggcccgugauccugaccuaccacgacaucgggaugaaccacaagacgugcuacaacccccucuucaacuacgaggacaugcaggagaucacccagcacuucgccgucugccacguggacgcgcccggccagcaggacggcgccgccagcuucccggccggguacauguaccccuccauggaccagcuggccgagaugcugcccggcgugcuccagcaguucgggcucaagagcaucaucggcauggggaccggcgcgggcgccuacauccugacccgcuucgcccugaacaaccccgagauggucgaggggcuggugcugaucaacgugaacccgugcgccgagggcuggauggacugggcggccuccaagaucagcggguggacgcaggcccuccccgacauggucgugucccaccuguucggcaaggaggagaugcagagcaacguggaggucgugcacaccuaccggcagcacaucgugaacgacaugaaccccggcaaccugcaccucuucaucaacgccuacaacucccgccgggaccuggagaucgagcgccccaugccggggacccacaccgucacgcugcagugccccgcccuccugguggugggcgacagcucccccgcggucgacgccgugguggagugcaacagcaagcuggaccccaccaagaccacccuccugaagauggccgacugcgggggccugccgcagaucucccagcccgccaagcucgccgaggcguucaaguacuucguccaggggaugggcuacaugcccagcgccuccaugacgcggcugaugcgcagccggaccgccuccggcagcuccgugaccagccuggacgggacccgcagccggucccacacgagcgagggcacccgcucccggagccacaccuccgaggggacccgcagccggucccacacgagcgagggcgcccaccucgacaucacccccaacuccggggccgcgggcaacagcgccggcccgaaguccauggaggucagcugcuga

SEQ ID NO: 33449 - RNA, 1104 nt, Artificial Sequence
  derived and/or modified sequence opt1 from NDRG2__Homo_sapiens__NP_001269140
auggagaacggcgggagcaugcaggccaccauggccgagcugcaggaggugcagaucaccgaggagaagccccuccugcccggccagacgcccgaggcggccaagacccacuccgucgagacccccuacgggagcgugaccuucacgguguacggcacccccaagccgaagcgccccgccauccugaccuaccacgacgucgggcucaacuacaaguccugcuuccagccccuguuccaguucgaggacaugcaggagaucauccagaacuucgugcgggugcacgucgacgcccccggcauggaggagggcgccccgguguucccccugggguaccaguaccccagccucgaccagcuggcggacaugauccccugcgugcugcaguaccucaacuucuccaccaucaucggcgucggggugggcgccggggccuacauccuggcccgcuacgcgcugaaccacccggacacgguggagggccucguccugaucaacaucgaccccaacgccaagggcuggauggacugggccgcccacaagcugaccgggcucaccagcuccauccccgagaugauccugggccaccuguucagccaggaggagcucuccgggaacagcgagcugauccagaaguaccggaacaucaucacccacgcccccaaccuggacaacaucgagcucuacuggaacuccuacaacaaccgccgggaccugaacuucgagcgcggcggcgacaucacgcugcggugcccggugaugcucguggucggggaccaggcgccccacgaggacgccgugguggagugcaacagcaagcuggaccccacccagaccuccuuccugaagauggccgacagcggcgggcagccccagcucacccagccgggcaagcugacggaggccuucaaguacuuccugcaggggaugggcuacauggccuccagcugcaugacccgccucucccggagccgcaccgcgucccugaccagcgccgccagcgucgacggcaaccggucccgcagccggacgcugucccagagcuccgagagcgggacccucuccagcggcccgcccgggcacaccauggagguguccugcuga

SEQ ID NO: 33450 - RNA, 1092 nt, Artificial Sequence
  derived and/or modified sequence opt1 from NDRG3__Homo_sapiens__NP_071922
auggacgagcugcaggacgugcagcucaccgagaucaagccccugcugaacgacaaggagcacgacaucgagaccacgcacggcgucgugcacgugaccauccgcgggcucccgaagggcaaccggcccgucauccugaccuaccacgacaucgggcugaaccacaagagcugcuucaacgccuucuucaacuucgaggacaugcaggagaucacccagcacuucgccgugugccacguggacgcgcccggccagcaggagggggcccccuccuucccgacgggcuaccaguaccccaccauggacgagcucgccgagaugcugccgcccguccugacccaccucagccugaaguccaucaucggcaucggggugggcgccggggccuacauccugagccgcuucgcgcucaaccaccccgagcugguggagggccugguccucaucaacguggaccccugcgccaagggguggaucgacugggccgccuccaagcugagcggccugaccacgaacguggucgacaucauccucgcgcaccacuucggccaggaggagcugcaggccaaccuggaccucauccagaccuaccggaugcacaucgcccaggacaucaaccaggacaaccugcagcuguuccucaacuccuacaacgggcgccgggaccuggagaucgagcgccccauccugggccagaacgacaacaagagcaagacccucaagugcuccacccugcugguggugggggacaacagccccgccgucgaggccgugguggagugcaacucccggcucaacccgaucaacacgacccugcugaagauggcggacugcggcggccucccccaggucgugcagcccgggaagcugaccgaggccuucaaguacuuccugcagggcaugggguacauccccagcgccuccaugacccgccucgcccggagccgcacgcacuccaccagcuccagccugggcuccggggagagcccguucagccgguccgugaccagcaaccaguccgacggcacccaggagagcugcgagucccccgacguccuggaccgccaccagacgauggaggugagcugcuga

SEQ ID NO: 33451 - RNA, 1176 nt, Artificial Sequence
  derived and/or modified sequence opt1 from NDRG4__Homo_sapiens__NP_001123959
augaaggugcugggccaccgccucgagcugcugaccgggcuccugcugcacgacgucaccauggccggccuccaggagcugcgguuccccgaggagaagccgcugcuccgcgggcaggacgccacggagcuggagagcuccgacgcguuccugcucgccgccgacaccgacuggaaggagcacgacaucgagacccccuacggccugcugcacguggugauccgggggagccccaagggcaaccgccccgccauccucaccuaccacgacgucggccugaaccacaagcugugcuucaacacguucuucaacuucgaggacaugcaggagaucaccaagcacuucguggugugccacgucgacgccccggggcagcaggucggcgcgucccaguucccccagggguaccaguuccccagcauggagcagcucgccgccaugcugcccuccguggugcagcacuucggcuucaaguacgugaucgggaucggcgugggcgccggggcguacguccuggccaaguucgcccucaucuucccggaccugguggagggccuggugcucgucaacaucgaccccaacgggaagggcuggaucgacugggccgccaccaagcugagcggccugaccuccacgcuccccgacaccgugcugagccaccuguucucccaggaggagcucgugaacaacaccgagcugguccagagcuaccggcagcagaucgggaacguggugaaccaggcgaaccugcagcuguucuggaacauguacaacucccgccgggaccucgacaucaaccgccccggcaccgucccgaacgccaagacgcugcggugccccgugaugcucguggucggggacaacgcccccgccgaggacggcguggucgagugcaacagcaagcuggaccccaccaccaccacguuccugaagauggccgacuccgggggccucccccaggugacccagccgggcaagcugaccgaggcguucaaguacuuccugcaggggaugggcuacaugcccagcgccuccaugacccgccucgcccggagccgcacggccucccugaccagcgccuccagcguggacgggagccggccccaggcgugcacccacuccgagagcuccgagggccuggggcaggucaaccacaccauggaggugagcugcuga

SEQ ID NO: 33452 - RNA, 2688 nt, Artificial Sequence
  derived and/or modified sequence opt1 from NDST1__Homo_sapiens__XP_005268491
augcccgcccuggccugccuccgccggcugugccgccacgugagcccgcaggcgguccuguuccuccuguucaucuucugccuguucuccguguucaucagcgccuacuaccucuacggcuggaagcgggggcuggagcccuccgccgacgcccccgagcccgacugcggcgacccgccgcccguggcccccagccgccugcucccccugaagcccguccaggcggccacccccucccggaccgacccccuggugcucguguucgucgagagccuguacucccagcuggggcaggaggugguggccauccucgagagcucccgcuucaaguaccggacggagaucgccccgggcaagggggacaugcccacccugaccgacaagggccgcggccgguucgcgcugaucaucuacgagaacauccucaaguacgucaaccuggacgccuggaaccgcgagcugcucgacaaguacugcguggccuacggggugggcaucaucggguucuucaaggccaacgagaacagccugcuguccgcccagcucaagggcuucccccuguuccugcacagcaaccucgggcugaaggacugcuccaucaaccccaagagcccgcugcucuacgucacccggcccuccgagguggagaagggcgugcugcccggcgaggacuggacggucuuccagagcaaccacuccaccuacgagcccgugcugcucgcgaagacccgcagcuccgagagcaucccgcaccugggggccgacgccggccugcacgccgcccuccacgcgaccgugguccaggaccuggggcugcacgacggcauccagcggguccucuucggcaacaaccugaacuucuggcugcacaagcucguguucguggacgccguggccuuccugacggggaagcgccugagccucccccuggaccgguacauccugguggacaucgacgacaucuucgucggcaaggaggggacccgcaugaagguggaggacgucaaggcccucuucgacacccagaacgagcugcgggcccacauccccaacuucaccuucaaccugggcuacuccgggaaguucuuccacacgggcaccaacgcggaggacgccggcgacgaccugcuccugagcuacgugaaggaguucuggugguucccccacauguggucccacaugcagccgcaccuguuccacaaccagagcgugcucgccgagcagauggcccugaacaagaaguucgccgucgagcacgggauccccaccgacaugggcuacgcgguggcgccccaccacuccgggguguaccccguccacgugcagcuguacgaggccuggaagcaggucuggagcauccgcgugaccuccacggaggaguacccgcaccucaagcccgcccgguaccgccggggcuucauccacaacgggaucauggugcugccccgccagaccugcggccuguucacccacaccaucuucuacaacgaguacccgggcgggagcuccgagcucgacaagaucaucaacggcggggagcuguuccugacggugcuccugaaccccaucagcaucuucaugacccaccuguccaacuacggcaacgaccgccucgggcuguacaccuucaagcaccugguccgguuccuccacagcuggaccaaccugcgccugcagacgcucccgcccgugcagcuggcccagaaguacuuccagaucuucuccgaggagaaggacccccuguggcaggaccccugcgaggacaagcggcacaaggacaucuggagcaaggagaagaccugcgaccgcuuccccaagcuccugaucaucggcccccagaagaccggcaccacggcccuguaccucuuccuggggaugcacccggaccuguccagcaacuaccccuccagcgagaccuucgaggagauccaguucuucaacggccacaacuaccacaaggggaucgacugguacauggaguucuuccccauccccuccaacaccaccagcgacuucuacuucgagaaguccgccaacuacuucgacagcgagguggccccgcggcgcgccgcggcccuccugcccaaggccaagguccugacgauccucaucaaccccgccgaccgggccuacagcugguaccagcaccagcgcgcgcacgacgaccccguggcccugaaguacaccuuccacgaggugaucaccgccggcuccgacgccagcuccaagcugcgggcccuccagaaccgcugccuggucccgggcugguacgcgacccacaucgagcgguggcugagcgccuaccacgccaaccagauccucgugcuggacgggaagcugcuccgcacggagcccgccaaggugauggacaugguccagaaguuccugggcgugaccaacaccaucgacuaccacaagacccuggcguucgaccccaagaagggguucuggugccagcuccuggagggcgggaagaccaagugccugggcaaguccaagggccggaaguaccccgagauggaccucgacgugagcgggggccacacgaccugcuccacgugcauccgcagccgggccuuccugaaggacuacuaccgcgaccacaacaucgagcuguccaagcuccuguacaagauggggcagacccugccgaccuggcuccgggaggaccugcagaacacccgcuga

SEQ ID NO: 33453 - RNA, 2448 nt, Artificial Sequence
  derived and/or modified sequence opt1 from NDST2__Homo_sapiens__XP_005270312
augcugcagcucuggaaggugguccgccccgcccggcagcuggagcugcaccgccucauccugcugcucaucgccuucagccugggcuccaugggguuccuggcguacuacgugagcaccuccccgaaggccaaggagccccucccccugccccugggcgacugcagcuccgggggcgccgccgggccgggccccgcccggccgcccgugccgccccggccgccccgcccgcccgagaccgcgcgcacggagcccgucgugcucguguucgucgagagcgccuacucccagcugggccaggagaucguggccauccuggagagcucccgguuccgcuacagcaccgagcucgcccccgggcggggcgacaugcccacccugaccgacaacacgcacgggcgcuacgugcuggucaucuacgagaaccuccugaaguacgugaaccuggacgcguggucccgggagcuccuggaccgcuacugcguggaguacggcgucgggaucaucggcuucuuccgggcccacgagcacagccugcucuccgcccagcugaagggcuucccccuguuccuccacagcaaccuggggcugcgcgacuaccaggugaaccccuccgcgccccuccugcaccugacccggccgagccgccucgagcccggcccccugcccggggacgacuggaccaucuuccaguccaaccacagcaccuacgagccggugcugcucgccucccugcggcccgccgagcccgccguccccggcccggugcugcgccgggcccgccuccccacggugguccaggaccugggccugcacgacgggauccagcggguccucuucggccacgggcugagcuucuggcugcacaagcucaucuucguggacgccguggccuaccugaccggcaagcgccugugccucgaccuggaccgcuacauccugguggacaucgacgacaucuucguggggaaggagggcacccggaugaaggucgcggacguggaggcccugcucaccacgcagaacaagcugcgcacccugguccccaacuucaccuucaaccucggcuucagcgggaaguucuaccacaccggcacggaggaggaggacgccggggacgacaugcugcugaagcaccggaaggaguucuggugguucccccacauguggucccacaugcagccccaccucuuccacaaccgcagcgugcuggccgaccagaugcggcugaacaagcaguucgcccucgagcacggcauccccaccgaccugggguacgcgguggcgccccaccacuccggcgucuacccgauccacacccagcuguacgaggccuggaaguccguguggggcauccaggugaccagcacggaggaguacccccaccuccgccccgcccgguaccgccggggguucauccacaacggcaucaugguccugccccgccagaccugcgggcuguucacccacaccaucuucuacaacgaguacccgggcgggagccgggagcucgaccgcuccauccggggcggcgagcuguuccugacggugcuccugaaccccaucagcaucuucaugacccaccuguccaacuacgggaacgaccgccucggccuguacaccuucgagagccuggugcgguuccuccagugcuggacccgccugcggcugcagacgcucccgcccgucccccuggcccagaaguacuucgagcuguucccccaggagcgcagcccccucuggcagaaccccugcgacgacaagcggcacaaggacaucugguccaaggagaagaccugcgaccgccugccgaaguuccugaucguggggccccagaagaccggcaccacggccauccacuucuuccucucccugcaccccgccgugaccagcuccuuccccagcccguccaccuucgaggagauccaguucuucaacagccccaacuaccacaagggcaucgacugguacauggacuucuuccccguccccuccaacgccagcaccgacuuccuguucgagaaguccgccacguacuucgacagcgagguggugccgcgccgcggggcggcccuccugccccgggccaagaucaucaccguccugaccaaccccgccgaccgggccuacagcugguaccagcaccagcgcgcgcacggcgacccgguggcccucaacuacaccuucuaccaggugaucuccgccagcucccagacgccccuggcccugcggagccuccagaaccgcugccugguccccggguacuacuccacccaccuccagcgguggcugaccuacuaccccagcggccagcugcugaucguggacgggcaggagcuccgcaccaacccggccgcguccauggagagcauccagaaguuccugggccugaugaugauccgggacuucggcgcccgcgaccucaaggugguccggcuggccguguga

SEQ ID NO: 33454 - RNA, 2622 nt, Artificial Sequence
  derived and/or modified sequence opt1 from NDST3__Homo_sapiens__NP_004775
augagcuucaucaugaagcugcaccgccacuuccagcggaccgugauccuccuggccaccuucugcauggucuccaucaucaucagcgccuacuaccuguacuccggcuacaagcaggagaacgagcucagcgagacggcguccgagguggacugcggggaccugcagcaccuccccuaccagcucauggaggugaaggccaugaagcuguucgacgccagccgcaccgacccgaccguccugguguucguggagucccaguacagcucccucggccaggacaucaucaugauccuggagagcucccgguuccaguaccacaucgagaucgcccccgggaagggcgaccugcccguccucaucgacaagaugaaggggaaguacauccugaucaucuacgagaacauccugaaguacaucaacauggacagcuggaaccgcucccuccuggacaaguacugcguggaguacggcgugggcgucaucggguuccacaagaccagcgagaaguccgugcagagcuuccagcugaagggcuuccccuucuccaucuacgggaaccucgccgugaaggacugcugcaucaacccgcacagcccccugauccgggucacgaaguccagcaagcuggagaagggcagccuccccgggaccgacuggaccguguuccagaucaaccacuccgcguaccagcccgugaucuucgccaaggucaagaccccggagaaccugagccccuccaucagcaagggcgccuucuacgccacgaucauccacgaccugggccuccacgacgggauccagcgcgugcuguucggcaacaaccugaacuucuggcuccacaagcugaucuucaucgacgcgaucuccuuccugagcgggaagcggcucacccugucccuggaccgcuacauccucguggacaucgacgacaucuucgucggcaaggagggcacccggaugaacaccaacgacgugaaggcccugcuggacacgcagaaccuccugcgcgcccagaucaccaacuucaccuucaaccugggguucagcggcaaguucuaccacaccgggacggaggaggaggacgagggcgacgacugccuccugggguccguggacgaguucuggugguucccccacauguggagccacaugcagccccaccuguuccacaacgaguccagccucgucgagcagaugauccugaacaagaaguucgcccuggagcacggcaucccgaccgacaugggcuacgccguggcgccccaccacuccgggguguaccccguccacgugcagcucuacgaggccuggaagaaggucuggaacaucaagaucaccagcaccgaggaguacccccaccugaagccggcccgguaccgccggggcuucauccacaagaacaucauggugcugccccgccagacgugcgggcuguucacccacaccaucuucuacaaggaguaccccggcgggcccaaggagcuggacaaguccauccagggcggcgagcuguucuucaccgugguccugaacccgaucagcaucuucaugacgcaccucuccaacuacgggaacgaccggcugggccuguacaccuucgugaaccucgccaacuucgucaagagcuggaccaaccugcgccugcagacccucccgcccgugcagcuggcccacaaguacuucgagcuguuccccgaccagaaggacccccucuggcagaaccccugcgacgacaagcggcaccgcgacaucugguccaaggagaagacgugcgaccggcugcccaaguuccuggugaucgggccccagaagaccggcaccaccgcgcucuaccuguuccuggugaugcacccgagcauccucagcaacucccccagccccaagacguucgaggagguccaguucuucaaccgcaacaacuaccaccgggggaucgacugguacauggacuucuucccggugcccuccaacgugaccaccgacuuccuguucgagaaguccgccaacuacuuccacagcgaggaggcccccaagcgcgccgccagccugguccccaaggcgaagaucaucaccauccucaucgacccguccgaccgcgccuacagcugguaccagcaccagcggucccacgaggaccccgccgcccugaaguucagcuucuacgaggugaucuccgccggcccccgcgcgcccagcgagcugcgggcccuccagaagcgcugccuggugccgggcugguacgccucccacaucgagcgguggcuggucuacuucccgcccuuccagcuccugaucaucgacgggcagcagcugcgcacggaccccgccaccgugauggacgaggugcagaaguuccucggcguccugccccacuacaacuacagcgaggcgcugaccuucgacucccacaagggguucuggugccagcuccuggaggagggcaagaccaagugccugggcaagagcaaggggcggaaguacccgcccauggacuccgacagccgcaccuuccucagcuccuacuaccgggaccacaacguggagcugagcaagcugcuccacaagcugggccagccccugcccuccuggcuccgccaggagcugcagaaggugcgguga

SEQ ID NO: 33455 - RNA, 2619 nt, Artificial Sequence
  derived and/or modified sequence opt1 from NDST4__Homo_sapiens__NP_072091
augaaccugaucgugaagcuccgccggagcuuccgcacccugaucguccugcucgccaccuucugccugguguccaucgugaucagcgccuacuuccuguacuccggcuacaagcaggagaugacgcucaucgagaccaccgcggaggccgagugcaccgacaucaagauccugcccuaccggagcauggagcugaagacggucaagccgaucgacaccuccaagaccgaccccaccgugcuccuguucguggagagccaguacucccagcuggggcaggacaucaucgccauccucgagagcucccgcuuccaguaccacauggucaucgcccccggcaagggggacaucccgccccugacggacaacggcaaggggaaguacacccuggugaucuacgagaacauccucaaguacgugagcauggacuccuggaaccgggagcugcuggagaaguacugcgucgaguacagcguguccaucaucggcuuccacaaggccaacgagaacagccuccccuccacccagcugaagggcuucccccugaaccucuucaacaaccuggcgcugaaggacugcuucgugaacccccagagcccgcuccugcacaucaccaaggcccccaaggucgagaaggggccccugcccggcgaggacuggacgaucuuccaguacaaccacuccaccuaccagccggugcuccugaccgagcugcagaccgagaagucccucagcagccugagcuccaagacgcuguucgccaccgugauccaggaccucgggcugcacgacggcauccagcgcguccuguucgggaacaaccucaacuucuggcugcacaagcugaucuucaucgacgccaucagcuuccucuccggcaagcggcugacccugagccucgaccgcuacauccugguggacaucgacgacaucuucgugggcaaggaggggacccggaugaacgucaaggacgugaaggcgcugcucgagacgcagaaccugcugcgcacccagguggccaacuucaccuucaaccucggcuucuccgggaaguucuaccacaccggcacggaggaggaggacgagggcgacgaccugcugcugcggagcgucgacgaguucuggugguucccccacauguggucccacaugcagccccaccucuuccacaacgagagcucccugguggagcagaugauccugaacaaggaguucgcccucgagcacgggauccccaucaacaugggcuacgccguggccccgcaccacagcggggucuaccccgugcacauccagcuguacgcggccuggaagaaggucuggggcauccaggugaccuccaccgaggaguacccccaccugaagcccgcccgcuaccggaagggguucauccacaacagcaucauggugcucccgcgccagaccugcggccuguucacgcacaccaucuucuacaaggaguaccccggcgggccccaggagcuggacaaguccauccggggcggggagcuguuccugaccauccugcucaaccccaucagcaucuucaugacccaccuguccaacuacggcaacgaccgccuggggcucuacacguucgucaaccuggugaacuucgugcagagcuggaccaaccugaagcuccagacccugccgcccguccagcuggcccaccaguacuucgagcuguuccccgagcagaaggacccccucuggcagaacccgugcgacgacaagcggcacaaggacaucuggucccgcgagaagaccugcgaccaccuccccaaguuccucgugaucggcccccagaagacgggcaccaccgcccuguaccuguuccuccugaugcacccgagcaucaucuccaaccugcccagccccaagaccuucgaggaggugcaguucuucaacgggaacaacuaccacaagggcaucgacugguacauggacuucuuccccaccccgagcaacacgaccuccgacuuccucuucgagaaguccgcgaacuacuuccacagcgaggaggcgccccggcgcgccgccagccugguccccaaggccaagaucaucaccauccugaucgaccccuccgaccgggccuacagcugguaccagcaccagcgcucccacgaggacccggccgcccuccgcuucaacuucuacgaggugaucagcaccgggcacugggcccccuccgaccugaagacgcugcagcggcgcugccucgugcccggcugguacgccguccacaucgagcgguggcugaccuacuucgcgaccagccagcugcucaucaucgacgggcagcagcugcgcuccgaccccgccaccgugauggacgaggugcagaaguuccugggcgucacgccgcgguacaacuacagcgaggcccucaccuucgacccccagaagggcuucuggugccagcugcuggagggcgggaagaccaagugccucgggaaguccaagggccgcaaguacccgcccauggaccccgagagccggaccuuccuguccaacuacuaccgcgaccacaacguggagcugagcaagcuccugcaccggcugggccagccccuccccuccuggcugcgccaggagcugcagaaggugcgguga

SEQ ID NO: 33456 - RNA, 1068 nt, Artificial Sequence
  derived and/or modified sequence opt1 from NDUFA10__Homo_sapiens__NP_004535
auggcccugcgccuccugaagcuggccgcgaccagcgccuccgcccggguggucgccgccggcgcgcagcgcgugcgggggauccacagcuccgugcagugcaagcuccgcuacggcauguggcacuuccugcugggggacaaggccagcaagcggcucaccgagcgcucccgggucaucacgguggacggcaacaucugcaccgggaagggcaagcuggccaaggagaucgccgagaagcugggcuucaagcacuuccccgaggcggggauccacuacccggacagcaccaccggcgacgggaagccccucgccacggacuacaacggcaacugcucccuggagaaguucuacgacgacccccgcagcaacgacgggaacuccuaccggcugcagagcuggcucuacuccagccgccugcugcaguacuccgacgcccucgagcaccuccugaccaccggccagggcgugguccuggagcggagcaucuucuccgacuucguguuccuggaggccauguacaaccagggguucauccgcaagcagugcguggaccacuacaacgaggucaagagcgugaccaucugcgacuaccugcccccgcaccucgugaucuacaucgacguccccgugcccgaggugcagcggcgcauccagaagaagggcgacccccacgagaugaagaucacguccgccuaccugcaggacaucgagaacgcguacaagaagaccuuccugccggagaugagcgagaagugcgagguccuccaguacuccgcccgggaggcccaggacagcaagaaggugguggaggacaucgaguaccugaaguucgacaaggggcccuggcugaagcaggacaaccgcacccucuaccaccuccggcugcugguccaggacaaguucgaggugcugaacuacaccagcauccccaucuuccugcccgaggugacgaucggcgcccaccagaccgaccgcguccuccaccaguuccgggagcugccgggccgcaaguacucccccggguacaacaccgaggugggcgacaaguggaucuggcugaaguga

SEQ ID NO: 33457 - RNA, 687 nt, Artificial Sequence
  derived and/or modified sequence opt1 from NDUFA11__Homo_sapiens__NP_001180304
auggcccccaagguguuccgccaguacugggacaucccggacggcaccgacugccaccggaaggccuacagcaccacguccaucgcgagcgucgccgggcugaccgccgccgccuaccgcgugacccucaacccgcccggcaccuuccuggaggggguggcgaaggucggccaguacacguucaccgccgccgccgugggggcgguguucggccugacgaccugcaucuccgcccacguccgggagaagcccgacgacccccucaacuacuuccugggcgggugcgccggcgggcugacccucggcgcccgcaagaccgggagccacugcguggugcaggccggccugaagcugcucgcguccagcagcccccacaccuccgccucccagagcgccggcaucaucgggaugucccacugcguccagcgguucugggugcccagcuccagcgccugccuggaggugcuguccggcgagagcaccgacguccacgccugcuccagcacgcgcggggcgugcaacuccagcggcagccggccccucccggagcugggcgcccgcgccuccgggagccugcggaagggcgggcacacccaccccgcgccccgcggcgccggggcccucacccccgugcaggcccugaucgagucccugcucaacacccugggcagcaacccgcggacguga

SEQ ID NO: 33458 - RNA, 192 nt, Artificial Sequence
  derived and/or modified sequence opt1 from NDUFA12__Homo_sapiens__NP_001245267
auggagcuggugcagguccucaagcgcggccugcagcagaucaccgggcacggcgggcugcggggcuaccuccgcguguucuuccggaccaacgacgccaagguggggacgcuggucggcgaggacaaguacggcaacaaguacuacgaggacaacaagcaguucuucgggaucgugggcuucaccguguga

SEQ ID NO: 33459 - RNA, 435 nt, Artificial Sequence
  derived and/or modified sequence opt1 from NDUFA13__Homo_sapiens__NP_057049
auggccgccagcaaggugaagcaggacaugcccccgcccggcggguacggccccaucgacuacaagcgcaaccugccccggcgcgggcucuccggcuacagcaugcuggcgaucgggaucggcacccugaucuacggccacugguccaucaugaaguggaaccgggagcgccggcgccuccagaucgaggacuucgaggcccggaucgcccugcugccccuccugcaggccgagaccgaccgccggacgcugcagaugcuccgcgagaaccuggaggaggaggccaucaucaugaaggacguccccgacuggaaggugggggagagcguguuccacaccacccggugggucccgccccugaucggcgagcucuacgggcugcgcaccacggaggaggcgcugcacgccucccacggcuucaugugguacaccuga

SEQ ID NO: 33460 - RNA, 213 nt, Artificial Sequence
  derived and/or modified sequence opt1 from NDUFA1__Homo_sapiens__NP_004532
augugguucgagauccugcccggccucagcgugaugggggucugccugcugaucccgggccucgccaccgccuacauccaccgcuucaccaacgggggcaaggagaagcggguggcgcacuucggguaccacuggucccugauggagcgcgaccggcgcaucagcggcguggaccgguacuacgucuccaagggccuggagaacaucgacuga

SEQ ID NO: 33461 - RNA, 231 nt, Artificial Sequence
  derived and/or modified sequence opt1 from NDUFA2__Homo_sapiens__NP_001171941
auggccgccgcggccgccagccgcggcgugggggccaagcugggccuccgggagauccgcauccaccugugccagcggucccccgggagccagggcguccgcgacuucaucgagaagcgguacguggagcugaagaaggccaacccggaccuccccauccugauccgcgagugcuccgacgugcagcccaagcugugggcgcgguacgccagccgcguccagaacuccuga

SEQ ID NO: 33462 - RNA, 351 nt, Artificial Sequence
  derived and/or modified sequence opt1 from NDUFA5__Homo_sapiens__NP_001269349
augcccuaccgcgugggccagaccaccgggcuggucggccucgccgugugcaacacgccgcacgagcggcugcgcauccuguacaccaagauccucgacgugcuggaggagauccccaagaacgccgcguaccggaaguacaccgagcagaucaccaacgagaagcuggccauggucaaggccgagcccgacgugaagaagcucgaggaccagcugcagggcgggcagcuggaggaggugauccuccaggccgagcacgagcugaaccuggcccgcaagaugcgggaguggaagcucugggagccccuggucgaggagccgcccgcggaccaguggaaguggcccaucuga

SEQ ID NO: 33463 - RNA, 465 nt, Artificial Sequence
  derived and/or modified sequence opt1 from NDUFA6__Homo_sapiens__NP_002481
augggcaaggacauccgcccccggagcgcccgcgccgccugcaagggggugggccugugguccgggugcuucggcaagauggccgggagcggcguccggcaggccaccuccaccgccagcacguucgugaagccgaucuucucccgcgacaugaacgaggccaagcggcgcgugcgggagcucuaccgcgcgugguaccgggagguccccaacaccgugcaccaguuccagcuggacaucaccgugaagaugggccgcgacaagguccgggagauguucaugaagaacgcccacgugaccgacccccgcguggucgaccugcucgugaucaaggggaagaucgagcuggaggagacgaucaagguguggaagcagcggacccacgucaugcgcuucuuccacgagaccgaggcgccccggccgaaggacuuccugagcaaguucuacgugggccacgaccccuga

SEQ ID NO: 33464 - RNA, 1134 nt, Artificial Sequence
  derived and/or modified sequence opt1 from NDUFA9__Homo_sapiens__NP_004993
auggccgccgcggcccagagccgcgugguccgggugcuguccaugagccgcuccgccaucaccgccaucgccaccagcgugugccacgggcccccgugccggcagcuccaccacgcgcugaugccccacgggaagggcgggcgcuccagcgucuccggcaucguggccacgguguucggggccaccggcuuccugggccgguacgucgugaaccaccucgggcgcaugggcagccaggugaucauccccuaccggugcgacaaguacgacaucaugcaccuccgccccaugggggaccugggccagcugcuguuccuggagugggacgcccgggacaaggacuccauccgccgggucgugcagcacagcaacguggucaucaaccucaucgggcgcgacugggagaccaagaacuucgacuucgaggacguguucgugaagaucccgcaggcgaucgcccagcuguccaaggaggccggcgucgagaaguucauccacgugagccaccugaacgccaacaucaaguccagcucccgguaccuccgcaacaaggccgugggcgagaaggucgugcgggacgcguuccccgaggccaucaucgugaagcccagcgacaucuucgggcgcgaggaccgguuccugaacuccuucgccagcaugcaccgcuucggccccaucccgcuggggucccucggcuggaagaccgucaagcagcccguguacguggucgacgugagcaagggcaucgucaacgccgugaaggaccccgacgccaacggcaagagcuucgcguucgugggccccucccgguaccugcuguuccaccucgucaaguacaucuucgccguggcccaccgccuguuccugccguucccccucccccuguucgccuaccgguggguggcccgcgucuucgagaucagccccuucgagccguggaucacgcgcgacaagguggagcggaugcacaucaccgacaugaagcugccccaccuccccgggcuggaggaccugggcauccaggcgacgccccucgagcugaaggccaucgaggugcugcgccggcaccgcaccuaccgguggcucuccgccgagaucgaggacgucaagccggccaagaccgugaacaucuga

SEQ ID NO: 33465 - RNA, 471 nt, Artificial Sequence
  derived and/or modified sequence opt1 from NDUFAB1__Homo_sapiens__NP_004994
auggccagccgcgugcuguccgccuacgucagccggcuccccgcggccuucgccccgcugccccgcgugcggaugcuggccguggcccgcccccucuccaccgcgcugugcagcgccggcacccagacgcggcuggggacccuccagcccgcccugguccuggcccaggugccgggccgcgugacccagcucugccggcaguacuccgacaugccgccccugacccuggaggggauccaggaccgcguccucuacgugcugaagcuguacgacaagaucgaccccgagaagcucagcgugaacucccacuucaugaaggaccugggccuggacagccucgaccaggucgagaucaucauggcgauggaggacgaguucggguucgagauccccgacaucgacgccgagaagcugaugugcccccaggagaucguggacuacaucgccgacaagaaggacguguacgaguga

SEQ ID NO: 33466 - RNA, 984 nt, Artificial Sequence
  derived and/or modified sequence opt1 from NDUFAF1__Homo_sapiens__NP_057097
auggcccuggugcacaagcuccugcgcggcaccuacuuccugcggaaguucagcaagcccaccuccgcccucuacccguuccuggggauccgcuucgcggaguacagcuccagccugcagaagcccgucgccucccccggcaaggccagcucccagcggaagacggagggggaccuccagggcgaccaccagaaggagguggcccuggacaucaccagcuccgaggagaagcccgacgugagcuucgacaaggccauccgcgacgaggcgaucuaccacuuccggcugcucaaggacgagaucgucgaccacuggcgcgggccggagggccacccccugcacgaggugcugcucgagcaggccaagguggucuggcaguuccggggcaaggaggaccuggacaaguggaccgugaccuccgacaagacgaucgggggccgcagcgagguguuccugaagauggggaagaacaaccaguccgcccuccuguacggcacccugagcuccgaggcgccccaggacggggagagcacccgguccggcuacugcgccaugaucagccgcaucccccggggcgccuucgagcgcaagauguccuacgacuggagccaguucaacacccucuaccugcggguccgcggggacggccggccguggauggugaacaucaaggaggacacggacuucuuccagcgcaccaaccagauguacagcuacuucauguucacccgcgggggccccuacuggcaggaggugaagauccccuucuccaaguucuucuucagcaaccggggccggauccgcgacguccagcacgagcugccccucgacaagaucuccagcaucggguucacccuggccgacaagguggacggcccguucuuccuggagaucgacuucaucgggguguucacggaccccgcccacaccgaggaguucgccuacgagaacucccccgagcucaacccccggcuguucaaguga

SEQ ID NO: 33467 - RNA, 510 nt, Artificial Sequence
  derived and/or modified sequence opt1 from NDUFAF2__Homo_sapiens__NP_777549
augggcuggagccaggaccuguuccgcgcccucuggcggucccugagccgcgaggugaaggagcacgucgggaccgaccaguucggcaacaaguacuacuacaucccccaguacaagaacuggcgggggcagaccauccgcgagaagcggaucguggaggccgcgaacaagaaggagguggacuacgaggccggcgacauccccacggagugggaggccuggauccgccggacccgcaagaccccgcccaccauggaggagauccugaagaacgagaagcaccgggaggagaucaagaucaagucccaggacuucuacgagaaggagaagcuccugagcaaggagacguccgaggagcugcucccgccgcccguccagacccagaucaaggggcacgccagcgcccccuacuucggcaaggaggagcccuccguggcgcccagcuccaccggcaagaccuuccagcccgggagcuggaugccccgcgacggcaagucccacaaccaguga

SEQ ID NO: 33468 - RNA, 555 nt, Artificial Sequence
  derived and/or modified sequence opt1 from NDUFAF3__Homo_sapiens__NP_951032
auggccaccgcccuggcgcuccgcagccuguaccgggcccgccccucccugcggugcccgcccguggagcuccccugggcgccccgccggggccaccgccugagccccgccgacgacgagcuguaccagcggacccgcaucucccuccugcagcgggaggccgcccaggccauguacaucgacagcuacaacucccgcggguucaugaucaacggcaaccggguccuggggcccugcgcccuccugccccacagcguggugcaguggaacgucggcucccaccaggacaucacggaggacagcuucucccuguucuggcuccuggagccccgcaucgagaucgugguggucgggaccggcgaccggaccgagcgccugcagagccaggugcuccaggccaugcggcagcgcggcaucgcgguggagguccaggacacccccaacgccugcgccacguucaacuuccugugccacgaggggcgggugaccggcgccgcccugaucccgccgcccgggggcaccucccucaccagccuggggcaggcggcccaguga

SEQ ID NO: 33469 - RNA, 528 nt, Artificial Sequence
  derived and/or modified sequence opt1 from NDUFAF4__Homo_sapiens__NP_054884
augggcgcccuggugauccgcgggauccggaacuucaaccucgagaaccgcgccgagcgggagaucagcaagaugaagcccuccgucgcgccgcgccaccccagcaccaacucccugcugcgggagcagaucagccucuaccccgaggugaagggcgagaucgcccgcaaggacgagaagcugcuguccuuccucaaggacguguacgucgacagcaaggaccccguguccagccuccaggugaaggccgccgagaccugccaggagccgaaggaguuccggcugcccaaggaccaccacuucgacaugaucaacaucaaguccauccccaaggggaagaucagcaucgucgaggcccucacgcugcugaacaaccacaagcuguuccccgagaccuggaccgcggagaagaucaugcaggaguaccagcuggagcagaaggacgugaacucccugcucaaguacuucgugaccuucgaggucgagaucuucccgcccgaggacaagaaggccauccgcagcaaguga

SEQ ID NO: 33470 - RNA, 954 nt, Artificial Sequence
  derived and/or modified sequence opt1 from NDUFAF5__Homo_sapiens__NP_001034464
augcugcgccccgccggccucuggcggcugugccgccggccgugggccgcgcgcgugcccgccgagaaccuggggcggcgcgaggucaccagcggcgugagcccccggggguccaccagcccccgcacgcucaacaucuucgaccgggaccugaagcgcaagcagaagaacugggccgcccggcagccggagcccaccaaguucgacuaccugaaggaggaggugggcucccgcaucgccgaccgggucuacgacaucccccgcaacuucccccucgcgcuggaccuggggugcggccggggcuacaucgcccaguaccucaacaagcugcagcuguuccacugccgcaagcuccuggaguccuucagcaagcugacccuccagaagaugcugugccugcacugggugaacgaccucccgcgggcccuggagcagauccacuacauccugaagcccgacgggguguucaucggcgccauguucgggggcgacacccucuacgagcugcgcugcucccugcagcucgcggagacggagcgggagggcggguucagcccccacaucucccccuucaccgccgucaacgaccugggccaccuccuggggcgcgccggcuucaacacccugaccguggacacggacgagauccaggugaacuacccggggauguucgagcugauggaggaccuccagggcaugggcgagagcaacugcgccuggaaccggaaggcccugcugcaccgcgacaccaugcucgcggccgccgccgucuaccgcgagauguaccggaacgaggacggguccgugcccgccaccuaccagaucuacuacaugaucggcuggaaguaccacgagagccaggcgcgccccgccgagcggggguccgccaccgugagcuucggcgagcuggggaagaucaacaaccugaugcccccgggcaagaagucccaguga

SEQ ID NO: 33471 - RNA, 1002 nt, Artificial Sequence
  derived and/or modified sequence opt1 from NDUFAF6__Homo_sapiens__NP_689629
auggccgccagcgcgcacggcuccgugugggggccccugcgccucggcaucccggggcugugcugccggcgcccgccccugggccucuacgcccggaugcgccggcugcccgggcccgaggucagcggccgcuccguggccgccgccagcggccccggggcguggggcaccgaccacuacugccuggagcuccugcggaagcgcgacuacgagggguaccugugcucccuccugcugcccgccgagagccgguccagcguguucgcccuccgcgccuucaacgucgagcuggcccaggugaaggacuccgugagcgagaagaccaucggccugaugcggaugcaguucuggaagaagacggucgaggacaucuacugcgacaacccgccccaccagcccguggcgaucgagcucuggaaggccgugaagcgccacaaccugaccaagcgguggcugaugaagaucgucgacgagcgcgagaagaaccucgacgacaaggccuaccggaacaucaaggagcuggagaacuacgccgagaacacccaguccagccugcucuaccugacccuggagauccucgggaucaaggaccugcacgcggaccacgccgccucccacaucggcaaggcccagggcaucgugacgugccugcgcgccacccccuaccacgggagccggcgcaagguguuccuccccauggacaucugcaugcugcacggcgucucccaggaggacuuccugcggcgcaaccaggacaagaacgugcgggacgugaucuacgacaucgcgagccaggcccaccuccaccugaagcacgcccgcuccuuccacaagaccgucccggugaaggccuuccccgccuuccugcagaccgugagccucgaggacuuccugaagaagauccagcgcgucgacuucgacaucuuccaccccucccugcagcagaagaacacgcuccugccccuguaccucuacauccagagcuggcggaagaccuacuga

SEQ ID NO: 33472 - RNA, 519 nt, Artificial Sequence
  derived and/or modified sequence opt1 from NDUFB10__Homo_sapiens__NP_004539
augcccgacagcugggacaaggacguguacccggagccgccccgccggacccccguccagcccaaccccaucguguacaugaugaaggccuucgaccugaucguggaccgccccgucacccucgugcgggaguucaucgagcgccagcacgccaagaaccgguacuacuacuaccaccgccaguaccggcgcgugcccgacaucacggagugcaaggaggaggacaucaugugcauguacgaggcggagaugcaguggaagcgggacuacaaggucgaccaggagaucaucaacaucaugcaggaccgccugaaggccugccagcagcgggagggccagaacuaccagcagaacugcaucaaggagguggagcaguucacccagguggccaaggccuaccaggaccgcuaccaggaccugggggccuacuccagcgcgcggaagugccucgccaagcagcgccagcggaugcugcaggagcgcaaggccgccaaggaggcggccgccgccaccuccuga

SEQ ID NO: 33473 - RNA, 462 nt, Artificial Sequence
  derived and/or modified sequence opt1 from NDUFB11__Homo_sapiens__NP_001129470
auggccgccggccuguucgggcucagcgcgcgccggcugcuggccgccgccgccacccgcggccuccccgcggcccgggugcgcugggaguccagcuucucccggaccgucguggccccgagcgccguggcggggaagcgcccgcccgagcccacgacccccuggcaggaggaccccgagcccgaggacgagaaccuguacgagaagaaccccgacucccacggcuacgacaaggacccgguccuggacguguggaacaugcggcucguguucuucuucggggucagcaucauccuggugcugggcuccaccuucguggccuaccuccccgacuaccgcaugaaggaguggagccggcgcgaggccgagcggcuggucaaguaccgcgaggccaacggccugcccaucauggaguccaacugcuucgaccccagcaagauccagcucccggaggacgaguga

SEQ ID NO: 33474 - RNA, 318 nt, Artificial Sequence
  derived and/or modified sequence opt1 from NDUFB2__Homo_sapiens__NP_004537
augagcgcccugacccgccucgccuccuucgcgcgggugggcgggcgccuguuccggagcggcugcgcccgcaccgccggggacggcgggguccggcacgccggcggcggggugcacaucgagccccgcuaccggcaguucccgcagcugacgcgcucccagguguuccagagcgaguucuucuccggccucaugugguucuggauccuguggcgguucuggcacgacagcgaggagguccuggggcacuuccccuaccccgaccccucccaguggaccgacgaggagcucggcaucccgcccgacgacgaggacuga

SEQ ID NO: 33475 - RNA, 297 nt, Artificial Sequence
  derived and/or modified sequence opt1 from NDUFB3__Homo_sapiens__NP_001244031
auggcccacgagcacggccacgagcacgggcaccacaagauggagcugcccgacuaccgccaguggaagaucgagggcaccccgcucgagaccauccagaagaagcuggccgcgaaggggcugcgggaccccuggggccgcaacgaggccuggcgguacaugggcggguucgccaagagcguguccuucagcgacgucuucuucaagggcuucaaguggggguucgccgccuucgugguggcggucggcgccgaguacuaccucgagucccugaacaaggacaagaagcaccacuga

SEQ ID NO: 33476 - RNA, 363 nt, Artificial Sequence
  derived and/or modified sequence opt1 from NDUFB4__Homo_sapiens__NP_001161803
augagcuuccccaaguacaagccguccagccugcgcacccuccccgagacccuggaccccgccgaguacaacaucucccccgagacgcggcgcgcccaggcggagcggcuggccauccgcgcccagcucaagcgggaguaccugcugcaguacaacgacccgaaccgccggggccucaucgagaaccccgcccugcugcgcugggccuacgcgcggaccaucaacguguaccccaacuuccgccccaccccgaagaacagccucaugggggcccugugcggcuucgggccccugaucuucaucuacuacaucaucaagaccgagcgggucuccauccagacgcgcugccucguguucgaguga

SEQ ID NO: 33477 - RNA, 414 nt, Artificial Sequence
  derived and/or modified sequence opt1 from NDUFB5__Homo_sapiens__NP_001186886
auggccgccaugagccugcuccgccggguguccgucaccgcgguggccgcccugagcggccgcccccuggggacccggcucggcuucgggggcuuccugacgcgcggguucccgaaggccgccggccaggcggagcuggccgagauccccgagggcuacgugcccgagcacugggaguacuacaagcaccccaucucccgguggaucgcccgcaacuucuacgacagcccggagaagaucuacgagcggaccauggccguccuccagaucgaggcggagaaggccgagcugcgcgugaaggagcuggaggugcggaagcucaugcacguccgcggggacggccccugguacuacuacgagaccaucgacaaggagcugaucgaccacucccccaaggccacccccgacaacuga

SEQ ID NO: 33478 - RNA, 387 nt, Artificial Sequence
  derived and/or modified sequence opt1 from NDUFB6__Homo_sapiens__NP_002484
augaccggcuacacccccgacgagaagcugcgccuccagcagcugcgggagcugcgccggcgcuggcucaaggaccaggagcugagcccccgggagcccgugcugccgccccagaagauggggcccauggagaaguucuggaacaaguuccucgagaacaagagccccuggcgcaagaugguccacggcguguacaagaaguccaucuucguguucacgcacguccuggugcccguguggaucauccacuacuacaugaaguaccacgucagcgagaagcccuacgggaucguggagaagaagucccggaucuucccgggcgacaccauccuggagaccggggaggugaucccgcccaugaaggaguuccccgaccagcaccacuga

SEQ ID NO: 33479 - RNA, 519 nt, Artificial Sequence
  derived and/or modified sequence opt1 from NDUFB8__Homo_sapiens__NP_001271296
auggccguggcccgcgcgggcguccugggggugcaguggcuccagcgggccagccgcaacgugaugccccugggcgcccggaccgccucccacaugaccaaggacauguucccggggcccuacccccgcacgcccgaggagcgggccgcggccgccaagaaguacaacaugcgcgucgaggacuacgagccguaccccgacgacggcaugggguacggcgacuaccccaagcugcccgaccggagccagcacgagcgcgacccgugguacuccugggaccagcccggccuccggcugaacuggggcgagcccaugcacuggcaccuggacauguacaaccgcaaccggguggacaccagccccaccccgguguccuggcacgucaugugcaugcagcuguucggguuccucgccuucaugaucuucaugugcugggugggggacguguaccccgucuaccagcccgugugccgccaccacuucagcuacaaccugggcuuccucuccgcgcugggguga

SEQ ID NO: 33480 - RNA, 540 nt, Artificial Sequence
  derived and/or modified sequence opt1 from NDUFB9__Homo_sapiens__NP_004996
auggccuuccuggccagcggccccuaccucacccaccagcagaaggugcugcgccuguacaagcgggcgcuccgccaccuggaguccuggugcguccagcgggacaaguaccgcuacuucgccugccugaugcgggcccgcuucgaggagcacaagaacgagaaggacauggccaaggccacccagcuccugaaggaggcggaggaggaguucugguaccggcagcacccccagcccuacaucuuccccgacagccccgggggcaccuccuacgagcgcuacgacugcuacaaggugccggaguggugccuggacgacuggcaccccagcgagaaggccauguaccccgacuacuucgccaagcgggagcaguggaagaagcuccgccgggaguccugggagcgcgaggugaagcagcugcaggaggagacgccgcccgggggcccccugaccgaggcccucccgcccgcgcggaaggagggggaccugccgccccuguggugguacaucgucacccgcccccgggagcgccccauguga

SEQ ID NO: 33481 - RNA, 267 nt, Artificial Sequence
  derived and/or modified sequence opt1 from NDUFC2__Homo_sapiens__NP_001190983
augaucgcccgccggaaccccgagccgcugcgcuuccuccccgacgaggcccggagccugcccccgcccaagcugaccgacccccgccuccuguacaucggcuuccugggguacugcuccggccucaucgacaaccugauccggcgccggcccaucgcgaccgccgggcugcaccgccagcuccuguacaucacggccuucuucuucgccggcuacuaccuggugaagcucgaggccuacgcgaaccuguacgucgacacccuguga

SEQ ID NO: 33482 - RNA, 2076 nt, Artificial Sequence
  derived and/or modified sequence opt1 from NDUFS1__Homo_sapiens__NP_001186910
augcugcgcauccccgugcggaaggcccucgucggccugagcaaguccccgaaggggugcgugcgcaccaccgccacggcggccagcaaccugaucgagguguucgucgacggccaguccgugaugguggagcccgggaccaccguccuccaggugguggccgccugcgccaugcccgucaugaagggcuggaacauccugaccaacagcgagaaguccaagaaggcgcgggagggggugauggaguuccugcucgccaaccacccccuggacugcccgaucugcgaccagggcggcgagugcgaccugcaggaccagagcaugauguucgggaacgaccgcucccgguuccucgagggcaagcgcgccguggaggacaagaacaucgggccccuggucaagacgaucaugacccggugcauccagugcacccgcugcauccgguucgccagcgagaucgcgggcguggacgaccuggggaccacgggccgcggcaacgacaugcaggucgggaccuacaucgagaagauguucauguccgagcucagcggcaacaucaucgacaucugccccgugggggcccugaccuccaagcccuacgccuucaccgcccggccgugggagacgcgcaagaccgagagcaucgacgugauggacgccgugggcuccaacaucgucgugagcacccggaccggcgaggugaugcgcauccugccccggaugcacgaggacaucaacgaggaguggaucuccgacaagacgcgcuucgcguacgacgggcucaagcggcagcgccugaccgagcccaugguccggaacgagaagggccugcucaccuacaccagcugggaggacgcccugucccgcguggccgggaugcugcagagcuuccagggcaaggacguggccgccaucgccgggggccucgucgacgccgaggcccugguggcccugaaggaccuccugaaccgggucgacuccgacacgcugugcaccgaggagguguuccccaccgccggcgcggggaccgaccuccgcagcaacuaccugcugaacacgaccaucgccggcguggaggaggccgacgucgugcuccugguggggaccaacccgcgcuucgaggcgccccuguucaacgcccggauccgcaagagcuggcuccacaacgaccugaaggucgcgcugaucggcucccccguggaccucaccuacacguacgaccaccugggggacagccccaagauccugcaggacaucgccuccggcagccacccguucucccaggugcucaaggaggccaagaagcccauggucgugcugggcagcuccgcccugcagcggaacgacggggcggccauccucgccgccgugagcuccaucgcccagaagauccgcaugaccagcggcgucaccggggacuggaaggugaugaacauccugcaccggaucgcgucccagguggccgcccuggaccucggcuacaagcccggggucgaggccauccgcaagaacccgcccaaggugcuguuccugcucggcgccgacggcgggugcaucacccggcaggaccugcccaaggacugcuucaucaucuaccagggccaccacggggacgugggcgcgcccaucgccgacgucauccugcccggcgccgccuacacggagaaguccgccaccuacgugaacaccgaggggcgcgcgcagcagaccaagguggccgucacgccgcccggccuggcccgggaggacuggaagaucauccgcgcccucagcgagaucgcggggaugacccugcccuacgacacccuggaccaggugcggaaccgccucgaggaggugagccccaaccugguccgguacgacgacaucgagggcgccaacuacuuccagcaggccaacgagcuguccaagcucgugaaccagcagcugcuggccgacccgcucgugccgccccagcugaccaucaaggacuucuacaugaccgacagcaucucccgcgccagccagacgauggcgaagugcgucaaggccgugaccgagggggcccaggccguggaggagcccuccaucugcuga

SEQ ID NO: 33483 - RNA, 1374 nt, Artificial Sequence
  derived and/or modified sequence opt1 from NDUFS2__Homo_sapiens__NP_001159631
auggccgcccugcgcgcgcucugcggcuuccgcgggguggccgcccagguccugcgccccggcgccggggugcggcugcccauccagcccagccgcggcgugcggcaguggcagcccgacgucgagugggcccagcaguucgggggcgcggugauguaccccuccaaggagaccgcccacuggaagccgccgcccuggaacgacguggacccgcccaaggacaccaucgucaagaacaucacgcucaacuucggcccccagcaccccgccgcccacggggugcugcgccuggugauggagcucagcggcgagaugguccggaagugcgacccccacaucgggcugcugcaccgcggcaccgagaagcucaucgaguacaagaccuaccugcaggcgcugcccuacuucgaccggcucgacuacguguccaugaugugcaacgagcaggccuacagccuggccguggagaagcugcucaacauccggcccccgccccgggcccaguggauccgcguccuguucggggagaucacccggcugcucaaccacaucauggccgugacgacccacgcgcuggaccugggcgccaugacccccuucuucuggcuguucgaggagcgcgagaagauguucgaguucuacgagcggguguccggcgcccgcaugcacgccgccuacauccggcccgggggcguccaccaggaccucccccuggggcucauggacgacaucuaccaguucagcaagaacuucucccugcgccuggacgagcucgaggagcugcugaccaacaaccggaucuggcgcaaccggacgaucgacaucggcguggugaccgcggaggaggcccucaacuacggcuucagcggggucaugcugcgcggcuccgggauccagugggaccugcgcaagacccagcccuacgacguguacgaccagguggaguucgacgucccggugggcagccgcggggacugcuacgaccgguaccucugccggguggaggagaugcgccagucccugcggaucaucgcccagugccugaacaagaugccgcccggcgagaucaaggucgacgacgccaaggugagcccgcccaagcgcgccgagaugaagaccuccauggagagccucauccaccacuucaagcuguacacggagggcuaccaggucccgcccggggcgaccuacaccgccaucgaggcccccaagggcgaguucgggguguaccugguguccgacggcagcucccggcccuaccgcugcaagaucaaggcccccggguucgcccaccucgcgggccuggacaagaugagcaagggccacaugcuggccgacgucguggccaucaucgggacccggcccaucguguga

SEQ ID NO: 33484 - RNA, 795 nt, Artificial Sequence
  derived and/or modified sequence opt1 from NDUFS3__Homo_sapiens__NP_004542
auggccgccgcggccguggcccgccugugguggcggggcauccucggggccagcgcccugacccgcggcaccgggcggcccuccguccugcuccugccggugcgccgggagagcgcgggcgccgacacgcgccccaccgugcggccccgcaacgacgucgcccacaagcagcuguccgccuucggggaguacguggcggagauccuccccaaguacgugcagcagguccaggugagcugcuucaacgagcuggaggugugcauccacccggacggcgucauccccgugcugaccuuccuccgggaccacaccaacgcccaguucaagucccugguggaccugacggccgucgacgugcccacccgccagaaccgguucgagaucguguacaaccuccugagccugcgcuucaacucccggauccgcgucaagaccuacaccgacgagcucacgcccaucgagagcgccguguccguguucaaggccgcgaacugguacgagcgggagaucugggacauguucggcgucuucuucgccaaccacccggaccugcgccggauccugaccgacuacggguucgagggccaccccuuccgcaaggacuucccccucagcggguacguggagcugcgguacgacgacgaggugaagcgcgucguggccgagcccguggagcuggcccaggaguuccggaaguucgaccucaacuccccgugggaggccuuccccgucuaccgccagccgcccgagagccugaagcuggaggcgggcgacaagaagcccgacgccaaguga

SEQ ID NO: 33485 - RNA, 528 nt, Artificial Sequence
  derived and/or modified sequence opt1 from NDUFS4__Homo_sapiens__NP_002486
auggccgccgugagcauguccgucgugcugcgccagacccucuggcggcgccgggcgguggccgucgccgcccugagcgugucccgcgugcccacccggagccugcgcacguccaccuggcggcucgcccaggaccagacccaggacacccagcugaucacggucgacgagaagcuggacaucaccacccucaccggcgugccggaggagcacaucaagacgcgcaaggugcggaucuucguccccgcgcgcaacaacaugcagagcggggugaacaacaccaagaaguggaagauggaguucgacacccgggagcgcugggagaacccccugaugggcugggccuccaccgccgacccccugagcaacauggugcucacguucuccaccaaggaggacgccgucagcuucgcggagaagaacgggugguccuacgacaucgaggagcggaaggugccgaagcccaagagcaaguccuacggcgccaacuucagcuggaacaagcgcacccggguguccaccaaguga

SEQ ID NO: 33486 - RNA, 375 nt, Artificial Sequence
  derived and/or modified sequence opt1 from NDUFS6__Homo_sapiens__NP_004544
auggccgccgcgaugaccuucugccgccugcucaaccggugcggcgaggccgcccgcagccugccccugggggcccggugcuucggcgugcgcgucuccccgaccggggagaaggugacgcacaccggccagguguacgacgacaaggacuaccggcgcauccgguucgucgggcgccagaaggaggugaacgagaacuucgccaucgaccucaucgcggagcagcccgugagcgaggucgagacccgggugaucgccugcgacggcggcgggggcgcccuggggcaccccaagguguacaucaaccuggacaaggagaccaagacggggaccugcggcuacugcggccuccaguuccgccagcaccaccacuga

SEQ ID NO: 33487 - RNA, 642 nt, Artificial Sequence
  derived and/or modified sequence opt1 from NDUFS7__Homo_sapiens__NP_077718
auggccgugcugagcgcccccggccuccgcggguuccggauccugggccugcgcuccagcgucgggcccgcggugcaggcccggggcgugcaccaguccgucgccaccgacgggcccagcuccacccagcccgcccuccccaaggcccgcgcgguggccccgaagcccagcucccggggcgaguacguggucgccaagcuggacgaccuggugaacugggcccgccggagcucccucuggcccaugacguucggccuggcgugcugcgccguggagaugaugcacauggccgcgccccgcuacgacauggaccgguucggggucguguuccgcgccagcccgcggcaguccgacgugaugaucgucgccggcacccugaccaacaagauggcccccgcccuccgcaagguguacgaccagaugcccgagccccgguacguggucagcaugggguccugcgccaacggcgggggcuacuaccacuacagcuacuccguggugcgcggcugcgaccggaucgucccgguggacaucuacauccccgggugcccgcccaccgccgaggcgcugcuguacggcauccuccagcugcagcgcaagaucaagcgggagcgccggcugcagaucugguaccgccgguga

SEQ ID NO: 33488 - RNA, 633 nt, Artificial Sequence
  derived and/or modified sequence opt1 from NDUFS8__Homo_sapiens__NP_002487
augcgcugccugaccacccccaugcuccugcgggcccuggcccaggcggcccgcgccggcccgcccgggggccggagccuccacuccagcgccguggccgcgacguacaaguacgucaacaugcaggaccccgagauggacaugaaguccgugaccgaccgcgccgcccggacccugcuguggaccgagcuguuccgcgggcucggcaugacgcugagcuaccucuuccgggagcccgccaccaucaacuacccguucgagaaggggccccugagcccccgcuuccggggcgagcacgcgcugcgccgguaccccuccggcgaggagcgcugcaucgccugcaagcucugcgaggccaucugcccggcccaggccaucaccaucgaggcggagccccgggccgacgggucccgccggaccacgcgcuacgacaucgacaugaccaagugcaucuacugcggcuucugccaggaggccugccccguggacgccaucgucgaggggcccaacuucgaguucagcaccgagacccacgaggagcugcuguacaacaaggagaagcuccugaacaacggcgacaagugggaggccgagaucgcggccaacauccaggccgacuaccuguaccgguga

SEQ ID NO: 33489 - RNA, 1368 nt, Artificial Sequence
  derived and/or modified sequence opt1 from NDUFV1__Homo_sapiens__NP_001159574
augcuggccacccgccggcuccugggcuggagccugcccgcccgcaccgcgccgaagaagacguccuucgggagccucaaggacgaggaccggaucuucaccaaccuguacggccgccacgacuggcggcugaaggggucccucagccgcggcgacugguacaagaccaaggagauccugcugaaggggcccgacuggauccucggcgagaucaagaccuccggccugcgggggcgcggcggggccggcuuccccacggggcugaaguggagcuucaugaacaagcccuccgacggccggccgaaguaccucguggucaacgccgacgagggcgagcccgggaccugcaaggaccgcgagauccugcggcacgacccccacaagcugcucgagggcugccuggucgggggccgcgccaugggcgcccgggcggccuacaucuacauccgcggggaguucuacaacgaggccagcaaccuccagguggccauccgggaggcguacgaggccggccucaucgggaagaacgccugcggcuccggguacgacuucgacguguucguggugcgcggcgccggcgccuacaucugcggggaggagaccgcgcugaucgagagcaucgagggcaagcaggggaagccccggcugaagccgcccuuccccgccgacgucggcguguucgggugccccaccacgguggccaacgucgagaccguggccguguccccgaccaucugccgccggggcggcaccugguucgccggguucggccgcgagcggaacagcgggacgaagcuguucaacaucuccggccacgucaaccaccccugcaccguggaggaggagaugagcgugccccugaaggagcugaucgagaagcacgccgggggcgucaccggcgggugggacaaccuccuggcggugauccccggcggguccagcaccccgcugauccccaaguccgugugcgagacgguccucauggacuucgacgcccuggugcaggcccagaccggccugggcaccgccgcggugaucgucauggaccgcagcaccgacaucgugaaggccaucgcccgccucaucgaguucuacaagcacgaguccugcgggcagugcacgcccugccgggagggcguggacuggaugaacaaggucauggcccgcuucgugcgcggggacgcccggcccgcggagaucgacagccugugggagaucagcaagcagaucgagggccacaccaucugcgcccugggggacggcgccgccuggccgguccagggccucauccggcacuuccgccccgagcuggaggagcggaugcagcgcuucgcgcagcagcaccaggcccggcaggccgccuccuga

SEQ ID NO: 33490 - RNA, 750 nt, Artificial Sequence
  derived and/or modified sequence opt1 from NDUFV2__Homo_sapiens__NP_066552
auguucuucagcgccgcccugcgcgcgcgggccgccggccucaccgcccacugggggcgccacgugcggaaccugcacaagaccgucaugcagaacggcgccgggggcgcgcuguucgugcaccgcgacacgcccgagaacaacccggacacccccuucgacuucacccccgagaacuacaagcggaucgaggccaucgugaagaacuaccccgaggggcacaaggccgccgcgguccucccggugcuggaccuggcccagcgccagaacggcuggcuccccaucuccgccaugaacaagguggccgagguccuccaggugccgcccaugcggguguacgaggucgccaccuucuacacgauguacaaccgcaagcccgugggcaaguaccacauccaggugugcaccaccacccccugcaugcugcggaacagcgacuccauccuggaggcgauccagaagaagcuggggaucaaggucggcgagacgacccccgacaagcuguucacccucaucgagguggagugccugggggccugcgugaacgcccccaugguccagaucaacgacaacuacuacgaggaccugaccgccaaggacaucgaggagaucaucgacgagcucaaggccggcaagaucccgaagcccgggccccgcagcggccgguucuccugcgagcccgcgggcgggcugacgagccugaccgagccgcccaagggccccggguucggcgugcaggccggccucuga

SEQ ID NO: 33491 - RNA, 327 nt, Artificial Sequence
  derived and/or modified sequence opt1 from NDUFV3__Homo_sapiens__NP_001001503
auggccgcccccugccugcuccgccagggccgggcgggggcccugaagaccaugcugcaggaggcccagguguuccgcggccucgccagcaccgucucccugagcgccgaguccgggaaguccgagaagggccagccgcagaacuccaagaagcagagcccgcccaagaagcccgcgcccgugcccgccgagcccuucgacaacacgaccuacaagaaccugcagcaccacgacuacuccaccuacaccuuccucgaccugaaccuggagcucagcaaguuccggaugccccagccguccagcgggcgcgagagcccccggcacuga

SEQ ID NO: 33492 - RNA, 25578 nt, Artificial Sequence
  derived and/or modified sequence opt1 from NEB__Homo_sapiens__NP_001157979
auggccgacgacgaggacuacgaggaggugguggaguacuacaccgaggaggugguguacgaggaggugcccggcgagaccaucaccaagaucuacgagaccaccaccacccgcaccagcgacuacgagcagagcgagaccagcaagcccgcccuggcgcagcccgcccucgcccagcccgccagcgccaagcccguggagcggcgcaaggugauccggaagaagguggaccccagcaaguucaugacccccuacaucgcgcacagccagaagaugcaggaccuguucagccccaacaaguacaaggagaaguucgagaagaccaagggccagcccuacgccagcaccaccgacacccccgagcugcgccggaucaagaaggugcaggaccagcucagcgaggugaaguaccgcauggacggcgacguggccaagaccaucugccacguggacgagaaggccaaggacaucgagcacgcgaagaaggugagccagcaggucagcaaggugcuguacaagcagaacugggaggacaccaaggacaaguaccugcugccgcccgacgcccccgagcuggugcaggccgugaagaacaccgccauguucagcaagaagcuguacaccgaggacugggaggccgacaagagccucuucuaccccuacaacgacagccccgagcugcggcgcguggcgcaggcccagaaggcccugagcgacguggccuacaagaaggggcucgccgagcagcaggcgcaguucacgccccuggccgacccgcccgacaucgaguucgccaagaaggugaccaaccaggugagcaagcagaaguacaaggaggacuacgagaacaagaucaagggcaaguggagcgagacccccugcuucgagguggccaacgcccggaugaacgcggacaacaucagcacccgcaaguaccaggaggacuucgagaacaugaaggaccagaucuacuucaugcagaccgagacccccgaguacaagaugaacaagaaggccgggguggccgccagcaaggugaaguacaaggaggacuacgagaagaacaagggcaaggccgacuacaacgugcugcccgcgagcgagaacccccagcuccggcagcugaaggccgccggcgacgcccugagcgacaagcucuacaaggagaacuacgagaagaccaaggccaagagcaucaacuacugcgagacccccaaguucaagcuggacaccguccugcagaacuucagcagcgacaagaaguacaaggacuccuaccucaaggacauccuggggcacuacgugggcagcuucgaggaccccuaccacucccacugcaugaaggucaccgcccagaacagcgacaagaacuacaaggccgaguacgaggaggaccgcgggaagggcuucuucccccagaccaucacccaggaguacgaggccaucaagaagcuggaccagugcaaggaccacaccuacaaggugcaccccgacaagaccaaguucacccaggugaccgacucccccguccuccugcaggcccaggugaacagcaagcagcuguccgaccucaacuacaaggcgaagcacgagagcgagaaguucaagugccacaucccgcccgacacccccgccuucauccagcacaaggugaacgccuacaaccuguccgacaaccuguacaagcaggacugggagaaguccaaggccaagaaguucgacaucaaggucgacgccaucccccuccuggcggccaaggccaacaccaagaacaccuccgacgugauguacaagaaggacuacgagaagaacaaggggaagaugaucggcgugcugagcaucaacgacgaccccaagaugcuccacucccugaaggucgccaagaaccagagcgaccggcuguacaaggagaacuacgagaagaccaaggccaaguccaugaacuacugcgagaccccgaaguaccagcucgacacccagcugaagaacuucagcgaggcgcgcuacaaggaccuguacgugaaggacgugcucggccacuacgucggguccauggaggaccccuaccacacccacugcaugaagguggccgcccagaacagcgacaagagcuacaaggccgaguacgaggaggacaagggcaagugcuacuucccccagaccaucacccaggaguacgaggcgaucaagaagcuggaccagugcaaggaccacacguacaaggugcaccccgacaagaccaaguucaccgccgucaccgacuccccggugcugcuccaggcccagcugaacacgaagcagcugagcgaccucaacuacaaggccaagcacgagggggagaaguucaagugccacauccccgccgacgcgccccaguucauccagcaccgggugaacgccuacaaccuguccgacaacgucuacaagcaggacugggagaaguccaaggccaagaaguucgacaucaagguggacgccaucccccugcucgccgcgaaggccaacaccaagaacaccuccgacgugauguacaagaaggacuacgagaaguccaagggcaagaugaucggcgcccuguccaucaacgacgacccgaagaugcugcacagccugaagaccgccaagaaccaguccgaccgcgaguaccggaaggacuacgagaaguccaagacgaucuacaccgcgccccuggacaugcugcaggucacccaggcgaagaagucccaggccaucgccagcgacguggacuacaagcacauccugcacuccuacagcuacccgcccgacuccaucaacguggaccucgccaagaaggcguacgcccugcagagcgacgucgaguacaaggccgacuacaacuccuggaugaaggggugcggcugggugccguucgggagccuggagauggagaaggccaagcgcgccagcgacauccucaacgagaagaaguaccggcagcaccccgacacccugaaguucacguccaucgaggacgcgcccaucaccgugcagagcaagaucaaccaggcccagcgcuccgacaucgccuacaaggccaagggcgaggagaucauccacaaguacaaccugcccccggaccucccccaguucauccaggccaaggucaacgcguacaacaucagcgagaacauguacaaggccgaccugaaggaccuguccaagaagggguacgaccuccggaccgacgccauccccauccgcgccgccaaggcggcccgccaggccgccagcgacgugcaguacaagaaggacuacgagaaggccaagggcaagauggugggcuuccagucccugcaggacgaccccaagcugguccacuacaugaacguggcgaagauccagagcgaccgggaguacaagaaggacuacgagaagaccaaguccaaguacaacacgccgcacgacauguucaacguggucgccgccaagaaggcccaggacguggugagcaacgucaacuacaagcacucccuccaccacuacaccuaccugcccgacgcgauggaccuggagcucagcaagaacaugaugcagauccaguccgacaacguguacaaggaggacuacaacaacuggaugaaggggaucggcuggauccccaucgggagccuggacguggagaaggucaagaaggccggcgacgcccugaacgagaagaaguaccgccagcaccccgacacccucaaguucaccuccaucguggacagcccggugaugguccaggccaagcagaacacgaagcaggucuccgacauccuguacaaggccaagggggaggacgugaagcacaaguacaccaugagccccgaccugccccaguuccuccaggcgaagugcaacgccuacaacaucuccgacgucugcuacaagcgggacuggcacgaccugaucgccaagggcaacaacgugcugggcgacgccaucccgaucaccgccgcgaaggccagccgcaacaucgccagcgacuacaaguacaaggaggccuacgagaaguccaaggggaagcacgugggcuuccggagccuccaggacgaccccaagcugguccacuacaugaacguggccaagcugcaguccgaccgcgaguacaagaagaacuacgagaacaccaagacgagcuaccacacccccggggacaugguguccaucaccgcggccaagauggcccaggacgucgccaccaacgugaacuacaagcagccccuccaccacuacacguaccugccggacgcgaugagccuggagcacacccggaacgucaaccagauccaguccgacaacguguacaaggacgaguacaacagcuuccucaagggcaucggguggauccccaucggcucccuggagguggagaaggucaagaaggccggcgacgcccugaacgagcgcaaguaccggcagcaccccgacaccgugaaguucaccagcgugcccgacuccauggggaugguccucgcccagcacaacacgaagcagcugagcgaccugaacuacaagguggagggcgagaagcucaagcacaaguacaccaucgacccggagcugccccaguucauccaggccaaggugaacgcgcugaacauguccgacgcccacuacaaggccgacuggaagaagaccaucgccaagggguacgaccuccgccccgacgccauccccaucgucgcggccaagagcucccggaacaucgccagcgacugcaaguacaaggaggccuacgagaaggccaagggcaagcaggucggcuuccugucccugcaggacgacccgaagcucgugcacuacaugaacgucgcgaagauccagagcgaccgcgaguacaagaagggguacgaggccuccaagaccaaguaccacacgccccuggacauggugagcgugaccgccgccaagaagucccaggaggucgcgaccaacgccaacuaccggcaguccuaccaccacuacacccugcuccccgacgcccugaacguggagcacagccgcaacgccaugcagauccaguccgacaaccuguacaagagcgacuucaccaacuggaugaagggcaucgggugggugcccaucgagucccucgaggucgagaaggccaagaaggcgggcgagauccugagcgagaagaaguaccggcagcacccggagaagcugaaguucacguacgccauggacaccauggagcaggcccucaacaaguccaacaagcugaacauggacaagcgccuguacaccgagaaguggaacaaggacaagaccacgauccacgugaugcccgacacccccgacauccuccugagccgggugaaccagaucaccauguccgacaagcuguacaaggccgggugggaggaggagaagaagaagggcuacgaccuccgccccgacgccaucgcgaucaaggccgcccgggccagccgcgacaucgccuccgacuacaaguacaagaaggcguacgagcaggccaagggcaagcacaucggguuccgcagccuggaggacgacccgaagcugguccacuucaugcaggucgccaagaugcaguccgaccgggaguacaagaagggcuacgagaaguccaagaccuccuuccacacgcccguggacaugcucagcgucguggccgccaagaagucccaggagguggcgaccaacgccaacuaccgcaacgucauccacaccuacaacaugcugcccgacgccaugagcuucgagcuggccaagaacaugaugcagauccaguccgacaaccaguacaaggcggacuacgccgacuucaugaaggggaucggcuggcucccccuggggagccuggaggccgagaagaacaagaaggccauggagaucaucagcgagaagaaguaccggcagcacccggacacccucaaguacuccacgcugauggacagcaugaacauggugcuggcccagaacaacgcgaagaucaugaacgagcaccucuacaagcaggccugggaggccgacaagaccaaggugcacaucaugcccgacaucccccagaucauccuggccaaggccaacgcgaucaacauguccgacaagcuguacaagcucagccuggaggaguccaagaagaagggcuacgaccugcgccccgacgccaucccgaucaaggccgccaaggccagccgggacaucgcguccgacuacaaguacaaguacaacuacgagaagggcaaggggaagauggucggcuuccgcagccucgaggacgaccccaagcuggugcacuccaugcaggucgccaagaugcagagcgaccgggaguacaagaagaacuacgagaacaccaagaccuccuaccacacgcccgccgacaugcugagcgucaccgccgcgaaggacgcccaggccaacaucaccaacaccaacuacaagcaccucauccacaaguacauccugcugccggacgccaugaacaucgagcucacgcgcaacaugaaccggauccaguccgacaacgaguacaagcaggacuacaacgagugguacaaggggcugggcuggagccccgccgggucccuggagguggagaaggcgaagaaggccaccgaguacgccagcgaccagaaguaccgccagcaccccuccaacuuccaguucaagaagcucaccgacagcauggacauggugcuggccaagcagaacgcccacaccaugaacaagcaccuguacacgaucgacuggaacaaggacaagaccaagauccacgucaugcccgacaccccggacauccuccaggcgaagcagaaccagacccuguacucccagaagcuguacaagcucggcugggaggaggcccugaagaagggcuacgaccugcccguggacgccaucagcgugcagcuggccaaggccagccgggacaucgcguccgacuacaaguacaagcagggguaccgcaagcagcucggccaccacgucggguuccggagccugcaggacgaccccaagcuggugcucuccaugaacguggccaagaugcagagcgagcgcgaguacaagaaggacuucgagaaguggaagacgaaguucuccagccccgucgacaugcugggcguggugcuggccaagaagugccaggagcucgucuccgacguggacuacaagaacuaccugcaccaguggaccugccugccggaccagaacgacgugguccaggccaagaagguguacgagcuccagagcgagaaccuguacaaguccgaccuggaguggcuccgggggaucggcuggagcccccugggcucccuggaggcggagaagaacaagcgcgccagcgagaucaucuccgagaagaaguaccggcagccgcccgaccgcaacaaguucaccagcaucccggacgccauggacaucgugcucgccaagaccaacgccaagaaccgguccgaccgccuguaccgggaggcgugggacaaggacaagacgcagauccacaucaugcccgacacccccgacaucguccuggccaaggccaaccucaucaacaccagcgacaagcuguaccgcaugggguacgaggagcugaagcgcaagggcuacgaccuccccguggacgccaucccgaucaaggccgcgaaggccucccgggagaucgccagcgaguacaaguacaaggagggguuccgcaagcagcugggccaccacaucggcgcccggaacaucgaggacgaccccaagaugaugugguccaugcacgucgccaagauccagagcgaccgcgaguacaagaaggacuucgagaaguggaagaccaaguucagcucccccguggacaugcugggggugguccucgcgaagaagugccagacgcuggugagcgacguggacuacaagaacuaccugcaccaguggaccugccuccccgaccaguccgacgucauccacgcccggcaggccuacgaccugcagagcgacaaccuguacaaguccgaccuccaguggcugaagggcaucggguggaugaccagcggcucccuggaggacgagaagaacaagcgcgccacccagauccucagcgaccacguguaccggcagcacccggaccaguucaaguucuccagccugauggacuccauccccauggugcuggccaagaacaacgcgaucaccaugaaccaccgccucuacacggaggccugggacaaggacaagaccaccguccacaucaugcccgacacccccgaggugcugcuggccaagcagaacaaggugaacuacagcgagaagcucuacaagcuggggcuggaggaggccaagcggaagggcuacgacaugcgcgucgacgcgaucccgaucaaggccgccaaggccucccgggacaucgccagcgaguucaaguacaaggagggcuaccgcaagcagcucgggcaccacaucggcgcgcgggccauccgcgacgaccccaagaugaugugguccaugcacguggccaagauccagagcgaccgggaguacaagaaggacuucgagaaguggaagacgaaguucuccagccccguggacaugcugggggucgugcuggccaagaagugccagacccucgugagcgacgucgacuacaagaacuaccugcaccaguggaccugccugcccgaccaguccgacgugauccacgcccgccaggcguacgaccuccagagcgacaacauguacaaguccgaccugcaguggaugcggggcaucgggugggugagcaucggcucccuggacgucgagaagugcaagcgcgccaccgagauccucagcgacaagaucuaccggcagccgcccgaccgcuucaaguucacguccgugaccgacagccuggagcagguccuggccaagaacaacgccaucaccaugaacaagcgccucuacaccgaggccugggacaaggacaagacgcagauccacaucaugcccgacaccccggagaucaugcuggcgcggaugaacaagaucaacuacuccgagagccuguacaagcucgccaacgaggaggccaagaagaagggcuacgaccugcgcuccgacgccauccccaucgucgcggccaaggccagccgggacaucaucuccgacuacaaguacaaggacggguacugcaagcagcugggccaccacaucggggcccgcaacaucgaggacgaccccaagaugauguggagcaugcacguggccaagauccaguccgaccgggaguacaagaaggacuucgagaaguggaagaccaaguucagcucccccguggacaugcucggcgucgugcuggcgaagaagugccagacccuggugagcgacgucgacuacaagaacuaccuccacgaguggacgugccugccggaccaguccgacgugauccacgcccgccaggccuacgaccugcagagcgacaacaucuacaagagcgaccuccaguggcugcgggggaucggcugggugcccaucggcuccauggacgucgugaagugcaagcgcgccaccgagauccugagcgacaacaucuaccggcagccgcccgacaagcucaaguucaccuccgugaccgacagccuggagcagguccuggccaagaacaacgcgcucaacaugaacaagcgccuguacacggaggccugggacaaggacaagacccagauccacaucaugccggacacccccgagaucaugcuggcccggcagaacaagaucaacuacuccgagacccucuacaagcuggccaacgaggaggccaagaagaagggguacgaccugcgcagcgacgcgauccccaucguggccgccaaggccucccgggacgugaucagcgacuacaaguacaaggacggcuaccgcaagcagcucgggcaccacaucggcgcccggaacaucgaggacgaccccaagaugaugugguccaugcacgucgcgaagauccagagcgaccgcgaguacaagaaggacuucgagaaguggaagacgaaguucuccagcccgguggacaugcugggcgugguccuggccaagaagugccagacccucguguccgacguggacuacaagaacuaccugcacgaguggaccugccugcccgaccagaacgacgucauccacgcccggcaggccuacgaccuccagagcgacaacaucuacaaguccgaccugcaguggcugcgcgggaucggcugggugcccaucgggagcauggacguggucaagugcaagcgggcggccgagauccucuccgacaacaucuaccgccagcccccggacaagcugaaguucaccagcgugacggacucccuggagcagguccucgccaagaacaacgcccugaacaugaacaagcggcuguacaccgaggccugggacaaggacaagacccagguccacaucaugcccgacacccccgagaucaugcucgcgcgccagaacaagaucaacuacagcgagagccuguaccgccaggccauggaggaggccaagaaggagggcuacgaccugcgguccgacgccauccccaucguggccgcgaaggccagccgcgacaucgccuccgacuacaaguacaaggaggccuaccggaagcagcucgggcaccacaucggcgcccgcgcgguccacgacgacccgaagaucauguggagccugcacaucgccaaggugcaguccgaccgggaguacaagaaggacuucgagaaguacaagacgcgcuacagcucccccguggacaugcugggcaucguccucgccaagaagugccagacccuggugagcgacguggacuacaagcacccccugcacgaguggaucugccugcccgaccagaacgacaucauccacgcccggaaggcguacgaccuccaguccgacaaccuguacaagagcgaccuggaguggaugaaggggaucggcugggucccgaucgacucccucgagguggugcgcgccaagcgggccggggagcugcugagcgacaccaucuaccgccagcggcccgagacccucaaguucacguccaucaccgacacccccgagcagguccuggccaagaacaacgcccugaacaugaacaagcgccucuacaccgaggcgugggacaacgacaagaagacgauccacgugaugccggacacccccgagaucaugcuggccaagcugaaccggaucaacuacagcgacaagcucuacaagcuggcccuggaggaguccaagaaggagggcuacgaccuccgccuggacgccauccccauccaggccgcgaaggccagccgggacaucgccuccgacuacaaguacaaggagggguaccgcaagcagcugggccaccacaucggcgcccggaacaucaaggacgaccccaagaugauguggagcauccacguggccaagauccaguccgaccgcgaguacaagaaggaguucgagaaguggaagaccaaguucagcagcccggucgacaugcucgggguggugcuggcgaagaagugccagauccuggucuccgacaucgacuacaagcacccccuccacgaguggaccugccugcccgaccagaacgacgugauccaggcccggaaggccuacgaccugcagagcgacgccaucuacaaguccgaccucgaguggcugcgcggcaucgggugggugcccaucggcagcgucgagguggagaaggugaagcgcgcgggggagauccuguccgaccggaaguaccgccagccggccgaccagcucaaguucacgugcaucacggacacccccgagaucguccuggccaagaacaacgcccugaccaugagcaagcaccucuacaccgaggccugggacgcggacaagacguccauccacgugaugcccgacacccccgacauccugcuggccaagagcaacuccgccaacaucagccagaagcucuacaccaagggcugggacgaguccaagaugaaggacuacgaccugcgggccgacgccaucagcaucaaguccgcgaaggccagccgcgacaucgccuccgacuacaaguacaaggaggccuacgagaagcagaagggccaccacaucggggcccagagcaucgaggacgacccgaagaucaugugcgcgauccacgccggcaagauccaguccgagcgggaguacaagaaggaguuccagaaguggaagaccaaguucagcucccccguggacaugcugagcauccuccuggccaagaagugccagacgcuggucaccgacaucgacuaccgcaacuaccuccacgaguggaccugcaugcccgaccagaacgacaucauccaggccaagaaggccuacgaccugcagagcgacuccguguacaaggcggaccuggaguggcuccgggggaucggcuggaugcccgaggggagcguggagaugaaccgcgucaagguggcccaggaccuggugaacgagcggcuguaccgcacccggccggaggcccucuccuucacgagcaucgucgacacccccgagguggugcuggccaaggcgaacucccugcagaucagcgagaagcucuaccaggaggccuggaacaaggacaaguccaacaucaccauccccagcgacacccccgagaugcugcaggcccacaucaacgcccugcagaucuccaacaagcucuaccagaaggacuggaacgacgccaagcagaagggcuacgacauccgcgcggacgccaucgagaucaagcacgccaaggccagccgggagaucgccuccgaguacaaguacaaggagggcuaccgcaagcagcuggggcaccacaugggcuuccggacgcugcaggacgaccccaagagcgucugggcgauccacgccgccaagauccaguccgaccgcgaguacaagaaggccuacgagaaguccaaggggauccacaacacgccccuggacaugauguccaucgugcaggccaagaagugccaggugcuggucagcgacaucgacuaccggaacuaccugcaccaguggaccugccuccccgaccagaacgacgugauccaggcgaagaaggccuacgaccugcaguccgacaaccuguacaagagcgaccucgaguggcugaagggcaucggcuggcugcccgagggguccguggaggucaugcgcgugaagaacgcccagaaccuccugaacgagcggcuguaccgcaucaagccggaggcccucaaguucaccagcaucguggacacgcccgaggucauccaggcgaagaucaacgccgugcagaucagcgagccccuguaccgggacgccugggagaaggagaaggccaacgugaacguccccgccgacaccccgcugaugcuccaguccaagaucaacgcgcugcagaucagcaacaagcgcuaccagcaggccugggaggacgugaagaugaccggcuacgaccugcgcgccgacgccaucgggauccagcacgccaaggcgucccgggacaucgccagcgacuaccucuacaagaccgccuacgagaagcagaagggccacuacaucgggugccgcuccgccaaggaggaccccaagcuggugugggccgcgaacguccugaagaugcagaacgaccggcucuacaagaaggccuacaacgaccacaaggccaagaucagcauccccguggacaugguguccaucagcgccgcgaaggagggccaggcccuggccuccgacgucgacuaccgccacuaccugcaccacuggagcugcuucccggaccagaacgacgugauccaggcccggaaggccuacgaccuccaguccgacagcgucuacaaggcggaccuggaguggcugcgcggcaucggguggaugcccgagggcuccguggagaugaaccgggugaaggucgcccaggaccucgugaacgagcgccuguaccggacgcgccccgaggcccugagcuucaccuccaucguggacacccccgaggucgugcucgccaaggccaacagccugcagaucuccgagaagcuguaccaggaggcguggaacaaggacaagagcaacaucaccaucccgagcgacacgcccgagaugcuccaggcccacaucaacgcccugcagaucuccaacaagcuguaccagaaggacuggaacgacaccaagcagaagggguacgacauccgggccgacgccaucgagaucaagcacgcgaaggccagccgcgagaucgccuccgaguacaaguacaaggagggcuaccggaagcagcucgggcaccacaugggcuuccgcacccugcaggacgaccccaagagcgugugggccauccacgccgcgaagauccaguccgaccgggaguacaagaaggccuacgagaaguccaagggcauccacaacacgccccucgacaugauguccaucguccaggccaagaagugccaggugcucgugagcgacaucgacuaccgcaacuaccugcaccaguggaccugccugccggaccagaacgacgucauccaggccaagaaggcguacgaccuccaguccgacaaccuguacaagagcgaccuggaguggcugaaggggaucggcuggcuccccgagggguccguggaggugaugcgggucaagaacgcccagaaccugcugaacgagcgccucuaccggaucaagcccgaggcccugaaguucaccagcaucguggacacccccgaggugauccaggccaagaucaacgccguccagaucuccgagccgcuguaccgcaacgcgugggagaaggagaaggccaacgugaacgugcccgccgacacgccccucaugcugcagagcaagaucaacgcccugcagaucuccaacaagcgcuaccagcaggccugggaggacgucaagaugacgggcuacgaccuccgggcggacgccaucgggauccagcacgccaaggccagccgcgacaucgccuccgacuaccuguacaagaccgcguacgagaagcagaagggccacuacaucggcugccggagcgccaaggaggaccccaagcuggugugggccgccaacgugcucaagaugcagaacgaccgccuguacaagaaggcguacaacgaccacaaggccaagaucuccaucccggucgacauggugagcaucagcgccgccaaggaggggcaggcccuggcguccgacguggacuaccggcacuaccuccaccacuggagcugcuuccccgaccagaacgacgucauccaggcccgcaaggccuacgaccugcaguccgacagcguguacaaggccgaccuggaguggcuccggggcaucggguggaugcccgagggcuccguggagaugaaccgcgucaagguggcccaggaccuggugaacgagcggcuguaccgcacccggcccgaggcgcucagcuucaccuccaucgucgacaccccggagguggugcuggccaaggccaacagccugcagaucuccgagaagcucuaccaggaggccuggaacaaggacaagagcaacaucacgauccccuccgacacccccgagaugcugcaggcccacaucaacgcgcugcagaucagcaacaagcucuaccagaaggacuggaacgacaccaagcagaagggguacgacauccgcgccgacgccaucgagaucaagcacgccaaggccucccgggagaucgcgagcgaguacaaguacaaggagggcuaccgcaagcagcugggccaccacaugggguuccggacccugcaggacgaccccaaguccgucugggccauccacgccgccaagauccagagcgaccgcgaguacaagaaggcguacgagaaguccaagggcauccacaacacgccgcucgacaugaugagcaucgugcaggccaagaagugccaggugcuggucuccgacaucgacuaccggaacuaccugcaccaguggaccugccuccccgaccagaacgacgugauccaggccaagaaggccuacgaccugcagagcgacaaccuguacaagagcgaccucgaguggcugaaggggaucggcuggcugcccgagggcuccguggaggucaugcgcgugaagaacgcccagaaccuccugaacgagcggcuguaccgcaucaagcccgaggcgcucaaguucaccagcaucguggacaccccggaggucauccaggccaagaucaacgccgugcagaucuccgagccccuguaccgggacgccugggagaaggagaaggccaacgugaacguccccgcggacacgccgcugaugcuccagagcaagaucaacgcccugcagaucuccaacaagcgcuaccagcaggccugggaggacgugaagaugaccggguacgaccugcgcgccgacgccaucggcauccagcacgcgaaggccagccgggacaucgccuccgacuaccucuacaagaccgccuacgagaagcagaaggggcacuacaucggcugccgcagcgcgaaggaggaccccaagcuggugugggccgccaacguccugaagaugcagaacgaccggcucuacaagaaggccuacaacgaccacaaggccaagaucuccauccccguggacauggucagcaucuccgcggccaaggaggggcaggcccuggccagcgacguggacuaccgccacuaccugcaccggugguccugcuuccccgaccagaacgacgugauccaggcccgcaaggcguacgaccuccagagcgacgcccuguacaaggccgaccuggaguggcuccggggcaucggcuggaugccgcaggggucccccgagguccugcgcgugaagaacgcccagaacaucuucugcgacagcguguaccggacccccgucgugaaccugaaguacacguccaucguggacacccccgaggucgugcucgccaagagcaacgcggagaacaucuccaucccgaaguaccgcgaggugugggacaaggacaagaccagcauccacaucaugcccgacacccccgagaucaaccuggcccgggccaacgcccugaacgucagcaacaagcucuaccgcgagggcugggacgagaugaaggcggggugcgacgugcggcuggacgccauccccauccaggccgccaaggccucccgcgagaucgcgagcgacuacaaguacaagcuggaccacgagaagcagaagggccacuacguggggacgcucaccgcccgggacgacaacaagauccgcugggcccugaucgccgacaagcugcagaacgagcgggaguaccgccucgacugggccaaguggaaggcgaagauccaguccccggucgacaugcugagcauccugcacuccaagaacagccaggcccucguguccgacauggacuaccggaacuaccugcaccaguggaccugcaugcccgaccagaacgacgugauccaggccaagaaggccuacgagcugcagagcgacaacgucuacaaggccgaccucgaguggcugcgcggcaucggcuggaugcccaacgacuccgugagcgugaaccacgcgaagcacgccgccgacaucuucuccgagaagaaguaccgcaccaagaucgagacgcugaacuucacccccgucgacgaccggguggacuacgugaccgccaagcagagcggggagauccucgacgacaucaaguaccgcaaggacuggaacgccaccaaguccaaguacacgcugaccgagaccccgcugcuccacaccgcgcaggaggccgcccggauccuggaccaguaccuguacaaggagggcugggagcgccagaaggccacgggguacauccugccgcccgacgcgguccccuucgugcacgcccaccacugcaacgacgugcagagcgagcugaaguacaaggccgagcacgucaagcagaagggccacuacgugggggugccgaccaugcgggacgaccccaagcuggucugguucgagcacgccggccagauccagaacgagcgccucuacaaggaggacuaccacaagaccaaggccaagaucaacauccccgcggacaugguguccgugcuggccgccaagcagggccagacccuggucagcgacaucgacuaccggaacuaccuccaccaguggaugugccaccccgaccagaacgacgugauccaggcccgcaaggccuacgaccugcaguccgacaacguguaccgggcggaccuggaguggcuccgcgggaucggcuggaucccgcuggacagcgucgaccacgugcgggugacgaagaaccaggagaugaugucccagaucaaguacaagaagaacgcccuggagaacuaccccaacuuccgcagcgucguggacccgcccgagaucgugcuggccaagaucaacagcgucaaccaguccgacgugaaguacaaggagaccuucaacaaggccaaggggaaguacaccuucagcccggacacgccccacaucucccacagcaaggacaugggcaagcucuacuccacgauccuguacaagggcgccugggaggggaccaaggcguacggcuacacccuggacgagcgguacauccccaucgugggggccaagcacgccgaccucgucaacagcgagcugaaguacaaggagaccuacgagaagcagaagggccacuaccuggccgggaaggugaucggcgaguucccgggcgugguccacugccucgacuuccagaagaugcgcuccgcgcugaacuaccggaagcacuacgaggacaccaaggccaacgugcacauccccaacgacaugaugaaccacgugcuggccaagcgcugccaguacauccucagcgaccuggaguaccggcacuacuuccaccaguggacgucccugcucgaggagcccaacgucauccgcgugcggaacgcccaggagauccugagcgacaacgucuacaaggacgaccugaacuggcucaaggggaucggcugcuacgugugggacacgccccagauccugcacgccaagaaguccuacgaccugcagagccagcuccaguacaccgcggccgggaaggagaaccugcagaacuacaaccuggugaccgacacgccgcucuacgucaccgccgugcaguccggcaucaacgccagcgaggugaaguacaaggagaacuaccaccagaucaaggacaaguacaccaccguccuggagacgguggacuacgaccgcacccggaaccugaagaaccucuacuccagcaaccuguacaaggaggccugggaccgcgugaaggcgaccuccuacauccugcccagcuccacccucagccugacgcacgccaagaaccagaagcaccuggccagccacaucaaguaccgcgaggaguacgagaaguucaaggcccucuacacccugccccgguccgucgacgacgaccccaacaccgcccgcugccugcggguggggaagcucaacaucgaccgccuguaccggagcguguacgagaagaacaagaugaagauccacaucgucccggacaugguggagauggugaccgcgaaggacucccagaagaaggucagcgagaucgacuaccgccugcggcuccacgaguggaucugccaccccgaccuccaggugaacgaccacgugcgcaaggucacggaccagaucuccgacaucguguacaaggacgaccugaacuggcucaagggcaucggcugcuacgugugggacacccccgagauccugcacgccaagcacgccuacgaccugcgggacgacaucaaguacaaggcccacaugcucaagacccgcaacgacuacaagcuggucaccgacacgcccguguacgugcaggcggucaagagcgggaagcagcuguccgacgccguguaccacuacgacuacgugcacagcguccggggcaagguggccccgaccaccaagaccguggaccucgaccgcgcccugcacgccuacaagcugcaguccagcaaccucuacaagacgucccugcggacccugcccaccggguaccgccuccccggcgacacgccccacuucaagcacaucaaggacacgcgguacaugagcuccuacuucaaguacaaggaggcguacgagcacaccaaggccuacggguacacccugggcccgaaggacguccccuucgugcacgugcgccgggucaacaacgugaccagcgagcgccuguaccgggagcucuaccacaagcugaaggacaagauccacacgacccccgacacccccgagauccgccaggugaagaagacccaggaggccgucuccgagcugaucuacaagagcgacuucuucaagaugcagggccacaugaucucccucccguacacgccccaggugauccacugccgcuacgugggggacaucaccagcgacaucaaguacaaggaggaccugcagguccugaagggcuucgggugcuuccucuacgacacccccgacauggugcggagccgccaccuccggaagcugugguccaacuaccucuacaccgacaaggcccgcaagaugcgggacaaguacaaggugguccuggacacccccgaguaccgcaaggugcaggagcugaagacgcaccucagcgagcugguguaccgggccgcgggcaagaagcagaaguccaucuucaccagcgucccggacacccccgaccugcuccgcgccaagcgggggcagaagcugcagucccaguaccuguacguggagcucgccaccaaggagcgcccccaccaccacgccggcaaccagacgaccgcccugaagcacgcgaaggacgugaaggacauggucagcgagaagaaguacaagauccaguacgagaagaugaaggacaaguacaccccggugcccgacacccccauccugauccgggccaagcgcgccuacuggaacgccuccgaccuccgguacaaggagacguuccagaagaccaagggcaaguaccacaccgugaaggacgcccuggacaucgucuaccaccgcaaggugaccgacgacaucagcaagaucaaguacaaggagaacuacaugucccagcuggggaucuggcggagcauccccgaccgcccggagcacuuccaccaccgggcggucacggacaccguguccgacgugaaguacaaggaggaccucaccuggcugaagggcaucgggugcuacgccuacgacacccccgacuucacgcuggccgagaagaacaagacccucuacagcaaguacaaguacaaggaggucuucgagcgcaccaaguccgacuucaaguacguggccgacagccccaucaaccggcacuucaaguacgcgacccagcugaugaacgagaagaaguaccgcgccgacuacgagcagcggaaggacaaguaccaccugguggucgacgagccccgccaccuccuggccaagacggccggcgaccagaucucccagaucaaguaccgcaagaacuacgagaaguccaaggacaaguucaccuccaucguggacaccccggagcaccuccggaccacgaaggugaacaagcagaucagcgacauccucuacaagcuggaguacaacaaggccaagccccgcggcuacaccaccauccacgacacccccaugcugcuccacguccggaaggugaaggacgagguguccgaccugaaguacaaggaggucuaccagcgcaacaagagcaacugcacgaucgagcccgacgcggugcacaucaaggccgccaaggacgccuacaaggugaacaccaaccuggacuacaagaagcaguacgaggccaacaaggcgcacuggaaguggaccccggaccggcccgacuuccuccaggccgccaagagcucccugcagcagagcgacuucgaguacaagcuggaccgcgaguuccucaaggggugcaagcuguccgucaccgacgacaagaacacggugcuggcccugcggaacacccucaucgagagcgaccugaaguacaaggagaagcacgugaaggagcgcgggaccugccacgccguccccgacacgccccagauccugcucgcgaagacgguguccaaccuggugagcgagaacaaguacaaggaccacgucaagaagcaccuggcccagggguccuacaccacccucccggagacccgggacaccgugcacgugaaggaggucacgaagcacgugagcgacaccaacuacaagaagaaguucgugaaggagaagggcaaguccaacuacagcaucaugcuggagccgcccgaggucaagcacgccauggagguggccaagaagcaguccgacguggcguaccgcaaggacgccaaggagaaccugcacuacaccaccgucgccgaccggcccgacaucaagaaggccacgcaggccgcgaagcaggccagcgagguggaguaccgcgccaagcaccggaaggaggggucccacggccucagcaugcugggccgcccggacaucgagauggccaagaaggccgcgaagcuguccagccaggugaaguaccgggagaacuucgacaaggagaaggggaagacccccaaguacaaccccaaggacucccagcucuacaaggucaugaaggacgccaacaaccuggccagcgaggugaaguacaaggccgaccugaagaagcuccacaagcccgugaccgacaugaaggagucccugaucaugaaccacguccugaacaccagccagcucgccagcuccuaccaguacaagaagaaguacgagaaguccaagggccacuaccacacgaucccggacaaccuggagcagcugcaccucaaggaggcgaccgagcugcaguccaucgugaaguacaaggagaaguacgagaaggagcgcgggaagcccaugcuggacuucgagacccccaccuacaucacggccaaggagagccagcagaugcaguccggcaaggaguaccggaaggacuacgaggagagcaucaaggggcgcaaccucaccggccuggaggugacccccgcccugcuccacgucaaguacgccaccaagaucgcguccgagaaggaguaccggaaggaccuggaggagagcauccgcggcaaggggcugacggagauggaggacaccccggacaugcuccgcgccaagaacgccacccagauccugaacgagaaggaguacaagcgggaccuggagcucgaggugaagggccgcgggcugaacgccauggccaacgagacccccgacuucaugcgggcgcgcaacgccacggacaucgccucccagaucaaguacaagcagagcgccgagauggagaaggccaacuucaccuccguggucgacacccccgagaucauccacgcgcagcaggucaagaaccugagcucccagaagaaguacaaggaggacgccgagaaguccauguccuacuacgagaccgugcucgacacgccggagauccagcggguccgcgagaaccagaagaacuucagccugcugcaguaccagugcgaccucaagaacuccaagggcaagaucaccguggugcaggacacccccgagauccugcgggucaaggagaaccagaagaacuucagcuccgugcuguacaaggaggacgugagccccgggaccgccaucggcaagacgcccgagaugaugcgcgucaagcagacccaggaccacaucagcuccgugaaguacaaggaggccaucggccaggggaccccgauccccgaccuccccgaggugaagcgggucaaggagacccagaagcacaucagcuccgugauguacaaggagaaccugggcacggggauccccaccaccgucaccccggagaucgagcgcgugaagcggaaccaggagaacuucagcuccgugcuguacaaggagaaccucggcaagggcauccccacgcccaucacccccgagauggagcgcgucaagcggaaccaggagaacuucagcuccauccuguacaaggagaaccugagcaaggggaccccgcuccccgugacccccgagauggagcgcgugaagcugaaccaggagaacuucuccagcguccuguacaaggagaacgugggcaaggggauccccaucccgaucacgcccgagauggagcgggugaagcacaaccaggagaacuucuccagcguccucuacaaggagaaccugggcaccgggauccccauccccaucaccccggagaugcagcgcgugaagcacaaccaggagaaccuguccagcgugcucuacaaggagaacaugggcaagggcacgccccugcccgucacccccgagauggagcgggugaagcacaaccaggagaacaucuccagcgugcuguacaaggagaacauggggaagggcacgccgcuccccgucacccccgagauggagcgcgugaagcacaaccaggagaacaucuccagcgugcuguacaaggagaacauggggaagggcacgccccuggccgucaccccggagauggagcgggugaagcacaaccaggagaacaucuccagcgugcucuacaaggagaacgucgggaaggcgacggccacccccgugacccccgagaugcagcgcgugaagcggaaccaggagaacaucagcuccguccuguacaaggagaaccugggcaaggccaccccgacgcccuucacccccgagauggagcgcgugaagcgcaaccaggagaacuucagcuccgugcucuacaaggagaacaugcggaaggccacccccaccccggucacgcccgagauggagcgcgccaagcggaaccaggagaacaucagcuccgugcuguacagcgacuccuuccgcaagcagauccagggcaaggcggccuacgugcuggacacccccgagaugcggcgcguccgggagacccagcgccacaucagcaccgugaaguaccacgaggacuucgagaagcacaaggggugcuucacgcccguggucaccgacccgaucaccgagcgggugaagaagaacaugcaggacuucuccgacaucaacuaccgcggcauccagcggaagguggucgagauggagcagaagcgcaacgaccaggaccaggagaccaucacggggcuccggguguggcgcaccaaccccggcagcguguucgacuacgaccccgccgaggacaacauccagucccggagccugcacaugaucaacguccaggcccagcgccggucccgcgagcagagccgguccgcgagcgcccuguccaucagcgggggcgaggagaaguccgagcacagcgaggcccccgaccaccaccucagcaccuacuccgacggcgggguguucgccgugagcaccgccuacaagcacgcgaagacgaccgagcugccgcagcagcgcuccagcuccgucgccacccagcagaccacggugagcuccauccccagccaccccuccaccgccggcaagaucuuccgcgccauguacgacuacauggccgcggacgccgacgaggugagcuucaaggacggggacgccaucaucaacguccaggccaucgacgagggcuggauguacgggaccgugcagcggaccggccgcacgggcaugcugcccgccaacuacguggaggcgaucuga

SEQ ID NO: 33493 - RNA, 3045 nt, Artificial Sequence
  derived and/or modified sequence opt1 from NEBL__Homo_sapiens__NP_006384
augcgcgugcccgucuucgaggacaucaaggacgagaccgaggaggagaagaucggcgaggaggagaacgaggaggaccagguguucuacaagccggugaucgaggaccugagcauggagcucgcccggaagugcaccgagcugaucuccgacauccgcuacaaggaggaguucaagaaguccaaggacaagugcacguucgucaccgacagccccaugcugaaccacgugaagaacaucggggccuucaucagcgaggcgaaguacaagggcaccaucaaggccgaccucuccaacagccuguacaagcggaugcccgccaccaucgacuccguguucgccggggaggucacgcagcugcagagcgagguggccuacaagcagaagcacgacgcggccaagggcuucuccgacuacgcccacaugaaggagcccccggaggugaagcacgccauggaggucaacaagcaccagagcaacaucuccuaccgcaaggacgugcaggacacccacaccuacagcgcggagcucgaccggcccgacaucaagauggccacccagaucuccaagaucaucagcaacgccgaguacaagaaggggcagggcaucaugaacaaggagcccgccgugaucggccgccccgacuucgagcacgccgucgaggcguccaagcugagcucccagaucaaguacaaggagaaguucgacaacgagaugaaggacaagaagcaccacuacaacccgcuggagagcgccuccuuccggcagaaccagcucgccgccacgcuggccagcaacgugaaguacaagaaggacauccagaacaugcacgaccccgugagcgaccugcccaaccuccuguuccuggaccacguccucaaggcguccaagaugcugagcgggcgcgaguacaagaagcuguucgaggagaacaagggcauguaccacuucgacgccgacgccguggagcaccuccaccacaaggggaacgccgugcugcagucccaggucaaguacaaggaggaguacgagaagaacaagggcaagcccaugcuggaguucguggagaccccgagcuaccaggccuccaaggaggcgcagaagaugcagagcgagaagguguacaaggaggacuucgagaaggagaucaaggggcgguccagccucgaccuggacaagacccccgaguuccugcacgucaaguacaucaccaaccuccugcgcgagaaggaguacaagaaggaccuggagaacgagaucaagggcaagggcauggagcucaacuccgaggugcuggacauccagcgggccaagcgcgccagcgagauggccuccgagaaggaguacaagaaggaccuggagagcaucaucaaggggaagggcaugcaggccgggacggacacccucgagaugcagcacgcgaagaaggccgccgagaucgccuccgagaaggacuacaagcgggaccuggagaccgagaucaagggcaagggcaugcaggucagcaccgacacgcuggacgugcagcgcgcgaagaaggccuccgagauggccagccagaagcaguacaagaaggaccucgagaacgagaucaaggggaagggcaugcaggucuccauggacauccccgacauccugcgggccaagcgcaccagcgagaucuacucccagcggaaguacaaggacgaggccgagaagaugcugagcaacuacagcaccaucgcggacacccccgagauccagcgcaucaagacgacccagcagaacaucuccgccguguucuacaagaaggaggugggggccggcaccgccgugaaggacagcccggagaucgagcgggucaagaagaaccagcagaacaucuccagcgugaaguacaaggaggagaucaagcacgccaccgcgaucuccgacccgcccgagcucaagcgcgugaaggagaaccagaagaacaucagcaaccugcaguacaaggagcagaacuacaaggccacgcccgucuccaugacccccgagaucgagcgggugcgccgcaaccaggagcagcugagcgccgugaaguacaagggggagcuccagcggggcaccgccaucuccgacccgcccgagcugaagcgcgccaaggagaaccagaagaacaucagcaacgucuacuaccggggccagcuggggcgcgcgaccacgcucuccgugacccccgagauggagcgggugaagaagaaccaggagaacaucagcuccgucaaguacacccaggaccacaagcagaugaagggccgccccagccugauccuggacacccccgccaugcggcacgugaaggaggcccagaaccacaucuccauggugaaguaccacgaggacuucgagaagacgaaggggcgcggcuucacccccgucguggacgaccccgugaccgagcggguccgcaagaacacccagguggugagcgacgccgcguacaaggggguccacccgcacaucguggagauggaccggcgccccggcaucaucguggaccucaaggucuggcggacggaccccggcuccaucuucgaccuggacccgcuggaggacaacauccagagccgcagccuccacaugcuguccgagaaggccagccacuaccggcgccacuggucccggagccacuccagcuccaccuucgggaccggccugggggacgaccgcagcgagaucuccgagaucuaccccagcuucuccugcugcagcgaggugacccggcccuccgacgagggcgcccccgugcugccgggggccuaccagcagagccacucccagggcuacggcuacaugcaccagaccagcgucuccagcaugcgcuccaugcagcacagccccaaccuccgcacguaccgggccauguacgacuacagcgcgcaggacgaggacgagguguccuuccgcgacggggacuacaucgugaacguccagcccaucgacgacggcuggauguacgggaccgugcagcggaccggccgcaccggcaugcugcccgccaacuacaucgaguucgugaacuga

SEQ ID NO: 33494 - RNA, 1056 nt, Artificial Sequence
  derived and/or modified sequence opt1 from NECAB1__Homo_sapiens__NP_071746
auggaggacagccaggagaccucccccagcuccaacaacagcuccgaggagcugagcuccgcccuccaccugagcaagggcauguccaucuuccuggacauccuccgccgggccgacaagaacgacgacgggaagcugagcuucgaggaguucaaggcguacuucgccgacggcgugcuguccggggaggagcuccacgagcuguuccacaccaucgacacgcacaacaccaacaaccuggacaccgaggagcucugcgaguacuucagccagcaccugggcgaguacgagaacguccuggccgcccucgaggaccugaaccuguccauccucaaggccauggggaagaccaagaaggacuaccaggaggcgagcaaccuggagcaguucgugacgcgcuuccugcucaaggagacccugaaccagcugcagucccuccagaacagccuggagugcgccauggagaccaccgaggagcagacgcggcaggagcgccagggcccggccaagcccgaggugcuguccauccaguggcccggcaagcggagcucccgccggguccagcgccacaacagcuucagccccaacuccccgcaguucaacgugagcgggcccggccuccuggaggaggacaaccaguggaugacccagaucaaccggcugcagaagcucaucgaccgccuggagaagaaggaccugaagcucgagccgcccgaggaggagaucaucgaggggaacaccaagucccacaucaugcuggugcagcggcagaugagcgucaucgaggaggaccuggaggaguuccagcucgcccugaagcacuacguggaguccgcgagcucccagagcggcugccugcgcaucuccauccagaagcucagcaacgagucccgguacaugaucuacgaguucugggagaacagcuccguguggaacagccaccuccagaccaacuacuccaagacguuccagcgcagcaacgucgacuuccuggagacccccgagcugaccuccaccaugcuggugcccgccagcugguggauccugaacaacuga

SEQ ID NO: 33495 - RNA, 1089 nt, Artificial Sequence
  derived and/or modified sequence opt1 from NECAB3__Homo_sapiens__NP_112508
auggccugcgccggccugcucaccgugugccugcugcggcccccggcgccccagccccagccccagaccccgcgccacccccagcucgcccccgaccccgggccggccggccacacgcuguuccaggacgucuuccgccgggccgacaagaacgacgacgggaagcugagcuucgaggaguuccagaacuacuucgccgacggcgugcucucccugggggagcugcaggagcuguucagcggcaucgacggccaccucaccgacaaccuggagaccgagaagcucugcgacuacuucuccgagcaccuggggguguaccgccccguccuggcggcccucgagagccugaaccgggccgugcuggccgcgauggacgccaccaagcucgaguacgagcgcgccuccaagguggaccaguucgucacgcgguuccugcugcgcgagaccgugagccagcuccaggcccugcaguccagccuggagggcgccuccgacacccucgaggcgcaggcccacggguggcggagcgacgccgaguccguggaggcccagagccgccugugcggcucccggcgcgccgggcggcgcgcgcugcggagcgucucccgcagcuccaccuggagccccggcuccagcgacacgggccggagcuccgaggccgagaugcaguggcgccuccaggugaaccggcugcaggagcugaucgaccagcucgagugcaaggcgccccgccuggagccgcugcgggaggaggaccucgccaaggggcccgaccugcacauccugauggcccagcgccaggugcaggucgccgaggagggccuccaggacuuccaccgcgcccugcggugcuacguggacuucaccggggcccagagccacugccugcacguguccgcccagaagaugcucgacggcgccagcuucacccuguacgaguucuggcaggacgaggcguccuggcgccggcaccagcagagccccggcuccaaggccuuccagcgcauccugaucgaccaccuccgggcccccgacacccugacgaccgucuucuucccggccagcugguggaucaugaacaacaacuga

SEQ ID NO: 33496 - RNA, 828 nt, Artificial Sequence
  derived and/or modified sequence opt1 from NECAP1__Homo_sapiens__NP_056324
auggccaccgagcuggaguacgagagcgugcucugcgucaagcccgacguguccguguaccgcaucccgccccgggccagcaaccgcggguaccgggccuccgacuggaagcuggaccagcccgacuggaccgggcgccugcggaucacgagcaagggcaagaccgccuacaucaagcucgaggacaaggucuccggggagcuguucgcccaggcccccguggagcaguacccgggcaucgccguggagaccgucaccgacagcucccgcuacuucgugauccggauccaggacgggacgggccgcagcgcguucaucggcaucggguucaccgaccggggcgacgccuucgacuucaacgugucccugcaggaccacuucaagugggucaagcaggagagcgagaucuccaaggagagccaggagauggacgcccgccccaagcucgaccugggguucaaggagggccagaccaucaagcugugcaucgggaacaucaccaacaagaagggcggcgccuccaagccccggacggcgcgcgggggcgggcucagccugcugcccccgccgcccggcggcaaggugaccaucccgccgcccuccagcuccguggccaucagcaaccacgucacgcccccgcccauccccaaguccaaccacgggggcagcgacgccgacauccuccuggaccuggacagccccgcccccgugaccacccccgcccccacccccguguccgucagcaacgaccucuggggcgacuucuccaccgcgagcuccagcgugcccaaccaggcgccccagcccuccaacugggugcaguucuga

SEQ ID NO: 33497 - RNA, 1983 nt, Artificial Sequence
  derived and/or modified sequence opt1 from NEDD1__Homo_sapiens__NP_001128648
augcaggagaaccugcgcuucgccagcuccggcgacgacaucaagaucugggacgccagcuccaugacccucguggacaaguucaacccccacaccagcccgcacgggaucuccagcaucugcugguccagcaacaacaacuuccuggucacggcguccagcuccggcgacaagaucguggugagcuccugcaagugcaagcccgucccccugcucgagcuggccgaggggcagaagcagaccugcgugaaccugaacagcaccuccauguaccucgugagcggcgggcugaacaacaccgucaacaucugggaccugaaguccaagcgggugcaccgcagccucaaggaccacaaggaccaggugacgugcgucaccuacaacuggaacgacugcuacaucgccuccggcagccugagcggcgagaucauccugcacuccgugaccaccaaccucagcuccacgcccuucgggcacggcagcaaccaguccgugcggcaccugaaguacagccuguucaagaagucccuccuggggagcgucuccgacaacggcaucgugacccugugggacgugaacagccaguccccguaccacaacuucgacagcguccacaaggcccccgccuccgggaucugcuucagccccgugaacgagcuccuguucgugaccaucggccuggacaagcgcaucauccucuacgacaccuccagcaagaagcuggucaagacgcugguggcggacacgccccucaccgccguggacuucaugccggacggcgccacccuggccaucggguccagccggggcaagaucuaccaguacgaccugcgcaugcucaagucccccgucaagaccaucagcgcgcacaagaccagcgugcagugcaucgccuuccaguacuccaccgugcugaccaagagcucccugaacaaggggugcagcaacaagcccacgaccgucaacaagcgguccgugaacgucaacgccgccagcggcggcgugcagaacuccgggaucgugcgcgaggcccccgcgaccagcaucgccaccguccucccgcagcccaugacguccgccaugggcaaggggaccguggccgugcaggagaaggccggccugccccggagcaucaacaccgacacccuguccaaggagacggacagcgggaagaaccaggacuucuccagcuucgacgacaccggcaaguccagccucggcgacauguucucccccauccgcgacgacgcggucgugaacaaggggagcgacgagagcaucggcaagggggacggcuucgacuuccugccgcagcugaacuccguguucccgccccggaagaaccccgucaccagcuccaccagcgugcuccacuccagcccccugaacguguucauggggucccccggcaaggaggagaacgagaaccgcgaccugacggccgagagcaagaagaucuacaugggcaagcaggaguccaaggacagcuucaagcagcucgccaagcuggucaccuccggggccgagagcggcaaccugaacaccucccccagcuccaaccagacccggaacagcgagaaguucgagaagcccgagaacgagaucgaggcccagcucaucugcgagccgcccaucaacggguccagcacgcccaaccccaagaucgcguccagcgugaccgccggcguggccagcucccugagcgagaagaucgccgacuccaucgggaacaaccgccagaacgccccgcugaccagcauccagauccgguucauccagaacaugauccaggagacccucgacgacuuccgcgaggcgugccaccgggacaucgucaaccuccagguggagaugaucaagcaguuccacaugcagcugaacgagaugcacucccugcuggagcgcuacagcgugaacgagggccuggucgccgagaucgagcggcugcgcgaggagaacaagcggcuccgcgcccacuucuga

SEQ ID NO: 33498 - RNA, 3960 nt, Artificial Sequence
  derived and/or modified sequence opt1 from NEDD4__Homo_sapiens__NP_001271267
auggcccagagccugcgccuccacuucgccgcgcggcgcuccaacaccuacccccugagcgagaccuccggcgacgaccuggacagccacgugcacaugugcuucaagcggccgacgcgcaucuccaccagcaacgucgugcagaugaagcucaccccccggcagaccgcccuggccccccugaucaaggagaacgugcagucccaggagcgcagcuccguccccagcuccgagaacgugaacaagaagagcuccugccuccagaucagccugcagccgacgcgguacuccggguaccugcagagcuccaacgugcucgccgacagcgacgacgccuccuucaccugcauccugaaggacggcaucuacagcagcgcggucguggacaacgagcugaacgccgugaacgacgggcaccucgucuccagccccgccaucugcuccggcagccuguccaacuucagcaccuccgacaacgggagcuacuccagcaacggcuccgacuucggcagcugcgccuccaucaccagcgggggcuccuacacgaacagcgugaucuccgacagcuccagcuacaccuucccccccagcgacgacaccuuccuggggggcaaccucccguccgacagcaccuccaaccgcagcgugcccaaccggaacacgacccccugcgagaucuucucccgcagcaccuccaccgaccccuucguccaggacgaccuggagcacgggcuggagaucaugaagcucccggugagccggaacacgaagaucccccugaagcgcuacuccagccuggugaucuucccccggucccccagcaccacccgcccgaccucccccacgagccucugcacccugcuguccaagggcagcuaccagaccucccaccaguucaucaucagccccagcgagaucgcgcacaacgaggacggcaccuccgccaagggguuccucagcacggccgucaacggccugcggcuguccaagaccaucugcacccccggggaggugcgcgacauccggccgcuccaccgcaagggcagccugcagaagaagaucgugcuguccaacaacaccccccggcagacggucugcgagaagagcuccgagggcuacagcugcguguccgugcacuucacccagcgcaaggccgccacccucgacugcgagaccacgaacggggacugcaagcccgagaugagcgagaucaagcugaacuccgacagcgaguacaucaagcugaugcaccggaccuccgcgugccuccccagcucccagaacgucgacugccagaucaacaucaacggcgagcuggagcgcccgcacagccagaugaacaagaaccacgggauccugcgccgguccaucagccucggcggggccuaccccaacaucuccugccugagcagccugaagcacaacugcuccaagggcggccccagccagcuccugaucaaguucgccuccgggaacgagggcaagguggacaaccugagccgcgacuccaaccgggacugcaccaacgagcucagcaacuccugcaagacccgcgacgacuuccuggggcagguggacgucccccuguacccgcuccccacggagaacccccggcuggagcgcccguacaccuucaaggacuucgugcugcacccccggagccacaagucccgcgucaagggcuaccuccggcugaagaugaccuaccugcccaagaccagcggguccgaggacgacaacgccgagcaggccgaggagcuggagcccggcuggguggugcucgaccagccggacgcggccugccaccugcagcagcagcaggagcccagcccccugcccccgggcugggaggagcgccaggacauccucgggcggaccuacuacgucaaccacgagucccgccggacgcaguggaagcgccccaccccccaggacaaccugaccgacgccgagaacggcaacauccagcugcaggcccagcgggccuucaccacgcgccggcagaucagcgaggagaccgaguccguggacaaccgcgagagcuccgagaacugggagaucauccgggaggacgaggcgaccauguacagcaaccaggccuuccccuccccgccccccagcagcaaccucgacgugcccacccaccuggccgaggagcugaacgcccgccucacgaucuucgggaacuccgccgucagccagccggcguccagcuccaaccacagcucccgccggggcagccugcaggccuacaccuucgaggagcagcccacccugcccgugcuccugcccaccuccagcgggcugccgcccggcugggaggagaagcaggacgagcgcggccgguccuacuacguggaccacaacagccgcacgaccaccuggaccaagcccacgguccaggccaccguggagaccucccagcucaccagcucccagagcuccgccgggccccagagccaggcguccacgagcgacagcggccagcaggugacccagccguccgagaucgagcagggguuccugcccaagggcugggagguccggcacgcccccaacggccgcccguucuucaucgaccacaacaccaagaccacgaccugggaggacccccggcugaagauccccgcccaccuccgcgggaagaccagccuggacaccuccaacgaccugggcccccucccgcccgggugggaggagcggacgcacaccgacggccgcaucuucuacaucaaccacaacaucaagcggacccagugggaggacccccgccuggagaacguggccaucaccgggcccgccgugccguacagccgggacuacaagcgcaaguacgaguucuuccggcgcaagcugaagaagcagaacgacauccccaacaaguucgagaugaagcuccggcgcgcgacgguccuggaggacuccuaccggcgcaucaugggcgugaagcgggccgacuuccugaaggcccgccucuggaucgaguucgacggcgagaaggggcuggacuacggcgggguggcccgcgagugguucuuccugaucagcaaggagauguucaaccccuacuacggccucuucgaguacuccgccaccgacaacuacacccugcagaucaaccccaacagcgggcugugcaacgaggaccaccucuccuacuucaaguucaucggccgggucgcgggcauggccguguaccacgggaagcugcuggacggcuucuucauccgcccguucuacaagaugaugcuccacaagcccaucacccugcacgacauggagagcguggacuccgaguacuacaacagccugcgguggauccucgagaacgaccccacggagcuggaccugcgcuucaucaucgacgaggagcucuucgggcagacccaccagcacgagcugaagaacggcggguccgagaucgucgugaccaacaagaacaagaaggaguacaucuaccuggugauccaguggcgguucgucaaccgcauccagaagcagauggccgccuucaaggagggcuucuucgagcucaucccccaggaccugaucaagaucuucgacgagaacgagcuggagcuccugaugugcggccugggggacguggacgugaacgacuggcgggagcacaccaaguacaagaacggcuacagcgccaaccaccaggucauccagugguucuggaaggcggugcucaugauggacuccgagaagcgcauccggcugcugcaguucgugaccgggacgagccgcgucccgaugaacggcuucgccgagcucuacggguccaacggcccccagagcuucaccguggagcaguggggcacccccgagaagcugccccgggcccacaccugcuucaaccgccuggaccucccgcccuacgaguccuucgaggagcugugggacaagcugcagauggccaucgagaacacgcagggguucgacggcguggacuga

SEQ ID NO: 33499 - RNA, 2928 nt, Artificial Sequence
  derived and/or modified sequence opt1 from NEDD4L__Homo_sapiens__NP_001138439
auggccaccggccugggggagcccguguacggccucagcgaggacgagggggagucccgcauccugcgggucaagguggugagcggcaucgaccuggccaagaaggacaucuucggggcguccgacccguacgucaagcucagccuguacguggccgacgagaaccgcgagcuggcccucgugcagaccaagacgaucaagaagacccugaaccccaaguggaacgaggaguucuacuuccgggucaaccccuccaaccaccgccuccucuucgagguguucgacgagaaccggcugacccgcgacgacuuccugggccagguggacgucccccucagccaccuccccaccgaggaccccacgauggagcggcccuacaccuucaaggacuuccugcuccgcccccggucccacaagagccgcgugaagggcuuccugcggcugaagauggccuacaugccgaagaacgggggccaggacgaggagaacuccgaccagcgcgacgacauggagcacgggugggagguggucgacagcaacgacuccgccagccagcaccaggaggagcucccgcccccgccccugccgcccggcugggaggagaagguggacaaccuggggcggaccuacuacgugaaccacaacaaccgcaccacgcaguggcaccggcccucccucauggacgucagcuccgagagcgacaacaacauccgccagaucaaccaggaggcggcccaccggcgcuuccggucccgccggcacaucagcgaggaccuggagcccgagcccuccgagggcggcgacgugcccgagcccugggagaccaucagcgaggaggugaacaucgccggggacagccugggccucgcccugcccccgccgcccgcgucccccgggagccgcaccagcccccaggagcuguccgaggagcucucccgccggcugcagaucacccccgacagcaacggcgagcaguucuccagccugauccagcgcgagcccuccagccggcugcgcuccugcagcgucaccgacgccguggccgagcagggccaccucccgccgcccuccgcccccgccgggcgggcgcgcagcuccaccgugaccggcggggaggagcccacccccagcgucgccuacgugcacacgacccccggccugccguccgggugggaggagcggaaggacgccaagggccgcaccuacuacgugaaccacaacaaccggaccacgaccuggacccgccccaucaugcagcuggccgaggacggcgccagcggguccgcgaccaacagcaacaaccaccugaucgagccccagauccggcgcccccggagccuguccagcccgacggucacccuguccgcgccccuggagggcgccaaggacagccccgugcgccgggccgucaaggacacccuguccaacccccagagcccgcagcccucccccuacaacagccccaagccgcagcacaaggugacccaguccuuccucccgcccgggugggagaugcgcaucgcccccaacggccggcccuucuucaucgaccacaacacgaagaccaccaccugggaggacccccgccugaaguuccccgugcacaugcggagcaagacgucccugaaccccaacgaccucgggccgcugccgcccggcugggaggagcgcauccaccuggacggccgcaccuucuacaucgaccacaacagcaagaucacccagugggaggacccccggcuccagaaccccgccaucaccgggcccgccguccccuacucccgcgaguucaagcagaaguacgacuacuuccggaagaagcugaagaagccggccgacauccccaaccgcuucgagaugaagcugcaccggaacaacaucuucgaggagagcuaccgccggaucauguccgugaagcgccccgacgugcucaaggcccggcuguggaucgaguucgagagcgagaagggccuggacuacgggggcgucgcccgcgagugguucuuccugcucuccaaggagauguucaaccccuacuacgggcuguucgaguacagcgcgacggacaacuacacccugcagaucaacccgaacagcggccucugcaacgaggaccaccuguccuacuucaccuucaucggccggguggccgggcuggccguguuccacggcaagcuccuggacggguucuucauccgccccuucuacaagaugaugcugggcaagcagaucacccucaacgacauggagagcgucgacuccgaguacuacaacagccugaaguggauccuggagaacgaccccaccgagcucgaccugauguucugcaucgacgaggagaacuucggccagacguaccagguggaccugaagcccaacggguccgagaucauggugaccaacgagaacaagcgggaguacaucgaccucgucauccaguggcgcuucgugaaccgggugcagaagcagaugaacgccuuccuggagggcuucaccgagcugcucccgaucgaccugaucaagaucuucgacgagaacgagcuggagcuccugaugugcgggcugggcgacgucgacgugaacgacuggcgccagcacagcaucuacaagaacggguacugccccaaccaccccgugauccagugguucuggaaggcgguccuccugauggacgccgagaagcggauccgccugcuccaguucgugaccggcacgucccgggugcccaugaacggcuucgccgagcuguacgggagcaacggcccgcagcuguucaccaucgagcagugggggucccccgagaagcucccccgcgcccacacgugcuucaaccggcuggaccugcccccguacgagaccuucgaggaccuccgcgagaagcugcugauggccgucgagaacgcgcagggcuucgaggggguggacuga

SEQ ID NO: 33500 - RNA, 246 nt, Artificial Sequence
  derived and/or modified sequence opt1 from NEDD8__Homo_sapiens__NP_006147
augcugaucaaggugaagacccucaccggcaaggagaucgagaucgacaucgagcccacggacaaggucgagcgcaucaaggagcggguggaggagaaggaggggaucccgccccagcagcagcgccugaucuacagcggcaagcagaugaacgacgagaagaccgccgccgacuacaagauccucgggggcuccgugcugcaccugguccuggcgcuccgcgggggcggcgggcugcggcaguga

SEQ ID NO: 33501 - RNA, 2505 nt, Artificial Sequence
  derived and/or modified sequence opt1 from NEDD9__Homo_sapiens__NP_001135865
auguggacccgcaaccugauggcccgggcccucuacgacaacgugcccgagugcgcggaggagcuggccuuccgcaagggcgacauccugaccgucaucgagcagaacaccgggggccucgaggggugguggcugugcagccugcacggccggcaggggaucgugccgggcaaccgcgugaagcuccugaucggccccaugcaggagacggccuccagccacgagcagcccgccuccgggcugaugcagcagaccuucggccagcagaagcucuaccagguccccaacccgcaggccgcgccccgggacaccaucuaccaggugccgcccagcuaccagaaccaggggaucuaccaggugcccacgggccacgggacccaggagcaggaggucuaccaggugccgcccuccgugcagcgcagcaucggcggcaccuccgggccccacgucggcaagaaggugaucacccccgugcggacggggcacggcuacgucuacgaguaccccagccgcuaccagaaggacguguacgacaucccgcccucccacaccacccagggcguguacgacaucccgcccagcuccgccaaggggcccgucuucagcgugcccgugggcgagaucaagccccagggggucuacgacaucccgcccaccaagggcguguacgccaucccgcccuccgccugccgggacgaggcggggcugcgcgagaaggacuacgacuucccgccgcccaugcggcaggccggccgccccgaccugcggcccgagggcguguacgacaucccgcccacgugcaccaagcccgccgggaaggaccuccacgucaaguacaacugcgacauccccggcgccgccgagcccguggcgcgccggcaccagagccugucccccaaccacccgccgccccagcuggggcagagcgugggcucccagaacgacgccuacgacgucccccgcggggugcaguuccucgagccgcccgccgagaccagcgagaaggccaacccccaggagcgggacggcgucuacgacgugccccugcacaacccgcccgacgccaagggcucccgcgaccugguggacgggaucaaccggcucagcuucagcuccaccggcagcacgcgcuccaacaugagcaccuccagcaccuccagcaaggaguccagccuguccgcgagccccgcccaggacaagcggcuguuccucgaccccgacaccgccaucgagcgccugcagcgccugcagcaggcccucgagaugggggucuccagccugauggcccuggugacgaccgacuggcggugcuacggcuacauggagcgccacaucaacgagauccggaccgcgguggacaaggucgagcuguuccugaaggaguaccugcacuucgugaagggggccguggccaacgccgccugccuccccgagcugauccugcacaacaagaugaagcgcgagcuccagcgggucgaggacucccaccagauccugagccagaccucccacgaccugaacgagugcagcuggucccucaacauccuggcgaucaacaagccccagaacaagugcgacgaccuggaccgcuucgugaugguggccaagacgguccccgacgacgccaagcagcucaccaccaccaucaacacgaacgccgaggcgcuguuccggcccggccccggcagccugcaccucaagaacgggcccgagagcaucaugaacuccaccgaguacccccacggcgggagccagggccagcugcugcaccccggcgaccacaaggcccaggcccacaacaaggcccucccgcccgggcuguccaaggagcaggcccccgacugcagcuccagcgacggcuccgagcgcagcuggauggacgacuacgacuacgugcaccuccaggggaaggaggaguucgagcggcagcagaaggagcuccuggagaaggagaacaucaugaagcagaacaagaugcagcuggagcaccaccagcugucccaguuccagcuccuggagcaggagaucaccaagcccguggagaacgacaucagcaaguggaagcccucccagagccugcccaccacgaacuccggcgucagcgcgcaggaccgccagcuccugugcuucuacuacgaccagugcgagacccacuucaucucccugcucaacgccaucgacgcccuguucagcugcguguccagcgcccagccgccccggaucuucguggcccacagcaaguucgucauccuguccgcgcacaagcucguguucaucggggacacccugacccgccaggugacggcccaggacauccggaacaaggucaugaacagcuccaaccagcugugcgagcagcucaagaccaucgugauggccaccaagauggccgcccugcacuaccccagcaccaccgcgcugcaggagauggugcaccaggucacggaccucucccgcaacgcccagcuguucaagcggagccugcucgagauggccaccuucuga

SEQ ID NO: 33502 - RNA, 3063 nt, Artificial Sequence
  derived and/or modified sequence opt1 from NEFH__Homo_sapiens__NP_066554
augaugagcuucggcggggccgacgcccugcucggcgcgcccuucgcgccccugcacgggggcgggucccugcacuacgcccucgcccgcaagggcggcgccgggggcacccggagcgccgccggguccagcuccggcuuccacagcuggacccgcacguccgugagcuccgucagcgccucccccagccgguuccgcggggccggcgcggccuccagcaccgacucccuggacacccugagcaacggccccgaggggugcaugguggccguggccaccucccggagcgagaaggagcagcuccaggcccugaacgaccgcuucgcgggcuacaucgacaagguccggcagcuggaggcccacaaccgcucccucgagggggaggccgccgcccugcggcagcagcaggcgggccgcagcgccaugggcgagcuguacgagcgggaggugcgcgagaugcgcggggccgugcuccggcugggcgccgcccgggggcagcugcgccucgagcaggagcaccuccuggaggacaucgcgcacguccggcagcgccucgacgacgaggcccggcagcgcgaggaggccgaggccgccgcgcgggcccuggcccgcuucgcccaggaggcggaggccgcccgcguggaccugcagaagaaggcccaggcccuccaggaggagugcggcuaccugcggcgccaccaccaggaggaggugggggagcugcucggccagauccagggcagcggggcggcccaggcccagaugcaggccgagacgcgggacgcccugaagugcgacgucaccuccgcgcugcgcgagauccgggcccagcucgagggccacgccgugcagagcacccugcaguccgaggagugguuccgcgugcggcuggaccgccucagcgaggccgccaaggucaacaccgacgcgaugcgguccgcccaggaggagaucacggaguaccgccggcagcugcaggcccgcaccaccgagcuggaggcccucaagagcaccaaggacucccuggagcggcagcgcagcgagcuggaggaccggcaccaggcggacaucgccuccuaccaggaggccauccagcagcuggacgccgagcugcgcaacacgaagugggagauggccgcgcagcugcgggaguaccaggaccuccugaacgugaagauggcccuggacaucgagaucgccgccuaccgcaagcuccuggagggggaggagugccggaucggcuucgggcccaucccguucagccugcccgagggccuccccaagauccccuccgugagcacccacaucaaggucaaguccgaggagaagaucaaggugguggagaaguccgagaaggagaccgucaucguggaggagcagaccgaggagacccaggugacggaggaggucaccgaggaggaggagaaggaggccaaggaggaggagggcaaggaggaggagggcggggaggaggaggaggcggagggcggggaggaggagaccaagagcccgcccgccgaggaggccgccagccccgagaaggaggccaagucccccgugaaggaggaggccaagagcccggcggaggccaagucccccgagaaggaggaggccaagagccccgcggaggucaagagccccgagaaggccaaguccccggccaaggaggaggccaagagcccgcccgaggccaagucccccgagaaggaggaggccaagagccccgcggaggugaagucccccgagaaggccaagagccccgccaaggaggaggccaagucccccgcggaggccaagagcccggagaaggccaagucccccgugaaggaggaggccaagagccccgccgaggcgaagucccccgucaaggaggaggccaagagcccggccgaggugaagucccccgagaaggccaagagccccacgaaggaggaggccaaguccccggagaaggccaagagccccgagaaggaggaggcgaagucccccgagaaggccaagagccccgugaaggccgaggccaagagcccggagaaggcgaagucccccgucaaggccgaggccaagagccccgagaaggccaagucccccgugaaggaggaggccaagagcccggagaaggcgaagucccccgugaaggaggaggccaagagccccgagaaggccaagucccccgucaaggaggaggccaagaccccggagaaggccaagagccccgugaaggaggaggcgaagucccccgagaaggccaagagccccgagaaggccaagacccuggacgugaaguccccggaggccaagacccccgcgaaggaggaggcccgcagccccgccgacaaguuccccgagaaggccaaguccccggucaaggaggaggugaagucccccgagaaggccaagagcccccugaaggaggacgcgaaggcccccgagaaggagaucccgaagaaggaggaggucaagagccccgugaaggaggaggagaagccccaggaggugaaggugaaggagccgcccaagaaggccgaggaggagaaggcccccgcgacgcccaagaccgaggagaagaaggacuccaagaaggaggaggccccgaagaaggaggcccccaagcccaaggucgaggagaagaaggagcccgccguggagaagccgaaggagagcaagguggaggccaagaaggaggaggcggaggacaagaagaagguccccacccccgagaaggaggcccccgccaagguggaggugaaggaggacgccaagccgaaggagaagaccgaggucgccaagaaggagcccgacgacgcgaaggccaaggagcccuccaagcccgccgagaagaaggaggccgcgccggagaagaaggacacgaaggaggagaaggccaagaagcccgaggagaagcccaagaccgaggccaaggccaaggaggacgacaagacccucagcaaggagcccagcaagccgaaggccgagaaggcggagaaguccagcuccaccgaccagaaggacagcaagccgcccgagaaggccacggaggacaaggccgccaaggggaaguga

SEQ ID NO: 33503 - RNA, 1623 nt, Artificial Sequence
  derived and/or modified sequence opt1 from NEFM__Homo_sapiens__NP_001099011
auggcccgccaccuccgggaguaccaggaccugcugaacgugaagauggcccuggacaucgagaucgcggccuaccgcaagcuccuggagggcgaggagacccgguucagcaccuucgccggguccaucacgggcccccuguacacccaccgcccgcccaucaccaucagcuccaagauccagaagcccaaggucgaggcccccaagcucaaggugcagcacaaguucguggaggagaucaucgaggagaccaaggucgaggacgagaaguccgagauggaggaggcccugacggcgaucaccgaggagcuggccgugagcaugaaggaggagaagaaggaggccgccgaggagaaggaggaggagccggaggcggaggaggaggagguggccgccaagaagucccccgucaaggccaccgcccccgaggugaaggaggaggagggggagaaggaggaggaggagggccaggaggaggaggaggaggaggacgagggggccaagagcgaccaggcggaggagggcggcagcgagaaggagggguccagcgagaaggaggagggcgagcaggaggagggggagaccgaggccgaggccgagggcgaggaggccgaggcgaaggaggagaagaagguggaggagaaguccgaggaggucgccacgaaggaggagcucguggccgacgccaagguggagaagcccgagaaggccaagagcccgguccccaagucccccguggaggagaagggcaagagccccgugccgaagucccccgucgaggagaaggggaagucccccgugcccaagagcccgguggaggagaagggcaagagccccguccccaagucccccguggaggagaagggcaagagcccggugagcaagucccccgucgaggagaaggcgaagucccccgugcccaagagcccgguggaggaggccaagagcaaggccgaggucgggaagggggagcagaaggaggaggaggagaaggaggugaaggaggcccccaaggaggagaaggucgagaagaaggaggagaagcccaaggacgugcccgagaagaagaaggccgaguccccggugaaggaggaggcggucgccgagguggugaccaucaccaagagcgucaaggugcaccuggagaaggagaccaaggaggagggcaagccccugcagcaggagaaggagaaggagaaggccggcggggagggcggguccgaggaggagggcagcgacaagggggccaagggcucccggaaggaggacaucgcggugaacggcgaggucgaggggaaggaggagguggagcaggagacgaaggagaagggcagcgggcgcgaggaggagaagggcguggucaccaacgggcucgaccugucccccgccgacgagaagaagggcggcgacaagagcgaggagaaggugguggucaccaagaccguggagaagaucacguccgagggcggggacggggccaccaaguacaucaccaagagcgugaccgucacgcagaagguggaggagcacgaggagaccuucgaggagaagcugguguccaccaagaaggucgagaaggugaccagccacgccaucgugaaggaggucacgcaguccgacuga

SEQ ID NO: 33504 - RNA, 1431 nt, Artificial Sequence
  derived and/or modified sequence opt1 from NEIL1__Homo_sapiens__NP_001243481
augggccgcaccgggccccgggccccgcugcuccccaagacccgcaucuggagccugacguucucccggaagaccagccccgugggcgcccgccccggggcggccccgcggugcggcgggggcaagguccgcgccuccgccguggccaagugcccccugccccucaaggcgcaccuccggcugcgcuuccggaccgcccgcggccagcgccagguggccaagcagggcgggcggcggacccugcccccgagccugcgcaugcccgaggggcccgagcugcaccucgccucccaguucgucaacgaggcgugccgggcccugguguucggcgggugcguggagaaguccuccgucagccgcaaccccgaggugccguucgaguccagcgccuaccggaucuccgccagcgcccgcggcaaggagcugcggcucauccugagcccccugcccggcgcgcagccccagcaggagccgcucgcccugguguuccgcuucgggaugagcggcuccuuccagcuggucccccgggaggagcucccccgccacgcccaccuccgcuucuacacggcgcccccggggccccggcuggcccugugcuucguggacauccgccgguucggccgcugggaccugggcgggaaguggcagcccggccgggggcccugcgugcugcaggaguaccagcaguuccgcgagaacguccuccggaaccuggccgacaaggccuucgaccgcccgaucugcgaggcccugcucgaccagcgguucuucaacggcaucgggaacuaccugcgcgccgagauccuguaccggcucaagaucccgcccuucgagaaggcccgcagcgugcuggaggcgcugcagcagcaccggcccucccccgagcucacccugagccagaagauccgcaccaagcugcagaaccccgaccuccuggagcugugccacuccgugcccaaggaggucgugcagcucggcggcaagggguacggcagcgagagcggggaggaggacuucgccgccuuccgggccuggcugcgcugcuacggcaugccggggauguccagccugcaggaccggcacggccgcaccaucugguuccagggcgaccccgggccccucgcccccaagggccggaagucccgcaagaagaaguccaaggcgacgcagcugagcccggaggaccgcguggaggacgcccugccgcccagcaaggcccccucccggacccgccgggccaagcgcgaccuccccaagcggaccgcgacccagcgccccgaggggacgagccugcagcaggaccccgaggcccccaccgucccgaagaagggccggcgcaaggggcggcaggccgccuccggccacugccgcccccggaaggugaaggccgacauccccagccuggagcccgagggcaccuccgcgagcuga

SEQ ID NO: 33505 - RNA, 816 nt, Artificial Sequence
  derived and/or modified sequence opt1 from NEIL2__Homo_sapiens__NP_001129219
auggggcccccgggcagcucccccacccccgagcccccgcagaaggaggugcagaaggagggcgccgccgaccccaagcaggucggggagcccagcggccagaagacccuggacggguccagccgcuccgcggagcucgugccccagggcgaggacgacagcgaguaccuggagcgggacgccccggccggcgacgccgggcgcuggcugcggguguccuucggccucuucgggagcgucugggugaacgacuucucccgcgccaagaaggcgaacaagcggggcgacuggcgcgaccccagcccccggcuggugcugcacuucgggggcggcggguuccucgccuucuacaacugccagcuguccuggagcuccagccccgucgugacgccgaccugcgacauccuguccgagaaguuccaccgcggccaggcccucgaggcccuggggcaggcgcagcccgugugcuacacccugcucgaccagcgguacuucagcggccugggcaacaucaucaagaacgaggcccuguaccgcgccgggauccacccccucucccugggcagcguccuguccgccagccggcgcgaggugcucguggaccacgucguggaguucagcaccgccuggcugcaggggaaguuccagggccggccccagcacacccagguguaccagaaggagcagugcccggcggggcaccaggucaugaaggaggccuucggccccgaggacggccugcagcgccucacgugguggugcccccagugccagccccagcuguccgaggagccggagcagugccaguucagcuga

SEQ ID NO: 33506 - RNA, 1818 nt, Artificial Sequence
  derived and/or modified sequence opt1 from NEIL3__Homo_sapiens__NP_060718
augguggagggccccgggugcacccugaacggcgagaagauccgcgcccggguccucccggggcaggccgugaccggcgugcgcgggagcgcgcugcggucccugcagggccgcgcccuccggcuggccgccagcacggucguggugagcccccaggccgcggcccugaacaacgacagcucccagaacguccucagccuguucaacggcuacguguacuccgggguggagacccugggcaaggagcuguucauguacuucgggcccaaggcccuccgcauccacuucggcaugaagggguucaucaugaucaacccccuggaguacaaguacaagaacggcgccagcccgguccucgaggugcagcugaccaaggaccugaucugcuucuucgacuccagcguggagcuccggaacuccauggagagccagcagcgcauccggaugaugaaggagcuggacgucugcucccccgaguucagcuuccugcgcgcggaguccgaggugaagaagcagaagggccggaugcucggggacgugcugauggaccagaacguccugcccggcguggggaacaucaucaagaacgaggcccucuucgacagcggccugcaccccgccgugaaggucugccagcugaccgacgagcagauccaccaccucaugaagaugauccgcgacuucuccauccuguucuaccggugccgcaaggccggccuggcccucagcaagcacuacaagguguacaagcggccgaacugcgggcagugccacugccgcaucacggugugccgguucggcgacaacaaccgcaugaccuacuucugcccccacugccagaaggagaacccccagcacgucgacaucugcaagcugcccacccggaacaccaucaucuccuggacgagcagccgcguggaccacgugauggacuccgucgcgcggaaguccgaggagcacuggaccugcguggucugcacccugaucaacaagccguccagcaaggccugcgacgccugccucaccucccgccccaucgacagcgugcugaaguccgaggagaacagcacgguguucucccaccugaugaaguaccccugcaacaccuucgggaagccccacaccgaggucaagaucaaccgcaagaccgccuucggcacgaccacccucgugcugaccgacuucagcaacaaguccagcacgcuggagcggaagaccaagcagaaccagauccucgacgaggaguuccagaacuccccgcccgccagcgugugccugaacgacauccagcaccccuccaagaagaccaccaacgacaucacgcagcccagcuccaaggucaacaucagcccgaccaucuccagcgagagcaagcuguucucccccgcgcacaagaagcccaagaccgcccaguacagcucccccgagcucaagagcugcaacccgggguacuccaacagcgagcugcagaucaacaugaccgacggcccccgcacgcugaaccccgacagcccccggugcuccaagcacaaccgccucugcauccugcggguggugcgcaaggacggcgagaacaaggggcggcaguucuacgccugcccgcugccccgcgaggcccagugcggcuucuucgagugggccgaccucuccuuccccuucugcaaccacgggaagcggagcaccaugaagaccguccugaagaucggcccgaacaacgggaagaacuucuucgugugcccccugggcaaggagaagcagugcaacuucuuccagugggcggagaacggccccgggaucaagaucauccccggcugcuga

SEQ ID NO: 33507 - RNA, 1425 nt, Artificial Sequence
  derived and/or modified sequence opt1 from NEK10__Homo_sapiens__NP_001026911
auggugcccguccagccggccgagccgcccgaggugcugaaguccgagcccuacggcgagaaggccgacgugugggcggucgggugcauccucuaccagauggccacccugagcccgcccuucuacagcaccaacaugcugucccucgccacgaagaucguggaggccguguacgagcccguccccgagggcaucuacagcgagaaggugaccgacaccaucucccgcugccugacccccgacgccgaggcgcggcccgacaucguggaggucagcuccaugaucagcgacgugaugaugaaguaccuggacaaccucuccacgagccagcugucccuggagaagaagcucgagcgcgagcggcgccggacccagcgcuacuucauggaggccaaccggaacaccgugaccugccaccacgagcuggccguccugagccacgagacguucgagaaggccucccucagcuccagcuccagcggggcggccucccucaagagcgagcugagcgaguccgccgaccugccgcccgagggcuuccaggccagcuacgggaaggacgaggaccgcgccugcgacgagauccuguccgacgacaacuucaaccuggagaacgcggagaaggacaccuacagcgagguggacgacgagcucgacaucuccgacaacagcuccagcuccagcuccagcccccugaaggaguccaccuucaacauccugaagcggagcuucuccgccagcggcggcgagcgccagucccagacccgggacuucaccgggggcacggggagccgcccccggcccgcccuccugccccuggaccuccugcugaaggugccgccccacaugcuccgcgcccacaucaaggagaucgaggccgagcuggucaccggcuggcagucccacagccugcccgcggugauccuccggaaccugaaggaccacgccagcgccgggaucgccgugucccagcgcaagguccggcagaucagcgaccccauccagcagauccugauccagcuccacaagaucaucuacaucacccagcugccgcccgcccugcaccacaaccucaagcgccgggugaucgagcgcuucaagaagucccuguucagccagcaguccaaccccugcaaccucaagagcgagaucaagaagcugucccagggcagccccgagccgaucgagcccaacuucuucacggcggacuaccaccuccugcaccgguccagcggcgggaacucccugagccccaacgaccccaccggccugccgaccuccaucgagcuggaggaggggaucaccuacgagcagaugcagacggugaucgaggagguccucgaggagagcggcuacuacaacuucaccuccaaccgcuaccacagcuaccccuggggcaccaagaaccaccccaccaagcgcuga

SEQ ID NO: 33508 - RNA, 1800 nt, Artificial Sequence
  derived and/or modified sequence opt1 from NEK11__Homo_sapiens__NP_001139475
augcugaaguuccaggaggccgccaagugcgugagcggcuccaccgcgaucagcaccuaccccaagacgcucaucgcccgccgguacguccugcagcagaagcugggguccggcagcuucgggaccguguaccucguguccgacaagaaggccaagcgcggcgaggagcugaagguccugaaggagaucagcgugggggagcucaacccgaacgagaccgugcaggccaaccuggaggcccagcugcucuccaagcuggaccaccccgcgaucgucaaguuccacgccagcuucguggagcaggacaacuucugcaucaucaccgaguacugcgagggccgggaccuggacgacaagauccaggaguacaagcaggccggcaagaucuuccccgagaaccagaucaucgagugguucauccagcuccugcuggggguggacuacaugcacgagcgccggauccuccaccgcgaccugaaguccaagaacgucuuccugaagaacaaccuccugaagaucggcgacuucggggugagccggcugcucaugggcuccugcgaccuggccacgacccugaccgggacgccccacuacaugagcccggaggcgcucaagcaccagggcuacgacaccaaguccgacaucuggagccuggccugcauccuguacgagaugugcugcaugaaccacgccuucgccggcuccaacuuccucagcaucgugcugaagaucgucgagggggacacccccucccugcccgagcgcuaccccaaggagcucaacgccaucauggagagcaugcugaacaagaacccgucccugcggcccagcgcgaucgagauccucaagauccccuaccuggacgagcagcugcagaaccucaugugccgcuacagcgagaugacccuggaggacaagaaccuggacugccagaaggaggccgcccacaucaucaacgccaugcagaagcggauccaccuccagacccugcgcgcccuguccgaggugcagaagaugacgccccgggagcgcaugcggcuccgcaagcugcaggcggccgacgagaaggcccggaagcugaagaagaucguggaggagaaguacgaggagaacagcaagcgcaugcaggagcuccggucccgcaacuuccagcagcugagcgucgacgugcugcacgagaagacccaccucaagggcauggaggagaaggaggagcagccggaggggcggcuguccugcagcccccaggacgaggacgaggagcgcuggcagggccgcgaggaggaguccgacgagcccacccuggagaaccugcccgagagccagccgauccccuccauggaccuccacgagcuggagagcaucguggaggacgccaccuccgaccugggcuaccacgagauccccgaggacccccucgucgccgaggaguacuacgcggacgccuucgacagcuacugcgaggaguccgacgaggaggaggaggagaucgcccuggagcggccggagaaggagauccgcaacgaggggagccagcccgccuaccggacgaaccagcaggacuccgacaucgaggcccuggcgcgcugccucgagaacgugcugggcugcaccagccuggaccagcccugccgguccugggggcagaaguaccucaagcgcagcaucaucaccucccgggagcagggcauccgcaugcuggccaagcagcggagcgccagcguguggaagaaguggugccugaagcccgccaccguccucaaguggacguccagcugcacccugaaguccagcugcuga

SEQ ID NO: 33509 - RNA, 3861 nt, Artificial Sequence
  derived and/or modified sequence opt1 from NEK1__Homo_sapiens__NP_001186326
auggagaaguacgugcgccugcagaagaucggcgaggggagcuucggcaaggccauccucgucaaguccaccgaggacgggcggcaguacgugaucaaggagaucaacaucagccgcauguccagcaaggagcgggaggagucccgccgggagguggccguccuggcgaacaugaagcaccccaacaucgugcaguaccgcgagagcuucgaggagaacggcucccuguacaucgugauggacuacugcgagggcggggaccucuucaagcggaucaacgcccagaagggcguccuguuccaggaggaccagauccuggacugguucgugcagaucugccucgcccugaagcacgugcacgaccgcaagauccugcaccgggacaucaagagccagaacaucuuccucaccaaggacgggacgguccagcugggcgacuucgggaucgcccgcgugcugaacuccaccguggagcucgcccggaccugcaucggcaccccguacuaccugagccccgagaucugcgagaacaagcccuacaacaacaaguccgacaucugggcgcuggggugcguccucuacgagcugugcacgcugaagcacgccuucgaggccggcagcaugaagaaccucgugcugaagaucaucuccggcagcuucccgcccgugucccugcacuacagcuacgaccuccgcucccuggucagccagcuguucaagcggaacccccgcgaccggcccuccgugaacagcauccucgagaagggguucaucgccaagcgcaucgagaaguuccugagcccccagcugaucgcggaggaguucugccucaagaccuucuccaaguucggcagccagccgauccccgccaagcggcccgccuccgggcagaacagcaucuccgugaugcccgcccagaagaucaccaagccggccgcgaaguacggcaucccccuggccuacaagaaguacggcgacaagaagcugcacgagaagaagccccuccagaagcacaagcaggcccaccagacccccgagaagcgcgucaacacgggggaggagcggcgcaagaucagcgaggaggccgcccggaagcgccgccuggaguucaucgagaaggagaagaagcagaaggaccagaucaucucccugaugaaggcggagcagaugaagcggcaggagaaggagcgccucgagcggaucaaccgcgcccgggagcagggcuggcgcaacgugcugagcgccgggggcuccggggaggugaaggccccguuccugggcagcggcgggaccaucgcccccuccagcuucuccagccggggccaguacgagcacuaccacgcgaucuucgaccagaugcagcagcagcgcgccgaggacaacgaggccaaguggaagcgggagaucuacgggcgcggccuccccgagcgggggauccugcccggcguccgcccgggcuuccccuacggggccgccggccaccaccacuuccccgacgcggacgacauccggaagacccugaagcgccucaaggccguguccaagcaggccaacgccaaccggcagaaggggcagcuggcgguggagcgcgccaagcaggucgaggaguuccugcagcggaagcgcgaggccaugcagaacaaggcccgggccgagggccacauggggauccuccagaaccuggcggccauguacggcggccgccccagcuccagccgcgggggcaagccgcggaacaaggaggaggagguguaccuggcccgccuccggcagauccgccugcagaacuucaacgagcggcagcagaucaaggccaagcugcgcggggagaagaaggaggccaaccacuccgagggccaggagggcagcgaggaggcggacaugcggcgcaagaagaucgagagccucaaggcccacgccaacgcccgggccgcgguccugaaggagcagcuggagcgcaagcggaaggaggccuacgagcgcgagaagaaggugugggaggagcaccugguggccaagggggucaaguccagcgacguguccccgccccucggccagcacgagaccgggggcagccccuccaagcagcagaugcggagcgugaucuccgucacgagcgcccugaaggagguggggguggacuccagccugaccgacacccgcgagaccuccgaggagaugcagaagacgaacaacgcgaucagcuccaagcgggagauccuccgccggcugaacgagaaccugaaggcccaggaggacgagaagggcaagcagaaccucagcgacaccuucgagaucaacguccacgaggacgccaaggagcacgagaaggagaaguccgugagcuccgaccgcaagaagugggaggccggcgggcagcuggugaucccccuggacgagcucacccuggacaccagcuucagcacgaccgagcggcacaccgucggcgaggugaucaagcuggggcccaacggcagcccccgccgggccuggggcaaguccccgaccgacuccgugcucaagauccugggggaggcggagcugcagcuccagacggagcugcuggagaacaccaccauccgcagcgagaucucccccgagggcgagaaguacaagccccucaucaccggggagaagaagguccagugcaucagccacgagaucaaccccuccgccaucguggacagcccgguggagacgaagucccccgaguucagcgaggccagcccccagaugucccugaagcuggagggcaaccucgaggagcccgacgaccuggagaccgagauccugcaggagccguccgggaccaacaaggacgagagccuccccugcaccaucacggacgucuggaucuccgaggagaaggagaccaaggagacccagagcgccgaccgcaucaccauccaggagaacgagguguccgaggacggcgugagcuccacggucgaccagcugagcgacauccacaucgagcccgggaccaacgacagccagcacuccaagugcgacguggacaagagcgugcagcccgagccguucuuccacaaggucgugcacuccgagcaccugaaccucgugccccagguccagagcgugcagugcucccccgaggagagcuucgccuuccggucccacagccaccucccgcccaagaacaagaacaagaacucccugcucaucggccugagcaccggccuguucgacgcgaacaaccccaagaugcuccggaccugcucccugcccgaccugagcaagcuguuccgcacccugauggacgugcccacggucggggacgugcgccaggacaaccuggagaucgacgagaucgaggacgagaacaucaaggagggcccguccgacagcgaggacaucguguucgaggagaccgacaccgaccuccaggagcugcaggccuccauggagcagcugcuccgggagcagcccggggaggaguacagcgaggaggaggaguccguccugaagaacagcgacguggagcccaccgccaacggcacggacguggccgacgaggacgacaaccccuccagcgagagcgcccugaacgaggaguggcacuccgacaacagcgacggggagaucgcguccgagugcgagugcgacagcgucuucaaccaccucgaggagcugcgccugcaccucgagcaggagaugggcuucgagaaguucuucgagguguacgagaagaucaaggccauccacgaggacgaggacgagaacaucgagaucugcuccaagaucgugcagaacauccugggcaacgagcaccagcaccuguacgccaagauccuccaccuggucauggccgacggggcguaccaggaggacaacgacgaguga

SEQ ID NO: 33510 - RNA, 1155 nt, Artificial Sequence
  derived and/or modified sequence opt1 from NEK2__Homo_sapiens__NP_001191112
augcccagccgcgccgaggacuacgaggugcuguacaccaucggcaccggguccuacggccggugccagaagauccgccgcaagagcgacgggaagauccucgucuggaaggagcuggacuacggcuccaugacggaggccgagaagcagaugcuggugagcgaggugaaccuccugcgggagcugaagcacccgaacaucguccgguacuacgaccgcaucaucgaccggaccaacaccacccucuacaucgugauggaguacugcgagggcggggaccuggcguccgugaucacgaagggcaccaaggagcgccaguaccuggacgaggaguucguccuccgggugaugacccagcugacccuggcccucaaggagugccaccgccggagcgacgggggccacacggugcugcaccgcgaccugaagcccgccaacgucuuccucgacgggaagcagaacgugaagcugggcgacuucgggcuggcccggauccucaaccacgacaccuccuucgccaagaccuucgugggcacccccuacuacaugagccccgagcagaugaaccgcauguccuacaacgagaaguccgacaucuggagccugggcugccugcucuacgagcugugcgcgcugaugccgcccuucacggccuucagccagaaggagcucgccgggaagauccgggagggcaaguuccgccggauccccuaccgcuacuccgacgagcugaacgagaucaucacccggaugcugaaccucaaggacuaccaccgccccagcgucgaggagauccuggagaacccgcugaucgccgaccucguggcggacgagcagcggcgcaaccuggagcgccgggggcgccagcugggcgagcccgagaagucccaggacagcucccccgugcucagcgagcugaagcugaaggagauccagcuccaggagcgggagcgcgcccugaaggcccgggaggagcgccuggagcagaaggagcaggagcucugcguccgggagcgccuggccgaggacaagcuggcccgggcggagaaccuccugaagaacuacucccugcucaaggagcgcaaguuccugagccuggccagcaaccccggcaugcggaucaaccucgugaaccgcuccuggugcuacaaguga

SEQ ID NO: 33511 - RNA, 1521 nt, Artificial Sequence
  derived and/or modified sequence opt1 from NEK3__Homo_sapiens__NP_002489
auggacgacuacauggugcugcgcaugaucggcgaggggagcuucggccgggcccuccugguccagcacgaguccagcaaccagauguucgccaugaaggagauccgccugcccaaguccuucagcaacacccagaacucccggaaggaggcggugcuccuggccaagaugaagcacccgaacaucguggccuucaaggagagcuucgaggccgaggggcaccuguacaucgucauggaguacugcgacggcggggaccucaugcagaagaucaagcagcagaagggcaagcuguuccccgaggacaugauccugaacugguucacccagaugugccucggcgugaaccacauccacaagaagcgcgugcugcaccgggacaucaaguccaagaacaucuuccugacgcagaacgggaaggucaagcucggcgacuucgggagcgcccgccugcuguccaaccccauggcguucgccugcaccuacgugggcacccccuacuacgugccgcccgagaucugggagaaccuccccuacaacaacaagagcgacaucuggucccuggggugcauccuguacgagcucugcacccugaagcaccccuuccaggccaacagcuggaagaaccugauccucaaggucugccagggcugcaucuccccgcugcccagccacuacuccuacgagcugcaguuccucgugaagcagauguucaagcggaaccccagccaccgccccuccgccacgacccugcugagccggggcaucguggcgcgccucguccagaagugccugccgcccgagaucaucauggaguacggggaggaggugcuggaggagaucaagaacuccaagcacaacacgccccggaagaagaccaaccccagccgcauccggaucgcccucggcaacgaggccagcaccgugcaggaggaggagcaggaccgcaaggggucccacaccgaccuggagagcaucaacgagaaccuggucgaguccgcccuccggcgcgugaaccgggaggagaagggcaacaagagcgugcaccuccgcaaggccuccagcccgaaccugcaccggcgccagugggagaagaacguccccaacaccgcgcugaccgcccuggagaacgccuccauccugacgagcucccucaccgccgaggacgaccggggcgggagcgugaucaaguacuccaagaacaccacccgcaagcaguggcugaaggagacgcccgacacccugcucaacauccugaagaacgccgaccugagccucgcguuccagaccuacaccaucuaccgccccggcuccgagggguuccugaagggcccgcugagcgaggagacggaggccuccgacagcguggacgggggccacgacuccgucauccucgaccccgagcggcuggagcccggccuggacgaggaggacaccgacuucgaggaggaggacgacaaccccgacugggugagcgagcugaagaagcgcgccggguggcagggccucugcgaccgguga

SEQ ID NO: 33512 - RNA, 2259 nt, Artificial Sequence
  derived and/or modified sequence opt1 from NEK4__Homo_sapiens__NP_001180462
augccccuggccgccuacugcuaccuccgcguggucggcaaggggagcuacggcgaggugacccuggugaagcaccggcgcgacgggaagcaguaccugcacgagaagcacauccuccaccgggaccugaagacccagaacgucuuccugacgcgcaccaacaucaucaaggugggcgaccucgggaucgcgcgggugcuggagaaccacugcgacauggccuccacccugaucggcaccccguacuacaugagccccgagcuguucuccaacaagcccuacaacuacaagagcgacgucugggcccugggcugcugcguguacgagauggccacgcugaagcacgccuucaacgcgaaggacaugaacucccucguguaccgcaucaucgaggggaagcugcccccgaugccccgggacuacagccccgagcuggccgagcucauccgcaccaugcuguccaagcggcccgaggagcgcccgagcguccgguccauccugcgccagcccuacaucaagcggcagaucagcuucuuccucgaggccaccaagaucaagaccuccaagaacaacaucaagaacggcgacagccaguccaagcccuucgccacgguggugagcggggaggcggaguccaaccacgaggucauccacccccagccgcugagcuccgagggcagccagaccuacaucaugggggagggcaagugccugucccaggagaagccccgcgccagcggccuccucaagagccccgccucccugaaggcccacacgugcaagcaggaccucagcaacaccaccgagcuggccaccaucuccagcgugaacaucgacauccugcccgcgaaggggcgggacuccgugagcgacggcuucguccaggagaaccagccgcgcuaccucgacgccuccaacgagcucgggggcaucugcagcaucucccagguggaggaggagaugcugcaggacaacaccaagagcuccgcccagcccgagaaccugauccccauguggagcuccgacaucgugaccggcgagaagaacgagcccgucaagccgcugcagccccugaucaaggagcagaagcccaaggaccagagccucgcccugucccccaagcuggagugcagcgggacgauccucgcccacuccaaccugcggcugcucggcagcuccgacagcccggcgagcgccucccgcguggccgggaucaccggcgugugccaccacgcccaggaccaggucgccggggagugcaucaucgagaagcagggccggauccaccccgaccugcagccccacaacagcggcuccgagcccagccugucccgccagcggcgccagaagcgccgggagcagaccgagcaccgcggggagaagcgccaggugcggcgggaccucuucgcguuccaggagagcccgccccgcuuccugcccucccacccgaucgugggcaaggucgacgugaccagcacgcagaaggaggccgagaaccagcggcgcgucgugaccggguccgugagcuccagccgguccagcgagauguccagcuccaaggaccgcccccugagcgcccgggagcgccggcgccucaagcagagccaggaggagauguccagcuccggccccagcguccggaaggccucccugagcguggccgggcccggcaagccgcaggaggaggaccagccccugcccgcgcgccggcucuccagcgacugcuccgugacccaggagcgcaagcagauccacugccugagcgaggacgagcuguccagcuccaccagcuccacggacaagagcgacggcgacuacggggagggcaaggggcagaccaacgagaucaacgcccugguccagcucaugacccagacccugaagcuggacuccaaggagagcugcgaggacgugcccguggccaacccggucuccgaguucaagcuccaccggaaguaccgcgacacgcugauccugcacggcaagguggccgaggaggcggaggagauccacuucaaggagcuccccagcgccaucaugcccgggagcgagaagauccgccggcugguggagguccugcgcaccgacgugauccggggccucggcgugcagcugcuggagcaggucuacgaccuccuggaggaggaggacgaguucgaccgcgaggugcggcugcgcgagcacaugggggagaaguacaccaccuacuccgugaaggcccggcagcucaaguucuucgaggagaacaugaacuucuga

SEQ ID NO: 33513 - RNA, 1044 nt, Artificial Sequence
  derived and/or modified sequence opt1 from NEK6__Homo_sapiens__NP_001138473
augccccgccgggaggugugcugggaggccgcccacuuccgccaggaggagcagagccugccgcggccccgcguccgggcgcucgugcgccuggccugccggauggccggccagcccgggcacaugccccacggcggguccagcaacaaccugugccacacccucggcccggugcacccgcccgacccccagcgccaccccaacacccuguccuuccggugcagccuggccgacuuccagaucgagaagaagaucgggcgcggccaguucuccgaggucuacaaggccacgugccuccuggaccggaagaccguggcgcugaagaaggugcagaucuucgagaugauggacgccaaggcccgccaggacugcgucaaggagaucggccuccugaagcagcugaaccaccccaacaucaucaaguaccucgacagcuucaucgaggacaacgagcugaacaucgugcuggagcucgccgacgcgggggaccugucccagaugaucaaguacuucaagaagcagaagcggcugauccccgagcgcaccguguggaaguacuucguccagcucugcagcgccguggagcacaugcacucccggcgcgugaugcaccgggacaucaagcccgccaacgucuucaucaccgccacgggcguggugaagcugggggaccugggccucgggcgcuucuucagcuccgagaccaccgccgcgcacagccuggucggcaccccguacuacaugucccccgagcggauccacgagaacggcuacaacuucaagagcgacaucuggucccuggggugccuccuguacgagauggccgcccugcagagccccuucuacggcgacaagaugaaccucuucucccugugccagaagaucgagcagugcgacuacccgccccugcccggggagcacuacagcgagaagcuccgcgagcugguguccaugugcaucugccccgacccccaccagcggccggacaucggcuacgugcaccaggucgccaagcagaugcacaucuggaugagcagcacguga

SEQ ID NO: 33514 - RNA, 909 nt, Artificial Sequence
  derived and/or modified sequence opt1 from NEK7__Homo_sapiens__NP_598001
auggacgagcagagccagggcaugcaggggcccccggugccccaguuccagccccagaaggcccugcgccccgacaugggcuacaacacccucgccaacuuccggaucgagaagaagaucgggcgcggccaguucuccgaggucuaccgggcggccugccugcuggacggggugccgguggcccucaagaagguccagaucuucgaccugauggacgccaaggcccgcgcggacugcaucaaggagaucgaccugcucaagcagcugaaccaccccaacgugaucaaguacuacgccagcuucaucgaggacaacgagcugaacaucgugcucgagcuggccgacgccggcgaccugucccggaugaucaagcacuucaagaagcagaagcgccucauccccgagcggaccgucuggaaguacuucgugcagcugugcagcgcgcuggagcacaugcacucccgccgggugaugcaccgcgacaucaagcccgccaacgucuucaucacggccaccggcguggugaagcucggggaccugggccuggggcgguucuucagcuccaagaccaccgccgcccacagccucgucggcacgccguacuacaugucccccgagcgcauccacgagaacggguacaacuucaagagcgacaucuggucccugggcugccugcucuacgagauggcggcccugcagagccccuucuacggcgacaagaugaaccuguacucccucugcaagaagaucgagcagugcgacuacccgccccugcccagcgaccacuacuccgaggagcugcggcagcucgugaacaugugcaucaaccccgaccccgagaagcgcccggacgugaccuacgucuacgacguggccaagcggaugcacgccugcaccgccagcuccuga

SEQ ID NO: 33515 - RNA, 2079 nt, Artificial Sequence
  derived and/or modified sequence opt1 from NEK8__Homo_sapiens__NP_835464
auggagaaguacgagcgcauccggguggucggccgcggggccuucggcaucgugcaccugugccuccggaaggccgaccagaagcuggugaucaucaagcagauccccgucgagcagaugaccaaggaggagcgccaggcggcccagaacgagugccaggugcugaagcuccugaaccaccccaacgugaucgaguacuacgagaacuuccuggaggacaaggcccucaugaucgccauggaguacgcccccgggggcacccuggcggaguucauccagaagcggugcaacagccugcucgaggaggagacgauccugcacuucuucguccagauccugcucgcccugcaccacgugcacacccaccugauccuccaccgcgaccugaagacccagaacauccugcucgacaagcaccggaugguggucaagaucggggacuucggcaucuccaagauccugagcuccaagagcaaggccuacaccguggugggcacgcccugcuacaucucccccgagcugugcgaggggaagccguacaaccagaaguccgacaucugggcccucggcugcguccuguacgagcuggcgucccucaagcgcgccuucgaggccgccaaccugcccgcccuggugcucaagaucaugagcgggaccuucgcgcccaucuccgaccgguacagccccgagcugcgccagcuggugcucagccugcugagccucgagccggcccagcggccgccccugucccacaucauggcccagccccugugcauccgcgcccuccugaaccugcacaccgacgucggcagcgugcggaugcgccgggccgagaaguccguggcgcccagcaacaccgggucccgcacgaccagcguccggugccgcggcaucccccggggccccgugcgccccgccaucccgccgccccucuccagcguguacgccuggggcggcgggcuggggacgccccugcggcuccccaugcugaacaccgaggucguccagguggccgccggccgcacccagaaggcgggggugacccgcagcggccggcugauccucugggaggccccgccccugggggccggcgggggcucccugcuccccggcgccguggagcagccccagccccaguucaucagccgcuuccuggaggggcaguccggcgucaccaucaagcacguggccugcggggacuucuucaccgcgugccugacggaccggggcaucaucaugaccuucgggagcggcuccaacggcugccuggggcacggcagccucaccgacaucucccagcccaccaucguggaggcccugcugggguacgagaugguccagguggccugcggcgccagccacgugcucgcgcuguccacggagcgcgagcuguucgccugggggcggggcgacagcggccgccucgggcugggcacccgggagucccacagcugcccccagcaggucccgaugccgcccgggcaggaggcccagcgcguggugugcggcaucgacuccagcaugauccugaccguccccggccaggcccucgccugcggguccaaccgguucaacaagcugggccuggaccaccucagccugggggaggagcccgugccccaccagcaggucgaggaggcgcuguccuucacccuccugggcagcgcgccccuggaccaggagccgcuccuguccaucgaccuggggacggcccacagcgccgccgugaccgccagcggcgacugcuacaccuucggcuccaaccagcacgggcagcucggcaccaacacgcgccgggggagccgcgcccccugcaaggugcagggccuggaggggaucaagauggccaugguggccugcggcgacgccuucaccgucgcgaucggcgccgaguccgagguguacagcugggggaagggcgcccgggggcgccugggccggcgcgacgaggacgccgggcucccccggcccgugcagcuggacgagacccacccguacaccgucacguccgugagcugcugccacggcaacacccugcucgcggugcgcuccgucaccgacgagcccgugccgcccuga

SEQ ID NO: 33516 - RNA, 2940 nt, Artificial Sequence
  derived and/or modified sequence opt1 from NEK9__Homo_sapiens__NP_149107
augagcgugcugggcgaguacgagcgccacugcgacuccaucaacagcgacuucggguccgagagcggcgggugcggcgacuccagccccgggcccuccgccagccagggcccccgggccggcgggggcgcggccgagcaggaggagcuccacuacauccccauccgcguccuggggcggggcgccuucggggaggccacccuguaccgccggaccgaggacgacucccucgugguguggaaggaggucgaccugacgcgccugagcgagaaggagcggcgcgacgcccucaacgagaucgugauccuggcgcugcuccagcacgacaacaucaucgccuacuacaaccacuucauggacaacaccacccugcugaucgagcucgaguacugcaacggcggcaaccuguacgacaagauccugcggcagaaggacaagcuguucgaggaggagaugguggucugguaccuguuccagaucguguccgccgugagcugcauccacaaggccgggauccugcaccgcgacaucaagacccucaacaucuuccugacgaaggcgaaccugaucaagcucggcgacuacgggcuggccaagaagcugaacuccgaguacagcauggccgagacccucgucggcacccccuacuacauguccccggagcugugccagggcgugaaguacaacuucaagagcgacaucugggccguggggugcgucaucuucgagcugcucacccugaagcggacguucgacgccaccaacccccugaaccucugcgugaagaucgugcagggcauccgcgcgauggaggucgacuccagccaguacucccuggagcugauccagauggugcacagcugccucgaccaggaccccgagcagcggcccaccgccgacgagcugcuggaccgcccgcuccugcggaagcgccggcgcgagauggaggagaaggugacccugcucaacgcccccacgaagcggccccgcagcuccaccgugaccgaggcccccaucgccguggugaccagccggacguccgaggucuacguguggggcgggggcaagagcaccccgcagaagcucgacgugaucaaguccgggugcagcgcgcgccaggucugcgccggcaacacccacuucgccguggucaccguggagaaggagcuguacacgugggugaacaugcagggcgggaccaagcuccacgggcagcugggccacggggacaaggccuccuaccgccagcccaagcacgucgagaagcugcagggcaaggccauccgccaggugagcugcggcgacgacuucaccgugugcgucaccgacgaggggcagcucuacgcguucggcuccgacuacuacgggugcaugggcguggacaagguggccgggcccgagguccuggagcccaugcagcugaacuucuuccucagcaacccgguggagcaggucuccugcggcgacaaccacgugguggugcugacgcggaacaaggaggucuacagcuggggcugcggggaguacggccggcuggggcuggacuccgaggaggacuacuacacgccccagaagguggacgugcccaaggcccucaucaucgucgccgugcagugcggcugcgacggcaccuuccugcugacccagagcgggaaggugcucgccugcggccugaacgaguucaacaagcuggggcucaaccagugcauguccggcaucaucaaccacgaggcguaccacgagguccccuacaccaccagcuucacccuggccaagcagcuguccuucuacaagauccgcaccaucgccccggggaagacgcacaccgccgcgaucgacgagcggggccgccuccugaccuucggcugcaacaagugcgggcagcugggcguggggaacuacaagaagcggcucggcaucaaccugcucgggggcccccugggcgggaagcaggucauccgcgugagcugcggcgacgaguucaccaucgccgccacggacgacaaccacaucuucgccugggggaacggcgggaacggccggcuggccaugacccccaccgagcgcccccacggcuccgacaucugcaccagcuggccgcggcccaucuucgggagccugcaccacgugcccgaccucuccugccgcggcuggcacaccauccugaucguggagaagguccugaacagcaagacgauccgguccaacagcuccgggcucagcaucggcaccguguuccaguccagcucccccgggggcggcgggggcgggggcggcggggaggaggaggacagccagcaggaguccgagaccccggaccccagcggcggguuccgcggcaccauggaggcggaccgggggauggagggccugaucucccccacggaggccaugggcaacagcaacggggccuccagcuccugcccgggcuggcugcgcaaggagcucgagaacgccgaguucauccccaugcccgacagccccagcccgcuguccgccgcguucagcgaguccgagaaggacacccugcccuacgaggagcuccaggggcugaagguggccagcgaggcgccccuggagcacaagccccaggucgaggccuccagcccgcggcucaaccccgccgugaccugcgccggcaaggggaccccgcugacgccgcccgccugcgccugcuccagccugcaggucgagguggagcgccuccagggccuggugcugaagugccucgccgagcagcagaagcugcagcaggagaaccugcagaucuucacccagcuccagaagcugaacaagaagcuggagggcgggcagcaggucggcaugcacuccaaggggacccagaccgcgaaggaggagauggagauggaccccaagcccgaccucgacagcgacuccuggugccugcugggcacggacagcugccggcccucccucuga

SEQ ID NO: 33517 - RNA, 1620 nt, Artificial Sequence
  derived and/or modified sequence opt1 from NELFA__Homo_sapiens__NP_005654
augcccggccagcgccgggcccugagcccgaagauggccuccaugcgcgagagcgacaccgggcucuggcugcacaacaagcugggcgcgaccgacgagcucugggccccgcccuccaucgccagccugcugacggccgccgugaucgacaacauccggcucugcuuccacgggcuguccagcgcggucaagcugaagcuccugcugggcacccuccaccucccccgccggaccguggacgagaugaagggggcccugauggagaucauccagcucgccucccuggacagcgaccccugggugcugauggucgccgacauccucaaguccuuccccgacaccggcagccugaaccuggagcucgaggagcagaaccccaacgugcaggacauccugggcgagcugcgcgagaaggugggggagugcgaggcguccgccaugcucccccuggagugccaguaccugaacaagaacgcccucacgacccuggccggcccgcugaccccgcccgucaagcacuuccagcucaagcggaagcccaagagcgccacccugcgcgcggagcugcugcagaaguccacggagaccgcccagcagcugaagcggagcgccggggugcccuuccacgccaagggccgcgggcugcuccggaagauggacaccaccacgccccugaagggcauccccaagcaggcccccuuccgcuccccgaccgcgcccagcguguucucccccaccggcaaccggacccccaucccgcccagccgcacgcugcuccggaaggagcgcggggucaagcugcuggacaucuccgagcucgacauggugggcgccgggcgggaggccaagcgccggcgcaagacccuggacgccgagguggucgagaagcccgccaaggaggagaccgugguggagaacgcgacccccgacuacgccgccggccuggucagcacgcagaagcucggcagccugaacaacgagccggcccugcccuccaccagcuaccuccccuccacccccagcguggugccggccuccagcuacauccccuccagcgagacgcccccggcgcccuccagccgggaggccucccgcccgcccgaggagcccagcgcccccucccccacccugcccgcccaguucaagcagcgcgcgccgauguacaacagcgggcugucccccgccacccccacccccgccgccccgaccagcccccugacgcccaccacgcccccggccgucgcgcccaccacccagaccccgcccguggccaugguggcgccccagacccaggcccccgcccagcagcagcccaagaagaaccucucccugacccgggagcagauguucgccgcccaggagauguucaagacggccaacaaggucacccgccccgagaaggcccugauccucggcuucauggccgggagccgggagaacccgugccaggagcagggcgacgugauccagaucaagcuguccgagcacaccgaggaccugcccaaggcggacgggcagggcagcaccaccaugcucguggacacggucuucgagaugaacuacgccaccggccaguggacccgcuucaagaaguacaagcccaugaccaacgugagcuga

SEQ ID NO: 33518 - RNA, 1887 nt, Artificial Sequence
  derived and/or modified sequence opt1 from NELFB__Homo_sapiens__NP_056271
auggccgagcuggagggcgccggggagcgcggcagcgggggcccccgggggccggccgagcgcgccuccggcgugagcgccgccgcccccggcgagcgggcgggggacggcgcccccucccgcgccgucgccggggcgagcgccauguucgccggccuccaggaccuggggguggccaacggcgaggaccugaaggagacccucaccaacugcacggagccccugaaggccaucgagcaguuccagaccgagaacggcgugcugcucccgucccugcagagcgcgcugcccuuccucgaccugcacgggacgccccggcuggaguuccaccaguccgucuucgacgagcuccgcgacaagcugcuggagcgggugagcgccaucgccuccgagggcaaggccgaggagcgcuacaagaagcucgaggaccugcuggagaaguccuucucccucgugaagaugcccagccugcagccggucgugaugugcgugaugaagcaccuccccaagguccccgagaagaagcugaagcuggugauggccgacaaggagcuguaccgggcgugcgccguggaggucaagcgccagaucuggcaggacaaccaggcccucuucggggacgaggugagcccccugcugaagcaguacauccucgagaaggagagcgcccuguucuccaccgagcugagcgugcuccacaacuucuucuccccgagccccaagacccggcgccagggcgaggucgugcagcggcugacccgcauggugggcaagaacgucaagcuguacgacauggugcuccaguuccugcggacccuguuccuccgcacccggaacgugcacuacugcacgcugcgcgccgagcugcucaugucccugcacgaccuggacgucggggagaucugcaccguggaccccugccacaaguucaccuggugccucgacgcgugcauccgggagcgcuucguggacagcaagcgggcccgcgagcugcagggcuuccuggacggggucaagaagggccaggagcagguccucggggaccugagcaugauccugugcgaccccuucgccaucaacacccucgcccuguccacggugcgccaccuccaggagcuggugggccaggagacccugccgcgggacagccccgaccugcugcuccugcugcgccuccuggcccugggccagggggcgugggacaugaucgacucccagguguucaaggagcccaagauggaggucgagcucaucacccgguuccugcccaugcugaugagcuuccucguggacgacuacaccuucaacguggaccagaagcugccggccgaggagaaggcccccgucuccuaccccaacacgcugcccgagagcuucaccaaguuccuccaggagcagcgcauggccugcgaggugggccuguacuacgugcugcacaucaccaagcagcggaacaagaacgcgcuccugcgccugcucccggggcuggucgagaccuucggcgaccuggccuucggggacaucuuccuccaccuccugacgggcaaccuggcccugcuggccgacgaguucgcccucgaggacuucugcuccagccuguucgacggcuucuuccugaccgcgagcccccggaaggagaacgugcaccgccacgcccuccggcugcugauccaccuccacccccgcguggcccccuccaagcuggaggcccugcagaaggcccucgagccgaccgggcaguccggcgaggcggucaaggagcuguacagccagcugggggagaagcucgagcagcuggaccaccggaagcccucccccgcccaggccgccgagaccccggcccuggagcucccccugcccagcgugcccgcgccggcgccccuguga

SEQ ID NO: 33519 - RNA, 1800 nt, Artificial Sequence
  derived and/or modified sequence opt1 from NELFCD__Homo_sapiens__NP_945327
augcgccgggcccgcagccgggagggcauggccggggccgugcccggcgccaucauggacgaggacuacuacggguccgccgccgaguggggcgacgaggccgacgggggccagcaggaggacgacagcggcgagggggaggacgacgcggagguccagcaggagugccugcacaaguucuccacccgcgacuacaucauggagccgagcaucuucaacacccucaagcgguacuuccaggccggcgggucccccgagaacgugauccagcugcugagcgagaacuacacggccguggcccagaccgucaaccuccuggcggaguggcugauccagaccggcguggagcccgugcagguccaggagaccguggagaaccaccucaagucccugcugaucaagcacuucgacccccgcaaggccgacagcaucuucacggaggagggggagaccccggccuggcucgagcagaugaucgcccacaccaccuggcgggaccuguucuacaagcuggccgaggcgcaccccgacugccucaugcugaacuucacggugaagcugaucuccgacgccggcuaccagggcgagaucaccagcgucuccaccgccugccagcagcucgagguguucagccgcgugcugcggaccucccuggccacgauccucgacgggggcgaggagaaccuggagaagaaccugcccgaguucgccaagauggucugccacggggagcacaccuaccucuucgcgcaggccaugaugagcgugcuggcccaggaggagcagggcggcuccgccgugcgccggaucgcccaggagguccagcgcuucgcgcaggagaaggggcacgacgccagccagaucacccuggcccucggcaccgccgccuccuacccccgggcgugccaggcccugggggccaugcugagcaagggcgcccucaacccggcggacaucacggugcuguucaagauguucaccuccauggacccgccgcccguggagcugauccgcguccccgccuuccucgaccuguucaugcagagccuguucaagcccggggcccggaucaaccaggaccacaagcacaaguacauccacauccucgccuacgccgcgagcgugguggagaccuggaagaagaacaagcgcgucuccaucaacaaggacgagcucaagagcaccuccaaggccguggagacggugcacaaccugugcugcaacgagaacaagggcgccagcgagcuggucgccgagcuguccacccuguaccagugcauccgguuccccguggucgccaugggcgugcucaaguggguggacuggaccgucagcgagccccgcuacuuccagcugcagaccgaccacacgcccgugcaccuggcgcuccuggacgagaucuccacgugccaccagcugcuccacccccaggugcugcagcugcucgucaagcuguucgagaccgagcacagccagcuggacgugauggagcagcuggagcucaagaagacccugcuggaccggauggugcaccuccugucccgcggguacguccugcccguggugagcuacauccggaagugccucgagaagcuggacaccgacaucucccugauccgcuacuucgucaccgaggugcucgacgugaucgcgcccccguacaccagcgacuucguccagcuguuccugcccauccucgagaacgacuccaucgccggcaccaucaagacggagggggagcacgaccccgugaccgaguucaucgcccacugcaagagcaacuucaucauggugaacuga

SEQ ID NO: 33520 - RNA, 1143 nt, Artificial Sequence
  derived and/or modified sequence opt1 from NELFE__Homo_sapiens__NP_002895
augcuggugaucccgcccggccucagcgaggaggaggaggcccugcagaagaaguucaacaagcugaagaagaagaagaaggcccuccuggcgcugaagaagcaguccagcuccagcaccaccucccagggcggggucaagcgcagccucuccgagcagcccgugauggacacggccaccgccaccgagcaggccaagcagcuggucaagagcggggccaucuccgcgaucaaggccgagaccaagaacagcggcuucaagcggucccgcacgcuggaggggaagcucaaggaccccgagaagggccccgugccgaccuuccagcccuuccagcggagcaucuccgccgacgacgaccugcaggagagcucccgccggccccagcgcaagagccuguacgaguccuucgugagcuccagcgaccggcuccgcgagcugggccccgacggggaggaggccgagggcccgggggcgggcgacgggccgccccggagcuucgacuggggcuacgaggagcgcuccggcgcccacagcuccgccagcccgccccggucccgcagccgggaccgcucccacgagcggaaccgcgaccgggaccgcgaccgggagcgcgaccgggaccgcgaccgcgaccgggaccgcgagcgggaccgcgaccgggaccgcgaccgggaccgcgaccgggagcgcgaccgggaccgcgagcgggaccgcgaccgggaccgcgaggggcccuuccggcgcagcgacuccuuccccgagcggcgcgcgccccgcaagggcaacacccuguacguguacggggaggacaugacccccacgcuccugcggggcgccuucagccccuucggcaacaucaucgaccuguccauggacccgccccgcaacugcgccuucgucaccuacgagaagauggagagcgccgaccaggccguggccgagcucaacgggacccagguggaguccguccagcugaaggugaacaucgcccggaagcagcccaugcuggacgcggccaccggcaagagcgugugggggucccucgccguccagaacagccccaagggcugccaccgcgacaagcggacgcagaucguguacuccgacgacguguacaaggagaaccuggucgacggguucuga

SEQ ID NO: 33521 - RNA, 2262 nt, Artificial Sequence
  derived and/or modified sequence opt1 from NELL1__Homo_sapiens__NP_001275643
augcccauggaccugauccucguggucugguucugcgugugcaccgcccgcaccguggucggcuucgggauggacccggaccugcagauggacaucgugaccgagcuggaccucgugaacaccacccugggcgucgcccaggugagcgggaugcacaacgcguccaaggccuuccuguuccaggacaucgagcgggagauccacgccgcgccccacgugagcgagaagcucauccagcuguuccgcaacaaguccgaguucaccauccuggccacgguccagcagaagcccagcaccuccggcgugauccucagcauccgggagcuggagcaccgcaucuacgagcgggugaucgacccgcccgacaccaaccugccgcccgggaucaaccucuggcugggccagcgcaaccagaagcacggccuguucaaggggaucauccaggacggcaagaucaucuucaugcccaacggguacaucacccagugccccaaccucaaccacacgugcccgaccugcuccgacuuccugagccugguccagggcaucauggaccuccaggagcugcuggccaagaugaccgccaagcucaacuacgccgagacccggcugucccagcuggagaacugccacugcgagaagacgugccaggugagcgggcuccuguaccgcgaccaggacuccuggguggacggcgaccacugccggaacugcacgugcaagagcggcgccgucgagugccgccggauguccugcccgccccugaacugcagccccgacucccuccccgugcacaucgcggggcagugcugcaaggugugccgccccaagugcaucuacggcgggaagguccuggccgagggccagcggauccugaccaagagcugccgcgagugccggggcggggugcucgugaagaucaccgagaugugcccgccccugaacugcuccgagaaggaccacauccugcccgagaaccagugcugccgcgucugccggggccacaacuucugcgccgaggggcccaagugcggcgagaacagcgagugcaagaacuggaacaccaaggcgaccugcgagugcaaguccggguacaucagcgugcagggcgacagcgccuacugcgaggacaucgacgagugcgccgccaagaugcacuacugccacgccaacaccgugugcgucaaccuccccggccuguaccgcugcgacugcgugcccggguacauccgggucgacgacuucuccugcaccgagcacgacgagugcggcagcgggcagcacaacugcgacgagaacgccaucugcacgaacaccgugcagggccacuccugcacgugcaagcccggguacgugggcaacggcaccaucugccgcgccuucugcgaggaggggugccgguacggcgggaccugcgucgcgcccaacaagugcgugugccccagcggcuucaccgggucccacugcgagaaggacaucgacgagugcagcgagggcaucaucgagugccacaaccacucccgcugcgugaaccugccgggcugguaccacugcgagugccgcagcggguuccacgacgacggcaccuacucccucagcggggaguccugcaucgacaucgacgagugcgcccugcggacccacacgugcuggaacgacagcgccugcaucaaccuggccggcggcuucgacugccucugccccuccgggcccagcugcuccggcgacugcccccacgagggcgggcugaagcacaacgggcaggucuggacccugaaggaggaccgcugcagcgugugcuccugcaaggacggcaagaucuucugccggcgcaccgccugcgacugccagaacccgagcgcggaccucuucugcugccccgagugcgacacccgggugacgucccagugccuggaccagaacggccacaagcuguaccgcagcggggacaacuggacccacagcugccagcagugccggugccucgagggcgaggucgacugcuggccccugaccugcccgaaccuguccugcgaguacaccgccauccucgagggggagugcugcccccgcugcgugagcgaccccugccuggccgacaacaucacguacgacauccggaagaccugccuggacuccuacggcgugagccgccuguccgggagcgucuggaccauggccggcucccccugcacgaccugcaagugcaagaacggccgggugugcugcagcguggacuucgagugccuccagaacaacuga

SEQ ID NO: 33522 - RNA, 2601 nt, Artificial Sequence
  derived and/or modified sequence opt1 from NELL2__Homo_sapiens__NP_001138579
augggcuucccgccccugcucaaggggcaggccagcgccacccgcuccagccuggcguccugcagcuggguggucuucuuccuguccugccucagccggcacgcccccgagaucgagggcgggcgccgguggaccgagcugauccgcacgauggagucccgggugcugcuccgcaccuucugccugaucuucggccugggggccguguggggccucggcgucgaccccagccugcagaucgacgugcugaccgagcucgagcugggggaguccaccacgggcgugcggcagguccccgggcugcacaacggcaccaaggccuuccucuuccaggacaccccgcgcagcaucaaggccuccaccgcgacggccgagcaguucuuccagaagcugcggaacaagcacgaguucaccauccuggugacccucaagcagacccaccugaacagcggggugauccuguccauccaccaccucgaccaccgcuaccuggagcuggagagcuccggccaccggaacgagguccgccuccacuaccggagcggcucccaccgcccccacacggagguguuccccuacauccuggccgacgacaaguggcacaagcugagccucgccaucuccgcgagccaccugauccugcacaucgacugcaacaagaucuacgagcggguggucgagaagcccagcaccgaccucccgcuggggaccaccuucuggcugggccagcgcaacaacgcccacggguacuucaagggcaucaugcaggacgugcagcuccuggugaugccccagggcuucaucgcccagugccccgaccugaaccggacgugcccgaccugcaacgacuuccacgggcucguccagaagaucauggagcugcaggacauccuggccaagaccuccgccaagcucagccgcgcggagcagcggaugaaccgccuggaccagugcuacugcgagcggaccugcacgaugaagggcaccaccuaccgcgaguucgaguccuggaucgacgggugcaagaacugcacgugccugaacggcaccauccagugcgagacccucaucugccccaaccccgacugcccccucaagagcgcccuggccuacguggacgggaagugcugcaaggagugcaaguccaucugccaguuccagggccgcaccuacuucgagggcgagcggaacaccguguacagcuccagcggggucugcgugcuguacgagugcaaggaccagacgaugaagcugguggaguccagcggcugccccgcccuggacugcccggagucccaccagaucacccucagccacuccugcugcaaggucugcaagggguacgacuucugcagcgagcgccacaacugcauggagaacuccaucugccggaaccugaacgaccgcgccgugugcagcugccgggacggcuuccgcgcgcugcgggaggacaacgccuacugcgaggacaucgacgagugcgccgaggggcgccacuacugccgggagaacaccaugugcgugaacacccccggcuccuucaugugcaucugcaagacgggcuacauccgcaucgacgacuacagcugcaccgagcacgacgagugcaucaccaaccagcacaacugcgacgagaacgcccugugcuucaacaccgucgggggccacaacugcgugugcaagcccggguacacgggcaacgggacgaccugcaaggccuucugcaaggacggcugccggaacggcggggcgugcaucgccgccaacgucugcgccugcccccagggcuucaccgggccguccugcgagaccgacaucgacgagugcagcgacggcuucgugcagugcgacagccgcgccaacugcaucaaccuccccggcugguaccacugcgagugccgggacggguaccacgacaacggcauguucucccccagcggggaguccugcgaggacaucgacgagugcggcaccgggcgccacagcugcgcgaacgacaccaucugcuucaaccuggacggcggcuacgacugccggugcccccacgggaagaacugcaccggcgacugcauccacgacgggaaggugaagcacaacggccagaucuggguccuggagaacgaccgcugcuccgugugcagcugccagaacggguucgugaugugccggcgcauggucugcgacugcgagaacccgaccguggaccucuucugcugccccgagugcgacccccggcuguccagccagugccugcaccagaacggcgagacgcucuacaacuccggcgacaccugggugcagaacugccagcagugccgcugccugcagggggaggucgacugcuggccccugccgugccccgacguggagugcgaguucagcauccuccccgagaacgagugcugcccgcgcugcgugaccgaccccugccaggccgacaccauccggaacgacaucacgaagaccugccuggacgagaugaacgucgugcgcuucaccggcuccagcuggaucaagcacgggaccgagugcacgcugugccagugcaagaacggccacaucugcugcuccguggacccccagugccuccaggagcuguga

SEQ ID NO: 33523 - RNA, 3168 nt, Artificial Sequence
  derived and/or modified sequence opt1 from NEMF__Homo_sapiens__NP_001288661
augaagucccgcuucagcaccaucgaccugcgggccgugcucgccgagcugaacgcgagccugcucggcaugcgcgucaacaacguguacgacguggacaacaagaccuaccugauccggcugcagaagcccgacuucaaggccacgcuccugcuggaguccgggauccgcauccacaccaccgaguucgaguggccgaagaacaugaugcccagcuccuucgccaugaagugccggaagcaccucaagagccgccggcuggucuccgccaagcagcugggcguggaccgcaucguggacuuccaguucgggagcgacgaggccgcguaccaccucaucaucgagcuguacgaccggggcaacaucguccugaccgacuacgaguacgugauccucaacauccugcgcuuccggacggacgaggccgacgacgugaaguucgccguccgcgagcgguacccccuggaccacgcccgcgcggccgagccccuccugacccuggagcggcucaccgagaucguggccuccgccccgaagggggagcugcugaagcgcgugcucaacccccugcugcccuacggccccgcccucaucgagcacugccugcuggagaacggcuucagcgggaacgucaagguggacgagaagcucgagaccaaggacaucgagaaggugcuggucucccugcagaaggcggaggacuacaugaagacgaccagcaacuucuccggcaagggguacaucauccagaagcgggagaucaagccgugccucgaggccgacaagcccguggaggacauccugaccuacgaggaguuccaccccuuccuguucagccagcacucccagugccccuacaucgaguucgagagcuucgacaaggccguggacgaguucuacuccaagaucgagggccagaagaucgaccucaaggcccugcagcaggagaagcaggcccugaagaagcucgacaacguccgcaaggaccacgagaaccggcuggaggcgcugcagcaggcccaggagaucgacaagcucaagggggagcugaucgagaugaaccugcagaucguggaccgcgccauccaggugguccggagcgcccucgccaaccagaucgacuggaccgagaucggccugaucgugaaggaggcgcaggcccagggcgacccgguggccuccgccaucaaggagcugaagcuccagacgaaccacgucaccaugcugcugcgcaaccccuaccugcucagcgaggaggaggacgacgacguggacggggacgucaacguggagaagaacgagaccgagccgcccaagggcaagaagaagaagcagaagaacaagcagcugcagaagccccagaagaacaagccccugcucguggacgucgaccugagccuguccgccuacgcgaacgccaagaaguacuacgaccacaagcgcuacgccgccaagaagacccagaagacgguggaggcggccgagaaggccuucaagagcgccgagaagaagaccaagcagacccucaaggaggugcagaccgucacguccauccagaaggcccggaagguguacugguucgagaaguuccugugguucaucagcuccgagaacuaccugaucaucgggggccgcgaccagcagcagaacgagaucaucgugaagcgguaccucacccccggcgagcccaucccgccccgcacccugaccgaggcggggacgauggcccugugcuacagcgccgccugggacgcccgggucaucaccuccgcgugguggguguaccaccaccaggugagcaagaccgcccccaccggcgaguaccucacgaccggguccuucaugauccgcggcaagaagaacuuccugcccccgagcuaccugaugaugggguucuccuuccucuucaaggucgacgagagcugcguguggcggcaccagggcgagcgcaaggugcggguccaggacgaggacauggagacccuggccuccugcaccagcgagcugaucuccgaggagauggagcagcucgacggcggggacacgagcuccgacgaggacaaggaggagcacgagacccccguggagguggagcugaugacccaggucgaccaggaggacaucacccugcagagcggccgcgacgagcucaacgaggagcugauccaggaggaguccagcgaggacgagggggaguacgaggaggugcggaaggaccaggacagcgugggcgagaugaaggacgagggggaggagacgcugaacuaccccgacaccaccaucgaccucucccaccuccagccccagcgcagcauccagaagcuggccuccaaggaggagagcuccaacagcuccgacagcaagucccagagccggcgccaccuguccgccaaggagcggcgcgagaugaagaagaagaagcugccgagcgacuccggcgaccuggaggcgcucgagggcaaggacaaggagaaggagagcaccguccacaucgagacccaccagaacacguccaagaacguggccgccgugcagcccaugaagcgggggcagaaguccaagaugaagaagaugaaggagaaguacaaggaccaggacgaggaggaccgcgagcugaucaugaagcugcucggcagcgccgggagcaacaaggaggagaagggcaagaaggggaagaagggcaagaccaaggacgagcccgucaagaagcagccgcagaagccccggggcgggcagcgcgugagcgacaacaucaagaaggagacccccuuccuggaggugaucacccacgagcugcaggacuucgcggucgacgacccccacgacgacaaggaggagcaggaccucgaccagcagggcaacgaggagaaccuguucgacucccugacggggcagccgcaccccgaggacgugcuccuguucgccauccccaucugcgcccccuacaccaccaugaccaacuacaaguacaaggugaagcugacgccgggcguccagaagaagggcaaggccgccaagaccgcgcucaacagcuucaugcacuccaaggaggccaccgcccgcgagaaggaccuguuccggagcgugaaggacaccgaccugucccgcaacauccccgggaaggugaaggucagcgcccccaaccuccugaacgugaagcggaaguga

SEQ ID NO: 33524 - RNA, 4227 nt, Artificial Sequence
  derived and/or modified sequence opt1 from NEO1__Homo_sapiens__NP_001166094
auggccgccgagcgcggcgcgcggcgccugcucagcacccccuccuucuggcuguacugccugcuccugcuggggcggcgcgccccgggcgccgccgccgcgcggagcggguccgcgccccagagccccggcgccuccauccgcaccuucacgcccuucuacuuccucguggagccggucgacacccugagcgugcggggguccagcgugauccugaacugcuccgccuacagcgagcccucccccaagaucgaguggaagaaggacggcaccuuccucaaccuggucagcgacgaccgccggcagcugcuccccgacggcucccuguucaucagcaacguggugcacuccaagcacaacaagccggacgagggguacuaccagugcgucgccaccguggagagccugggcacgaucaucucccgcaccgccaagcucaucguggccgggcugccccgguucaccagccagcccgagcccuccagcgucuacgccggcaacaacgccauccugaacugcgaggugaacgcggaccucgugccguucguccgcugggagcagaaccggcagccccugcugcucgacgaccgcgugaucaagcugcccagcgggaugcuggugaucuccaacgccaccgagggcgacggcgggcucuaccggugcgucguggagagcggcgggcccccgaaguacuccgacgagguggagcugaagguccugcccgaccccgaggugaucagcgaccucguguuccugaagcagcccuccccgcugguccgcgugaucggccaggacgugguccuccccugcguggccagcggccugcccacgcccaccaucaaguggaugaagaacgaggaggcccuggacaccgaguccagcgagcggcucguccugcuggccgggggcucccucgagaucagcgacgugaccgaggacgacgcggggacguacuucugcaucgccgacaacggcaacgagaccaucgaggcccaggccgagcugaccgugcaggcccagccggaguuccugaagcagcccaccaacaucuacgcgcacgaguccauggacaucgucuucgagugcgaggugacggggaagcccacccccaccgugaagugggucaagaacggcgacauggugaucccgagcgacuacuucaagaucgugaaggagcacaaccuccagguccugggccuggugaaguccgacgagggguucuaccagugcaucgccgagaacgacgugggcaacgcccaggccggggcccagcucaucauccuggagcacgcgcccgccaccacgggcccccugccgagcgcgccccgcgacgucguggccucccucgugagcacccgguucaucaagcugaccuggcgcacccccgccuccgacccccacggggacaaccugacguacagcgucuucuacaccaaggagggcaucgcccgggagcgcguggagaacaccucccacccgggcgagaugcaggucaccauccagaaccucaugcccgccacgguguacaucuuccgcgugauggcccagaacaagcacgggagcggcgagagcuccgcgccccugcggguggagacccagcccgagguccagcugccggggcccgcccccaaccugcgcgccuacgccgccagccccaccuccaucaccgugacgugggagaccccggugagcggcaacggggagauccagaacuacaagcucuacuacauggagaagggcaccgacaaggagcaggacgucgacguguccagccacuccuacaccaucaacggccugaagaaguacacggaguacagcuuccggguggucgccuacaacaagcacgggcccggcguguccacccccgacguggcgguccgcacccugagcgacgugcccuccgccgccccgcagaaccucagccuggaggugcggaacuccaagagcaucaugauccacuggcagccgcccgcccccgccacccagaacgggcagaucaccggcuacaagauccgcuaccggaaggcgucccgcaagagcgacgucacggagacccugguguccggcacccagcucagccagcugaucgaggggcuggaccggggcaccgaguacaacuuccgcguggccgcccucacgaucaacgggaccggccccgccaccgacuggcugagcgcggagaccuucgaguccgaccuggacgagacgcggguccccgaggugcccagcucccuccacgugcgcccccuggucaccagcaucgugguguccuggaccccgcccgagaaccagaacaucgucgugcggggguacgccaucggcuacggcaucgggagcccccacgcccagaccaucaagguggacuacaagcagcgcuacuacacgaucgagaaccuggacccguccagccacuacgucaucacccucaaggccuucaacaacgugggcgaggggaucccccuguacgaguccgccgugacccggccccacaccgacacgagcgaggucgaccuguucgugaucaacgcgcccuacaccccggugcccgaccccacccccaugaugccgcccgucggcgugcaggccuccauccucagccacgacaccauccgcaucacgugggccgacaacucccugcccaagcaccagaagaucaccgacagccgguacuacaccguccgcuggaagaccaacauccccgccaacacgaaguacaagaacgccaacgcgaccacccuguccuaccucgugaccgggcugaagccgaacacgcuguacgaguucagcgugauggucaccaagggccggcgcuccagcaccugguccaugaccgcccacggcacgaccuucgagcucgugcccaccagcccgcccaaggacgugaccgucgugagcaaggaggggaagcccaagacgaucaucgugaacuggcagccgcccuccgaggccaacggcaagaucaccggguacaucaucuacuacagcaccgacgucaacgccgagauccacgacugggugaucgagcccguggucggcaaccgccugacccaccagauccaggagcugacccucgacacgcccuacuacuucaagauccaggcccggaacuccaaggggaugggccccaugagcgaggcggugcaguuccgcacccccaaggccgacuccagcgacaagaugcccaacgaccaggccuccggcagcgggggcaaggggucccggcugccggaccugggcagcgacuacaagccgcccauguccgggagcaacagcccccacggcucccccaccagcccccucgacuccaacaugcugcuggugaucaucgucuccgugggcgugaucaccaucgucgugguggucaucaucgccguguucugcacgcgccggaccaccagccaccagaagaagaagcgcgcggccugcaaguccgugaacgggagccacaaguacaagggcaacagcaaggacgucaagcccccggaccucuggauccaccacgagcggcuggagcugaagcccaucgacaagucccccgaccccaacccgaucaugaccgacacgcccaucccccgcaacagccaggacaucacccccguggacaacuccauggacagcaacauccaccagcggcgcaacuccuaccgggggcacgagagcgaggacuccaugagcacccucgccggccgccggggcaugcgcccgaagaugaugaugcccuucgacucccagccgccccagcagagcgugcggaacacccccuccacggacaccaugcccgccagcuccagccagaccugcugcaccgaccaccaggaccccgagggggccacguccagcuccuaccuggcgagcucccaggaggaggacagcggccagagccugcccaccgcccacguccgcccgucccacccccucaagagcuucgccgugcccgccaucccgccgcccgggccgcccaccuacgaccccgcccugcccuccacgccccugcucagccagcaggcgcugaaccaccacauccacuccgugaagaccgccagcaucggcacccuggggcggucccggccgcccaugcccgucguggugcccagcgcccccgagguccaggagaccacccgcaugcucgaggacuccgagagcuccuacgagcccgacgagcugacgaaggagauggcccaccuggagggccucaugaaggaccugaacgccaucaccaccgcguga

SEQ ID NO: 33525 - RNA, 4866 nt, Artificial Sequence
  derived and/or modified sequence opt1 from NES__Homo_sapiens__NP_006608
auggagggcugcaugggggaggagagcuuccagaugugggagcugaaccgccggcucgaggccuaccuggcccgcgugaaggcgcuggaggagcagaacgagcuccuguccgccgagcugggcgggcuccgggcccagagcgccgacaccuccuggcgcgcccacgcggacgacgagcuggccgcccugcgggcccucgucgaccagcgcuggcgggagaagcacgcggccgagguggcccgcgacaaccuggccgaggagcuggagggcguggccgggcggugccagcagcuccgccuggcgcgggagcgcaccacggaggaggucgcccggaaccgccgggccguggaggccgagaagugcgcccgcgcguggcugagcucccagguggccgagcucgagcgggagcuggaggcccugcgcgucgcccacgaggaggagcgggugggccucaacgcccaggcggccugcgccccccgcugcccggcccccccccggggccccccggcccccgcgcccgagguggaggagcuggcccgccgccugggggaggccuggcggggcgccguccgcggguaccaggagcggguggcgcacauggagaccagccucggccaggcccgcgagcggcuggggcgcgccgugcagggcgcccgggagggccgccuggagcuccagcagcugcaggccgagcgggggggccugcucgagcgccgggcggcccuggagcagcgccuggaggggcgguggcaggagcgccuccgggccaccgagaaguuccagcuggccgucgaggcccuggagcaggagaagcagggccuccagucccagaucgcgcaggugcuggagggccgccagcagcuggcccaccucaagaugagccugucccuggagguggccaccuaccggacgcuccuggaggccgagaacagccgccugcagacccccgggggcggguccaagaccagccucuccuuccaggacccgaagcuggagcugcaguucccccggacccccgagggccgccgccucgggagccugcugcccguccucuccccgacgagccugcccuccccccugcccgccacccuggagaccccggugcccgcguuccucaagaaccaggaguuccugcaggcccggacccccacgcuggccagcacccccaucccgcccaccccccaggcccccuccccggcgguggacgccgagauccgcgcccaggacgccccccucagccugcugcagacccagggcggccggaagcaggcccccgagccccuccgcgcggaggcccgggucgccaucccggccagcgugcugcccgggcccgaggagccgggcgggcagcgccaggaggccuccacgggccagagccccgaggaccacgcgucccuggcccccccccucagcccggaccacuccagccuggaggccaaggacggggaguccggcggcagccggguguucuccaucugccgcggggagggcgaggggcagaucuggggccuggucgagaaggagaccgccaucgaggggaagguggugagcucccuccagcaggagaucugggaggaggaggaccugaaccggaaggagauccaggacagccaggucccccuggagaaggagacccucaagucccugggcgaggagauccaggagagccugaagacccucgagaaccagucccacgagacgcuggagcgcgagaaccaggagugcccccggagccuggaggaggaccucgagacccugaagucccuggagaaggagaacaaggagcuccugaaggacguggaggucgugcgcccccuggagaaggaggccgugggccagcucaagccgaccgggaaggaggacacccagacgcugcagagccugcagaaggagaaccaggagcucaugaagucccuggagggcaaccuggagaccuuccucuuccccgggaccgagaaccaggagcuggucagcagccugcaggagaaccucgagucccugaccgcgcuggagaaggagaaccaggagccccuccggagccccgaggugggcgacgaggaggcccugcgcccgcugacgaaggagaaccaggagccccuccggucccuggaggacgagaacaaggaggccuuccgcagccuggagaaggagaaccaggagccccucaagacccuggaggaggaggaccaguccaucgugcggccccuggagaccgagaaccacaagagccuccgcucccuggaggagcaggaccaggagacccugcggacgcucgagaaggagacccagcagcgccggcgcagccugggcgagcaggaccagaugacccugcgcccgcccgagaaggucgaccucgagccccugaagucccuggaccaggagaucgcccggccccucgagaacgagaaccaggaguuccugaagagccugaaggaggaguccguggaggcggugaagagccucgagaccgagauccuggagucccugaagagcgccgggcaggagaaccucgagacgcugaaguccccggagacccaggccccccuguggacccccgaggagaucaaccagggcgccaugaacccccucgagaaggagauccaggagccgcuggagagcgucgaggugaaccaggagaccuuccgccugcucgaggaggagaaccaggagucccugcggagccugggggccuggaaccucgagaaccugcgcagccccgaggagguggacaaggagucccagcggaaccuggaggaggaggagaaccucggcaagggggaguaccaggagagccugcgcucccuggaggaggagggccaggagcucccccagagcgcggacguccagcggugggaggacaccguggagaaggaccaggagcuggcccaggaguccccgcccggcauggccgggguggagaacgaggacgaggccgagcugaaccuccgcgagcaggacggcuucacggggaaggaggaggucguggagcagggcgagcugaacgccaccgaggagguguggauccccggggagggccaccccgagagcccggagcccaaggagcagcggggccuggucgagggggcguccgugaagggcggggccgagggccuccaggaccccgaggggcagagccagcaggugggcgcccccggccugcaggccccgcaggggcugcccgaggccaucgagccccucgucgaggacgacguggcgcccggcggggaccaggccuccccggaggugaugcugggcagcgagcccgccaugggggaguccgccgccggcgcggagcccggccccgggcagggcgucgggggccugggcgacccggggcaccucacccgcgaggaggugauggagcccccccuggaggaggagagccuggaggccaagcgggugcagggccucgaggggccccgcaaggaccuggaggaggccggcgggcugggcaccgaguucuccgagcugccgggcaagagccgggaccccugggagcccccccgcgaggggcgggaggaguccgaggccgaggcgccgcgcggcgccgaggaggccuuccccgccgagacgcucgggcacaccggcagcgacgcccccucccccuggccgcuggggagcgaggaggcggaggaggacgucccccccgugcugguguccccgagccccaccuacacccccauccucgaggacgcccccggcccgcagccccaggccgagggcagccaggaggccuccugggggguccagggccgggccgaggcgcuggggaagguggagagcgagcaggaggagcugggcuccggggagauccccgagggcccccaggaggagggcgaggagagccgcgaggaguccgaggaggacgagcucggggagacgcugccggacagcaccccccugggcuucuaccuccggucccccaccagcccccgcugggacccgaccggggagcagcgcccccccccccagggcgagacgggcaaggaggggugggacccggccgugcuggccuccgagggccuggaggccccccccagcgagaaggaggagggggaggagggcgaggaggagugcgggcgggacuccgaccucagcgaggaguucgaggaccugggcaccgaggcccccuuccugccgggcguccccggggagguggcggagccccucggccaggugccccagcugcugcucgacccggccgccugggaccgcgacggggaguccgacggcuucgccgacgaggaggagagcggggaggagggcgaggaggaccaggaggagggccgggagcccggggcgggccgcugggggcccggcuccagcgucgggucccugcaggcccugagcuccagccagcggggcgaguuccucgagagcgacuccgugagcguguccguccccugggacgacagccugcgcggcgccguggccggggccccgaagaccgcgcuggagaccgagucccaggacagcgccgagcccuccggcagcgaggaggaguccgaccccgugagccucgagcgggaggacaaggucccggggccccuggagauccccuccggcauggaggacgccgggcccggcgccgacaucaucggcgugaacgggcagggcccgaaccuggaggggaagagccagcacgugaacggcggcgucaugaacgggcucgagcaguccgaggaggugggccaggggaugccccuggugagcgagggcgaccgcgggucccccuuccaggaggaggagggcagcgcccugaagacguccugggcgggcgcccccguccaccucgggcagggccaguuccugaaguucacccagcgggagggggaccgcgagagcugguccagcggcgaggacuga

SEQ ID NO: 33526 - RNA, 1791 nt, Artificial Sequence
  derived and/or modified sequence opt1 from NET1__Homo_sapiens__NP_001040625
auggagcccgagcuggccgcccagaagcagccgcgcccccggcgccggagccgccgggcguccggccucagcaccgagggggccaccggccccuccgccgacacgagcggguccgagcuggacggccgcugcagccugcggcgcggguccagcuucaccuuccucacccccggcccgaacugggacuucacccugaagcggaagcgccgggagaaggacgacgacguggucucccugagcucccucgaccugaaggagcccagcaacaagcgcgugcggccccuggcccgcgugacgucccucgccaaccugaucagccccguccggaacggcgcggugcgccgguucgggcagaccauccaguccuucacccugcgcggcgaccaccggagcccggccuccgcccagaaguucagcucccgcagcaccgugcccacgcccgccaagcggcgcagcuccgcgcucuggagcgagaugcuggacaucaccaugaaggagucccugaccacccgcgagauccggcgccaggaggccaucuacgagaugagccgcggggagcaggaccucaucgaggaccugaagcuggcccggaaggccuaccacgaccccaugcucaagcuguccaucaugagcgaggaggagcugacgcacaucuucggcgaccucgacuccuacaucccgcugcacgaggaccugcucacccggaucggggaggccaccaagcccgacggcaccgucgagcagaucggccacauccuggugagcuggcugccccgccucaacgcguaccggggguacugcuccaaccagcuggccgccaaggcccugcucgaccagaagaagcaggacccccgcgugcaggacuuccugcagcggugccuggagagcccguucucccgcaagcucgaccuguggagcuuccuggacaucccccggucccgccucgucaaguacccccugcugcucaaggagauccugaagcacacgcccaaggagcacccggacgugcagcugcucgaggacgccauccugaucauccagggcgugcugagcgacaucaaccucaagaagggggaguccgagugccaguacuacaucgacaagcuggaguaccuggacgagaagcagcgggacccccgcaucgaggcgagcaagguccuccugugccacggcgagcugcgguccaagagcggccacaagcuguacaucuuccucuuccaggacauccuggugcugacccgccccgugacccggaacgagcgccacuccuaccaggucuaccggcagcccaucccggugcaggagcucgugcuggaggaccugcaggacggggacguccgcaugggcgggagcuuccgcggcgccuucagcaacuccgagaaggccaagaacaucuuccggauccgcuuccacgaccccagccccgcccagucccacacccuccaggccaacgacguguuccacaagcagcagugguucaacugcauccgggcggccaucgcccccuuccagagcgccggguccccgcccgagcugcagggccugcccgagcuccacgaggagugcgagggcaaccacccgagcgcccgcaagcugacggcgcagcggcgcgccuccaccgugagcuccgucacccagguggagguggacgagaacgccuaccggugcgggagcggcaugcagauggccgaggacuccaagagccugaagacccaccagacgcagcccgggauccgccgggcgcgcgacaaggcccucuccggcgggaagcggaaggagacccuggucuga

SEQ ID NO: 33527 - RNA, 471 nt, Artificial Sequence
  derived and/or modified sequence opt1 from NETO1__Homo_sapiens__NP_620552
augcuggccgagcccuuccccaagguggucgccagccucaucauccugcaccuguccggcgcgaccaagaaggggaccgagaagcagacgaccagcgagacccagaaguccgugcagugcggcaccuggacgaagcacgccgagggcgggaucuucaccagccccaacuaccccuccaaguacccgcccgaccgcgagugcaucuacaucaucgaggccgcgccccggcagugcaucgagcucuacuucgacgagaaguacagcaucgagcccuccugggagugcaaguucgaccacaucgaggugcgcgacgggcccuucggcuucagcccgaucaucggccgguucugcgggcagcagaacccgcccgucaucaaguccagcggccgcuuccuguggaucaaguucuucgccgacggggagcuggaguccaugggcuucagcgcccgguacaacuucacccccgaguga

SEQ ID NO: 33528 - RNA, 1578 nt, Artificial Sequence
  derived and/or modified sequence opt1 from NETO2__Homo_sapiens__NP_060562
auggcccuggagcgccucugcagcgugcugaagguccugcucaucaccgugcugguggucgagggcaucgccguggcgcagaagacccaggacgggcagaacaucggcaucaagcacauccccgccacgcagugcgggaucugggugcggaccuccaacggcgggcacuucgccagcccgaacuaccccgacuccuacccgcccaacaaggagugcaucuacauccuggaggccgcgccccgccagcggaucgagcucaccuucgacgagcacuacuacaucgagcccagcuucgagugccgcuucgaccaccuggagguccgggacggccccuucggcuucagcccccugaucgaccgcuacugcggggucaagagcccgccccucauccgguccaccggccgcuucauguggaucaaguucagcuccgacgaggagcuggaggggcugggcuuccgggccaaguacagcuucauccccgaccccgacuucacguaccucgggggcauccugaacccgauccccgacugccaguucgagcuguccggcgccgacgggaucgugcgcagcucccagguggagcaggaggagaagaccaagcccggccaggccguggacugcaucuggaccaucaaggccacccccaaggcgaagaucuaccuccgguuccuggacuaccagauggagcacagcaacgagugcaagcgcaacuucguggccgucuacgacggguccagcuccaucgagaaccugaaggccaaguucugcagcacgguggccaacgacgugaugcucaagaccggcaucggcgucauccggaugugggccgacgaggggucccgccugagccgguuccgcaugcuguucaccagcuucguggagccgcccugcaccuccagcacguucuucugccacuccaacaugugcaucaacaacagccucgugugcaacggcguccagaacugcgcguaccccugggacgagaaccacugcaaggagaagaagaaggccgggguguucgagcagaucaccaagacccacggcaccaucaucgggaucacguccggcaucgugcugguccugcucaucaucagcauccugguccaggugaagcagccccggaagaaggugauggccugcaagaccgccuucaacaagaccggcuuccaggagguguucgacccgccccacuacgagcuguucucccuccgcgacaaggagaucagcgccgaccuggcggaccuguccgaggagcucgacaacuaccagaagaugcggcgcagcuccaccgccagccggugcauccacgaccaccacugcgggucccaggccagcuccgucaagcagagccgcacgaaccuguccagcauggagcugcccuuccgcaacgacuucgcccagccccagccgaugaagaccuucaacuccaccuucaagaaguccagcuacaccuucaagcagggccacgagugccccgagcaggcccucgaggaccgggugauggaggagauccccugcgagaucuacgugcgcgggcgggaggacuccgcgcaggccagcaucuccaucgacuucuga

SEQ ID NO: 33529 - RNA, 1248 nt, Artificial Sequence
  derived and/or modified sequence opt1 from NEU1__Homo_sapiens__NP_000425
augaccggcgagcgccccagcaccgcccugccggaccggcgcugggggccccggauccucggcuucuggggcgggugccgcgugugggucuucgccgcgaucuuccugcugcucucccuggccgccagcugguccaaggccgagaacgacuucgggcuggugcagccccucgugacgauggagcagcugcugugggucagcggccggcagaucggcuccguggacaccuuccgcaucccccucaucaccgccaccccgcgggggacgcugcuggcguucgccgaggcccgcaagaugagcuccagcgacgagggcgccaaguucaucgcgcuccggcgcuccauggaccaggggagcaccuggucccccaccgccuucaucgugaacgacggcgacguccccgacgggcugaaccugggcgccguggugagcgacgucgagaccggcgugguguuccucuucuacucccugugcgcccacaaggccgggugccaggucgcgagcacgaugcuggugugguccaaggacgacggcgugagcugguccacgccccggaaccucagccuggacaucgggaccgaggucuucgccccgggccccggcuccgggauccagaagcagcgcgagccccggaagggccgccugaucgugugcgggcacggcacccucgagcgggacgggguguucugccugcugagcgacgaccacggcgccagcuggcgcuacggcuccggggucagcggcauccccuacgggcagccgaagcaggagaacgacuucaaccccgacgagugccagcccuacgagcuccccgacggcuccguggugaucaacgcccggaaccagaacaacuaccacugccacugccgcaucguccugcggagcuacgacgccugcgacacccugcgcccgcgggacgugaccuucgaccccgagcucguggaccccgucguggcggccggggccgucgugaccuccagcggcaucguguucuucuccaaccccgcccacccggaguuccgcgucaaccugacccugcgcuggagcuucuccaacggcacgagcuggcggaaggagaccgugcagcucuggcccgggcccuccggcuacagcucccuggccacccuggaggggagcauggacggcgaggagcaggcgccccagcucuacgugcuguacgagaaggggcgcaaccacuacaccgaguccaucagcgucgccaagaucuccguguacggcacgcuguga

SEQ ID NO: 33530 - RNA, 1386 nt, Artificial Sequence
  derived and/or modified sequence opt1 from NEU3__Homo_sapiens__NP_006647
augcgccccgccgaccugccgccccggcccauggaggagagccccgccuccagcuccgcgccgaccgagaccgaggagcccggcagcuccgccgaggugauggaggaggucacgaccugcagcuucaacagcccccucuuccgccaggaggacgaccgggggaucaccuaccgcauccccgcccugcuguacaucccgcccacccacacguuccucgccuucgccgagaagcgguccacccgccgggacgaggacgcgcugcaccuggugcuccgccggggccugcgcaucgggcagcuggugcaguggggcccccucaagccccugauggaggccacccugccggggcaccggaccaugaaccccugccccgucugggagcagaaguccggcugcguguuccucuucuucaucugcgugcgcggccacgucacggagcggcagcagaucgugagcgggcgcaacgccgcccggcugugcuucaucuacucccaggacgcgggcugcagcugguccgaggugcgcgaccugaccgaggaggucaucgggagcgagcucaagcacugggccaccuucgccgugggccccgggcacggcauccagcugcaguccggccggcuggugaucccggccuacaccuacuacauccccagcugguucuucugcuuccagcuccccugcaagacgcgcccccacucccugaugaucuacagcgacgaccugggggucaccuggcaccacggccggcucauccgcccgauggugaccguggagugcgaggucgccgaggugaccgggcgggcgggccaccccgugcuguacugcuccgcccgcacgcccaaccgcugccgggccgaggcccugagcaccgaccacggcgagggguuccagcgccucgcccugagccggcagcugugcgagcccccgcacggcugccagggguccgucgugagcuuccgcccccucgagaucccccaccggugccaggacuccagcuccaaggacgcgcccaccauccagcagagcuccccgggcagcucccugcgccuggaggaggaggccgggacccccagcgaguccuggcuccuguacagccaccccacgucccggaagcagcgcguggaccugggcaucuaccucaaccagaccccgcuggaggccgccugcuggagccggcccuggauccugcacugcggccccugcggguacuccgaccucgccgcgcuggaggaggagggccuguucgggugccucuucgagugcggcaccaagcaggagugcgagcagaucgccuuccgccuguucacccaccgggagauccugagccaccuccagggggacugcacgucccccggccgcaacccgagccaguucaaguccaacuga

SEQ ID NO: 33531 - RNA, 1725 nt, Artificial Sequence
  derived and/or modified sequence opt1 from NEURL1__Homo_sapiens__NP_004201
augggcaacaacuucagcuccauccccagccugccgcgcgggaaccccucccgggcgccccgcggccacccccagaaccucaaggacagcaucgggggcccguuccccgugaccucccaccggugccaccacaagcagaagcacugccccgccguccugcccagcgggggccugccggccacgccccuccuguuccacccccacaccaagggcucccagauccugauggaccucagccacaaggccgugaagcgccaggccuccuucugcaacgccaucaccuucagcaaccggcccgugcugaucuacgagcagguccgccugaagaucaccaagaagcagugcugcugguccggggcccuccggcugggcuucaccagcaaggacccgucccgcauccaccccgacagccugcccaaguacgcgugccccgaccucgugucccagagcggguucugggccaaggcccugccggaggaguucgccaacgagggcaacaucaucgcguucuggguggacaagaaggggcgggucuuccaccgcaucaacgacuccgccgugaugcuguucuucagcggcgugcggacggccgacccccucugggcccuggucgacguguacggccugacccgcggggugcagcuccuggacuccgagcugguccuccccgacugccugcggccccgcagcuucaccgcccugcggcgcccgagccuccggcgcgaggcggacgacgcccggcuguccgugagccugugcgaccucaacgugcccggcgccgacggggacgaggccgcccccgcggccggcugccccaucccgcagaacucccugaacagccagcacucccgcgcccugcccgcccagcucgacggcgaccugcgguuccacgcccugcgcgcgggggcccacguccgcauccucgacgagcagaccguggcccggguggagcacggccgcgacgagcgggcccuggucuucacgagccgccccgugcggguggccgagaccaucuucgucaaggugacccgcuccgggggcgcgcggcccggggcccugagcuucggcgugaccacgugcgacccgggcacccuccgccccgccgaccugcccuucuccccggaggcccuggucgaccggaaggaguucugggcggugugccgcguccccgggccccuccacagcggcgacauccuggggcugguggugaacgccgacggcgagcuccaccugucccacaacggggccgccgccggcaugcagcugugcgucgacgcgagccagccccucuggaugcuguucggccugcacgggaccaucacccagauccggauccucggcuccacgauccuggccgagcgcgggaucccgagccugcccugcucccccgccagcacccccaccuccccgagcgcccugggcucccggcucagcgacccccugcugagcacgugcuccagcgggccccucggcuccagcgccggcgggaccgcgcccaacuccccggugagccugcccgagucccccgugacccccggccuggggcaguggagcgacgagugcaccaucugcuacgagcacgccgucgacaccgugaucuacacgugcggccacaugugccucugcuacgccugcggccugcgccugaagaaggcccuccacgccugcugcccgaucugccggcgccccaucaaggacaucaucaagaccuaccgguccagcuga

SEQ ID NO: 33532 - RNA, 858 nt, Artificial Sequence
  derived and/or modified sequence opt1 from NEURL2__Homo_sapiens__NP_542787
auggccgccgcgagcgagcccguggacuccggcgcccugugggggcuggagcgcccggagcccccgcccacccgguuccaccgcguccacggcgccaacauccggguggaccccagcgggacccgcgccacgcggguggaguccuucgcccacggcgucugcuucagccgcgagccccuggcgcccggccagguguuccugguggagaucgaggagaaggagcucggguggugcggccaccuccggcuggggcucaccgcccuggaccccgccucccuggccccgguccccgaguucagccuccccgaccuggugaaccugggccacaccuggguguucgcgaucacccgccaccacaaccgggucccccgcgaggggcggccggaggccgaggccgccgcccccucccgcccgcccacgcuccugguggagcccuaccugcggaucgagcaguuccgcaucccccgggaccgccucgugggccggagccgccccgggcuguacucccaccuccuggaccagcuguacgagcugaacguccugcccccgaccgcgcggcgcagccggcugggcgugcuguucugcccccgccccgacggcaccgccgacaugcacaucaucaucaacggggaggacaugggccccuccgcccgcgggcucccggccgcccagccccuguacgcgguggucgacguguucgccagcaccaaguccgugcggcugguccagcucgaguacggccugcccagccugcagacgcucugccgccuggugauccagcgguccauggugcaccgccuggccaucgacggccuccaccuccccaaggagcugaaggacuucugcaaguacgaguga

SEQ ID NO: 33533 - RNA, 1071 nt, Artificial Sequence
  derived and/or modified sequence opt1 from NEUROD1__Homo_sapiens__NP_002491
augaccaagagcuacuccgagagcggccugaugggggagccccagccgcagggcccgcccuccuggaccgacgagugccucagcucccaggacgaggagcacgaggccgacaagaaggaggacgaccuggaggccaugaacgccgaggaggacagccugcgcaacgggggcgaggaggaggacgaggacgaggaccucgaggaggaggaggaggaggaggaggaggacgacgaccagaagcccaagcggcgcgggcccaagaagaagaagaugacgaaggcccggcuggagcgcuucaagcugcggcgcaugaaggccaacgcccgggagcgcaaccggaugcacggccucaacgccgcgcuggacaaccugcgcaaggugguccccugcuacuccaagacccagaagcucagcaagaucgagacccugcggcuggccaagaacuacaucugggcccucuccgagauccugcgcagcggcaagucccccgaccuggugagcuucgugcagacccucugcaaggggcugucccagcccacgaccaaccuggucgccggcugccuccagcugaacccgcggaccuuccugcccgagcagaaccaggacaugccgccccaccuccccaccgcgagcgccuccuuccccgugcaccccuacagcuaccagucccccgggcugccgagcccgcccuacggcacgauggacuccagccacguguuccacgucaagcccccgccccacgccuacagcgccgcccuggagcccuucuucgagagcccccucaccgacugcaccucccccuccuucgacgggccccugagcccgccccuguccaucaacggcaacuucagcuucaagcacgagcccuccgcggaguucgagaagaacuacgccuucaccaugcacuaccccgccgccacgcucgccggcgcgcagagccacggguccaucuucagcggcaccgccgcgccccgcugcgagaucccgaucgacaacaucauguccuucgacagccacucccaccacgagcgggugaugagcgcccagcugaacgccaucuuccacgacuga

SEQ ID NO: 33534 - RNA, 1173 nt, Artificial Sequence
  derived and/or modified sequence opt1 from NEUROD2__Homo_sapiens__XP_005257466
augaugcccccgagccugggcaccaugcugacccgccuguucuccgagcccgggcugcucagcgacgugcccaaguucgccuccuggggcgacggggaggacgacgagccccggagcgacaagggcgacgccccgcccccgccgccgcccgcgcccgggcccggcgcccccggccccgcccgcgccgccaagcccgucccccugcgcggggaggagggcacggaggcgacccuggccgaggugaaggaggagggggagcucggcggggaggaggaggaggaggaggaggaggaggagggccuggacgaggccgagggcgagcggcccaagaagcgggggcccaagaagcgcaagaugaccaaggcccggcuggagcgcuccaagcuccggcgccagaaggcgaacgcccgggagcgcaaccggaugcacgaccugaacgccgcccuggacaaccuccgcaaggugguccccugcuacagcaagacccagaagcuguccaagaucgagacgcugcggcucgccaagaacuacaucugggcgcugagcgagauccugcgcuccggcaagcggcccgaccucgugagcuacgugcagacccugugcaaggggcugucccagccgaccaccaaccucgucgccggcugccugcagcugaacagccgcaacuuccucacggagcagggcgccgacggggccggccgguuccacggguccggcgggcccuucgccaugcaccccuaccccuacccgugcagccgccuggcgggcgcccagugccaggccgccggcgggcugggcgggggcgccgcgcacgcccuccggacccacggguacugcgccgccuacgagacccuguacgccgcggccggcggcgggggcgccucccccgacuacaacagcuccgaguacgaggggccccugagcccgccccucugccugaacggcaacuucucccugaagcaggacagcagccccgaccacgagaaguccuaccacuacagcaugcacuacuccgcccuccccgggagccgcccgaccggccacggccugguguucggguccagcgcggugcgcggcgggguccacuccgagaaccugcucagcuacgacaugcaccuccaccacgaccggggccccauguacgaggagcugaacgccuucuuccacaacuga

SEQ ID NO: 33535 - RNA, 996 nt, Artificial Sequence
  derived and/or modified sequence opt1 from NEUROD4__Homo_sapiens__NP_067014
augagcaagaccuucgugaaguccaaggagaugggcgagcuggucaacacccccagcuggauggacaaggggcucggcucccagaacgaggugaaggaggaggagagccgcccggggacguacggcaugcuguccagccugaccgaggagcacgacuccaucgaggaggaggaggaggaggaggaggacggggagaagcccaagcggcgcggccccaagaagaagaagaugaccaaggcccggcucgagcgcuuccgggcccgccgggugaaggcgaacgcccgcgagcggacccgcaugcacggccugaacgacgcccuggacaaccuccggcgcgucaugcccugcuacagcaagacgcagaagcuguccaagaucgagacccugcggcucgcccgcaacuacaucugggcccugagcgaggugcuggagaccgggcagaccccggagggcaagggguucguggagaugcucugcaagggccugucccagcccacgagcaaccuggucgcggggugccuccagcugggcccccaguccgugcugcucgagaagcacgaggacaagagccccaucugcgacuccgccaucagcgugcacaacuucaacuaccaguccccgggccugcccagcccgcccuacgggcacauggagacccaccuccugcaccugaagccccaggucuucaagucccugggcgagagcagcuucgggucccaccuccccgacugcagcaccccgcccuacgagggcccccugaccccgccccuguccaucagcggcaacuucucccucaagcaggacgggagccccgaccuggagaaguccuacagcuucaugccccacuaccccuccagcucccugagcuccggccacgugcacagcacgcccuuccaggccgggacgccccgguacgacgugccgaucgacauguccuacgacagcuacccccaccacggcaucgggacccagcucaacaccgucuucaccgaguga

SEQ ID NO: 33536 - RNA, 1014 nt, Artificial Sequence
  derived and/or modified sequence opt1 from NEUROD6__Homo_sapiens__NP_073565
augcugacccuccccuucgacgagagcguggucaugccggagucccagaugugccgcaaguucagccgggagugcgaggaccagaagcagaucaagaagcccgaguccuucagcaagcagaucgugcugcgcggcaaguccaucaagcgggcccccggggaggagaccgagaaggaggaggaggaggaggaccgcgaggaggaggacgagaacggccugccccggcgccgggggcuccgcaagaagaagacgaccaagcugcggcuggagcgcgugaaguuccggcgccaggaggccaacgcgcgggagcgcaaccggaugcacggccucaacgacgcccuggacaaccugcgcaaggucgugccgugcuacagcaagacccagaagcucuccaagaucgagacccugcggcuggccaagaacuacaucugggcccucagcgagauccugcgcaucgggaagcggcccgaccugcucacguucgugcagaaccugugcaagggccugucccagcccaccaccaaccucgucgccggcugccugcagcugaacgcgcgcagcuuccucauggggcagggcggggaggccgcccaccacacccggucccccuacagcacguucuacccgcccuaccacucccccgagcugaccacgccgcccggccacgggacccuggacaacagcaaguccaugaagcccuacaacuacugcagcgccuacgaguccuucuacgagagcaccucccccgagugcgcgagcccccaguucgagggcccccucagcccgccgcccaucaacuacaacggcaucuucucccugaagcaggaggagacccuggacuacgggaagaacuacaacuacggcaugcacuacugcgccgugccgccccgcgggccccucggccagggcgccauguuccgccugcccaccgacagccacuuccccuacgaccugcaccuccggucccagagccugaccaugcaggacgagcugaacgccguguuccacaacuga

SEQ ID NO: 33537 - RNA, 714 nt, Artificial Sequence
  derived and/or modified sequence opt1 from NEUROG1__Homo_sapiens__NP_006152
augcccgcccgccuggagaccugcaucagcgaccucgacugcgccuccagcuccggcagcgaccuguccggguuccugaccgacgaggaggacugcgcgcggcuccagcaggccgccagcgccuccggcccgcccgcccccgcgcgccgcggggcccccaacaucagccgggccuccgaggugccgggcgcccaggacgacgagcaggagcggcgccggcgccgggggcgcacgcggguccgcagcgaggcgcugcugcacucccuccggcgcagccggcgcgugaaggccaacgaccgggagcgcaaccggaugcacaaccugaacgccgcccuggacgcccuccgcuccgugcugcccagcuuccccgacgacaccaagcugaccaagaucgagacccuccgguucgcguacaacuacaucugggcccuggccgagacgcugcgccucgccgaccagggccugcccggcgggggcgcccgcgagcggcugcucccgccccagugcguccccugccugcccgggccgcccucccccgcgagcgacgccgaguccuggggcagcggggccgccgccgcgagcccccuguccgacccgagcucccccgccgccagcgaggacuucaccuaccgccccggcgaccccguguucuccuucccgagccuccccaaggaccugcugcacaccacccccugcuucauccccuaccacuga

SEQ ID NO: 33538 - RNA, 819 nt, Artificial Sequence
  derived and/or modified sequence opt1 from NEUROG2__Homo_sapiens__NP_076924
auguucgucaagagcgagacccuggagcucaaggaggaggaggacgugcuggugcugcucggcuccgccagccccgcccuggcggcccugaccccgcucuccagcuccgccgacgaggaggaggaggaggagcccggggccagcggcggggcccgccggcagcgcggcgcggaggccgggcagggcgcccggggcgggguggccgcgggcgccgaggggugccgccccgcccggcugcugggccucguccacgacugcaagcgccggcccucccgcgcccgggccgugagccgcggggcgaagacggccgagaccgugcagcggaucaagaagacccgccggcugaaggccaacaaccgcgagcggaaccgcaugcacaaccugaacgccgcccucgacgcgcugcgggagguccugccgaccuuccccgaggacgccaagcucacgaagaucgagacccugcgcuucgcccacaacuacaucugggcccugaccgagacccuccggcuggccgaccacugcggcggcgggggcgggggccugcccggcgcgcuguucuccgaggccgugcugcugagccccgggggcgccuccgccgcccucagcuccagcggggacuccccgagccccgcguccacguggagcugcaccaacucccccgcccccagcagcuccgugagcuccaacagcaccuccccguacagcugcacccugucccccgccagccccgccggcuccgacauggacuacuggcagcccccgccgcccgacaagcaccgcuacgcgccccaccuccccaucgcccgggacugcaucuga

SEQ ID NO: 33539 - RNA, 645 nt, Artificial Sequence
  derived and/or modified sequence opt1 from NEUROG3__Homo_sapiens__NP_066279
augaccccgcagccgagcggcgcccccaccgugcaggucacgcgcgagaccgagcgguccuucccccgcgccagcgaggacgaggugaccugccccaccuccgcgccgcccagccccacgcggacccgcgggaacugcgccgaggccgaggagggcgggugccggggcgcgccccgcaagcugcgggcccgccgcgggggccggucccggcccaagagcgagcucgcccuguccaagcagcgccggagccgccggaagaaggccaacgaccgcgagcggaaccgcaugcacaaccugaacuccgcccucgacgcccugcggggcgugcugcccaccuuccccgacgacgcgaagcucaccaagaucgagacgcugcgcuucgcccacaacuacaucugggcccugacccagacccuccggaucgccgaccacagccuguacgcccuggagcccccggcgccccacugcggggagcucggcucccccgggggcagccccggggacuggggcucccuguacagcccggucucccaggccggcagccugucccccgccgccagccucgaggagcgccccgggcugcugggcgccaccuucuccgcgugccucagccccgggagccuggccuucuccgacuuccuguga

SEQ ID NO: 33540 - RNA, 8457 nt, Artificial Sequence
  derived and/or modified sequence opt1 from NF1__Homo_sapiens__NP_000258
auggccgcccaccgccccguggagugggugcaggcgguggugagccgguucgacgagcagcugcccaucaagaccgggcagcagaacacccacaccaaggucuccaccgagcacaacaaggagugccucaucaacaucagcaaguacaaguucucccuggugaucagcgggcugaccaccauccucaagaacgugaacaacaugcgcaucuucggcgaggccgccgagaagaaccuguaccugucccagcucaucauccuggacacccuggagaagugccucgccgggcagcccaaggacaccaugcggcuggacgagaccaugcuggucaagcagcuccugcccgagaucugccacuuccugcacacgugccgcgagggcaaccagcacgccgcggagcuccggaacagcgccuccggggugcuguucagccuguccugcaacaacuucaacgccguguucagccgcaucuccacccggcuccaggagcugaccgucugcagcgaggacaacguggacgugcacgacaucgagcugcuccaguacaucaacgucgacugcgccaagcugaagcgccugcucaaggagaccgcguucaaguucaaggcccugaagaagguggcccagcuggccgugaucaacucccucgagaaggccuucuggaacugggucgagaacuaccccgacgaguucaccaagcuguaccagaucccccagaccgacauggcggagugcgccgagaagcuguucgaccucguggacggcuucgccgagagcaccaagcggaaggccgccguguggccccugcagaucauccugcucauccugugccccgagaucauccaggacaucuccaaggacgucguggacgagaacaacaugaacaagaagcuguuccucgacagccugcgcaaggcgcuggccggccacgggggcucccggcagcucaccgagagcgccgccaucgccugcgugaagcugugcaaggcguccaccuacaucaacugggaggacaacagcgucaucuuccugcucgugcagagcaugguggucgaccugaagaaccuccuguucaaccccuccaagccguucagccgcgggucccagcccgccgacguggaccugaugaucgacugccuggucagcugcuuccggaucagcccccacaacaaccagcacuucaagaucugccucgcccagaacagccccuccacguuccacuacgugcuggugaacagccugcaccgcaucaucaccaacuccgcccuggacugguggcccaagaucgacgccgucuacugccacagcguggagcuccggaacauguucggcgagacccugcacaaggcggugcaggggugcggcgcccaccccgccauccgcauggcccccucccugaccuucaaggagaaggucacgagccucaaguucaaggagaagcccaccgaccuggagacccgguccuacaaguaccugcuccugagcauggugaagcugauccacgcggacccgaagcuccugcugugcaacccccgcaagcagggccccgagacccagggguccacggccgagcucaucaccggccuggugcagcuggucccccagagccacaugccggagaucgcccaggaggccauggaggcccuccuggugcugcaccagcucgacuccaucgaccuguggaaccccgacgcgcccguggagaccuucugggagaucagcucccagaugcuguucuacaucugcaagaagcucaccagccaccagaugcugagcuccacggagauccugaaguggcuccgggagauccugaucugccgcaacaaguuccugcucaagaacaagcaggccgaccggagcuccugccacuuccugcuguucuacggggucggcugcgacauccccagcuccggcaacaccagccagauguccauggaccacgaggagcuccugcgcaccccgggggccagccugcgcaagggcaaggggaacuccagcauggacuccgccgccggcugcagcgggacgccgcccaucugccggcaggcgcagacgaagcucgagguggcccuguacauguuccuguggaaccccgacaccgaggccgugcucgucgccauguccugcuuccgccaccugugcgaggaggccgacauccggugcggcguggacgaggugagcguccacaaccugcucccgaacuacaacaccuucauggaguucgcguccgugagcaacaugauguccaccggccgcgccgcccugcagaagcgggugauggcccugcuccgccggaucgagcaccccacggcggggaacaccgaggccugggaggacacccacgccaagugggagcaggccaccaagcugauccugaacuaccccaaggccaagauggaggacggccaggcggccgagagccuccacaagaccaucgucaagcgccggaugagccacguguccgggggcgggagcaucgaccuguccgacacggacagccugcaggaguggaucaacaugaccggcuuccucugcgcccugggcggggugugccugcagcagcgcuccaacagcggccucgccaccuacuccccgcccauggggcccgucagcgagcggaagggcuccaugaucagcgugauguccagcgaggggaacgccgacacccccguguccaaguucauggaccgccugcugagccucauggucugcaaccacgagaaggugggccugcagauccggacgaacgugaaggaccuggucggccucgagcuguccccggcgcuguaccccaugcuguucaacaagcugaagaacaccaucagcaaguucuucgacucccagggccaggugcugcucaccgacaccaacacgcaguucguggagcagaccaucgccaucaugaagaaccugcuggacaaccacaccgagggcagcuccgagcaccucgggcaggccagcaucgagaccaugaugcugaaccugguccgcuacgugcgggugcucggcaacaugguccacgccauccagaucaagacgaagcugugccagcugguggaggugaugauggcccgccgggacgaccucagcuucugccaggagaugaaguuccgcaacaagauggucgaguaccugaccgacugggugaugggcaccuccaaccaggcggccgacgacgacgugaagugccugacccgggaccucgaccaggccagcauggaggccgucgugucccugcuggcggggcucccccugcagcccgaggagggcgacgggguggagcugauggaggccaagagccagcuguuccugaaguacuucacgcuguucaugaaccuccugaacgacugcuccgaggucgaggacgagagcgcccagaccggcgggcgcaagcgcggcaugucccggcgccuggccagccuccggcacugcaccgugcuggccauguccaaccugcucaacgcgaacguggacagcggccugaugcacuccaucgggcugggcuaccacaaggaccuccagacccgcgccacguucauggagguccugaccaagauccugcagcaggggaccgaguucgacacccuggccgagacggugcucgccgaccgguucgagcgccugguggagcuggucaccaugaugggcgaccagggggagcucccgaucgccauggcgcuggccaacgugguccccugcagccagugggacgagcuggcccgggugcucgugacccuguucgacucccgccaccuccuguaccagcugcuguggaacauguucagcaaggaggucgagcucgccgacuccaugcagacccuguuccggggcaacagccuggccuccaagaucaugacguucugcuucaagguguacggcgcgaccuaccuccagaagcugcuggacccccuccugcgcaucgugaucaccagcuccgacuggcagcacgucagcuucgagguggaccccacccggcuggagccgagcgagucccucgaggagaaccagcgcaaccugcugcagaugacggagaaguucuuccacgccaucaucagcuccagcuccgaguucccgccccagcuccggagcgugugccacugccuguaccaggucgugucccagcgcuucccccagaacagcaucggggccgugggcuccgccauguuccugcgguucaucaacccggccaucgucagccccuacgaggcggggauccucgacaagaagccgccgccccgcaucgagcggggccugaagcugauguccaagauccuccagagcaucgccaaccacgugcuguucaccaaggaggagcacaugcgccccuucaacgacuucgugaaguccaacuucgacgccgcccggcgcuucuuccuggacaucgcgagcgacugccccaccuccgacgccgucaaccacagccucuccuucaucagcgacgggaacgugcuggcccugcaccggcuccuguggaacaaccaggagaagaucggccaguaccuguccagcaaccgcgaccacaaggccgugggccgccggcccuucgacaagauggccacccuccuggcguaccuggggccgcccgagcacaagcccgucgccgacacgcacuggagcucccucaaccugaccagcuccaaguucgaggaguucaugacccgccaccaggugcacgagaaggaggaguucaaggcccugaagacccucagcaucuucuaccaggccggcaccuccaaggccgggaaccccaucuucuacuacguggcgcggcgcuucaagacgggccagaucaacggggaccugcugaucuaccacguccuccugacccugaagcccuacuacgccaagcccuacgagaucgugguggaccucacccacaccggccccagcaaccgguucaagacggacuuccuguccaagugguucgucguguucccgggcuucgccuacgacaacgugagcgccgucuacaucuacaacugcaacuccugggugcgcgaguacaccaaguaccacgagcggcugcucaccgggcugaagggcagcaagcgccugguguucaucgacugccccgggaagcucgccgagcacaucgagcacgagcagcagaagcugcccgcggccacccuggcccucgaggaggaccugaaggucuuccacaacgcccugaagcucgcgcacaaggacacgaagguguccaucaaggugggcagcaccgccguccaggugaccuccgccgagcggaccaaggugcugggccagagcgucuuccugaacgacaucuacuacgccuccgagaucgaggagaucugccucguggacgagaaccaguucacgcugaccaucgccaaccaggggacgccccucaccuucaugcaccaggagugcgaggcgaucgugcagagcaucauccacauccgcacgcggugggagcucucccagccggacagcaucccccagcacaccaagauccgccccaaggacguccccggcacccugcugaacaucgcccuccugaaccugggguccagcgacccgagccuccgguccgccgccuacaaccugcugugcgcccugaccugcacguucaaccugaagaucgagggccagcugcucgagaccagcgggcugugcauccccgcgaacaacacccuguucaucguguccaucagcaagacccucgccgccaacgagccccaccugacgcuggaguuccucgaggagugcaucuccggcuucagcaaguccagcaucgagcugaagcaccugugccucgaguacaugacccccuggcuguccaaccuggugcgcuucugcaagcacaacgacgacgccaagcggcagcgcgucaccgccauccucgacaagcugaucaccaugacgaucaacgagaagcagauguacccgagcauccaggcgaagaucuggggcucccuggggcagaucaccgaccuccuggacguggugcuggacagcuucaucaagaccuccgccaccggcgggcucggcagcaucaaggccgaggucauggccgacacggcgguggcccuggccuccgggaacgugaagcuggucagcuccaaggugaucggccggaugugcaagaucaucgacaagaccugccugagccccacccccacccucgagcagcaccugaugugggacgacaucgccauccuggcccgcuacaugcucaugcuguccuucaacaacagccuggacguggcggcccaccuccccuaccuguuccacgucgugacguuccuggucgccaccggcccgcucagccugcgggccuccacccacgggcuggugaucaacaucauccacagccucugcacgugcucccagcugcacuucagcgaggagaccaagcagguccugcgccucucccugacggaguucagccugcccaaguucuaccuccuguucggcaucuccaaggucaagagcgccgcggugaucgccuuccgcuccagcuaccgggaccgcuccuucagccccggguccuacgagcgggagaccuucgcccugaccagccucgagaccgugacggaggcccugcuggagaucauggaggccugcaugcgcgacaucccgaccugcaaguggcucgaccaguggaccgagcuggcgcagcgguucgccuuccaguacaacccgucccugcagccccgcgcccucgucguguucggcugcaucagcaagcgggugucccacgggcagaucaagcagaucauccgcauccugagcaaggcccuggagagcugccucaagggccccgacaccuacaacucccagguccugaucgaggccacggugaucgcgcugaccaagcuccagccccugcugaacaaggacagcccgcuccacaaggcccuguucuggguggccgucgccgugcugcagcucgacgaggugaaccuguacuccgcgggcaccgcccugcucgagcagaaccugcacacccuggacagccuccggaucuucaacgacaagucccccgaggaggucuucauggccauccgcaacccccuggaguggcacugcaagcagauggaccacuucguggggcugaacuucaacagcaacuucaacuucgcccucgugggccaccuccugaagggguaccggcacccgucccccgccaucgucgcgcgcacggugcggauccuccacacccugcugacccucgugaacaagcaccgcaacugcgacaaguucgaggucaacacccagagcguggccuaccuggccgcccugcucacgguguccgaggagguccggagccgcugcucccugaagcaccggaagucccugcuccugaccgacaucuccauggagaacgugcccauggacaccuaccccauccaccacggcgacccgagcuaccgcacccugaaggagacgcagcccugguccagccccaagggcuccgagggguaccucgccgcgaccuaccccaccgugggccagaccagcccgcgggcccgcaaguccaugagccuggacauggggcagcccagccaggccaacacgaagaagcugcucggcacccggaaguccuucgaccaccugaucagcgacaccaaggcccccaagcgccaggagauggaguccgggaucaccacgcccccgaagaugcgccgggucgccgagaccgacuacgagauggagacccagcgcaucagcuccagccagcagcacccccaccuccggaagguguccgugagcgaguccaacguccuccuggacgaggaggugcugaccgaccccaagauccaggcgcuccugcugacggugcucgccacccuggucaaguacaccaccgacgaguucgaccagcgcauccuguacgaguaccucgccgaggccagcgugguguuccccaaggucuucccgguggugcacaaccugcuggacuccaagaucaacacgcuccugagccugugccaggaccccaaccuccugaaccccauccacggcaucguccaguccgugguguaccacgaggagagcccgccccaguaccagaccuccuaccugcagagcuucggcuucaacgggcucuggcgguucgcgggccccuucuccaagcagacccagauccccgacuacgccgagcugaucgucaaguuccuggacgcccucaucgacaccuaccugcccgggaucgacgaggagacgagcgaggagucccugcucacccccaccagccccuacccgcccgcccugcagagccagcuguccaucaccgccaaccucaaccugagcaacuccaugaccagccuggcgacgucccagcacagcccgggcaucgacaaggagaacguggagcugucccccaccaccgggcacugcaacagcggccgcacccggcacggcuccgccagccaggugcagaagcagcgcuccgccgggagcuucaagcggaacuccaucaagaagaucgucuga

SEQ ID NO: 33541 - RNA, 1788 nt, Artificial Sequence
  derived and/or modified sequence opt1 from NF2__Homo_sapiens__NP_000259
auggccggcgccaucgcgagccgcauguccuucagcucccugaagcggaagcagcccaagaccuucaccgugcgcaucgucacgauggacgccgagauggaguucaacugcgagaugaaguggaaggggaaggaccucuucgaccuggugugccggacccugggccuccgcgagaccugguucuucgggcugcaguacaccaucaaggacacgguggccuggcugaagauggacaagaagguccucgaccacgacgugagcaaggaggagcccgugaccuuccacuuccuggccaaguucuaccccgagaacgccgaggaggagcugguccaggagaucacccagcaccucuucuuccuccaggugaagaagcagauccuggacgagaagaucuacugcccgcccgaggcguccgugcugcuggccagcuacgccguccaggccaaguacggcgacuacgaccccuccgugcacaagcggggguuccuggcgcaggaggagcuccugcccaagcgcgugaucaaccuguaccagaugacccccgagaugugggaggagcggaucacggccugguacgccgagcaccgcggccgggcccgcgacgaggccgagauggaguaccucaagaucgcgcaggaccuggagauguacggcgucaacuacuucgccauccggaacaagaaggggaccgagcugcuccugggcguggacgcccuggggcuccacaucuacgaccccgagaaccgccugaccccgaagaucagcuuccccuggaacgagauccggaacaucuccuacagcgacaaggaguucaccaucaagccccuggacaagaagaucgacguguucaaguucaacuccagcaagcuccgcgucaacaagcugauccugcagcucugcaucggcaaccacgaccuguucaugcggcgccggaaggccgacucccuggaggugcagcagaugaaggcccaggcgcgcgaggagaaggcccggaagcagauggagcgccagcggcucgcccgcgagaagcagaugcgcgaggaggccgagcggacgcgcgacgagcuggagcggcgccugcuccagaugaaggaggaggccaccauggcgaacgaggcccugaugcggagcgaggagaccgccgaccugcucgccgagaaggcccagaucaccgaggaggaggcgaagcugcuggcccagaaggccgccgaggcggagcaggagaugcagcgcaucaaggccacggccauccggaccgaggaggagaagcgccucauggagcagaaggugcuggaggccgagguccuggcccucaagauggcggaggaguccgagcggcgcgccaaggaggccgaccagcugaagcaggaccugcaggaggcccgggaggccgagcgccgggcgaagcagaagcuccuggagaucgccaccaagcccaccuacccgcccaugaaccccauccccgccccgcugccgcccgacauccccagcuucaaccugaucggggacucccucagcuucgacuucaaggacacggacaugaagcgccuguccauggagaucgagaaggagaagguggaguacauggagaaguccaagcaccuccaggagcagcugaacgagcugaagaccgagaucgaggcccugaagcucaaggagcgggagaccgcccuggacauccugcacaacgagaacagcgaccgcggcggcagcagcaagcacaacaccaucaagaagcucacgcugcaguccgccaagagccggguggcguucuucgaggagcuguga

SEQ ID NO: 33542 - RNA, 813 nt, Artificial Sequence
  derived and/or modified sequence opt1 from NFAM1__Homo_sapiens__NP_666017
auggagaaccagcccgugcgcuggcgggcccugccgggccucccccgcccgcccgggcugcccgccgcgcccuggcugcuccugggcguccugcuccugcccgggacccugcggcucgccggcgggcagagcgugacccacacgggccugcccaucauggccucccuggccaacaccgccaucagcuucuccugccgcaucaccuacccguacacgccccaguucaagguguucaccgucagcuacuuccacgaggaccuccagggccagcggucccccaagaagcccaccaacugccacccggggcugggcaccgagaaccagagccacacccuggacugccaggugacgcucgugcugcccggggcguccgccaccggcaccuacuacugcagcguccacuggccccacuccaccgugcgcgggagcggcacguucauccuggugcgggacgccggcuaccgcgagcccccgcagagcccccagaagcuccugcuguucggguucaccggccuccuguccguccuguccgugguggggaccgcccuccugcuguggaacaagaagcggaugcgcggccccggcaaggaccccacccggaagugcccggacccccgcagcgcguccagccccaagcagcaccccuccgagagcgucuacacggcccuccagcggcgcgagaccgagguguacgccugcaucgagaacgaggacggguccagcccgaccgccaagcagagcccccugucccaggagcggccccaccgcuucgaggacgacggcgagcugaaccucguguacgagaaccuguga

SEQ ID NO: 33543 - RNA, 3723 nt, Artificial Sequence
  derived and/or modified sequence opt1 from NFASC__Homo_sapiens__NP_001005388
auggcccgccagcccccgccccccugggugcacgccgcguuccugcucugccugcugagccucggcggggccaucgagauccccauggacccguccauccagaacgagcugacccagccccccaccaucacgaagcagagcgccaaggaccacaucgucgacccccgggacaacauccugaucgagugcgaggccaagggcaacccggcccccuccuuccacuggacccgcaacagccgguucuucaacaucgcgaaggacccccgcguguccaugcggcgccggagcgggacccucgugaucgacuuccgcuccggcgggcggcccgaggaguacgagggcgaguaccagugcuucgcccgcaacaaguucggcaccgcccugagcaaccggauccgccugcaggucuccaagagcccgcucuggcccaaggagaaccuggaccccguggugguccaggagggggccccccugacgcuccagugcaacccgccccccggccugcccuccccggugaucuucuggaugagcuccagcauggagcccaucacccaggacaagcgggugucccaggggcacaacggcgaccuguacuucagcaacgucaugcuccaggacaugcagaccgacuacuccugcaacgcgcgcuuccacuucacccacacgauccagcagaagaaccccuucacccugaaggugcugaccacccgggggguggccgagcgcacgcccagcuucauguacccgcagggcaccgccuccagccagaugguccuccggggcauggaccugcugcucgagugcaucgccagcggggugcccacccccgacaucgccugguacaagaagggcggggaccugcccuccgacaaggcgaaguucgagaacuucaacaaggcccugcgcaucaccaacgugagcgaggaggacuccggcgaguacuucugccucgccagcaacaagaugggcuccauccggcacacgaucagcguccgcgugaaggccgccccguacuggcuggacgagcccaagaaccugauccucgcgcccggggaggacggccggcuggugugccgcgccaacgggaacccgaagcccaccguccaguggauggugaacggcgagccccugcaguccgcccccccgaaccccaaccgcgagguggccggggacaccaucaucuuccgggacacccagaucagcucccgcgccgucuaccagugcaacacgagcaacgagcacggcuaccuccuggcgaacgccuucguguccgugcuggacguccccccccggaugcucagcccgcgcaaccagcugauccgggugauccuguacaaccgcacccggcucgacugccccuucuucggcucccccauccccacccugcgcugguucaagaacgggcagggcagcaaccuggacgggggcaacuaccacgucuacgagaacgggucccucgagaucaagaugauccggaaggaggaccagggcaucuacaccugcguggccacgaacauccugggcaaggccgagaaccaggugcgccuggaggucaaggacccgacccggaucuaccgcaugcccgaggaccagguggcccggcgcgggaccaccgugcagcucgagugccgggucaagcacgaccccagccugaagcugacgguguccuggcucaaggacgacgagccccuguacaucggcaaccgcaugaagaaggaggacgacagccugaccaucuucgggguggcggagcgggaccagggcuccuacaccugcgucgccagcaccgagcucgaccaggaccuggccaaggccuaccugacggugcuggcggaccaggccaccccgaccaaccgccucgccgcccugcccaaggggcggcccgaccgcccccgcgaccuggagcucaccgaccuggccgagcggagcgugcgccugacguggaucccgggcgacgcgaacaacucccccaucaccgacuacgucgugcaguucgaggaggaccaguuccagcccggcguguggcacgaccacagcaaguaccccggguccgucaacagcgccgugcuccggcuguccccguacgugaacuaccaguuccgcgucaucgccaucaacgaggugggcagcucccaccccagccugcccuccgagcgguaccgcaccagcggggccccgcccgaguccaaccccggcgacgugaagggcgaggggacccggaagaacaacauggagaucaccuggacgcccaugaacgccaccagcgcguucggcccgaaccuccgcuacaucgucaaguggcggcgccgggagacccgcgaggccuggaacaacgugaccgugugggggucccgguacgucgugggccagacgcccguguacguccccuacgagauccgcgugcaggccgagaacgacuucgggaagggccccgagccggagagcgugaucggcuacuccggggaggaccugcccagcgccccccggcgcuuccggguccgccagcccaaccuggagaccaucaaccucgagugggaccacccggagcaccccaacggcaucaugaucggguacacccugaaguacguggccuucaacggcaccaagguggggaagcagaucgucgagaacuucucccccaaccagacgaaguucaccgugcagcggaccgaccccgugagccgcuaccgguucacccugagcgcgcgcacgcaggucggcuccggcgaggccgugaccgaggagagcccggccccccccaacgaggccacccccaccgcggccccgcccacgcucccccccaccaccgugggggccaccggcgccgucuccagcacggacgccaccgcgaucgccgccaccaccgaggccacgaccgugccgaucauccccaccguggcccccaccacgaucgcgaccaccaccacggucgccaccaccaccacgaccaccgccgccgccaccaccacgaccgagucccccccgaccaccacgagcgggaccaagauccacgaguccgcgcccgacgagcagagcaucuggaacgugaccgugcugcccaacuccaagugggccaacaucaccuggaagcacaacuucggcccggggacggacuucgucguggaguacaucgacagcaaccacaccaagaagaccgugcccgucaaggcccaggcccagcccauccagcugaccgaccucuaccccggcaugacguacacccugcgcguguacucccgggacaacgagggcaucagcuccaccgugaucaccuucaugacgagcaccgcguacaccaacaaccaggccgacaucgccacccaggggugguucaucggccugaugugcgccaucgcccuccugguccugauccuccugaucgugugcuucaucaagcgcucccgggggggcaaguacccgguccgcgagaagaaggacgugccccuggggcccgaggaccccaaggaggaggacggcagcuucgacuacuccgacgaggacaacaagccgcuccagggcagccagacgucccuggacgggaccaucaagcagcaggagagcgacgacagccugguggacuacggcgaggggggcgagggccaguucaacgaggacggguccuucaucggccaguacaccgucaagaaggacaaggaggagaccgaggggaacgagagcuccgaggcgacgagccccgugaacgccaucuacucccucgccuga

SEQ ID NO: 33544 - RNA, 4647 nt, Artificial Sequence
  derived and/or modified sequence opt1 from NFAT5__Homo_sapiens__NP_001106649
augcccagcgacuucaucucccugcucagcgccgaccuggaccuggaguccccgaagagccucuacucccgcgacagccugaagcugcaccccucccagaacuuccaccgggccggccuccuggaggagagcguguacgaccugcuccccaaggagcugcagcugcccccgucccgcgagaccagcgucgcguccaugagccagaccuccgggggcgaggccgggagccccccccccgccgugguggccgccgacgcguccagcgccccguccagcuccagcaugggcggggccugcagcuccuucacgaccagcuccagccccaccaucuacuccaccagcgucacggacuccaaggccaugcagguggagagcugcuccagcgcggugggcgucuccaaccggggcgugagcgagaagcagcucaccuccaacaccgugcagcagcaccccagcacccccaagcgccacacgguccuguacaucuccccgccccccgaggaccugcucgacaacagccggauguccugccaggacgaggggugcggccuggagagcgagcaguccugcagcauguggauggaggacagccccuccaacuucagcaacauguccaccagcuccuacaacgacaacaccgaggugccgcgcaagagccggaagcgcaaccccaagcagcggcccggggugaagcgccgggacugcgaggaguccaacauggacaucuucgacgccgacagcgccaaggccccccacuacguccugucccagcucaccacggacaacaagggcaacagcaaggccgggaacggcacccuggagaaccagaagggcaccggggugaagaaguccccgaugcugugcggccaguaccccgugaagagcgaggggaaggagcucaagaucgucgugcagcccgagacccagcaccgcgcgcgguaccugacggagggcucccgcggcagcgugaaggaccggacccagcagggguuccccaccgucaagcuggagggccacaacgagccgguggugcuccaggucuucguggggaacgacuccggccgcgugaagccccacggguucuaccaggccugccgggucaccggccgcaacacgacccccugcaaggagguggacaucgagggcaccaccgucaucgagguggggcuggaccccagcaacaacaugacgcuggccguggacugcgucggcauccucaagcugcggaacgccgacguggaggcccgcaucgggaucgcgggcuccaagaagaagagcacccgggcccgccugguguuccgcgucaacaucaugcggaaggacgggagcacccucacccugcagacgccguccagccccauccugugcacccagcccgccggcgugccggagauccucaagaagucccugcacagcugcuccgugaagggcgaggaggaggucuuccugaucgggaagaacuuccucaagggcaccaaggugaucuuccaggagaacgugagcgacgagaacuccuggaagagcgaggccgagaucgacauggagcuguuccaccagaaccaccugaucgucaaggugccccccuaccacgaccagcacaucacccuccccguguccgucgggaucuacguggugacgaacgccggccgcagccacgacguccagccguucaccuacacccccgaccccgcggccggggcccugaacgugaacgugaagaaggagaucuccagccccgcccggccgugcuccuucgaggaggccaugaaggcgaugaagaccacgggcugcaaccuggacaaggucaacaucauccccaacgcccucaugaccccccugauccccagcuccaugaucaagagcgaggacgugaccccgauggaggugaccgccgagaagcgcuccagcaccaucuucaagacgaccaaguccgucggcagcacccagcagacccuggagaacaucagcaacaucgccgggaacggcuccuucagcucccccagcuccagccaccuccccuccgagaacgagaagcagcagcagauccagcccaaggcguacaacccggagacgcugaccaccauccagacccaggacaucagccagcccgggacguuccccgccguguccgccagcucccagcugcccaacagcgacgcccuccugcagcaggccacccaguuccagacccgggagacccagucccgcgagauccugcagagcgacggcacgguggucaaccugucccagcucaccgaggcgagccagcagcagcagcaguccccgcugcaggagcaggcccagacccugcagcagcagaucagcuccaacaucuuccccagccccaacagcgugucccagcuccagaacaccauccagcagcugcaggccggcagcuucacgggguccaccgccagcggcuccagcggguccguggaccugguccagcaggugcucgaggcccagcagcagcugagcuccgugcuguucagcgcgcccgacggcaacgagaacguccaggagcagcucuccgccgacaucuuccagcaggugagccagauccaguccggggugagcccgggcauguucuccagcaccgagcccaccguccacacgcggcccgacaaccugcugccgggccgcgccgaguccgugcacccccagagcgagaacacccucuccaaccagcagcagcagcagcagcagcagcagcaggugauggagagcagcgccgccauggucauggagaugcagcaguccaucugccaggcggccgcccagauccagagcgagcuguuccccuccaccgccagcgcgaacgggaaccugcagcagucccccguguaccagcagaccagccacaugauguccgcccucagcacgaacgaggacaugcagaugcagugcgagcuguucuccagcccgcccgccguguccggcaacgagaccagcaccaccacgacccagcaggucgccacccccgggaccacgauguuccagaccuccagcuccggcgacggggaggagaccggcacccaggccaagcagauccagaacagcguguuccagacgauggugcagaugcagcacuccggcgacaaccagccccaggucaaccuguucagcuccaccaagagcaugaugagcgugcagaacuccgggacccagcagcagggcaacgggcucuuccagcagggcaacgagaugaugagccugcaguccgggaacuuccugcagcagagcucccacagccaggcgcagcucuuccacccgcagaaccccaucgccgacgcccagaaccugucccaggagacccagggcagccuguuccacucccccaaccccaucgugcacagccagaccuccacgaccagcuccgagcagaugcagccgcccauguuccacagccaguccaccaucgccguccuccagggcagcuccgugccccaggaccagcagagcaccaacaucuuccugucccagagccccaugaacaaccugcagacgaacaccguggcccaggaggcguucuucgccgccccgaacagcaucuccccccuccagagcaccuccaacagcgagcagcaggccgccuuccagcagcaggcgcccaucucccacauccagacccccaugcugagccaggagcaggcccagccgccccagcaggggcuguuccagccccaggucgcccucggcucccugcccccgaaccccaugccccagagccagcaggggacgauguuccagucccagcacagcaucguggccaugcaguccaacagccccucccaggagcagcagcagcagcagcagcagcagcagcagcagcagcagcagcagcagcagagcauccuguucuccaaccagaacaccauggcgaccauggccagcccgaagcagccccccccgaacaugaucuucaaccccaaccagaaccccauggccaaccaggagcagcagaaccaguccaucuuccaccagcagagcaacauggcccccaugaaccaggagcagcagccgaugcaguuccagagccaguccaccgucagcucccuccagaaccccggccccacgcagagcgaguccagccagaccccccuguuccacuccagcccgcagauccagcuggugcaggggucccccagcucccaggagcagcaggugacccucuuccugagccccgccuccaugagcgcgcugcagaccuccaucaaccagcaggacaugcagcagagcccccucuacuccccgcagaacaacaugcccggcauccagggcgccacgagcuccccccagccccaggccacccuguuccacaacaccgccgggggcaccaugaaccagcugcagaacagcccggggagcucccagcagacgagcggcauguuccucuucggcauccagaacaacugcucccagcugcugaccagcgggcccgccacccuccccgaccagcugauggcgaucucccagcccggccagccgcagaacgaggggcagccccccgucaccacgcugcucagccagcagaugcccgagaacuccccgcuggccagcuccaucaacaccaaccagaacaucgagaagaucgaccugcucgugagccugcagaaccagggcaacaaccugaccggguccuucuga

SEQ ID NO: 33545 - RNA, 2832 nt, Artificial Sequence
  derived and/or modified sequence opt1 from NFATC1__Homo_sapiens__NP_001265598
augcccagcaccuccuucccggugcccagcaaguucccccugggccccgccgccgcggucuucgggcgcggcgagacccucgggccggcgccccgggccggcgggacgaugaaguccgccgaggaggagcacuacggcuacgccagcuccaacgugagccccgcccugccccugccgaccgcccacuccacccuccccgcccccugccacaaccugcagaccagcacgcccggcaucaucccgcccgccgaccaccccuccggguacggcgcggcccuggacgggggccccgccggguacuuccucagcuccggccacacccgcccggacggcgcccccgcccuggagagcccccggaucgagaucaccuccugccuggggcucuaccacaacaacaaccaguucuuccacgacguggaggucgaggacgugcugcccagcuccaagcgcagcccguccaccgcgacgcugagccuccccucccuggaggccuaccgggaccccagcugccugagccccgccuccagccucuccagccgcuccugcaacagcgaggccuccagcuacgaguccaacuacagcuacccguacgccagcccccagaccucccccuggcagucccccugcgugagcccgaagaccaccgaccccgaggagggcuucccccgggggcugggcgcgugcacgcugcucggcuccccgcgccacagccccuccaccagcccccgggccuccgucaccgaggagagcuggcugggggcccgcagcucccggcccgccagcccgugcaacaagcgcaaguacucccugaacggccggcagccgcccuacagcccccaccacucccccacccccagcccccacgggagcccccgcguguccgugacggacgacuccuggcucggcaacaccacccaguacaccagcuccgccaucgucgcggccaucaacgcccugacgaccgacagcucccuggaccucggggacggcgugccggucaagagccggaagaccacccuggagcagccgcccuccguggcccugaagguggagcccgugggcgaggaccucgggagcccgcccccgcccgccgacuucgcgcccgaggacuacuccagcuuccagcacauccgcaagggcggguucugcgaccaguaccuggccgucccccagcaccccuaccagugggccaagcccaagccccugagccccacguccuacaugagccccacccucccggcccuggacuggcagcugcccucccacagcggccccuacgagcuccggaucgaggugcagcccaagucccaccaccgcgcgcacuacgagaccgaggggagccggggcgccgugaaggccuccgccggcgggcacccgaucguccagcugcacggcuaccuggagaacgagccccucaugcugcagcuguucaucgggaccgccgacgaccgccuccugcggccccacgcguucuaccaggugcaccgcaucacgggcaagaccgugagcaccaccucccacgaggccauccugagcaacacgaagguccucgagaucccccugcugccggagaacuccaugcgcgccgugaucgacugcgccgggauccucaagcugcggaacagcgacaucgagcugcgcaagggcgagaccgacaucggccggaagaacacccgcgugcggcucgucuuccgcgugcacgucccccagcccuccgggcggacccugagccuccagguggccuccaaccccaucgagugcagccagcgcuccgcgcaggagcugccgcugguggagaagcagagcacggacuccuaccccgucgugggcgggaagaagauggugcugagcggccacaacuuccugcaggacagcaaggucaucuucguggagaaggcccccgacggccaccacgugugggagauggaggccaagaccgaccgggaccucugcaagcccaacucccuggucguggagaucccgcccuuccgcaaccagcggaucaccagccccgugcacgucuccuucuacgugugcaacgggaagcgcaagcggagccaguaccagcgcuucaccuaccugcccgccaacgugccgaucaucaagaccgagcccacggacgacuacgagcccgccccgaccugcggccccgucucccaggggcucagcccccugccccggcccuacuacucccagcagcuggcgaugccgcccgaccccagcuccugccucguggccggcuucccgcccugcccccagcgcagcacccugaugcccgccgccccgggggugucccccaagcugcacgaccucagccccgcggccuacaccaagggcgucgccucccccggccacugccaccuggggcugccgcagcccgccggcgaggcccccgcggugcaggacgugccccggccggucgccacgcaccccgggagccccggccagcccccgcccgcccuccugccccagcaggucuccgcgcccccgagcuccagcugcccgcccgggcuggagcacucccucugccccagcagccccuccccgccccugccgcccgccacccaggagcccacgugccugcagcccugcagccccgccugcccgcccgccaccggccgcccccagcaccuccccuccaccgugcggcgcgacgagagccccaccgccggcccccgccugcugcccgaggugcacgaggacggguccccgaaccucgcccccauccccgugaccgugaagcgggagcccgaggagcuggaccagcuguaccucgacgacgucaacgagaucauccgcaacgaccugagcuccaccagcacgcacuccuga

SEQ ID NO: 33546 - RNA, 2706 nt, Artificial Sequence
  derived and/or modified sequence opt1 from NFATC2__Homo_sapiens__NP_001129493
augcagcgcgaggccgccuuccggcugggccacugccacccccuccgcaucauggggagcguggaccaggaggagcccaacgcgcacaaggucgccuccccgcccagcggccccgccuaccccgacgacgugcuggacuacgggcugaagcccuacagcccccucgccucccuguccggcgagcccccggggcgguucggcgagcccgaccgcgugggcccccagaaguuccugagcgccgcgaagcccgccggggccuccggccucagcccgcggaucgagaucacccccucccacgagcugauccaggccgucgggccccugcgcaugcgggacgcgggccuccugguggagcagcccccgcuggccgggguggccgccagcccccgcuucacccuccccguccccggcuucgagggcuaccgggagccgcugugccugucccccgccagcuccgggagcuccgcgagcuucaucuccgacacguucagccccuacaccucccccugcgugagcccgaacaacggcgggcccgacgaccucugcccccaguuccagaacauccccgcccacuacagcccgcgcaccucccccaucaugagcccccggaccucccuggccgaggacagcugccugggccgccacuccccggugccccggcccgccagccgcuccagcucccccggcgccaagcggcgccacagcugcgcggaggcccucgucgcccugccgcccggggccagcccccagcggucccgcucccccagcccgcagcccuccagccacguggcgccccaggaccacggcucccccgccggguacccgcccguggccggcagcgccgucaucauggacgcccugaacucccucgccacggacagccccugcgggaucccgcccaagauguggaagaccagccccgaccccucccccgugagcgcggccccguccaaggccggccugccccggcacaucuaccccgccguggaguuccugggccccugcgagcagggggagcgccggaacagcgcgccggaguccauccuccuggucccgcccaccuggcccaagccccuggugcccgccauccccaucugcagcaucccggugaccgccucccucccgccccuggaguggccccugagcucccagagcggcuccuacgagcuccgcaucgagguccagcccaagccccaccaccgcgcccacuacgagacggaggggagccggggcgccgugaaggcgcccaccgggggccaccccgugguccagcugcacggcuacauggagaacaagccgcuggggcuccagaucuucaucggcaccgccgacgagcgcauccugaagccccacgccuucuaccaggugcaccggaucaccgggaagacggugaccaccaccuccuacgagaagaucgucggcaacacgaaggugcuggagaucccccucgagcccaagaacaacaugcgcgccaccaucgacugcgccgggauccugaagcugcggaacgcggacaucgagcuccgcaagggcgagaccgacaucggccggaagaacacccgcguccggcugguguuccgcgugcacaucccggagagcuccgggcggaucgucagccugcagacggccuccaaccccaucgagugcagccagcgcagcgcccacgagcuccccaugguggagcggcaggacaccgacuccugccugguguacggcgggcagcagaugauccugaccggccagaacuucaccagcgaguccaaggucguguucacggagaagaccaccgacggccagcagaucugggagauggaggccaccguggacaaggacaagagccagcccaacaugcuguucgucgagaucccggaguaccgcaacaagcacauccggacgcccgugaaggugaacuucuacgucaucaacgggaagcgcaagcggucccagccccagcacuucaccuaccaccccgugccggccaucaagaccgagcccaccgacgaguacgaccccacgcucaucugcagccccacccacggcgggcugggcucccagccguacuacccccagcaccccaugguggcggagagcccguccugccucgucgccaccauggcccccugccagcaguuccgcaccgggcugagcucccccgacgcccgguaccagcagcagaaccccgcggccgugcuguaccagcgcagcaagucccugagcccgucccuccugggcuaccagcagcccgcccugauggccgcgccccucagccuggccgacgcccaccgcuccgugcugguccacgccggcagccaggggcaguccagcgcccuccugcaccccagcccgacgaaccagcaggccucccccgugauccacuacagccccaccaaccagcagcugcggugcggcucccaccaggaguuccagcacaucauguacugcgagaacuucgcgcccgggaccacccgcccgggcccgccgcccgugagccaggggcagcggcucucccccggcagcuaccccaccgucauccagcagcagaacgccacgucccagcgcgccgccaagaacggcccgcccgugagcgaccagaaggaggugcugcccgccggggucaccaucaagcaggagcagaaccuggaccagaccuaccucgacgacgagcugaucgacacccaccuguccuggauccagaacauccucuga

SEQ ID NO: 33547 - RNA, 3207 nt, Artificial Sequence
  derived and/or modified sequence opt1 from NFATC3__Homo_sapiens__NP_004546
augaccaccgccaacugcggcgcccacgacgagcuggacuucaagcucguguucggggaggacggcgcgcccgccccgcccccgcccgggagccgccccgccgaccuggagcccgacgacugcgccuccaucuacaucuucaacgucgacccgccgcccagcacgcugaccacgccccucugccugccccaccacggccugcccucccacagcuccgugcucagccccuccuuccagcugcagagccacaagaacuacgaggggaccugcgagauccccgaguccaaguacagcccccugggcggccccaagccguucgagugccccuccauccagaucaccagcaucucccccaacugccaccaggagcucgacgcccacgaggacgaccugcagaucaacgaccccgagcgggaguuccuggagcgcccgagccgggaccaccucuaccugccccuggagcccuccuaccgcgagagcucccucagccccuccccggcgagcagcaucuccagccgguccugguucagcgacgccuccagcugcgagucccugagccacaucuacgacgacguggacuccgagcugaacgaggccgccgcgcgcuucacccucgggagcccccugaccucccccggcgggagccccggcgggugcccgggcgaggagaccuggcaccagcaguacggccuggggcacucccucagcccccggcagucccccugccacagcccgcgcuccagcgucacggacgagaacuggcugagcccccggcccgccuccggccccagcucccgcccgaccagccccugcgggaagcggcgccacuccagcgccgaggugugcuacgccggcucccugagcccccaccacucccccgugccgagccccggccacagcccccggggguccgucaccgaggacaccuggcucaacgccuccgugcacggcgggagcggccuggggcccgcgguguucccguuccaguacugcgucgagacggacaucccccugaagacccgcaagaccuccgaggaccaggccgccauccuccccggcaagcuggagcugugcagcgacgaccagggcucccucagccccgcccgggagaccuccaucgacgacgggcugggcagccaguacccgcugaagaaggacagcugcggggaccaguuccucuccgugcccagccccuucacgugguccaagcccaagccgggccacacccccaucuuccgcaccagcucccugccgccccuggacuggccccuccccgcccacuucgggcagugcgagcugaagaucgaggugcagcccaagacccaccaccgggcgcacuacgagacggagggcagccgcggcgccgucaaggccuccaccgggggccacccgguggugaagcugcucggguacaacgagaagcccaucaaccugcagauguucaucggcaccgccgacgaccgguaccugcgcccccacgccuucuaccagguccaccggaucaccgggaagacgguggcgaccgccagccaggagaucaucaucgccuccaccaaggugcucgagaucccccugcugccggagaacaacaugagcgccuccaucgacugcgccggcauccucaagcugcgcaacagcgacaucgagcugcgcaagggcgagaccgacaucgggcggaagaacacgcgcguccggcucguguuccgcgugcacaucccccagcccuccggcaagguccugagccugcagaucgcguccauccccguggagugcagccagcgguccgcccaggagcugccgcacaucgagaaguacagcaucaacuccugcagcgugaacgggggccacgagauggucgugaccggcagcaacuuccuccccgaguccaagaucaucuuccuggagaaggggcaggacggccgcccccagugggaggucgaggggaagaucauccgggagaagugccagggcgcccacaucgugcuggaggugcccccguaccacaaccccgccgucaccgcggccguccaggugcacuucuaccucugcaacgggaagcgcaagaagucccagagccagcgguucaccuacacgcccgugcugaugaagcaggagcaccgcgaggagaucgaccugagcuccgugcccagccucccggugccccaccccgcccagacccagcggcccuccagcgacuccggcugcagccacgacuccguccugagcggccagcgcucccugaucugcagcaucccgcagaccuacgccuccauggugaccagcucccaccucccccagcugcagugccgggacgagagcguguccaaggagcagcacaugauccccagccccaucguccaccagccguuccaggugacgcccaccccgcccguggggagcuccuaccagcccaugcagaccaacgucguguacaacggcccgaccugccugcccaucaacgccgcgagcucccaggaguucgacagcguccucuuccagcaggacgccacccuguccgggcuggugaaccucggcugccagccccugagcuccauccccuuccacagcuccaacagcggguccacgggccaccuccuggcccacacgccccacagcgugcacacccugccccaccuccaguccaugggcuaccacugcagcaacaccgggcagcgcucccugagcuccccgguggccgaccagaucaccggccagcccagcucccagcugcagcccaucaccuacgggcccagccacagcggcuccgccaccaccgcgagcccggccgccucccacccccuggccagcagcccccucuccgggcccccgagcccccagcugcagcccaugcccuaccaguccccguccagcggcacggccuccagccccucccccgcgacccggaugcacagcggccagcacuccacccaggcccagagcaccgggcagggcgggcuguccgcccccagcucccucaucugccacagccugugcgacccggccagcuucccgcccgacggcgcgacggucuccaucaagcccgagcccgaggaccgcgagcccaacuucgccaccaucgggcugcaggacaucacccucgacgacgaccaguucaucagcgaccuggagcaccagcccuccggcagcgccgagaaguggcccaaccacuccgugcugagcugcccggcccccuucuggcggaucuga

SEQ ID NO: 33548 - RNA, 2895 nt, Artificial Sequence
  derived and/or modified sequence opt1 from NFATC4__Homo_sapiens__NP_001129494
augaucaccacccugcccagccuccugccggccucccuggccagcaucucccaccgcgugacgaaccuccccagcaacucccugagccacaaccccggccuguccaagcccgacuucccggggaacagcucccccggccuccccagcuccagcucccccgggcgggaccugggcgcgccggccgggagcaugggcgccgccuccugcgaggacgaggagcuggaguucaagcucgucuucggcgaggagaaggaggcccccccccugggggcgggcgggcugggcgaggagcucgacagcgaggacgcccccccgugcugccgccuggcccugggggagcccccccccuacggcgccgcgccgaucggcaucccccggccccccccgccccgccccgggaugcacucccccccgccccggcccgcccccagcccgggcaccugggagucccagcccgcccgcagcgugcggcucgggggccccggcgggggcgccgggggcgccgggggcggccgcgugcuggagugcccgagcauccggaucaccuccaucagccccacccccgagcccccggcggcccuggaggacaaccccgacgccuggggggacggcuccccccgcgacuaccccccgcccgagggguucggcggguaccgggaggccggcggccaggggggcggggccuucuucagccccucccccggcagcuccagccucuccagcugguccuucuucagcgacgcguccgacgaggccgcccuguacgccgccugcgacgaggucgagagcgagcugaacgaggcggccucccgcuucgggcucggcagcccgcugcccuccccccgggccagcccccgcccguggacgcccgaggaccccuggucccuguacggccccagcccggggggccgggggcccgaggacagcuggcuccugcuguccgcccccggccccaccccggccagcccccgccccgcguccccgugcggcaagcggcgcuacagcuccagcgggacccccuccagcgccucccccgcccucagccggcgcggcucccugggggaggagggcagcgagcccccgcccccccccccgcugccccucgcccgggaccccgggucccccggcccguucgacuacgugggcgcgccccccgccgagagcaucccccagaagacccgccgcacguccagcgagcaggccguggcccugccgcgguccgaggagcccgccagcugcaacgggaagcugccccucggcgcggaggagagcgucgcccccccggggggcucccgcaaggagguggccgggauggacuaccuggccgugcccagcccccuggccugguccaaggcgcggaucggcggccacagccccaucuuccgcaccuccgcccucccgccccuggacuggccccugcccagccaguacgagcagcucgagcugcggaucgagguccagccgcgcgcccaccaccgggcccacuacgagaccgaggggucccgcggcgccgugaaggcggcccccgggggccaccccguggucaagcugcucggguacagcgagaagccgcugacccugcagauguucaucggcacggccgacgagcggaaccuccgcccccacgccuucuaccaggugcaccggaucaccggcaagaugguggcgaccgccuccuacgaggccgucgugagcgggaccaaggugcuggagaugacgcugcuccccgagaacaacauggccgccaacaucgacugcgcgggcauccugaagcugcgcaacuccgacaucgagcugcggaagggggagaccgacaucggccgcaagaacacccggguccgccucguguuccgggugcacgucccccaggggggcggcaagguggugagcguccaggccgccuccgugccgaucgagugcagccagcgcuccgcccaggagcugccccaggucgaggccuacagccccuccgcgugcagcgugcgggggggcgaggagcuggugcucaccggguccaacuuccugcccgacagcaaggucguguucaucgagcgcggcccggacggcaagcugcagugggaggaggaggccacggugaaccgccuccagagcaacgaggucacccugacccugaccgugcccgaguacuccaacaagcgggugagccgccccguccagguguacuucuacguguccaacgggcggcgcaagcggagccccacgcaguccuuccgcuuccucccggucaucugcaaggaggagccccugcccgacagcucccugcggggcuuccccagcgccuccgccaccccguucgggaccgacauggacuucagccccccccgccccccguaccccuccuacccccacgaggaccccgccugcgagaccccguaccucagcgagggcuucggguacggcaugcccccccuguacccccagacgggcccgccccccuccuaccggccggggcugcgcauguuccccgagacccggggcaccaccgggugcgcgcagccccccgccgugagcuuccucccgcgccccuuccccuccgaccccuacggcgggcggggcagcuccuucagccugggccugccguucuccccccccgcccccuuccgcccgcccccccuccccgccagcccgccccuggaggggcccuuccccagccaguccgacgugcacccgcugcccgcggagggcuacaacaaggucgggcccggcuacgggcccggcgagggcgccccggagcaggagaagagccgggggggcuacuccagcggguuccgcgacuccgugcccauccagggcaucacgcucgaggagggcgggugcggcaccgggggcugcgagugcgagugcgugcaggagaucgcccugcacgucugcuga

SEQ ID NO: 33549 - RNA, 1122 nt, Artificial Sequence
  derived and/or modified sequence opt1 from NFE2__Homo_sapiens__XP_005268963
augagccccugcccgccccagcagucccgcaaccgggugauccagcugagcaccuccgagcucggcgagauggagcugaccuggcaggagaucaugagcaucacggagcugcaggggcucaacgcccccuccgagcccagcuucgagccgcaggcccccgcgcccuaccuggggcccccgccgcccaccaccuacugccccugcuccauccaccccgacagcggcuucccccugcccccgccgcccuacgagcuccccgccuccaccagccacguccccgacccgcccuacuccuacggcaacauggccauccccgugagcaagccccugucccugagcgggcuccuguccgagccccugcaggacccccucgcccugcuggacaucggccuccccgccgggcccccgaagccccaggaggaccccgagagcgacuccggccugagccugaacuacuccgacgcggagagccucgagcuggagggcacggaggccgggcgccggcgcagcgaguacguggagauguacccggucgaguaccccuacucccugaugcccaacagccucgcccacuccaacuacacccugcccgccgcggagaccccgcuggcccucgagcccagcuccggccccgugcgggccaagcccaccgcccgcggggaggccggcagccgggacgagcgccgggcgcuggccaugaagaucccguuccccacggacaagaucgugaaccugcccgucgacgacuucaacgagcuccuggcccgcuacccccugaccgagucccagcucgcccuggugcgggacauccgccggcgcggcaagaacaagguggccgcgcagaacugccggaagcgcaagcuggagaccaucguccagcucgagcgggagcuggagcgccugaccaacgagcgggagcgccuccugcgggcccgcggggaggccgaccgcacgcuggaggugaugcggcagcagcucaccgagcuguaccgcgacaucuuccagcaccuccgggacgagagcggcaacuccuacagcccggaggaguacgcccugcagcaggccgcggacgggaccaucuuccuggugccccgcggcaccaagauggaggccacggacuga

SEQ ID NO: 33550 - RNA, 2319 nt, Artificial Sequence
  derived and/or modified sequence opt1 from NFE2L1__Homo_sapiens__NP_003195
augcugagccucaagaaguaccugaccgagggccugcuccaguucaccauccugcugucccucaucggggugcgcgucgacguggacacguaccugaccagccagcugcccccgcuccgggagaucauccugggccccuccagcgccuacacccagacccaguuccacaaccugcgcaacacgcucgacggguacggcauccaccccaaguccaucgaccuggacaacuacuucaccgcccggcgccugcucagccaggugcgggcgcuggaccgcuuccagguccccaccaccgaggugaacgccuggcuggugcaccgggacccggagggguccgucagcggcucccagcccaacagcggccucgcccuggaguccagcuccgggcugcaggacgugacgggccccgacaacggggugcgcgagagcgagaccgagcagggcuucggggaggaccucgaggaccugggcgccgucgcgcccccgguguccggcgaccugaccaaggaggacaucgaccucaucgacauccuguggcggcaggacaucgaccugggggccggccgcgagguguucgacuacagccaccggcagaaggagcaggacgucgagaaggagcuccgcgacgggggcgagcaggacaccugggccggcgagggggccgaggcccuggcgcggaaccugcucguggacggcgagacgggggaguccuuccccgcccaggugcccagcggcgaggaccagaccgcccugucccuggaggagugccuccgccugcuggaggcgaccugccccuucggggagaacgccgaguucccggccgacaucagcagcaucaccgaggccguccccuccgagagcgagccgcccgcccuccagaacaaccugcugagcccccuccugacgggcaccgagucccccuucgaccuggagcagcaguggcaggaccucauguccaucauggagaugcaggccauggaggugaacaccagcgccuccgagauccuguacagcgcgccgcccggcgacccccuguccaccaacuacagccucgcccccaacacgcccaucaaccagaacgugucccugcaccaggccagccucgggggcugcucccaggacuuccugcuguucagccccgaggucgagucccugccgguggccagcuccagcacccugcucccccuggcccccuccaacagcaccagccugaacuccaccuucgggagcacgaaccucaccggccuguucuucccgccccagcugaacgggaccgcgaacgacaccgccggccccgagcuccccgacccgcugggcgggcugcucgacgaggccaugcuggacgagaucucccugauggaccucgccaucgaggagggcuucaaccccgugcaggccagccagcuggaggaggaguucgacuccgacagcgggcugucccucgacagcucccacagccccuccagccuguccagcuccgagggcagcuccagcagcuccagcuccagcuccagcuccagcuccagcgcguccagcuccgccagcuccagcuucuccgaggagggggccgucggcuacagcuccgacagcgagacgcuggaccucgaggaggccgagggcgcggugggguaccagcccgaguacagcaaguucugccggauguccuaccaggacccggcccagcugagcugccugcccuaccucgagcacgugggccacaaccacaccuacaacauggcccccuccgcccuggacagcgccgaccugcccccgcccuccgcgcucaagaaggggagcaaggagaagcaggccgacuuccuggacaagcagaugucccgcgacgagcaccgggcccgcgccaugaagauccccuucaccaacgacaagaucaucaaccugcccgucgaggaguucaacgagcuccugagcaaguaccagcuguccgaggcccagcucagccugauccgggacauccgccggcgcggcaagaacaagauggcggcccagaacugccgcaagcggaagcuggacaccauccucaaccuggagcgcgacguggaggaccugcagcgggacaaggcccgccuccugcgggagaaggucgaguuccugcgcucccuccggcagaugaagcagaaggugcagagccuguaccaggagguguucggccgccugcgggacgagaacgggcgcccguacucccccagccaguacgcccuccaguacgccggcgacggguccguccugcugaucccccggacgauggcggaccagcaggcccgccggcaggagcgcaagcccaaggaccggcgcaaguga

SEQ ID NO: 33551 - RNA, 1770 nt, Artificial Sequence
  derived and/or modified sequence opt1 from NFE2L2__Homo_sapiens__NP_001138884
auggaccugaucgacauccucuggcgccaggacaucgaccugggcgugagccgggaggucuucgacuucucccagcgccggaaggaguacgagcuggagaagcagaagaagcucgagaaggagcgccaggagcagcugcagaaggagcaggagaaggccuucuucgcccagcugcagcucgacgaggagaccggggaguuccugcccauccagccggcgcagcacauccagagcgagaccuccggcagcgccaacuacucccagguggcccacauccccaagagcgacgcccuguacuucgacgacugcaugcagcuccuggcccagacguuccccuucguggacgacaacgaggucuccagcgcgaccuuccagucccuggugcccgacaucccggggcacaucgagagccccguguucaucgccaccaaccaggcccagucccccgagaccagcgucgcccagguggcgcccguggaccucgacggcaugcagcaggacaucgagcaggucugggaggagcugcuguccaucccggagcuccagugccugaacaucgagaacgacaagcugguggagacgaccauggugcccagccccgaggccaagcucaccgaggucgacaacuaccacuucuacuccagcauccccuccauggagaaggagguggggaacugcagcccgcacuuccugaacgccuucgaggacuccuucagcagcauccuguccaccgaggaccccaaccagcucacggugaacagccugaacuccgacgccaccgucaacaccgacuucggcgacgaguucuacagcgccuucaucgcggagcccuccaucagcaacuccaugcccagcccggccacccugucccacagccucuccgagcugcugaacggccccaucgacgugagcgaccucucccugugcaaggccuucaaccagaaccaccccgagagcacggccgaguucaacgacuccgacagcgggaucucccugaacaccagccccuccguggccagcccggagcacagcgucgaguccagcuccuacggcgacacccuccuggggcugagcgacuccgagguggaggagcucgacagcgcgcccggcuccgugaagcagaacgggcccaagacccccguccacagcuccggcgacauggugcagccgcugagccccucccagggccagagcacgcacgugcacgacgcccagugcgagaacacccccgagaaggagcugcccgucuccccggggcaccggaagacccccuucaccaaggacaagcacagcucccgccucgaggcccaccugacgcgggacgagcugcgcgccaaggcccuccacauccccuucccgguggagaagaucaucaaccugcccgucguggacuucaacgagaugaugagcaaggagcaguucaacgaggcgcagcuggcccucauccgggacauccgccggcgcggcaagaacaagguggccgcccagaacugccggaagcgcaagcuggagaacaucgucgagcuggagcaggaccucgaccaccugaaggacgagaaggagaagcugcucaaggagaagggggagaacgacaagucccugcaccuccugaagaagcagcugagcacccuguaccuggagguguucagcaugcuccgggacgaggacggcaagcccuacucccccagcgaguacucccugcagcagacccgcgacggcaacguguuccugguccccaagagcaagaagccggacgugaagaagaacuga

SEQ ID NO: 33552 - RNA, 2085 nt, Artificial Sequence
  derived and/or modified sequence opt1 from NFE2L3__Homo_sapiens__NP_004280
augaagcaccugaagcgcugguggagcgccggcgggggccuccugcaccugacccuccugcugucccucgccgggcugcggguggaccuggaccucuaccugcugcugcccccgcccacccugcugcaggacgagcuccuguuccugggcgggcccgcgagcuccgccuacgcccucagccccuucuccgccagcggcggcugggggcgcgccggccaccuccacccgaaggggcgggagcuggaccccgcggccccgcccgagggccagcuccugcgcgagguccgggcccugggggugcccuucgugccccgcacguccgucgacgccuggcucgugcacagcguggcggccggcuccgccgacgaggcccacggccugcugggggccgcggccgccagcuccaccggcggggccggcgccagcgucgacggcgggucccaggcggugcagggcgggggcggggacccccgggccgcccgcagcggcccccucgacgccggcgaggaggagaaggccccggcggagcccaccgcccaggugcccgacgccgggggcugcgccuccgaggagaacgggguccugcgggagaagcacgaggccguggaccacagcucccagcacgaggagaacgaggagcgcgugagcgcgcagaaggagaacucccugcagcagaacgacgacgacgagaacaagaucgccgagaagcccgacugggaggccgagaagaccacggagagccggaacgagcgccaccucaacggcaccgacaccagcuucucccuggaggaccuguuccagcuccugagcucccagccggagaacagccuggaggggaucucccucggcgacaucccccugcccggcagcaucuccgacgggaugaacagcuccgcccacuaccacgucaacuucagccaggcgaucucccaggacgugaaccugcacgaggccauccuccugugccccaacaacaccuuccggcgcgacccgacggcccggaccagccagucccaggagcccuuccugcagcucaacagccacaccaccaaccccgagcagacgcugcccggcaccaaccugaccggguuccucuccccgguggacaaccacaugcgcaaccugaccagccaggaccugcucuacgaccuggacaucaacaucuucgacgagaucaaccugaugucccuggccacggaggacaacuucgaccccaucgacgucagccagcuguucgacgagcccgacuccgacagcggccugagccuggacuccagccacaacaacaccuccgugaucaagagcaacuccagccacuccgugugcgacgagggggccaucggcuacugcaccgaccacgagagcuccagccaccacgaccucgagggcgcggucgggggcuacuaccccgagccguccaagcugugccaccuggaccagagcgacuccgacuuccacggggaccucaccuuccagcacguguuccacaaccacacguaccaccuccagcccaccgcccccgagagcaccuccgagccguuccccuggcccggcaagagccagaagauccggucccgcuaccuggaggacaccgaccggaaccucagccgcgacgagcagcgggccaaggcccugcacauccccuucagcguggacgagaucgucggcaugccgguggacuccuucaacagcaugcugucccgcuacuaccucacggaccuccaggugagccugauccgcgacauccggcgccgggggaagaacaaggucgccgcgcagaacugccgcaagcggaagcuggacaucauccugaaccuggaggacgacgugugcaaccuccaggccaagaaggagacccugaagcgcgagcaggcccagugcaacaaggccaucaacaucaugaagcagaagcugcacgaccucuaccacgacaucuucucccggcugcgcgacgaccagggccggcccgucaaccccaaccacuacgcccugcagugcacccacgacgggagcauccucaucgugcccaaggagcugguggcguccggccacaagaaggagacccagaaggggaagcgcaaguga

SEQ ID NO: 33553 - RNA, 1551 nt, Artificial Sequence
  derived and/or modified sequence opt1 from NFIA__Homo_sapiens__XP_011539817
auguacagcccccugugccucacccaggacgaguuccaccccuucaucgaggcccugcugccccacgugcgcgccuucgcguacaccugguucaaccuccaggcccggaagcgcaaguacuucaagaagcacgagaagcggauguccaaggaggaggagcgcgccgucaaggacgagcugcugagcgagaagcccgaggugaagcagaagugggccucccggcuccuggccaagcugcgcaaggacauccggcccgaguaccgcgaggacuucgugcucacggucaccggcaagaagccgcccugcugcgugcugagcaaccccgaccagaaggggaagaugcggcgcaucgacugccugcggcaggcggacaagguguggcgccucgaccuggucauggugauccuguucaagggcaucccccucgaguccaccgacggggagcggcuggucaagagcccgcagugcuccaaccccggccugugcgugcagccccaccacaucggggugagcgugaaggagcucgaccuguaccuggccuacuucguccacgccgccgacuccagccaguccgagagccccucccagccgagcgacgcggacaucaaggaccagcccgagaacggccaccucggcuuccaggacuccuucgugaccagcgggguguucuccgucacggagcuggugcgcgugagccagacccccaucgccgccggcaccgggcccaacuucucccugagcgaccucgagagcuccagcuacuacuccaugagcccgggcgccaugcggcgcucccugcccagcaccuccagcacguccagcaccaagcggcugaaguccgucgaggacgagauggacagccccggggaggagcccuucuacaccggccagggccgcuccccggggagcggcucccagagcuccggguggcacgagguggagcccggcaugcccagccccaccacgcucaagaaguccgagaaguccggcuucagcuccccgagccccucccagaccagcucccuggggaccgccuucacccagcaccaccggcccgugaucacgggcccccgcgaguucaagauggcgccgagcauccuggggucccccuucuggaaggucuacagcgccagcccccacgccaccccgagcacccuccacuuccccaccucccccaucauccagcagcccggcccguacuucagccaccccgccauccgguaccacccccaggagacgcugaaggaguucgugcagcuggugugccccgacgccgggcagcaggcgggccaggucggcuuccucaacccgaacggguccagccagggcaaggugcacaaccccuuccugcccacccccaugcugccgcccccgccgcccccgcccauggcccgccccgucccccuccccgugcccgacaccaagccgcccaccacguccaccgagggcggggccgccagccccaccucccccauccuggugcccgggaucaaggucgccgcgagccaccacccgcccgaccgcccgcccgaccccuucagcacccuguga

SEQ ID NO: 33554 - RNA, 1485 nt, Artificial Sequence
  derived and/or modified sequence opt1 from NFIB__Homo_sapiens__NP_001177666
augauguacagccccaucugccugacccaggacgaguuccacccguucaucgaggcccuccugccccacgugcgcgccaucgcguacaccugguucaaccugcaggcccggaagcgcaaguacuucaagaagcacgagaagcggauguccaaggacgaggagcgcgccgucaaggacgagcuccugagcgagaagcccgagaucaagcagaagugggccucccggcugcucgccaagcugcgcaaggacauccggcaggaguaccgcgaggacuucgugcugacggugaccggcaagaagcaccccugcugcguccucagcaacccggaccagaaggggaagauccggcgcaucgacugccugcggcaggcggacaagguguggcgccuggaccucgugauggucauccuguucaagggcaucccccuggaguccaccgacggggagcggcucaugaaguccccgcacugcaccaaccccgcccugugcgugcagccccaccacaucacgguguccgucaaggagcuggaccucuuccuggccuacuacgugcaggagcaggacagcggccaguccgggagccccucccacaacgaccccgccaagaacccgcccggcuaccuggaggacagcuucgugaaguccggcgucuucaacgugagcgagcucgugcgcgucucccggacccccaucacccaggggaccggcgugaacuuccccaucggggagauccccagccagccguacuaccacgacaugaacuccggcgugaaccugcagcgcagccuguccagcccgcccagcuccaagcggcccaagacgaucagcaucgacgagaacauggagcccucccccaccggggacuucuaccccagccccuccagcccggcggccggcucccgcaccuggcacgagcgggaccaggacaugagcucccccaccacgaugaagaagcccgagaagccccucuucagcuccgccagcccgcaggacuccagcccccgccuguccaccuucccccagcaccaccacccgggcauccccggggucgcccacagcgugaucuccacccggaccccgccgccgcccagcccccugcccuuccccacgcaggccauccucccgcccgcgcccuccagcuacuucagccaccccaccauccgcuacccgccccaccugaacccccaggacacccugaagaacuacgugcccuccuacgaccccagcagcccccagaccagccagcccaacggcuccgggcaggucgugggcaaggugcccggccacuucacgcccguccucgcccccagcccccacccguccgccgugcgccccgucacccugagcaugaccgacaccaagcccaucacgaccuccaccgaggccuacaccgccagcgggacgucccaggcgaaccgguacgugggccugagcccgcgcgaccccuccuuccuccaccagcagcagagcugguaccugggguga

SEQ ID NO: 33555 - RNA, 1527 nt, Artificial Sequence
  derived and/or modified sequence opt1 from NFIC__Homo_sapiens__NP_001231931
auguacagcagcccccugugccucacccaggacgaguuccacccguucaucgaggcccugcugccccacgugcgcgccuucgcguacaccugguucaaccuccaggcccggaagcgcaaguacuucaagaagcacgagaagcggauguccaaggacgaggagcgcgccgucaaggacgagcugcugggcgagaagcccgaggugaagcagaagugggccucccggcuccuggccaagcugcgcaaggacauccggcccgagugccgcgaggacuucgugcucagcaucacggggaagaaggcgccgggcugcguccuguccaaccccgaccagaaggggaagaugcggcgcaucgacugccugcggcaggccgacaagguguggcgccucgaccuggugauggucauccuguucaagggcaucccccucgagagcaccgacggggagcggcuggugaaggccgcccagugcggccaccccgugcugugcguccagccgcaccacaucggcguggcggugaaggagcucgaccuguaccuggccuacuucguccgcgagcgggacgccgagcaguccgggagcccccgcaccggcaugggguccgaccaggaggacagcaagcccaucacccucgacacgaccgacuuccaggaguccuucgugaccagcggcguguucuccgucaccgagcugauccaggugagccggacgcccguggucaccgggaccggcccgaacuucucccugggcgagcuccaggggcaccuggccuacgaccugaaccccgccagcaccggccuccgccggacgcugcccuccaccagcuccagcgggagcaagcgccacaaguccggcagcauggaggaggacguggacaccucccccggcggggacuacuacaccagcccguccagccccacguccagcucccggaacuggaccgaggacauggagggcgggaucagcucccccgugaagaagaccgagauggacaagagccccuucaacuccccgagcccccaggacagcccccgccuguccuccuucacccagcaccaccgccccgucaucgcggugcacagcggcaucgcccgguccccgcaccccagcagcgcccuccacuuccccacgaccuccauccugccccagaccgccagcaccuacuucccgcacacggccauccgcuacccgccccaccugaacccccaggacccccucaaggaccuggugucccuggcgugcgaccccgccagccagcagcccgggccgcucaacggcuccggccagcugaagaugcccagccacugccuguccgcccagaugcucgcgcccccgccgcccgggcugccccggcuggcccugccgcccgccaccaagcccgccaccaccagcgagggcggggccacgucccccaccagccccuccuacagcccgcccgacaccucccccgccaaccgcagcuucgucggccucgggccccgggaccccgccggcaucuaccaggcgcaguccugguaccugggcuga

SEQ ID NO: 33556 - RNA, 1389 nt, Artificial Sequence
  derived and/or modified sequence opt1 from NFIL3__Homo_sapiens__NP_001276929
augcagcugcgcaagaugcagaccgugaagaaggagcaggccagccucgacgccuccagcaacgucgacaagaugauggugcugaacuccgcgcugaccgaggugagcgaggacuccacgaccggcgaggagcuccugcugagcgagggguccgucggcaagaacaagagcuccgccugccggcgcaagcgggaguucauccccgacgagaagaaggacgccauguacugggagaagcgccggaagaacaacgaggccgccaagcgcagccgggagaagcgccggcucaacgaccuggugcuggagaacaagcucaucgcgcugggggaggagaacgccacccugaaggccgagcuccugucccugaagcucaaguucggccugaucagcuccaccgccuacgcgcaggagauccagaagcugagcaacuccacggccguguacuuccaggacuaccagaccagcaaguccaacgucagcuccuucguggacgagcacgagccgagcauggugagcuccagcugcaucuccgucaucaagcacagcccccaguccagccucuccgacgugagcgagguguccagcgucgagcacacccaggaguccagcgugcagggguccugccgcagccccgagaacaaguuccagaucaucaagcaggagcccauggagcuggaguccuacacccgggagccgcgcgacgaccggggcagcuacacggccuccaucuaccagaacuacaugggcaacagcuucuccggguacagccacagcccgccccugcuccaggugaaccgcuccagcuccaacagcccccggaccuccgagaccgacgacggcgucgugggcaagagcuccgacggggaggacgagcagcagguccccaaggggcccauccacagccccguggagcugaagcacgugcacgccaccguggucaaggugcccgaggugaacuccagcgcccugccgcacaagcuccgcaucaaggcgaaggccaugcagaucaaggucgaggccuucgacaacgaguucgaggccacgcagaagcuguccagccccaucgacaugaccuccaagcggcacuucgagcuggagaagcacagcgcccccuccauggugcacagcucccucacccccuucagcguccaggugaccaacauccaggacuggagccugaaguccgagcacuggcaccagaaggagcugagcggcaagacgcagaacuccuucaagaccggcguggucgagaugaaggacagcggguacaagguguccgacccggagaaccucuaccugaagcagggcaucgcgaaccugagcgccgagguggucucccucaagcgccugaucgccacccagcccaucagcgccuccgacagcggguga

SEQ ID NO: 33557 - RNA, 1533 nt, Artificial Sequence
  derived and/or modified sequence opt1 from NFIX__Homo_sapiens__NP_001257972
auggagaugagcugggcccgccagucccuggccggcauccccgcggccugcgacgaguuccacccguucaucgaggcccuccugccccacgugcgggccuucagcuacaccugguucaaccugcaggcccgcaagcggaaguacuucaagaagcacgagaagcgcauguccaaggacgaggagcgggcggucaaggacgagcuccugggggagaagcccgagaucaagcagaagugggccagccgccugcucgccaagcugcggaaggacauccgccccgaguuccgggaggacuucgugcugaccaucacgggcaagaagccgcccugcugcgugcucuccaaccccgaccagaaggggaagauccgccggaucgacugccugcgccaggccgacaaggucuggcggcuggaccucgugauggugauccuguucaagggcaucccccuggagagcaccgacggggagcgccucuacaaguccccgcagugcagcaaccccggccugugcguccagccccaccacaucggcgugaccaucaaggagcuggaccucuaccuggcguacuucgugcacacccccgaguccgggcagagcgacuccagcaaccagcagggcgacgccgacaucaagccgcugcccaacgggcaccucuccuuccaggacugcuucgucacgagcggcguguggaacgugaccgagcugguccgggugucccagacccccguggccaccgccagcgggcccaacuucucccuggccgaccucgagagcccguccuacuacaacaucaaccaggucacgcugggccgccggagcaucaccagcccgcccuccaccagcaccacgaagcgccccaaguccaucgacgacagcgagauggagucccccguggacgacguguucuaccccggcaccgggcggagccccgcggccggcuccagccaguccagcggguggcccaacgacgucgacgccggcccggccucccugaagaaguccggcaagcucgacuucugcuccgcccugagcucccaggggagcagcccccgcauggcguucacccaccacccccugcccgugcucgccggcgugcggccggggagcccccgcgccaccgccuccgcccugcacuuccccagcacgagcaucauccagcaguccagcccguacuucacccaccccaccauccgcuaccaccaccaccacggccaggacucccugaaggaguucguccaguucgugugcagcgacggguccggccaggcgaccggccagcccaacgggagcggccaggggaaggugcccggcuccuuccuccugccgcccccgccgcccgucgcccggcccgugccccugcccaugcccgacagcaaguccacgagcaccgcccccgacggggccgcccucaccccgcccucccccagcuucgcgaccacgggcgccuccagcgccaaccgcuucgucuccaucggcccccgggacgggaacuuccugaacaucccccagcagagccaguccugguuccuguga

SEQ ID NO: 33558 - RNA, 2907 nt, Artificial Sequence
  derived and/or modified sequence opt1 from NFKB1__Homo_sapiens__NP_001158884
auggccgaggacgaccccuaccugggccgcccggagcagauguuccaccucgaccccagccugacccacaccaucuucaaccccgagguguuccagccccagauggcccugccgacggacgggcccuaccuccagauccuggagcagcccaagcagcggggcuuccgcuuccgguacgucugcgaggggcccucccacggcgggcugccgggcgcgagcuccgagaagaacaagaaguccuacccccaggugaagaucugcaacuacgugggccccgccaaggucaucgugcagcucgugaccaacgggaagaacauccaccuccacgcccacagccuggucggcaagcacugcgaggacgggaucugcaccgugaccgccggccccaaggacaugguggucggguucgccaaccugggcauccugcacgugacgaagaagaagguguucgagacccuggaggcgcgcaugaccgaggccugcauccggggcuacaacccggggcuccugguccaccccgaccuggccuaccuccaggccgagggcgggggcgaccgccagcugggcgaccgggagaaggagcugauccgccaggcggcccuccagcagaccaaggagauggaccugagcguggugcggcugauguucacggccuuccuccccgacuccaccgggagcuucacccgccggcuggagcccgucguguccgacgccaucuacgacagcaaggccccgaacgcguccaaccugaagaucgugcgcauggaccggaccgccggcugcgucaccgggggcgaggagaucuaccuccugugcgacaaggugcagaaggacgacauccagauccgcuucuacgaggaggaggagaacgggggcgugugggagggcuucggggacuucagccccaccgacguccaccggcaguucgccaucguguucaagacccccaaguacaaggacaucaacaucaccaagcccgccuccguguucguccagcugcgccgcaagagcgaccucgagacguccgagccgaagcccuuccuguacuaccccgagaucaaggacaaggaggaggugcagcggaagcggcagaagcugaugcccaacuucagcgacuccuucggcgggggcagcggggccggcgcgggcgggggcgggauguucggcuccgggggcggcgggggcgggaccggcagcaccggcccgggguacagcuucccccacuacggcuuccccaccuacgggggcaucacguuccaccccgggaccaccaaguccaacgccggcaugaagcacggcaccauggacacggagagcaagaaggacccggaggggugcgacaaguccgacgacaagaacaccgucaaccucuucggcaaggugaucgagaccaccgagcaggaccaggagcccagcgaggccacgguggggaacggcgaggucacccugaccuacgccaccgggacgaaggaggaguccgccggcgugcaggacaaccuguuccucgagaaggcgaugcagcuggccaagcgccacgccaacgcccuguucgacuacgccgugaccggcgacgucaagaugcuccuggcggugcagcggcaccugaccgccgugcaggacgagaacggggacagcguccuccaccuggccaucauccaccuccacucccagcuggugcgcgaccugcuggaggugaccagcggccucaucuccgacgacaucaucaacaugcgcaacgaccuguaccagacgccccugcaccucgccgucaucaccaagcaggaggacgugguggaggaccugcugcgggcgggggccgaccugagccuccuggaccgccugggcaacuccguccuccaccuggccgccaaggaggggcacgacaaggugcugagcauccuccugaagcacaagaaggccgcgcugcuccuggaccacccgaacggcgacggccugaacgccauccaccucgccaugauguccaacagccugcccugccugcuccugcugguggccgccggggcggacgucaacgcccaggagcagaaguccggccggaccgcccuccaccuggccguggagcacgacaacaucagccuggccgggugccuccugcuggagggcgacgcgcacguggacuccaccaccuacgacgggacgacgccccuccacaucgccgccggccgcggcagcacccggcuggccgcgcugcucaaggccgccggggccgacccccuggucgagaacuucgagccgcuguacgaccucgacgacuccugggagaacgccggcgaggacgaggggguggugcccggcaccacgccccuggacauggcgaccagcuggcaggucuucgacauccugaacggcaagcccuacgagccggaguucaccagcgacgaccuccuggcccagggggacaugaagcagcuggccgaggacgugaagcuccagcuguacaagcugcucgagauccccgaccccgacaagaacugggccacccuggcccagaagcugggccucgggauccugaacaacgcguuccgccugucccccgccccgagcaagacgcucauggacaacuacgagguguccggcgggaccguccgggagcugguggaggcccugcgccagaugggcuacaccgaggccaucgaggugauccaggccgcgagcucccccgucaagaccacgagccaggcccacucccucccccugagccccgccuccacccggcagcagaucgacgagcugcgcgacagcgacuccgugugcgacagcggcguggagaccuccuuccggaagcucagcuucaccgagucccugacgagcggggccucccugcucacccugaacaagaugccgcacgacuacggccaggaggggccccuggagggcaagaucuga

SEQ ID NO: 33559 - RNA, 2700 nt, Artificial Sequence
  derived and/or modified sequence opt1 from NFKB2__Homo_sapiens__NP_002493
auggagagcugcuacaaccccggccuggacgggaucaucgaguacgacgacuucaagcucaacuccagcaucguggagcccaaggagcccgcccccgagaccgccgacggccccuaccuggucaucguggagcagcccaagcagcgcggguuccgguuccgcuacggcugcgaggggcccucccacggcggccugcccggggcgagcuccgagaagggccggaagaccuaccccacggugaagaucugcaacuacgaggggccggccaagaucgaggucgaccucgugacccacagcgacccgccccgcgcccacgcccacucccuggugggcaagcagugcagcgagcuggggaucugcgccgucuccgugggccccaaggacaugaccgcgcaguucaacaaccucggcgugcugcacgucaccaagaagaacaugauggggacgaugauccagaagcugcagcggcagcgccuccggagccgcccgcagggccugaccgaggccgagcagcgggagcuggagcaggaggccaaggagcucaagaaggugauggaccuguccaucgugcgccugcgguucagcgccuuccuccgcgcguccgacgggagcuucucccugccccugaagcccgucaucagccagcccauccacgacuccaagagcccgggcgccuccaaccucaagaucagccggauggacaagaccgccggcagcgugcgcgggggcgacgagguguaccugcugugcgacaagguccagaaggacgacaucgaggugcgguucuacgaggacgacgagaacggguggcaggccuucggcgacuucucccccaccgacgugcacaagcaguacgccaucgucuuccgcacgccgcccuaccacaagaugaagaucgagcggcccgugaccguguuccuccagcugaagcgcaagcgcgggggcgacgucagcgacuccaagcaguucaccuacuacccccugguggaggacaaggaggaggugcagcggaagcggcgcaaggcgcuccccaccuucagccagcccuucggcgggggcucccacaugggcggcgggagcgggggcgccgccgggggcuacgggggcgccgggggcggcgggucccugggcuucuucccgagcucccuggccuacagccccuaccaguccggggcgggccccaugggcugcuaccccgggggcgggggcggggcccagauggccgccacggucccgagccgcgacuccggcgaggaggccgcggagcccagcgcccccucccggaccccgcagugcgagccccaggcccccgagaugcuccagcgcgcccgggaguacaacgcccgccuguucggccuggcgcagcggagcgcccgcgcccuccuggacuacggggugaccgccgacgcgcgggcccugcucgccggccagcgccaccuccugaccgcccaggacgagaacggggacacgccccugcaccuggccaucauccacggccagaccuccgucaucgagcagaucguguacgugauccaccacgcgcaggaccugggggucgugaaccucaccaaccaccuccaccagaccccgcugcaccuggccgugaucacgggccagaccagcgucguguccuuccugcugcgggugggcgccgaccccgcccuccuggaccgccacggggacagcgccaugcaccuggcgcuccgggccggcgccggggcccccgagcugcugcgcgcccugcuccagagcggcgcgcccgccgucccgcagcugcugcacaugcccgacuucgaggggcucuaccccgugcaccuggccgugcgggcccgcucccccgagugccuggaccuccuggucgacagcggcgcggagguggaggccaccgagcggcagggcgggcgcaccgcccugcaccucgccacggagauggaggagcugggccuggugacccaccucgucaccaagcugcgggccaacgugaacgcgcgcaccuucgccgggaacacgccgcugcaccucgccgccggccugggguaccccacccugacccggcuccugcugaaggccggcgcggacauccacgccgagaacgaggagccccucugcccccugccguccccgcccaccagcgacuccgacagcgacuccgagggccccgagaaggacacgcgcagcuccuuccgcgggcacacgccccuggaccugaccugcagcaccaaggugaagacccuccugcucaacgccgcccagaacaccauggagccgccccugacgccgcccucccccgccggccccgggcugagccucggcgacaccgcgcugcagaaccuggagcagcuccuggacggccccgaggcccagggguccugggccgagcuggccgagcggcucggccugcgcagccuggucgacaccuaccggcagaccaccucccccagcgggucccuccugcgcagcuacgagcuggcgggcggggaccucgccggccugcuggaggcccucagcgacaugggccuggaggagggggugcggcugcuccgcggccccgagacccgggacaagcugcccuccaccgaggugaaggaggacagcgccuacgggucccagagcgucgagcaggaggccgagaagcugggcccgccgcccgagccgcccgggggccucugccacggccacccccagccccaggugcacuga

SEQ ID NO: 33560 - RNA, 954 nt, Artificial Sequence
  derived and/or modified sequence opt1 from NFKBIA__Homo_sapiens__NP_065390
auguuccaggccgccgagcgcccccaggagugggcgauggagggcccgcgggacgggcugaagaaggagcgccuccuggacgaccggcacgacagcggccuggacuccaugaaggacgaggaguacgagcagauggugaaggagcuccaggagauccgccuggagccccaggaggucccccgggggagcgagcccuggaagcagcagcugaccgaggacggcgacuccuuccuccaccuggccaucauccacgaggagaaggcccugaccauggaggugauccgccaggugaagggggaccucgccuuccugaacuuccagaacaaccugcagcagacgccgcuccaccuggccgucaucaccaaccagcccgagaucgcggaggcccugcucggcgccggcugcgaccccgagcugcgggacuuccgcgggaacacgccccugcaccucgccugcgagcagggcugccuggcgagcgugggggugcugacccaguccugcaccaccccgcaccuccacagcauccugaaggccaccaacuacaacggccacacgugccugcaccucgccuccauccacggguaccugggcaucgucgagcugcucgugagccugggcgccgacgugaacgcccaggagcccugcaacgggcggaccgcgcugcaccucgccgucgaccugcagaaccccgaccuggugucccuccugcugaagugcggcgccgacgugaaccgcgucaccuaccagggguacagccccuaccagcucaccuggggccggccguccacccgcauccagcagcagcugggccagcugacgcucgagaaccugcagaugcugcccgagagcgaggacgaggaguccuacgacaccgagagcgaguucaccgaguucaccgaggacgagcuccccuacgacgacugcguguucgggggccagcggcugacgcuguga

SEQ ID NO: 33561 - RNA, 1071 nt, Artificial Sequence
  derived and/or modified sequence opt1 from NFKBIB__Homo_sapiens__NP_002494
auggccggcguggccugccuggggaaggcggccgacgccgacgaguggugcgacagcggccucgggucccugggccccgacgccgccgcgcccgggggccccggccugggggccgagcucggccccgggcugagcugggcgccccuggucuucggcuacgugaccgaggacggggacaccgcccuccaccuggccgugauccaccagcacgagccguuccuggacuuccuccugggcuucuccgccggcaccgaguacauggaccugcagaacgaccucgggcagaccgcccugcaccuggccgccauccucggcgagaccagcaccgucgagaagcuguacgcggccggggccggccugugcguggccgagcgccggggccacacggcccuccaccuggcgugccgcgugggggcccacgccugcgcccgggcccugcuccagccccgcccccggcgcccccgggaggcgccggacaccuaccuggcccagggccccgaccgcacccccgacaccaaccacacgcccgucgcccuguacccggacuccgaccucgagaaggaggaggaggagagcgaggaggacuggaagcugcagcuggaggccgagaacuacgaggggcacacgccccuccacguggccgugauccacaaggacgucgagauggugcggcugcugcgcgacgcgggcgccgaccucgacaagcccgagccgaccugcgggcgguccccgcugcaccuggccguggaggcccaggcggccgacguccucgagcugcugcuccgcgccggcgccaaccccgccgcgcggauguacggcgggcgcacgccccugggcagcgccaugcugcggcccaacccgauccucgcccgccugcugcgggcccacggggcccccgagcccgagggcgaggacgagaaguccgggcccugcagcuccagcuccgacagcgacuccggcgacgagggcgacgaguacgacgacaucguggugcacagcucccgcagccagacccggcucccgcccacccccgcguccaagccccugccggacgacccccgccccgucuga

SEQ ID NO: 33562 - RNA, 1503 nt, Artificial Sequence
  derived and/or modified sequence opt1 from NFKBIE__Homo_sapiens__NP_004547
augaaccagcgccggagcgagucccgccccggcaaccaccggcugcaggccuacgccgagccggggaagggcgacagcgggggcgcggggccccucuccggcagcgcccgccggggccgcgggggcgggggcgccauccgggugcgccggcccugcugguccgggggcgccggccgcgggggcgggcccgccugggcgguccggcugccgaccgugaccgccggcuggaccuggcccgcccugcgcacccucagcucccugcgggccggccccagcgagccccacuccccggggcgccggccgccccgcgcgggccggccccugugccaggccgacccccagcccgggaaggccgcccgccggagccucgagcccgaccccgcccagaccggcccgcgccccgcgcgggccgccgggauguccgaggcccgcaagggccccgacgaggccgaggagagccaguacgacuccggcaucgagagccugcgcucccugcggagccuccccgaguccaccagcgcgccggccuccgggcccagcgacggcagcccccagcccugcacgcacccgcccgggcccgugaaggagccccaggagaaggaggacgccgacggcgagcgcgccgacuccaccuacgggagcuccagccugaccuacacccugucccuccugggcggcccggaggccgaggaccccgcgccccggcugccgcucccccacgucggggcccugagcccccagcagcuggaggcccucacguacaucuccgaggacggcgacacccuggugcaccuggccgugauccacgaggcccccgcgguccuccugugcugccuggcccuccugccgcaggaggugcuggacauccagaacaaccucuaccagaccgcccugcaccuggccgugcaccucgaccagcccggggcgguccgcgcccuggugcugaagggcgccagccgggcccuccaggaccgccacggggacaccgcccugcacguggcgugccagcggcagcaccuggccugcgcccgcugccuccuggagggccggcccgagcccggccgcgggacgucccacagccuggaccuccagcugcagaacuggcagggccuggccugccuccacaucgccacccugcagaagaaccagccgcugauggagcuccugcugcggaacggggcggacaucgacguccaggagggcaccuccggcaagaccgcccuccaccuggccguggagacgcaggagcgcgggcuggugcaguuccugcuccaggccggcgcccaggucgacgcgcggaugcugaacgggugcacgccccugcaccucgccgccggccgcgggcugaugggcaucagcuccacccugugcaaggccggcgcggacagccuccugcggaacguggaggacgagacgccccaggaccugaccgaggagucccucgugcugcugcccuucgacgaccucaagaucagcgggaagcugcugcucugcaccgacuga

SEQ ID NO: 33563 - RNA, 1101 nt, Artificial Sequence
  derived and/or modified sequence opt1 from NFKBIL1__Homo_sapiens__NP_001138433
augagcaaccccagcccccaggugcccgaggaggaggccuccaccuccgucugccgccccaagagcuccauggccagcaccucccggcgccagcggcgcgagcggcgcuuccggcgcuaccugagcgcgggccggcucgugcgcgcccaggcccugcugcagcggcaccccgggcucgacguggacgccggccagccgccgccccugcaccgcgccugcgcgcggcacgacgcccccgcccugugccuccugcugcgccucggggccgacccggcgcaccaggaccggcacggcgacacggcccugcacgccgccgcccgccaggggcccgacgcguacaccgacuucuuccugccccuccugucccggugccccagcgccaugggcaucaagaacaaggacggcgagaccccggggcagauccugggcugggggccgcccugggacuccgccgaggaggaggaggaggacgacgccagcaaggagcgcgaguggcggcagaagcuccagggcgacgccucccacgagacccaggagcccgagagcuucuccgcguggagcgaccgccuggcccgggagcacgcccagaagugccagcagcagcagcgcgaggccgaggggucccgccggccgccccgcgccgagggcagcucccagagcuggcggcagcaggaggaggagcagcgccuguuccgggagcgcgcgcgggccaaggaggaggagcuccgcgagagccgggcccgccgggcccaggaggcccugggcgaccgcgagcccaagcccacgcgggcggggccgcgcgaggagcacccccggggcgccgggcgcggcucccuguggcgguucggcgacguccccuggcccugccccgggggcggggaccccgaggccauggccgcggcccucguggcccgcggcccgccccuggaggagcagggggcccugcggcgcuaccuccgcgugcagcagguccgguggcaccccgaccgcuuccugcagcgguuccgcagccagaucgagaccugggagcugggccgggugaugggcgccgugaccgcgcucucccaggcccugaaccgccacgccgaggcccugaaguga

SEQ ID NO: 33564 - RNA, 1857 nt, Artificial Sequence
  derived and/or modified sequence opt1 from NFKBIZ__Homo_sapiens__NP_001005474
augggcguggggcgccagcagcggggccccuuccaggggguccgcgugaagaacagcgugaaggagcugcuccugcacauccggucccacaagcagaaggccagcggccaggccgucgacgacuucaagacccagggggugaacaucgagcaguuccgcgagcugaagaacaccguguccuacagcggcaagcggaagggcccggacucccucagcgacgggcccgcgugcaagcgccccgcccugcugcacucccaguuccucacgcccccgcagacccccacccccggcgagagcauggaggacguccaccugaacgagcccaagcaggaguccagcgccgaccugcuccagaacaucaucaacaucaagaacgagugcuccccggugagccugaacaccgugcaggucuccuggcugaaccccgugguggucccccagagcucccccgccgagcagugccaggacuuccacgggggccagguguucagcccgccccagaagugccagcccuuccaggugcgggggucccagcagaugaucgaccaggccagccucuaccaguacagcccccagaaccagcacgucgagcagcagccgcacuacacgcacaagcccacccuggaguacucccccuuccccaucccgccccagagccccgcguacgagcccaaccuguucgacggcccggagucccaguucugccccaaccagagccucgugucccugcugggcgaccagcgcgagagcgagaacaucgccaaccccaugcagaccuccagcuccgugcagcagcagaacgacgcccaccuccacagcuucuccaugaugcccagcuccgccugcgaggcgauggucgggcacgagauggccagcgacuccagcaacaccucccugccguucagcaacaugggcaaccccaugaacacgacccagcuggggaagucccucuuccaguggcaggucgagcaggaggagagcaagcuggccaacaucucccaggaccaguuccugagcaaggacgccgacggcgacaccuuccuccacaucgccguggcgcagggccggcgcgcccugagcuacgugcuggcccggaagaugaacgcccuccacaugcuggacaucaaggagcacaacgggcaguccgccuuccagguggcgguggccgccaaccagcaccugaucguccaggaccucgugaacaucggcgcccaggucaacaccacggacugcugggggcgcacgccccugcacgugugcgccgagaagggccacagccaggugcugcaggcgauccagaagggggccgucggcuccaaccaguucguggaccucgaggccaccaacuacgacggccugaccccgcugcacugcgccgugaucgcccacaacgcggucgugcacgagcuccagcggaaccagcagccccacagccccgaggugcaggagcugcugcucaagaacaagucccuggucgacaccaucaagugccugauccagaugggggccgccguggaggccaaggaccgcaagagcggccggaccgcgcuccaccuggccgccgaggaggccaaccuggagcucauccgccuguuccuggagcuccccuccugccugagcuucgugaacgccaaggcguacaacgggaacaccgcccugcacgucgccgccucccugcaguaccggcucacccagcuggacgccgugcgccugcucaugcggaagggcgcggacccgagcacgcgcaaccuggagaacgagcagcccgugcaccugguccccgacgggcccgugggcgagcagauccggcgcauccucaagggcaaguccauccagcagcgcgccccgcccuacuga

SEQ ID NO: 33565 - RNA, 3900 nt, Artificial Sequence
  derived and/or modified sequence opt1 from NFRKB__Homo_sapiens__NP_001137307
auggacagccuggaccacaugcugaccgacccccuggagcugggcccgugcggggacggccacgggacccgcaucauggaggacugccuccugggcgggacgcgggugucccugcccgaggaccuccuggaggaccccgagaucuucuucgacgucgugagccuguccaccuggcaggaggugcucagcgacucccagcgcgagcaccuccagcaguuccugccccaguucccggaggacagcgccgagcagcagaacgagcugauccuggcccuguucuccggcgagaacuuccgguucggcaacccccuccacaucgcgcagaagcuguuccgcgacgggcacuucaaccccgaggucgugaaguaccggcagcugugcuucaagagccaguacaagcgcuaccucaacucccagcagcaguacuuccaccggcugcugaagcagauccucgccagccgcuccgaccugcuggagauggcccggcgcagcggccccgcccucccguuccggcagaagcgccccucccccagccggacccccgaggagcgcgaguggcggacccagcagcgcuaccugaaggugcugcgggaggucaaggaggagugcggggacacggcccucuccagcgacgaggaggaccuguccagcuggcugccguccagccccgcgcgcagccccucccccgccgugccgcuccgggugguccccacccugagcaccaccgacaugaagacggccgacaagguggagcugggcgacuccgaccucaagaucaugcugaagaagcaccacgagaagcgcaagcaccagcccgaccaccccgaccugcucaccggggaccugacccugaacgacaucaugacccgggugaacgccggccgcaagggcagccucgcggcccuguacgaccuggccguccucaagaagaaggugaaggagaaggaggagaagaagaagaagaagaucaagacgaucaaguccgaggccgaggaccuggccgagccgcugagcuccaccgaggggguggcgccccucagccaggcccccagcccccuggccaucccggccaucaaggaggagccccuggaggaccucaagcccugccugggcaucaacgagaucuccuccagcuucuucucccugcugcucgagauccugcugcucgagagccaggccucccugcccaugcuggaggagcgcguccucgacuggcagagcuccccggcgagcucccugaacagcugguucagcgccgcccccaacugggccgagcuggugcuccccgcccugcaguaccuggcgggggagucccgggccgugccgagcuccuucagccccuucgucgaguucaaggagaagacccagcaguggaagcuccugggccagucccaggacaacgagaaggagcuggccgcccucuuccagcuguggcuggagaccaaggaccaggccuucugcaagcaggagaacgaggacagcuccgacgcgacgacccccgugccccgcgugcggaccgacuacgucgugcgcccgagcaccggcgaggagaagcggguguuccaggagcaggagcgcuaccgguacucccagccccacaaggccuucacguuccgcaugcacggguucgagagcgucgugggccccgucaaggggguguucgacaaggagaccucccucaacaaggcccgggagcacagccugcugcgcuccgaccggcccgccuacgugaccauccucagccugguccgcgacgcggccgcccggcugccgaacggcgaggggacccgcgccgagaucugcgagcuccugaaggacucccaguuccuggcccccgacgugacgagcacccaggugaacaccgucguguccggcgcgcucgaccggcugcacuacgagaaggaccccugcgugaaguacgacaucggccgcaagcuguggaucuaccuccaccgggaccgcagcgaggaggaguucgagcggauccaccaggcccaggccgccgccgcgaaggcccgcaaggcccugcagcagaagcccaagccgcccagcaaggucaaguccagcuccaaggagagcuccaucaaggugcugagcuccgggcccagcgagcagucccagaugagccucuccgacagcuccaugcccccgacccccgugacgcccgucacccccaccaccccggcccugcccgccauccccaucagcccgccgcccguguccgcggugaacaagagcggccccuccacggucagcgagcccgccaaguccagcagcggggugcugcucguguccagccccaccaugccccaccugggcaccaugcugucccccgccagcucccagaccgccccgagcucccaggcggccgcccgcgucgugagccacuccgggagcgccggccucucccaggugcgggucguggcccagcccagccugcccgcggugccccagcaguccggcgggccggcccagacgcugccccagaugcccgccggcccccagauccgcgucccggccaccgccacccagaccaagguggugccccagaccgucauggcgacggugcccgugaaggcccagaccaccgccgccaccguccagcggcccgggccgggccagacggggcucaccgugaccagccugcccgccaccgcgucccccgugagcaagcccgccacguccagcccgggcaccuccgcccccagcgccagcaccgcggccgucauccagaacgugaccggccagaacaucaucaagcaggucgccaucacggggcagcugggcgugaagccccagaccgggaacuccaucccccucaccgccaccaacuuccgcauccagggcaaggacgugcugcggcugccgcccagcuccaucacgaccgacgccaagggccagaccgugcuccgcaucacccccgacaugauggcgacgcuggccaagagccaggucaccaccgugaagcugacccaggaccucuucgggacgggcgggaacaccaccggcaaggggaucuccgccacccugcacgugacgagcaaccccguccacgccgccgacuccccggcgaaggccagcuccgccagcgcccccuccagcacccccaccggcaccacgguggugaaggucaccccggaccugaagcccaccgaggccuccagcuccgcguuccggcucaugcccgcccugggcgugagcguggccgaccagaaggggaaguccaccgucgccagcuccgaggccaagcccgcggccacgauccgcaucgugcagggccugggggugaugccgcccaaggccggccagaccaucaccgucgccacccacgcgaagcagggggccagcguggccagcggcuccggcaccguccacacgagcgccgugucccuccccagcaugaacgccgcgguguccaagaccgucgccguggccagcggggccgccuccacccccaucagcaucuccaccggcgcgccgacggugcggcagguccccgugagcaccaccguggucuccaccagccaggccgggaagcugcccacgcgcaucaccgugccccuguccgugaucagccagccgaugaagggcaaguccgucgugaccgcccccaucaucaaggggaaccucggcgccaaccugagcggccuggggcggaacaucauccucaccacgaugcccgccggcaccaagcugaucgcggggaacaagcccguguccuuccugaccgcccagcagcuccagcagcugcagcagcagggccaggccacccagguccgcauccagacggugccggccagccaccuccagcaggggaccgcguccggcagcagcaaggccguguccaccgucguggugaccacggcccccagccccaagcaggcccccgagcagcaguga

SEQ ID NO: 33566 - RNA, 1221 nt, Artificial Sequence
  derived and/or modified sequence opt1 from NFS1__Homo_sapiens__NP_001185918
augcugcuccgcgccgccuggcggcgcgcggccguggccgucaccgccgcccccggcccgaagcccgcggcccccacccgggggcugcgccugcgggugggcgaccgcgcgccccagagcgccgugccggccgacacggccgccgcccccgaggucgggcccgugcuccggccccuguacauggacgugcaggccaccaccccgcuggacccccgcguccucgacgcgaugcugcccuaccugaucaacuacuacggcaacccccacucccggacccacgccuacgggugggagagcgaggccgccauggagcgcgcccggcagcaggucgcgucccucaucggcgccgacccgcgcgagaucaucuucacgagcggcgccaccgaguccaacaacaucgccaucaaggagcuggaggccgcgauccagcccgacaccagccugguguccgugaugaccgugaacaacgagaucggggugaagcagcccaucgccgagaucggccggaucugcagcucccgcaaggucuacuuccacacggacgccgcccaggccguggggaagaucccccucgacgugaacgacaugaagaucgaccugaugagcaucuccggccacaagaucuacgggccgaagggcgucggcgcgaucuacauccggcgccggccccgcgugcggguggaggcccugcagagcgggggcgggcaggagcgcggcaugcgguccggcaccguccccacgccccucgugguggggcugggcgccgccugcgaggucgcgcagcaggagauggaguacgaccacaagcgcaucagcaagcuguccgagcgccucauccagaacaucaugaagucccugccggacguggugaugaacggggaccccaagcaccacuaccccggcugcaucaaccugagcuucgccuacgucgagggggagagccuccugauggcccugaaggacguggcccucuccagcggcagcgccugcaccuccgcgagccuggagcccuccuacguccugcgggccaucggcaccgacgaggaccucgcccacagcuccauccgcuucgggaucggccgguucaccaccgaggaggagguggacuacaccguggagaagugcauccagcacgucaagcgccugcgggagaugagcccgcugugggagauggugcaggacgggaucgaccucaaguccaucaaguggacgcagcacuga

SEQ ID NO: 33567 - RNA, 765 nt, Artificial Sequence
  derived and/or modified sequence opt1 from NFU1__Homo_sapiens__NP_001002755
auggccgccaccgcgcgccggggcuggggcgccgccgccguggccgcggggcugcgccggcgcuucugccacaugcucaagaaccccuacaccaucaagaagcagccgcugcaccaguucgugcagcggccccuguucccccuccccgccgccuucuaccacccggugcgcuacauguucauccagacgcaggacacccccaaccccaacagccugaaguucauccccgggaagccggugcuggagacccggaccauggacuuccccacgcccgccgcggccuuccgcagcccccucgcccggcagcuguuccgcaucgagggcgucaaguccguguucuucgggccggacuucaucaccgugaccaaggagaacgaggagcuggacuggaaccuccugaagcccgacaucuacgccaccaucauggacuucuucgccuccggccugccccucgucacggaggagacccccagcggcgaggcgggguccgaggaggacgacgaggugguggccaugaucaaggagcugcuggacacccggauccgcccgaccguccaggaggacggcggggacgugaucuacaagggcuucgaggacgggaucgugcagcucaagcugcagggcagcugcacguccugccccagcuccaucaucacccugaagaacggcauccagaacaugcuccaguucuacauccccgaggucgaggggguggagcaggucauggacgacgagagcgacgagaaggaggccaacucccccuga

SEQ ID NO: 33568 - RNA, 1044 nt, Artificial Sequence
  derived and/or modified sequence opt1 from NFYA__Homo_sapiens__NP_002496
auggagcaguacaccgccaacagcaacuccagcaccgagcagaucgugguccaggccggccagauccagcagcagcagcagggcggggugacggcggugcagcugcagaccgaggcccaggucgccuccgccagcgggcagcagguccagacccuccagguggugcagggccagccccugaugguccagguguccgggggccagcugaucaccagcacgggccagccgaucauggugcaggccgugcccgggggccaggggcagaccaucaugcagguccccguguccggcacccaggggcuccagcagauccagcuggugcccccgggccagauccagauccagggcgggcaggcggugcagguccagggccagcaggggcagacccagcagaucaucauccagcagccccagacggccgugaccgccggccagacccagacccagcagcagaucgccgugcagggccagcaggucgcgcagacggccgaggggcagaccaucguguaccagcccgugaacgccgacggcaccauccugcagcaggucaccgugcccgugagcgggaugaucacgaucccggccgccucccucgcgggcgcccagaucguccagaccggggccaacaccaacaccacgagcuccggccagggcaccgugaccgucacccugcccguggccgggaacguggucaacagcggcgggauggugaugauggugcccggcgccggguccguccccgcgauccagcgcaucccgcugcccggcgccgagaugcucgaggaggagccccuguacgugaacgccaagcaguaccaccggauccugaagcgccggcaggcccgcgccaagcucgaggcggagggcaagauccccaaggagcggcgcaaguaccugcacgagagccggcaccgccacgccauggcccggaagcgcggggagggcgggcgguucuucuccccgaaggagaaggacagcccccacaugcaggaccccaaccaggccgacgaggaggccaugacgcagaucauccgcguguccuga

SEQ ID NO: 33569 - RNA, 624 nt, Artificial Sequence
  derived and/or modified sequence opt1 from NFYB__Homo_sapiens__NP_006157
augaccauggacggcgacagcuccaccacggacgccagccagcuggggaucuccgccgacuacaucggcgggagccacuacgugauccagccccacgacgacaccgaggacuccaugaacgaccacgaggacaccaacggcagcaaggaguccuuccgcgagcaggacaucuaccucccgaucgcgaacgucgcccggaucaugaagaacgccaucccccagaccgggaagaucgccaaggacgccaaggagugcgugcaggagugcgugagcgaguucaucuccuucaucacgagcgaggcguccgagcgcugccaccaggagaagcggaagaccaucaacggcgaggacauccuguucgccaugagcacccugggcuucgacuccuacgucgagccccucaagcuguaccugcagaaguuccgcgaggccaugaagggggagaagggcaucgggggcgccgugaccgcgacggacgggcucagcgaggagcugaccgaggaggccuucaccaaccagcugcccgccggccucaucaccacggacggccagcagcagaacgugauggucuacaccaccuccuaccagcagaucagcggggugcagcagauccaguucuccuga

SEQ ID NO: 33570 - RNA, 1284 nt, Artificial Sequence
  derived and/or modified sequence opt1 from NFYC__Homo_sapiens__XP_011539819
augagcaccgagggcggguucggcgggaccuccagcuccgacgcccagcagagccugcaguccuucuggccccgcgugauggaggagauccggaaccucacggugaaggacuuccgcgugcaggagcugccccuggcccggaucaagaagaucaugaagcucgacgaggacgugaagaugaucagcgcggaggcccccguccuguucgccaaggccgcccagaucuucaucaccgagcugacccuccgcgcguggauccacaccgaggacaacaagcggcgcacgcugcagcggaacgacaucgccauggccaucaccaaguucgaccaguucgacuuccugaucgacaucgugccccgcgacgagcucaagcccccgaagcggcaggaggaggugcgccaguccgucacccccgccgagcccgugcaguacuacuucacccuggcgcagcagcccacggccgugcagguccagggccagcagcaggggcagcagaccaccagcuccaccacgaccauccagccgggccagaucaucaucgcccagccccagcagggccagaccacccccgugacgaugcaggucggggagggccagcagguccagaucgugcaggcccagccccaggggcaggcccagcaggcgcagagcggcaccgggcagaccaugcaggucaugcagcagaucaucaccaacacgggcgagauccagcagaucccggugcagcugaacgccggccagcuccaguacauccggcuggcccagcccguguccgggacccagguggugcagggccagauccagacccuggccaccaacgcccagcaggggcagcgcaacgcgagccagggcaagccccggcgcugccucaaggagacgcugcagaucacccagaccgaggugcagcagggccagcagcaguucucccaguucaccgacgggcagcggaacagcgugcagcaggcccgcgucuccgagcugacgggcgaggccgagccccgggaggugaaggccaccgggaacagcaccccgugcaccuccagccuccccacgacccacccgcccucccaccgcgccggcgcgagcugcgugugcugcagccagccccagcaguccagcaccuccccgccgcccagcgacgcccugcagugggucguggucgagcagcuguaccagauccagcaggucaccaugcccgccgggcaggaccucgcccagcccauguucauccaguccgccaaccagcccagcgacggccaggcgccccaggugacgggcgacuga

SEQ ID NO: 33571 - RNA, 456 nt, Artificial Sequence
  derived and/or modified sequence opt1 from NGB__Homo_sapiens__NP_067080
auggagcgccccgagccggagcugauccggcagagcuggcgcgccgugucccggagcccccucgagcacggcaccguccuguucgcccgccuguucgcgcucgagcccgaccugcugccccucuuccaguacaacugccggcaguucuccagcccggaggacugccuguccagccccgaguuccuggaccacauccgcaaggugaugcucgugaucgacgccgccgucaccaacguggaggaccuguccagccuggaggaguaccucgccucccuggggcggaagcaccgcgccgugggcgucaagcugagcuccuucagcacggugggggagucccuccuguacaugcuggagaagugccucggccccgcguucacccccgccacccgggccgccuggagccagcuguacggggcggugguccaggccaugucccgcggcugggacggcgaguga

SEQ ID NO: 33572 - RNA, 948 nt, Artificial Sequence
  derived and/or modified sequence opt1 from NGDN__Homo_sapiens__NP_001036100
auggccgcccugggcgugcucgagagcgaccugcccuccgcggucacccugcucaagaaccugcaggagcaggucauggccgugaccgcccaggucaagagccugacgcagaaggugcaggccggggccuacccgaccgagaagggccucuccuuccuggaggugaaggaccagcugcuccugauguaccugauggaccucacccaccugauccuggacaaggcgagcgggggcucccuccaggggcacgacgccguccugcgccugguggagauccggaccgugcucgagaagcugcgcccccuggaccagaagcucaaguaccagaucgacaagcugaucaagacggccgucaccggcagccuguccgagaacgacccccuccgguucaagccccacccgagcaacaugauguccaagcugagcuccgaggacgaggaggaggacgaggccgaggacgaccagagcgaggcguccggcaagaaguccgugaagggggugagcaagaaguacgugccgccccgccuggugcccgugcacuacgacgagaccgaggccgagcgggagaagaagcgccucgagcgggccaagcgccgggcccugagcuccagcgucauccgcgagcugaaggagcaguacuccgacgcccccgaggagauccgggacgcgcgccacccccacgugacccggcagagccaggaggaccagcaccgcaucaacuacgaggagagcaugauggugcggcucuccgucagcaagcgcgagaagggccggcgcaagcgggccaacgugauguccagccagcugcacucccugacgcacuucagcgacaucuccgcccucaccgggggcaccgugcaccuggacgaggaccagaaccccaucaagaagcgcaagaagaucccccagaaggggcggaagaagaagggcuuccgccgccggcgcuga

SEQ ID NO: 33573 - RNA, 1857 nt, Artificial Sequence
  derived and/or modified sequence opt1 from NGEF__Homo_sapiens__NP_001107562
auggagcugcucgccgccgcguucagcgccgccugcgccguggaccacgacuccagcaccuccgagagcgacgcccgcgacuccgcggccggccaccuccccgggagcgaguccagcuccaccccgggcaacggggccacgcccgaggaguggcccgcccuggcggacagccccaccacccugaccgaggcccugcggaugauccacccgauccccgccgacuccuggcgcaaccugaucgagcagaucggccuccuguaccaggaguaccgggacaagagcacgcugcaggagaucgagacccgccggcagcaggacgccgagaucgaggacaacaccaacgggucccccgccagcgaggacacccccgaggaggaggaggaggaggaggaggaggaggagccggcguccccgcccgagcgcaagacgcucccccagaucugccugcugagcaacccgcacucccgguucaaccucuggcaggaccugcccgagauccgcagcuccggcguccuggagauccuccagcccgaggagaucaagcugcaggaggccauguucgagcuggugaccagcgaggccagcuacuacaagucccucaaccugcuggugagccacuucauggagaacgagcggauccgcaagauccuccaccccuccgaggcccacauccuguucagcaacguccuggacgugcucgccguguccgagcgguuccugcuggagcucgagcaccgcauggaggagaacaucgucaucagcgacgugugcgacaucguguaccgguacgcggccgaccacuucuccgucuacaucaccuacgugagcaaccagaccuaccaggagcgcacguacaagcagcugcugcaggagaaggccgccuuccgggagcucaucgcccagcuggagcuggacccgaagugccgcggccuccccuucuccagcuuccugauccugcccuuccagcggaucacccgccucaagcugcuggugcagaacauccucaagcgggucgaggagcgcuccgagcgggagugcaccgcgcuggacgcccacaaggagcuggagaugguggugaaggccugcaacgaggggguccgcaagaugagccgcaccgagcagaugaucuccauccagaagaagauggaguucaagaucaagagcgugcccaucaucucccacagccgguggcuccugaagcagggcgagcugcagcagauguccgggccgaagacgagccgcacccuccggaccaagaagcuguuccacgagaucuaccuguuccucuucaacgaccugcuggugaucugccgccagauccccggcgacaaguaccaggucuucgacuccgcgccccgggggcugcuccgcguggaggagcuggaggaccagggccagacccuggccaacguguucauccuccggcugcuggagaacgccgacgaccgcgaggccacguacaugcucaaggccagcagccaguccgagaugaagcgguggaugaccagccuggcccccaaccgccggaccaaguucgucuccuucaccagccgccugcucgacugcccccaggugcagugcgugcaccccuacgucgcgcagcagcccgacgagcugacgcuggagcucgccgacauccugaacauccuggacaagaccgacgacggcuggaucuucggggagcggcuccacgaccaggagcgcggcugguuccccuccagcaugaccgaggagauccugaacccgaagauccggucccagaaccugaaggagugcuuccgcgugcacaagauggacgacccccagcggagccagaacaaggaccgccggaagcucgggucccgcaaccgccaguga

SEQ ID NO: 33574 - RNA, 891 nt, Artificial Sequence
  derived and/or modified sequence opt1 from NGF__Homo_sapiens__XP_011539820
auggccagcuccaacggccacuucaacgaggugcuggccagcgggcgcgcgguccagggcgccggguggcacgccggccccaagcucuccagcgccuccgggccgaacaacagcuucaccaagggcgccgcguucuaccccggccacaccgaggugcacuccgugaugagcaugcuguucuacacgcugaucaccgccuuccucaucgggauccaggccgagccccacuccgagagcaacguccccgccggccacaccaucccgcaggcgcacuggaccaagcugcagcacucccuggacacggcccuccggcgcgcccggagcgcccccgccgcggccaucgccgcccgcguggccgggcagacccggaacaucaccguggacccccgccuguucaagaagcggcgccugcggagcccccgcguccucuucuccacccagccgccccgggaggcggccgacacgcaggaccuggacuucgaggugggcggggccgcccccuucaaccgcacccaccgguccaagcgcagcuccagccaccccaucuuccaccggggcgaguucuccgugugcgacagcgucagcgugugggugggcgacaagaccaccgccacggacaucaaggggaaggaggucauggugcugggcgaggugaacaucaacaacuccgucuucaagcaguacuucuucgagaccaagugccgcgacccgaaccccguggacagcgggugccggggcaucgacuccaagcacuggaacagcuacugcaccaccacgcacaccuucgugaaggcgcucaccauggacggcaagcaggccgccuggcgcuucauccggaucgacaccgccugcgucugcgugcugucccgcaaggccgugcggcgcgcguga

SEQ ID NO: 33575 - RNA, 576 nt, Artificial Sequence
  derived and/or modified sequence opt1 from NGFRAP1__Homo_sapiens__NP_001269603
auggccguggccggcgggggcaagggggagauccugcuccacuggcccccgaagcugggcggggagcugggcggcgacgcgcgccccagccgggaccccgagcuccaguccgacgccgccuucggggccgucgugacccgcguguggcugcccgccccgcggugccccgagcugggcgggcucgcguucggccccggcaagagcggggccgagaagcagcccgagaagaagaaccugaucauggccaacauccaccaggagaacgaggagauggagcagccgaugcagaacggcgaggaggaccgcccccucgggggcggggagggccaccagcccgccggcaaccggcgcgggcaggcgcggcgccuggcccccaacuuccggugggccaucccgaaccgccagaucaacgacggcaugggcggggacggggacgacauggagaucuucauggaggagaugcgggagauccgccggaagcugcgcgagcugcagcuccggaacugccugcgcauccugaugggcgagcucuccaaccaccacgaccaccacgacgaguucugccugaugcccuga

SEQ ID NO: 33576 - RNA, 1284 nt, Artificial Sequence
  derived and/or modified sequence opt1 from NGFR__Homo_sapiens__NP_002498
augggcgccggggccaccggccgcgcgauggacgggccccggcugcuccugcugcuccugcugggcgugagccucgggggcgccaaggaggccugcccgaccggccuguacacgcacuccggggagugcugcaaggccugcaaccugggcgagggggucgcccagcccugcggcgcgaaccagaccgugugcgagcccugccucgacagcgugaccuucuccgacgucgugagcgccaccgagcccugcaagccgugcacggagugcguggggcugcaguccaugagcgcccccugcgucgaggccgacgacgcggugugccgcugcgccuacggcuacuaccaggacgagaccaccggccggugcgaggccugccgcgugugcgaggccggguccggccuggucuucagcugccaggacaagcagaacaccgugugcgaggagugccccgacgggacguacuccgacgaggccaaccacguggaccccugccucccgugcaccgucugcgaggacaccgagcggcagcugcgcgagugcacccggugggcggacgccgagugcgaggagauccccggccgcuggaucacgcggagcaccccgcccgagggcuccgacagcaccgcccccuccacccaggagcccgaggccccgcccgagcaggaccugaucgccagcacgguggcggggguggucaccaccgugaugggcuccagccagcccguggucacccgcgggacgaccgacaaccucauccccguguacugcuccauccuggccgccguggucgugggccugguggccuacaucgccuucaagcgguggaacagcugcaagcagaacaagcagggggcgaacucccgccccgucaaccagacgcccccgcccgagggcgagaagcuccacagcgacagcggcaucuccguggacagccagucccugcacgaccagcagccccacacccagaccgccagcgggcaggcccugaagggcgacgggggccucuacuccagccugcccccggccaagcgggaggaggucgagaagcugcucaacggguccgccggcgacaccuggcgccaccuggcgggcgagcugggguaccagcccgagcacaucgacagcuucacccacgaggccugccccgugcgggcccuccuggccuccugggcgacccaggacagcgccacgcuggacgcccuccuggccgcccugcgccggauccagcgcgcggaccucguggagucccugugcagcgaguccaccgccaccagccccgucuga

SEQ ID NO: 33577 - RNA, 1911 nt, Artificial Sequence
  derived and/or modified sequence opt1 from NGLY1__Homo_sapiens__NP_001138765
auggccgccgcggcccugggcagcuccagcggguccgccagccccgccguggccgagcucugccagaacaccccggagaccuuccuggaggcguccaagcugcuccugacguacgccgacaacauccugcgcaaccccaacgacgagaaguaccggagcauccgcaucggcaacaccgccuucuccacccggcuccugcccguccgcggggccguggagugccuguucgagaugggcuucgaggagggggagacccaccucaucuuccccaagaaggcgagcguggagcagcugcagaagauccgggaccugaucgccaucgagcgcuccagccggcucgacggcuccaacaagagccacaaggucaaguccagccagcagccggccgccuccacgcagcugcccaccacccccagcuccaaccccagcggccugaaccagcacacccgcaaccggcaggggcaguccagcgacccgcccagcgccuccacgguggcggccgacagcgccauccucgaggugcugcaguccaacauccagcacguccugguguacgagaaccccgcccuccaggagaaggcccuggcgugcauccccgugcaggagcugaagcgcaagagccaggagaagcucucccgggcccgcaagcuggacaagggcaucaacaucagcgacgaggacuuccugcuccuggagcugcuccacugguucaaggaggaguucuuccacugggucaacaacgugcugugcuccaagugcgggggccagacccggagccgcgaccggucccugcucccgagcgacgacgagcugaaguggggcgccaaggagguggaggaccacuacugcgacgccugccaguucuccaaccgcuucccccgguacaacaaccccgagaagcugcucgagacccgcugcgggcggugcggcgagugggccaacugcuucacccugugcugccgcgcggucggguucgaggcccgguacgugugggacuacacggagcugcagcgcacccucagccugaagcugaccacccucaaggagaucggcaagacguuccugcgcaucuccaagcggcagaagcugauccagguggucgacgugaccuggcgcuacagcugcaagcacgaggaggugaucgcccggcgcaccaaggucaaggaggcccuccugcgggacaccaucaacgggcugaacaagcagcgccagcuguuccucuccgagaaccggcgcaaggagcugcuccagcggaucaucguggagcugguggaguucaucagccccaagacgccgaagcccggcgagcugggcgggcgcaucuccggcagcgucgccuggcggguggcgcgcggggagaugggccugcagcggaaggagacccucuucauccccugcgagaacgagaagaucuccaagcagcugcaccugugcuacaacaucgugaaggaccgcuacguccgggugagcaacaacaaccagaccaucagcgggugggagaacggcgucuggaagauggaguccaucuuccgcaagguggagaccgacuggcacaugguguaccucgcccggaaggagggcagcuccuucgccuacaucagcuggaaguucgagugcggguccgucggccugaagguggacagcaucuccauccgcacgagcucccagaccuuccagaccgggaccguggaguggaagcugcggagcgacacggcccaggucgagcucaccggcgacaacucccugcacagcuacgcggacuucuccggggccaccgaggugauccuggaggccgagcucagccgcggcgacggcgacguggccuggcagcacacccagcuguuccgccagucccugaacgaccacgaggagaacugccucgagaucaucaucaaguucagcgaccuguga

SEQ ID NO: 33578 - RNA, 900 nt, Artificial Sequence
  derived and/or modified sequence opt1 from NHEJ1__Homo_sapiens__NP_079058
auggaggagcuggagcagggccuccugaugcagcccugggccuggcugcagcucgccgagaacagccugcuggcgaagguguucaucaccaagcagggguacgcccuccuggucuccgaccugcagcaggucuggcacgagcaggucgacaccagcguggugucccagcgcgccaaggagcucaacaagcggcugacggccccgcccgccgcguuccugugccaccucgacaaccugcugcgcccccuccugaaggacgccgcccaccccagcgaggccaccuucuccugcgacugcguggcggacgcccugauccuccgggugcgcagcgagcuguccggccugccguucuacuggaacuuccacugcaugcucgccagccccucccuggugagccagcaccugauccggccccucauggggaugucccuggcccugcagugccaggugcgcgagcucgccacccugcugcacaugaaggaccucgagauccaggacuaccaggagagcggcgcgacccugauccgggaccgccugaagacggagcccuucgaggagaacuccuuccucgagcaguucaugaucgagaagcugccggaggccugcagcaucggggacggcaagcccuucgucaugaaccugcaggaccucuacauggccgugaccacccaggaggugcaggucggccagaagcaccagggggccggcgacccccacaccuccaacagcgccucccugcaggggaucgacagccagugcgugaaccagcccgagcagcugguguccagcgcgccgacgcucagcgcccccgagaaggaguccaccggcaccagcgggccccugcagcggccccagcuguccaaggucaagcgcaagaagccgcggggccucuucagcuga

SEQ ID NO: 33579 - RNA, 402 nt, Artificial Sequence
  derived and/or modified sequence opt1 from NHLH1__Homo_sapiens__NP_005589
augaugcugaacagcgacaccauggagcucgaccugcccccgacccacuccgagacggagagcggcuucuccgacugcgggggcggggccggccccgacggggccggccccggcgggcccggcgggggccaggcgcgcgggccggagcccggcgagcccggccggaaggaccugcagcaccucagccgcgaggagcggcgccggcgccggcgcgccaccgccaaguaccggaccgcccacgccacccgcgagcggauccgcguggaggcguucaaccuggccuucgccgagcugcggaagcuccugcccacgcugccgcccgacaagaagcucuccaagaucgagauccugcgccuggccaucugcuacaucagcuaccucaaccacguccuggacguguga

SEQ ID NO: 33580 - RNA, 1188 nt, Artificial Sequence
  derived and/or modified sequence opt1 from NHLRC1__Homo_sapiens__NP_940988
auggccgccgaggcgagcgaguccggccccgcccugcacgagcucaugcgcgaggccgagaucagccugcuggagugcaaggugugcuucgagaaguucgggcaccggcagcagcgccggccgcgcaaccucuccugcggccacgucgugugccuggccugcguggccgcgcuggcccacccccggacccucgcccuggagugccccuucugccgccgggccugccgcgggugcgacaccagcgacugccugcccguccuccaccugaucgagcugcucggcuccgcgcugcggcagagcccggccgcccaccgcgccgcccccuccgcgcccggggcccugacgugccaccacaccuucggcggcugggggacccucgugaaccccaccggccuggcccugugcccgaagacggggcggguggucguggugcacgacggccgccggcgcgucaagaucuucgacagcgggggcggcugcgcccaccaguucggggagaagggcgacgccgcgcaggacauccgguaccccguggacgugaccaucaccaacgacugccacgucguggugaccgacgccggggaccgcuccaucaaggucuucgacuucuucggccagaucaagcucgugaucggcgggcaguucagccugcccuggggcguggagacgacgccccagaacgggaucgucgugaccgacgccgaggccggcucccugcaccuccuggacguggacuucgccgaggggguccugcggcgcaccgagcggcuccaggcgcaccugugcaacccgcgcggcguggccgugagcuggcugaccggcgccaucgccguccucgagcacccccuggcccuggggaccggcgugugcuccacccgggucaagguguucagcuccagcaugcagcucguggggcaggucgacaccuucggccugucccuguacuuccccagcaagaucacggcguccgccgugaccuucgaccaccaggggaacgugaucgucgccgacaccagcggccccgccauccucugccugggcaagccggaggaguuccccgugcccaagcccauggugacccacgggcugagccacccggucgcgcucacguucaccaaggagaacucccugcuggugcucgacaccgccagccacuccaucaagguguacaaggucgacuggggcuga

SEQ ID NO: 33581 - RNA, 1044 nt, Artificial Sequence
  derived and/or modified sequence opt1 from NHLRC3__Homo_sapiens__NP_001012772
auggcccgcuucugggugugcgucgccggcgcgggguucuuccuggccuuccucgugcugcacagccgguucugcggcucccccgugcugcgcaacuucaccuucgccgucagcuggcggaccgagaagauccucuaccgccuggacgugggguggccgaagcaccccgaguacuucacgggcaccaccuucugcguggccgucgacucccugaacgggcucguguacaucggccagcggggcgacaacauccccaagauccugguguucaccgaggacggguacuuccugcgcgccuggaacuacacggucgacacgccccacggcaucuucgcggccagcacccucuacgagcaguccguguggaucaccgacguggggagcggcuucuucgggcacaccgucaagaaguacuccagcuucggcgaccugguccaggugcugggcaccccggggaagaagggcaccucccucaacccccugcaguucgacaaccccgccgagcuguacguggaggacaccggggacaucuacaucguggacggcgacggcgggcucaacaaccggcugaucaagcugagccaggacuucaugauccucuggcugcacggcgagaacgggacgggccccgccaaguucaacaucccgcacuccgugacccuggacagcgcggggcgcgucuggguggccgaccggggcaacaagcgcauccagguguucgacaaggacaccggcgaguggcucggggccuggaacaacugcuucaccgaggagggccccuccagcguccgguucacgcccgacgggaaguaccugaucguggcccagcugaaccucucccgccugagcguggucgccgcgcccccggugggcuccaucggggagugcagcgucaucuccaccauccagcuggccgaccaggugcucccccaccuccuggagguggaccggaagaccggcgccgucuacguggccgagaucggcgccaagcagguccagaaguacgugccccugaacagcuacgugcccagcuucggguccuga

SEQ ID NO: 33582 - RNA, 273 nt, Artificial Sequence
  derived and/or modified sequence opt1 from NHP2__Homo_sapiens__NP_001030005
augaccaagaucaaggccgaccccgacggccccgaggcccaggcggaggccugcagcggggagcgcaccuaccaggagcugcucgugaaccagaaccccaucgcccagccccuggccucccggcgccugacgcggaagcucuacaagugcaucaagaaggccgucaagcagaagcagauccgccggggcgugaaggaggugcagaaguucgucaacaagggggagaagggcaccugggugcagccccaggcgccgagcgccccgcccguguga

SEQ ID NO: 33583 - RNA, 387 nt, Artificial Sequence
  derived and/or modified sequence opt1 from NHP2L1__Homo_sapiens__NP_004999
augaccgaggccgacgugaaccccaaggccuacccgcuggcggacgcccaccucaccaagaagcugcuggaccucguccagcagagcugcaacuacaagcagcugcgcaagggcgccaacgaggccacgaagacccugaaccgggggaucuccgaguucaucgugauggccgcggacgccgagccccucgagaucauccugcaccucccccugcugugcgaggacaagaacgugcccuacgucuucgugcgcagcaagcaggcccugggccgggccugcggggugucccgcccggucaucgcgugcagcgugaccaucaaggagggcucccagcucaagcagcagauccagagcauccagcaguccaucgagcggcugcugguguga

SEQ ID NO: 33584 - RNA, 4425 nt, Artificial Sequence
  derived and/or modified sequence opt1 from NHS__Homo_sapiens__NP_001129496
auggcccuggccugcugcaugcccaagaacgcggccgugagcaaccucgacaucgaguccaagcugagcgucuacuaccgcgccccguggcaccagcagcggaacaucuuccugcccgccacccgcccgcccugcguggaggagcuccaccggcacgcccgccagucccugcaggcgcugcggcgcgagcaccggagccgcuccgaccggcgcgagcagcgggccgccgcgccccucagcaucgccgccccgccccugcccgccuacccgcccgcccacucccagcgccggcgcgaguucaaggaccggcacuuccugaccuucaacagcacgcgcucccccagccccaccgagugcugccacaugacccccuggucccgcaagagccacccgcccgaggacgaggacaccgacgugaugcucggccagcgccccaagaaccccauccacaacauccccuccacgcuggacaagcagaccaacuggagcaaggcccugccccuccccaccccggaggagaagaugaagcaggacgcgcaggucaucuccagcugcaucauccccaucaacgugaccggggugggcuucgaccgggaggccuccauccgcugcagccugguccacucccagagcgugcugcagcggcgccgcaagcuccggcgccggaagacgaucagcgggaucccccgccgggugcagcaggagaucgacuccgacgagagccccgucgcccgcgagcggaacgugaucgugcacaccaacccggaccccuccaacaccgucaaccgcaucagcggcacccgggacuccgagugccagacggaggacauccugaucgccgcccccagccgccggcgcauccgggcgcagcgcgggcaguccaucgccgccagccugucccacagcgccggcaacaucuccgcccucgcggacaagggcgacaccauguucacccccgccgugagcucccggacccgcagccggucccugccgcgcgaggggaaccggggcggggacgccgagcccaaggugggcgccaagcccagcgccuacgaggagggggaguccuucgucggcgaccacgagcgcacgccgaacgacuucagcgaggcgcccuccagccccagcgcccaggaccaccagcccacccugggccucgccugcucccagcaccuccacagcccgcagcacaagcuguccgagcgcgggcggagccgccucucccggauggccgcggacagcggcuccugcgacaucagcuccaacagcgacaccuucgggucccccauccacugcaucagcaccgccggcgugcugcuguccagccacauggaccagaaggacgaccaccaguccagcuccggcaacuggagcgggagcuccagcacgugccccucccagaccagcgagaccaucccgcccgccgccuccccgccccucaccggcagcucccacugcgacagcgagcugucccugaacacggcgccccacgccaacgaggacgccagcguguucgucaccgagcaguacaacgaccaccuggacaaggugcgggggcaccgggccaacuccuucaccagcaccguggccgaccugcuggacgaccccaacaacuccaacacgagcgacuccgaguggaacuaccuccaccaccaccacgacgccagcugccgccaggacuucucccccgagcggcccaaggcggacagccugggcugccccuccuucaccagcauggccaccuacgacagcuuccuggagaaguccccgagcgacaaggccgacaccuccagccacuucuccgucgacacggagggguacuacaccagcaugcacuucgacugcggccucaagggcaacaaguccuacgugugccacuacgccgcccuggggcccgagaacggccagggggugggcgcgagccccgggcugcccgacugcgccuggcaggacuaccucgaccacaagcgccagggccggccguccaucagcuuccgcaagcccaaggccaagcccacgcccccgaagcgguccagcucccugcgcaagagcgacggcaacgccgacaucuccgagaagaaggagcccaagaucagcuccgggcagcaccucccccacagcucccgggagaugaagcugccgcuggacuucgcgaacacccccagccgcauggagaacgccaaccugcccaccaagcaggagcccagcuggaucaaccaguccgagcagggcaucaaggagccgcagcucgacgccagcgacaucccgcccuucaaggacgaggucgccgaguccacccacuacgccgaccuguggcugcucaacgaccugaagaccaacgaccccuaccggagccuguccaacagcuccaccgcgaccgggacgaccgugaucgagugcaucaagagccccgaguccagcgagucccagaccagccaguccgagagccgcgccaccacgcccucccugcccagcgucgacaacgaguucaagcucgccucccccgagaagcuggccggccuggccagcccguccagcggguacagcucccagagcgagacccccaccuccagcuuccccaccgcguucuucuccggcccccucagcccgggcggguccaagcggaagcccaaggugcccgagcgcaagagcucccugcagcagcccagccugaaggacggcacgaucucccucagcaaggaccuggagcugccgaucaucccgcccacccaccucgaccuguccgcccugcacaacgugcucaacaagcccuuccaccaccggcacccccugcacgucuucacccacaacaagcagaacaccgugggggagacgcugcgcagcaacccgccgcccucccucgccaucacccccaccauccucaagagcgugaaccugcgguccaucaacaagagcgaggaggucaagcagaaggaggagaacaacaccgaccugcccuaccuggaggaguccacgcugaccaccgccgcccucagccccagcaagauccgcccccacaccgcgaacaaguccgugagccgccaguacuccacggaggacaccauccugagcuuccuggacuccagcgccguggagaugggccccgacaagcuccaccuggagaagaacuccaccuucgacgucaagaaccggugcgaccccgagaccaucacgagcgccggcuccagccugcucgacuccaacgugaccaaggaccaggugcgcaccgagaccgagcccaucccggagaacacgcccaccaagaacugcgccuuccccaccgagggguuccagcgggucagcgcggcccgccccaacgaccuggacggcaagaucauccaguacgggccgggccccgacgagacccuggagcagguccagaaggcccccuccgccgggcucgaggagguggcccagcccgagagcguggacgugaucacgucccagagcgacuccccgacccgggcgaccgacgugagcaaccaguucaagcaccaguucgucaugucccgccaccacgacaaggugcccggcaccaucagcuacgagagcgagaucacguccgugaacagcuuccccgagaagugcuccaagcaggagaacaucgccagcggcaucuccgccaagagcgccuccgacaacagcaaggccgaggagacccaggggaacgucgacgaggcgucccugaaggagagcucccccagcgacgacuccaucaucagcccgcuguccgaggacagccaggccgaggccgagggcguguucgugucccccaacaagccccggaccaccgaggaccucuucgccgucauccaccgcagcaagcggaaggugcuggggcgcaaggacagcggcgacauguccgugcggagcaagucccgcgcgccccugagcuccagcuccagcuccgccagcuccaucaccagcccguccagcaacgucacgacccccaacucccagcggagccccgggcucaucuaccgcaacgccaagaaguccaacaccagcaacgaggaguucaagcugcugcuccugaagaagggcucccggagcgacagcuccuaccgcaugagcgccaccgagauccugaagucccccauccucccgaagccgcccggcgagcugacggccgagagcccccaguccaccgacgacgcccaccaggggagccagggcgcggaggcccugagcccccucucccccugcagcccccgggugaacgccgagggguucuccuccaagagcuucgccaccuccgcgagcgcccgcgugggccggucccgcgccccgcccgccgccagcuccagccgcuacuccguccggugccgccuguacaacacccccaugcaggcgaucagcgagggggagacggagaacagcgacggcagcccccacgacgaccgguccucccagagcuccaccuga

SEQ ID NO: 33585 - RNA, 4821 nt, Artificial Sequence
  derived and/or modified sequence opt1 from NHSL1__Homo_sapiens__NP_001137532
augguggucuucaucaacgccaagaucaagagccugaucaagcuguucaagaagaagaccguguccaaccuggacgaggagagccgguggaccgugcacuacacggcccccuggcaccagcaggagaacgucuuccugccgaccacccggccgcccugcguggaggaccuccaccgccaggcgaagcugaaccugaaguccgugcuccgggagugcgacaagcugcgccacgacggcuaccggagcucccaguacuacagccaggggcccaccuucgccgccaacgccucccccuucugcgacgacuaccaggacgaggacgaggagaccgaccagaagugcagccuguccagcuccgaggaggagcgcuucaucagcauccggcgccccaagacccccgccuccagcgacuucuccgaccucaacacccagaccaacuggaccaagagccugccccugccgacgcccgaggagaagaugcggcagcaggcgcagaccguccaggccgacguggugcccaucaacaucaccggcgagaacuucgaccgccaggccucccuccggcgcagccugaucuacacggacacccugguccggcgccccaagaaggugaagcggcgcaagaccaucaccggggugcccgacaacauccagaaggagcucgccuccggcacggggcaggacgacgcggacggccacagcgucuacacccccgaccacuacagcacccugggccgguucaacuccugccgcagcgccgggcagcgguccgagacccgcgacagcuccugccagacggaggacgugaagguggugccgcccagcaugcggcgcauccgcgcccagaagggccaggggaucgccgcccagaugggccacuucuccgggagcuccggcaacaugagcgugcuguccgacagcgcgggcaucguguuccccucccggcucgacagcgacgccggguuccacucccugccccgcagcggcgcccgggccaacauccagucccuggagccccgccucggggcccugggccccgcgggcgacaugaacgggaccuuccuguaccagcggggccacccccaggccgacgagaaccucgggcaccugggcggggccagcggcaccggcacccugcuccgccccaagucccaggagcugcggcacuucgagagcgagaacaucaugagccccgccugcgucgugagcccccacgccacguacagcaccuccaucauccccaacgcgacccugagcuccagcuccgaggugaucgccauccccaccgcccagagcgccgggcagcgcgaguccaagagcuccggcagcucccacgcccggaucaagagccgcgaccaccucaucucccggcacgcggucaagggggacccccagagccccggccgccacuggaacgaggggcacgccacgauccugucccaggaccuggacccccacagccccggcgagcccgcccuccugagccugugcgacuccgccgugccccucaacgcgcccgccaaccgggagaacggcagccaggccaugcccuacaacugccgcaacaaccuggccuuccccgcccacccccaggacguggacgggaaguccgagagcuccuacagcggcgggggcgggcacuccagcuccgagcccugggaguacaagagcuccggcaacggccgggcgagcccccugaagccccaccucgccacccccggguacuccacccccaccagcaacauguccagcugcucccuggaccagacgagcaacaaggaggacgccggcucccuguacagcgaggaccacgacggguacugcgccagcguccacaccgacuccggccacggcagcgggaaccucugcaacuccagcgacggcuucgggaacccccgccacuccgugaucaacgucuucgugggccgggcccagaagaaccagggggaccgcagcaacuaccaggacaagucccugagccggaacaucucccugaagaaggcgaagaagccgccccugccgcccagccgcaccgacucccugcgccggauccccaagaaguccucccagugcaacggccaggugcugaacgagagccucaucgccacccugcagcacucccugcagcugagccuccccggcaaguccgggagcucccccagccagagccccugcuccgaccuggaggagcccuggcugccgcgcagccggucccagagcacggucuccgccggcagcuccaugaccagcgccaccacccccaacguguacucccucugcggggccacccccagccaguccgacacgagcuccgucaaguccgaguacaccgaccccuggggcuacuacaucgacuacaccgggaugcaggaggacccgggcaaccccgcgggcgggugcuccaccagcuccggcguccccacggggaacggcccggugcgccacgugcaggaggggagccgggccaccaugccccagguccccggcggcuccgugaagcccaagaucaugagcccggagaagucccaccgcgugaucucccccagcuccggguacagcucccagagcaacacccccaccgcccugacgcccgucccgguguuccugaaguccgugagccccgccaacggcaaggggaagcccaagcccaaggucccggagcggaaguccagccucaucuccagcguguccaucagcuccagcuccaccagccuguccagcagcaccuccaccgagggcagcgggacgaugaagaagcuggaccccgcggugggcagcccgcccgccccgccgccgccgcccguccccuccccgcccuuccccugccccgccgaccgcucccccuuccugcccccgcccccgcccgugaccgacugcagccagggcagcccccucccccacagccccguguucccgcccccgccgcccgaggcccucauccccuucugcagcccgcccgacuggugccucagcccgccccggcccgcccugucccccauccugcccgacagccccgucucccucccccugcccccgccccugcuccccagcuccgagcccccgcccgcgccgccccucgacccgaaguucaugaaggacacccggccgcccuucaccaacagcgggcagccggaguccagccggggcucccugcggccgcccagcacgaaggaggagaccagccggcccccgaugccccucaucaccaccgaggcccugcagauggugcagcugcgccccgugcggaagaacuccggggccgaggccgcccagcucagcgagcgcacggcgcaggagcagcggacccccgucgccccgcaguaccaccugaagcccuccgccuuccugaagucccgcaacuccaccaacgagauggagagcgagucccagcccgccagcgugaccuccagccuccccacgccggccaaguccagcucccagggcgaccacggcagcgcggccgagcgcgggggccccgugucccgcagccccggggcccccuccgccggcgaggcggaggcccggccgagccccagcaccacgccccugcccgacuccagcccgucccgcaagccgccgcccaucagcaagaagccgaagcuguuccucgucgugccgccgccccagaaggacuucgccguggagcccgccgagaacgucuccgaggcccugcgcgcggugcccagccccaccacgggggaggagggcuccgugcacagccgggaggccaaggaguccagcgccgcccaggccggcucccacgcgacccaccccgggaccagcguccuggagggcggggccgccggcuccaugagccccucccgcguggaggccaacgugcccaugguccagcccgacgugagccccgcccccaagcaggaggagcccgcggagaacuccgccgacaccgggggcgacggcgagagcugccucucccagcaggacggggccgccggcgugcccgagacgaacgccgcggggagcagcuccgaggccugcgacuuccugaaggaggacggcaacgacgaggucaugaccccgagccggccccgcaccaccgaggaccuguucgccgccauccaccgguccaagcgcaaggugcucgggcggcgcgacagcgacgacgaccacucccggaaccacagccccagcccgcccgugacgcccaccggcgcggcccccagccuggccucccccaagcaggucggcagcauccagcgcuccauccgcaaguccuccaccagcuccgacaacuucaaggcccugcuccugaagaaggggagccgcuccgacaccagcgcccggauguccgcggccgagaugcugaagaacaccgacccccgcuuccagcggagccgcagcgagcccucccccgacgcccccgagagcccguccagcugcucccccagcaagaaccggcgcgcccaggaggagugggccaagaacgagggccucaugccccggucccugagcuucuccgggccccgcuacggccgcagccggacgccgcccuccgcggccagcucccgcuacagcaugcggaaccgcauccaguccagccccaugaccgugaucuccgagggcgagggggaggccguggagccggucgacagcaucgcccggggcgcccugggggcggccgagggcugcucccucgacgggcuggcccgcgaggagauggacgagggcggccugcucugcggggagggccccgccgcgagccugcagccccaggcccccgggccgguggacggcaccgccagcgccgaggggcgggagcccagcccccagugcggcggcagccuguccgaggagagcuga

SEQ ID NO: 33586 - RNA, 642 nt, Artificial Sequence
  derived and/or modified sequence opt1 from NICN1__Homo_sapiens__NP_115692
augagccgcgugcugguccccugccacgugaagggcuccguggcccuccaggucggggacgugcggaccagccagggccgcccgggggugcuggucaucgacgugaccuuccccuccguggcccccuucgagcugcaggagaucacguucaagaacuacuacaccgcguuccucagcauccggguccgccaguacaccuccgcccacacccccgccaagugggugacgugccugcgggacuacugccugaugccggacccccacagcgaggagggcgcccaggaguacgugucccucuucaagcaccagaugcugugcgacauggcccgcaucagcgagcugcggcucauccugcgccagcccagcccccuguggcucuccuucaccgucgaggagcugcagaucuaccagcaggggccgaagucccccagcgugaccuuccccaaguggcugucccaccccgugccgugcgagcagcccgcgcuccugcgggagggccugcccgaccccagccgcgucuccagcgaggugcagcagaugugggcccucaccgagaugauccgggccucccacacgagcgcccgcaucggccgguucgacguggacgggugcuacgaccugaaccugcucuccuacaccuga

SEQ ID NO: 33587 - RNA, 3744 nt, Artificial Sequence
  derived and/or modified sequence opt1 from NID1__Homo_sapiens__NP_002499
augcuggccagcuccagccgcauccgggccgcguggacccgcgcccuccugcugccccuccugcuggccggcccgguggggugccucucccggcaggagcuguuccccuucggccccgggcagggcgaccuggagcucgaggacggggacgacuucgucagccccgcccuggagcuguccggcgcccuccgcuucuacgaccggagcgacaucgacgcgguguacgugaccacgaacggcaucaucgccaccuccgagccgcccgccaaggagagccaccccgggcuguucccgcccaccuucggcgccgucgcgcccuuccuggccgaccucgacaccacggacgggcugggcaagguguacuaccgcgaggaccugucccccagcaucacccagcgggccgccgagugcgugcaccgcggguuccccgagaucuccuuccagccgagcuccgccgucguggugaccugggagagcgucgcgcccuaccagggccccucccgggaccccgaccagaagggcaagcgcaacaccuuccaggccgugcucgccagcuccgacagcuccagcuacgccaucuuccuguacccggaggacgggcugcaguuccacacgaccuucagcaagaaggagaacaaccaggugcccgccgucguggcguucucccagggcagcgugggguuccucuggaaguccaacggcgccuacaacaucuucgccaacgaccgggagagcgucgagaaccuggccaaguccagcaacuccggccagcaggggguguggguguucgagaucggcagccccgccaccaccaacggggucgugcccgcggacgugauccugggcacggaggacggggccgaguacgacgacgaggacgaggacuacgaccucgccaccacccgccugggccuggaggacgucggcaccacgccguucuccuacaaggcccuccggcgcgggggcgccgacaccuacagcgugcccuccgugcugagcccccggcgcgcggccaccgagcggccccuggggccgcccaccgagcgcacgcgguccuuccagcucgccgucgagaccuuccaccagcagcacccccaggugaucgacgucgacgagguggaggagaccggcguggucuucagcuacaacaccgacucccgccagacgugcgccaacaaccggcaccagugcagcgugcacgcggagugccgcgacuacgccaccggguucugcugcuccugcguggccggcuacaccggcaacgggcgccagugcgucgccgagggcagcccccagcgggugaacgggaaggugaagggccgcaucuucgucggguccagccaggugccgaucguguucgagaacaccgaccugcacagcuacgucgugaugaaccacggccgguccuacacggccaucagcaccauccccgagaccgugggcuacucccugcucccccuggcgccggucgggggcaucaucggguggauguucgccguggagcaggacggcuucaagaacggcuucagcaucaccgggggcgaguucacgcgccaggccgaggugaccuucgucgggcaccccggcaaccuggugaucaagcagcgguucuccgggaucgacgagcacggccaccucaccaucgacaccgagcuggagggccgcgugccccagauccccuucgggagcuccguccacaucgagccguacacggagcuguaccacuacagcaccuccgugaucaccagcuccagcacccgggaguacaccgugacggagcccgagcgcgacggcgccucccccagccggaucuacaccuaccaguggcgccagaccaucaccuuccaggagugcguccacgacgacucccggcccgcccucccgagcacgcagcagcuguccguggacagcguguucguccuguacaaccaggaggagaagauccuccgcuacgcgcugagcaacuccaucgggcccgugcgggagggcagccccgacgcccugcagaaccccugcuacaucgggacccacggcugcgacaccaacgccgccugccgcccgggcccccggacccaguucacgugcgagugcuccaucggguuccgcggcgacgggcggaccugcuacgacaucgacgagugcagcgagcagcccuccgugugcggcagccacaccaucugcaacaaccaccccgggaccuuccgcugcgagugcgucgagggcuaccaguucuccgacgagggcacgugcguggccguggucgaccagcggccgaucaacuacugcgagaccgggcuccacaacugcgacaucccccagcgcgcgcagugcaucuacaccggcgggagcuccuacacgugcagcugccugcccggcuucuccggggacggccaggccugccaggacguggacgagugccagcccagccgcugccacccggacgccuucugcuacaacacccccggcuccuucacgugccagugcaagcccggguaccagggcgacggguuccggugcgugcccggcgaggucgagaagacccgcugccagcacgagcgggagcacauccugggcgccgcgggggccaccgacccgcagcgccccaucccgcccggccucuucgugcccgagugcgacgcccacgggcacuacgcccccacccagugccacggcagcaccggguacugcuggugcguggaccgggacggccgcgaggucgagggcacccggacccgccccgggaugacgccgcccugccuguccaccguggccccgcccauccaccagggccccgcggugcccaccgccgucaucccccugcccccggggacccaccuccuguucgcccagacgggcaagaucgagcggcugccccuggaggggaacaccaugcgcaagaccgaggccaaggccuuccuccacgugcccgcgaaggugaucaucggccuggccuucgacugcgucgacaagaugguguacuggaccgacaucacggagcccagcaucggccgggccucccugcacgggggcgagccgaccaccaucauccgccaggaccucgggagccccgagggcaucgccguggaccaccuggggcggaacaucuucuggaccgacuccaaccuggaccgcaucgaggucgccaagcucgacggcacgcagcggcgcgugcuguucgagaccgaccuggugaacccccggggcaucgucaccgacagcgugcgcgggaaccucuacuggaccgacuggaaccgggacaaccccaagaucgagaccagcuacauggacggcacgaaccgccggauccugguccaggacgaccuggggcucccgaacggccugaccuucgacgcguucuccagccagcugugcuggguggacgccggcaccaaccgcgccgagugccucaaccccucccagcccagccgccggaaggcccuggaggggcugcaguaccccuucgcggugaccuccuacggcaagaaccucuacuucacggacuggaagaugaacagcgucguggcccuggaccuggccaucuccaaggagaccgacgccuuccagccgcacaagcagacccgccucuacgggaucaccacggcccugagccagugcccccagggccacaacuacugcuccgugaacaacgggggcugcacccaccugugccucgcgacccccggcagccggaccugccgcugccccgacaacacgcugggggucgacugcaucgagcagaaguga

SEQ ID NO: 33588 - RNA, 4128 nt, Artificial Sequence
  derived and/or modified sequence opt1 from NID2__Homo_sapiens__NP_031387
auggagggcgaccgcguggccgggcggcccguccugagcucccucccggugcugcugcuccugccccugcucaugcugcgcgccgcggcccugcaccccgacgagcucuucccccacggcgagagcuggggggaccagcugcugcaggagggcgacgacgaguccagcgccguggucaagcucgccaacccgcugcacuucuacgaggcccgguucuccaaccuguacguggggaccaacggcaucaucagcacccaggacuucccccgcgagacgcaguacguggacuacgacuuccccaccgacuuccccgcgaucgccccguuccucgccgacaucgacaccucccacggccgggggcgcguccuguaccgggaggacaccagccccgccgugcugggccucgcggcccgcuacgugcgggccggguucccccgcuccgcccgguucacgcccacccacgccuuccuggcgaccugggagcaggucggcgccuacgaggaggugaagcgcggggcccugccgagcggcgagcucaacaccuuccaggccgugcuggccuccgacggcagcgacuccuacgcgcuguuccucuaccccgccaacgggcugcaguuccugggcacgcggcccaaggagagcuacaacguccagcuccagcugcccgcccgcgugggguucugccggggcgaggccgacgaccugaaguccgagggcccguacuucagccucaccuccaccgagcagagcgugaagaaccuguaccagcuguccaaccucgggauccccggcgucugggccuuccacaucgggagcaccagcccccuggacaacgugcgccccgcggccgugggcgaccuguccgccgcccacagcuccgucccgcucgggcggagcuucucccacgccacggcgcuggagagcgacuacaacgaggacaaccuggacuacuacgacgugaacgaggaggaggccgaguaccuccccggcgagcccgaggaggcccugaacggccacuccagcaucgacguguccuuccagagcaaggucgacaccaagccccuggaggaguccagcacccucgacccgcacaccaaggaggggacgucccugggcgagguggggggccccgaccugaaggggcagguggagcccugggacgagcgcgagacccggagccccgccccgcccgaggucgaccgcgacucccucgcgcccagcugggagaccccgccccccuaccccgagaacggcuccauccagccguaccccgacggcgggcccgugcccagcgagauggacgucccgcccgcccaccccgaggaggagaucgugcugcgguccuaccccgccagcggccacaccacgccgcugagccgcgggaccuacgaggugggccucgaggacaacaucggguccaacaccgaggucuucaccuacaacgccgccaacaaggagacgugcgagcacaaccaccgccagugcagccggcacgcguucugcaccgacuacgccaccggcuucugcugccacugccaguccaaguucuacggcaacgggaagcacugccugcccgagggcgccccccaccgcgugaacgggaaggugagcggccaccugcacgucggccacacccccgugcacuucacggacguggaccugcacgccuacaucgucgggaacgacggccgggccuacaccgcgaucucccacaucccgcagcccgccgcccaggcccuccugccccugacccccaucgggggccucuucggguggcuguucgcccuggagaagccgggcagcgagaacggcuucucccucgcgggggccgccuucacccacgacauggaggugacguucuaccccggcgaggagaccgugcgcaucacccagaccgccgaggggcuggaccccgagaacuaccugagcaucaagacgaacauccagggccagguccccuacguguccgcgaacuucaccgcccacaucagcccguacaaggagcucuaccacuacuccgacagcaccgugaccuccaccagcucccgggacuacagccugacguucggggccaucaaccagaccugguccuaccgcauccaccagaacaucaccuaccaggucugccggcacgccccccgccaccccagcuucccgaccacgcagcagcugaacguggaccggguguucgcccucuacaacgacgaggagcgcguccugcgguucgcggugaccaaccagaucggccccgugaaggaggacagcgaccccacccccggcaacccgugcuacgacgggucccacaugugcgacaccacggcccgcugccaccccggcaccggggucgacuacaccugcgagugcgccagcggcuaccagggggacggccggaacugcguggacgagaacgagugcgccaccggcuuccaccgcugcgggcccaacuccgugugcaucaaccugcccggcagcuaccggugcgagugccgcuccggguacgaguucgccgacgaccggcacacgugcauccucaucaccccgcccgcgaaccccugcgaggacggcagccacaccugcgcccccgccgggcaggcccgcugcguccaccacggcggcuccaccuucagcugcgccugccugccgggguacgcgggcgacgggcaccagugcacggacguggacgagugcuccgagaaccggugccaccccgccgccaccugcuacaacacccccggcagcuucuccugccgcugccagcccggcuacuacggggacggcuuccagugcaucccggacagcaccuccagccugacgcccugcgagcagcagcagcgccacgcccaggcgcaguacgccuaccccggggcccgguuccacaucccccagugcgacgagcagggcaacuuccucccgcugcagugccacggguccaccggcuucugcuggugcguggaccccgacggccacgagguccccgggacccagacccccccgggcagcacgcccccccacugcgggcccuccccggagcccacccagcgccccccgaccaucugcgagcgguggcgcgagaaccugcucgagcacuacggcgggaccccccgggacgaccaguacgugccccagugcgacgaccugggccacuucaucccccugcagugccacggcaagagcgacuucugcuggugcguggacaaggacgggcgcgagguccagggcacgcggucccagccggggaccacccccgccugcauccccaccguggcccccccgauggugcgccccacgccccggcccgacgucaccccgcccagcgugggcaccuuccuccuguacacccaggggcagcagaucggcuaccugccccucaacggcacgcgccugcagaaggacgcggccaagacccugcucagccugcacggguccaucaucgugggcaucgacuacgacugccgggagcgcauggucuacuggaccgacguggccgggcggaccaucagccgcgccggccuggagcucggcgccgagcccgagaccaucgugaacuccgggcugaucagcccggagggccuggcgaucgaccacauccggcgcacgauguacuggaccgacuccguccucgacaagaucgagagcgcccugcuggacggguccgagcggaaggugcucuucuacaccgaccuggugaacccccgcgccaucgccgucgaccccauccggggcaaccuguacuggaccgacuggaaccgcgaggcccccaagaucgagacgagcucccucgacggggagaaccggcgcauccugaucaacaccgacaucggccugccgaacggccucaccuucgaccccuucagcaagcugcugugcugggcggacgccgggaccaagaagcucgagugcacgcugcccgacggcaccgggcgccgggugauccagaacaaccugaaguaccccuucuccaucgugagcuacgccgaccacuucuaccacaccgacuggcgccgggacggcgucguguccgugaacaagcacagcgggcaguucaccgacgaguaccucccggagcagcgcucccaccuguacggcaucacggccgucuaccccuacugccccaccggccggaaguga

SEQ ID NO: 33589 - RNA, 1134 nt, Artificial Sequence
  derived and/or modified sequence opt1 from NIF3L1__Homo_sapiens__NP_001129511
augcugagcuccugcgugcgccccgucccgaccaccgugcgguucguggacagccugaucugcaacuccagccgcuccuucauggaccugaaggcccugcucagcucccugaacgacuucgccagccuguccuucgcggagagcugggacaacgucggccuccugguggagcccuccccgccccacacggugaacacccuguuccucaccaacgaccugaccgaggaggucauggaggaggugcugcagaagaaggccgaccucauccugagcuaccacccgcccaucuuccggcccaugaagcgcaucacguggaacaccuggaaggagcggcuggugauccgcgcccucgagaaccgggucgggaucuacagcccccacaccgccuacgacgccgcgccccagggcgugaacaacuggcuggccaaggggcugggcgccugcaccucccgccccauccaccccuccaaggcccccaacuacccgacggaggggaaccaccggguggaguucaacgucaacuacacccaggaccucgacaaggugaugagcgcggugaagggcaucgacggcgucuccgugaccagcuucuccgcccgcaccgggaacgaggagcagacgcggaucaaccugaacugcacccagaaggcccugaugcaggucguggacuuccucagccgcaacaagcagcuguaccagaagaccgagauccugagccucgagaagccccugcugcuccacaccggcauggggcggcugugcacgcuggacgaguccgugagccucgccaccaugaucgaccgcaucaagcggcaccugaagcugucccacauccgccucgcccugggcguggggcggacccuggagagccaggucaaggugguggcgcucugcgccggcuccggcagcuccguccugcaggggguggaggccgaccuguaccucaccggcgagaugagccaccacgacacgcuggacgccgccucccaggggaucaacgucauccugugcgagcacagcaacaccgagcgcggcuuccucuccgaccugcgggacaugcuggacagccaccucgagaacaagaucaacaucauccuguccgagaccgaccgcgacccccuccaggugguguga

SEQ ID NO: 33590 - RNA, 1311 nt, Artificial Sequence
  derived and/or modified sequence opt1 from NIM1K__Homo_sapiens__XP_006714513
augaccgccguguacaugaacggcgggggccuggucaacccccacuacgcccgcugggaccggcgcgacagcguggaguccgggugccagaccgagagcuccaaggagggcgaggaggggcagccgcggcagcucacgcccuucgagaagcugacccaggacaugagccaggacgagaaggugguccgcgagaucacccugggcaagcggaucggcuucuaccgcauccgcggggagaucggcuccgggaacuucagccaggugaagcucggcauccacucccugaccaaggagaagguggcgaucaagauccuggacaagacgaagcucgaccagaagacccagcggcugcugagccgggagaucuccagcauggagaagcuccaccaccccaacaucauccgccuguacgaggucguggagacccuguccaagcuccaccuggugauggaguacgccgggggcggcgagcuguucgggaagaucagcaccgagggcaagcucuccgagcccgagagcaagcugaucuucucccagaucgucagcgccgugaagcacaugcacgagaaccagaucauccaccgggaccugaaggccgagaacguguucuacacguccaacacgugcgucaaggugggggacuucggcuucagcaccguguccaagaagggcgagaugcucaacaccuucugcgggagcccgcccuacgccgcgcccgagcuguuccgcgacgagcacuacaucggcaucuacgucgacaucugggcccugggggugcuccuguacuucauggugaccggcaccaugcccuuccgggccgagaccgucgccaagcugaagaaguccauccucgaggggaccuacagcgugccgccccacgugagcgagcccugccaccgccugauccggggcguccugcagcagauccccacggagcgcuacggcaucgacugcaucaugaacgacgaguggaugcagggggugccguaccccacgccccucgagcccuuccagcuggacccgaagcaccuguccgagaccagcacccucaaggaggaggagaacgaggugaaguccacccuggagcaccugggcaucaccgaggagcacauccggaacaaccaggggcgcgacgcgcggagcuccaucaccggcgucuaccgcaucauccuccaccgggugcagcgcaagaaggcccuggagagcguccccgugaugaugcugcccgaccccaaggagcgcgaccucaagaaggggucccggguguaccgcggcauccggcacaccagcaaguucugcuccauccuguga

SEQ ID NO: 33591 - RNA, 4134 nt, Artificial Sequence
  derived and/or modified sequence opt1 from NIN__Homo_sapiens__NP_057434
auggacgagguggagcaggaccagcacgaggcccgccugaaggagcuguucgacagcuucgacaccaccggcacggggucccugggccaggaggagcugaccgaccucugccacaugcugagccuggaggagguggcccccgugcuccagcagacccugcugcaggacaaccuccuggggcgggugcacuucgaccaguucaaggaggcgcugauccucauccugucccgcacccugagcaacgaggagcacuuccaggagccggacugcucccucgaggcccagcccaaguacguccggggcgggaagcgcuacggccggcgcagccugcccgaguuccaggaguccguggaggaguuccccgaggugacggucaucgagccgcuggacgaggaggcccggcccagccacauccccgccggcgacugcuccgagcacuggaagacccagcgcagcgaggaguacgaggccgaggggcagcuccgguucuggaaccccgacgaccugaacgcgucccagagcggcuccagcccgccccaggacuggaucgaggagaagcugcaggaggugugcgaggaccucgggaucacccgcgacggccaccugaaccggaagaagcugguguccaucugcgagcaguacgggcuccagaacgucgacggcgagaugcuggaggagguguuccacaaccuggaccccgacggcaccaugagcguggaggacuucuucuacgggcuguucaagaacggcaagucccugacgcccagcgccuccaccccguaccgccagcugaagcggcaccucagcaugcagagcuucgacgaguccgggcgccggaccaccacgagcuccgccaugaccagcaccaucggcuuccgcgucuucuccugccuggacgacggcauggggcacgccagcguggagcggauccuggacaccuggcaggaggagggcaucgagaacucccaggagauccucaaggcgcuggacuucagccuggacgggaacaucaaccucacggagcugacccuggcccucgagaacgagcugcuggugaccaagaacuccauccaccaggccgcccucgccagcuucaaggcggagauccgccaccuccuggagcgggucgaccagguggugcgcgagaaggagaagcuccgguccgaccuggacaaggccgagaagcucaagagccucauggccuccgaggucgacgaccaccacgccgccaucgagcgccgcaacgaguacaaccugcggaagcuggacgaggaguacaaggagcgcaucgcggcccugaagaacgagcuccggaaggagcgcgagcagauccugcagcaggccggcaagcagcggcuggagcucgagcaggagaucgagaaggccaagaccgaggagaacuacauccgcgaccggcuggcccugagccucaaggagaacucccgccuggagaacgagcugcucgagaacgcggagaagcuggccgaguacgagaaccugacgaacaagcuccagcggaaccuggagaacgugcuggccgagaaguucggggaccucgaccccagcuccgccgaguucuuccugcaggaggagcgccugacccagaugcggaacgaguacgagcgccagugccgggugcuccaggaccaggucgacgagcugcagagcgagcuggaggaguaccgcgcccagggccgggugcuccgccugccccugaagaacucccccagcgaggagguggaggcgaacagcggcgggaucgagccggagcacggccucggguccgaggagugcaacccccugaacaugagcaucgaggccgagcuggucaucgagcagaugaaggagcagcaccaccgggacaucugcugccuccgccuggagcuggaggacaaggugcggcacuacgagaagcagcucgacgagaccgucguguccugcaagaaggcccaggagaacaugaagcagcgccacgagaacgagacccacacgcuggagaagcagaucagcgaccugaagaacgagaucgccgagcuccagggccaggcggccgugcugaaggaggcccaccacgaggcgaccugccgccacgaggaggagaagaagcagcugcaggucaagcucgaggaggagaagacccaccuccaggagaagcugcggcugcagcacgagauggagcugaaggcccgccugacccaggcccaggccuccuucgagcgggagcgcgaggggcuccagagcuccgccuggacggaggagaaggugcggggccugacccaggagcuggagcaguuccaccaggagcagcucaccagccugguggagaagcacacccuggagaaggaggagcuccgcaaggagcugcuggagaagcaccagcgggagcuccaggagggccgcuacgaguccgagaagcugcagcaggagaacagcauccugcggaacgagaucacgacccucaacgaggaggacuccaucagcaaccugaagcuggggacccucaacggcucccaggaggagauguggcagaagaccgagacggucaagcaggagaacgccgccgugcagaagaugguggagaaccugaagaagcagaucagcgagcugaagaucaagaaccagcagcucgaccuggagaacaccgagcugucccagaagaacagccagaaccaggagaagcuccaggagcugaaccagcgccugaccgagaugcucugccagaaggagaaggagcccgggaacuccgcgcuggaggagcgggagcaggagaaguucaaccugaaggaggagcucgagcgcugcaagguccagagcagcacccugguguccagccuggaggccgagcucuccgaggugaagauccagacccacaucguccagcaggagaaccaccuccugaaggacgagcuggagaagaugaagcagcugcaccggugccccgaccugagcgacuuccagcagaagaucuccagcgugcucuccuacaacgagaagcugcugaaggagaaggaggcccucagcgaggagcugaacuccugcguggacaagcuggccaagagcucccuccuggagcaccgcaucgccacgaugaagcaggagcagaaguccugggagcaccagagcgcgagccugaagucccagcucgucgccagccaggagaaggugcagaaccuggaggacaccgugcagaacgucaaccugcagaugucccggaugaaguccgaccuccgcgugacccagcaggagaaggaggcccugaagcaggaggugaugagccugcacaagcagcuccagaacgccggcggcaagagcugggcgccggagaucgccacccaccccagcgggcugcacaaccagcagaagcggcuguccugggacaagcuggaccaccucaugaacgaggagcagcagcugcuguggcaggagaacgagcgccuccagacgaugguccagaacaccaaggccgagcugacccacagccgggagaaggugcgccagcuggaguccaaccuccugcccaagcaccagaagcaccugaaccccagcggcaccaugaacccgacggagcaggagaagcucucccugaagcgggagugcgaccaguuccagaaggagcagagccccgccaaccgcaaggugucccagaugaacagccuggagcaggagcucgagaccauccaccuggagaacgaggggcugaagaagaagcaggucaagcucgacgagcagcugauggagaugcagcaccuccgcuccaccgccacccccagccccuccccgcacgcgugggaccugcagcugcugcagcagcaggccugccccauggugccccgggagcaguuccuccagcugcagcgccagcugcuccaggccgagcggaucaaccagcaccuccaggaggagcuggagaaccgcacgagcgagaccaacaccccgcagggcaaccaggagcagcuggugaccgucauggaggagcggaugaucgagguggagcagaagcugaagcuggugaagcgccuccugcaggagaaggucaaccagcugaaggagcaggucucccuccccgggcaccugugcagccccacgucccacagcuccuucaacagcuccuucaccagccuguacugccacuga

SEQ ID NO: 33592 - RNA, 459 nt, Artificial Sequence
  derived and/or modified sequence opt1 from NINJ1__Homo_sapiens__NP_004139
auggacagcggcaccgaggaguacgagcugaacgggggccugcccccggggacccccggcucccccgacgccagccccgcccgcuggggguggcggcacggcccgaucaacgugaaccacuacgccuccaagaaguccgccgccgagagcaugcucgacaucgcccugcucauggccaacgcgagccagcugaaggccgucguggagcagggccccuccuucgccuucuacgugccccuggucgugcucaucagcaucucccuggugcugcagaucggggucggcgugcuccugaucuuccuggugaaguacgaccucaacaaccccgccaagcacgcgaagcuggacuuccugaacaaccucgccacggggcuggucuucaucaucgugguggucaacaucuucaucaccgccuucggcgugcagaagccgcugauggacauggcgccccagcaguga

SEQ ID NO: 33593 - RNA, 408 nt, Artificial Sequence
  derived and/or modified sequence opt1 from NINJ2__Homo_sapiens__NP_001281274
augauguacaugcccggcagcuccgacccgcgcagccagcccaucaaccugaaccacuacgccaccaagaaguccguggccgagagcaugcucgacgucgcgcuguucauguccaacgccaugcggcugaaggccgugcucgagcaggggcccagcucccacuacuacaccacgcuggugacccugaucagccucucccugcugcuccaggucgugaucggcgugcugcuggucgugaucgcccgccucaaccugaacgagguggagaagcaguggcggcugaaccagcucaacaacgccgcgaccauccuggucuucuucaccguggugaucaacgucuucaucacggccuucggggcccacaagaccggcuuccuggccgcgcgcgccagccggaacccccucuga

SEQ ID NO: 33594 - RNA, 4149 nt, Artificial Sequence
  derived and/or modified sequence opt1 from NINL__Homo_sapiens__NP_079452
auggacgaggaggagaaccacuacgugagccagcugcgcgaggucuacuccagcugcgacaccaccggcacgggguuccucgaccggcaggagcugacccagcugugccucaagcugcaccuggagcagcagcuccccgugcugcugcagacccuccugggcaacgaccacuucgcccgcgugaacuucgaggaguucaaggagggguucgucgccgugcuguccagcaacgcgggcgugcggccguccgacgaggacagcuccagccucgaguccgccgccagcuccgccaucccgcccaaguacgucaacgggagcaagugguacggccgccggucccgccccgagcugugcgacgccgcgaccgaggcccggcgcgugcccgagcagcagacgcaggccagccugaagucccaccucuggcggagcgccucccuggagagcguggagucccccaagagcgacgaggaggcggagagcaccaaggaggcccagaacgagcuguucgaggcccagggccagcuccagaccugggacuccgaggacuucgggagcccccagaaguccugcagccccuccuucgacaccccggagagccagauccgcggcgucugggaggagcugggggugggcuccagcgggcaccuguccgagcaggagcucgccguggucugccagagcgugggccugcagggccuggagaaggaggagcucgaggaccuguucaacaagcuggaccaggacggggacggcaaggugucccucgaggaguuccagcuggggcuguucagccacgagcccgcccuccugcuggaguccagcacgcgggucaagcccuccaaggcguggagccacuaccaggugcccgaggaguccggcugccacaccaccaccacgagcucccucgugagccugugcagcucccugcgccucuucagcuccaucgacgacggcagcggguucgccuucccggaccagguccuggccauguggacccaggagggcauccagaacgggcgggagauccugcagucccucgacuucagcguggacgagaaggugaaccugcuggagcucaccugggcccuggacaacgagcugaugaccgucgacuccgccgugcagcaggcggcccucgccugcuaccaccaggagcugagcuaccagcagggccagguggagcagcuggcccgcgagcgggacaaggcccgccaggaccucgagcgggcggagaagcgcaaccuggaguucgucaaggagauggacgacugccacuccacgcuggagcagcugaccgagaagaagaucaagcaccucgagcagggguaccgggagcgccugagccugcuccgguccgagguggaggccgagcgcgagcuguucugggagcaggcccaccgccagcgggccgcccuggagugggacgucggccgccuccaggcggaggaggccggccugcgggagaagcugacccucgcccugaaggagaacagccgccugcagaaggagaucguggagguggucgagaagcucuccgacagcgagcggcuggcccugaagcuccagaaggaccuggaguucgugcugaaggacaagcucgagccccaguccgcggagcugcuggcccaggaggagcgcuucgccgccgugcucaaggaguacgagcugaagugccgggaccugcaggaccgcaacgacgagcuccaggccgagcuggaggggcugugggcgcggcuccccaagaaccgccacagccccuccuggagcccggacggccggcgccggcagcugcccgggcugggccccgccgggaucagcuuccucggcaacuccgcccccgucagcaucgagaccgagcugaugauggagcaggucaaggagcacuaccaggaccugcgcacgcagcucgagaccaaggugaacuacuacgagcgggagaucgccgcccugaagcgcaacuucgagaaggagcggaaggacauggagcaggcgcgccggcgcgagguguccgugcuggagggccagaaggccgaccucgaggagcugcacgagaagucccaggaggugaucugggggcugcaggagcagcuccaggacaccgcccgcggcccggagcccgagcagauggggcuggcccccugcugcacccaggcccugugcggccucgcgcugcggcaccacagccaccuccagcagauccgccgggaggccgaggccgagcugagcggggagcuguccggccugggcgcccuccccgcgcgccgggaccugacgcuggagcucgaggagccgccccaggggccccugccccgcggcagccagcgguccgagcagcuggagcucgagcgcgcccugaagcugcagccgugcgccagcgagaagcgggcccagaugugcgucucccucgcccuggaggaggaggagcuggagcucgcgcgcgggaagcggguggacggccccagccuggaggccgagaugcaggcccugcccaaggacggccucguggccggguccggccaggaggggacccgcggccugcugccgcuccggcccgggugcggcgagcgcccccuggccuggcuggcgcccggcgacgggcgggagagcgaggaggccgccggcgccgggccgcgccggcgccaggcccaggacaccgaggcgacccagucccccgcccccgcccccgccccggcgagccacggccccuccgagcgguggagccgcaugcagcccugcggggucgacggcgacaucgugcccaaggagccggagcccuucggcgccuccgccgccgggcucgagcagcccggcgcccgggagcugccccugcucgggacggagcgcgacgcgagccagacccagccgcgcaugugggagccgccccugcggcccgccgccagcugccgcggccaggccgagcggcugcaggccauccaggaggagcgcgcgcgguccuggagccgcgggacccaggagcaggccuccgagcagcaggcccgggccgagggcgcccucgagcccggcugccacaagcacagcguggaggucgcgcgccgggggucccugcccagccaccuccagcuggccgacccccagggcuccuggcaggagcagcuggccgcccccgaggagggggagaccaagaucgcccuggagcgcgagaaggacgacauggagacgaagcuccugcaccuggaggacguggugcgggcgcucgagaagcacgucgaccugcgcgagaacgaccggcuggaguuccaccgccucagcgaggagaacacccugcugaagaacgaccucggccgggugcgccaggagcuggaggccgccgaguccacccacgacgcccagcggaaggagaucgaggugcugaagaaggacaaggagaaggcgugcagcgagauggagguccucaaccgccagaaccagaacuacaaggaccagcugucccagcugaacgugcgggugcugcagcucgggcaggaggccagcacccaccaggcccagaacgaggagcaccgcgucacgauccagaugcugacccagucccuggaggagguggugcgcagcggccagcagcaguccgaccagauccagaagcuccgggucgagcuggagugccugaaccaggagcaccagagccuccagcugccgugguccgagcugacccagacccucgaggagagccaggaccaggugcagggcgcccaccuccgccugcggcaggcccaggcgcagcaccuccaggaggugcgccuggucccccaggaccggguggccgagcugcaccgccugcugucccugcagggggagcaggcccggcgccggcucgacgcccagcgcgaggagcacgagaagcagcugaaggccaccgaggagcggguggaggaggcggagaugauccugaagaacauggagaugcuccugcaggagaaggucgacaagcugaaggagcaguucgagaagaacaccaagagcgaccuccugcugaaggagcucuacguggagaacgcccaccuggugcgcgcccugcaggccacggaggagaagcagcggggcgccgagaagcagagccgccuccuggaggagaagguccgggcgcugaacaagcucgugucccgcaucgcccccgccgcccugagcguguga

SEQ ID NO: 33595 - RNA, 765 nt, Artificial Sequence
  derived and/or modified sequence opt1 from NIPA1__Homo_sapiens__NP_001135747
auggccgugggccagaucgggaacuuccuggccuacaccgcgguccccaccgugcucgugacgccgcugggcgcccuggggguccccuucggcagcauccucgccuccuaccugcugaaggagaagcucaacauccuggggaagcugggcugccuccugagcugcgccggcuccguggugcugaucauccacagccccaaguccgagagcgucaccacccaggccgagcucgaggagaagcugaccaaccccguguucgugggguaccugugcaucguccuccugaugcugcuccugcugaucuucuggaucgcgccggcccacggccccacgaacaucaugguguacaucuccaucugcagccuccugggguccuucaccgugcccagcaccaagggcaucgggcuggccgcccaggacauccuccacaacaaccccuccagccagcgcgcgcugugccugugccucguccugcuggccgugcucggcugcuccaucaucgugcaguuccgguacaucaacaaggcccuggagugcuucgacagcuccgucuucggcgccaucuacuacgugguguucaccacgcugguccuccuggccagcgcgauccuguuccgcgagugguccaacguggggcucguggacuuccugggcauggccugcggguucaccaccgucagcgugggcaucgugcugauccaggucuucaaggaguucaacuucaaccucggcgagaugaacaaguccaacaugaagaccgacuga

SEQ ID NO: 33596 - RNA, 1083 nt, Artificial Sequence
  derived and/or modified sequence opt1 from NIPA2__Homo_sapiens__NP_001008892
augagccagggccgcgggaaguacgacuucuacaucggccuggggcucgccauguccagcuccaucuucaucggcgggagcuucauccugaagaagaagggccugcuccggcuggcccgcaagggcuccaugcgggcggggcagggcgggcacgccuaccugaaggaguggcucuggugggccggccugcugagcaugggggccggcgagguggccaacuucgcggccuacgccuucgcccccgcgacccucgucaccccgcugggcgcccuguccgugcucgugagcgccauccuguccagcuacuuccugaacgagcgccucaaccugcacgggaagaucggcugccugcucuccauccuggggagcacggucauggugauccacgcccccaaggaggaggagaucgagacccugaacgagaugucccacaagcucggcgaccccggcuucguggucuucgccacccugguggugaucgucgcgcugauccucaucuucgugguggggccccggcacggccagaccaacauccuggucuacaucacgaucugcagcgugaucggggccuucuccgugagcugcgucaagggccuggggaucgccaucaaggagcuguucgccggcaagccggugcuccgccacccccuggccuggauccuccugcugucccucaucgugugcgucagcacccagaucaacuaccugaaccgggcgcuggacaucuucaacaccuccaucgugacccccaucuacuacguguucuucacgaccagcguccugaccugcagcgccauccucuucaaggaguggcaggacaugcccguggacgacgugaucggcacccuguccggguucuucacgaucaucgucggcaucuuccuccugcacgccuucaaggacgugagcuucucccuggccagccucccggucuccuuccgcaaggacgagaaggccaugaacgggaaccugagcaacauguacgaggugcugaacaacaacgaggagucccugaccugcggcaucgagcagcacaccggggagaacgugagccggcgcaacggcaaccucaccgcguucuga

SEQ ID NO: 33597 - RNA, 1179 nt, Artificial Sequence
  derived and/or modified sequence opt1 from NIPAL3__Homo_sapiens__XP_011540110
auggcccccaccggccugaccuucgccagcccgcccuccgcggugcgcgaggagaaccucaucggggcccugcuggccaucuucggccaccucgucgugagcaucgcccugaaccugcagaaguacugccacauccggcucgccggguccaaggacccccgcgcguacuucaagacgaagaccugguggcugggccuguuccucaugcugcugggggagcucggcguguucgccagcuacgccuucgcgccccugucccugaucgucccgcucagcgccguguccgugaucgccagcgccaucaucggcaucaucuucaucaaggagaaguggaagcccaaggacuuccugcggcgcuacguccuguccuucguggggugcggccucgccguggucgggaccuaccugcuggugaccuucgcccccaacagccacgagaagaugacgggcgagaacgugacccggcaccucgucuccuggcccuuccugcuguacaugcucguggagaucauccuguucugccugcuccuguacuucuacaaggagaagaacgcgaacaacaucguggucauccugcuccugguggcccugcucgggagcaugaccguggucaccgugaaggccguggccggcaugcugguccuguccauccagggcaaccuccagcuggacuacccgaucuucuacgugauguucgugugcauggucgccacggcgguguaccaggccgccuuccugagccaggccucccagauguacgacagcucccucaucgccagcgucggguacauccuguccaccaccaucgcgaucaccgccggcgccaucuucuaccuggacuucaucggggaggacgugcuccacaucugcauguucgcccugggcugccugaucgccuuccucggcguguuccugaucacgcgcaaccggaagaagcccauccccuucgagcccuacaucagcauggacgcgaugccggggaugcagaacaugcacgacaagggcaugaccguccagcccgagcugaaggccagcuucuccuacggggcccucgagaacaacgacaacaucagcgagaucuacgcccccgcgacccugcccgugaugcaggaggagcacggcucccgcagcgccuccggggugccguaccggguccuggagcacaccaagaaggaguga

SEQ ID NO: 33598 - RNA, 1401 nt, Artificial Sequence
  derived and/or modified sequence opt1 from NIPAL4__Homo_sapiens__NP_001092757
augcccggcgacagcuccccggggacccugccccucugggacgccagccuguccccgccccugggccccgaccccgggggcuucagccgcgccucccacgcgggggacaagagccggccgcccgcccccgagcucggcucccccggcgccgugcgcccccgggucgggagcugcgcccccggcccgauggagcugcgcguguccaacaccagcugcgagaacgggucccugcuccaccuguacugcagcucccaggaggugcugugccagaucgucaacgaccucagccccgaggugcccuccaacgccacguuccacagcuggcaggagcggauccgccagaacuacggcuucuacaucgggcugggccuggcguuccucuccagcuuccugaucggcuccagcgugauccugaagaagaaggggcuccugcggcuggucgccaccggcgccacccgcgccguggacgggggcuucggcuaccucaaggacgcgauguggugggccggguuccugaccauggccgccggcgagguggccaacuucggggcguacgccuucgcccccgccacggucgugaccccgcugggcgcccucagcgugcugaucuccgcgauccugagcuccuacuuccuccgggagagccugaaccugcucgggaagcugggcugcgucaucugcguggccggcuccaccgugauggucauccacgcccccgaggaggagaaggugaccacgaucauggagauggccagcaagaugaaggacaccggguucaucguguucgccguccugcuccugguguccugccugauccucaucuucgugaucgcgccccgcuacggccagcggaacauccugaucuacaucaucaucugcagcgucaucggggccuucuccguggccgccgugaagggccuggggaucaccaucaagaacuucuuccagggccuccccgucgugcgccacccgcugcccuacauccugagccucauccuggcccugucccucagcacccaggucaacuuccugaaccgggcgcuggacaucuucaacacgucccucguguuccccaucuacuacguguucuucaccaccgucguggugaccagcuccaucauccuguucaaggagugguacagcauguccgccgucgacaucgccggcacgcugagcggguucgugaccaucauccucggcguguucaugcugcacgccuucaaggaccuggacaucuccugcgcgagccugccccacaugcacaagaacccgccgcccagccccgcccccgagcccaccgucauccgccucgaggacaagaacgugcugguggacaacaucgagcuggccuccaccagcucccccgaggagaagccgaaggucuucaucauccacagcuga

SEQ ID NO: 33599 - RNA, 8094 nt, Artificial Sequence
  derived and/or modified sequence opt1 from NIPBL__Homo_sapiens__NP_056199
augaacggcgacaugccccacgugcccaucaccacccuggccgggaucgccagccugacggaccugcugaaccagcugccccugcccagcccccuccccgcgaccaccaccaagagccugcuguucaacgcccggaucgccgaggaggugaacugccugcucgccugccgggacgacaaccuggugucccagcuggugcacagccucaaccaggucuccacggaccacaucgagcugaaggacaaccugggcagcgacgaccccgagggggacauccccgugcuccugcaggccgugcuggcgcgcucccccaacgucuuccgggagaaguccaugcagaaccgcuacgugcaguccggcaugaugaugagccaguacaagcucucccagaacagcaugcacuccagccccgccuccagcaacuaccagcagaccaccaucucccacagccccuccagccgguucgugccgccccagaccagcuccgggaaccgcuucaugccgcagcagaacagccccguccccucccccuacgccccgcagagccccgccggcuacaugcccuacucccaccccagcuccuacacgacccacccgcagaugcagcaggcgagcguguccagccccaucguggccggcgggcugcggaacauccacgacaacaaggucuccggcccccugagcgggaacuccgccaaccaccacgccgacaacccccgccacggcagcuccgaggacuaccuccacauggugcaccggcugagcuccgacgacggggacagcuccaccaugcgcaacgccgcgagcuucccgcugcggagcccccagcccgugugcucccccgccggcagcgagggcaccccgaaggggucccggccgccccugauccugcagagccagucccugccgugcagcagcccccgcgacgugccgcccgacauccuccuggacagcccggagcgcaagcagaagaagcagaagaagaugaagcugggcaaggacgagaaggagcaguccgagaaggccgccauguacgacaucaucagcucccccagcaaggacuccacgaagcucacccugcggcugagccgcgugcgguccagcgacauggaccagcaggaggacaugaucuccgggguggagaacagcaacgucagcgagaacgacauccccuucaacgugcaguaccccggccagaccuccaagaccccgaucacgccccaggacaucaaccgcccccucaacgccgcgcagugccugagccagcaggagcagaccgccuuccugcccgccaaccaggugccgguccuccagcagaacaccuccguggccgccaagcagccccagaccagcgugguccagaaccagcagcagaucucccagcagggccccaucuacgacgagguggagcuggacgcgcuggccgagaucgagcggaucgagcgcgagagcgccaucgagcgggagcgcuucuccaaggagguccaggacaaggacaagccccucaagaagcgcaagcaggacagcuacccgcaggaggccgggggcgccaccgggggcaaccggcccgcgucccaggagaccgggagcaccggcaacggcucccgccccgcccugauggugagcaucgaccugcaccaggccgggcggguggacucccaggccagcaucacccaggacuccgacagcaucaagaagcccgaggagaucaagcagugcaacgacgcgccggucuccgugcuccaggaggacaucgugggcagccugaaguccacgcccgagaaccaccccgagacccccaagaagaaguccgacccggagcugagcaaguccgagaugaagcagagcgagucccgccucgccgagagcaagcccaacgagaaccggcuggucgagaccaaguccagcgagaacaagcuggagaccaagguggagacgcagaccgaggagcucaagcagaacgagucccgcaccaccgagugcaagcagaacgagagcacgaucguggagcccaagcagaacgagaaccggcuguccgacaccaagccgaacgacaacaagcagaacaacgggcgcagcgagaccaccaagucccggcccgagacgcccaagcagaagggcgagagccgccccgagaccccgaagcagaaguccgacgggcaccccgagacccccaagcagaagggcgacggccggcccgagaccccgaagcagaagggggagagccgccccgagacccccaagcagaagaacgagggccggcccgagacgccgaagcaccgccacgacaaccggcgcgacuccgggaagcccagcaccgagaagaagcccgaggucuccaagcacaagcaggacaccaagagcgacagcccccggcucaagagcgagcgcgccgaggcccugaagcagcggccggacggccgcagcguguccgagagccuccgccgggaccacgacaacaagcagaaguccgacgaccgcggggagagcgagcggcaccgcggcgaccagucccgggugcgccggcccgagacccugcgcagcuccagccggaacgagcacggcaucaaguccgacagcuccaagacggacaagcuggagcgcaagcaccggcacgagagcggggacucccgcgagcggcccagcuccggcgagcagaagucccgccccgacuccccgcgggucaagcagggggacagcaacaagucccgcagcgacaagcucggcuucaagagccccaccuccaaggacgacaagcggaccgagggcaacaagagcaagguggacaccaacaaggcccaccccgacaacaaggcggaguuccccuccuaccugcucgggggccgcagcggggcccucaagaacuucgugaucccgaagaucaagcgggacaaggacggcaacgucacgcaggagaccaagaagauggagaugaagggggagcccaaggacaagguggagaagaucggccugguggaggaccugaacaagggcgccaagcccgucguggugcuccagaagcugucccuggacgacguccagaagcucaucaaggaccgcgaggacaagagccgguccagccugaagcccaucaagaacaagccguccaagagcaacaagggguccaucgaccagagcgugcugaaggagcugccgcccgagcugcuggccgagaucgaguccaccaugccgcucugcgagcgcgugaagaugaacaagcgcaagcggagcaccgucaacgagaagcccaaguacgccgagaucuccagcgacgaggacaacgacuccgacgaggcguucgagagcucccgcaagcggcacaagaaggacgacgacaaggccugggaguacgaggagcgcgaccggcgcagcagcggcgaccaccggcgcuccgggcacagccacgagggccggcgcuccagcgggggcggccgguaccgcaaccggucccccagcgacuccgacauggaggacuacagcccgccgcccucccugagcgagguggcccgcaagaugaagaagaaggagaagcagaagaagcggaaggccuacgagcccaagcugacgcccgaggagaugauggacuccagcaccuucaagcgcuucaccgccuccaucgagaacauccucgacaaccuggaggacauggacuucaccgcguucggggacgacgacgagaucccccaggagcugcuccugggcaagcaccagcugaacgagcucgggagcgaguccgccaagaucaaggccaugggcaucauggacaagcugagcacggacaagaccgugaagguccugaacauccucgagaagaacauccaggacggguccaagcugagcacccugcucaaccacaacaacgacaccgaggaggaggagcggcuguggcgcgaccugaucauggagcgggugacgaaguccgccgacgcgugccucaccaccaucaacaucaugaccagccccaacaugcccaaggccguguacaucgaggacgucaucgagcgcgugauccaguacacgaaguuccaccuccagaacacccuguacccccaguacgaccccguguaccgccucgacccccacggcggcgggcugcugagcuccaaggccaagcgggccaagugcagcacccacaagcagcgcgucaucgugaugcucuacaacaaggugugcgacaucgucuccagccuguccgagcugcucgagauccagcugcugaccgacacgaccauccuccaggugagcuccaugggcaucacccccuucuucguggagaacgucagcgagcugcagcugugcgccaucaagcucgugaccgcgguguucucccgguacgagaagcaccgccagcugauccuggaggagaucuucacgagccucgcccggcugcccaccuccaagcgcagccugcggaacuuccgccucaacuccagcgacauggacggggagccgauguacauccagauggucaccgcccuggugcugcagcucauccagugcgugguccaccuccccuccagcgagaaggacuccaacgccgaggaggacagcaacaagaagaucgaccaggacguggugaucaccaacagcuacgagacggccaugcggaccgcgcagaacuuccuguccaucuuccucaagaagugcggcagcaagcagggggaggaggacuaccgcccccuguucgagaacuucguccaggaccugcucuccaccgugaacaagcccgaguggccggccgccgagcugcugcucagccugcugggccggcuccuggugcaccaguucuccaacaagagcaccgagauggcccugcgcgucgccucccucgacuaccugggcaccguggcggcccggcugcgcaaggacgccgucacgagcaagauggaccagggguccaucgagcggauccucaagcaggucagcggcggggaggacgagauccagcagcugcagaaggcccugcucgacuaccuggacgagaacaccgagaccgaccccucccugguguucagccgcaaguucuacaucgcgcagugguuccgggacaccacgcucgagaccgagaaggccaugaagucccagaaggacgaggagagcuccgagggcacccaccacgccaaggagaucgagaccacgggccagaucaugcaccgcgccgagaaccggaagaaguuccugcgcagcaucaucaagaccacccccucccaguucagcacccugaagaugaacuccgacacggucgacuacgacgacgccugccucaucgugcgguaccuggcgagcaugcgccccuucgcccagagcuucgacaucuaccugacccagauccuccgcgugcugggggagaacgccaucgccguccggaccaaggccaugaagugccuguccgaggugguggcggucgacccgagcauccucgcccgccuggacaugcagcggggcgugcacgggcgccugauggacaacuccaccagcgugcgggaggccgccgucgagcugcucggccgcuucgugcugugccggccccagcuggccgagcaguacuacgacaugcucaucgagcgcauccuggacacggggaucuccgugcggaagcgcgucaucaagauccugcgggacaucugcaucgagcagcccaccuuccccaagaucaccgagaugugcgugaagaugauccgccgggugaacgacgaggagggcaucaagaagcucgucaacgagaccuuccagaagcugugguucacgccgacgccccacaacgacaaggaggcgaugacccgcaagauccugaacaucaccgacgugguggccgccugccgggacacgggcuacgacugguucgagcagcuccugcagaaccugcucaagagcgaggaggacuccagcuacaagcccgucaagaaggccugcacccagcugguggacaaccugguggagcacauccucaaguacgaggagucccuggccgacagcgacaacaagggggucaacuccggccgccugguggcgugcaucaccacccucuuccuguucagcaagauccggccgcagcugauggugaagcacgccaugacgaugcagcccuaccucaccaccaagugcuccacccagaacgacuucauggucaucugcaacguggccaagauccuggagcugguggucccccucauggagcaccccagcgagacguuccuggccaccaucgaggaggaccugaugaagcucaucaucaaguacgggaugaccguggugcagcacugcgucuccugccugggcgcgguggugaacaaggucacccagaacuucaaguucgugugggccugcuucaaccgcuacuacggggccaucagcaagcugaagucccagcaccaggaggacccgaacaacacgagccuccugaccaacaagcccgcccugcuccggucccuguucaccgugggcgcccugugccgccacuucgacuucgaccucgaggacuucaagggcaacagcaaggucaacaucaaggacaaggugcuggagcugcucauguacuucaccaagcacagcgacgaggaggugcagaccaaggcgaucaucgggcugggcuucgccuucauccagcaccccucccugauguucgagcaggaggucaagaaccucuacaacaacauccugagcgacaagaacuccagcgugaaccugaagauccaggugcucaagaaccugcagacguaccugcaggaggaggacacccgcaugcagcaggccgaccgggacuggaagaaggucgccaagcaggaggaccucaaggagaugggggacguguccagcggcauguccagcuccaucaugcagcuguaccugaagcagguccucgaggccuucuuccacacccagagcuccguccgccacuucgcgcugaacgugaucgcccugacccucaaccaggggcugauccaccccgugcagugcgucccguaccugaucgccaugggcacggaccccgagcccgccaugcggaacaaggccgaccagcagcucguggagaucgacaagaaguacgcgggcuucauccacaugaaggccgucgccgggaugaagaugagcuaccaggugcagcaggccaucaacacgugccugaaggaccccgugcgcggcuuccggcaggacgaguccagcuccgcgcugugcagccaccucuacuccaugauccgcgggaaccggcagcaccgccgggccuuccugaucagccugcucaaccuguucgacgacaccgccaagaccgacgucaccaugcugcucuacaucgccgacaaccuggccugcuucccguaccagacccaggaggagccccuguucaucaugcaccacaucgacaucacccucuccgugagcggcagcaaccugcugcaguccuucaaggagagcauggugaaggacaagcgcaaggagcggaaguccagccccuccaaggagaacgagagcuccgacagcgaggaggaggucucccgcccccgcaagagccgcaagcggguggacuccgacagcgacuccgacagcgaggacgacaucaacuccgugaugaagugccucccggagaacagcgcgccccugaucgaguucgccaacgucucccagggcauccugcuccugcugaugcucaagcagcaccugaagaaccugugcggguucagcgacuccaagauccagaaguacagccccagcgaguccgccaagguguacgacaaggccaucaaccgcaagaccggcgugcacuuccaccccaagcagacgcucgacuuccugcggagcgacauggccaacuccaagaucaccgaggaggucaagcgcagcaucgugaagcaguaccuggacuucaagcuccugauggagcaccuggacccggacgaggaggaggaggagggggagguguccgcgagcaccaacgcccggaacaaggccaucaccucccuccugggcgggggcagccccaagaacaacacggccgccgagaccgaggacgacgaguccgacggcgaggaccgcgggggcgggaccagcggcguccggcgccgccggucccagcgcaucagccagcggaucaccuga

SEQ ID NO: 33600 - RNA, 855 nt, Artificial Sequence
  derived and/or modified sequence opt1 from NIPSNAP1__Homo_sapiens__NP_003625
auggcgccccgccugugcagcaucuccgugaccgcccggcgccuccugggcgggccgggcccccgggccggggacgucgccagcgccgccgccgcgcgcuucuacuccaaggacaacgagggcagcugguuccggucccuguucgugcacaagguggacccccgcaaggacgcccacagcacccuccuguccaagaaggagacgagcaaccuguacaagauccaguuccacaacgucaagcccgaguaccucgacgccuacaacucccugaccgaggccgugcugccgaagcuccaccuggacgaggacuaccccugcagccugguggggaacuggaacaccugguacggcgagcaggaccaggcgguccaccucuggcgguucuccggcggguaccccgcccugauggacugcaugaacaagcugaagaacaacaaggaguaccucgaguuccgccgggagcgcagccagaugcugcugucccggcgcaaccagcuccugcuggaguucagcuucuggaacgagccccagccgcggaugggccccaacaucuacgagcuccgcaccuacaagcugaagcccgggacgaugaucgaguggggcaacaacugggcccgggccaucaaguaccgccaggagaaccaggaggccgucgggggcuucuucucccagaucggcgagcuguacguggugcaccaccucugggcguacaaggaccugcagagccgggaggagacccgcaacgccgccuggcggaagcgcgggugggacgagaacguguacuacaccgugccccugguccggcacauggagucccgcaucaugaucccgcucaagaucagcccccugcaguga

SEQ ID NO: 33601 - RNA, 744 nt, Artificial Sequence
  derived and/or modified sequence opt1 from NIPSNAP3B__Homo_sapiens__NP_060846
augcuggugcuccgcagcggccugaccaaggcccuggccucccggacccucgcgccccaggucugcagcuccuucgccacggggccgcgccaguacgacggcaccuucuacgaguuccggaccuacuaccugaagcccagcaacaugaacgccuucauggagaaccugaagaagaacauccaccuccgcaccuccuacagcgagcuggugggguucugguccguggaguucggcgggcggacgaacaaggucuuccacaucuggaaguacgacaacuucgcccaccgcgccgaggugcggaaggcgcuggccaacugcaaggaguggcaggagcagagcaucauccccaaccucgcccgcaucgacaagcaggagaccgagaucaccuaccugauccccugguccaagcuggagaagccgcccaaggagggcguguacgagcucgccgucuuccagaugaagcccggcgggcccgcgcuguggggcgacgccuucgagcgggccaucaacgcccacgugaaccugggguacaccaagguggucggcguguuccacacggaguacggggagcucaaccgcgugcacguccugugguggaacgagagcgccgacucccgggcggccggccgccacaagagccacgaggacccgcgggugguggccgccguccgcgaguccgugaacuaccuggugagccagcagaacaugcuccugauccccgccuccuucagcccccugaaguga

SEQ ID NO: 33602 - RNA, 1752 nt, Artificial Sequence
  derived and/or modified sequence opt1 from NISCH__Homo_sapiens__NP_001263222
auggccaccgcccgcaccuucggccccgagcgggaggcggagccggccaaggaggcccgcguggucgggagcgagcugguggacaccuacaccguguacaucauccaggucaccgacggcucccacgaguggaccgugaagcaccgguacagcgacuuccacgaccuccacgagaagcugguggccgagcgcaagaucgacaagaaccugcucccgcccaagaagaucaucgggaagaacucccggagccuggucgagaagcgcgagaaggaccuggagguguaccuccagaagcugcuggccgcguuccccggcgugacgccccggguccucgcccacuuccugcacuuccacuucuacgagaucaacgggaucaccgccgcccuggcggaggagcuguucgagaagggcgagcagcuccugggcgccggggagguguucgccaucggcccccuccagcuguacgccgugaccgagcagcugcagcaggggaagccgaccugcgccuccggcgacgcgaagacggaccucgggcacauccuggacuucacgugccgccugaaguaccucaaggucagcggcaccgagggccccuucgggaccuccaacauccaggagcagcugcugcccuucgaccucagcaucuucaagucccugcaccagguggagaucagccacugcgacgccaagcacauccggggccugguggccuccaagcccacccucgccacccugagcguccgcuucuccgccaccagcaugaaggaggugcuggugcccgaggcguccgaguucgacgagugggagcccgaggggaccacgcucgagggcccggucaccgccgugauccccaccuggcaggcccugaccacgcuggaccucagccacaacuccaucagcgagaucgacgaguccgugaagcugauccccaagaucgaguuccuggaccucagccacaacggccugcuggucguggacaaccuccagcaccuguacaaccuggugcaccucgaccugagcuacaacaagcuguccagccucgaggggcugcacaccaagcugggcaacaucaagacccucaaccuggccgggaaccugcuggagucccucagcggccugcacaagcuguacucccucgucaaccuggaccugcgggacaaccgcaucgagcagauggaggaggugcggagcaucgggucccuccccugccuggagcacgucagccugcucaacaacccgcuguccaucauccccgacuaccgcaccaaggugcuggcccaguucggcgagcgggcgagcgaggugugccucgacgacacggucaccaccgagaaggagcuggacaccguggaggugcugaaggccauccagaaggccaaggaggucaaguccaagcucagcaaccccgagaagaagggcggggaggacucccgccugagcgccgcccccugcauccggccguccagcuccccgcccacgguggcgcccgccagcgccucccugccccagcccauccucagcaaccagggcaaccgcgugugcauccugcugcucgucgagccccacagccccgccugggcgccguggcugggguggggcugggggcggggcgccuccacgugcuuccagcagggccagacccagggcgggcagugccugcuccaggccgggccccgcggcgggacccacggccggggcgccuggcccgacgccagcugcugccugcugggggaggacucccagcuccuguga

SEQ ID NO: 33603 - RNA, 732 nt, Artificial Sequence
  derived and/or modified sequence opt1 from NIT1__Homo_sapiens__NP_001172021
augcugggcuucaucacccggcccccgcaccgcuuccucagccugcugugccccgggcuccgcaucccccagcuguccgugcugugcgcccagccccggccgcgcgccauggcgaucagcuccagcuccugcgagcucccccuggucgccgugugccaggugaccagcacgcccgacaagcagcagaacuucaagaccugcgccgagcugguccgggaggccgcccgccucggcgcgugccuggccuuccugcccgaggccuucgacuucaucgcccgggacccggcggagacccuccaccuguccgagccccucgggggcaagcugcuggaggaguacacccagcuggcccgcgagugcgggcucuggcugagccugggcggcuuccacgagcgggggcaggacugggagcagacgcagaagaucuacaacugccacgugcuccugaacuccaagggcgccguggucgccaccuaccgcaagacccaccugugcgacguggagauccccgggcagggccccaugugcgagagcaacuccaccaugccggggcccagccucgagucccccgugagcacgcccgccggcaagaucggccuggcggucugcuacgacaugcgguucccggagcugucccucgcccuggcccaggccggggccgagauccugaccuaccccagcgcguucggcuccaucaccgggcccgcccacugggagcccgugagcuccuga

SEQ ID NO: 33604 - RNA, 831 nt, Artificial Sequence
  derived and/or modified sequence opt1 from NIT2__Homo_sapiens__NP_064587
augaccagcuuccgccuggcccucauccagcugcagaucuccagcaucaaguccgacaacgugacccgggccugcagcuucauccgcgaggcggccacgcagggcgccaagaucgucucccugcccgagugcuucaacagcccguacggggccaaguacuuccccgaguacgccgagaagauccccggcgaguccacccagaagcucagcgagguggcgaaggagugcuccaucuaccugaucgggggcagcauccccgaggaggacgccgggaagcuguacaacacgugcgccguguucggcccggacggcacccuccuggccaaguaccggaagauccaccuguucgacaucgacguccccgggaagaucaccuuccaggaguccaagacccucagccccggcgacuccuucagcaccuucgacacccccuacugccgcguggggcugggcaucugcuacgacaugcgguucgcggagcuggcccagaucuacgcccagcgcgggugccagcuccugguguacccgggcgccuucaaccugacgaccggccccgcccacugggagcuccugcagcggucccgcgcggucgacaaccagguguacguggccaccgccagccccgcccgggacgacaaggccuccuacgucgcgugggggcacagcaccguggugaaccccuggggcgagguccuggccaaggccgggacggaggaggccaucguguacuccgacaucgaccucaagaagcuggccgagauccgccagcagaucccgguguuccggcagaagcgcagcgaccuguacgcggucgagaugaagaagcccuga

SEQ ID NO: 33605 - RNA, 627 nt, Artificial Sequence
  derived and/or modified sequence opt1 from NKAIN2__Homo_sapiens__NP_001035304
augggcuacugcagcgggcgcugcacccugaucuucaucugcggcaugcagcucgugugcguccuggagcggcagaucuucgacuuccugggguaccagugggcccccauccucgccaacuucgugcacaucaucaucgugauccugggccuguucgggaccauccaguaccgcccgcgguacaucacgggcuacgcggucuggcucgugcugugggugaccuggaacgucuucgugaucugcuucuaccuggaggccggcgaccucuccaaggagaccgaccugauccugaccuucaacaucagcaugcaccgcuccugguggauggagaacgggcccggcugcacggugaccagcgucacccccgcccccgacugggccccggaggaccaccgguacaucaccguguccgggugccuccuggaguaccaguacaucgagguggcccacagcucccugcagaucguccucgcgcuggccggcuucaucuacgccugcuacguggugaagugcaucacggaggaggaggacagcuucgacuucaucgggggcuucgacuccuacggcuaccaggggccccagaagaccagccaccuccagcugcagcccauguacauguccaaguga

SEQ ID NO: 33606 - RNA, 657 nt, Artificial Sequence
  derived and/or modified sequence opt1 from NKAIN3__Homo_sapiens__NP_001291462
augggcugcugcaccgggcgcugcagccugaucugccucugcgcccugcagcugguguccgcccucgagcggcagaucuucgacuuccugggcuuccagugggcgcccauccuggggaacuuccuccacaucaucgucgugauccugggccuguucgggaccauccaguaccgcccgcgguacaucaugguguacacggucuggaccgcccucugggugaccuggaacguguucaucaucugcuucuaccuggaggucggcggccugagcaaggacaccgaccucaugacguucaacaucuccgugcaccgcagcugguggcgggagcacgggcccggcugcgugcgccggguccugccgcccuccgcccacgggaugauggacgacuacaccuacgugagcgugaccggcugcaucgucgacuuccaguaccuggaggugauccacuccgccgugcagauccuccugagccuggucggguucguguacgccugcuacgugaucuccaucagcauggaggaggaggacaccuucgacuucaucggcggccucgacacgcacuccuacuaccaggaccacgucgagcugaagcccgugaagcccguggagaucagcaacgacaucgagcccgagaugcgccugcucaaccugaccuga

SEQ ID NO: 33607 - RNA, 1248 nt, Artificial Sequence
  derived and/or modified sequence opt1 from NKAP__Homo_sapiens__NP_078804
auggcccccgugagcggcucccgcagcccggaccgggaggccuccgggagcggcgggcgccggcgcuccagcuccaagagccccaagcccuccaagagcgcgcggagcccccgcggccggcgcagccggucccacagcugcucccgcagcggggaccggaacggccugacccaccagcucggcgggcugucccagggcagccgcaaccaguccuaccggagccgcagccggucccgcagccgggagcgcccguccgcgccccgggggauccccuucgccagcgccuccagcuccgucuacuacggcagcuacucccgccccuacgggagcgacaagccguggcccucccugcucgacaaggagcgggaggagagccugcgccagaagcgccuguccgagcgggagcgcaucggcgagcucggcgcccccgaggugugggggcugagccccaagaacccggagcccgacuccgacgagcacacccccguggaggacgaggagcccaagaaguccacgaccuccgccagcaccuccgaggaggagaagaagaagaaguccagccggagcaaggagcgcagcaagaagcggcgcaagaagaaguccagcaagcggaagcacaagaaguacuccgaggacagcgacuccgacagcgacuccgagaccgacagcuccgacgaggacaacaagcgccgggccaagaaggccaagaagaaggagaagaagaagaagcaccgcagcaagaaguacaagaagaagcgguccaagaagucccgcaaggagagcagcgacuccagcagcaaggagucccaggaggaguuccuggagaacccguggaaggaccggacgaaggccgaggagcccagcgaccucaucggccccgaggcgcccaagacccugaccucccaggacgacaagccgcugaacuacgggcacgcccuccugcccggcgagggcgccgccauggccgaguacgucaaggcggggaagcgcaucccccggcgcggcgagaucgggcugaccagcgaggagaucgccuccuucgagugcagcggcuacgugauguccgggagccggcaccgccggauggaggccgugcgccuccgcaaggagaaccagaucuacuccgccgacgagaagcgggcccuggcgagcuucaaccaggaggagcgccggaagcgcgagaacaagauccuggccuccuuccgggagauggucuaccgcaagacgaagggcaaggacgacaaguga

SEQ ID NO: 33608 - RNA, 1413 nt, Artificial Sequence
  derived and/or modified sequence opt1 from NKD1__Homo_sapiens__NP_149110
augggcaagcugcacagcaagcccgccgccgugugcaagcgccgggaguccccggagggggacagcuucgcggucuccgccgccugggcccgcaagggcaucgaggaguggaucgggcggcagcgcugccccggcggggugagcggcccccggcagcuccgccuggccggcaccaucgggcgguccacccgcgagcuggugggcgacguccuccgggacacgcugagcgaggaggaggaggacgacuuccgccuggagguggcgcugcccccggagaagaccgacgggcugggcuccggggacgagaagaagauggagcgggugagcgagcccugccccggcuccaagaagcagcugaaguucgaggagcuccagugcgacgucagcauggaggaggacucccgccaggaguggaccuucacccuguacgacuucgacaacaacggcaaggugacgcgggaggacaucaccagccugcuccacaccaucuacgagguggucgacuccagcgugaaccacucccccaccagcuccaagaugcugcgcgugaagcugacggucgccccggacgggagccaguccaagcggagcgugcucgugaaccaggccgaccugcagagcgcccgcccccgggcggagaccaagcccaccgaggaccugcgcuccugggagaagaagcagcgggcgccccuccgcuuccagggcgacagccggcuggagcaguccgggugcuaccaccacugcgucgacgagaacaucgagcgccgcaaccacuaccuggaccucgccggcaucgagaacuacaccagccaguucggcccggggucccccagcguggcccagaaguccgagcugccgccccggacgagcaaccccacccgcucccggagccacgagcccgaggccauccacaucccccaccgcaagccccagggcguggacccggccuccuuccacuuccuggacacccccaucgccaaggucagcgagcuccagcagcggcugcgcgggacccaggacggcuccaagcacuucgugcggagccccaaggcccaggggaaguccgugggcgucggccacguggcccgcggggcccggaacaagcccccgcugggccccgcgauccccgccgugagccccuccgcccaccucgccgccagcccggcgcugcugcccucccucgcgccccuggggcacaagaagcacaagcaccgcgccaaggagagccagcagggcugccgggggcugcaggccccgcucgccagcggcggccccguccuggggcgcgagcaccuccgggagcuccccgcccugguggucuacgagucccaggccggccagcccgugcagcgccacgagcaccaccaccaccacgagcaccaccaccacuaccaccacuucuaccagacguga

SEQ ID NO: 33609 - RNA, 936 nt, Artificial Sequence
  derived and/or modified sequence opt1 from NKD2__Homo_sapiens__NP_001258011
augggcaagcugcagagcaagcacgccgccgcggcccgcaagcggcgcgagucccccgagggggacagcuucguggccuccgccuacgccagcggccggaagggggcggaggaggccgagcgccgggcccgcgacaagcaggagcucccgaacggcgaccccaaggaggggcccuuccgggaggaccagugcccccugcaggucgcccugccggcggagaaggccgagggccgcgagcaccccggccagcuccuguccgccgacgacggggagcgggccgccaaccgcgagggcccccgggggcccggcgggcagcgccugaacaucgacgcgcuccagugcgacgugagcguggaggaggacgaccggcaggaguggaccuucacccuguacgacuucgacaacugcggcaaggucacgcgcgaggacauguccagccugaugcacaccaucuacgaggugguggacgccuccgucaaccacagcuccggcagcuccaagacccuccgggugaagcugaccgugagcccggagcccuccagcaagcgcaaggaggggccgcccgccggccaggaccgggagcccacgcgcugccggauggagggggagcuggccgaggagccccgcgucgccgaccggcgccucuccgcgcacgugcgccggcccagcaccgacccccagccgugcuccgagcgcggccccuacugcguggacgagaacaccgagcggcgcaaccacuaccuggaccuggccggcaucgagaacuacaccagccgguucgggcccggcagccagcucugcgagaagcgcuccagcgcgccccggacgcacuccggggacaaggcccgcggcgucgggcugugccgggagcuguggagccaggccggccacccgcaguggcccggccccuuccccuccgggcucguggccguguga

SEQ ID NO: 33610 - RNA, 498 nt, Artificial Sequence
  derived and/or modified sequence opt1 from NKG7__Homo_sapiens__NP_005592
auggagcugugccgcagccucgcccugcugggcgggucccucggccugauguucugccugaucgcccucagcaccgacuucugguucgaggcgguggggcccacccacuccgcccacagcggccuguggccgacggggcacggcgacaucaucuccggcuacauccacgucacccagaccuucagcaucauggccgugcugugggcccucguguccgucagcuuccuggugcuguccugcuuccccagccucuucccgcccgggcacggcccccugguguccaccacggccgcguucgccgccgccaucagcauggucguggcgauggccguguacaccuccgagcggugggaccagccgccccacccccagauccagaccuucuucagcugguccuucuaccuggggugggucagcgccauccuccugcugugcaccggcgcccucucccugggggcccacugcggcggcccccgccccggguacgagacgcuguga

SEQ ID NO: 33611 - RNA, 579 nt, Artificial Sequence
  derived and/or modified sequence opt1 from NKIRAS1__Homo_sapiens__NP_065078
augggcaaggggugcaagguggucgugugcggccugcucagcguggggaagaccgccauccuggagcagcugcucuacggcaaccacaccaucgggauggaggacugcgagacgauggaggacgucuacauggccuccguggagaccgaccgcggcgugaaggagcagcugcaccuguacgacacccggggccuccaggagggggucgagcugcccaagcacuacuucagcuucgcggacggcuucgugcugguguacuccgucaacaaccucgagagcuuccagcgcguggagcugcugaagaaggagaucgacaaguucaaggacaagaaggagguggccaucgucgugcucgggaacaagaucgaccuguccgagcagcgccagguggacgccgaggucgcccagcagugggccaagagcgagaaggugcggcugugggaggugaccgucacggaccggaagacccucaucgagccguucacccugcuggcguccaagcucagccagccccaguccaagagcuccuucccccugcccggccgcaagaacaaggggaacagcaacuccgagaacuga

SEQ ID NO: 33612 - RNA, 408 nt, Artificial Sequence
  derived and/or modified sequence opt1 from NKIRAS2__Homo_sapiens__NP_001138400
augggcaagagcugcaagguggucgugugcgggcaggccuccgugggcaagaccagcauccuggagcagcuccuguacgggaaccacgucgugggcuccgagaugaucgagacccaggaggacaucuacguggggagcaucgagacggaccgcggcguccgggagcaggucaccaucguggugcugggcaacaagugcgaccuccaggagcagcgccggguggaccccgacguggcccagcacugggcgaaguccgagaaggucaagcugugggaggugagcguggccgaccgccggucccugcucgagccguucgucuaccuggccagcaagaugacccagccccaguccaagagcgccuucccccugucccgcaagaacaaggggagcggcucccucgacggguga

SEQ ID NO: 33613 - RNA, 2118 nt, Artificial Sequence
  derived and/or modified sequence opt1 from NKRF__Homo_sapiens__NP_001166958
augggcuucaugcugccccucaucuuccgcuacagcccgcggcugauggagaagauccugcagauggccgaggggaucgacaucggcgagaugcccuccuacgaccucgugcugagcaagcccuccaaggggcagaagcgccaccugagcacgugcgacggccagaacccgcccaagaagcaggccggguccaaguuccacgcgcggccccgcuucgagcccguccacuucguggccagcuccagcaaggacgagcggcaggaggaccccuacggcccgcagaccaaggaggugaacgagcagacccacuucgccuccaugccccgcgacaucuaccaggacuacacccaggacagcuucuccauccaggacggcaacagccaguacugcgacuccagcggguucauccucaccaaggaccagcccgucaccgccaacauguacuucgacuccggcaaccccgccccgagcacgaccucccagcaggcgaacagccaguccacccccgagcccagccccagccagaccuucccggaguccgugguggccgagaagcaguacuucaucgagaagcugacggccaccaucuggaagaaccugagcaaccccgagaugaccuccgggagcgacaagaucaacuacaccuacaugcucacgcggugcauccaggccugcaagaccaaccccgaguacaucuacgcgccccugaaggagaucccgcccgccgacauccccaagaacaagaagcugcucaccgacggcuacgccugcgagguccgcugccagaacaucuaccugaccacgggguacgccggcuccaagaacggcagccgggaccgcgccaccgagcuggcggugaagcuccugcagaagcggaucgaggugcgcgucgugcggcgcaaguucaagcacaccuucggggaggaccugguggucugccagaucggcauguccagcuacgaguucccgcccgcccucaagccgcccgaggaccugguggugcuggggaaggacgccuccggccagcccaucuucaacgccagcgccaagcacuggaccaacuucgucaucacggagaacgcgaacgacgccaucggcauccucaacaacuccgccagcuucaacaagauguccaucgaguacaaguacgagaugaugcccaaccggaccuggcgcugccggguguuccugcaggaccacugccuggccgagggguacggcaccaagaagaccagcaagcacgccgcggccgacgaggcccucaagauccugcagaagacgcagcccaccuaccccuccgucaagagcucccagugccacaccgggagcuccccgcgcggcagcgggaagaagaaggacaucaaggaccuggugguguacgagaacagcuccaaccccgugugcacccucaacgacacggcccaguucaaccggaugaccgucgaguacguguacgagcgcaugaccggccugcgguggaagugcaaggugauccuggagagcgaggucaucgccgaggcggugggcgucaagaagaccgugaaguacgaggccgccggggaggccgugaagacgcucaagaagacccagcccaccgucaucaacaaccugaagaagggcgcgguggaggacgugaucucccgcaacgagauccaggggcgcagcgccgaggaggccuacaagcagcagaucaaggaggacaacaucggcaaccagcugcuccggaagaugggguggaccggcggcgggcugggcaaguccggggagggcauccgcgagcccaucagcgucaaggagcagcacaagcgggaggggcugggccucgacguggagcgcgugaacaagaucgccaagcgggacaucgagcagaucauccgcaacuacgcccgguccgagagccacacggaccugaccuucucccgcgagcugaccaacgacgagcggaagcagauccaccagaucgcgcagaaguacggccucaagagcaagucccacggggucggccacgaccgcuaccuggugguggggcggaagcgccggaaggaggaccugcucgaccagcugaagcaggagggccaggucggccacuacgagcuggugaugccgcaggccaacuga

SEQ ID NO: 33614 - RNA, 4389 nt, Artificial Sequence
  derived and/or modified sequence opt1 from NKTR__Homo_sapiens__NP_005376
augggcgcccaggaccgcccccagugccacuucgacaucgagaucaaccgggagccgguggggcgcaucauguuccagcuguucagcgacaucugccccaagaccugcaagaacuuccucugccugugcuccggcgagaaggggcugggcaagaccacggggaagaagcucugcuacaagggcagcaccuuccaccgggucgugaagaacuucaugauccagggcggggacuucuccgagggcaacgggaagggcggggagagcaucuacggcggcuacuucaaggacgagaacuucauccugaagcacgaccgcgccuuccugcucuccauggcgaaccgggggaagcacaccaacggcagccaguucuucaucaccacgaagcccgcgccccaccuggacggggugcacgucguguucggccuggugaucuccggcuucgaggucaucgagcagaucgagaaccucaagaccgacgccgccagccgcccguacgccgacgugcgggugaucgacugcgggguccuggccaccaaguccaucaaggacguguucgagaagaagcgcaagaagcccacccacagcgagggcuccgacagcuccagcaacuccagcuccagcuccgagagcagcuccgagagcgagcuggagcacgagcggucccgccggcgcaagcacaagcggcgccccaaggugaagcggagcaagaagcgccggaaggaggccuccagcuccgaggagccccgcaacaagcacgccaugaacccgaaggggcacagcgagcgguccgacacgaacgagaagcgcagcgucgacuccagcgccaagcgggagaagcccguggugcgccccgaggagaucccgcccguccccgagaaccgcuuccuccugcggcgcgacaugcccguggugaccgcggagcccgagccgaagauccccgacgucgcccccaucguguccgaccagaagcccagcguguccaagagcggccggaagaucaaggggcgcggcaccauccgguaccacaccccgccccgcucccggagcugcuccgagagcgacgacgacgacagcuccgagacgccgccccacuggaaggaggagaugcagcgccugcgggccuaccgcccgcccagcggcgagaagugguccaagggggacaagcucagcgaccccugcuccagccggugggacgagcgcucccugagccagcggucccgcagcugguccuacaacggcuacuacagcgaccuguccaccgcccggcacagcgggcaccacaagaagcgccggaaggagaagaaggucaagcacaagaagaagggcaagaagcagaagcacugccgccggcacaagcagaccaagaagcgccgcauccucauccccuccgacaucgagagcuccaagagcagcacccggcgcaugaaguccagcugcgaccgggagcgcuccagccgguccagcucccugagcucccaccacagcuccaagcgcgacuggagcaaguccgacaaggacgugcagagcucccugacgcacagcucccgggacagcuaccgcuccaagagccacagccaguccuacagccggggguccagccgcucccggaccgccagcaaguccagcucccacagccgcucccggagcaagucccgcagcuccagcaaguccggccaccggaagcgcgcgagcaagagcccccggaagaccgccucccagcucagcgagaacaagcccgugaagaccgagccccugcgcgccacgauggcccagaacgagaacgucgugguccagccggugguggccgagaacauccccgucaucccccuguccgacagcccgccgcccucccgguggaagcccggccagaagcccuggaagcccagcuacgagcgcauccaggagaugaaggcgaagaccacccaccuccugcccauccaguccaccuacagccuggccaacaucaaggagacgggguccagcuccagcuaccacaagcgggagaagaacuccgagagcgaccaguccaccuacagcaaguacuccgaccgcagcuccgagagcagcccccgcagccggagccgcuccagccggucccgcagcuacucccggagcuacacccgcucccggagccucgccuccagccacucccgcagccggucccccagcucccgcagccacucccggaacaaguacagcgaccacucccagugcagccgcagcuccagcuacaccuccaucagcuccgacgacggccggcgcgccaagcggcgccugcggagcuccgggaagaagaacagcgugucccacaagaagcacagcuccagcuccgagaagacgcugcacagcaaguacgugaagggccgcgaccgguccagcugcguccgcaaguacuccgagagccgcuccagccucgacuacagcuccgacagcgagcaguccagcgugcaggccacccaguccgcgcaggagaaggagaagcaggggcagauggagcggacccacaacaagcaggagaagaaccgcggcgaggagaaguccaaguccgagcgggagugcccgcacagcaagaagcgcacccugaaggagaaccuguccgaccaccuccggaacggcagcaagcccaagcgcaagaacuacgccggguccaagugggacagcgaguccaacagcgagcgggacgugacgaagaacuccaagaacgacagccaccccuccagcgacaaggaggagggcgaggccaccagcgacuccgagagcgaggucuccgagauccacaucaaggugaagcccaccaccaagagcuccacgaacaccagccugccggacgacaacggggccuggaaguccagcaagcagcgcaccuccaccagcgacuccgagggcagcugcuccaacagcgagaacaaccggggcaagccccagaagcacaagcacggguccaaggagaaccugaagcgcgagcacaccaagaaggugaaggagaagcucaagggcaagaaggacaagaagcacaaggcccccaagcggaagcaggcguuccacuggcagcccccgcuggaguucggggaggaggaggaggaggagaucgacgacaagcaggucacgcaggagagcaaggagaagaagguguccgagaacaacgagaccaucaaggacaacauccugaagaccgagaaguccagcgaggaggaccucagcggcaagcacgacaccgugacggucagcuccgaccuggaccaguucaccaaggacgacagcaagcuguccaucagccccaccgcccucaacaccgaggagaacguggccugccugcagaacauccagcacguggaggaguccguccccaacgggguggaggacgugcugcagacggacgacaacauggagaucugcacccccgaccgcagcuccccggccaaggucgaggagaccagcccccucggcaacgcgcggcuggacacccccgacaucaacaucgugcugaagcaggacauggccacggagcacccgcaggccgagguggucaagcaggaguccagcauguccgagagcaaggugcucggcgagguggggaagcaggacuccagcuccgccagccuggccuccgcgggcgagagcaccgggaagaaggaggucgccgagaagucccagaucaaccugaucgacaagaaguggaagccccugcagggcguggggaaccucgccgcccccaacgccgcgaccagcagcgccguggaggucaaggugcugaccacggugcccgagaugaagccgcagggccugcgcaucgagaucaaguccaagaacaagguccggcccggcagccucuucgacgaggugcgcaagaccgcccggcugaaccgccggccccgcaaccaggaguccagcuccgacgagcagacccccagccgggacgacgacucccagagccgcuccccgagccgcucccggagcaaguccgagaccaagagccgccaccggacgcgcuccgugagcuacucccacagccggucccgcagccggagcuccaccagcuccuaccgcagccgguccuacagccgcucccggagccgcgggugguacucccggggccgcacccggagccgcuccagcuccuaccggagcuacaagucccaccgcaccagcucccggagccgcucccgcagcagcuccuacgacccccacagccggucccgcagcuacacguacgacuccuacuacagccggucccgcagccggucccgcagccagcgguccgacagcuaccaccgcgggcgguccuacaaccgccggagccgcuccugccggagcuacggcuccgacagcgaguccgaccgcagcuacagccaccaccggucccccagcgaguccagccgcuacuccuga

SEQ ID NO: 33615 - RNA, 1347 nt, Artificial Sequence
  derived and/or modified sequence opt1 from NKX1-1__Homo_sapiens__NP_001277008
augagcgccuccggccccgaggccccgggggacauccccgcccugccgcccccgccccagcccggcagcgggcccgccccgcccgcccccgccgccgcggcccaggaggccauggacggccgcgccgagcuccccgcguucccgcgggccggggccccgccccuggccgccuccgacaccgugcccgcggcccccgagggcgccggcgccgcccgccccgcggcgccccugcggcccaccagcuucuccguccucgacauccuggacccgaacaaguucaacagccgccggcgccggugcgugcugcucgggcccguggcccccgccgccugcgcccccugcgccuccgccccgugcgcccccgcccccgcggccagcggccggcccccgcgggccgaggagcuggagcgccgggcccuggcgggggccggcggggucggcgccgccggcgccgagccgcccaacgcgggggaccccuucaaggccggcgaggccgagacgaacgacaccaacggguacuccagcggcggcgggggccacucccccagcgccgacuccggggacgaggugcccgacgacgaggacgacgacgaggacgaggcccccgagaccgaggcggcccgcggcgccgaggaggcccgcgggggcggcgggggccucggggcccgcggcagcgggugccagggcgcggccgagaccgacgccuccccgggcgccacgguggacgaggcggccgcccccgggccccgggagaacagccccgucgcccagggcccgcccgggggcgccgcggcccccgggggcgccggcaccacgccccaggggaccgccaccgccgcgaagccgaagcgcaagcggaccggcuccgacagcaaguccgggaagccccgccgggcccgcaccgccuucaccuacgagcagcugguggcccuggagaacaaguucaaggccacgcgguaccucagcgugugcgagcgccugaaccuggcgcucagccugucccugaccgagacccaggucaagaucugguuccagaaccgccggaccaaguggaagaagcagaaccccggcgccgacacgagcgcccccaccggcgggggcgggggcccggggcccggcgccggccccgggaccggccuccccgggggccuguccccgcugagccccuccccgcccaugggggcgccccucggcaugcacggccccgccggguaccccgcccacggccccgggggccuggugugcgccgcccagcugcccuuccucagcucccccgcggugcugagccccuucguccuggggucccagaccuacggcgccccggccuucuacgcgccccaccucuga

SEQ ID NO: 33616 - RNA, 933 nt, Artificial Sequence
  derived and/or modified sequence opt1 from NKX1-2__Homo_sapiens__NP_001139812
augcuggccuggcaggacggcggggccaaggccgcccccagccaccacaagaucuccuucagcgugcucgacauccuggacccgcagaaguucacccgcgccgcccugcccgccgugcggcccgcgccccgcgaggcccggaagucccucgccgagguggaggccggcaaggacgcgagcucccgcgacccggugcggcagcuggagacccccgacgccgccgggcccggcgccgggcaggccagcccccuggagggcuccgaggcggaggaggaggaggacgccgaggacccgcgccggccccgccuccgggagcgcgccgcccggcugcugcccggccucgcccgcagccccgacgcgccggccggggcccuggccuccggcgagcccugcgaggacgggggcgggggccccguccggagcccgcccggcucccccgggagcccccgcccccggcgccggcgccuggagccgaacugcgccaagccccggcgcgcgcggacggccuucaccuacgagcagcucguggcccuggagaacaaguuccgcgccacccgcuaccuguccgugugcgagcggcucaaccuggcccugagccucucccugaccgagacgcaggucaagaucugguuccagaaccgccggaccaaguggaagaagcagaaccccggcgcggacggggccgcccaggugggcggcggggcgccccagccgggcgccgccgggggcgggggcggcgggggcagcgggggcucccccgggccgcccggcaccggcgcccugcacuuccagaccuuccccagcuacuccgccgccaacguccucuuccccagcgcggccagcuucccccugacggccgccgccccggggucccccuucgcgcccuuccugggccccagcuaccucaccccguucuacgcgccccgccuguga

SEQ ID NO: 33617 - RNA, 1206 nt, Artificial Sequence
  derived and/or modified sequence opt1 from NKX2-1__Homo_sapiens__NP_001073136
auguggagcggcggguccggcaaggcccgcgggugggaggccgcggccggcgggcggagcucccccggccgccugagccggcgccggaucauguccaugagcccgaagcacaccacccccuucuccgugagcgacauccucagcccccuggaggaguccuacaagaaggucggcauggagggcggcgggcugggggcgccccucgccgccuaccgccaggggcaggccgccccgcccacggccgccaugcagcagcacgcggugggccaccacggcgccgugaccgccgccuaccacaugaccgccgcgggggucccccagcugucccacagcgccgugggcggguacugcaacggcaaccugggcaacauguccgagcugcccccguaccaggacaccaugcggaacagcgccuccgggcccggcugguacggggccaaccccgacccccgcuucccggccaucagccgguucaugggccccgcguccgggaugaacaugagcggcaugggcgggcucggcucccugggggacgugagcaagaacauggcgccccuccccagcgccccgcgccggaagcgccggguccuguucucccaggcccagguguacgagcuggagcgccgguucaagcagcagaaguaccucagcgcccccgagcgcgagcaccuggccuccaugauccaccugacgcccacccaggugaagaucugguuccagaaccaccgguacaagaugaagcgccaggccaaggacaaggccgcccagcagcagcuccagcaggacagcggcgggggcggcgggggcgggggcaccgggugcccccagcagcagcaggcccagcagcaguccccgcggcgcgucgcggugcccgugcuggucaaggacggcaagcccugccaggccggcgcccccgccccgggggcggccagccugcagggccacgcccagcagcaggcccagcaccaggcccaggcggcccaggccgccgccgcggccaucuccguggggagcggcggcgccgggcucggcgcccaccccgggcaccagcccggcuccgccgggcagagccccgaccuggcgcaccacgccgccuccccggccgcgcugcagggccaggugagcucccucagccaccugaacuccagcggcuccgacuacgggaccaugagcugcuccacgcugcucuacggccggaccugguga

SEQ ID NO: 33618 - RNA, 822 nt, Artificial Sequence
  derived and/or modified sequence opt1 from NKX2-2__Homo_sapiens__NP_002500
augagccugaccaacaccaagacgggcuucuccgugaaggacauccucgaccugcccgacaccaacgacgaggaggggagcgucgccgagggcccggaggaggagaacgaggggcccgagcccgccaagcgcgcgggcccccuggggcagggcgcccucgacgccgugcagucccugccgcugaagaaccccuucuacgacagcuccgacaaccccuacacccgguggcucgccagcaccgagggccugcaguacucccugcacgggcucgccgcgggcgccccgccgcaggacagcuccagcaagucccccgagcccagcgccgacgagucccccgacaacgacaaggagacgcccgggggcgggggcgacgccggcaagaagcgcaagcggcgcgugcuguucagcaaggcgcagaccuacgagcuggagcggcgcuuccggcagcagcgcuaccucuccgcccccgagcgggagcaccuggccagccugauccgccucacccccacccaggucaagaucugguuccagaaccaccgguacaagaugaagcgcgcccgggccgagaaggggauggaggugacgccccugccgagcccccgccggguggcgguccccgugcuggugcgcgacggcaagcccugccacgcccucaaggcccaggaccuggccgccgcgaccuuccaggccgggaucccguucuccgccuacuccgcccagagccugcagcacaugcaguacaacgcccaguacagcuccgcgagcacgccccaguaccccaccgcccacccccucguccaggcccagcaguggaccugguga

SEQ ID NO: 33619 - RNA, 1095 nt, Artificial Sequence
  derived and/or modified sequence opt1 from NKX2-3__Homo_sapiens__NP_660328
augaugcugcccagcccggugaccuccacccccuucagcgucaaggacauccucaaccuggagcagcagcaccagcacuuccacggcgcccaccuccaggccgaccucgagcaccacuuccacuccgcgcccugcaugcuggccgccgccgaggggacgcaguucagcgacggcggggaggaggacgaggaggacgagggcgagaagcuguccuaccucaacagccuggccgcggccgacgggcacggcgacuccggccugugcccccagggguacgugcacaccgugcuccgcgacagcugcuccgagccgaaggagcacgaggaggagcccgaggucgugcgggaccgcagccagaaguccugccagcugaagaagucccuggagaccgccggcgacugcaaggccgcggaggagagcgagcggcccaagccccgcagccggcgcaagccgcgggugcuguucucccaggcccaggucuucgagcuggagcgccgguucaagcagcagcgcuaccugagcgcccccgagcgggagcaccucgccuccagccugaagcugaccuccacccaggugaagaucugguuccagaaccgccgguacaagugcaagcgccagcggcaggacaagagccucgagcugggggcccacgcgcccccgcccccgccccgccggguggccguccccgugcuggugcgcgacggcaagcccugcgucacgcccagcgcccaggccuacggggcccccuacuccgugggcgcgagcgccuacuccuacaacagcuuccccgccuacggcuacgggaacuccgccgccgcggccgccgccgccgcggccgccgccgcggccgccgccgccuacagcuccagcuacggcugcgcguacccggccgggggcggcgggggcgggggcgggaccuccgccgccaccacggccaugcagcccgcgugcagcgccgccggcggcgggcccuucgugaacgucuccaaccucggcggguucggcagcgggggcuccgcccagccccugcaccagggcaccgccgcgggggccgccugcgcccagggcacccugcaggggauccgggcgugguga

SEQ ID NO: 33620 - RNA, 339 nt, Artificial Sequence
  derived and/or modified sequence opt1 from NKX2-5__Homo_sapiens__NP_001159647
auguuccccagcccggcccugacccccacccccuucuccgugaaggacauccucaaccuggagcagcagcagcgcagccuggccgcggccggcgagcucuccgcccggcuggaggccacgcuggcccccagcuccugcaugcucgcggccuucaagccggaggccuacgccgggcccgaggcggccgcccccggccugcccgagcugcgcgccgagcucgggcgggccccgagccccgcgaagugcgccuccgccuuccccgccgcccccgcguucuacccgcgcgccuacagcgaccccgaccccgccaaggacccccgggccgagaagaaggccuga

SEQ ID NO: 33621 - RNA, 906 nt, Artificial Sequence
  derived and/or modified sequence opt1 from NKX2-6__Homo_sapiens__NP_001129743
augcugcucagccccgugaccuccaccccguucagcgucaaggacauccugcgccuggagcgggagcgcuccugccccgccgccagcccccacccccgggugcgcaaguccccggagaacuuccaguaccuccggauggacgcggagccccgcggcagcgaggugcacaacgccgggggcgggggcggggaccggaagcuggacggcuccgagccgcccggcgggcccugcgaggccguccuggagauggacgccgagcgcaugggcgagccccagcccgggcucaacgccgcgagcccccugggcgggggcacccgggugccggagcgcggcguggggaacuccggcgacagcguccgcgggggccgguccgagcagcccaaggcccggcagcgccggaagccccgcgugcuguucagccaggcccaggugcucgcccuggagcggcgcuucaagcagcagcgguaccuguccgcgcccgagcgcgagcaccucgccagcgcccugcagcugaccuccacccaggucaagaucugguuccagaaccggcgcuacaagugcaagcgccagcggcaggacaagagccucgagcuggccggccacccgcugacgccccgccggguggccgugcccguccucgugcgcgacgggaagcccugccugggcccggggcccggcgcgcccgccuuccccuccccguacagcgccgccgugucccccuacagcugcuacgggggcuacagcggcgcccccuacggggcgggcuacgggaccugcuacgccggcgcccccuccgggccggcgccccacacgccccuggccagcgccggcuucggccacgggggccagaacgccaccccgcaggggcaccucgccgccacccugcagggcguccgggccugguga

SEQ ID NO: 33622 - RNA, 720 nt, Artificial Sequence
  derived and/or modified sequence opt1 from NKX2-8__Homo_sapiens__NP_055175
auggccaccagcggccgccuguccuucaccgugcggagccuccuggaccugcccgagcaggacgcccagcaccucccgcgccgggagcccgagccccgcgcgccccagccggaccccugcgccgccuggcuggacuccgagcgggggcacuaccccagcuccgacgagagcucccuggagacgagcccgcccgacuccagccagcgccccuccgcccggcccgccagccccggcuccgacgcggagaagcgcaagaagcggcgcguccucuucagcaaggcccagacccuggagcuggagcggcgcuuccggcagcagcgcuaccucuccgccccggagcgggagcagcuggccagccugcuccgccugacccccacccaggugaagaucugguuccagaaccaccgguacaagcugaagcgcgcgcgggcccccggggccgccgagucccccgaccucgccgcgagcgccgagcugcacgccgccccgggccugcuccgccggguggucgugcccgugcugguccgcgacgggcagcccugcggcggcgggggcgggggcgagguggggacggccgcggcccaggagaagugcggcgcgcccccggccgccgccugcccccugcccggcuaccccgccuucgggccgggcuccgcccucgggcuguuccccgccuaccagcaccuggccagccccgcgcucgugagcuggaacugguga

SEQ ID NO: 33623 - RNA, 480 nt, Artificial Sequence
  derived and/or modified sequence opt1 from NKX3-1__Homo_sapiens__NP_001243268
augcugcgcgugcccgagccgcggcccggcgaggccgagacccucgccgagaccgagcccgagcgccaccuggggagcuaccugcucgacuccgagaacacgagcggcgcgcugccccggcugccgcagacccccaagcagccccagaagcgcucccgggccgccuucagccacacccaggucaucgagcucgagcgcaaguucucccaccagaaguaccugagcgcccccgagcgggcccaccuggcgaagaaccucaagcugaccgagacccaggugaagaucugguuccagaaccgccgguacaagacgaagcgcaagcagcuguccagcgagcucggggaccuggagaagcacuccagccugccggcccucaaggaggaggccuucucccgggccagccugguguccgucuacaacagcuaccccuacuaccccuaccuguacugcgugggcuccuggagccccgcguucugguga

SEQ ID NO: 33624 - RNA, 1104 nt, Artificial Sequence
  derived and/or modified sequence opt1 from NKX6-1__Homo_sapiens__XP_006714293
augcuggccgugggcgccauggaggggacccgccagagcgcguuccuccuguccagcccgccccuggccgcccuccacuccauggccgagaugaagacgccccuguaccccgccgcguacccgccccugcccgccggcccgcccagcuccagcuccagcuccagcuccagcuccagccccuccccgccccucgggacccacaaccccggcgggcugaagccgcccgccaccggcggccugagcucccucgggagcccgccccagcagcuguccgccgcgacgccccacggcaucaacgacauccugagccggcccagcaugcccgucgccuccggggccgcccuccccagcgccucccccagcggcuccagcuccagcuccagcuccagcgcguccgccagcuccgccagcgccgccgcggccgccgccgccgcggccgccgccgccgcguccagccccgccgggcugcuggccggccucccccgcuucuccagccugagcccgcccccgccgccgcccggccuguacuucucccccagcgccgcggccguggccgccguggggcgguaccccaagccccucgccgagcugcccggccgcacccccaucuucuggcccggggucaugcaguccccgcccuggcgggacgcgcgccuggccugcacgccccaccagggcagcauccuccuggacaaggacggcaagcggaagcacacccgccccaccuucuccgggcagcagaucuucgcccuggagaagaccuucgagcagaccaaguaccucgccggccccgagcgggcccgccuggcguacagccuggggaugaccgagucccaggugaaggugugguuccagaaccggcgcaccaaguggcggaagaagcacgccgccgagauggccaccgccaagaagaagcaggacagcgagacggagcgccucaagggcgcguccgagaacgaggaggaggacgacgacuacaacaagccccuggaccccaacagcgacgacgagaagaucacccagcugcucaagaagcacaaguccagcuccgggggcggcgggggccugcugcuccacgccagcgagcccgaguccagcuccuga

SEQ ID NO: 33625 - RNA, 834 nt, Artificial Sequence
  derived and/or modified sequence opt1 from NKX6-2__Homo_sapiens__NP_796374
auggacaccaaccgccccggcgccuucgugcugagcuccgccccgcucgcggcccugcacaacauggccgagaugaagaccagccuguuccccuacgcccuccaggggcccgccggcuucaaggcgcccgcccucgggggccugggggcccagcugccgcugggcacgccccacggcaucuccgacauccuggggcggcccgucggcgccgccgggggcgggcuccugggcggccugccccgccucaacgggcuggcgagcuccgccggcguguacuucgggccggccgccgcgguggcccggggcuaccccaagccccuggccgagcuccccggccgcccgcccaucuucuggcccggggucgugcagggcgcccccuggcgggacccgcgccuggccgggcccgcgcccgccggcggggugcuggacaaggacggcaagaagaagcacagccggcccaccuucuccggccagcagaucuucgcccucgagaagaccuucgagcagaccaaguaccuggccgggccggagcgcgcccggcuggcguacagccucggcaugacggagucccaggucaaggugugguuccagaaccgccggaccaaguggcgcaagcggcacgccgccgagauggccagcgccaagaagaagcaggacuccgacgcggagaagcugaaggucgggggcagcgacgccgaggacgacgacgaguacaaccgcccccuggaccccaacuccgacgacgagaagaucacccggcuccugaagaagcacaagcccagcaaccuggcccucguguccccgugcgggggcggcgccggggacgcgcuguga

SEQ ID NO: 33626 - RNA, 582 nt, Artificial Sequence
  derived and/or modified sequence opt1 from NLE1__Homo_sapiens__NP_001014445
auggcccugagcaccgacuacgcccuccgcaccggcgcguucgagcccgccgaggccuccgugaacccgcaggaccugcaggggagccugcaggagcucaaggagcgggcccugucccgcuacaaccugguccggggccaggggcccgagcgccucgugagcggcuccgacgacuucacgcuguuccuguggagccccgccgaggacaagaagccccucacccggaugaccgggcaccaggcgcugaucaaccaggugcuguucuccccggacagccgcaucgucgccuccgccagcuucgacaaguccaucaagcucugggacggccggaccggcaaguaccuggccagccugcgcgggcacguggcggccguguaccagaucgccugguccgccgacagccggcuccuggucuccggcagcuccgacagcacgcugaaggugugggacgugaaggcccagaagcucgcgauggaccugcccgggcacgccgacgaggucuacgccguggacuggucccccgacggccagcgcguggccagcgggggcaaggacaagugccugcggaucuggcgccgguga

SEQ ID NO: 33627 - RNA, 2472 nt, Artificial Sequence
  derived and/or modified sequence opt1 from NLGN1__Homo_sapiens__NP_055747
auggcccugccccgcugcaccuggccgaacuacguguggcgggccgucauggcgugccucgugcaccgcggccugggggcgccccugacccucugcaugcugggcugccugcuccaggccgggcacgugcugagccagaagcuggacgacgucgacccccucguggccacgaacuucggcaagauccgggggaucaagaaggagcugaacaacgagauccugggccccgugauccaguuccucggcgucccguacgccgccccgcccaccggggagcgccgguuccagccgcccgagccgcccucccccuggagcgacauccgcaacgccacccaguucgcccccgugugcccccagaacaucaucgacggccggcugcccgaggugaugcugcccgucugguucaccaacaaccucgacgugguguccagcuacguccaggaccaguccgaggacugccuguaccugaacaucuacgugccgacggaggacgacauccgcgacagcgggggccccaagcccgugauggucuacauccacgggggcuccuacauggagggcaccgggaaccucuacgacggcagcgugcuggccuccuacgggaacgugaucgucaucaccgugaacuaccggcugggcgugcucggcuuccugagcaccggggaccaggcggccaagggcaacuacgggcugcucgaccugauccaggcccugcgcuggacguccgagaacaucggcuucuucgggggcgacccccuccggaucaccgucuucggcagcggggccggcggguccugcgugaaccugcugacccucagccacuacuccgagggcaaccgcuggagcaacuccaccaaggggcuguuccagcgggccaucgcgcagagcggcacggcccuguccagcugggccgugagcuuccagcccgccaaguacgcccgcaugcucgcgaccaaggucggcugcaacguguccgacaccgucgagcugguggagugccugcagaagaagcccuacaaggagcucguggaccaggacauccagcccgcccgguaccacaucgccuucgggcccgucaucgacggcgacgugaucccggacgacccccagauccugauggagcagggggaguuccugaacuacgacaucaugcucggcgugaaccagggggagggccugaaguucgucgagaacaucguggacagcgacgacggcaucuccgccagcgacuucgacuucgccguguccaacuucgucgacaaccuguacggguaccccgagggcaaggacgugcuccgcgagaccaucaaguucauguacacggacugggcggaccggcacaaccccgagacccgccggaagacccugcuggcccucuucaccgaccaccaguggguggccccggccgucgccacggcggaccugcacagcaacuucgggucccccaccuacuucuacgccuucuaccaccacugccagaccgaccaggugcccgccugggccgacgcggcccacggcgacgaggugccguacguccugggcauccccaugaucgggcccaccgagcuguuccccugcaacuucagcaagaacgacgugaugcuguccgccguggucaugacguacuggaccaacuucgccaagaccggcgacccgaaccagcccgugccccaggacaccaaguucauccacacgaagcccaaccgcuucgaggagguggccuggacccgguacagccagaaggaccagcuguaccugcacaucgggcucaagccgcgcgucaaggagcacuaccgcgcgaacaaggugaaccuguggcuggagcucgugccccaccuccacaaccugaacgacaucucccaguacaccagcaccacgaccaagguccccuccaccgacaucaccuuccggcccacgcgcaagaacagcgugccggugaccuccgccuuccccaccgccaagcaggacgaccccaagcagcagcccagcccguucuccgucgaccagcgggacuacagcaccgagcucuccgugaccaucgccgugggcgccagccugcuguuccucaacauccuggcguucgccgcccuguacuacaagaaggacaagcgccggcacgacguccaccgccggugcagcccccagcgcacgaccaccaacgaccucacccacgcccaggaggaggagaucaugucccugcagaugaagcacacggaccuggaccacgagugcgagagcauccacccccacgagguggugcuccggaccgccugcccgcccgacuacacccuggcgaugcgccggucccccgacgacgucccccugaugacccccaacacgaucaccaugaucccgaacaccauccccgggauccagccccuccacaccuucaacacguucaccggcggccagaacaacacccugccgcacccccacccccacccccacagccacuccaccacgcgcguguga

SEQ ID NO: 33628 - RNA, 2508 nt, Artificial Sequence
  derived and/or modified sequence opt1 from NLGN2__Homo_sapiens__NP_065846
auguggcugcucgcccugugccuggugggccucgccggggcgcagcgcggcgggggcgggcccggcggcggggccccgggcgggcccggccuggggcugggcagccucggcgaggagcgguuccccgucgugaacaccgccuacgggcgcgugcggggcguccgccgggagcugaacaacgagauccuggggcccguggugcaguuccucggcgucccguacgccacccccccccugggcgcccgccgguuccagcccccggaggcgcccgccuccuggcccggggugcgcaacgccacgacccugcccccggccugcccccagaaccuccacggcgcgcugcccgccaucaugcugcccgugugguucaccgacaaccucgaggccgccgccaccuacguccagaaccagagcgaggacugccuguaccugaaccucuacgugccgacggaggacgggccccugaccaagaagcgggacgaggcgacccugaacccccccgacaccgacauccgcgacccgggcaagaagcccgugaugcucuuccugcacgggggcuccuacauggagggcacggggaacauguucgacggcagcguccuggccgccuacgggaacgugaucguggccacccucaacuaccggcugggcguccugggguuccucuccaccggcgaccaggccgcgaagggcaacuacgggcugcuggaccagauccaggcccuccgcuggcugagcgagaacaucgcccacuucggcggggaccccgagcggaucaccaucuucggcuccggggccggcgccagcugcgugaaccugcucauccugucccaccacagcgagggccuguuccagaaggcgaucgcccaguccgggacggccaucagcuccuggagcgugaacuaccagccccucaaguacacccgccugcuggccgccaaggucggcugcgaccgggaggacuccgcggaggccguggagugccuccgccggaagccgagccgcgagcugguggaccaggacguccagcccgcccgguaccacaucgccuucgggcccgugguggacggcgacgucgugcccgacgacccggagauccugaugcagcagggcgaguuccucaacuacgacaugcugaucggggucaaccagggcgaggggcugaaguucguggaggacuccgcggagagcgaggacggcguguccgccagcgccuucgacuucaccgucagcaacuucguggacaaccucuacggguaccccgagggcaaggacgugcugcgcgagaccaucaaguucauguacacggacugggccgaccgggacaacggcgagaugcgccgcaagacccugcucgcccuguucaccgaccaccagugggucgcgcccgccguggccaccgccaagcugcacgccgacuaccaguccccgguguacuucuacacguucuaccaccacugccaggcggaggggcggcccgagugggccgacgccgcccacggcgacgagcugcccuacgucuucggggugcccauggugggcgccaccgaccucuucccgugcaacuucagcaagaacgacgucaugcuguccgcgguggugaugaccuacuggaccaacuucgccaagacgggggaccccaaccagcccgucccccaggacaccaaguucauccacaccaagccgaaccgcuucgaggaggugguguggagcaaguucaacuccaaggagaagcaguaccugcacaucggccucaagccccggguccgcgacaacuaccgggccaacaagguggccuucuggcuggagcuggugccccaccuccacaaccugcacaccgagcuguucacgaccaccacccgccuccccccguacgcgacgcgguggcccccccgccccccggccggcgcccccgggacccggcgcccccccccgcccgccacccugccccccgagccggagcccgagcccggcccgcgggccuacgaccgcuuccccggggacagccgggacuacuccaccgagcugagcgucacgguggcggugggcgccucccuccuguuccugaacauccucgccuucgccgcccuguacuacaagcgcgaccggcgccaggagcugcggugccgccggcucagcccccccgggggcuccggcagcggggucccgggcgggggcccccugcugcccgcggccgggcgcgagcuccccccggaggaggagcuggugucccugcagcucaagcgcggcggcggggugggcgccgaccccgccgaggcccugcggcccgcgugccccccggacuacacccuggcccuccgccgggcccccgacgacgucccccugcuggcccccggggcgcucacccugcugccgagcggccucggccccccccccccgcccccccccccgucccugcaccccuucgggcccuuccccccgccccccccgaccgccaccagccacaacaacacgcugccccacccccacuccaccacccgcguguga

SEQ ID NO: 33629 - RNA, 2427 nt, Artificial Sequence
  derived and/or modified sequence opt1 from NLGN3__Homo_sapiens__NP_001160132
auguggcugcgccucgggcccccgagccugucccugagccccaagcccaccgugggccggucccucugccugacccugugguuccucagccuggcccugcgcgccuccacgcaggcgcccgccccgaccgucaacacccacuucggcaagcuccgcggggcccgggugccccugcccagcgagauccugggccccguggaccaguaccucggggucccguacgccgccccgcccaucggcgagaagcgguuccugccgcccgagcccccgcccuccuggagcggcauccgcaacgcgacccacuucccgcccgugugcccccagaacauccacacggccgugcccgaggucaugcugcccgugugguucaccgccaaccucgacaucguggccaccuacauccaggagcccaacgaggacugccuguaccugaacgucuacgugcccaccgaggacgacauccgggacuccggggcgaagcccgugauggucuacauccacggcgggagcuacauggagggcacggggaacaugaucgacggcuccauccucgccagcuacggcaacgugaucgugaucacccugaacuaccgcgucggggugcugggcuuccucuccaccggggaccaggccgccaagggcaacuacggccugcuggaccagauccaggcccuccggugggugagcgagaacaucgcguucuucgggggcgacccgcgccggaucaccgucuucggguccggcaucggggccagcugcgugucccugcugacgcucagccaccacuccgagggccuguuccagcgcgccaucauccagagcggcagcgcccuguccagcugggccgugaacuaccagcccgucaaguacaccucccuccuggcggacaagguggggugcaacgugcuggacaccgucgacaugguggacugccuccggcagaaguccgccaaggagcuggucgagcaggacauccagcccgcccgcuaccacguggccuucggccccgugaucgacggggacgucauccccgacgaccccgagauccugauggagcagggcgaguuccucaacuacgacaucaugcugggggugaaccagggcgagggccugaaguucguggagggggucguggaccccgaggacggcgugagcgggaccgacuucgacuacagcgucuccaacuucguggacaaccucuacggcuacccggaggggaaggacacgcugcgggagaccaucaaguucauguacaccgacugggccgaccgcgacaaccccgagacccggcgcaagacgcugguggcccucuucaccgaccaccagugggucgagcccagcguggugaccgcggaccugcacgcccgguacggcucccccaccuacuucuacgccuucuaccaccacugccagagccugaugaagccggccugguccgacgcggcccacggcgacgagguccccuacguguucggggugcccauggucggccccacggaccucuucccgugcaacuucagcaagaacgacgugaugcuguccgccguggucaugaccuacuggaccaacuucgccaagaccggggaccccaacaagcccgugccccaggacacgaaguucauccacaccaaggcgaaccgcuucgaggagguggccuggagcaaguacaacccgcgggaccagcuguaccuccacaucggccugaagccccgcguccgcgaccacuaccgggccaccaagguggccuucuggaagcaccuggugccccaccuguacaaccuccacgacauguuccacuacaccuccacgaccaccaaggugcccccgcccgacaccacgcacagcucccacaucacccgccggcccaacggcaagaccuggagcaccaagcgccccgccaucuccccggcguacagcaacgagaacgcccaggggagcuggaacggcgaccaggacgccgggccccugcuggucgagaacccccgggacuacuccaccgagcucagcgugacgaucgccgucggcgccucccugcuguuccucaacgugcuggcguucgccgcccuguacuaccgcaaggacaagcggcgccaggagccccuccggcagccgagcccccagcgcggggccggcgcccccgagcugggcgcggccccggaggaggagcuggccgcccuccagcuggggcccacccaccacgagugcgaggcgggcccgccccacgacacccugcggcucaccgcccugcccgacuacacgcugacccuccgccggucccccgacgacaucccccugaugacccccaacaccaucacgaugaucccgaacagccugguggggcuccagacccugcaccccuacaacaccuucgccgccggcuucaacuccaccgggcugccccacagccacuccacgacccgcgucuga

SEQ ID NO: 33630 - RNA, 2451 nt, Artificial Sequence
  derived and/or modified sequence opt1 from NLGN4X__Homo_sapiens__NP_001269075
augagccgcccccagggccugcucuggcugccgcuccuguucacccccgugugcgucaugcugaacuccaacgugcugcucuggcugaccgcccuggccaucaaguucacgcucaucgacagccaggcgcaguaccccguggucaacaccaacuacgggaagauccggggccugcgcacgccccugccgaacgagauccucgggcccguggagcaguaccugggcgugcccuacgccagcccgcccaccggggagcggcgcuuccagccgcccgagccgcccuccuccuggaccggcauccggaacaccacccaguucgccgccgucugcccccagcaccuggacgagcgcagccuccugcacgacaugcugcccaucugguucaccgccaaccucgacacgcugaugaccuacgugcaggaccagaacgaggacugccuguaccucaacaucuacgugcccaccgaggacgacauccacgaccagaacuccaagaagcccgucaugguguacauccacggcgggagcuacauggagggcaccgggaacaugaucgacggcuccauccuggcgagcuacgggaacgugaucgucaucacgaucaacuaccggcugggcauccucggcuuccuguccaccggggaccaggccgccaagggcaacuacgggcugcucgaccagauccaggcccugcgcuggaucgaggagaacgugggcgcguucggcggggaccccaagcgggugaccaucuucggcagcggggccggcgccuccugcgucagccugcucacccugucccacuacagcgaggggcuguuccagaaggccaucauccaguccggcacggcccucagcuccugggcggugaacuaccagcccgccaaguacacccgcauccuggccgacaaggugggcugcaacaugcuggacaccaccgacauggucgagugccuccggaacaagaacuacaaggagcugauccagcagacgaucacccccgccaccuaccacaucgccuucgggccggugaucgacggcgacgugauccccgacgacccccagauccugauggagcagggggaguuccucaacuacgacaucaugcugggcgucaaccagggggagggccugaaguucguggacggcaucguggacaacgaggacggggucacccccaacgacuucgacuucagcgugagcaacuucgucgacaaccucuacggcuacccggaggggaaggacacgcugcgcgagaccaucaaguucauguacaccgacugggcggacaaggagaaccccgagacccggcgcaagacgcugguggcccucuucaccgaccaccaguggguggcccccgccgucgccaccgcggaccugcacgcccaguacggcucccccaccuacuucuacgccuucuaccaccacugccagagcgagaugaagccguccugggccgacagcgcccacggggacgaggugcccuacguguucggcauccccaugaucggcccgacggagcuguucuccugcaacuucagcaagaacgacgucaugcucuccgcgguggugaugaccuacuggaccaacuucgccaagaccggggaccccaaccagcccgucccccaggacacgaaguucauccacaccaagccgaaccgguucgaggagguggccuggagcaaguacaaccccaaggaccagcuguaccugcacaucggccugaagccccgcgugcgggaccacuaccgcgccaccaaggucgcguucuggcucgagcuggugccccaccuccacaaccugaacgagaucuuccaguacguguccaccaccacgaaggucccgccgcccgacaugaccagcuuccccuacgggacccggcgcucccccgccaagaucuggcccaccacgaagcggcccgccaucacccccgccaacaacccgaagcacagcaaggacccccacaagaccggccccgaggacaccacggugcugaucgagaccaagcgcgacuacuccaccgagcugagcgugaccaucgccgucggcgcgucccuccuguuccugaacauccucgccuucgccgcccuguacuacaagaaggacaagcgccggcacgagacgcaccgccggcccagcccgcagcgcaacaccaccaacgacaucgcccacauccagaacgaggagaucaugucccugcagaugaagcagcucgagcacgaccacgagugcgagagccugcaggcgcacgacacccugcggcucacgugcccgcccgacuacacccugacccugcgccggucccccgacgacaucccccucaugacccccaacacgaucaccaugauccccaacacccugaccgggaugcagccgcugcacacguucaacaccuucagcggcgggcagaacagcaccaaccucccccacggccacuccaccacgcgcguguga

SEQ ID NO: 33631 - RNA, 1947 nt, Artificial Sequence
  derived and/or modified sequence opt1 from NLGN4Y__Homo_sapiens__NP_001193779
augguguacauccacggcgggagcuacauggagggcaccgggaacaugaucgacggcuccauccuggccagcuacgggaacgucaucgugaucaccaucaacuaccgccucggcauccugggcuuccuguccacgggggaccaggccgcgaagggcaacuacgggcuccuggaccagauccaggcccugcgguggaucgaggagaacgugggcgccuucgggggcgaccccaagcgcgucaccaucuucggcagcggggccggcgccuccugcgugagccuccugacccugucccacuacagcgaggggcuguuccagaaggcgaucauccaguccggcaccgcccugagcuccugggccgugaacuaccagccggccaaguacacgcggauccuggcggacaaggucggcugcaacaugcucgacaccaccgacaugguggagugccugaagaacaagaacuacaaggagcugauccagcagaccaucacgcccgccaccuaccacaucgccuucgggcccgugaucgacggcgacgucauccccgacgacccgcagauccucauggagcagggggaguuccugaacuacgacaucaugcugggcgugaaccagggggagggccucaaguucguggacggcaucgucgacaacgaggacggggugacccccaacgacuucgacuucagcguguccaacuucgucgacaaccuguacggcuaccccgaggggaaggacacccugcgcgagacgaucaaguucauguacaccgacugggccgacaaggagaaccccgagacccggcgcaagacccucguggcccuguucacggaccaccaguggguggcgccggccgucgccaccgccgaccugcacgcccaguacggcagccccaccuacuucuacgcguucuaccaccacugccaguccgagaugaagcccagcugggccgacuccgcccacggggacgaggugcccuacguguucggcaucccgaugaucggccccaccgagcuguucagcugcaacuucuccaagaacgacgucaugcugagcgccguggugaugacguacuggaccaacuucgccaagaccggggaccccaaccagcccgucccgcaggacaccaaguucauccacacgaagcccaaccgguucgaggagguggcguggagcaaguacaaccccaaggaccagcuguaccuccacaucggccugaagccccgcguccgggaccacuaccgcgccaccaagguggccuucuggcuggagcucgugccgcaccuccacaaccugaacgagaucuuccaguacgucuccaccaccacgaaggugcccccgcccgacaugaccagcuuccccuacgggacccggcgcucccccgccaagaucuggcccaccacgaagcggcccgccaucaccccggcgaacaaccccaagcacagcaaggacccccacaagaccggcccggaggacaccacggugcucaucgagaccaagcgcgacuacuccaccgagcugagcgucaccaucgccgugggggccucccuccucuuccugaacauccuggccuucgcggcccucuacuacaagaaggacaagcggcgccacgagacccaccggcaccccagcccccagcgcaacacgaccaacgacaucacccacauccagaacgaggagaucaugucccugcagaugaagcagcuggagcacgaccacgagugcgagagccuccaggcccacgacacccugcggcugacgugcccgcccgacuacacccucacccugcgccggucccccgacgacauccccuucaugacccccaacacgaucaccaugaucccgaacacccugaugggcaugcagccccuccacaccuucaagacguucagcggcgggcagaacuccaccaaccugccccacggccacagcaccacccgcguguga

SEQ ID NO: 33632 - RNA, 1584 nt, Artificial Sequence
  derived and/or modified sequence opt1 from NLK__Homo_sapiens__NP_057315
augagccugugcggcgcccgcgccaacgcgaagaugauggccgccuacaacgggggcaccuccgccgccgcggccgggcaccaccaccaccaccaccaccaccucccccaccucccgccgccccaccuccaccaccaccaccacccccagcaccaccuccaccccggcagcgccgccgcggugcaccccguccagcagcacaccuccagcgccgccgccgccgcggccgccgccgccgcggccgccgccaugcugaaccccgggcagcagcagcccuacuucccgucccccgcccccggccaggcgcccggcccggccgccgccgcccccgcccaggugcaggcggccgccgcggccacggugaaggcccaccaccaccagcacagccaccacccccagcagcagcuggacaucgagcccgaccggccgaucggguacggcgccuucggggucgugugguccgugaccgacccccgcgacggcaagcgggucgcccugaagaagaugcccaacguguuccagaaccuggugagcugcaagcgcgucuuccgggagcugaagaugcugugcuucuucaagcacgacaacgugcuguccgcgcuggacauccuccagcccccgcacaucgacuacuucgaggagaucuacguggucaccgagcugaugcagagcgaccugcacaagaucaucgugagcccccagccccucuccuccgaccacgugaaggucuuccuguaccagauccugcgcgggcucaaguaccugcacagcgccggcauccugcaccgggacaucaagcccggcaaccuccuggugaacuccaacugcgugcugaagaucugcgacuucgggcucgcccgcgucgaggagcuggacgagagccggcacaugacccaggagguggugacgcaguacuaccgcgccccggagauccugaugggcucccggcacuacagcaacgccaucgacaucugguccgucgggugcaucuucgcggagcuccugggccgccggauccuguuccaggcccagagccccauccagcagcucgaccugaucaccgaccugcucggcacccccagccuggaggccaugcgcaccgccugcgagggggccaaggcgcacauccugcggggcccccacaagcagccgucccuccccgugcuguacacgcugagcucccaggccacccacgaggccgugcaccuccugugccgcaugcuggucuucgaccccagcaagcggaucuccgccaaggacgcgcucgcccacccguaccuggacgaggggcgccugcgguaccacacgugcaugugcaagugcugcuucagcaccuccaccggccgcguguacaccagcgacuucgagcccgucaccaaccccaaguucgacgacaccuucgagaagaaccucuccagcgugcgccaggugaaggagaucauccaccaguucauccuggagcagcagaaggggaaccgggucccccugugcaucaacccgcaguccgccgccuucaagagcuucaucuccagcacgguggcccagcccuccgagaugccgcccagcccccucgugugggaguga

SEQ ID NO: 33633 - RNA, 2115 nt, Artificial Sequence
  derived and/or modified sequence opt1 from NLN__Homo_sapiens__NP_065777
augaucgcccgcugccugcucgccgugcggagccugcgccgggucggcgggucccgcauccugcuccggaugacccugggccgcgaggugaugagcccccugcaggcgauguccagcuacaccguggccgggcggaacguccuccgcugggaccuguccccggagcagaucaagacgcggaccgaggagcugaucgugcagaccaagcaggucuacgacgccgugggcaugcucgggaucgaggaggugaccuacgagaacugccugcaggcccuggccgacguggaggucaaguacaucguggagcgcacgaugcucgacuucccccagcacgugagcuccgacaaggagguccgggcggccagcaccgaggccgacaagcgccugucccgguucgacaucgagaugagcaugcgcggcgacaucuucgagcggaucgugcaccuccaggagaccugcgaccugggcaagaucaagcccgaggcccgccgguaccuggagaaguccaucaagauggggaagcgcaacggccugcaccuccccgagcagguccagaacgagaucaagagcaugaagaagcggauguccgagcugugcaucgacuucaacaagaaccugaacgaggacgacaccuuccucguguucagcaaggcggagcugggggcccugccggacgacuucaucgacucccucgagaagacggacgacgacaaguacaagaucacccugaaguacccccacuacuuccccgugaugaagaagugcugcauccccgagacccgccggcgcauggagauggccuucaacacccgcugcaaggaggagaacacgaucauccugcagcagcuccugccgcugcggaccaagguggccaagcuccugggcuacagcacccacgccgacuucguccuggagaugaacaccgcgaaguccacgagccgcgugaccgccuuccucgacgaccugucccagaagcugaagccccucggggaggccgagcgggaguucauccugaaccugaagaagaaggagugcaaggaccgcggcuucgaguacgacggcaagaucaacgccugggaccucuacuacuacaugacccagaccgaggagcugaaguacagcaucgaccaggaguuccugaaggaguacuuccccaucgagguggucacggaggggcuccugaacaccuaccaggagcugcucggccugagcuucgagcagaugaccgacgcccacguguggaacaaguccgugacccuguacacggucaaggacaaggcgaccggggaggugcucggccaguucuaccuggaccuguacccccgggagggcaaguacaaccacgccgccugcuucgggcugcagccgggcugccuccugcccgacgggagccgcaugauggccgucgccgcgcugguggugaacuucucccagcccgucgccggccggcccagccuccugcgccacgacgaggugcggaccuacuuccacgaguucgggcacgugaugcaccagaucugcgcccagaccgacuucgcccgcuucuccggcacgaacgucgagaccgacuucguggaggugccgagccagaugcuggagaacugggucugggacguggacucccuccggcgccugagcaagcacuacaaggacggcucccccaucgccgacgaccugcucgagaagcugguggcgagccggcuggucaacaccgggcuccugacccugcgccagaucgugcucuccaagguggaccagagccugcacacgaacaccucccuggacgccgccagcgaguacgccaaguacugcuccgagauccucggcgucgcggccacccccgggaccaacaugcccgccacguucggccaccuggccgggggcuacgacggccaguacuacggguaccuguggagcgagguguucuccauggacauguucuacagcugcuucaagaaggagggcaucaugaacccggagguggggaugaaguaccggaaccucauccugaagcccggcgggucccuggacggcauggacaugcuccacaacuuccugaagcgcgagcccaaccagaaggccuuccugaugagccggggccuccacgcgcccuga

SEQ ID NO: 33634 - RNA, 3198 nt, Artificial Sequence
  derived and/or modified sequence opt1 from NLRC3__Homo_sapiens__NP_849172
augcgcaagcaggaggugcggaccggccgcgaggccgggcagggccacgggaccggcagccccgccgagcaggucaaggcgcugauggaccuccuggccgggaagggcucccagggcagccaggccccgcaggcccuggaccggacccccgacgcgccccucgggcccugcuccaacgacagccgcauccagcggcaccgcaaggcccugcuguccaaggugggcgggggcccggagcucgggggccccuggcaccggcuggccagccugcuccugguggagggccugaccgaccuccagcugcgcgagcacgacuucacccaggucgaggccacccgcgggggcgggcaccccgcccggacgguggcgcuggaccggcuguuccugccccugucccgcgugagcgucccgccccggguguccaucaccaucggcguggccggcauggggaagaccacccucguccgccacuucgugcggcugugggcccacggccagguggggaaggacuucagccugguccucccccugacguuccgcgaccugaacacccacgagaagcucugcgccgaccggcugaucugcuccguguucccccacgugggcgagccgagccuggccgucgcggugcccgcccgcgcccuccugauccuggacgggcucgacgagugccggacgccccuggacuucuccaacaccguggccugcaccgaccccaagaaggagaucccggucgaccaccugaucaccaacaucauccgcggcaaccucuuccccgaggugagcaucuggaucaccucccggcccagcgccuccggccagauccccgggggccugguggaccgcaugaccgagauccgcggguucaacgaggaggagaucaaggucugccuggagcagauguucccggaggaccaggcgcuccugggcuggaugcugagccaggugcaggccgaccgggcccucuaccugaugugcacggugcccgccuucugccgccugaccgggauggcccucggccaccuguggcggucccgcaccggcccccaggacgcggagcuguggcccccgcggacccucugcgagcuguacagcugguacuuccgcauggcccugagcggggagggccaggagaaggggaaggccagcccccggaucgagcaggucgcccacggcgggcgcaagauggugggcacgcucggccggcuggccuuccacgggcugcugaagaagaaguacgucuucuacgagcaggacaugaaggcguucggcguggaccucgcccugcugcagggggcccccugcuccugcuuccuccagcgcgaggagacccuggccuccagcguggcguacugcuucacccaccugucccuccaggaguucgucgccgccgccuacuacuacggcgccagccggcgcgcgaucuucgaccuguucaccgaguccggcgugagcuggccccggcugggguuccucacgcacuuccgcuccgccgcccagcgggccaugcaggccgaggacggccgccuggacguguuccugcgguuccucagcgggcugcuguccccgcgcgucaacgcgcuccuggccggcagccugcucgcccagggggagcaccaggccuaccggacccagguggccgagcugcugcagggcugccuccgccccgacgcggccgugugcgcccgcgccaucaacguccugcacugccugcacgagcuccagcacaccgagcuggcgcgguccguggaggaggccauggagagcggcgcccuggcccgccucaccgggcccgcccaccgggcggcccuggccuaccugcuccagguguccgacgccugcgcccaggaggcgaaccugagccugucccucagccagggcguccugcagucccugcucccgcagcugcuguacugccgcaagcuccggcuggacacgaaccaguuccaggaccccgugauggagcugcucgggagcgugcugagcggcaaggacugccgcauccagaagaucucccuggccgagaaccagaucagcaacaagggggccaaggcccucgcccggucccugcuggucaaccgcagccucaccucccuggaccugcggggcaacagcaucggcccccagggggcgaaggcccucgccgacgcccugaagaucaaccgcacccugaccucccucagccugcagggcaacacggugcgggacgacggggcgcgcuccauggccgaggcccuggccagcaaccggacccucuccaugcugcaccuccagaagaacagcaucggccccaugggggcccagcgcauggcggacgcccucaagcagaaccggucccugaaggagcugauguucagcuccaacagcaucggcgacggcggggccaaggcccucgccgaggcgcugaaggugaaccagggccuggagucccucgaccugcagagcaacagcaucuccgacgccggggucgccgcccugaugggcgcccucugcaccaaccagacccugcugagccucucccugcgcgagaacagcaucuccccggagggggcgcaggccaucgcccacgcccugugcgccaacagcacgcucaagaaccuggaccugaccgcgaaccuccugcacgaccagggcgcccgggccaucgccguggcggugcgcgagaaccggacccugaccucccuccaccuccaguggaacuucauccaggccggcgccgcccaggcccuggggcaggcgcugcagcugaaccgcagccugaccucccucgaccugcaggagaacgccaucggcgacgacggggccugcgccgucgcccgggcgcugaaggugaacacggcccucaccgcccuguaccuccagguggccagcaucggcgccuccggcgcgcagguccugggggaggcccuggccgugaaccgcacccuggagauccuggaccuccgcggcaacgccaucgggguggcgggcgccaaggcccuggccaacgcccugaaggucaacagcucccuccggcgccugaaccugcaggagaacagccucgggauggacggcgcgaucugcaucgccaccgcccuguccggcaaccaccggcugcagcacaucaaccuccaggggaaccacaucggcgacagcggggcccgcaugaucuccgaggccaucaagacgaacgcgcccacgugcaccguggagauguga

SEQ ID NO: 33635 - RNA, 3075 nt, Artificial Sequence
  derived and/or modified sequence opt1 from NLRC4__Homo_sapiens__NP_001186068
augaacuucaucaaggacaacagccgcgcccugauccagcggaugggcaugaccgugaucaagcagaucaccgacgaccucuucgucuggaacgugcugaaccgcgaggaggugaacaucaucugcugcgagaaggucgagcaggacgccgcgcgggggaucauccacaugauccugaagaagggcuccgagagcugcaaccucuuccugaagucccugaaggaguggaacuacccccucuuccaggaccugaacgggcagagccuguuccaccagacguccgagggcgaccucgacgaccuggcccaggaccugaaggaccucuaccacaccccgagcuuccugaacuucuacccccugggggaggacaucgacaucaucuucaaccucaaguccaccuucaccgagcccgugcuguggcgcaaggaccagcaccaccaccggguggagcagcugacgcucaacggccugcugcaggcccuccagagccccugcaucaucgagggcgaguccgggaagggcaagagcacccugcugcagcgcaucgccaugcucuggggguccggcaagugcaaggcccugaccaaguucaaguucgucuucuuccugcggcucagccgcgcgcagggcgggcuguucgagacccugugcgaccagcuccuggacaucccgggcacgauccggaagcagaccuucauggccaugcugcucaagcugcgccagcgggugcuguuccuccuggacggguacaacgaguucaagccccagaacugccccgagaucgaggcccugaucaaggagaaccaccgcuucaagaacauggugaucgucaccaccacgaccgagugccuccggcacauccgccaguucggcgcccugaccgcggaggugggggacaugaccgaggacuccgcccaggcccugauccgggaggugcucaucaaggagcuggccgagggccugcuccugcagauccagaagucccgcugccugcggaaccucaugaagacgccccuguucgucgugaucacgugcgccauccagaugggcgaguccgaguuccacagccacacccagaccacccuguuccacaccuucuacgaccugcucauccagaagaacaagcacaagcacaaggggguggcggccuccgacuucauccgcagccuggaccacugcggcgaccuggcccucgagggggucuucucccacaaguucgacuucgagcugcaggacgugagcagcgugaacgaggacguccugcucaccaccggccugcugugcaaguacacggcccagcgguucaagccgaaguacaaguucuuccacaaguccuuccaggaguacaccgccgggcgccggcucagcucccugcugaccagccacgagcccgaggaggugaccaagggcaacggcuaccuccagaagaugguguccaucagcgacaucacguccaccuacagcucccugcugcgcuacacgugcgggagcuccgucgaggcgacccgcgccgugaugaagcaccucgccgccguguaccagcacggcugccugcuggggcucagcaucgccaagcggccccuguggcgccaggagucccugcagagcgucaagaacaccaccgagcaggagauccucaaggcgaucaacaucaacuccuucguggagugcggcauccaccuguaccaggagagcaccuccaagagcgcccugucccaggaguucgaggccuucuuccagggcaagagccucuacaucaacagcgggaacauccccgacuaccuguucgacuucuucgagcaccucccgaacugcgccuccgcccuggacuucaucaagcuggacuucuacggcggggcgauggccagcugggagaaggccgccgaggacaccggcgggauccacauggaggaggcgcccgagacguacauccccucccgggccgucagccuguucuucaacuggaagcaggaguuccgcacccucgaggugacccugcgggacuucuccaagcugaacaagcaggacauccgcuaccucggcaagaucuucagcuccgccaccagccugcggcugcagaucaagcgcugcgccgggguggccggcucccucagccugguccuguccacgugcaagaacaucuacagccucaugguggaggcgagcccccugaccaucgaggacgagcggcacaucaccagcgugaccaaccugaagacccucuccauccacgaccugcagaaccagcgccugccgggcgggcucacggacagccugggcaaccugaagaaccucaccaagcugaucauggacaacaucaagaugaacgaggaggacgccaucaagcuggccgaggggcucaagaaccugaagaagaugugccuguuccaccucacccaccuguccgacaucggcgagggcauggacuacaucgucaagagccugagcuccgagcccugcgaccucgaggagauccagcuggugagcugcugccuguccgccaacgccgugaagauccucgcgcagaaccugcacaaccuggucaagcucagcauccuggaccuguccgagaacuaccucgagaaggacgggaacgaggcccugcacgagcugaucgaccggaugaacgugcucgagcagcugaccgcccugaugcuccccuggggcugcgacgugcaggggagccuguccagccugcucaagcaccuggaggaggucccccagcuggugaagcucggccugaagaacuggcgccugacggacaccgagauccggauccucggggccuucuucggcaagaacccgcugaagaacuuccagcagcugaaccucgccggcaaccgcguguccagcgacggguggcuggcguucaugggcgucuucgagaaccugaagcagcucguguucuucgacuucuccaccaaggaguuccugcccgaccccgcccuggugcggaagcucagccagguccuguccaagcugaccuuccuccaggaggcccgccuggugggguggcaguucgacgacgacgaccugagcgugaucacgggcgccuucaagcuggucaccgcguga

SEQ ID NO: 33636 - RNA, 5601 nt, Artificial Sequence
  derived and/or modified sequence opt1 from NLRC5__Homo_sapiens__XP_005256251
auggaccccgugggccugcagcucgggaacaagaaccugugguccugccugguccggcuccugaccaaggaccccgaguggcugaacgccaagaugaaguucuuccuccccaacaccgaccuggacucccggaacgagacccuggaccccgagcagcgcgugauccuccagcugaacaagcugcacgugcagggcuccgacaccuggcaguccuucauccacugcgucugcaugcagcucgaggugccccuggaccuggaggugcuccugcugagcaccuucggguacgacgacggcuucaccucccagcucggggccgagggcaagagccagcccgagucccagcugcaccacggccugaagcggccccaccagagcugcggguccagcccccgccggaagcagugcaagaagcagcagcucgagcuggcgaagaaguaccugcagcuccugcgcacguccgcccagcagcgguaccgcagccagauccccggcuccgggcagccccacgccuuccaccaggucuacgugccgcccauccugcggcgcgccaccgccagccucgacacccccgagggcgccaucaugggggacgugaaggucgaggacggcgccgacguguccaucagcgaccuguucaacacccgggugaacaagggcccccgcgucacggugcugcucgggaaggccggcauggggaagaccacccuggcccaccggcugugccagaagugggcggagggccaccucaacugcuuccaggcccuguuccuguucgaguuccgccagcucaaccugaucacccgguuccugacgcccuccgagcuccuguucgaccuguaccucagccccgaguccgaccacgacaccguguuccaguaccuggagaagaacgccgaccagguccugcucaucuucgacggccuggacgaggcccugcagcccauggggccggacggccccgggcccgugcucacccuguucagccaccugugcaacggcacccugcuccccgggugccgcgugauggccacgagccggccgggcaagcugcccgcgugccugcccgccgaggccgccaugguccacaugcucggcuucgacgggccccgcguggaggaguacgugaaccacuucuucuccgcccagccgagccgggagggcgcgcuggucgagcugcagaccaacgggcgccuccggucccugugcgccgugcccgcccugugccagguggccugccucugccugcaccaccuccugcccgaccacgcccccggccagagcgucgcgcugcugccgaacaugacccagcucuacaugcagauggugcuggcccugagcccgcccgggcaccucccgaccagcucccugcuggaccucggcgaggucgcccugcgcggccuggagacggggaaggugaucuucuacgccaaggacaucgcgccgccccucaucgcguucggcgccacccacagccugcugaccuccuucugcgugugcaccgggcccggccaccagcagacgggguacgccuucacccaccucagccugcaggaguuccuggccgcgcuccaccugauggccuccccgaaggucaacaaggacacccugacccaguacgugacgcuccacagccgcugggugcagcggaccaaggcccgccugggccuguccgaccaccuccccaccuuccuggccggccuggccagcugcacgugccggcccuuccucucccaccuggcgcaggggaacgaggacugcgucggcgccaagcaggccgccguggugcagguccugaagaagcucgccacgcgcaagcugaccgggcccaaggugguggagcugugccacugcgucgacgagacccaggagccggagcucgcgagccugaccgcccagucccugcccuaccagcuccccuuccacaacuucccccugacgugcaccgaccuggccacccucaccaacauccuggagcaccgggaggccccgauccaccuggacuucgacggcugcccccucgagccccacugccccgaggcccuggugggcugcgggcagaucgagaaccugagcuucaagucccgcaagugcggcgacgcguucgccgaggcccucagccggagccugccgaccauggggcgccugcagaugcucggccuggccggguccaagaucacggcgcggggcaucagccaccuggugaaggcccucccccugugcccccagcugaaggaggucuccuuccgcgacaaccagcucagcgaccagguggugcugaacaucgucgaggugcugccccaccucccgcggcugcgcaagcuggaccucuccagcaacuccaucugcgugagcacccugcugugccucgcccgggucgccgugaccugccccaccgugcgcaugcugcaggcccgggaggcggaccugaucuuccuccugagcccgcccacggagaccaccgccgagcugcagcgcgccccggaccuccaggagagcgacggccagcggaagggggcccagucccgcagccugacccugcggcuccagaagugccagcugcagguccacgacgccgaggcgcugaucgcccuccugcaggagggcccccaccuggaggagguggaccucuccgggaaccagcuggaggacgagggcugccgccugauggccgaggccgccagccagcuccacaucgcgcgcaagcuggaccuguccaacaacgggcugagcguggccggcguccacugcgugcuccgggccguguccgccugcuggacgcuggcggagcugcacaucagccuccagcacaagaccgucaucuucauguucgcccaggagcccgaggagcagaagggcccgcaggagcgcgccgccuuccuggacagccugaugcuccagaugcccuccgagcugccccugagcucccggcgcaugcggcucacccacugcgggcugcaggagaagcaccuggagcagcucugcaaggcccugggcgggagcugccaccugggccaccuccaccuggacuucuccgggaacgcgcugggcgacgagggcgccgcccgccucgcccagcugcugcccgggcucggcgcccugcagagccugaaccucuccgagaacgggcugagccuggacgcggugcucggccuggugcggugcuucuccacccugcaguggcuguuccgccuggacaucagcuucgagucccagcacauccugcuccgcggggacaagacgagccgcgacaugugggccaccggcucccugccggacuuccccgccgccgccaaguuccugggcuuccggcagcgcugcaucccccggagccucugccuguccgagugcccccuggagccgcccagccucacccgccugugcgcgacccugaaggacugccccgggccccucgagcugcagcuguccugcgaguuccucagcgaccagucccuggagacgcugcucgacugccugccgcagcugccccagcucagccugcugcagcucagccagaccggccugucccccaagagccccuuccugcucgccaacacccugucccugugcccgcgggucaagaagguggaccuccgcagccugcaccacgccacccugcacuuccgguccaacgaggaggaggagggggugugcugcggccgcuucacgggcugcagccucucccaggagcacgucgagagccugugcuggcugcucuccaagugcaaggaccugagccagguggaccuguccgccaaccuccugggggacagcggccugcggugccuccuggagugccugccccaggugcccaucuccgggcuccuggaccugagccacaacuccaucagccaggaguccgcccucuaccugcuggagacccuccccagcugcccgcgcguccgggaggcguccgugaaccugggcagcgagcagagcuuccgcauccacuucucccgcgaggaccaggccgggaagacccugcggcucagcgagugcuccuuccgccccgagcacgugagccggcuggccaccggccuguccaagagccuccagcugacggagcugacccucacccagugcugccugggccagaagcagcuggccauccuccugucccuggucgggcgccccgcgggccucuucagccugcgggugcaggagcccugggccgaccgcgcccgggugcugucccuccuggaggucugcgcccaggccagcggguccgugaccgagaucagcaucuccgagacgcagcagcagcugugcgugcagcuggaguucccgcgccaggaggagaaccccgaggcggucgcccuccggcuggcccacugcgaccugggcgcccaccacagccuccugguggggcagcugauggagaccugcgcccgccuccagcagcugucccugagccaggugaaccucugcgaggacgacgacgcguccagccugcugcuccagucccugcugcucagccugagcgagcugaagaccuuccggcucaccuccagcugcgucuccacggagggccuggcccaccuggccagcggccucgggcacugccaccaccuggaggagcuggaccucuccaacaaccaguucgacgaggagggcaccaaggcccugaugcgcgcccuggaggggaaguggaugcucaagcggcuggaccugagccaccuccugcugaacuccagcacccucgcgcugcugacccaccgccucucccagaugacgugccugcagagccugcggcucaaccgcaacuccaucggcgacguggggugcugccaccugagcgaggcccugcgggccgccaccucccucgaggagcuggaccugagccacaaccagaucggcgacgcgggcguccagcaccucgccaccauccugcccgggcugcccgagcuccgcaagaucgaccuguccggcaacagcaucuccagcgccgggggcgugcagcuggccgagucccucgugcugugccggcgccuggaggagcucaugcugggcugcaacgcccugggggacccgaccgcgcucggccuggcccaggagcugccccagcaccuccgcguccugcaccuccccuucagccaccucgggccgggcggggcccugagccuggcccaggcccucgacggcagcccccaccuggaggagaucagccuggcggagaacaaccucgccggcggggugcugcgguucugcauggagcugccccuccugcgccagaucgaccugguguccugcaagaucgacaaccagaccgccaagcuccugacgagcuccuucaccagcugccccgcccuggaggucauccuccuguccuggaaccugcucggcgacgaggccgcggccgagcuggcccaggugcugccgcagauggggcggcucaagcgcguggaccuggagaagaaccagaucaccgcccugggcgcguggcuccuggccgaggggcuggcccagggcagcuccauccaggucauccggcucuggaacaaccccauccccugcgacauggcccagcaccugaagucccaggagccccgccuggacuucgccuucuucgacaaccagccgcaggcgcccuggggcaccuga

SEQ ID NO: 33637 - RNA, 1968 nt, Artificial Sequence
  derived and/or modified sequence opt1 from NLRP10__Homo_sapiens__XP_011518345
auggccauggccaaggcgcgcaagccccgggaggcccugcucugggcccugagcgaccuggaggagaacgacuucaagaagcucaaguucuaccugcgcgacaugacccuguccgagggccagccgccccucgcccgcggggagcuggagggccugauccccguggaccucgccgagcugcugaucagcaaguacggggagaaggaggcggucaagguggugcucaagggccugaaggucaugaaccugcucgagcugguggaccagcugucccacaucugccuccacgacuaccgggagguguaccgggagcacguccgcugccuggaggaguggcaggaggccggggugaacggccgguacaaccaggugcugcucgucgccaagcccagcuccgagagcccggagucccuggccugccccuuccccgagcaggagcuggagagcgugaccguggaggcgcuguucgacuccggcgagaagcccagccuggccccgucccuggucgugcuccaggggagcgccggcacggggaagaccacccuggcccgcaagauggugcuggacugggccaccggcacgcucuaccccgggcgguucgacuacgucuucuacguguccugcaaggaggugguccugcugcucgagagcaagcuggagcagcugcuguucuggugcugcggcgacaaccaggcgcccgugaccgagauccugcgccagcccgagcggcuccucuucauccuggacggcuucgacgagcugcagcgcccguucgaggagaagcucaagaagcgggggcugucccccaaggagagccugcuccaccuccugauccgccggcacacccucccgaccugcucccugcugaucacgacccgcccccuggcccuccggaaccuggagccccugcucaagcaggcccgccacgugcacauccugggcuucagcgaggaggagcgggcccgcuacuucuccagcuacuucaccgacgagaagcaggccgaccgggcguucgacaucguccagaagaacgacauccuguacaaggccugccaggugcccgggaucugcuggguggucugcagcuggcuccagggccagauggagcgcggcaaggugguccuggagacgccccgcaacuccaccgacaucuucauggccuacgugagcaccuuccugcccccggacgacgacgggggcugcuccgagcucagccggcaccgcgugcugcggucccugugcagccucgccgccgaggggauccagcaccagcgcuuccuguucgaggaggcggagcugcggaagcacaaccucgacggcccccgccuggccgccuuccuguccagcaacgacuaccagcucgggcuggccaucaagaaguucuacuccuuccggcacaucagcuuccaggacuucuuccacgccauguccuaccuggucaaggaggaccagagccgccucggcaaggagucccggcgcgaggugcagcggcugcuggaggugaaggagcaggagggcaacgacgagaugacccucaccaugcaguuccugcuggacaucagcaagaaggacuccuucagcaaccucgagcugaaguucugcuuccgcaucucccccugccuggcgcaggaccucaagcacuucaaggagcagauggagagcaugaagcacaaccggacgugggaccuggaguucucccuguacgaggccaagaucaagaaccucgucaaggggauccagaugaacaacgugagcuucaagaucaagcacagcaacgagaagaagucccagagccagaaccuguucuccgucaagagcucccugagccacggccccaaggaggagcagaagugcccguccgugcacgggcagaaggagggcaaggacaacaucgccgggacccagaaggaggccagcaccggcaagggccgcgggaccgaggagacgcccaagaacaccuacaucuga

SEQ ID NO: 33638 - RNA, 3102 nt, Artificial Sequence
  derived and/or modified sequence opt1 from NLRP11__Homo_sapiens__NP_659444
auggccgagagcgacuccaccgacuucgaccugcucugguaccuggagaaccugagcgacaaggaguuccaguccuucaagaaguaccucgcccgcaagauccuggacuucaagcugccccaguucccgcucauccagaugaccaaggaggagcuggcgaacgugcugcccaucagcuacgagggccaguacaucuggaacaugcuguucuccaucuucagcaugaugcggaaggaggaccugugccgcaagaucaucgggcggcgcaaccggaaccaggaggccugcaaggccgucaugcgccggaaguucaugcugcagugggagucccacacguucggcaaguuccacuacaaguucuuccgcgacgugagcuccgacguguucuacauccuccagcuggccuacgacagcaccuccuacuacagcgccaacaaccugaacgucuuccucaugggggagcgggcguccggcaagaccaucgugaucaaccuggccgugcugcgcuggaucaagggggagauguggcagaacaugaucagcuacgucgugcaccucaccgcccacgagaucaaccagaugacgaacuccagccuggccgagcugaucgcgaaggacuggcccgacggccaggcccccaucgccgacauccucuccgacccgaagaagcugcuguucauccucgaggaccuggacaacauccgguucgagcugaacgugaacgagagcgcccucugcuccaacagcacccagaagguccccauccccgugcugcuggugagccuccugaagcgcaagauggcccccggcugcugguuccugaucuccagccggccgacccgcgggaacaacgucaagaccuuccucaaggagguggacugcugcacgacccugcagcuguccaacggcaagcgggagaucuacuucaacagcuucuucaaggaccgccagcgggcguccgccgcccuccagcuggugcacgaggacgagauccuggucgggcucugccgcguggccauccugugcuggaucacgugcaccgugcugaagcggcagauggacaagggccgcgacuuccagcucugcugccagacccccaccgaccugcacgcccacuuccuggcggacgcccucaccagcgaggccgggcugaccgccaaccaguaccaccugggccuccugaagcggcugugccugcucgccgcgggcgggcuguuccuguccacgcucaacuucagcggcgaggaccugcgcugcgucggguucaccgaggccgacguguccgugcugcaggccgccaacauccuccugcccagcaacacccacaaggaccgcuacaaguucauccaccugaacguccaggaguucugcaccgccaucgcguuccucauggccgugcccaacuaccugaucccguccggcagccgggaguacaaggagaagcgcgagcaguacuccgacuucaaccagguguucacguucaucuucggccugcucaacgccaaccggcgcaagauccuggagaccagcuucggguaccagcugcccauggucgacuccuucaagugguacagcgugggcuacaugaagcaccucgaccgggaccccgagaagcugacccaccacaugccccuguucuacugccucuacgagaaccgcgaggaggaguucgucaagaccaucguggacgcccugauggaggugacggucuaccugcaguccgacaaggacaugauggugagccucuacugccuggacuacugcugccaccuccggacccucaagcuguccgugcagcgcaucuuccagaacaaggagccgcugauccggcccaccgcgagccagaugaagucccucgucuacuggcgcgagaucugcagccuguucuacaccauggagagccugcgggagcuccacaucuucgacaacgaccugaacgggaucuccgagcgcauccugagcaaggcccucgagcacuccagcugcaagcugcggacgcugaagcucuccuacgugagcaccgccuccggcuucgaggaccugcugaaggcccucgcccgcaaccggagccugaccuaccuguccaucaacugcaccagcaucucccucaacauguucagccugcugcacgacauccuccacgagcccacgugccagaucucccaccugagccugaugaagugcgaccuccgcgcguccgagugcgaggagaucgccagccugcugaucagcgggggcucccuccggaagcugacccugagcuccaacccccuccgcagcgacggcaugaacauccugugcgacgcccugcuccacccgaacugcacccugaucucccuggugcucgucuucugcugccugaccgagaacugcugcagcgcccuggggcgggugcuccuguucucccccacgcugcgccagcucgaccugugcgugaaccgccugaagaacuacggcguccuccacgugaccuucccccugcuguucccgaccugccagcucgaggagcugcaccugagcgggugcuucuucuccagcgacaucugccaguacaucgccaucgugaucgcgaccaacgagaagcuccggucccuggagaucggcagcaacaagaucgaggacgccgggaugcagcugcucugcggcggccugcgccaccccaacugcaugcuggucaacaucgggcucgaggagugcaugcugaccuccgccugcugccggagccuggccuccgugcucacgaccaacaagacccuggagcgccugaaccuccugcagaaccaccugggcaacgacgggguggccaagcuccuggagagccugaucucccccgacugcguccucaagguggugggccugccccugaccgggcugaacacgcagacccagcagcuccugaugaccgucaaggagcggaagcccagccugaucuuccucuccgagaccuggagccugaaggagggccgcgagaucggcgugacgccggcgagccagcccggguccaucauccccaacagcaaccuggacuacauguucuucaaguucccgcggauguccgccgccaugcgcaccagcaacaccgccucccggcagccccucuga

SEQ ID NO: 33639 - RNA, 3189 nt, Artificial Sequence
  derived and/or modified sequence opt1 from NLRP12__Homo_sapiens__NP_001264055
augcugcgcaccgccggccgggacgggcucugccgccugagcaccuaccuggaggagcucgaggccguggagcugaagaaguucaagcuguaccucggcacggcgaccgagcugggggagggcaagauccccuggggguccauggagaaggccggcccgcuggagauggcccagcuccugaucacccacuucggccccgaggaggccuggcggcuggcccucagcaccuucgagcgcaucaaccggaaggaccugugggagcgcgggcagcgggaggaccugguccgcgacacgccgcccggcgggcccuccagccucggcaaccaguccacgugccugcuggaggugagccucgugacgccccggaaggacccccaggagaccuaccgcgacuacguccggcgcaaguuccggcugauggaggaccgcaacgcgcggcugggggagugcgugaaccucucccaccgcuacacccggcugcugcucgugaaggagcacagcaaccccaugcagguccagcagcagcugcuggacaccggccgcggccacgcccggaccguggggcaccaggccuccccgaucaagaucgagacccucuucgagcccgacgaggagcgccccgagcccccgcggaccguggucaugcagggcgccgcggggaucggcaagagcaugcuggcccacaaggugaugcuggacugggccgacggcaagcuguuccaggggcgcuucgacuaccuguucuacaucaacugccgcgagaugaaccaguccgccaccgagugcagcaugcaggaccugaucuucuccugcuggcccgagcccagcgcgccccuccaggagcugauccgggugccggagcgccuccucuucaucaucgacggcuucgacgagcugaagcccuccuuccacgacccccaggggcccuggugccugugcugggaggagaagcggccgaccgagcuccugcugaacagccucauccgcaagaagcugcugcccgagcucucccugcugaucaccacgcggcccaccgcccucgagaagcugcaccgccugcuggagcacccccggcacgucgagauccucggcuucagcgaggccgagcgcaaggaguacuucuacaaguacuuccacaacgccgagcaggccggccagguguucaacuacgugcgggacaacgagccgcuguucaccaugugcuucgucccccuggugugcuggguggucugcacgugccuccagcagcagcuggagggcggcgggcugcuccgccagaccucccggaccaccaccgccguguacaugcuguaccugcucagccugaugcagcccaagcccggggcgccgcgccugcagccgccgcccaaccagcgggggcucugcagccuggccgccgacggccuguggaaccagaagauccucuucgaggagcaggaccugcgcaagcacgggcuggacggcgaggacguguccgccuuccucaacaugaacaucuuccagaaggacaucaacugcgagcgguacuacagcuucauccaccuguccuuccaggaguucuucgccgcgauguacuacauccuggacgagggcgagggcggggccgggcccgaccaggacgucacgcgccuccugaccgaguacgccuucagcgagcgguccuuccuggcccucaccagccgcuuccuguucggccugcucaacgaggagacccggucccaccuggagaagucccugugcuggaaggugagcccccacaucaagauggaccuccugcaguggauccagagcaaggcccaguccgacgggagcacgcugcagcagggcucccucgaguucuucagcugccuguacgagauccaggaggaggaguucauccagcaggcgcugucccacuuccaggugaucgucgugagcaacaucgccuccaagauggagcacauggucagcuccuucugccucaagcgcugccgcagcgcccaggugcugcaccuguacggcgccaccuacagcgcggacggggaggaccgggcccgcugcuccgccggcgcccacacccuccuggugcagcugcggcccgagcgcaccguccuccuggacgccuacagcgagcaccuggcggccgcccucugcacgaaccccaaccugaucgagcugucccucuaccggaacgcccuggggagccgcggcgugaagcugcucugccagggccugcggcaccccaacugcaagcugcagaaccuccgccugaagcggugccgcaucuccagcuccgccugcgaggaccugagcgcggcccucaucgccaacaagaaccugacccggauggaccuguccgggaacggcgugggguuccccggcaugaugcuccugugcgaggggcugcgccacccccagugccggcuccagaugauccagcugcgcaagugccagcuggagagcggcgccugccaggagauggccuccguccucggcaccaacccgcaccugguggagcuggaccucaccgggaacgcgcuggaggaccugggccuccggcugcugugccaggggcuccgccaccccgugugccggcugcgcacgcuguggcucaagaucugccggcugaccgccgccgccugcgacgagcuggcgagcacccucuccgucaaccagagccugcgcgagcuggaccucucccugaacgagcugggcgaccucggggugcugcugcucugcgagggccugcggcacccgaccugcaagcugcagacccuccgccugggcaucugccgccuggggagcgccgccugcgagggccuguccgugguccuccaggccaaccacaaccugcgggagcuggaccucagcuucaacgaccugggggacuggggccuguggcuccuggccgaggggcugcagcaccccgcgugccgccuccagaagcuguggcuggacagcugcggccucacggccaaggccugcgagaaccuguacuucacccugggcaucaaccagacccucaccgaccuguaccugacgaacaacgcccucggggacaccggcgugcggcugcugugcaagcgccucucccaccccgggugcaagcugcgggugcuguggcuguucggcauggaccucaacaagaugacccacagccgccuggccgcgcuccgggucaccaagcccuaccuggacaucgggugcuga

SEQ ID NO: 33640 - RNA, 3132 nt, Artificial Sequence
  derived and/or modified sequence opt1 from NLRP13__Homo_sapiens__NP_789780
augaacuucagcgugaucacgugccccaacggcgggaccaaccagggccugcucccguaccugauggcccuggaccaguaccagcucgaggaguucaagcugugccuggagccccagcagcucauggacuucuggagcgcgccccaggggcacuucccccgcaucccgugggccaaccugcgggccgccgacccccugaaccucagcuuccugcuggacgagcacuuccccaagggccaggccuggaaggucgugcucgggaucuuccagaccaugaaccugaccucccugugcgagaaggugcgcgccgagaugaaggagaacguccagacccaggagcuccaggaccccacccaggaggaccuggagaugcuggaggcggccgccggcaacaugcagacgcagggcugccaggacccgaaccaggaggagcucgacgagcuggaggaggagaccgggaacgugcaggcccagggcugccaggaccccaaccaggaggagcccgagaugcuggaggaggcggaccaccggcgcaaguaccgggagaacaugaaggccgagcuccuggagaccugggacaacaucagcuggcccaaggaccacguguacauccgcaacaccuccaaggacgagcacgaggagcugcagcggcuccuggacccgaaccgcacgcgggcccaggcccagaccaucguccugguggggcgcgccggcguggggaagaccacccucgcgaugcaggccaugcugcacugggccaacggcguccuguuccagcagcgguucagcuacguguucuaccucuccugccacaagauccgcuacaugaaggagacgaccuucgccgagcugaucagccuggacuggcccgacuucgacgcccccaucgaggaguucaugucccagcccgagaagcuccuguucaucaucgacggcuucgaggagaucaucaucagcgagucccggagcgagucccuggacgacgggagcccgugcaccgacugguaccaggagcuccccgugaccaagauccugcacucccugcucaagaaggagcuggucccccuggcgacgcuccugaucaccaucaagaccugguucgugcgcgaccugaaggccagccucgugaaccccugcuucguccagaucaccggcuucacgggggacgaccugcggguguacuucaugcgccacuucgacgacuccagcgagguggagaagauccugcagcagcuccggaagaacgagacccuguuccacuccugcagcgccccgauggucugcuggaccgugugcagcugccugaagcagcccaaggugcgcuacuacgaccugcaguccaucacccagacgaccaccagccucuacgccuacuucuucuccaaccuguucagcaccgccgaggucgaccuggcggacgacuccuggcccggccaguggcgggcccucugcagccuggccaucgagggccugugguccaugaacuucacguucaacaaggaggacaccgagaucgaggggcucgaggugcccuucaucgacagccuguacgaguucaacauccugcagaagaucaacgacugcggcgggugcaccaccuucacgcaccucuccuuccaggaguucuucgccgccaugagcuucgugcuggaggagccgcgcgaguucccgccccacuccaccaagccccaggagaugaagaugcugcuccagcacguccugcuggacaaggaggcguacuggacccccgugguccucuucuucuucggccugcugaacaagaacaucgcccgggagcucgaggacacccugcacugcaagaucagcccccgcgugauggaggagcugcucaaguggggcgaggagcuggggaaggccgaguccgccagccugcaguuccacauccuccgccuguuccacugccugcacgagucccaggaggaggacuucacgaagaagaugcucggccggaucuucgagguggaccugaacauccuggaggacgaggagcuccaggcgagcuccuucugccugaagcacugcaagcgccugaacaagcuccggcugagcgucuccagccacauccuggagcgcgaccucgagauccuggagaccagcaaguucgacucccggaugcacgccuggaacagcaucugcuccacccuggugaccaacgagaaccuccacgagcuggaccugagcaacuccaagcuccacgccagcuccgugaaggggcugugccuggcccucaagaacccccgcugcaagguccagaagcugaccugcaagagcgugacgccggagugggugcugcaggaccucaucaucgcccugcagggcaacuccaagcugacccaccucaacuucagcuccaacaagcuggggaugaccgucccccugauccucaaggcgcugcggcacagcgccugcaaccugaaguaccucugccuggagaagugcaaccuguccgccgccagcugccaggaccucgcccuguuccugaccuccauccagcacgugacgcgccucugccugggcuucaaccggcugcaggacgacgggaucaagcuccugugcgcggcccugacccaccccaagugcgcccucgagcgccuggagcugugguucugccagcucgccgcccccgcgugcaagcaccugagcgacgcccugcuccagaaccggucccugacccaccugaaccucagcaagaacagccugcgcgacgagggcgugaaguuccugugcgaggcccucggccggccggacgggaaccugcagucccugaaccucagcggcugcuccuucacccgcgaggggugcggcgagcuggccaacgcgcugagccacaaccacaacgucaagauccucgaccugggggagaacgaccugcaggacgacggcgugaagcuccugugcgaggcccugaagccccaccgggcccuccacacgcugggccuggccaagugcaaccugaccaccgccugcugccagcaccucuucuccgugcugagcuccagcaagucccuggucaaccucaaccugcuggggaacgagcucgacaccgacggcgugaagaugcugugcaaggcgcugaagaaguccacgugccgccuccagaagcugggguga

SEQ ID NO: 33641 - RNA, 3282 nt, Artificial Sequence
  derived and/or modified sequence opt1 from NLRP14__Homo_sapiens__NP_789792
auggccgacagcuccagcuccagcuucuuccccgacuucggccugcuccuguaccuggaggagcucaacaaggaggagcugaacaccuucaagcuguuccucaaggagaccauggagccggagcacgggcugacgcccuggaacgaggugaagaaggcccgccgggaggaccuggcgaaccucaugaagaaguacuaccccggcgagaaggccugguccgucagccugaagaucuucgggaagaugaaccugaaggaccucugcgagcgcgccaaggaggagaucaacugguccgcccagaccaucggccccgacgacgccaaggcgggggagacccaggaggaccaggaggccgugcugggcgacggcaccgaguaccggaaccgcaucaaggagaaguucugcaucacgugggacaagaagucccuggccgggaagccggaggacuuccaccacggcaucgccgagaaggaccggaagcuccuggagcaccuguucgacguggacgucaagaccggggcgcagccccagaucguggugcuccagggcgccgccggggucggcaagaccacccuggugcgcaaggccaugcuggacugggccgagggcagccucuaccagcagcgguucaaguacguguucuaccugaacgggcgcgagaucaaccagcugaaggagcggagcuucgcgcagcucaucuccaaggacuggcccagcacggagggccccaucgaggagaucauguaccagccguccagccugcuguucaucaucgacuccuucgacgagcucaacuucgccuucgaggagcccgaguucgcccugugcgaggacuggacccaggagcaccccgucagcuuccugauguccagccuccugcgcaaggugaugcugcccgaggccucccuccuggugaccacccggcugacgaccagcaagcgccucaagcagcugcugaagaaccaccacuacgucgagcuccuggggaugagcgaggacgcccgggaggaguacaucuaccaguucuucgaggacaagcgcugggcgaugaagguguucuccagccugaaguccaacgagaugcuguucagcaugugccaggugccgcuggucugcugggccgccugcacgugccugaagcagcagauggagaagggcggcgacgugacccugaccugccagaccaccaccgcccucuucacgugcuacaucuccagccuguucacccccguggacgggggcucccccagccuccccaaccaggcccagcugcggcgccugugccaggucgcggccaaggggaucuggaccaugaccuacguguucuaccgggagaaccugcgccggcucggccugacgcaguccgacgugagcuccuucauggacagcaacaucauccagaaggacgccgaguacgagaacugcuacgucuucacccaccuccacgugcaggaguucuucgccgccauguucuacaugcucaagggguccugggaggcgggcaacccgagcugccagcccuucgaggaccugaagucccugcuccagagcaccuccuacaaggacccccaccugacccagaugaagugcuuccuguucggccuccugaacgaggaccgcgugaagcagcuggagcggacguucaacugcaagaugagccucaagaucaaguccaagcugcugcagugcauggagguccucgggaacagcgacuacagccccucccagcugggcuuccuggagcuguuccacugccuguacgagacccaggacaaggccuucaucagccaggccaugcgcugcuucccgaagguggccaucaacaucugcgagaagauccaccuccucgucuccagcuucugccugaagcacugccgcugccugcggaccauccgccucuccgugaccguggucuucgagaagaagauccugaagacgagccugcccaccaacaccugggacggggaccggaucacccacugcuggcaggaccucugcuccgugcugcacacgaacgagcaccuccgcgagcuggaccuguaccacagcaaccuggacaaguccgcgaugaacauccuccaccacgagcugcggcaccccaacugcaagcugcagaagcuccugcugaaguucaucaccuuccccgacggcugccaggacaucagcaccucccucauccacaacaagaaccugaugcaccuggaccucaaggggagcgacaucggcgacaacggcgugaagucccugugcgaggcccugaagcacccggagugcaagcuccagacccugcgccuggagagcugcaaccucaccgucuucugcugccugaacaucuccaacgcccugauccggagccagucccucaucuuccugaaccugagcacgaacaaccuccuggacgacggggugcagcugcucugcgaggcccugcgccaccccaagugcuaccuggagcggcucagccuggaguccugcggccugaccgaggccgggugcgaguaccucagccuggcgcugaucuccaacaagcgccucacccaccugugccuggccgacaacgugcucggcgacgggggcgucaagcugaugagcgacgcccugcagcacgcccagugcacccucaagucccuggugcugcggcgcugccacuucacgagccucuccagcgaguaccuguccaccagccugcuccacaacaagucccugacccaccuggaccucggcagcaacuggcugcaggacaacggggugaagcugcucugcgacgucuuccggcaccccuccugcaaccugcaggaccuggagcucaugggcugcgugcugaccaacgccugcugccuggaccucgcgagcgugauccugaacaaccccaaccugcgcucccucgaccuggggaacaacgaccugcaggacgacggcgucaagauccugugcgacgcccuccgguacccgaacugcaacauccagcgccugggccuggaguacugcgggcucacgagccugugcugccaggaccuguccagcgcccucaucugcaacaagcggcugaucaagaugaaccugacccagaacacccucggcuacgaggggaucgugaagcuguacaaggugcugaagucccccaagugcaagcuccagguccugggccugugcaaggaggccuucgacgaggaggcccagaagcuccuggaggcggugggggugagcaacccccaccugaucaucaagccggacugcaacuaccacaacgaggaggacgucagcuggugguggugcuucuga

SEQ ID NO: 33642 - RNA, 4128 nt, Artificial Sequence
  derived and/or modified sequence opt1 from NLRP1__Homo_sapiens__NP_001028225
auggccggcggggccuggggccgccuggcgugcuaccucgaguuccugaagaaggaggagcugaaggaguuccagcuccugcuggccaacaaggcccacagccgguccagcuccggggagacccccgcccagccggagaagaccagcggcauggagguggccuccuaccucgucgcgcaguacggggagcagcgcgccugggaccuggcccugcacacgugggagcagaugggccuccggagccugugcgcccaggcgcaggagggcgccgggcacucccccagcuuccccuacucccccagcgagccgcaccugggcucccccagccagcccaccuccaccgccgugcucaugcccuggauccacgagcugccggccgggugcacccagggcagcgagcgccgggugcugcgccagcuccccgacacguccgggcggcgcuggcgggagaucagcgccucccugcuguaccaggcgcuccccagcucccccgaccacgagagcccgagccaggagucccccaacgcccccaccagcaccgccguccugggcuccuggggcagcccgccccagcccucccuggcgccccgcgagcaggaggcccccgggacccaguggccgcucgacgagacgagcggcaucuacuacaccgagauccgggagcgcgagcgggagaaguccgagaaggggcgcccgcccugggccgccguggugggcaccccgccccaggcccacaccagccugcagccccaccaccaccccugggagcccuccguccgggagagccugugcuccacguggcccuggaagaacgaggacuucaaccagaaguucacccagcuccugcugcuccagcgcccccacccccggagccaggacccgcuggugaagcgcuccuggcccgacuacguggaggagaaccggggccaccugaucgagauccgcgaccucuucgggcccggccuggacacccaggagccccggaucgucauccugcagggggccgccggcaucggcaagagcacccucgcgcgccaggugaaggaggccugggggcgcggccagcuguacggggaccgguuccagcacguguucuacuucuccugccgcgagcuggcccagagcaaggucgugucccucgccgagcugaucggcaaggacgggacggccaccccggcgcccauccggcagauccugagccgccccgagcggcuccuguucauccuggacggcguggacgagcccggguggguccuccaggagccguccagcgagcugugccugcacuggagccagccccagcccgccgacgcccuccugggcucccugcucggcaagaccauccugcccgaggccagcuuccugaucaccgcgcgcacgaccgcccugcagaaccucaucccgucccuggagcaggcccgguggguggaggugcugggguucagcgaguccagccgcaaggaguacuucuaccgguacuucaccgacgagcgccaggccauccgggccuuccgccucgucaaguccaacaaggagcugugggcgcugugccucgugcccugggugagcuggcuggccugcacgugccugaugcagcagaugaagcggaaggagaagcucacccugaccuccaagaccaccacgacccugugccuccacuaccuggcccaggcccugcaggcccagccccucggcccccagcugcgcgaccugugcagccucgcggccgaggggaucuggcagaagaagacccuguucuccccggacgaccugcggaagcacggccucgacggggccaucaucagcaccuuccugaagaugggcauccugcaggagcaccccaucccccucuccuacagcuucauccaccugugcuuccaggaguucuucgccgccauguccuacguccuggaggacgagaagggccgcgggaagcacagcaacugcaucaucgaccucgagaagacgcuggaggcguacggcauccacgggcuguucggcgccuccaccacccgguuccuccugggccugcucagcgacgagggggagcgcgagauggagaacaucuuccacugccggcugagccagggccgcaaccugaugcagugggugcccucccuccagcugcugcuccagccgcacagccuggagucccugcacugccucuacgagacccgcaacaagacguuccugacccaggugauggcccacuucgaggagauggggaugugcgucgagaccgacauggagcugcucgugugcaccuucugcaucaaguucagccggcacgucaagaagcugcagcugaucgagggccgccagcaccgguccaccuggagccccacgauggugguccucuuccgcugggugcccgugaccgacgccuacuggcagauccuguucuccgugcugaaggucacccggaaccucaaggagcuggaccugagcgggaacucccucagccacuccgcggucaagagccugugcaagacccugcgccggccccgcugccuccuggagacgcugcggcucgccggcugcggccugaccgccgaggacugcaaggaccuggccuucgggcuccgcgccaaccagacccugaccgagcuggaccucuccuucaacgugcugacggacgcgggcgccaagcaccugugccagcggcuccgccagccgagcugcaagcugcagcggcugcagcucguguccugcgggcugaccagcgacugcugccaggaccuggccuccgugcucagcgccucccccagccugaaggagcuggaccuccagcagaacaaccuggacgacgugggcguccgccugcucugcgaggggcugcggcaccccgccugcaagcugauccgccucggccuggaccagaccacccugagcgacgagaugcggcaggagcuccgcgcgcuggagcaggagaagccgcagcugcucaucuucucccggcgcaagcccagcgugaugacgcccaccgagggccuggacaccggggagauguccaacagcaccuccagccugaagcggcagcgccucggcuccgagcgcgccgccagccacguggcccaggccaaccugaagcugcuggacgucuccaagaucuuccccaucgcggagaucgccggcaagagccacgaggaguccagcccggagguggugcccgucgagcuccugugcgugcccucccccgccagccagggggaccugcacacgaagccgcucgggaccgacgacgacuucuggggccccaccggccccguggccaccgaggucguggacaaggagaagaaccuguaccgggugcacuuccccgucgcgggguccuaccgcuggccgaacacgggccugugcuucgugaugcgggaggccgugaccgucgagaucgaguucugcgugugggaccaguuccucggggagaucaacccccagcacagcuggaugguggccggcccccugcuggacaucaaggccgagcccggggccgucgaggcggugcaccucccgcacuucguggcccugcagggcggccacgucgacaccucccuguuccagauggcccacuucaaggaggaggggaugcuccuggagaagcccgcccgcguggagcugcaccacaucgugcucgagaaccccagcuucagcccccugggcguccugcucaagaugauccacaacgcccugcgguucaucccggugaccuccgugguccugcucuaccaccgcgugcaccccgaggaggugacguuccaccuguaccugauccccagcgacugcuccauccggaaggcgaucgacgaccucgagaugaaguuccaguucguccgcauccacaagcccccgccccugacgccccuguacauggggugccgguacaccgugagcggcuccggcagcgggaugcucgagauccugcccaaggagcuggagcucugcuaccgcuccccgggcgaggaccagcuguucagcgaguucuacguggggcaccugggcuccgggauccggcuccaggucaaggacaagaaggacgagacccuggugugggaggcccuggugaagcccggccgcaacaccagccagcccuggaaccuccggugcaaccgcgacgcccggcgcuacuga

SEQ ID NO: 33643 - RNA, 3189 nt, Artificial Sequence
  derived and/or modified sequence opt1 from NLRP2__Homo_sapiens__NP_001167552
auggugagcuccgcccagaugggcuucaaccugcaggcccuccuggagcagcugagccaggacgagcucuccaaguucaaguaccugaucaccaccuucagccuggcgcacgagcuccagaagaucccccacaaggaggucgacaaggccgacgggaagcagcugguggagauccugacgacccacugcgacuccuacuggguggagauggccagccuccaggucuucgagaagaugcaccgcauggaccuguccgagcgggccaaggacgaggugcgcgaggccgcgcucaagagcuucaacaagcggaagccgcucucccugggcaucacccgcaaggagcggccgccccuggacguggacgagaugcucgagcgcuucaagaccgaggcccaggccuucacggagaccaaggggaacgucaucugccugggcaaggagguguucaaggggaagaagcccgacaaggacaaccggugccgcuacauccugaagaccaaguuccgggagauguggaaguccuggcccggcgacagcaaggaggugcaggucauggccgagcgcuacaagaugcucauccccuucagcaacccccgggugcugcccggcccguucuccuacaccgugguccuguacgggcccgcgggccucgggaagacgacccuggcccagaagcugaugcucgacugggccgaggacaaccugauccacaaguucaaguacgccuucuaccugagcugccgcgagcucucccggcugggccccugcagcuucgccgagcugguguuccgcgacuggcccgagcuccaggacgacaucccgcacauccuggcgcaggcccggaagauccuguucgugaucgacggguucgacgagcucggcgccgcccccggcgcccugaucgaggacaucugcggggacugggagaagaagaagcccguccccgugcugcucggcucccugcugaaccgcgugaugcucccgaaggcggcccugcuggucaccacccggccccgcgcccuccgggaccugcgcauccuggccgaggagcccaucuacauccggguggagggguuccucgaggaggaccgccgcgccuacuuccugcggcacuucggcgacgaggaccaggcgaugcgcgccuucgagcugaugcggagcaacgccgcccucuuccagcugggcuccgcccccgcggugugcuggaucgucugcacgacccugaagcugcagauggagaagggggaggacccggugccgaccugccucacccgcacgggccuguuccugcgguuccucugcagccgcuucccccagggggcccagcugcggggcgcccugcgcacccucagccugcuggccgcgcaggggcucugggcccagaccuccgugcugcaccgggaggaccuggagcgccucggcguccaggagagcgaccugcggcuguuccucgacggcgacauccugcgccaggaccggguguccaaggggugcuacagcuucauccaccuguccuuccagcaguuccucaccgcccuguucuacacgcuggagaaggaggaggaggaggaccgcgacggccacaccugggacaucggggacguccagaagcuccugagcggcguggagcggcugcgcaaccccgaccucauccaggccggguacuacuccuucggccuggccaacgagaagcgggcgaaggagcuggaggccaccuucggcugccgcaugagccccgacaucaagcaggagcuccugcggugcgacaucuccugcaagggcgggcacagcaccgugacggaccugcaggagcuccuggggugccuguacgagucccaggaggaggagcucgucaaggaggugauggcccaguucaaggagaucagccugcaccugaacgccguggacgucgugcccuccagcuucugcgugaagcacugccgcaaccuccagaagaugucccugcaggucaucaaggagaaccugcccgagaacgugaccgccagcgaguccgacgcggagguggagcgcagccaggacgaccagcacaugcuccccuucuggaccgaccugugcuccaucuucggcagcaacaaggaccugauggggcucgccaucaacgacagcuuccuguccgccagccugguccggauccucugcgagcagaucgccuccgacacgugccaccuccagcgcgugguguucaagaacaucagcccggccgacgcgcaccggaaccugugccuggcccugcgcggccacaagaccgucaccuaccugacccuccagggcaacgaccaggacgacauguuccccgcccugugcgaggugcugcggcaccccgagugcaaccuccgcuaccuggggcugguguccugcagcgccaccacgcagcagugggcggaccucucccuggcccuggaggucaaccagagccugaccugcgugaaccuguccgacaacgagcugcucgacgagggcgccaagcugcuguacaccacccuccggcacccgaagugcuuccugcagcgccugagccucgagaacugccaccugacggaggccaacugcaaggaccuggccgcggugcucgucgugucccgggagcugacccaccugugccucgccaagaaccccaucgggaacaccggcgugaaguuccugugcgagggccugcgcuaccccgagugcaagcuccagacccugguccuguggaacugcgacaucaccagcgacgggugcugcgaccucacgaagcugcugcaggagaaguccagccuccugugccuggaccucggccugaaccacaucggggugaagggcaugaaguuccugugcgaggcccuccggaagccccugugcaaccugcgcugccucuggcugugggggugcuccaucccgcccuucagcugcgaggaccugugcuccgcccugagcugcaaccagagccucgugacccuggaccugggccagaacccccucggcuccagcggggucaagaugcuguucgagacccugaccugcuccagcggcacgcuccggacccugcgccugaagaucgacgacuucaacgacgagcucaacaagcugcuggaggagaucgaggagaagaacccccagcucaucaucgacaccgagaagcaccacccgugggccgagcggcccuccagccacgacuucaugaucuga

SEQ ID NO: 33644 - RNA, 2940 nt, Artificial Sequence
  derived and/or modified sequence opt1 from NLRP3__Homo_sapiens__NP_001120933
augaagauggccagcacccgcugcaagcuggcccgguaccucgaggaccuggaggacguggaccugaagaaguucaagaugcaccucgaggacuacccgccccagaagggcugcaucccccugccccgcgggcagaccgagaaggcggaccacgucgaccuggccacgcucaugaucgacuucaacggcgaggagaaggccugggccauggccguguggaucuucgcggccaucaaccggcgcgaccuguacgagaaggccaagcgggacgagcccaaguggggguccgacaacgcccgcgugagcaacccgaccgucaucugccaggaggacuccaucgaggaggaguggaugggccugcucgaguaccugagccggaucuccaucugcaagaugaagaaggacuaccgcaagaaguaccggaaguacgugcgcagccgguuccagugcaucgaggaccgcaacgcgcggcugggggaguccgugagccucaacaagcgcuacacccggcugcgccugaucaaggagcaccggucccagcaggagcgcgagcaggagcuccuggccaucggcaagaccaagacgugcgagagccccgucucccccaucaagauggagcugcuguucgaccccgacgacgagcacagcgagccggugcacaccguggucuuccagggcgccgccgggaucggcaagaccauccuggcccggaagaugaugcuggacugggcguccgggacccucuaccaggaccgcuucgacuaccuguucuacauccacugccgggaggugagccuggugacgcagcgcucccucggcgaccugaucaugagcugcugccccgaccccaacccgcccauccacaagaucguccgcaagcccucccggauccuguuccucauggacggguucgacgagcugcagggcgccuucgacgagcacaucggcccccugugcaccgacuggcagaaggccgagcgcggggacauccuccugagcucccugauccggaagaagcuccugcccgaggccagccugcucaucaccacccgcccgguggcccuggagaagcugcagcaccuccuggaccacccccggcacguggagauccugggcuucagcgaggcgaagcgcaaggaguacuucuucaaguacuucuccgacgaggcccaggcccgggccgccuucagccucauccaggagaacgagguccuguucacgaugugcuucaucccccuggugugcuggaucgugugcaccgggcucaagcagcagauggaguccggcaagagccuggcgcagaccuccaagaccacgaccgccgucuacguguucuuccugagcucccuccugcagccccgcggcgggagccaggagcacggccugugcgcccaccugugggggcucugcucccuggccgccgacggcaucuggaaccagaagauccuguucgaggagagcgaccuccggaaccacgggcugcagaaggcggacguguccgccuuccugcgcaugaaccucuuccagaaggaggucgacugcgagaaguucuacagcuucauccacaugaccuuccaggaguucuucgccgccauguacuaccugcuggaggaggagaaggagggccggaccaacgugccgggcucccgccucaagcugcccagccgggacgugacgguccugcucgagaacuacgggaaguucgagaagggcuaccugaucuucgugguccgcuuccuguucgggcucgugaaccaggagcggaccuccuaccuggagaagaagcugagcugcaagaucucccagcagauccgccucgagcugcugaaguggaucgaggugaaggcgaaggccaagaagcuccagauccagcccagccagcuggagcuguucuacugccucuacgagaugcaggaggaggacuucguccagcgggccauggacuacuuccccaagaucgagaucaaccuguccacccgcauggaccacauggugagcagcuucugcaucgagaacugccaccggguggagucccugagccucggcuuccugcacaacaugccgaaggaggaggaggaggaggagaaggaggggcgccaccuggacaugguccagugcgugcuccccuccagcucccacgccgccugcagccacggccuggugaacucccaccugaccagcuccuucugccgcggccucuucagcguccuguccacgagccagucccugaccgagcucgaccugagcgacaacucccugggggaccccggcaugcgggugcucugcgagacccugcagcaccccgggugcaacauccgccggcuguggcucggccgcugcgggcugagccacgagugcugcuucgacaucucccuggugcucagcagcaaccagaagcuggucgagcuggaccucuccgacaacgcgcugggcgacuucggcauccggcugcucugcguggggcugaagcaccuccucugcaaccugaagaagcuguggcucgugaacagcggccugaccuccgucugcugcagcgcccuguccagcgugcucuccacgaaccagaaccugacccaccuguaccuccgcgggaacacccugggcgacaagggcaucaagcugcucugcgaggggcugcugcacccggacugcaagcuccaggugcuggagcuggacaacugcaaccucaccagccacugcugcugggaccuguccacgcugcucaccagcucccagagccugcggaagcugucccucggcaacaacgaccugggggaccugggcgucaugauguucugcgaggugcucaagcagcagagcugccugcugcagaaccucgggcuguccgagauguacuucaacuacgagaccaagagcgcccuggagacccuccaggaggagaagcccgagcugacgguggucuucgagcccuccugguga

SEQ ID NO: 33645 - RNA, 3087 nt, Artificial Sequence
  derived and/or modified sequence opt1 from NLRP4__Homo_sapiens__XP_006723105
augagccgcgccaucaacggcauggacgaggaguucggguucaucuaccugcuguuccuggugaccgucucccugcggaucggcaucagcgcccccgagaagauggcggccuccuucuucagcgacuucgggcucaugugguaccuggaggagcugaagaaggaggaguuccgcaaguucaaggagcaccucaagcagaugacccugcagcuggagcucaagcagaucccguggacggaggugaagaaggccucccgggaggagcuggccaaccugcucaucaagcacuacgaggagcagcaggccuggaacaucacccugcgcaucuuccagaagauggaccggaaggaccugugcaugaaggugaugcgcgagcggaccggcuacaccaagacguaccaggcgcacgccaagcagaaguucagccgccucugguccagcaaguccgucaccgagauccaccuguacuucgaggaggaggugaagcaggaggagugcgaccaccuggaccggcuguucgcccccaaggaggccgggaagcagccccgcaccgugaucauccagggcccccagggcaucgggaagaccacgcugcugaugaagcucaugauggcguggagcgacaacaagaucuuccgggaccgcuuccuguacaccuucuacuucugcugccgggagcugcgcgagcucccgcccaccucccuggccgaccugaucagccgggaguggcccgaccccgccgccccgaucaccgagaucgucucccagcccgagcgccuccuguucgugaucgacagcuucgaggagcugcagggcgggcucaacgagcccgacuccgaccugugcggcgaccugauggagaagcggcccgugcagguccuccugagcucccugcuccgcaagaagaugcugccggaggccagccugcucaucgcgaucaagcccgugugccccaaggagcugcgggaccaggugacgaucuccgagaucuaccagccccgcggguucaacgagagcgaccggcuggucuacuucugcugcuucuucaaggacccgaagcgcgccauggaggccuucaaccucgugcgcgagagcgagcagcuguucuccaucugccagaucccccugcucugcuggauccugugcaccagccugaagcaggagaugcagaagggcaaggaccucgcccugaccugccaguccaccacgagcguguacuccagcuucgucuucaaccuguucacccccgagggcgccgaggggcccaccccgcagacccagcaccagcugaaggcgcucugcucccuggccgccgagggcauguggacggacaccuucgaguucugcgaggacgaccugcggcgcaacggggugguggacgccgacauccccgcccuccugggcaccaagauccugcucaaguacggcgagcgggagagcuccuacgucuuccugcacgugugcauccaggaguucugcgcggcccuguucuaccuccucaagagccaccuggaccacccccaccccgccgugcgcugcguccaggagcuccugguggccaacuucgagaaggcccggcgcgcgcacuggaucuuccuggggugcuuccucaccggccugcugaacaagaaggagcaggagaagcucgacgccuucuucggguuccagcugucccaggagaucaagcagcagauccaccagugccucaagagccucggcgagcgggggaacccgcagggccagguggacucccuggccaucuucuacugccuguucgagaugcaggaccccgccuucgucaagcaggcggugaaccuccugcaggaggccaacuuccacaucaucgacaacgucgaccugguggugagcgccuacugccucaaguacugcuccagccugcgcaagcugugcuucuccguccagaacguguucaagaaggaggacgagcacagcuccacgagcgacuacagccucaucugcuggcaccacaucugcuccgugcugaccaccagcggccaccuccgggagcuccagguccaggacuccacccugagcgaguccacguucgugaccuggugcaaccagcugcgccaccccagcugccggcuccagaagcuggggaucaacaacguguccuucagcggccaguccguccugcuguucgaggugcuguucuaccagcccgaccugaaguaccucagcuucacccugaccaagcugucccgcgacgacauccggagccucugcgacgcccugaacuacccggccgggaacgugaaggagcuggcgcucgucaacugccaccugucccccaucgacugcgaggugcuggccggccuccugacgaacaacaagaagcugaccuaccucaacgugagcugcaaccagcuggacaccggggucccccugcucugcgaggcccugugcuccccggacaccgugcugguguaccucaugcuggccuucugccaccugagcgagcagugcugcgaguacaucuccgagaugcuccugcgcaacaagagcguccgguaccuggaccucagcgccaacgugcugaaggacgagggccugaagacgcucugcgaggcgcugaagcaccccgacugcugccuggacucccucugccuggugaagugcuucaucaccgccgccggcugcgaggaccuggccagcgcccucaucuccaaccagaaccugaagauccugcagaucgggugcaacgagaucggcgacgucggggugcagcuccugugccgcgcgcugacccacaccgacugccggcucgagauccugggccuggaggagugcgggcucaccagcacgugcugcaaggaccuggccuccgugcugaccugcagcaagacccuccagcagcugaaccugacccucaacacgcuggaccacaccggcgucguggugcugugcgaggcccuccgccaccccgagugcgcccugcagguccugggccugcggaagaccgacuucgacgaggagacccaggcgcuccugacggccgaggaggagcgcaaccccaaccugaccaucaccgacgacugcgacaccaucacgcgcguggagaucuga

SEQ ID NO: 33646 - RNA, 3603 nt, Artificial Sequence
  derived and/or modified sequence opt1 from NLRP5__Homo_sapiens__NP_703148
augaagguggccggcgggcuggagcucggcgccgcggcccugcugagcgccagcccccgcgcccucgucacccugagcaccgggccgacgugcuccauccugcccaagaacccccucuucccccagaaccugagcucccagccgugcaucaagauggagggcgacaagagccugaccuucuccagcuacgggcuccaguggugccuguacgagcuggacaaggaggaguuccagaccuucaaggagcuccugaagaagaaguccagcgaguccaccacgugcagcaucccccaguucgagaucgagaacgccaacguggagugccuggcgcuccugcugcacgaguacuacggcgccucccucgccugggccaccagcaucuccaucuucgagaacaugaaccugcggacccugagcgagaaggcgcgcgacgacaugaagcggcacucccccgaggaccccgaggccaccaugacggaccagggcccgagcaaggagaaggugcccgggaucucccaggccguccagcaggacagcgccaccgccgcggagaccaaggagcaggagaucagccaggccauggagcaggagggcgccaccgccgccgagacggaggagcaggagaucucccaggcgauggagcaggagggggccaccgccgccgagaccgaggagcagggccacgggggcgacaccugggacuacaagagccacgugaugacgaaguucgccgaggaggaggacgugcgccgguccuucgagaacaccgcggccgacuggcccgagaugcagacccucgccggcgccuucgacagcgaccgcuggggguuccggccccgcaccgucgugcugcacggcaaguccgggaucggcaagagcgcccuggcgcggcgcaucgugcucugcugggcccagggcgggcuguaccagggcauguucuccuacgucuucuuccugccggugcgggagaugcagcgcaagaaggagagcuccgugacggaguucaucagccgggaguggcccgacucccaggcccccgucaccgagaucaugagccgccccgagcggcuccuguucaucaucgacggguucgacgaccugggcuccgugcucaacaacgacaccaagcugugcaaggacugggccgagaagcagccgcccuucacccugauccgcagccuccugcggaaggugcugcuccccgaguccuuccugaucgucacggugcgcgacguggggaccgagaagcugaaguccgaggucgugagcccccgguaccuccuggugcgcggcaucagcggcgagcagcggauccaccuccugcuggagcgcgggaucggcgagcaccagaagacccaggggcugcgcgcgaucaugaacaaccgggagcuccuggaccagugccaggucccggccgugggcucccugaucugcguggcccuccagcugcaggacgucgugggggagagcgucgcccccuucaaccagacccugacgggccugcacgccgcguucguguuccaccagcucacgccccgcggcgugguccggcgcugccugaaccuggaggagcggguggugcucaagcgcuucugccggauggccgucgaggggguguggaaccgcaagagcguguucgacggcgacgaccugaugguccaggggcugggcgaguccgagcuccgggcccuguuccacaugaacauccugcuccccgacagccacugcgaggaguacuacaccuucuuccaccugucccugcaggacuucugcgccgcccucuacuacgugcuggaggggcuggagaucgagccggcgcucugcccccuguacguggagaagaccaagcgcagcauggagcugaagcaggccggcuuccacauccacucccucuggaugaagcgguuccuguucggccuggucagcgaggacgugcgccggccccucgaggugcugcuggggugccccgucccgcucggcgugaagcagaagcugcugcacugggugucccuccuggggcagcagcccaacgccaccacccccggcgacacccuggacgccuuccacugccucuucgagacccaggacaaggaguucguccgccuggcccugaacagcuuccaggagguguggcucccgaucaaccagaaccuggaccugaucgcguccagcuucugccuccagcacugccccuaccugcggaagauccgcguggacgucaagggcaucuucccccgggacgaguccgccgaggccugccccguggugccgcuguggaugcgcgacaagacgcucaucgaggagcagugggaggacuucugcagcaugcuggggacccacccccaccuccggcagcuggaccugggcuccagcauccugaccgagcgcgccaugaagacccucugcgcgaagcugcgccacccgaccugcaagauccagacgcugauguuccggaacgcccagaucacccccgggguccagcaccucuggcgcaucgugauggccaaccggaaccugcgcucccugaaccucggcgggacccaccugaaggaggaggacgugcggauggccugcgaggcccugaagcaccccaagugccuccuggagagccugcgccucgacugcugcggccugacccacgcgugcuaccugaagaucucccagauccucacgaccagccccagccugaagucccugagccucgccggcaacaaggucaccgaccagggggugaugccccuguccgacgcccugcgggugagccagugcgcccuccagaagcugauccuggaggacugcggcaucaccgccacggggugccagucccucgcgagcgcccuggucuccaaccgcagccugacccaccucugccuguccaacaacagccugggcaacgagggggugaaccuccugugccgguccaugcgccugccccacugcagccuccagcggcugaugcugaaccagugccaccucgacaccgccggcugcggcuuccuggcccuggcccucauggggaacuccuggcugacccaccugagccucuccaugaacccgguggaggacaacggcgucaagcugcugugcgaggugaugcgcgagcccagcugccaccuccaggaccuggagcuggugaagugccaccucacggcggccugcugcgagucccugagcugcgucaucucccggagccgccaccugaagucccuggaccucaccgacaacgcccugggggacggcgggguggccgcgcugugcgagggccucaagcagaagaacuccgugcuggcccggcugggccucaaggccugcgggcugaccagcgacugcugcgaggcccugucccucgcccugagcugcaaccgccaccugaccucccucaaccugguccagaacaacuucagccccaagggcaugaugaagcugugcuccgcguucgccugccccacgagcaaccuccagaucaucgggcuguggaaguggcaguacccggugcagauccggaagcugcucgaggaggugcagcugcugaagccccgcgucgugaucgacggcuccuggcacagcuucgacgaggacgaccgguacugguggaagaacuga

SEQ ID NO: 33647 - RNA, 2676 nt, Artificial Sequence
  derived and/or modified sequence opt1 from NLRP6__Homo_sapiens__NP_001263629
auggaccagcccgaggcccccugcagcuccaccggcccccgccuggccguggcgcgggagcuccugcuggccgcccucgaggagcugagccaggagcagcugaagcgcuuccggcacaagcuccgcgacgucgggcccgacggccgguccauccccugggggcgccuggagcgggccgacgccguggaccuggcggagcagcucgcccaguucuacggcccggagcccgcccuggagguggcccgcaagacccugaagcgggcggacgcccgcgacgucgccgcccagcuccaggagcggcgccugcagcggcuggggcucggcagcggcacgcugcuguccgugagcgaguacaagaagaaguaccgcgagcacgugcuccagcugcacgcccgggucaaggagcgcaacgcgcgguccgugaagaucaccaagcgcuucaccaagcugcucaucgcccccgagagcgccgcccccgaggaggccauggggccggcggaggagcccgagcccggccgggcccgccgguccgacacccacacguucaaccgccuguuccgccgggacgaggaggggcgccggccccugaccgugguccuccagggcccggccgggaucggcaagaccauggccgccaagaagauccuguacgacugggcggccggcaagcuguaccagggccagguggacuucgccuucuucaugcccugcggggagcuccuggagcgccccgggacccggagccuggccgaccucauccuggaccagugccccgaccgcggcgccccggugccccagaugcuggcgcagccccagcggcuccuguucauccuggacggcgccgacgagcuccccgcccucgggggcccggaggccgcgcccugcacggaccccuucgaggccgccuccggggcccgcguccugggcgggcuccugagcaaggcccugcuccccaccgcgcugcugcucgugaccacccgggccgccgccccgggccgccugcagggccggcugugcagcccccagugcgccgaggugcgcggguucuccgacaaggacaagaagaaguacuucuacaaguacuuccgggacgagcgccgggcggagcgcgccuaccgguucgucaaggagaacgagacgcuguucgcccugugcuucgugcccuucgugugcuggaucgucugcaccgugcugcgccagcagcuggagcucggccgggaccugucccgcaccagcaagaccacgaccuccguguaccuccuguucaucaccagcguccuguccagcgcccccguggccgacgggccgcgccugcagggcgaccuccggaaccugugccgccuggcgcgggagggggugcucggccgccgggcccaguucgccgagaaggagcuggagcagcuggagcuccgcggcagcaagguccagacccuguuccuguccaagaaggagcuccccggggugcuggagacggaggucaccuaccaguucaucgaccagagcuuccaggaguuccuggccgcgcucuccuaccugcuggaggacggcggggugccccggaccgccgccggcggggugggcacccuccugcgcggcgacgcccagccgcacagccaccugguccucacgacccgguuccuguucgggcugcucuccgccgagcgcaugcgggacaucgagcgccacuucggcugcauggugagcgagcgggugaagcaggaggcgcugcgcuggguccaggggcagggccagggcugccccgggguggcccccgaggugaccgagggcgccaaggggcuggaggacaccgaggagcccgaggaggaggaggagggcgaggagccgaacuacccccucgagcugcuguacugccucuacgagacgcaggaggacgccuucguccggcaggcccugugccgcuuccccgagcuggcgcuccagcgggugcgcuucugccggauggacguggccguccuguccuacugcgugcgcugcugccccgccgggcaggcccugcggcucaucagcugccgccugguggccgcgcaggagaagaagaagaagucccugggcaagcgccuccaggccagccugggcgggggcuccagccaggggaccaccaagcagcugccggccucccuccugcacccccuguuccaggccaugaccgacccccucugccaccugagcucccugacgcucagccacugcaagcugcccgacgcggucugccgggaccuguccgaggcccuccgcgccgccccggcccugaccgagcugggccuccugcacaaccggcugagcgaggcggggcuccgcaugcuguccgagggccuggccuggccccagugccgggugcagaccgugcgcguccagcuccccgacccccagcggggccugcaguaccugguggggaugcuccgccagagcccggcccugaccacgcuggaccucagcggcugccagcugcccgcccccauggugaccuaccugugcgccguccuccagcaccaggggugcggccugcagacccugucccucgcgagcguggagcuguccgagcagagccugcaggagcuccaggccgugaagcgggccaagcccgaccuggucaucacccacccggcccuggacgggcacccccagccgcccaaggagcucaucuccaccuucuga

SEQ ID NO: 33648 - RNA, 3030 nt, Artificial Sequence
  derived and/or modified sequence opt1 from NLRP7__Homo_sapiens__NP_631915
augaccagcccccagcuggaguggacccuccagacgcugcuggagcagcucaacgaggacgagcugaaguccuucaagagccugcucugggccuucccccuggaggacgugcugcagaagacccccugguccgaggucgaggaggccgacggcaagaagcucgcggagauccuggugaacaccagcuccgagaacuggauccgcaacgccaccgugaacauccuggaggagaugaaccucacggagcugugcaagauggccaaggccgagaugauggaggacgggcagguccaggagaucgacaaccccgagcugggcgacgccgaggaggacagcgagcucgcgaagcccggggagaaggagggcuggcggaacuccauggagaagcagagccugguguggaagaacaccuucuggcagggggacaucgacaacuuccacgacgacgugacccugcgcaaccagcgguucaucccguuccucaacccccgcacgccccggaagcugacccccuacaccgucgugcugcacggcccggccggcguggggaagaccacccucgccaagaagugcaugcuggacuggacggacugcaaccugucccccacccuccgcuacgccuucuaccugagcugcaaggagcugucccggaugggccccugcagcuucgcggagcucaucuccaaggacuggcccgagcugcaggacgacaucccgagcauccuggcccaggcccagcgcauccucuucgucguggacgggcuggacgagcugaaggugccgcccggcgcccucauccaggacaucugcggggacugggagaagaagaagcccguccccgugcugcugggcucccuccugaagcggaagaugcugccccgcgccgcgcuccuggugaccacccggccccgcgcccugcgggaccuccagcugcuggcccagcagcccaucuacguccgcguggagggcuuccucgaggaggaccggcgcgccuacuuccugcggcacuucggggacgaggaccaggccaugcgcgcguucgagcugaugcggagcaacgccgcccucuuccagcugggcuccgccccggccgugugcuggaucgucugcacgacccugaagcugcagauggagaagggggaggaccccgugccgaccugccucacccgcacgggccuguuccugcgguuccucugcagccgcuucccccagggcgcgcagcugcgcggggcccugcggacccucucccugcuggccgcccagggccucugggcccagaugagcguguuccaccgcgaggaccuggagcggcuggggguccaggagagcgaccuccgccuguuccuggacggcgacauccuccggcaggaccgcguguccaaggggugcuacagcuucauccaccuguccuuccagcaguuccugaccgcgcuguucuacgcccuggagaaggaggagggcgaggaccgggacggccacgccugggacaucggggacgugcagaagcugcucagcggcgaggagcgccugaagaaccccgaccugauccaggucgggcacuuccucuucggccuggccaacgagaagcgggcgaaggagcuggaggccaccuucgggugccgcaugucccccgacaucaagcaggagcuccugcagugcaaggcccaccuccacgccaacaagccccucagcgugacggaccugaaggagguccugggcugccucuacgagucccaggaggaggagcuggccaaggugguggucgcgcccuucaaggagaucagcauccaccugaccaacaccuccgaggugaugcacugcagcuucucccucaagcacugccaggaccugcagaagcugagccuccagguggccaagggcgucuuccuggagaacuacauggacuucgagcuggacaucgaguucgaguccagcaacuccaaccucaaguuccuggaggugaagcagagcuuccuguccgacagcuccgugcggauccucugcgaccacgucacccgcagcacgugccaccuccagaagguggagaucaagaacgugaccccggacaccgccuaccgggacuucugccuggccuucaucgggaagaagacccucacgcaccugacccuggccggccacaucgagugggagcgcaccaugaugcucaugcugugcgaccugcuccggaaccacaagugcaaccugcaguaccugcgccucgggggccacugcgcgacccccgagcagugggccgaguucuucuacguccugaaggccaaccagagccugaagcaccuccggcuguccgccaacgugcugcucgacgagggggccaugcugcuguacaagacgaugacccgccccaagcacuuccuccagaugcugagccuggagaacugccggcucaccgaggcguccugcaaggaccuggccgccgugcuggucgugagcaagaagcucacccaccugugccuggccaagaacccgaucggcgacaccggcgugaaguuccucugcgaggggcuguccuaccccgacugcaagcugcagacgcucguccugcagcagugcagcaucaccaagcugggcugccgcuaccucuccgaggcgcugcaggaggccugcagccugaccaaccucgaccuguccaucaaccagaucgcccgcgggcuguggauccucugccaggcccuggagaaccccaacugcaaccugaagcaccuccggcuguggagcugcucccugaugcccuucuacugccagcaccucggcagcgcccugcuguccaaccagaagcuggagacccucgaccugggccagaaccaccuguggaaguccgggaucaucaagcuguucggcgugcugcgccagcggacggggagccugaagauccuccgccugaagaccuacgagaccaaccuggagaucaagaagcuccuggaggaggugaaggagaagaacccgaagcugaccaucgacugcaacgcgagcggcgccacggccccgcccugcugcgacuucuucugcuga

SEQ ID NO: 33649 - RNA, 3147 nt, Artificial Sequence
  derived and/or modified sequence opt1 from NLRP8__Homo_sapiens__NP_789781
augagcgacgugaacccgcccuccgacacccccauccccuucagcuccagcuccacccacagcucccacaucccgcccuggacguucagcugcuaccccggcucccccugcgagaacggggucaugcuguacaugcgcaacgugagccacgaggagcuccagcgguucaagcagcugcugcucaccgagcuguccaccggcaccaugcccaucacgugggaccagguggagaccgccagcugggccgaggucgugcaccuccucaucgagcgcuuccccgggcggcgcgcgugggacgugaccuccaacaucuucgccaucaugaacugcgacaagaugugcgucguggugcggcgcgagaucaacgccauccugcccacccuggagcccgaggaccucaacgucggcgagacccaggugaaccuggaggagggggagagcggcaagauccggcgcuacaaguccaacgugauggagaaguucuuccccaucugggacaucaccaccuggccgggcaaccagcgggacuucuucuaccaggggguccaccgccacgaggaguaccugcccugccuccugcugcccaagcggccccagggccgccagccgaagaccguggccauccagggggcccccggcaucgggaagacgauccucgcgaagaaggugauguucgagugggcccggaacaaguucuacgcccacaagcgcuggugcgccuucuacuuccacugccaggaggucaaccagaccaccgaccagagcuucuccgagcugaucgagcagaaguggcccggcagccaggaccugguguccaagaucaugagcaagcccgaccagcuccugcugcuccuggacggcuucgaggagcugaccagcacgcucaucgaccggcuggaggaccuguccgaggacuggcgccagaagcucccggggagcgugcugcuguccagccuccuguccaagaccaugcugcccgaggcgacccuccugaucaugauccgguucaccagcuggcagacgugcaagccccugcucaagugccccucccuggucacccugccgggcuucaacaccauggagaagaucaaguacuuccagauguacuucgggcacaccgaggagggcgaccaggugcucagcuucgccauggagaacacgauccuguucuccaugugccgcgugcccgucgugugcuggauggugugcagcggccugaagcagcagauggagcgggggaacaaccucacccaguccugccccaacgccaccagcgucuucgugcgcuacaucuccagccuguuccccacccgggccgagaacuucucccgcaagauccaccaggcccagcuggagggccucugccaccuggcggccgacagcauguggcaccgcaaguggguccuggggaaggaggaccucgaggaggccaagcuggaccagacgggcgugaccgccuuccuggggauguccauccugcggcgcaucgccggcgaggaggaccacuacguguucacccucgucaccuuccaggaguucuucgcggcccuguucuacgugcugugcuucccgcagcggcucaagaacuuccacgugcugagccacgucaacauccagcgccugaucgccagcccccggggcuccaagagcuaccucucccacauggggcuguuccuguucggcuuccucaacgaggccugcgccagcgcgguggagcaguccuuccagugcaaggugagcuucgggaacaagcgcaagcugcugaaggucaucccccuccugcacaagugcgacccgcccucccccggcagcggggugccccagcuguucuacugccuccacgagauccgggaggaggccuucgugucccaggcccugaacgacuaccacaaggucgugcugcgcaucggcaacaacaaggaggugcaggucagcgccuucugccucaagcggugccaguaccugcacgagguggagcugacggugacccucaacuucaugaacgucuggaagcuguccagcuccagccacccgggcuccgaggcccccgagagcaacgggcugcaccgcugguggcaggaccucugcuccguguucgcgaccaacgacaagcuggaggugcugaccaugacgaacagcguccucggcccgcccuuccugaaggcccuggccgccgcgcuccggcacccccagugcaagcugcagaagcugcuccugcgccgggugaacuccaccaugcugaaccaggaccucaucggggugcugaccggcaaccagcaccuccgcuaccuggagauccagcacgucgagguggagagcaaggccgugaagcugcugugccggguccuccgcagcccccggugccgccugcagugccugcggcucgaggacugccuggccacgccccgcaucuggaccgaccuggggaacaaccuccagggcaacggccaccugaagacgcugauccuccgcaagaacucccuggagaacugcggggccuacuaccugagcguggcccagcucgagcggcuguccaucgagaacugcaaccugacccagcugaccugcgagagccuggcguccugccugcgccagagcaagaugcucacccaccugucccuggccgagaacgcccucaaggacgagggcgccaagcacaucuggaacgcccugccccaccuccggugcccgcugcagcgccuggugcugcggaagugcgaccucacguucaacugcugccaggacaugaucagcgcgcugugcaagaacaagacccugaagucccucgaccugagcuucaacucccugaaggacgacggggucauccuccugugcgaggcccugaagaaccccgacugcacccuccagauccuggagcuggagaacugccucuucaccagcaucugcugccaggccauggccuccaugcugcgcaagaaccagcaccuccggcaccuggaccugagcaagaacgccaucggcguguacggcauccugacgcucugcgaggcguucuccagccagaagaagcgcgaggaggugaucuucugcauccccgccuggacccggaucaccuccuucagccccaccccgcacccgcccgacuucacggggaaguccgacugccugagccagaucaaccccuga

SEQ ID NO: 33650 - RNA, 2976 nt, Artificial Sequence
  derived and/or modified sequence opt1 from NLRP9__Homo_sapiens__XP_011525195
auggccgagagcuucuucuccgacuucggccugcucugguaccugaaggagcugcggaaggaggaguucuggaaguucaaggagcuccugaagcagccccuggagaaguucgagcucaagccgauccccugggccgagcugaagaaggcgagcaaggaggacguggccaagcugcucgacaagcacuaccccgggaagcaggccugggaggucacccugaaccuguuccuccagaucaaccggaaggaccuguggaccaaggcccaggaggagaugcgcaacaagcugaaccccuaccggaagcacaugaaggagacguuccagcucaucugggagaaggagaccugccugcacgugccggagcacuucuacaaggagaccaugaagaacgaguacaaggagcugaacgacgccuacaccgcggccgcccgccggcacacggugguccucgagggccccgacgggaucggcaagaccacccugcugcgcaaggugaugcucgacugggccgaggggaaccuguggaaggaccgguucaccuucguguucuuccugaacgucugcgagaugaacggcaucgcggagacgucccuccuggagcugcucagccgcgacuggcccgaguccagcgagaagaucgaggacaucuucucccagcccgagcggauccuguucaucauggacggcuucgagcagcugaaguucaaccuccagcugaaggccgaccugagcgacgacuggcgccagcggcagccgaugcccaucauccucuccagccugcugcagaagaagaugcuccccgaguccagccugcugaucgcccucgggaagcuggccaugcagaagcacuacuucaugcugcgccaccccaagcucaucaagcugcugggcuucuccgagagcgagaagaaguccuacuucagcuacuucuucggggagaaguccaaggcccucaagguguucaacuucgugcgggacaacggcccgcuguucauccugugccacaaccccuucacgugcuggcucgucugcacgugcgugaagcagcgccuggagcgcggggaggaccuggagaucaacagccagaacaccaccuaccuguacgcguccuuccucaccaccguguucaaggccggcagccagagcuucccgcccaaggucaaccgggcccggcugaagucccugugcgcccucgccgcggagggcaucuggaccuacaccuucguguucagccacggggaccugcgccggaacggccuguccgagagcgagggggugaugugggucggcaugcgccuccugcagcggcgcggcgacugcuucgccuucaugcaccugugcauccaggaguucugcgccgccauguucuaccuccugaagcgccccaaggacgaccccaaccccgccaucggguccaucacccagcuggugcgggcgagcgugguccagccccagacccuccugacccaggugggcaucuucauguucgggaucuccacggaggagaucgugagcaugcuggagaccuccuucggcuucccgcucagcaaggaccugaagcaggagaucacccagugccuggagucccucagccagugcgaggccgaccgcgaggccaucgccuuccaggagcuguucaucgggcuguucgagacccaggagaaggaguucgucacgaaggugaugaacuucuucgaggagguguucaucuacaucggcaacaucgagcaccucgucaucgccuccuucugccugaagcacugccagcaccugaccacccuccggaugugcguggagaacaucuuccccgacgacagcggcugcaucuccgacuacaacgagaagcuggucuacuggcgcgagcugugcagcauguucaucaccaacaagaacuuccagauccucgacauggagaacacgucccuggacgaccccagccuggcgauccucugcaaggcccuggcccagcccgugugcaagcugcggaagcucaucuucaccuccguguacuucgggcacgacagcgagcuguucaaggccguccugcacaacccgcaccucaagcugcugagccucuacggcaccucccugagccaguccgacauccgccaccugugcgagacccucaagcaccccaugugcaagaucgaggagcugauccuggggaagugcgacaucagcuccgaggugugcgaggacaucgcgagcgugcucgccugcaacuccaagcugaagcaccugagccucgucgagaacccccugcgggacgagggcaugacgcugcucugcgaggcccugaagcacucccacugcgcccuggagcgccucaugcugauguacugcugccugaccagcguguccugcgacagcaucuccgaggugcuccugugcagcaagucccugagccuccuggaccugggguccaacgcccucgaggacaacggcgucgcgagccugugcgccgcccugaagcaccccggcugcagcauccgggagcucuggcugauggggugcuuccugaccuccgacagcugcaaggacaucgccgccgugcucaucugcaacggcaagcugaagacccugaagcucgggcacaacgagaucggcgacacgggggugcgccagcugugcgcggcccugcagcacccgcacugcaagcucgagugccugggccugcagaccugccccaucacccgggccugcugcgacgacaucgccgccgcgcucaucgccugcaagacccugcgcucccugaaccucgacuggaucgcccuggacgccgacgcggucguggugcugugcgaggcccucagccaccccgacugcgcccugcagaugcugggccuccacaaguccggguucgacgaggagacccagaagauccugaugagcgucgaggagaagaucccgcaccugacgaucucccacggccccuggaucgacgaggaguacaagauccgcggggugcuccuguga

SEQ ID NO: 33651 - RNA, 366 nt, Artificial Sequence
  derived and/or modified sequence opt1 from NMB__Homo_sapiens__NP_066563
auggcccgccgggccggcggggcgcgcauguucggcagccugcuccuguucgcccugcucgccgccgggguggcgccccuguccugggaccugcccgagccccggagccgcgccuccaagauccggguccacagccgcggcaaccucugggccaccgggcacuucaugggcaagaagucccuggagcccagcucccccagcccgcugggcaccgccccgcacacgucccuccgggaccagcgccugcagcugagccacgaccuccuggggauccugcuccugaagaaggcccugggcgugucccucagccggcccgcgccccagauccaguaccgccggcugcuggugcagauccuccagaaguga

SEQ ID NO: 33652 - RNA, 1173 nt, Artificial Sequence
  derived and/or modified sequence opt1 from NMBR__Homo_sapiens__NP_002502
augcccagcaagucccugagcaaccucuccgugaccaccggcgccaacgagagcggguccgucccggagggcugggagcgcgacuuccugcccgccagcgacgggacgaccaccgagcuggugauccggugcgugauccccucccucuaccugcugaucaucaccgucggccuccuggggaacaucaugcuggugaagaucuucaucacgaacagcgcgaugcgcuccgugcccaacaucuucaucagcaaccucgccgccggcgaccugcugcuccugcugaccugcgucccgguggacgccucccgguacuucuucgacgaguggauguucggcaagguggggugcaagcucauccccgucauccagcugaccagcgugggcguguccgucuucacccugacggcccucagcgcggaccgcuaccgggccaucgugaaccccauggacaugcagaccuccggggcccugcugcggaccugcgugaaggccaugggcaucugggucgugagcgugcuccuggcgguccccgaggccguguucuccgagguggcccgcaucagcucccuggacaacagcagcuucaccgccugcaucccguacccccagacggacgagcuccaccccaagauccacuccguccugaucuuccugguguacuuccucaucccccuggccaucaucagcaucuacuacuaccacaucgcgaagacccugaucaaguccgcccacaaccucccgggggaguacaacgagcacaccaagaagcagauggagacccgcaagcggcuggccaagaucgugcuggucuucgugggcugcuucaucuucugcugguuccccaaccacauccucuacauguaccgcagcuucaacuacaacgagaucgaccccucccugggccacaugaucgucacgcugguggcccgggugcucagcuucgggaacuccugcgucaaccccuucgcccuguaccugcucagcgaguccuuccgccggcacuucaacagccagcugugcugcggccgcaaguccuaccaggagcgggggaccagcuaccugcucuccagcuccgcggugcgcaugaccagccugaaguccaacgccaagaacauggugaccaacagcguccugcucaacggccacuccaugaagcaggagauggcccuguga

SEQ ID NO: 33653 - RNA, 459 nt, Artificial Sequence
  derived and/or modified sequence opt1 from NME1__Homo_sapiens__NP_000260
auggccaacugcgagcgcaccuucaucgccaucaagcccgacggcgugcagcgggggcuggucggcgagaucaucaagcgcuucgagcagaagggguuccggcucgugggccugaaguucaugcaggcgagcgaggaccugcucaaggagcacuacguggaccugaaggaccgcccguucuucgccgggcuggucaaguacaugcacuccggccccgugguggccauggucugggagggccucaacguggugaagaccgggcgggucaugcugggcgagacgaaccccgccgacagcaagcccgggaccauccgcggcgacuucugcauccagguggggcggaacaucauccacggcuccgacagcguggaguccgccgagaaggagaucggccugugguuccacccggaggagcucgucgacuacaccagcugcgcgcagaacuggaucuacgaguga

SEQ ID NO: 33654 - RNA, 804 nt, Artificial Sequence
  derived and/or modified sequence opt1 from NME1-NME2__Homo_sapiens__NP_001018146
auggccaacugcgagcgcaccuucaucgccaucaagcccgacggcgugcagcgggggcuggucggcgagaucaucaagcgcuucgagcagaagggguuccggcucgugggccugaaguucaugcaggcgagcgaggaccugcucaaggagcacuacguggaccugaaggaccgcccguucuucgccgggcuggucaaguacaugcacuccggccccgugguggccauggucugggagggccucaacguggugaagaccgggcgggucaugcugggcgagacgaaccccgccgacagcaagcccgggaccauccgcggcgacuucugcauccagguggggcggaccauggccaaccuggagcgcaccuucaucgcgaucaagccggacggcgugcagcggggccucgucggggagaucaucaagcgcuucgagcagaagggcuuccggcugguggccaugaaguuccugcgcgccuccgaggagcaccucaagcagcacuacaucgaccugaaggaccggcccuucuuccccgggcuggugaaguacaugaacagcggccccgucguggccauggugugggagggccucaacgucgugaagacggggcgcgugaugcugggcgagaccaacccggcggacuccaagcccgggaccauccggggcgacuucugcauccaggucgggcgcaacaucauccacggcagcgacuccgucaagagcgccgagaaggagaucucccugugguucaagcccgaggagcucguggacuacaagagcugcgcccacgacuggguguacgaguga

SEQ ID NO: 33655 - RNA, 459 nt, Artificial Sequence
  derived and/or modified sequence opt1 from NME2__Homo_sapiens__NP_001018148
auggccaaccuggagcgcaccuucaucgccaucaagcccgacggcgugcagcgggggcucgucggcgagaucaucaagcgcuucgagcagaagggguuccggcugguggcgaugaaguuccugcgcgccagcgaggagcaccucaagcagcacuacaucgaccugaaggaccggccguucuuccccggccuggugaaguacaugaacuccgggcccgucguggccauggugugggagggccucaacgucgugaagaccggccgcgugaugcugggggagacgaaccccgccgacagcaagccgggcaccauccgcggggacuucugcauccaggucggccggaacaucauccacggguccgacagcgugaaguccgccgagaaggagaucagccugugguucaagcccgaggagcucguggacuacaaguccugcgcgcacgacugggucuacgaguga

SEQ ID NO: 33656 - RNA, 510 nt, Artificial Sequence
  derived and/or modified sequence opt1 from NME3__Homo_sapiens__NP_002504
augaucugccuggugcucaccaucuucgccaaccuguuccccgccgcgugcaccggcgcccacgagcgcacguuccuggccgucaagccggacggggugcagcggcgccucgugggcgagaucguccggcgcuucgagcggaagggguucaagcugguggcccugaagcucgugcaggccagcgaggagcugcugcgcgagcacuacgcggagcuccgggagcgccccuucuacggccggcuggucaaguacauggccuccgggcccgugguggccauggucuggcagggccuggacguggugcgcaccagccgggcccucaucggcgcgaccaaccccgccgacgccccgcccgggaccauccgcggcgacuucugcaucgaggucgggaagaaccugauccacggcuccgacagcguggaguccgcccggcgcgagaucgcccugugguuccgggcggacgagcuccugugcugggaggacagcgccgggcacuggcuguacgaguga

SEQ ID NO: 33657 - RNA, 522 nt, Artificial Sequence
  derived and/or modified sequence opt1 from NME4__Homo_sapiens__NP_001273364
augggcgggcuguucuggcgcagcgcccuccggggccugcgcugcgggccccgggccccgggccccucccugcucgugcgccacgggagcggcggccccuccuggacccgggagcgcacccuggucgccgugaagcccgacggggugcagcggcgccuggucggcgacgugauccagcgguucgagcgccggggguucacgcucgugggcaugaagaugcugcaggccccggagagcguccuggccgagcacuaccaggaccuccgccggaagcccuucuaccccgcccugauccgcuacauguccagcgggcccgugguggccauggucugggagggcuacaacguggugcgggcgucccgcgccaugaucggccacaccgacagcgccgaggccgcgccggggaccauccggggcgacuucuccguccacaucagcucccaccgccuggcgccccucgaccgggggcagcgcgagcagcagauggugcccggcaucccccagggcgcccacgaggccuga

SEQ ID NO: 33658 - RNA, 639 nt, Artificial Sequence
  derived and/or modified sequence opt1 from NME5__Homo_sapiens__NP_003542
auggagaucagcaugcccccgccccagaucuacguggagaagacccuggccaucaucaagcccgacaucgucgacaaggaggaggagauccaggacaucauccuccgcuccggcuucaccaucgugcagcggcgcaagcugcggcugagccccgagcagugcuccaacuucuacguggagaaguacgggaagauguucuucccgaaccucacggccuacaugagcuccggcccccuggucgcgaugauccuggcccgccacaaggccaucagcuacuggcucgagcugcuggggcccaacaacucccucguggccaaggagacccaccccgacagccugcgggccaucuacggcaccgacgaccugcgcaacgcgcuccacggguccaacgacuucgccgccgccgagcgggagauccgcuucauguucccggaggugaucgucgagcccauccccaucggccaggcggccaaggacuaccugaaccugcacaucaugcccacccuccuggagggccugacggagcucugcaagcagaagccggccgacccccugaucuggcuggccgacuggcuccugaagaacaaccccaacaagcccaagcugugccaccacccgaucguggaggagcccuacuga

SEQ ID NO: 33659 - RNA, 585 nt, Artificial Sequence
  derived and/or modified sequence opt1 from NME6__Homo_sapiens__NP_005784
augacccagaaccugggcagcgagauggccuccauccuccgcagcccccaggcccugcagcugacccucgcgcugaucaagccggacgccguggcccacccccugauccucgaggccguccaccagcagauccuguccaacaaguuccugaucgugcggaugcgcgagcuccuguggcggaaggaggacugccagcgcuucuaccgggagcacgaggggcgcuucuucuaccagcggcugguggaguucauggccagcggccccauccgcgcguacauccucgcccacaaggacgccauccagcuguggcggacgcugauggggcccacccgcgucuuccgggcccgccacguggcgccggacuccauccggggcagcuucgggcucaccgacacccgcaacacgacccacggcuccgacagcguggucuccgccagccgggagaucgccgccuucuuccccgacuucuccgagcagcgcugguacgaggaggaggagccccagcugcggugcggccccgugugcuacagcccggagggcggggugcacuacgucgccgggaccggcgggcugggccccgcguga

SEQ ID NO: 33660 - RNA, 1131 nt, Artificial Sequence
  derived and/or modified sequence opt1 from NME7__Homo_sapiens__NP_037462
augaaccacagcgagcgcuucguguucaucgccgagugguacgaccccaacgccucccugcuccggcgcuacgagcugcuguucuacccgggcgacgggagcgucgagaugcacgacgugaagaaccaccggaccuuccucaagcgcaccaaguacgacaaccugcaccuggaggaccucuucaucggcaacaaggugaacgucuucucccggcagcuggugcugaucgacuacggggaccaguacacggcgcgccagcucggcagccggaaggagaagacccuggcccugaucaagcccgacgccaucuccaaggccggggagaucaucgagaucaucaacaaggccggcuucaccaucaccaagcucaagaugaugaugcugagccgcaaggaggcgcuggacuuccacguggaccaccagucccggcccuucuucaacgagcucauccaguucaucacgaccggccccaucaucgccauggagauccugcgcgacgacgccaucugcgaguggaagcggcugcucgggccggccaacagcggcgucgcgcgcaccgacgccuccgagagcauccgggcccuguucgggaccgacggcauccgcaacgccgcccacgggcccgacuccuucgcgagcgccgcccgggagauggagcuguucuuccccuccagcggcggcugcgggcccgccaacacggccaaguucaccaacugcacgugcugcaucgugaagccgcacgcgguguccgagggccuccuggggaagauccugauggccauccgcgacgccggcuucgagaucagcgccaugcagauguucaacauggaccgggucaacguggaggaguucuacgagguguacaagggcgucgugaccgaguaccacgacauggugaccgagauguacuccgggcccugcgucgccauggagauccagcagaacaacgcgaccaagaccuuccgcgaguucugcggccccgccgaccccgagaucgcccggcaccuccgcccggggacccugcgggccaucuucggcaagacgaagauccagaacgccgugcacugcaccgaccugcccgaggacgggcuccuggaggugcaguacuucuucaagauccuggacaacuga

SEQ ID NO: 33661 - RNA, 1767 nt, Artificial Sequence
  derived and/or modified sequence opt1 from NME8__Homo_sapiens__NP_057700
auggccagcaagaagcgcgaggugcagcugcagaccgucaucaacaaccagucccucugggacgagaugcugcagaacaagggccugaccgugaucgacguguaccaggccuggugcgggcccugccgggcgaugcagccccucuuccgcaagcugaagaacgagcugaacgaggacgagauccuccacuucgccgucgccgaggccgacaacaucgugacgcugcagcccuuccgggacaagugcgagcccguguuccuguucagcgucaacggcaagaucaucgagaagauccagggggccaacgcgccccucgugaacaagaaggugaucaaccugaucgacgaggagcgcaagaucgccgccggcgagauggcccggccgcaguaccccgagaucccccuggucgacuccgacagcgagguguccgaggagagccccugcgaguccgugcaggagcucuacagcaucgcgaucaucaagccggacgccgucaucuccaagaaggugcuggagaucaagcgcaagaucaccaaggccggguucaucaucgaggccgagcacaagaccgugcugaccgaggagcaggucgugaacuucuacagccggaucgccgaccagugcgacuucgaggaguucguguccuucaugacgagcggccucuccuacauccuggucgugagccagggcuccaagcacaacccgcccagcgaggagaccgagccccagaccgacaccgagccgaacgagcgcuccgaggaccagcccgagguggaggcgcaggucacgcccgggaugaugaagaacaagcaggacagccugcaggaguaccucgagcggcagcaccuggcccagcugugcgacaucgaggaggacgccgccaacguggccaaguucauggacgcguucuuccccgacuucaagaagaugaaguccaugaagcucgagaagacccuggcccugcuccgcccgaaccuguuccacgagcggaaggacgacgugcugcgcaucaucaaggacgaggacuucaagauccucgagcagcggcaggucgugcugagcgagaaggaggcccaggcccugugcaaggaguacgagaacgaggacuacuucaacaagcucaucgagaacaugaccagcggccccucccuggcccugguccuccugcgcgacaacgggcugcaguacuggaagcagcuccugggcccccggaccguggaggaggcgaucgaguacuuccccgagagccugugcgcccaguucgccauggacucccucccggugaaccagcuguacgggagcgacucccuggagacggccgagcgcgagauccagcacuucuucccccuccagagcacccugggccugaucaagccccacgccaccuccgagcagcgggagcagauccucaagaucgucaaggaggcgggcuucgaccugacccaggugaagaagauguuccugacgcccgagcagaucgagaagaucuacccgaaggugaccgggaaggacuucuacaaggaccuccuggagaugcugagcgucggccccuccauggugaugauccugaccaaguggaacgccguggccgaguggcgccggcucauggggcccaccgaccccgaggaggccaagcugcugagcccggacuccauccgcgcgcaguucggcaucagcaagcucaagaacaucguccacggcgccuccaacgccuacgaggccaaggagguggugaaccggcuguucgaggaccccgaggagaacuga

SEQ ID NO: 33662 - RNA, 792 nt, Artificial Sequence
  derived and/or modified sequence opt1 from NME9__Homo_sapiens__NP_835231
augcugagcuccaagggccucaccguggucgacguguaccagggguggugcggccccugcaagccgguggucagccuguuccagaagaugcgcaucgagguggggcuggaccuccugcacuucgcccuggccgaggccgaccggcucgacgugcuggagaaguaccgcggcaagugcgagcccaccuuccuguucuacgccaucaaggacgaggcccucuccgacgaggacgagugcgucagccacgggaagaacaacggcgaggacgaggacaugguguccagcgagcggacgugcacccuggccaucaucaagcccgacgccguggcgcacggcaagaccgacgagaucaucaugaagauccaggaggccggguucgagauccugaccaacgaggagcgcacgaugaccgaggccgagguccggcuguucuaccagcacaaggccggcgaggaggcguucgagaagcuggugcaccacaugugcuccgggcccagccaccuccucauccugacccgcaccgagggcuucgaggacguggucacgaccuggcggaccgugauggggccgcgcgaccccaacguggcccggcgcgagcagcccgagucccugcgggcccaguacggcaccgagaugcccuucaacgccguccacggcagccgcgaccgggaggacgccgaccgcgagcucgcgcugcuguucccgucccucaaguucagcgacaaggacacggaggcgccccagggggaguccagcacccagccccggcugaagaucaccgaccuggacuga

SEQ ID NO: 33663 - RNA, 924 nt, Artificial Sequence
  derived and/or modified sequence opt1 from NMI__Homo_sapiens__NP_004679
auggaggccgacaaggacgacacccagcagauccugaaggagcacagccccgacgaguucaucaaggacgagcagaacaagggccucaucgacgagaucaccaagaagaacauccagcugaagaaggagauccagaagcuggagacggagcuccaggaggccaccaaggaguuccagaucaaggaggacaucccggagaccaagaugaaguuccuguccguggagacccccgagaacgacagccagcuguccaacaucagcugcuccuuccaggucagcuccaaggugcccuacgagauccagaaggggcaggcgcucaucacguucgagaaggaggagguggcccagaacgucgugagcauguccaagcaccacgugcagaucaaggacgucaaccuggaggugaccgccaagcccgugccgcugaacagcggcguccgcuuccagguguacguggaggucuccaagaugaagaucaacgugaccgagauccccgacacccuccgggaggaccagaugcgcgacaagcuggagcugagcuucuccaagagccggaacgggggcggggagguggaccgcgucgacuacgaccggcaguccggcagcgccgugaucacguucguggagaucggcgucgccgacaagauccucaagaagaaggaguacccccuguacaucaaccagaccugccaccgcgugaccgugucccccuacaccgagauccaccugaagaaguaccagaucuucagcgggacguccaagcggaccguccuccugaccggcauggaggggauccagauggacgaggagaucguggaggaccugaucaacauccacuuccagcgcgcgaagaacggcgggggcgagguggacgucgugaagugcagccucggccagccgcacaucgccuacuucgaggaguga

SEQ ID NO: 33664 - RNA, 840 nt, Artificial Sequence
  derived and/or modified sequence opt1 from NMNAT1__Homo_sapiens__NP_001284707
auggagaacagcgagaagaccgaggugguccugcucgccugcggcuccuucaaccccaucaccaacaugcaccuccgccuguucgagcuggccaaggacuacaugaacgggacgggccgguacaccguggugaaggggaucaucagcccggucggcgacgcguacaagaagaaggggcugauccccgccuaccaccgcgugaucauggccgagcuggccaccaagaacuccaaguggguggaggucgacaccugggagagccuccagaaggaguggaaggagacgcugaaggugcugcggcaccaccaggagaagcucgaggccuccgacugcgaccaccagcagaacagccccacccuggagcgccccggccggaagcgcaaguggaccgagacccaggacuccagccagaagaagucccuggagccgaagacgaaggcggugcccaaggucaagcuccugugcggcgccgaccugcucgagagcuucgccgugcccaaccuguggaaguccgaggacaucacccagaucguggccaacuacgggcugaucugcgucacccgggcgggcaacgacgcccagaaguucaucuacgagagcgacgugcucuggaagcaccgcuccaacauccacguggucaacgaguggaucgccaacgacaucagcuccaccaagauccggcgcgcccugcggcgcgggcagagcauccgguaccuggugcccgaccucgugcaggaguacaucgagaagcacaaccuguacuccagcgaguccgaggaccgcaacgccggcgucauccuggcgccgcuccagcggaacacggccgaggccaagaccuga

SEQ ID NO: 33665 - RNA, 924 nt, Artificial Sequence
  derived and/or modified sequence opt1 from NMNAT2__Homo_sapiens__NP_055854
augaccgagaccacgaagacccacgugauccugcuggccugcggcagcuucaaccccaucaccaaggggcacauccagauguucgagcgcgcccgggacuaccugcacaagaccggccgcuucaucgucaucgggggcaucguguccccggugcacgacagcuacgggaagcagggccuggucuccagccggcaccgccucaucaugugccagcuggcggugcagaacuccgacuggauccggguggaccccugggagugcuaccaggacacguggcagacgaccugcagcguccuggagcaccaccgcgaccucaugaagcgggugaccggcugcauccuguccaacgugaacacccccagcaugacccccgucaucgggcagccgcagaacgagacgccccagcccaucuaccagaacuccaacguggccaccaagcccaccgccgccaagauccugggcaaggugggggagagccucucccgcaucugcugcguccggccgcccguggagcgcuucaccuucguggacgagaacgccaaccugggcaccgucaugcgguacgaggagaucgagcugcgcauccuccugcugugcgggagcgaccuccuggaguccuucugcauccccggccuguggaacgaggcggacauggaggugaucgugggcgacuucgggaucgucguggugccccgggacgccgccgacaccgaccgcaucaugaaccacagcuccauccuccggaaguacaagaacaacaucauggucgugaaggacgacaucaaccacccgaugagcguggucuccagcacgaagucccgccuggcccugcagcacggcgacgggcacguggucgacuaccucagccagcccgugaucgacuacauccucaagagccagcuguacaucaacgcguccggcuga

SEQ ID NO: 33666 - RNA, 492 nt, Artificial Sequence
  derived and/or modified sequence opt1 from NMNAT3__Homo_sapiens__NP_001186976
augaagucccgcauccccgugguccugcucgccugcggcagcuucaacccgaucaccaacaugcaccuccggauguucgagguggcccgcgaccaccuccaccagaccgcggugcccgagcugaagcugcugugcggggccgacguccugaagacguuccagacccccaaccuguggaaggacgcccacauccaggagaucguggagaaguucggccuggugugcgucgggcgggugggccacgaccccaagggguacaucgccgagagcccgauccuccgcaugcaccagcacaacauccaccuggccaaggagcccgugcagaacgagaucuccgcgaccuacauccggcgcgcccugggccagggccagagcgucaaguaccucauccccgacgccgugaucaccuacaucaaggaccacgggcuguacacgaagggcuccaccuggaagggcaagagcacccaguccaccgaggggaagacgagcuga

SEQ ID NO: 33667 - RNA, 462 nt, Artificial Sequence
  derived and/or modified sequence opt1 from NMS__Homo_sapiens__NP_001011717
augaagcaccuccgcccccaguucccgcugauccuggccaucuacugcuucugcaugcugcagauccccagcuccggcuucccccagccccucgccgacccgagcgacgggcuggacaucgugcagcuggagcagcucgcguacugccugucccagugggcgccccugagccggcagcccaaggacaaccaggacaucuacaagcgcuuccucuuccacuacucccggacccaggaggccacccaccccgucaagacgggcuucccgcccgugcacccccugaugcaccuggccgccaagcucgccaaccgccggaugaagcgcauccugcagcgggggagcggcaccgccgccguggacuucaccaagaaggaccacaccgccacgugggggcgccccuucuuccuguuccggccgcgcaacggccggaacaucgaggacgaggcgcagauccagugguga

SEQ ID NO: 33668 - RNA, 1491 nt, Artificial Sequence
  derived and/or modified sequence opt1 from NMT1__Homo_sapiens__NP_066565
auggccgacgagagcgagaccgccgugaagcccccggcgccgccccugccccagaugauggagggcaacgggaacggccacgagcacugcuccgacugcgagaacgaggaggacaacagcuacaaccgcgggggccucucccccgccaacgacaccggggccaagaagaagaagaagaagcagaagaagaagaaggagaagggcagcgagacggacuccgcccaggaccagcccgucaagaugaacagccugcccgccgagcggauccaggagauccagaaggcgaucgagcuguucuccgugggccaggggcccgccaagaccauggaggaggccagcaagcgcuccuaccaguucugggacacccagccggugcccaagcucggcgaggucgugaacacccacgggcccguggagcccgacaaggacaacauccggcaggagccguacacgcugccccagggcuucaccugggacgcccuggaccucggggaccgcggcguccugaaggagcuguacacccuccugaacgagaacuacguggaggacgacgacaacauguuccgguucgacuacagccccgaguuccugcucugggcgcugcggcccccgggcuggcugccccaguggcacugcggggugcgcgucguguccagccgcaagcucgugggcuucaucuccgccauccccgccaacauccacaucuacgacaccgagaagaagauggucgagaucaacuuccugugcgugcacaagaagcugcggagcaagcgcguggcccccguccucauccgggagaucacgcgccgggugcaccuggaggggaucuuccaggccguguacaccgcgggcgucgugcugccgaagcccguggggaccugccgcuacuggcaccggucccucaacccccgcaagcugaucgaggucaaguucagccaccugucccggaacaugaccaugcagcgcacgaugaagcucuaccggcugcccgagaccccgaagaccgccggccugcgccccauggagaccaaggacauccccguggugcaccagcuccugacgcgguaccugaagcaguuccaccucacccccgucaugagccaggaggagguggagcacugguucuacccgcaggagaacaucaucgacaccuucgucguggagaacgccaacggcgaggugaccgacuuccuguccuucuacacgcugcccagcaccaucaugaaccaccccacccacaagagccucaaggccgccuacuccuucuacaacguccacacccagacgccgcugcuggaccucaugagcgacgcgcuggugcuggccaagaugaagggguucgacguguucaacgcccucgaccugauggagaacaagaccuuccuggagaagcucaaguucggcaucggggacggcaaccugcaguacuaccuguacaacuggaagugccccuccaugggcgccgagaaggucgggcucgugcugcaguga

SEQ ID NO: 33669 - RNA, 1497 nt, Artificial Sequence
  derived and/or modified sequence opt1 from NMT2__Homo_sapiens__NP_004799
auggccgaggacagcgaguccgccgcgagccagcagucccuggagcucgacgaccaggacacgugcggcaucgacggggacaacgaggaggagaccgagcacgccaagggcagccccgggggcuaccugggggccaagaagaagaagaagaagcagaagcgcaagaaggagaagccgaacuccggcggcaccaagagcgacuccgccagcgacucccaggagaucaagauccagcagcccagcaagaaccccuccgugcccaugcagaagcugcaggacauccagcgggccauggagcuccugagcgcgugccaggggccggcccgcaacaucgacgaggccgccaagcaccgguaccaguucugggacacccagcccguccccaagcuggacgaggugaucaccucccacggcgcgaucgagcccgacaaggacaacgugcgccaggagccguacagccucccccagggguucaugugggacacccuggaccuguccgacgccgagguccucaaggagcuguacacgcugcucaacgagaacuacguggaggacgacgacaacauguuccgguucgacuacagccccgaguuccugcugugggcccuccggcccccgggcuggcugcugcaguggcacugcggggugcgcgucuccagcaacaagaagcucgugggcuucaucuccgccauccccgccaacauccgcaucuacgacagcgugaagaagauggucgagaucaacuuccugugcgugcacaagaagcugcggagcaagcgcguggcgcccguccucauccgggagaucacccgccgggugaaccuggagggcaucuuccaggccguguacaccgccggggucgugcugcccaagccgaucgcgaccugccgcuacuggcaccggucccucaacccccgcaagcugguggaggucaaguucagccaccugucccggaacaugacgcuccagcgcaccaugaagcuguaccggcugcccgacgugaccaagaccagcggccuccgccccauggagccgaaggacaucaaguccgugcgggagcugaucaacacguaccugaagcaguuccaccucgcccccgucauggacgaggaggagguggcgcacugguuccugccccgcgagcacaucaucgacaccuucguggucgagagccccaacgggaagcugaccgacuuccucuccuucuacacccugccgagcacggugaugcaccaccccgcccacaagucccugaaggccgccuacagcuucuacaacauccacaccgagacgccccuccuggaccugauguccgacgcccucauccuggccaagagcaagggcuucgacgucuucaacgcccuggaccucauggagaacaagaccuuccuggagaagcugaaguucggcaucggggacggcaaccuccaguacuaccuguacaacuggcgcugccccgggaccgacuccgagaaggugggccuggugcugcaguga

SEQ ID NO: 33670 - RNA, 525 nt, Artificial Sequence
  derived and/or modified sequence opt1 from NMU__Homo_sapiens__NP_006672
augcugcgcaccgagagcugccggccccgcuccccggccggccagguggccgcggccagcccccuccugcugcuccugcugcuccuggccuggugcgccggggccugccggggcgcgcccauccugccccaggggcuccagccggagcagcagcugcagcuguggaacgagaucgacgacacgugcuccagcuuccucuccaucgacagccagccccaggccuccaacgcccuggaggagcugugcuucaugaucaugggcaugcuccccaagccccaggagcaggacgagaaggacaacaccaagcgcuuccuguuccacuacagcaagacccagaagcuggggaaguccaacgucgugagcuccgugguccacccgcuccugcagcuggugccccaccuccacgagcggcgcaugaagcgguuccgcguggacgaggaguuccagagccccuucgccucccagagccggggcuacuuccuguuccgcccccggaacggccgccgguccgcgggguucaucuga

SEQ ID NO: 33671 - RNA, 1281 nt, Artificial Sequence
  derived and/or modified sequence opt1 from NMUR1__Homo_sapiens__NP_006047
augacgccccugugccucaacugcagcgugcugccgggcgaccuguaccccgggggcgcccgcaaccccauggccugcaacggguccgcggcccggggccacuucgaccccgaggaccucaaccugaccgacgaggcccugcgccucaaguaccuggggccgcagcagaccgagcuguucaugcccaucugcgccaccuaccuccugaucuucgucgugggcgccgugggcaacgggcugaccugccucgucauccugcggcacaaggcgaugcgcacccccacgaacuacuaccuguucagccucgccguguccgaccugcuggugcuccuggucggccugccccucgagcuguacgagauguggcacaacuacccguuccugcucggggugggcgggugcuacuuccggacccugcuguucgagauggugugccucgccagcguccugaacgugaccgcccuguccguggagcgcuacgucgcgguggugcacccccuccaggcccggagcauggucacccgcgcccacgugcggcgcgugcugggcgccgucuggggccuggccaugcucugcucccugcccaacacgagccugcacgggauccggcagcuccacgugcccugccgcggcccggugcccgacuccgcggucugcaugcuggugcggccccgcgcccuguacaacauggugguccagaccaccgcccuccuguucuucugccugcccauggccaucaugagcgugcucuaccugcugaucgggcuccggcugcgccgggagcgccugcuccugaugcaggaggccaagggccggggcuccgcggccgcccgcagccgguacacgugccgccugcagcagcacgaccgcgggcggcgccaggucaccaagaugcuguucgugcucguggucguguucggcaucugcugggccccguuccacgccgaccgggugaugugguccgucgugagccaguggaccgacgggcugcaccuggcguuccagcacgugcacgucaucuccggcaucuucuucuaccucgggagcgccgccaaccccgugcuguacucccugaugagcucccgcuuccgggagaccuuccaggaggcccucugccugggcgccugcugccaccgccugcggccccgccacagcagccacucccucagccggaugaccacgggcuccacccugugcgacguggggagccugggcuccuggguccacccccucgcggggaacgacggcccggaggcccagcaggagaccgaccccagcuga

SEQ ID NO: 33672 - RNA, 1248 nt, Artificial Sequence
  derived and/or modified sequence opt1 from NMUR2__Homo_sapiens__NP_064552
augagcggcauggagaagcugcagaacgccuccuggaucuaccagcagaagcuggaggaccccuuccagaagcaccugaacagcaccgaggaguaccuggccuuccucugcgggccgcgccggucccacuucuuccugcccgugagcgucguguacgugcccaucuucgucgugggcgugaucgggaacguccuggugugccucgugauccugcagcaccaggcgaugaagacccccacgaacuacuaccuguucucccucgccgucagcgaccugcuggugcuccugcugggcaugccgcucgagguguacgagauguggcgcaacuaccccuuccuguucgggcccgucggcugcuacuucaagaccgcccuguucgagaccgugugcuucgccuccauccucagcaucaccacgguguccgucgagcgguacguggccauccugcaccccuuccgcgcgaagcugcagagcacccggcgccgggcccuccgcauccugggcaucguguggggguucuccguccuguucagccucccgaacaccuccauccacggcaucaaguuccacuacuuccccaacgggagccuggugcccggcuccgcgaccugcacggugaucaagcccauguggaucuacaacuucaucauccaggucaccagcuuccuguucuaccuccugccgaugaccgugaucuccgugcuguacuaccucauggcccugcggcugaagaaggacaagagccucgaggccgacgaggggaacgccaacauccagcgccccugccggaaguccgucaacaagaugcuguucgugcugguccucguguucgccaucugcugggcccccuuccacaucgaccgccuguucuucagcuucguggaggaguggagcgagucccuggccgcggucuucaaccucgugcacguggucagcggcguguucuucuaccuguccagcgccgugaaccccaucaucuacaaccugcucucccggcgcuuccaggccgccuuccagaacgucaucagcuccuuccacaagcaguggcacagccagcacgacccgcagcugccgcccgcccagcggaacaucuuccugaccgagugccacuucguggagcucacggaggacaucggcccccaguuccccugccaguccagcaugcacaacucccaccuccccgcggcccugagcuccgagcagaugagccgcaccaacuaccaguccuuccacuucaacaagaccuga

SEQ ID NO: 33673 - RNA, 246 nt, Artificial Sequence
  derived and/or modified sequence opt1 from NNAT__Homo_sapiens__NP_005377
auggccgccguggcggccgccagcgccgagcugcucaucaucggcugguacaucuuccgcguccugcuccagguguuccuggagugcugcaucuacugggugggguucgccuuccggaacccgcccggcacccagcccaucgcgcgcuccgaggucuuccgguacagccugcagaagcuggccuacaccgugucccgcacggggcgccaggugcucggcgagcggcggcagcgcgcccccaacuga

SEQ ID NO: 33674 - RNA, 795 nt, Artificial Sequence
  derived and/or modified sequence opt1 from NNMT__Homo_sapiens__NP_006160
auggagagcggcuucaccuccaaggacaccuaccugagccacuucaacccccgcgacuaccucgagaaguacuacaaguucgggucccggcacagcgccgagucccagauccugaagcaccuccucaagaaccuguucaagaucuucugccuggacggcgugaagggggaccuccugaucgacaucggcagcgggccgacgaucuaccagcugcucuccgccugcgagagcuucaaggagaucgucgugaccgacuacuccgaccagaaccugcaggagcuggagaaguggcucaagaaggagcccgaggcguucgacuggagccccguggucaccuacgugugcgaccuggagggcaaccgcgugaagggccccgagaaggaggagaagcugcggcaggccgucaagcagguccucaagugcgacgugacccagucccagccgcugggggccgugccccugccgcccgccgacugcgugcucagcacgcugugccuggacgccgcgugccccgaccuccccaccuacugccgcgcccugcggaaccugggcucccuccugaagcccgggggcuuccuggugaucauggacgcccucaagagcuccuacuacaugaucggggagcagaaguucagcucccugccccugggccgcgaggccgucgaggcggccgugaaggaggccggcuacaccaucgagugguucgaggugaucagccaguccuacagcagcaccauggccaacaacgaggggcuguucucccuggucgcccggaagcugagccgcccgcucuga

SEQ ID NO: 33675 - RNA, 2868 nt, Artificial Sequence
  derived and/or modified sequence opt1 from NNT__Homo_sapiens__XP_006714524
auggugaaccccacccugggcguccacgaggccgaccuccugaagaccagcgggacgcugaucuccuucaucuacccggcccagaaccccgagcuccugaacaagcugagccagcgcaagaccaccgugcucgcgauggaccaggugccccgggucaccaucgcccagggcuacgacgcccuguccagcauggccaacaucgccggguacaaggcgguggugcuggccgccaaccacuucggccgcuucuucacggggcagaucaccgccgcgggcaaggugcccccggccaagauccucaucgugggcgggggcguggccgggcuggccuccgccggcgcggccaagagcaugggggccaucguccggggcuucgacacccgcgccgccgcgcuggagcaguucaagucccucggcgccgagccccuggagguggaccugaaggagagcggggagggccagggcggguacgccaaggagauguccaaggaguucaucgaggccgagaugaagcuguucgcccagcagugcaaggagguggacauccugaucagcaccgcgcugauccccggcaagaaggcccccguccucuucaacaaggagaugaucgaguccaugaaggaggggagcgugguggucgaccuggccgccgaggccggcgggaacuucgagacgaccaagccgggcgagcuguacauccacaaggggaucacccacaucggcuacaccgaccuccccucccggauggcgacgcaggccagcacccuguacuccaacaacaucaccaagcugcucaaggccaucagccccgacaaggacaacuucuacuucgacgugaaggacgacuucgacuucggcaccauggggcacgugauccgcggcacggucgugaugaaggacgggaaggugaucuuccccgccccgacccccaagaacaucccccagggcgcgcccgucaagcagaagaccguggccgagcuggaggccgagaaggccgccaccaucacgccguuccggaagaccauguccaccgcgagcgccuacaccgccgggcugacgggcauccucggccuggggaucgccgcccccaaccuggcguucucccagauggugaccaccuucggccucgccgggaucgucggcuaccacaccguguggggcgucacgcccgcccugcacagcccccugaugagcgugaccaacgccaucuccgggcucaccgccgugggcgggcuggcgcugaugggcgggcaccucuacccgagcaccacgucccagggccuggccgcccuggccgcguucaucagcuccgucaacaucgccggcggguuccucgugacccagcgcaugcuggacauguucaagcggcccaccgacccgcccgaguacaacuaccuguaccuccugcccgccggcaccuucgucgggggcuaccuggccgcccucuacagcggguacaacaucgagcagaucauguaccugggcuccggccugugcugcgucggggcgcucgccggccugagcacgcaggggaccgcccgccugggcaacgcccuggggaugaucggcguggccggcgggcucgcggccacccugggcgugcugaagcccgggcccgagcuccuggcccagauguccggcgccauggcccucgggggcaccaucggccucaccaucgcgaagcggauccagaucagcgaccugccccagcuggucgccgccuuccacucccucguggggcuggccgcggugcugacgugcaucgccgaguacaucaucgaguacccgcacuucgccaccgacgccgccgcgaaccucaccaagaucgucgccuaccugggcaccuacaucgggggcgugacguucagcgggucccugaucgccuacggcaagcuccagggccugcucaagagcgcgccccugcugcugcccgggcgccaccuccugaacgccggccugcucgccgccuccgucgggggcaucaucccguucaugguggaccccagcuucaccaccggcaucacgugccugggguccgugagcgcccuguccgccgugaugggcgucacccucaccgccgcgaucgggggcgccgacaugcccguggugaucaccguccugaacagcuacagcgggugggcccugugcgccgagggcuuccuccugaacaacaaccugcucaccaucgugggcgcccugaucggguccagcggcgcgauccuguccuacaucaugugcguggccaugaaccggagccucgccaacgucauccucgggggcuacgggacgaccuccaccgccggcggcaagcccauggagaucagcgggacccacacggagaucaaccuggacaacgcgaucgacaugauccgcgaggccaacuccaucaucaucaccccgggcuacgggcugugcgccgccaaggcccaguaccccaucgcggaccuggugaagaugcugaccgagcagggcaagaaggugcgguucgggauccaccccgucgccggccgcaugcccggccagcucaacgugcugcuggccgaggccggggugccguacgacaucguccucgagauggacgagaucaaccacgacuuccccgacaccgaccuggugcuggugaucggcgccaacgacacggucaacagcgcggcccaggaggaccccaacuccaucaucgccgggaugcccgugcucgagguguggaaguccaagcaggucaucgugaugaagcggagccugggcgugggcuacgccgccgucgacaacccgaucuucuacaagcccaacaccgcgaugcugcucggggacgccaagaagaccugcgacgcccugcaggccaaggugcgcgagagcuaccagaaguga

SEQ ID NO: 33676 - RNA, 2097 nt, Artificial Sequence
  derived and/or modified sequence opt1 from NOA1__Homo_sapiens__NP_115689
augcugcccgcccgccuccccuuccggcugcugagccucuuccugcgcggcuccgcccccaccgcggcccggcacgggcugcgcgagccccuccuggagcggcgcugcgccgccgccagcuccuuccagcacagcuccagccugggccgggagcuccccuacgacccgguggacaccgagggguucggcgagggcggggacaugcaggagcgcuuccuguuccccgaguacauccuggaccccgagccccagccgacgcgggagaagcagcuccaggagcugcagcagcagcaggaggaggaggagcgccagcggcagcagcgccgggaggagcgccggcagcagaaccugcgcgcgcggucccgcgagcaccccgucgugggccaccccgaccccgcccucccgcccagcggggugaacugcuccggcugcggggccgagcugcacugccaggacgccggcguccccggguaccugccccgggagaaguuccuccgcaccgcggaggccgacggcggccuggcccggaccgugugccagcgcugcuggcugcucagccaccaccgccgggcccugcgccuccaggugucccgggagcaguaccuggagcuggucagcgccgcgcugcgccggccggggcccucccucgugcuguacaugguggaccugcucgaccugcccgacgcccugcuccccgaccugccggcccuggucggccccaagcagcucaucgugcuggggaacaagguggaccugcucccccaggacgcccccggcuaccgccagcggcugcgcgagcggcugugggaggacugcgcccgcgcgggccuccugcuggccccggggcaccagggcccccagcggcccgucaaggacgagccccaggacggggagaacccgaacccgcccaacuggagccgcaccguggugcgggacguccgccucaucuccgccaagacgggcuacgggguggaggagcugaucagcgcccugcagcgguccuggcgcuaccggggcgacguguaccucgucggcgccaccaacgcgggcaagagcacccuguucaacacccugcuggaguccgacuacugcacggccaaggggagcgaggccaucgaccgcgccaccaucagccccuggcccgggaccacccucaaccugcugaaguuccccaucugcaaccccacgccguaccggauguucaagcgccaccagcgccucaagaaggacuccacccaggccgaggaggaccugagcgagcaggagcagaaccagcugaacgugcucaagaagcacggcuacguggucgggcgggugggccgcaccuuccuguacuccgaggagcagaaggacaacauccccuucgaguucgacgcggacagccuggccuucgacauggagaacgaccccgugaugggcacccacaaguccacgaagcaggucgagcucaccgcccaggacgugaaggacgcccacugguucuacgacacccccgggaucaccaaggagaacugcauccugaaccugcucacggagaaggaggucaacaucgugcugccgacccagagcaucgugccccggaccuucguccugaagcccggcaugguccucuuccugggggcgaucggccgcaucgacuuccugcaggggaaccaguccgccugguucaccgugguggccagcaacauccuccccgugcacaucacgucccuggaccgggccgacgcccuguaccagaagcacgcgggccacacccuccugcagaucccgaugggcgggaaggagcgcauggccggcuucccgccccugguggccgaggacaucaugcucaaggaggggcugggcgccagcgaggccgucgcggacaucaaguucuccagcgccggcuggguguccgugacccccaacuucaaggaccggcugcaccuccgcggguacacccccgagggcacgguccugaccgugcggccgccccugcuccccuacaucgugaacaucaaggggcagcgcaucaagaaguccgucgccuacaagaccaagaagccgcccagccugauguacaacgugcggaagaagaagggcaagaucaacguguga

SEQ ID NO: 33677 - RNA, 1239 nt, Artificial Sequence
  derived and/or modified sequence opt1 from NOB1__Homo_sapiens__NP_054781
auggcccccguggagcacgucguggccgacgcgggcgccuuccugcgccacgccgcccuccaggacaucgggaagaacaucuacaccauccgggagguggucaccgagauccgcgacaaggccacgcggcgccggcuggcggugcugccguacgagcuccgcuucaaggagccccugcccgaguacgugcggcuggucaccgaguucagcaagaagaccggcgacuaccccucccucagcgccaccgacauccaggugcuggcccugacguaccagcucgaggccgaguucgugggggucucccaccugaagcaggagccgcagaaggugaaggugagcuccagcauccagcaccccgagacgccccugcacaucuccggcuuccaccuccccuacaagccgaagccgccccaggagaccgagaaggggcacagcgcgugcgagcccgagaaccuggaguucuccagcuucauguucuggcgcaacccccugcccaacaucgaccacgagcuccaggagcugcugaucgaccggggcgaggacguccccuccgaggaggaggaggaggaggagaacggcuucgaggaccgcaaggacgacagcgacgacgacgggggcggguggaucacccccuccaacaucaagcagauccagcaggagcucgagcagugcgacgugccggaggacgugcgggucggcugccugaccaccgacuucgccaugcagaacgugcugcuccagauggggcugcacgugcuggccgucaacggcaugcucauccgcgaggcccggagcuacauccugcgcugccacggcugcuucaagaccaccuccgacaugagccggguguucugcucccacugcgggaacaagacgcugaagaaggugagcgucaccguguccgacgacggcacccuccacaugcacuucagccgcaaccccaaggugcugaacccccgggggcugcgcuacagccuccccaccccgaagggcggcaaguacgccaucaacccccaccugacggaggaccagcgguucccccagcugcgccucucccagaaggcgcggcagaagaccaacgucuucgcccccgacuacaucgccggggugagcccguucgucgagaacgacaucuccagccgcuccgccacccuccaggugcgcgacagcacccugggcgccgggcggcgccggcugaaccccaacgcgucccgcaagaaguucgugaagaagcgguga

SEQ ID NO: 33678 - RNA, 2076 nt, Artificial Sequence
  derived and/or modified sequence opt1 from NOBOX__Homo_sapiens__NP_001073882
auggcccugcuccugacccugaccagccccgaccucgagggcacgugggacacccgcgacaaggacggguucaaggcccaggagggcccgccccuggcggugcccgaguuccccgucugcgggcuguaccggaucuacggcgugugcggguccuucagcuccuucuucaucauccgcugcagccucugcgcccuggagacccugaaguccccgcagcacgacccccucgagauccccgagcagagccugaagcugaucccccucguguccggcaagcgggagcugacccgcggccagaaggccggggagaagccgcuggccgccggccccggggaggaggagcuccugcggggcagcgcgccccacgcccaggacacgcaguccgaggagcugcccccgagcugcaccaucuccggggagaagaagccgcccgccgucagcggcgaggccaccggcgcggacgccgggcgccucugcccgccgccccggucccgcgcgccccacaaggaccggacccuggcccgcagccggccccagacgcagggcgaggacugcucccugcccgugggggaggugaagaucggcaagcgcagcuacucccccgcccccggcaagcagaagaagcccaacgccauggggcucgcccccaccagcucccccggcgcccccaacagcgcccgggccacccacaaccccgucccgugcgggagcggccgcgggcccugccaccuggcgaaccugcucuccacccuggcccagagcaaccagaaccgggaccacaagcaggggcccccggaggugacgugccagauccgcaagaagacccggacccuguaccgcuccgaccagcucgaggagcuggagaagaucuuccaggaggaccacuaccccgacagcgacaagcggcgcgagaucgcccagaccgugggcgucacgccccagcggaucauggugaagggcgccggcucccugguggccggguggagcggcgggggccccaccaucgagacccucgagcugcaguccgagcgcagcgcggucgccugggugugguuccagaaccgccgggccaaguggcgcaagauggagaagcugaacggcaaggaguccaaggacaacccggccgcccccgggcccgcgagcucccagugcagcuccgccgccgagauccuccccgccgugccgauggagcccaagcccgaccccuucccgcaggagagcccccuggacaccuuccccgagcccccgaugcugcucacguccgaccagacccuggcgcccacccagcccagcgagggcgcccagcgggucgugaccccgccccuguucuccccgccgcccgugcgccgggccgaccuccccuucccccuggggcccguccacacgccccagcugaugccccuccugauggacguggccggcagcgacuccagccacaaggacgggcccugcggcagcuggggcaccuccaucacccugcccccgcccugcagcuaccucgaggagcuggagccccaggacuaccagcaguccaaccagcccgggccguuccaguucagccaggcgccccagccgccccuguuccagagcccccagcccaagcuccccuaccugcccaccuucccguucuccaugcccuccagccugacgcugccgccgcccgaggacucccucuucauguuccccugcggccccagcgggggcaccucccagggcuacugccccggggccagcuccggccagauccugaugcagccgcccgccgggaacaucggcaccgccagcugguccgaccccugccugcccgagcuccccuuccccgggcccuucugcccgcaggcccugggccacccgcccggcggggacggcuacuuccccgaccuguuccccacccccugcccccaggcccucgggcgccagcccagcuccgcgcugagcuggaugccggagggcgcccggcccgggacgggcccccugcucagcaaggccaaggaggagcccccggccgccucccuggaccagcccagcgcgcuggaggaggcccgcggcgacgacaagaacucccacgugcccuga

SEQ ID NO: 33679 - RNA, 2403 nt, Artificial Sequence
  derived and/or modified sequence opt1 from NOC3L__Homo_sapiens__NP_071896
augaaggcccgccggaacaagaagcagauccccagcuuccgcaagcugaucaagaccuccaaggugaagcucgagaacaagcugaagaacaagcaguucaagcagcagagcacccugaagaaguaccggaaggagcagcgcaagcuccggcaggccgucaaggacgcgguguccaagaagccgaucccccuggagaaccccaaggagaagcgccccggcaagcggaucgagcgcgaggaggaggaggaggaggaggcccugccgcucgacaugauggacgaggacgaccugcagcugaugaaggaccucgggcagcgggugagcuuccugacgcgcgaccuguccagcuccgagcccguccacgccaagaagcggaagcacgagcgcaucaucgacaaguacgagaagaucccccggacccuccagaccgcccccgagaaggagcugauccaccuccucccgaucaaggacaagagcggcaucaucccccagacccgcgagaagcccgugacggacuccaacaaggacgaggaggaccaggaggaggagcgggagcuggaggaggagaucaucgaggaccccauccaggagcugaccaucgaggagcaccucaucgagcgcaagaagaagcugcaggagaagaagaugcacaucgccgcgcuggccagcgccauccucuccgacccggagaacaacaucaagaagcugaaggagcugcggagcaugcucauggagcaggaccccgacguggccgucaccgugcgcaagcuggugaucgucucccugauggagcuguucaaggacaucacccccagcuacaagauccggccccugacggaggcggagaaguccaccaagacccgcaaggagacccagaagcugcgggaguucgaggaggggcucgugagccaguacaaguucuaccuggagaaccuggagcagauggugaaggacuggaagcagcgcaagcucaagaaguccaacgucgugagccugaaggccuacaagggccuggccgagguggccgucaagucccucugcgagcugcugguggcccucccgcacuucaacuuccacaacaacaucaucgugcugaucgucccccugaugaacgacaugagcaagcucaucagcgagaugugcugcgaggcggugaagaagcuguucaagcaggacaagcuggggcaggccucccucggcgugaucaaggucaucagcggcuucgugaaggggcgcaacuacgaggugcggcccgagaugcugaagacguuccugugccuccgcaucaaggaggucgaggugaagaaggacaccgaggacaucaacaagcccaagaaguucaugaccuucaaggagaagcggaagucccugagccgcaugcagcggaaguggaagaaggccgaggagaagcuggagcgcgagcugcgggaggccgaggccuccgagagcaccgagaagaagcucaagcugcacacggagacccugaacaucgucuucgugaccuacuuccgcauccucaagaaggcgcagcgguccccgcugcugcccgccgugcucgagggccuggccaaguucgcccaccugaucaacgucgaguucuucgacgaccuccugguggugcugcacacccucaucgagagcggggaccuguccuaccaggagagccugcacugcguccagacggccuuccacauccucuccggccagggggacgugcugaacaucgacccccugaaguucuacacccaccucuacaagacccuguucaagcugcacgcgggcgccaccaacgagggcguggagaucguccuccagugccuggacgugaugcugacgaagcgccggaagcaggucagccagcagcgcgcccucgccuucaucaagcggcugugcacccuggcccuccacgugcugcccaacuccagcaucgggauccuggcgaccacccgcauccucaugcacacguucccgaagaccgaccugcugcucgacuccgagagccagggcuccgggguguuccugcccgagcuggacgagcccgaguacugcaacgcccagaacaccgcccucugggagcugcacgcccugcggcgccacuaccaccccaucgugcagcgguucgcggcccaccucaucgccggcgccccgagcgagggcuccggggcccugaagcccgagcugagccgccggagcgcgaccgagcuguucgaggccuacuccauggccgagaugacguucaacccgcccgucgagagcuccaaccccaagaucaagggcaaguuccuccagggggacagcuuccugaacgaggaccucaaccagcugaucaagcgcuacuccagcgagguggccaccgagagcccccuggacuucaccaaguaccucaagaccucccugcacuga

SEQ ID NO: 33680 - RNA, 2862 nt, Artificial Sequence
  derived and/or modified sequence opt1 from NOD1__Homo_sapiens__NP_006083
auggaggagcagggccacagcgagauggagaucauccccuccgagagccacccgcacauccagcugcucaaguccaaccgcgagcugcuggugacccacauccggaacacccagugccucgucgacaaccugcugaagaacgacuacuucagcgccgaggacgccgagaucgugugcgcgugccccacgcagcccgacaaggugcgcaagauccucgaccugguccaguccaagggggaggaggugagcgaguucuuccuguaccuccugcagcagcuggccgacgccuacguggaccuccggcccuggcugcuggagaucggcuucuccccgagccuccugacccaguccaaggucguggugaacaccgaccccgucagccgcuacacccagcagcugcggcaccaccucgggcgcgacuccaaguucgugcugugcuacgcccagaaggaggagcugcuccuggaggagaucuacauggacacgaucauggagcuggugggcuucagcaacgagucccucgggagccugaacucccuggccugccuccuggaccacaccaccggcauccugaacgagcagggcgagaccaucuucauccucggggacgcgggcgucggcaagagcaugcugcugcagcggcuccagucccugugggccacggggcgccuggacgccggggugaaguucuucuuccacuuccggugccgcauguucagcugcuucaaggaguccgaccggcucugccugcaggaccugcuguucaagcacuacugcuaccccgagcgcgaccccgaggagguguucgccuuccugcugcgguucccgcacgucgcgcuguucaccuucgacggccuggacgagcugcacagcgaccucgaccugagccgcgugcccgacuccagcugccccugggagcccgcccacccgcuggugcuccuggccaaccugcuguccggcaagcuccugaagggggccagcaagcugcucaccgcccggaccggcaucgaggucccccgccaguuccugcggaagaaggugcugcuccgcggguucucccccagccaccuccgggcguacgcccgccggauguuccccgagcgcgcccugcaggaccgccuccugucccagcuggaggccaacccgaaccucugcagccugugcuccgugccccuguucugcuggaucaucuuccggugcuuccagcacuuccgcgccgcguucgagggcagcccccagcuccccgacugcacgaugacccugaccgacgucuuccugcucgugaccgaggugcaccugaaccggaugcagccguccagccugguccagcgcaacacgcggucccccguggagacccuccacgccggccgcgacacccugugcagccuggggcaggucgcccaccggggcauggagaagucccucuucguguucacccaggaggaggugcaggccagcgggcugcaggagcgcgacaugcagcugggcuuccuccgggcccugcccgagcuggggcccggcggcgaccagcaguccuacgaguucuuccaccucacgcugcaggcguucuucaccgccuucuuccugguccucgacgaccgcguggggacccaggagcugcugcgguucuuccaggaguggaugccgcccgccggcgccgccaccacgagcugcuacccgcccuuccuccccuuccagugccugcagggguccggccccgcgcgcgaggaccuguucaagaacaaggaccacuuccaguucaccaaccucuuccugugcgggcugcucagcaaggccaagcagaagcugcugcggcaccucgugcccgccgccgcgcugcgccggaagcgcaaggcccugugggcccaccucuucagcucccugcggggcuaccucaagagccucccgcgcguccagguggaguccuucaaccaggugcaggccaugcccaccuucaucuggaugcugcggugcaucuacgagacccagagccagaaggucggccagcuggccgcgcgcgggaucugcgccaacuaccucaagcugacguacugcaacgccugcuccgccgacugcagcgcccuguccuucgugcuccaccacuuccccaagcgccuggcgcuggaccucgacaacaacaaccugaacgacuacggcgugcgggagcugcagcccugcuucagccgccucaccguccugcggcuguccgugaaccagaucaccgacgggggcgugaagguccucagcgaggagcugaccaaguacaagaucgugacguaccuggggcucuacaacaaccagaucaccgacgugggcgcccgcuacgucaccaagauccuggacgagugcaagggccugacccaccucaagcuggggaagaacaagaucacguccgagggcgggaaguaccuggcccucgccgugaagaacagcaaguccaucagcgaggugggcauguggggcaaccaggucggggacgagggcgccaaggcguucgccgaggcccugcggaaccacccgucccugaccacccucagccuggccuccaacgggaucagcaccgagggcggcaagagccuggcgcgcgcccuccagcagaacaccucccuggagauccuguggcucacgcagaacgagcugaacgacgagguggccgagagccuggccgagaugcucaaggugaaccagacccugaagcaccuguggcucauccagaaccagaucaccgccaaggggaccgcgcagcuggccgacgcccugcaguccaacacgggcaucaccgagaucugccucaacgggaaccugaucaagcccgaggaggccaaggucuacgaggacgagaagcggaucaucugcuucuga

SEQ ID NO: 33681 - RNA, 3123 nt, Artificial Sequence
  derived and/or modified sequence opt1 from NOD2__Homo_sapiens__NP_071445
augggcgaggagggcgggagcgccucccacgacgaggaggagcgcgccagcgugcugcucgggcacucccccggcugcgagaugugcagccaggaggcguuccaggcccagcggucccagcuggucgagcugcucgugagcgggucccuggagggcuucgagagcgugcuggacuggcuccuguccugggagguccugagcugggaggacuacgagggcuuccaccuccuggggcagccgcugucccaccucgcccgccggcugcuggacaccguguggaacaagggcaccugggccugccagaagcucaucgccgcggcccaggaggcccaggccgacagccagucccccaagcugcacgggugcugggacccccacagccugcaccccgcgcgcgaccuccagucccaccggccggccaucgugcgccggcugcacagccacgucgagaacaugcuggaccucgccugggagcgcggcuucgugucccaguacgagugcgacgagauccggcugcccaucuucacgcccagccagcgcgcccggcgccugcucgaccuggccaccgugaaggcgaacgggcuggccgccuuccuccugcagcacguccaggagcugcccgugccgcucgcccugccccuggaggccgcgaccugcaagaaguacauggccaagcuccggaccacgguguccgcccagagccgcuuccugagcaccuacgacggcgccgagacccugugccucgaggacaucuacaccgagaacguccuggaggugugggccgacgugggcauggcggggccgccccagaagucccccgccacgcugggccucgaggagcuguucagcacccccgggcaccugaacgacgacgccgacaccguccucguggugggcgaggccggcuccggcaagagcacccugcugcagcggcuccaccuccugugggccgcggggcaggacuuccaggaguuccucuucgucuuccccuucuccugccgccagcugcagugcauggccaagccccugagcgugcggacgcugcuguucgagcacugcugcuggccggacguggggcaggaggacaucuuccagcugcugcucgaccaccccgaccgcguccugcugaccuucgacggcuucgacgaguucaaguuccgguucaccgaccgcgagcggcacugcucccccaccgaccccacgagcgugcagacccuccuguucaaccugcuccaggggaaccugcugaagaacgcccgcaagguggucaccucccgcccggccgcggugagcgccuuccuccggaaguacauccgcaccgaguucaaccugaagggcuucuccgagcagggcaucgagcuguaccuccggaagcgccaccacgagcccggggucgccgaccggcugauccgccugcuccaggagacgagcgcccugcacggccugugccaccuccccguguucuccuggauggugagcaagugccaccaggagcugcugcuccaggagggcgggucccccaagaccaccaccgacauguaccugcugauccuccagcacuuccugcugcacgccacgccgcccgacagcgcgucccaggggcucggccccagccugcugcggggccgccuccccacccugcugcaccucgggcggcuggcccuguggggccucgggaugugcugcuacgucuucuccgcccagcagcugcaggccgcccaggugagcccggacgacaucagccugggcuuccucgugcgcgcgaagggggucgugcccggcuccaccgcgccccuggaguuccugcacaucaccuuccagugcuucuucgccgccuucuaccucgcccugagcgcggacgugccgcccgcccugcuccggcaccuguucaacugcggccgccccgggaacucccccauggcccggcugcucccgacgaugugcauccaggccagcgagggcaaggacuccagcgucgcggcccugcugcagaaggccgagccccacaaccuccagaucaccgccgccuuccuggcggggcugcucucccgcgagcacuggggccugcuggccgagugccagaccagcgagaaggcccuccugcggcgccaggccugcgcccgguggugccuggcgcgcucccuccggaagcacuuccacagcaucccgcccgccgcccccggcgaggccaaguccgugcacgccaugcccggguucaucuggcugauccgcagccuguacgagaugcaggaggagcgccucgcgcggaaggccgcccgcggccugaacguggggcaccugaagcucaccuucugcuccgucggccccacggagugcgccgcgcuggccuucgugcugcagcaccuccggcgccccguggcccugcagcuggacuacaacagcgucggggacaucggcguggagcagcuccugccgugccugggcgugugcaaggcccucuaccugcgggacaacaacaucuccgaccgcgggaucugcaagcugaucgagugcgcccuccacugcgagcagcugcagaagcuggcccucuucaacaacaagcugaccgacggcugcgcccacagcauggccaagcugcucgccugccggcagaacuuccuggcccugcgccucgggaacaacuacaucaccgcggccggcgcccagguccuggccgaggggcugcggggcaacaccucccuccaguuccugggcuucugggggaaccgcgugggcgacgagggggcccaggcgcuggccgaggcccugggcgaccaccagagccuccgguggcugagccugguggggaacaacaucggcuccgucggcgcccaggcccucgcgcugaugcuggccaagaacgugaugcucgaggagcugugccuggaggagaaccaccuccaggacgagggggugugcagccuggccgagggccugaagaagaacuccagccucaagauccugaagcuguccaacaacugcaucacguaccucggggccgaggcgcugcugcaggcccucgagcgcaacgacaccauccuggaggucuggcugcggggcaacaccuucagccucgaggagguggacaagcuggggugccgcgacacccggcugcuccuguga

SEQ ID NO: 33682 - RNA, 1044 nt, Artificial Sequence
  derived and/or modified sequence opt1 from NODAL__Homo_sapiens__NP_060525
augcacgcccacugccugcccuuccuccugcacgccuggugggcgcugcuccaggccggcgccgccaccguggccaccgcgcugcugcgcacgcgggggcagccgagcucccccagcccccucgccuacaugcugucccuguaccgcgacccccucccgcgggccgacaucauccgcagccugcaggccgaggacgucgcgguggacggccagaacuggaccuucgccuucgacuucuccuuccugagccagcaggaggaccucgccugggccgagcugcggcugcagcucuccagccccguggaccugcccaccgaggggucccuggccaucgagaucuuccaccagcccaagccggacaccgagcaggcgagcgacuccugccucgagcgcuuccagauggaccuguucacggucacccugagccaggugaccuucucccucggcagcauggugcuggaggucacccggccccuguccaaguggcucaagcaccccggggcccuggagaagcagaugagccgcguggccggcgagugcuggccccggccgcccacgccgcccgccaccaacgugcugcucaugcuguacuccaaccugagccaggagcagcgccagcucggcggguccacccugcugugggaggccgagagcagcuggcgggcgcaggagggccagcucuccugggagugggggaagcgccaccggcgccaccaccuccccgaccggagccagcugugccgcaaggucaaguuccagguggacuucaaccugaucggcuggggguccuggaucaucuaccccaagcaguacaacgccuaccggugcgagggcgagugccccaaccccgugggcgaggaguuccacccgaccaaccacgccuacauccagagccugcugaagcgcuaccagccccaccggguccccuccacgugcugcgcccccgugaagaccaagccgcucagcaugcuguacguggacaacgggcgcguccugcucgaccaccacaaggacaugaucguggaggagugcggcugccuguga

SEQ ID NO: 33683 - RNA, 699 nt, Artificial Sequence
  derived and/or modified sequence opt1 from NOG__Homo_sapiens__NP_005441
auggagcgcugccccagccugggcgugacccucuacgcccuggucguggugcuggggcuccgggccaccccggcgggcgggcagcacuaccugcacauccgccccgcccccuccgacaaccugccccucgucgaccugaucgagcacccggaccccaucuucgaccccaaggagaaggaccugaacgagacgcuccugcggagccugcucggcgggcacuacgaccccggcuucauggccaccuccccgcccgaggaccgccccggcgggggcgggggcgccgccgggggcgcggaggaccuggccgagcuggaccagcuccugcggcagcgccccagcggcgccaugccguccgagaucaaggggcuggaguucagcgagggccucgcccaggggaagaagcagcggcuguccaagaagcugcgccggaagcuccagauguggcuguggagccagaccuucugccccgugcuguacgcguggaacgaccucggcucccgcuucuggccccgguacgugaaggucggcagcugcuucuccaagcgcagcugcuccgugcccgaggggauggugugcaagccgagcaaguccguccaccugaccgugcugcgguggcgcugccagcggcgcggcgggcagcggugcggcuggauccccauccaguaccccaucaucagcgagugcaagugcuccugcuga

SEQ ID NO: 33684 - RNA, 1614 nt, Artificial Sequence
  derived and/or modified sequence opt1 from NOL11__Homo_sapiens__NP_001290201
auguucaacagccgcauccucaccaaguacacccuccugcugggccaggacgagaacuccgugaucaagagcuucacggccuccgucgaccggaaguucaucagccucaugucccugagcuccgacgggugcaucuacgagacccugauccccauccgcccggccgaccccgagaagaaccagagccucgugaagucccugcugcucaaggcgguggucagcggcaacgcccggaacgggguggcccugaccgcccuggaccaggaccacguggccguccucggcagcccccuggcggccagcaaggagugccuguccguguggaacaucaaguuccagacccuccagacgagcaaggagcugccccaggggaccuccggccagcugugguacuacggcgagcaccucuucaugcugcacgggaagucccugaccgugaucccguacaagugcgaggucuccagccucgccggcgcccuggggaagcugaagcacucccaggaccccggcacccacguggugagccacuucgucaacugggagacgccccaggggugcggccucggcuuccagaacagcgagcagucccgccggauccugcgccggcgcaagaucgaggugagccugcagcccgaggugccgcccuccaagcagcuccugagcaccaucaugaaggacuccgagaagcacaucgaggucgaggugcggaaguuccuggcgcucaagcagacccccgacuuccacaccgugaucggggacacggucaccggccugcuggagcgcugcaaggccgagcccagcuucuacccgcggaacugccucaugcagcugauccagacccacgugcuguccuacagccucugccccgaccugauggagaucgcccugaagaagaaggacgugcagcuccugcagcugugccuccagcaguuccccgacauccccgaguccgugaccugcgccugccugaagaucuuccugagcaucggggacgacucccuccaggagacggacgugaacauggagagcguguucgacuacuccaucaacagcguccacgacgagaagauggaggagcagaccgagauccugcagaacggcuucaacccggaggaggacaagugcaacaacugcgaccaggagcugaacaagaagccccaggacgagaccaaggaguccaccagcugccccgugguccagaagcgcgccgcgcuccugaacgccauccugcacuccgccuacagcgagacguuccugcucccccaccugaaggacaucccggcccagcacaucacccuguuccucaaguaccuguacuuccuguaccucaagugcuccgagaacgccaccaugacccugcccggcauccacccgcccacgcugaaccagaucauggacuggaucugccuccugcuggacgcgaacuucaccgugguggucaugaugcccgaggccaagcggcuccugaucaaccuguacaagcucgucaagagccagaucagcguguacuccgagcugaacaagaucgaggucagcuuccgcgagcugcagaagcucaaccaggagaagaacaaccgggggcuguacuccaucgaggugcuggagcuguucuga

SEQ ID NO: 33685 - RNA, 627 nt, Artificial Sequence
  derived and/or modified sequence opt1 from NOL3__Homo_sapiens__NP_001263236
augggcaacgcccaggagcgccccagcgagaccaucgaccgggagcgcaagcggcugguggagacccuccaggccgacuccgggcugcugcucgacgcgcugcuggcccgcggcguccucacggggccggaguacgaggcccuggacgcccugcccgacgccgagcggcgcgugcggcgccuccugcugcucgugcagggcaagggggaggcggccugccaggagcugcugcggugcgcccagcgcaccgccggcgcgcccgaccccgccugggacuggcagcacgucggcccgggguaccgggaccgcagcuacgacccgcccugccccggccacuggacccccgaggcccccggguccggcaccacgugccccgggcucccccgggccagcgacccggacgaggccggcggccccgagggguccgaggcggugcagagcggcacccccgaggagcccgagccggagcuggaggccgaggccuccaaggaggccgagcccgagcccgagcccgagccggagcuggagcccgaggccgaggcggagcccgagcccgagcucgagccggagcccgaccccgagcccgagccggacuucgaggagcgcgacgagagcgaggacuccuga

SEQ ID NO: 33686 - RNA, 1725 nt, Artificial Sequence
  derived and/or modified sequence opt1 from NOL4__Homo_sapiens__NP_001185475
auggagagcgagcgcgacauguaccggcaguuccaggacuggugccugcgcaccuacggcgacuccgggaagaccaagacggugacccggaagaaguacgagcgcaucguccagcuccugaacggcagcgaguccagcuccaccgacaacgccaaguucaaguucugggugaaguccaagggguuccagcugggccagcccgacgaggugcgcgggggcggcgggggcgccaagcagguccucuacgugccggugaagaccacggacggggucggcguggacgagaagcugucccugcggcggguggcggucguggaggacuucuucgacaucaucuacagcaugcacguggagaccgggcccaacggcgagcagauccgcaagcacgccggccagaagcggaccuacaaggccaucuccgagagcuacgccuuccucccccgcgaggccgucacccgguuccugauguccugcagcgagugccagaagcgcaugcaccugaaccccgacgggacggaccacaaggacaacggcaagccgcccacccucgugaccuccaugaucgacuacaacaugcccaucaccauggcguacaugaagcacaugaagcugcagcugcucaacagccagcaggacgaggacgaguccagcaucgaguccgacgaguucgacaugagcgacuccacgcggaugagcgccgugaacagcgaccuguccagcaaccuggaggagcgcaugcagagcccccagaaccuccacgggcagcaggacgacgacagcgccgccgaguccuucaacggcaacgagacccugggccacagcuccaucgcgagcgggggcacccacucccgggagaugggggacagcaacuccgacggcaagaccgggcuggagcaggacgagcagccgcucaaccugagcgacagcccccuguccgcccagcucacguccgaguaccgcaucgacgaccacaacagcaacggcaagaacaaguacaagaaccugcugaucuccgaccucaagauggagcgggaggcccgcgagaacggcagcaagucccccgcccacagcuacagcuccuacgacagcgggaagaacgaguccgucgaccggggcgccgaggaccugagccugaaccgcggggacgaggacgaggacgaccacgaggaccacgacgacuccgagaaggugaacgagaccgacggcguggaggcggagcggcucaaggccuucaacagccgccccaucccgucccaccugaccagcgccgucgccgaguccauccuggccagcgcgugcgaguccgagagccgcaacgccgccaagcggaugcgccucgagcggcagcaggacgaguccgcccccgccgacaagcagugcaagcccgaggcgacccaggccacguacagcaccuccgccgugcccgggagccaggacgugcuguacaucaacggcaacggcaccuacuccuaccacagcuaccgcgggcugggcgggggccuccugaaccugaacgacgccagcuccagcgggccgaccgaccucuccaugaagcggcagcuggccacgagcuccggcagcuccagcuccagcaacucccgcccccagcugagccccaccgagaucaacgcgguccggcagcucguggccggcuaccgcgaguccgccgccuuccugcugcggagcgcggacgagcucgagaaccugauccugcagcagaacuga

SEQ ID NO: 33687 - RNA, 3441 nt, Artificial Sequence
  derived and/or modified sequence opt1 from NOL6__Homo_sapiens__NP_075068
augggccccgccccggccggggagcagcugcgcggcgcgaccggggagcccgaggugauggagcccgcccucgagggcaccgggaaggagggcaagaaggccagcucccggaagcgcacgcuggccgagcccccggccaagggccugcuccagcccgucaagcugagccgggcggagcuguacaaggagcccaccaacgaggagcucaaccgccugcgggagaccgagauccuguuccacuccagccuccugcgccugcagguggaggagcuccugaaggaggugcggcuguccgagaagaagaaggaccgcaucgacgccuuccuccgggaggucaaccagcgcguggugcggguccccagcgugccggagaccgagcugacggaccaggccuggcugcccgccggggugcgcgucccccuccaccaggugcccuacgcggugaagggcugcuuccgguuccugccgcccgcccaggucaccguggugggguccuaccugcucggcaccugcauccgccccgacaucaacgucgacguggcccugaccaugccccgggagauccugcaggacaaggacgggcucaaccagcgcuacuuccggaagcgcgcccuguaccuggcccaccucgcgcaccaccuggcccaggacccgcuguucggcagcgugugcuucuccuacacgaacggcugccaccucaagcccagccugcugcuccggccccgcgggaaggacgagcggcuggucaccgugcgccugcaccccugcccgccccccgacuucuuccgccccugccggcuccugccgaccaagaacaacgugcgcuccgccugguaccggggccagagccccgccggggacggcucccccgagcccccgaccccccgcuacaacacguggguccugcaggacaccgugcucgagagccaccugcagcugcucuccaccauccugagcuccgcccagggccugaaggacgggguggcgcuccugaaggucuggcugcggcagcgcgagcucgacaagggccaggggggcuucaccggguuccuggugagcaugcuggucguguuccugguguccacgcggaagauccacaccaccaugagcggcuaccagguccuccgcagcgugcugcaguuccuggccaccacggaccucaccgugaacggcaucucccugugccugagcuccgaccccagccucccggcccuggccgacuuccaccaggccuucuccgucguguuccuggacagcuccgggcaccucaaccugugcgcggacgugaccgccagcaccuaccaccagguccagcacgaggcccggcuguccaugaugcuccuggacagccgcgccgacgacggcuuccaccugcuccugaugacgcccaagcccaugauccgggccuucgaccacgugcugcaccuccgcccccugucccggcugcaggcggccugccaccgccucaagcuguggccggagcugcaggacaacgggggcgacuacgugagcgccgcccucgggccccugaccacccugcucgagcagggccugggcgcgcggcugaaccuccuggcccacucccgcccccccgucccggagugggacaucagccaggacccccccaagcacaaggacuccgggacccugacgcucggccugcugcuccggcccgaggggcugaccagcgugcuggagcucggcccggaggccgaccagcccgaggccgccaaguuccgccaguucugggggucccggagcgagcugcgccgcuuccaggacggcgcgauccgggaggccguggucugggaggccgccuccaugagccagaagcgccugaucccccaccagguggugacccaccuccuggcccugcacgcggacauccccgagaccugcguccacuacgugggcgggccgcucgacgcccugauccagggccugaaggagacgagcuccaccggggaggaggcccucguggccgccguccggugcuacgacgaccugagccgccugcucuggggccuggagggccugccccucaccguguccgcggugcagggggcccaccccguccugcgguacaccgagguguuccccccgacgcccgugcgccccgccuucagcuucuacgagacccugcgggagcgcuccagccuccugccccggcuggacaagccgugccccgccuacgucgagcccaugaccguggugugccaccucgagggcuccgggcaguggccgcaggacgcggaggccguccagcgcgugcgggccgccuuccagcugcgccuggccgagcuccugacccagcagcacggccugcagugccgggcgaccgccacgcacaccgacgugcucaaggacggguucgucuuccgcauccggguggccuaccagcgcgagccccagauccugaaggaggugcagagccccgagggcaugaucucccugcgggacaccgccgccagccuccgccuggagcgggacacccgccagcugccccuccugacguccgcgcugcacggccuccagcagcagcacccggccuucagcggggucgcccggcuggccaagcgcugggugcgcgcccagcugcucggcgagggguucgcggacgagucccuggaccugguggccgccgcccucuuccugcaccccgagcccuucacccccccgagcuccccccaggucggcuuccugcgguuccucuuccuggugagcaccuucgacuggaagaacaacccccuguucgugaaccucaacaacgagcugaccgucgaggagcagguggagauccgcuccggguuccuggcggcccgggcccagcuccccgugauggucaucgugacgccgcaggaccgcaagaacagcguguggacccaggacggccccagcgcccagauccugcagcagcuggucgugcucgccgcggaggcccugcccaugcuggagaagcagcugauggacccccggggcccgggggacauccgcaccguguuccggcccccccucgacaucuacgacguccugauccgccuguccccccggcacaucccgcgccaccggcaggccguggacagccccgccgccuccuucugccgcggccuccugagccagcccgggcccuccagccugaugccgguccucggcuacgaccccccccagcuguaccugacccagcuccgggaggcguucggggaccuggcccuguucuucuacgaccagcacggcggcgaggugaucggggugcucuggaagcccacguccuuccagccgcagcccuucaaggccagcuccaccaagggccgcauggucaugagccgggggggcgagcuggugauggugcccaacgucgaggccauccuggaggacuucgccgugcucggggagggccuggugcagaccgucgaggcgcgcuccgagcgguggaccguguga

SEQ ID NO: 33688 - RNA, 3300 nt, Artificial Sequence
  derived and/or modified sequence opt1 from NOL8__Homo_sapiens__NP_001243323
augagcgugcugaacaagaccaaguggaagggcgggacccuccagauccagcuggccaaggaguccuuccugcaccgccucgcccaggagcgggaggcggccaaggccaagaaggaggagagcacgaccggcaacgccaaccugcuggagaagaccgggggcgucgacuuccacaugaaggccgugcccgggaccgaggugccgggccacaagaacugggucguguccaaguucggccgcgugcuccccguccugcaccugaagaaccagcacaagcggaagaucaucaaguacgaccccagcaaguacugccacaaccucaagaagaucggggaggacuucuccaacacgauccccaucagcucccugaccugggagcuggagggcgggaacgacccgaugagcaagaagcgccggggcgaguucuccgacuuccacgggccgcccaagaagaucaucaaggugcagaaggacgagagcuccaccggcagccucgcgauguccacccgcccccggcgcgugaucgagcggccgccccugacgcagcagcaggccgcccagaagcggaccugcgacagcaucacccccuccaagagcucccccguccccgugagcgacacccagaagcugaagaaccuccccuucaagacguccggccuggagaccgccaagaagcgcaacagcaucagcgacgacgacaccgacuccgaggacgagcugcgcaugaugaucgcgaaggaggagaaccuccagcggaccacgcagcccagcaucaacgaguccgagagcgaccccuucgaggugguccgcgacgacuucaaguccggggugcacaagcugcacagccugaucggccucgggaucaagaaccggguguccugccacgacagcgacgacgacaucaugcgcaacgaccgggaguacgacuccggcgacaccgacgagaucaucgccaugaagaagaacgucgccaaggugaagaacagcaccgaguucucccagauggagaaguccaccaagaagacgagcuucaagaaccgcgagaacugcgagcugagcgaccacugcaucaagcugcagaagcggaaguccaacguggagagcgcccucucccacggccucaagagccugaaccgcaaguccccgagccacagcuccagcuccgaggacgccgacagcgcguccgagcucgccgacagcgagggcggggaggaguacaacgccaugaugaagaacugccugcgggucaaccugacccucgccgaccuggagcagcuggccggguccgaccucaaggugcccaacgaggacaccaagagcgacggccccgagaccacgacccagugcaaguucgaccgcggguccaagagccccaagaccccgaccggccugcgccggggccgccagugcauccggcccgcggagaucguggccucccugcucgagggggaggagaacacgugcggcaagcagaagcccaaggagaacaaccugaagcccaaguuccaggccuucaagggggucggcugccuguacgagaaggagagcaugaagaagucccucaaggacagcguggccuccaacaacaaggaccagaacagcaugaagcacgaggacccguccaucaucagcauggaggacgggagccccuacgugaacggcucccugggcgaggucacccccugccagcacgccaagaaggcgaacgggcccaacuacauccagccgcagaagcgccagaccaccuucgagagccaggaccggaaggccgugucccccagcuccagcgagaagcgcuccaagaaccccaucagccggccgcuggagggcaagaagucccucagccuguccgccaagacgcacaacaucggguucgacaaggacagcugccacuccaccaccaagaccgaggccagccaggaggagcgcuccgacagcuccggccugacgagccucaagaagucccccaaggucagcagcaaggacacccgggagaucaagaccgacuucucccugagcaucuccaacagcuccgacgugagcgccaaggacaagcacgcggaggacaacgagaagcgccuggccgcccucgaggcccggcagaaggcgaaggaggugcagaagaagcugguccacaacgcccuggccaaccuggacgggcaccccgaggacaagcccacccacaucaucuucggcuccgacagcgagugcgagaccgaggagacguccacccaggagcagagccacccgggcgaggagugggugaaggaguccauggggaagaccagcggcaagcuguucgacuccagcgacgacgacgaguccgacagcgaggacgacuccaaccgcuucaagaucaagccccaguucgaggggcgggccggccagaagcugauggaccugcagagccacuucggcaccgacgaccgcuuccggauggacucccgcuuccucgagacggacagcgaggaggagcaggaggaggugaacgagaagaagaccgccgaggaggaggagcuggcggaggagaagaagaaggcccugaacgucgugcagagcgugcuccagaucaaccuguccaacagcaccaaccggggguccgucgccgccaagaaguucaaggacaucauccacuacgaccccaccaagcaggaccacgccacguacgagcgcaagcgggacgacaagcccaaggagagcaaggcgaagcgcaagaagaagcgcgaggaggccgagaagcugccggagguguccaaggagauguacuacaacaucgccauggaccucaaggagaucuuccagaccaccaaguacaccagcgagaaggaggagggcacgcccuggaacgaggacugcgggaaggagaagcccgaggagauccaggaccccgccgcccugaccuccgacgcggagcagccgagcggcuucaccuucuccuucuucgacagcgacaccaaggacaucaaggaggagacguaccggguggagaccgucaagcccgggaagaucguguggcaggaggacccccgccugcaggacuccagcuccgaggaggaggacgugaccgaggagaccgaccaccggaacagcucccccggcgaggccagccuccuggagaaggagacgacccgcuucuucuucuucuccaagaacgacgagcggcugcagggcagcgaccucuucuggcgcggggucggcuccaacaugagccggaacagcugggaggcccgcaccaccaaccugcggauggacugccgcaagaagcacaaggacgccaagcggaagaugaagccgaaguga

SEQ ID NO: 33689 - RNA, 2130 nt, Artificial Sequence
  derived and/or modified sequence opt1 from NOLC1__Homo_sapiens__NP_001271317
auggccgacgccggcauccgccgggugguccccagcgaccuguacccgcucgugcugggguuccugcgcgacaaccagcucuccgagguggcgaacaaguucgccaaggccaccggcgccacccagcaggacgccaacgcgagcucccugcuggacaucuacagcuucuggcucaaguccgccaagguccccgagcggaagcugcaggccaacgggcccguggccaagaaggcgaagaagaaggccagcuccagcgacuccgaggacagcuccgaggaggaggaggaggugcaggggcccccggccaagaaggccgccguccccgcgaagcgcguggggcugccgcccggcaaggccgccgccaaggccagcgaguccagcuccagcgaggaguccagcgacgacgacgacgaggaggaccagaagaagcagcccgugcagaagggcgucaagccccaggcgaaggccgccaaggccccgcccaagaaggccaaguccagcgacagcgacuccgacagcuccagcgaggacgagccgcccaagaaccagaagcccaagaucacgcccgugaccgugaaggcgcagaccaaggccccgcccaagcccgcccgggccgcccccaagaucgcgaacgggaaggccgccuccagcuccagcuccagcuccagcuccagcuccagcgacgacuccgaggaggagaaggccgcggccacccccaagaagguguggacgaucaccagcgugcgcgccgagaccgugcccaagaagcaggucguggccaaggcccccgugaaggcggccaccacgcccacccggaaguccagcagcuccgaggacagcuccagcgacgaggaggaggagcagaagaagccgaugaagaacaagcccggccccuacuccagcgugcccccgcccuccgcgcccccgcccaagaagucccucgggacccagccgcccaagaaggccguggagaagcagcagcccguggagagcagcgaggacuccagcgacgaguccgacagcuccagcgaggaggagaagaagccgcccaccaaggccgucguguccaaggccacgaccaagcccccgcccgccaagaaggccgccgagagcagcuccgacagcuccgacagcgacuccagcgaggacgacgaggcccccuccaagcccgcgggcaccaccaagaacagcuccaacaagcccgccgugacgaccaagagccccgccgucaagcccgccgcggcccccaagcagccggucgggggcggccagaagcugcugacccgcaaggccgacuccagcuccagcgaggaggaguccagcuccagcgaggaggagaagaccaagaagauggucgccacgaccaagcccaaggccaccgcgaaggccgcccucucccugcccgccaagcaggcgccccaggggagccgggacagcuccagcgacuccgacagcuccagcuccgaggaggaggaggagaagaccagcaaguccgccgugaagaagaagccgcagaagguggccggcggggccgcccccagcaagcccgccuccgcgaagaagggcaaggccgagagcuccaacagcuccagcuccgacgacagcuccgaggaggaggaggagaagcugaagggcaaggggagcccccgcccgcaggcccccaaggccaacggcacgagcgcgcucaccgcccagaacgggaaggccgccaagaacuccgaggaggaggaggaggagaagaagaaggccgcggucguggugagcaaguccggcagccugaagaagcggaagcagaacgaggccgccaaggaggccgagacgccccaggccaagaagaucaagcugcagaccccgaacaccuuccccaagcgcaagaagggggagaagcgggcguccagccccuuccgccggguccgcgaggaggagaucgagguggacucccggguggccgacaacagcuucgacgccaagcgcggcgccgccggcgacuggggcgagcgggcgaaccagguccucaaguucaccaagggcaaguccuuccgccacgagaagaccaagaagaagcgggggagcuaccgcggcggguccaucagcguccaggugaacuccaucaaguucgacagcgaguga

SEQ ID NO: 33690 - RNA, 2583 nt, Artificial Sequence
  derived and/or modified sequence opt1 from NOM1__Homo_sapiens__NP_612409
auggccgccagccgcuccgcgggcgaggccgggcccggcgggagccagggccgggugguccgcaugaagcggcgcgggggccggggcccgcgccgggggcccgccggcgggggcgagaaggcccugaagcgccucaagcuggccguggaggaguucgugcacgcgaccuccgagggggaggcccccggcggcugcgaggggcggggcgcccccgucagcuuccgccccgggggccggaagucccgcaaggagcugcggaaggagaagcgccaccuccggaaggcccgccggcugcagcgcaccgcgggccccgagcaggggcccggccucgggggccggagcggggccgaggaggccuccggccaccgccaggacacggaggagcgggcccgccccgccccgagccgcgaccccuccccgccccggaagccgcgccccagccgggugaaggcgaaggccaccgccgccaccgccaagacccgccccuccgcggccgccacggccgccgcgcggaagcgcgcccugcuggccgccaacgaggaggaggaccgggagauccgcaagcuggagcggugccucggccugaacaagcgcaagaagaaggacgggagcuccagcgugccccuguccuucgcccgggacggccucgacuacauccugggggcgcuggagagcggcaagaacuccgggcucuacgacagcuccggcgaggaggaggaggacgccggccagacccugccggagagcgaccuggagagcgacucccaggacgagagcgaggaggaggaggagggggacgucgagaaggagaagaaggcccaggaggccgaggcgcaguccgaggacgacgacgaggacaccgaggaggagcagggcgaggagaaggagaagggggcccaggagaagcgccggggcaagcgcgugcgguucgccgaggacgaggagaaguccgagaacagcagcgaggacggggacaucaccgacaagucccucugcggcagcggcgagaaguacaucccgccccacgugcgccaggccgaggagacggucgacuucaagaagaaggaggagcuggagcggcugaagaagcacgugaaggggcuccugaaccgccuguccgagcccaacauggccagcaucuccggccagcucgaggagcuguacauggcgcacagccggaaggacaugaacgacacccugaccuccgcccucaugggggccugcgugaccgccagcgccaugcccucccgccugaugauggagcacguccugcucgugagcauccugcaccacacggugggcaucgaggucggcgcgcacuuccuggaggccguggugcgcaaguucgacgccaucuacaaguacggguccgagggcaaggagugcgacaaccucuucaccgucaucgcccaccuguacaacuuccacguggugcagagccugcucaucuucgacauccugaagaagcugaucgggaccuucaccgagaaggacaucgagcucauccugcugaugcucaagaacgucggcuucucccugcggaaggacgacgcccugagccucaaggagcugaucacggaggcgcagaccaaggccagcggggccggcuccgaguuccaggaccagacccgcauccgguucaugcuggagaccaugcucgcccugaagaacaacgacaugcgcaagauccccggcuacgaccccgagcccguggagaagcugcggaagcugcagcgcgcgcucgugcggaacgccgggagcggcuccgagacgcagcugcgcgucagcugggacuccgugcugagcgccgagcagaccgggcggugguggaucgucggcuccgccuggagcggggccccgaugaucgacaacucccaccacacccaccuccagaagcagcuggugggcaccgugagcuccaagauccuggagcucgcgcgcaagcagcggaugaacacggacauccgccggaacaucuucugcaccaucaugaccagcgaggacuuccuggacgccuucgagaagcugcucaagcugggccugaaggaccagcaggagcgcgagaucauccacguccucauggacugcugccugcaggagaagaccuacaaccccuucuacgccuuccuggccuccaaguucugcgaguacgagcggcgcuuccagaugacguuccaguucagcaucugggacaaguuccgggaccucgagaaccugcccgccaccaacuucuccaaccuggugcaccucguggcgcaccuccugaagaccaagagccugucccugagcauccugaaggucguggaguucagcgagcucgacaagccccgcgugcgguuccugcgcaagguccuguccauccuccugauggagaccgagguggaggaccugagccucaucuucacgcggguguccgacaacccgaagcuggggguccugcgcgagggccucaagcuguucaucagccacuuccugcucaagaacgcccaggcccaccgcuccgccgacgaggccaacgugcugcgggagaaggcggaccuggccaccaagugccuccaggggaaggccagccugcgcauguga

SEQ ID NO: 33691 - RNA, 3669 nt, Artificial Sequence
  derived and/or modified sequence opt1 from NOMO1__Homo_sapiens__NP_055102
augcuggugggccagggggccggcccccucgggccggccgucgugaccgcggccgugguccugcugcucagcggcguggggcccgcccacggcuccgaggacaucguggucggcugcgggggcuucgucaagagcgacguggagaucaacuacucccugaucgagaucaagcuguacaccaagcacgggacgcucaaguaccagaccgacugcgcccccaacaacggcuacuucaugaucccccuguacgacaagggggacuucauccugaagaucgagccgccccucggcuggagcuucgagcccaccaccguggagcugcacguggacggcguguccgacaucugcacgaagggcggggacaucaacuucgucuucaccggguucagcgugaacggcaaggugcuguccaagggccagccccucgggccggccggcguccaggugagccugcgcaacaccgggaccgaggcgaagauccaguccacggugacccagcccggcgggaaguucgccuucuucaagguccugcccggcgacuacgagauccucgccacccaccccaccugggcccugaaggaggcgagcacgaccgugcgggugaccaacuccaacgccaacgccgccagcccgcugaucgucgccggcuacaacguguccgggagcgugcgcuccgacggcgagcccaugaagggggucaaguuccuccuguucagcucccuggugaccaaggaggacguccucggcugcaacgugagccccgugcccggguuccagccgcaggacgagucccuggucuaccugugcuacacggugagccgggaggacggcagcuucuccuucuacagccuccccuccggcggguacaccgugauccccuucuaccgcggcgagcggaucaccuucgacgucgcgcccagccgccuggacuucaccguggagcacgacucccugaagaucgagccgguguuccacgucaugggguucagcgugacgggccgggugcucaacgggcccgagggcgacggcguccccgaggccguggugacccugaacaaccagaucaaggucaagaccaaggccgacggguccuuccgccuggagaacaucaccacgggcaccuacaccauccacgcccagaaggagcaccucuacuucgagaccgugacgaucaagaucgcccccaacaccccgcagcuggcggacaucaucgccaccggguucagcgugugcggccagaucuccaucauccgguuccccgacaccgucaagcagaugaacaaguacaagguggugcugagcucccaggacaaggacaagagccucgucacgguggagaccgacgcccacggcuccuucugcuucaaggccaagcccgggaccuacaaggugcaggucauggugcccgaggccgagacccgcgcgggccugacgcugaagccgcagaccuucccccucaccgugaccaaccggcccaugauggacgucgccuucgugcaguuccuggccagcguguccgggaaggucagcugccuggacacgugcggcgaccuccuggugacccugcagucccucagccgccagggggagaagcggucccugcagcugagcggcaaggugaacgccaugaccuucaccuucgacaacguccucccgggcaaguacaagaucagcaucaugcacgaggacuggugcuggaagaacaagucccuggagguggaggugcuggaggacgacaugagcgccgucgaguuccgccagaccggguacaugcuccggugcucccugagccacgcgaucacgcuggaguucuaccaggacggcaacgggcgcgagaacgugggcaucuacaaccuguccaagggggugaaccgguucugccucagcaagcccggcgucuacaaggugacgccccgcuccugccaccgguucgagcaggccuucuacaccuacgacaccagcucccccagcauccugacccugaccgccauccgccaccacgugcucggcaccaucaccacggacaagaugauggacgucaccgugaccaucaaguccagcaucgacuccgagccggcccuggugcuggggccccucaagagcguccaggagcugcggcgcgagcagcagcuggcggagaucgaggcccgccggcaggagcgcgagaagaacggcaacgaggagggggaggagcggaugaccaagccgcccgugcaggagaugguggacgagcuccagggccccuucuccuacgacuucagcuacugggcccgcuccggggagaagaucacggucacccccagcagcaaggagcugcuguucuacccgcccuccauggaggccguggugagcggcgaguccugccccggcaagcucaucgagauccacgggaaggccggccuguuccuggaggggcagauccaccccgagcucgagggcgucgagaucgugaucagcgagaagggggcguccagcccccugaucaccgucuucaccgacgacaagggcgccuacuccgugggcccccugcacagcgaccucgaguacacggugaccucccagaaggagggguacguccugaccgccguggagggcaccaucggggacuucaaggccuacgcccuggcgggcgugagcuucgagaucaaggccgaggacgaccagccgcuccccggcguccugcugucccucagcgggggccuguuccgguccaaccugcucacgcaggacaacgggauccugaccuucagcaaccugucccccggccaguacuacuucaagcccaugaugaaggaguuccgcuucgagccgagcucccagaugaucgaggugcaggaggggcagaaccucaagaucaccaucaccggcuaccggacggccuacagcugcuacggcaccguguccagccugaacggggagcccgagcagggcgucgccauggaggccguggggcagaacgacugcagcaucuacggcgaggacaccgugaccgacgaggaggggaaguuccgccugcggggccuccugcccggcugcgucuaccacgugcagcugaaggcggaggggaacgaccacaucgagcgcgcccucccccaccaccgggugaucgaggucggcaacaacgacaucgacgacgugaacaucaucguguuccgccagaucaaccaguucgaccuguccgggaacgucaucacgagcuccgaguaccugccgacccucugggugaagcuguacaagagcgagaaccuggacaaccccauccagaccgugucccucggccagagccuguucuuccacuucccgccccugcuccgggacggggagaacuacgucgugcugcuggacuccacccucccccgcagccaguacgacuacauccugccccagguguccuucacggccgucggcuaccacaagcacaucacccugaucuucaaccccacccggaagcucccggagcaggacaucgcccagggcagcuacaucgcgcugccccugacccuccuggugcugcucgccggguacaaccacgacaagcugaucccccugcuccugcagcugaccucccgccuccagggcgugcgggcccuggggcaggccgccagcgacaacuccggccccgaggacgcgaagcgccaggccaagaagcagaagacgcggcgcaccuga

SEQ ID NO: 33692 - RNA, 1416 nt, Artificial Sequence
  derived and/or modified sequence opt1 from NONO__Homo_sapiens__NP_001138881
augcagagcaacaagaccuucaaccuggagaagcagaaccacaccccccgcaagcaccaccagcaccaccaccagcagcagcaccaccagcagcagcagcagcagccgcccccccccccgauccccgccaacggccagcaggccuccagccagaacgaggggcucacgaucgaccugaagaacuuccggaagcccggcgagaagaccuucacccagcgcucccggcuguucguggggaaccuccccccggacaucaccgaggaggagaugcgcaagcuguucgagaaguacggcaaggcgggggaggucuucauccacaaggacaagggcuucggcuucauccggcuggagacgcgcacccucgccgagaucgccaagguggagcuggacaacaugccccugcgggggaagcagcuccgcgugcgguucgccugccacagcgccucccugaccguccgcaaccugccccaguacgugagcaacgagcuccuggaggaggcguucuccguguucggccaggucgagcgggccguggugaucgucgacgaccgcgggcggcccagcggcaaggggaucguggaguucuccggcaagccggccgcccgcaaggcgcuggaccggugcagcgagggcuccuuccuccugaccacguucccccgccccgugaccgucgagcccauggaccagcuggacgacgaggaggggcucccggagaagcuggugaucaagaaccagcaguuccacaaggagcgggagcagcccccccgcuucgcccagcccggcagcuucgaguacgaguacgccaugcgguggaaggcccugaucgagauggagaagcagcagcaggaccagguggaccgcaacaucaaggaggcccgggagaagcucgagauggagauggaggcggcccgccacgagcaccaggucaugcugaugcgccaggaccugaugcggcgccaggaggagcuccggcgcauggaggagcugcacaaccaggaggugcagaagcggaagcagcuggagcuccgccaggaggaggagcggcgccggcgcgaggaggagaugcggcgccagcaggaggagaugaugcggcgccagcaggagggguucaagggcaccuucccggacgcccgggagcaggagauccgcaugggccagauggccauggggggcgccauggggaucaacaaccggggcgcgaugccccccgcccccgugccggccgggacccccgccccccccggcccggccacgaugaugcccgacggcacccuggggcugacccccccgaccacggagcgcuucggccaggcggccaccauggaggggaucggcgccaucgggggcaccccccccgccuucaaccgggccgcgcccggcgccgaguucgccccgaacaagcgccgccgguacuga

SEQ ID NO: 33693 - RNA, 195 nt, Artificial Sequence
  derived and/or modified sequence opt1 from NOP10__Homo_sapiens__NP_061118
auguuccugcaguacuaccucaacgagcagggcgaccgcguguacacccugaagaaguucgaccccauggggcagcagaccugcagcgcccacccggcccgguucucccccgacgacaaguacagccgccaccggaucacgaucaagaagcgcuucaagguccugaugacccagcagccccggcccgugcucuga

SEQ ID NO: 33694 - RNA, 2421 nt, Artificial Sequence
  derived and/or modified sequence opt1 from NOP14__Homo_sapiens__NP_001278908
auggccaaggccaagaaggugggcgcgcgccggaaggccagcggggcccccgccggcgcccgcgggggcccggcgaaggccaacuccaaccccuucgaggucaaggugaaccggcagaaguuccagauccuggggcgcaagacccggcacgacgugggccuccccggcgucagccgcgcccgggcccugcgcaagcggacccagacgcugcucaaggaguacaaggagcgcgacaaguccaacguguuccgggacaagcgcuucggggaguacaacagcaacaugucccccgaggagaagaugaugaagcgguucgcgcuggagcagcagcgccaccacgagaagaaguccaucuacaaccugaacgaggacgaggagcucacccacuacggccagagccuggccgacaucgagaagcacaacgacaucguggacagcgacuccgacgccgaggaccgggggacccugagcgccgagcucaccgccgcgcacuucggcgggggcggcgggcugcugcacaagaagacgcagcaggagggcgaggagcgcgagaagccgaagucccggaaggagcucaucgaggagcugaucgccaagagcaagcaggagaagcgcgagcggcaggcccagcgcgaggacgcccuggagcucaccgagaagcuggaccaggacuggaaggagauccagacccugcucucccacaagacccccaagagcgagaaccgggacaagaaggagaagcccaagcccgacgccuacgacaugaugguccgcgagcugggguucgagaugaaggcgcagccguccaaccgcaugaagacggaggccgagcuggccaaggaggagcaggagcaccuccggaagcuggaggccgagcgccugcggcgcaugcucggcaaggacgaggacgagaacgugaagaagcccaagcacaugagcgccgacgaccugaacgacggcuucgugcuggacaaggacgaccggcgccuccuguccuacaaggacgggaagaugaacgucgaggaggacgugcaggaggagcagagcaaggaggcguccgaccccgagagcaacgaggaggagggcgacagcuccgggggcgaggacaccgaggagagcgacucccccgacagccaccuggaccucgaguccaacguggagagcgaggaggagaacgagaagccggccaaggagcagcggcagacccccgggaagggccugaucuccggcaaggagcgcgccgggaaggccacccgggacgagcugcccuacacguucgccgcgcccgagagcuacgaggagcuccgcucccugcugcucggccggagcauggaggagcagcugcuggucguggagcgcauccagaagugcaaccacccgucccucgccgaggggaacaaggccaagcuggagaagcuguucggcuuccuccuggaguacgugggggaccuggccaccgacgacccgcccgaccucaccgucaucgacaagcugguggugcaccuguaccaccucugccagauguuccccgagagcgcguccgacgccaucaaguucguccugcgggacgccaugcacgagauggaggagaugaucgagaccaagggccgcgccgcccugcccggccuggacgugcucaucuaccugaagaucacggggcuccucuuccccaccagcgacuucuggcaccccguggucacccccgcgcuggugugccugucccagcuccugaccaagugcccgauccugagccuccaggacguggucaagggccuguucgugugcugccuguuccucgaguacgucgcccugucccagcgguucauccccgagcugaucaacuuccuccuggggauccuguacaucgccacgcccaacaaggccagccagggcuccacccucgugcaccccuuccgcgcccuggggaagaacagcgagcugcucguggucagcgcgcgggaggacguggccaccuggcagcaguccagccugucccugcgcugggccagccggcuccgcgccccgaccuccacggaggccaaccacauccgccugagcugccuggcggugggccucgcccugcugaagcggugcguccucauguacggcucccugcccagcuuccacgccaucauggggccccugcaggcccuccugaccgaccaccuggcggacugcucccacccgcaggagcuccaggagcugugccagagcacccugaccgagauggagucccagaagcagcucugccgcccccugacgugcgagaaguccaagcccgugccccugaagcuguucaccccgcggcuggugagcaacagccgcccccaggucauccaccuccccuggcccccgaacuaccggugcgagccccagcaccccgccaagaaggugaucuucuuccgcgugaucaugcuguga

SEQ ID NO: 33695 - RNA, 699 nt, Artificial Sequence
  derived and/or modified sequence opt1 from NOP16__Homo_sapiens__NP_001243468
augcccaaggccaagggcaagacccgccggcagaaguucggguacagcgugaaccgcaagcggcugaaccgcaacgcccggcgcaaggcggccccgcggaucgagugcucccacauccgccacgccugggaccacgccaagagcguccggcagaaccucgccgagaugggccuggcgguggaccccaaccgcgccgugccccugcggaagcgcaaggucaaggccauggagguggacaucgaggagcggcccaaggagcucgugcgcaagccguacguccugaacgaccuggaggccgaggcgucccuccccgagaagaaggggaacacccugagccgggaccugaucgacuacgugcgcuacaugguggagaaccacggcgaggacuacaagcaguccgggaagacgagcuccauccucugccggcgcggccgguggcgcuggagcgacugguucaccucccagcugccccaggccgaggccagccccggcccggucaagcuggagcccgggugcaaggcccggcgcugcugcguggcccccgaggagcucgcgcgcucccacggcauccggcgccugcacacccacgugcacacgccccggagcggggagggcaccguccugcgcggguccaaccucuacagcuccggcggcagccggaagucccagaaccugcuguucagcgggugggugauguga

SEQ ID NO: 33696 - RNA, 2427 nt, Artificial Sequence
  derived and/or modified sequence opt1 from NOP2__Homo_sapiens__NP_001028886
augggccgcaagcuggaccccaccaaggagaagcgggggccgggccgcaaggcccggaagcagaagggggccgagaccgagcucgugcgcuuccugcccgcggucagcgacgagaacuccaagcggcugagcucccgcgcccggaagcgcgccgccaagcggcgccucggcagcguggaggcccccaagacgaacaagucccccgaggcgaagccgcugcccgggaagcugcccaagggcgccgugcagaccgccggcaagaaggggccccagagccucuucaacgccccgcggggcaagaagcgccccgcgcccggguccgacgaggaggaggaggaggaggacagcgaggaggacggcauggucaaccacggggaccuguggggcuccgaggacgacgccgacaccguggacgacuacggcgccgacagcaacuccgaggacgaggaggagggggaggcccugcuccccaucgagcgggccgcgcgcaagcagaaggcccgggaggccgccgccggcauccaguggagcgaggaggagaccgaggacgaggaggaggagaaggaggugacgccggaguccgggccgcccaaggucgaggaggcggacggcggccugcagaucaacguggacgaggagcccuucgugcugccgcccgccggggagauggagcaggacgcccaggcccccgaccuccagcgcguccacaagcggauccaggacaucgugggcauccugcgcgacuucggggcccagcgggaggagggccgcagccgguccgaguaccugaaccgccucaagaaggaccuggcgaucuacuacagcuacggggacuuccugcucggcaagcugauggaccuguucccccucuccgagcugguggaguuccuggaggccaacgaggucccccgccccgugacccuccggaccaacacccugaagacgcgccggcgcgaccuggcccaggcccucaucaaccggggcgugaaccuggacccccuggggaaguggagcaagaccggccucgucguguacgacuccagcgugcccaucggggccaccccggaguaccuggcgggccacuacaugcugcagggggccagcuccaugcuccccgucauggcccuggcgccccaggagcacgagcgcauccuggacaugugcugcgcccccggcggcaagaccagcuacauggcccagcucaugaagaacacgggggugauccuggccaacgacgccaacgccgagcggcugaaguccguggucggcaaccuccaccgccugggggugaccaacaccaucaucagccacuacgacggccggcaguucccgaagguggucgggggcuucgaccgcgugcugcucgacgcgcccugcuccggcaccggggucaucagcaaggaccccgccgugaagacgaacaaggacgagaaggacauccugcggugcgcccaccuccagaaggagcugcugcuguccgccaucgacagcgugaacgccaccuccaagaccggcggguaccucgucuacugcacgugcagcaucaccguggaggagaacgaguggguggucgacuacgcgcugaagaagcgcaacgugcggcuggugccgaccggccuggacuucggccaggagggguucacccgcuuccgggagcgccgguuccaccccucccuccgcagcacccggcgcuucuacccccacacgcacaacauggacggcuucuucaucgccaaguucaagaaguucuccaacagcaucccccagucccagaccgggaacagcgagaccgccaccccgacgaacgucgaccugccccaggugauccccaaguccgagaacagcucccagcccgccaagaaggccaagggcgcggccaagaccaagcagcagcugcagaagcagcagcacccgaagaaggccagcuuccagaagcucaacgggaucagcaagggcgccgacuccgagcugagcaccgugcccuccgucaccaagacgcaggcgagcuccagcuuccaggacuccagccagcccgccggcaaggccgaggggauccgcgagcccaaggugaccggcaagcugaagcagcgguccccgaagcuccagagcuccaagaagguggccuuccugcgccagaacgccccgcccaaggggaccgacacccagacgcccgcgguccugagccccuccaagacccaggccacccucaagcccaaggaccaccaccagccccugggccgggccaaggggguggagaagcagcagcugcccgagcagccguucgagaaggccgccuuccagaagcagaacgacacccccaagggcccccagcccccgaccgugagccccauccgcuccagccggcccccgcccgcgaagcgcaagaagucccagagccggggcaacagccagcuccugcuguccuga

SEQ ID NO: 33697 - RNA, 1785 nt, Artificial Sequence
  derived and/or modified sequence opt1 from NOP56__Homo_sapiens__NP_006383
auggugcugcuccacguccuguucgagcacgccgugggcuacgcccugcucgcgcugaaggagguggaggagaucagccugcuccagccccaggucgaggaguccgugcugaaccuggggaaguuccacagcaucgugcgccucgucgccuucugcccguucgccuccagccagguggcccuggagaacgccaacgcgguguccgagggcgucgugcacgaggaccugcggcuccugcuggagacccaccuccccagcaagaagaagaaggugcugcugggggucggcgaccccaagaucggggccgccauccaggaggagcucggcuacaacugccagaccggcggggugaucgccgagauccugcgcggcgugcggcugcacuuccacaaccucgucaaggggcugacggaccuguccgcgugcaaggcccagcucggccuggggcacagcuacucccgcgccaaggugaaguucaacgugaaccgggucgacaacaugaucauccagagcaucucccugcucgaccagcuggacaaggacaucaacaccuucagcaugcgcgugcgggagugguacggcuaccacuuccccgagcuggugaagaucaucaacgacaacgccaccuacugccgccucgcccaguucaucggcaaccggcgcgagcugaacgaggacaagcuggagaagcucgaggagcugaccauggacggggcgaaggccaaggccauccuggacgccucccggagcuccaugggcauggacaucagcgccaucgaccucaucaacaucgaguccuucagcucccgcgucgugagccugagcgaguaccggcagucccugcacacguaccuccgcagcaagaugucccagguggcgccgagccuguccgcccugaucggggaggccgucggcgcccggcucaucgcccacgcgggcagccugaccaaccuggccaaguaccccgccuccaccgugcagauccucggggccgagaaggcccuguuccgcgcgcugaagacccggggcaacacgcccaaguacgggcucaucuuccacagcaccuucaucggccgcgccgccgccaagaacaaggggcggaucucccgcuaccuggcgaacaagugcagcaucgccucccggaucgacugcuucagcgagguccccaccuccguguucggcgagaagcugcgcgagcaggucgaggagcgccugagcuucuacgagaccggcgagaucccgcggaagaaccucgacgugaugaaggaggccauggugcaggccgaggaggccgcggccgagaucacgcgcaagcuggagaagcaggagaagaagcggcugaagaaggagaagaagcgccucgccgcccuggcccuggcguccagcgagaacuccagcuccacccccgaggagugcgaggagaugagcgagaagcccaagaagaagaagaagcagaagccccaggaggugccgcaggagaacgggauggaggaccccagcaucuccuucagcaagcccaagaagaagaaguccuucagcaaggaggagcucauguccagcgaccuggaggagaccgccggcuccaccagcauccccaagcggaagaaguccacgccgaaggaggagaccgucaacgaccccgaggaggccgggcaccgcagcggcuccaagaagaagcggaaguucagcaaggaggagcccguguccagcgggcccgaggaggccgugggcaaguccagcuccaagaagaagaagaaguuccacaaggccagccaggaggacuga

SEQ ID NO: 33698 - RNA, 1911 nt, Artificial Sequence
  derived and/or modified sequence opt1 from NOP9__Homo_sapiens__NP_777573
augggccaggggccccgcagcccgcacaaggugggccggcgcuuccccgccgggggcaagcgggggcgcggcgccaagggcuccgggcggccccugcccggccgcaagcggcagccguggcccccgcccgacgggcgcagcgagcccgcgcccgacucccacccccaccucagccccgaggcccugggcuacuuccggcgcgcccuguccgcccucaaggaggccccggagaccggggaggagcgggaccugaugguccacaacaucaugaaggagguggagacccaggcgcuggcccucagcacgaaccgcaccggcuccgagaugcugcaggagcugcucggcuucagcccccugaagccccugugccgggugugggccgcccuccgcuccaaccugcggaccgucgcgugccaccgcugcggggugcacgugcugcagagcgcccuccugcagcugccccggcuccugggcuccgccgccgaggaggaggaggaggaggaggaggacgggaaggacggcccgaccgagacgcuggaggagcucguccugggccuggccgcggaggugugcgacgacuuccucguguacugcggggacacccacggcagcuucgucgugcgcacccugcugcagguccucgggggcaccauccuggaguccgagcgggcccgcccccgggggagccaguccagcgaggcccagaagacgcccgcccaggagugcaagcccgccgacuucgaggugccggagaccuuccugaaccgccuccaggaccuguccagcuccuuccugaaggacaucgcgguguucaucaccgacaagaucagcagcuucugccuccagguggcccugcagguccugcaccgcaagcucccccaguucugcgcccaccugugcaacgccgugaucggcuaccuguccacccggggcagcuccguggacgggagcccccuccugcuguuccuccgcgaccagacguccagccggcugcuggagcagguccuccuggugcuggagcccccgcgccuccagucccuguucgaggagcaccuccagggccagcugcagacccuggccgcgcaccccaucgccaacuucccccugcagcggcugcucgacgccgugaccacccccgagcugcugagcccggucuucgaggagcucucccccgugcuggaggccgugcuggcccaggggcaccccggcgucgugaucgcgcucgucggggccugccgccgggugggcgccuaccaggccaaggugcugcagcugcuccuggaggcguuccacugcgccgagccgagcucccgccaggucgccugcgugccccuguucgccacgcucauggccuacgagguguacuacggccugaccgaggaggagggggcgguccccgccgagcaccagguggccauggccgccgcgcgggcccugggcgacgugaccguccucgggagccugcugcuccagcaccuccugcacuucuccacccccggccuggugcugcgcagccugggggcccucacgggcccgcagcugcugucccucgcccagagccccgccggcucccacgugcuggacgcgauccugaccagccccuccgucacccggaagcuccgccggcgcgugcugcagaaccugaaggggcaguacguggcccucgccugcagccggcacggcagccgcguccuggacgccaucugguccggggcggcccugcgggcccgcaaggagaucgccgccgagcucggcgagcagaaccaggagcugauccgggaccccuucggccaccacguggcgcgcaacguggcccugaccacguuccucaagcgccgggaggccugggagcagcagcagggggccgucgccaagcgccggcgcgcgcugaacagcauccuggaggacuga

SEQ ID NO: 33699 - RNA, 636 nt, Artificial Sequence
  derived and/or modified sequence opt1 from NOS1AP__Homo_sapiens__NP_001119532
augagccuguccagccucugccccguguucuccgccgccgcgagcucccugcagguccaccuccugaaggaccagcuggccgccgaggccgccgcgcgccuggaggcccaggcccgggugcaccagcuccugcugcagaacaaggacaugcuccagcacaucagccugcuggugaagcagguccaggagcucgagcugaagcuguccggccagaacgccauggggagccaggacucccuccuggagaucaccuuccgcagcggcgcgcugcccgugcucugcgaccccaccacgcccaagcccgaggaccugcacuccccgccccugggggccggccucgccgacuucgcccaccccgccgggagcccccugggccggcgcgacugccuggugaagcucgagugcuuccgguuccugccgcccgaggacaccccgccgcccgcgcagggcgaggcccugcucgggggccuggagcugaucaaguuccgcgaguccgggaucgccagcgaguacgaguccaacaccgacgagagcgaggagcgggacuccuggagccaggaggagcucccccgccugcugaacguccuccagcggcaggagcugggcgacgggcuggacgacgagaucgccguguga

SEQ ID NO: 33700 - RNA, 4305 nt, Artificial Sequence
  derived and/or modified sequence opt1 from NOS1__Homo_sapiens__NP_000611
auggaggaccacauguucggcgugcagcagauccagcccaacgucaucagcgugcgccuguucaagcggaagguggggggccucggguuccuggucaaggagcgcguguccaagccgcccgugaucaucagcgaccugauccggggcggggccgccgagcaguccggccucauccaggcgggcgacaucauccuggccgucaacgggcgcccccugguggaccucagcuacgacuccgcccuggaggugcugcggggcaucgccagcgagacccacgucgugcucauccugcgcgggcccgagggcuucaccacgcaccuggagaccaccuucaccggggacggcacgccgaagaccauccgggugacccagccccucggcccccccaccaaggccgucgaccugucccaccagccgcccgcggggaaggagcagccccuggccguggacggcgccagcgggcccggcaacggcccgcagcacgccuacgacgacgggcaggaggcgggcucccucccccacgccaacgggcuggccccccgccccccgggccaggaccccgccaagaaggccacgcgggugagccugcaggggcgcggcgagaacaacgagcuccugaaggagaucgagcccguccugucccuccugaccagcggcucccggggggugaagggcggggcgcccgccaaggccgagaugaaggacaugggcauccagguggaccgcgaccuggacgggaagagccacaagccgcucccccugggcgucgagaacgaccggguguucaacgaccuguggggcaaggggaacgugcccgucgugcucaacaaccccuacuccgagaaggagcagccgcccaccagcggcaagcagucccccaccaagaacgggagccccuccaagugcccgcgcuuccugaaggugaagaacugggagacggaggucgugcugaccgacacccuccaccugaagagcacccuggagacgggcugcaccgaguacaucugcauggggagcaucaugcaccccucccagcacgcccggcgccccgaggacguccggaccaagggccagcucuucccgcuggccaaggaguucaucgaccaguacuacagcuccaucaagcgcuucggcagcaaggcgcacauggagcggcuggaggaggugaacaaggagaucgacaccacguccaccuaccagcucaaggacaccgagcugaucuacggggccaagcacgccuggcgcaacgccagccggugcgugggccgcauccagugguccaagcugcaggucuucgacgcccgcgacugcaccacggcgcacgggauguucaacuacaucugcaaccacgugaaguacgccaccaacaagggcaaccuccggagcgccaucaccaucuucccccagcgcaccgacggcaagcacgacuuccggguguggaacucccagcugauccgcuacgccggguacaagcagcccgacggcagcacgcugggggaccccgccaacguccaguucaccgagaucugcauccagcagggcuggaagccgccccgggggcgcuucgacgugcucccccugcugcuccaggcgaacggcaacgaccccgagcuguuccagaucccgcccgagcuggugcucgagguccccauccggcaccccaaguucgagugguucaaggaccugggccugaagugguacgggcugccggccguguccaacaugcuccuggagaucggcgggcuggaguucagcgccugccccuucuccggcugguacauggggaccgagaucggcgugcgcgacuacugcgacaacagccgguacaacauccucgaggaggucgccaagaagaugaaccuggacaugcgcaagaccuccagccuguggaaggaccaggcgcucguggagaucaacaucgccgugcuguacuccuuccagagcgacaaggucacgaucguggaccaccacuccgccaccgagagcuucaucaagcacauggagaacgaguaccggugccgcggcgggugccccgccgacuggguguggaucguccccccgaugagcggcuccaucacccccguguuccaccaggagaugcugaacuaccggcucacccccagcuucgaguaccagcccgacccguggaacacgcacguguggaaggggaccaacggcacccccaccaagcgccgggccaucggguucaagaagcuggcggaggccgucaaguucuccgccaagcugaugggccaggccauggccaagcgcgugaaggcgaccauccucuacgccacggagaccggcaagagccaggccuacgccaagacccugugcgagaucuucaagcacgccuucgacgcgaaggugauguccauggaggaguacgacaucguccaccuggagcacgagacccucgugcugguggucacgagcaccuucgggaacggcgacccccccgagaacggggagaaguucggcugcgcccugauggagaugcggcacccgaacuccgugcaggaggagcgcaagagcuacaaggugcgguucaacuccgucagcuccuacagcgacucccagaagagcuccggggacggccccgaccuccgcgacaacuucgagagcgccggcccccuggccaacgugcgcuucuccguguucgggcugggcagccgggcguacccgcacuucugcgccuucgggcacgccgucgacacccuccuggaggagcugggcggcgagcgcauccucaagaugcgggagggggacgagcugugcggccaggaggaggccuuccgcaccugggccaagaagguguucaaggcggccugcgacguguucugcgucggggacgacgugaacaucgagaaggccaacaacagccugaucuccaacgaccggagcuggaagcgcaacaaguuccggcucacguucguggccgaggcccccgagcugacccagggccuguccaacguccacaagaagcgcgugagcgcggcccggcuccugucccgccagaaccugcagagccccaaguccagccgguccaccaucuucgugcgccuccacaccaacgggagccaggagcugcaguaccagcccggcgaccaccugggcgucuucccggggaaccacgaggaccucgugaacgcccugaucgagcggcuggaggacgccccccccgugaaccagauggucaagguggagcuccuggaggagcgcaacacggcccugggcgugaucuccaacuggaccgacgagcuccggcugcccccgugcaccaucuuccaggcguucaaguacuaccuggacaucaccacgccccccaccccccuccagcugcagcaguucgccagccuggccaccuccgagaaggagaagcagcgccuccugguccugagcaaggggcuccaggaguacgaggaguggaaguggggcaagaacccgaccaucguggaggugcuggaggaguuccccuccauccagaugcccgccacgcugcuccugacccagcugagccuccugcagccccgguacuacuccaucagcuccagcccggacauguaccccgacgagguccaccugaccguggcgaucgucagcuaccgcacccgggacggggagggccccauccaccacggcgugugcuccagcuggcucaaccgcauccaggccgacgagcuggugcccugcuucguccggggggccccguccuuccaccugccccgcaacccccaggugcccugcauccucgugggcccggggacgggcaucgcccccuuccgcagcuucuggcagcagcggcaguucgacauccagcacaaggggaugaaccccugccccaugguccugguguucggcugccgccaguccaagaucgaccacaucuaccgggaggagacccugcaggccaagaacaagggcguguuccgcgagcucuacaccgcguacagccgggagccggacaagcccaagaaguacguccaggacauccugcaggagcagcuggccgaguccguguaccgcgcccucaaggagcaggggggccacaucuacgugugcggggacgucaccauggccgccgacgugcugaaggcgauccagcggaucaugacgcagcagggcaagcugagcgccgaggacgccggcguguucaucucccgcaugcgggacgacaaccgcuaccacgaggacaucuucggggucacccuccggaccuacgaggugaccaaccgccugcggagcgaguccaucgccuucaucgaggagagcaagaaggacacggacgagguguucuccagcuga

SEQ ID NO: 33701 - RNA, 3462 nt, Artificial Sequence
  derived and/or modified sequence opt1 from NOS2__Homo_sapiens__NP_000616
auggccugccccuggaaguuccuguucaagaccaaguuccaccaguacgccaugaacggcgagaaggacaucaacaacaacguggagaaggcgccgugcgccaccagcucccccgucacgcaggacgaccuccaguaccacaaccugagcaagcagcagaacgagagcccccagccccugguggagaccgggaagaaguccccggagucccucgugaagcuggacgccacgccccuguccagcccccgccacguccggaucaagaacuggggcuccgggaugaccuuccaggacacccuccaccacaaggccaagggcauccugaccugccgcuccaagagcugccugggguccaucaugacccccaagagccucacccggggcccgcgcgacaagcccacgccgcccgacgagcugcugccccaggccaucgaguucgugaaccaguacuacggcuccuucaaggaggcgaagaucgaggagcaccucgcccggguggaggccgucaccaaggagaucgagaccaccgggacguaccagcugaccggcgacgagcugaucuucgccaccaagcaggcguggcgcaacgcgccccggugcaucgggcgcauccaguggagcaaccuccagguguucgacgcccgguccugcagcaccgcccgcgagauguucgagcacaucugccggcacgugcgcuacuccacgaacaacggcaacauccggagcgccaucaccgucuucccccagcgcuccgacgggaagcacgacuuccggguguggaacgcccagcugauccgcuacgccggcuaccagaugcccgacggcagcauccgcggggacccggccaacguggaguucacccagcugugcaucgaccucggcuggaagcccaaguacgggcgguucgacgucgugccccuggugcugcaggccaacggccgggaccccgagcuguucgagaucccgcccgaccugguccuggagguggccauggagcaccccaaguacgagugguuccgcgagcucgagcugaagugguacgcgcugcccgccguggccaacaugcuccuggaggucggcgggcuggaguucccgggcugccccuucaacgggugguacaugggcaccgagaucggggugcgggacuucugcgacgugcagcgcuacaacauccucgaggaggucggccgccggaugggccucgagacgcacaagcuggccagccucuggaaggaccaggccgugguggagaucaacaucgcgguccugcacagcuuccagaagcagaacgugaccaucauggaccaccacagcgccgccgaguccuucaugaaguacaugcagaacgaguaccgcagccgcgggggcugccccgccgacuggaucuggcuggugcccccgauguccgggagcaucacccccgucuuccaccaggagaugcucaacuacgugcugucccccuucuacuacuaccaggucgaggccuggaagacccacguguggcaggacgagaagcggcggccgaagcgccgggagaucccccugaaggugcucgucaaggcggugcuguucgccugcaugcugaugcgcaagacgauggccagccgggugcgcgucaccauccucuucgccaccgagaccggcaaguccgaggcgcuggccugggaccugggggcccucuucagcugcgccuucaaccccaagguggugugcauggacaaguaccggcuguccugccuggaggaggagcgccuccugcuggucgugacgagcaccuucggcaacggcgacugccccgggaacggcgagaagcugaagaagucccucuucaugcugaaggagcugaacaacaaguuccgguacgccguguucgggcucggcagcuccauguacccgcgcuucugcgcguucgcccacgacaucgaccagaagcugagccaccugggggccucccagcucacccccaugggcgagggcgacgagcugagcgggcaggaggacgccuuccgguccugggccguccagaccuucaaggcggccugcgagacguucgacgugcgcggcaagcagcacauccagauccccaagcuguacaccagcaacgugaccugggacccccaccacuaccggcucguccaggacagccagccgcuggaccuguccaaggcccucagcuccaugcacgccaagaacguguucaccaugcgccugaagucccggcagaaccugcagagccccacgagcucccgcgccaccauccucguggagcugagcugcgaggacgggcagggccugaacuaccuccccggcgagcaccugggggucugccccggcaaccagccggcgcuggugcaggggauccucgagcgcguggucgacggccccacgccccaccagaccgugcggcuggaggcccuggacgaguccgggagcuacuggguguccgacaagcgccugcccccgugcagccucucccaggcccugaccuacuuccucgacaucaccaccccgcccacccagcugcugcuccagaagcuggcccaggucgcgaccgaggagcccgagcggcagcgccuggaggcccucugccagcccagcgaguacuccaaguggaaguucacgaacagccccaccuuccuggaggugcuggaggaguuccccucccuccgggugagcgccggcuuccugcugagccagcuccccauccugaagccgcgcuucuacuccaucagcuccagccgggaccacacccccaccgagauccaccugacggucgccguggugaccuaccacacccgcgacggccaggggccccuccaccacggcgucugcuccaccuggcugaacagccugaagccgcaggaccccgugcccugcuucgugcggaacgccuccggguuccaccuccccgaggacccgagccaccccugcauccugaucggccccgggacgggcaucgcgcccuuccgcuccuucuggcagcagcggcugcacgacagccagcacaagggcguccgcgggggccggaugacccucguguucgggugccgccggccggacgaggaccacaucuaccaggaggagaugcuggagauggcccagaagggcgugcugcacgccguccacaccgccuacucccgccuccccgggaagcccaagguguacgugcaggacauccugcggcagcagcuggccagcgagguccuccgcgugcugcacaaggagcccggccaccuguacgugugcggcgacguccggauggcgcgcgacguggcccacacccucaagcagcugguggccgccaagcugaagcucaacgaggagcaggucgaggacuacuucuuccagcugaagucccagaagcgguaccacgaggacaucuucggggccguguucccguacgaggcgaagaaggaccgcguggccguccagcccagcucccuggagaugagcgcccucuga

SEQ ID NO: 33702 - RNA, 3612 nt, Artificial Sequence
  derived and/or modified sequence opt1 from NOS3__Homo_sapiens__NP_000594
augggcaaccucaagagcguggcccaggagcccgggccgcccugcggccucgggcugggccuggggcucggccugugcggcaagcaggggcccgccacccccgcgccggagcccucccgcgcccccgccagccugcugcccccggcccccgagcacuccccgcccagcagcccccugacccagccgcccgagggccccaaguucccccgggucaagaacugggaggugggguccaucacguacgacacccuguccgcccaggcgcagcaggacggccccugcacgccccgccggugccucgggagccugguguucccccgcaagcugcagggccggccgucccccggcccgcccgcccccgagcagcuccugagccaggcccgcgacuucaucaaccaguacuacuccagcaucaagcgguccgggagccaggcccacgagcagcgccugcaggaggucgaggcggagguggccgccaccggcaccuaccagcuccgggaguccgagcugguguucggggccaagcaggccuggcgcaacgcgccccggugcgucggccgcauccaguggggcaagcuccagguguucgacgcccgggacugccgcagcgcccaggagauguucaccuacaucugcaaccacaucaaguacgccaccaaccgggggaaccuccgcuccgccaucaccguguucccccagcggugccccggccgcggggacuuccggaucuggaacagccagcugguccgcuacgcgggcuaccggcagcaggacggguccgugcgcggcgacccggccaacguggagaucacggagcugugcauccagcacggcuggacccccgggaacggccgcuucgacguccucccccugcugcuccaggccccggacgacccgcccgagcuguuccugcucccgcccgagcuggugcuggaggugccccucgagcaccccacccuggagugguucgccgcccuggggcuccggugguacgcgcugcccgccgucagcaacaugcugcucgagaucggcgggcuggaguuccccgccgcccccuucagcggcugguacauguccaccgagaucggcacgcgcaaccugugcgacccccaccgguacaacauccucgaggacguggccgugugcauggaccuggacacccgcaccaccagcucccuguggaaggacaaggcggccgucgagaucaacguggccgugcuccacagcuaccagcuggccaaggucacgaucguggaccaccacgcggccaccgccuccuucaugaagcaccuggagaacgagcagaaggcccgcgggggcugccccgccgacugggcguggaucgugccgcccaucagcgggucccucacccccgucuuccaccaggagauggugaacuacuuccugagccccgccuuccgguaccagccggaccccuggaagggcuccgccgccaaggggaccggcaucacgcggaagaagaccuucaaggaggucgccaacgcggugaagaucagcgccucccugaugggcaccgugauggccaagcgcgucaaggccaccauccucuacgggagcgagacgggccgggcccaguccuacgcgcagcagcuggggcgccuguuccggaaggccuucgacccccgcgugcugugcauggacgaguacgacguggucagccucgagcacgagacccuggugcugguggucaccuccaccuucggcaacggcgacccgcccgagaacggggagagcuucgccgccgcgcucauggagauguccggccccuacaacagcagcccccggcccgagcagcacaaguccuacaagauccgcuucaacagcaucuccugcagcgacccgcugguguccagcuggcggcgcaagcggaaggaguccagcaacacggacuccgccggggcccugggcacccuccgcuucugcguguucgggcugggcagccgggccuacccccacuucugcgccuucgcgcgcgccgucgacacccgccuggaggagcucggcggggagcggcugcugcagcucggccagggggacgagcugugcggccaggaggaggccuuccgcgggugggcccaggccgcguuccaggccgccugcgagaccuucugcgugggcgaggacgccaaggccgcggcccgggacaucuucucccccaagcgcagcuggaagcggcagcgcuaccggcuguccgcccaggccgagggccuccagcugcugccggggcucauccacgugcaccgccggaagauguuccaggcgacgauccgcagcgucgagaaccugcaguccagcaaguccacccgggccaccauccuggugcgccucgacaccggcgggcaggagggccugcaguaccagcccggggaccacaucggcgugugcccgcccaaccggcccggccuggucgaggcccuccugagccgcguggaggacccgcccgcccccacggagcccguggccgucgagcagcuggagaaggggucccccggcgggccgccgcccggcugggugcgggacccccgccucccgcccugcacccugcggcaggcgcugaccuucuuccucgacaucaccagcccgcccagcccccagcugcugcgccuccuguccacccuggccgaggagccccgggagcagcaggagcucgaggcccugagccaggacccccgccgguacgaggaguggaagugguuccgcugccccacgcugcucgaggugcuggagcaguuccccuccgucgcccugcccgcgccccuccugcugacccagcucccccugcugcagccccgcuacuacagcguguccagcgcccccuccacccacccgggggagauccaccucaccguggccguccuggccuaccggacgcaggacggccugggcccccuccacuacggggugugcagcaccuggcugucccagcugaagcccggcgacccggugcccugcuucauccgcggggcccccagcuuccggcugcccccggaccccucccugcccugcauccuggucggccccggcaccgggaucgccccguuccgcggcuucuggcaggagcggcuccacgacaucgagagcaaggggcugcagcccacccccaugacgcugguguucggcugccgcugcucccagcucgaccaccuguaccgggacgaggugcagaacgcgcagcagcgcggggucuucggccgggugcugaccgccuucagccgcgagcccgacaacccgaagaccuacgugcaggacauccuccggaccgagcuggccgccgagguccaccgcgugcugugccucgagcggggccacauguucgugugcggggacgucacgauggccaccaacgugcugcagaccgugcagcgcauccuggcgaccgagggcgacauggagcucgacgaggccggggacgucaucggcgugcugcgggaccagcagcgcuaccacgaggacaucuucgggcugacgcuccggacccaggaggugaccucccgcauccggacccagagcuucucccugcaggagcgccagcugcgcggcgccguccccugggccuucgacccgcccggcagcgacacgaacucccccuga

SEQ ID NO: 33703 - RNA, 906 nt, Artificial Sequence
  derived and/or modified sequence opt1 from NOSIP__Homo_sapiens__NP_057037
augacccgccacggcaagaacugcaccgccggggccguguacacguaccacgagaagaagaaggacaccgcggccagcggcuacgggacccagaacauccggcugucccgcgacgccgucaaggacuucgacugcugcugccucagccugcagcccugccacgacccgguggugacccccgacggcuaccuguacgagcgggaggccauccucgaguacauccugcaccagaagaaggagaucgcccgccagaugaaggcguacgagaagcagcgggggacgcgccgggaggagcagaaggagcugcagcgcgccgccucccaggaccacguccggggcuuccucgagaaggagagcgccaucgugucccgcccccugaaccccuucaccgcgaaggcccugagcggcaccuccccggacgacgugcagcccgggcccagcgucgggcccccguccaaggacaaggacaaggugcuccccagcuucuggauccccucccugacccccgaggccaaggccacgaagcuggagaagccgagccggaccgugaccugccccauguccggcaagccccuccgcaugagcgaccugacccccguccacuucacgccgcuggacuccagcguggaccgggugggccucaucacccgcuccgagcgguacgucugcgccgugacccgcgacagccuguccaacgcgacccccugcgccgugcugcggcccagcggggccgucgugacgcucgagugcguggagaagcugauccgcaaggacauggucgaccccgugaccggcgacaagcugaccgaccgggacaucaucgugcuccagcgcggcgggaccggcuucgccgggagcggcgucaagcugcaggccgagaagucccggccggugaugcaggcguga

SEQ ID NO: 33704 - RNA, 1521 nt, Artificial Sequence
  derived and/or modified sequence opt1 from NOSTRIN__Homo_sapiens__NP_001034813
augcgcgacccccugaccgacugcccguacaacaagguguacaagaaccucaaggaguucagccagaacggcgagaacuucugcaagcaggucaccuccgugcugcagcagcgggccaaccuggagaucagcuacgccaaggggcuccagaagcuggcguccaagcugagcaaggcccuccagaacacgcgcaaguccugcgugagcuccgccugggccugggccagcgagggcaugaaguccaccgcggaccugcaccagaagcuggggaaggccaucgagcucgaggccaucaagcccaccuaccagguccugaacgugcaggagaagaagcgcaagagccuggacaacgagguggagaagaccgccaaccucgucaucuccaacuggaaccagcagaucaaggcgaagaagaagcugauggugagcacgaagaagcacgaggcccuguuccagcucguggaguccagcaagcaguccaugaccgagaaggagaagcggaagcugcugaacaagcucaccaagagcaccgagaagcuggagaaggaggacgagaacuacuaccagaagaacauggccggcuacuccacgcggcugaagugggagaacacccucgagaacugcuaccagagcauccuggagcuggagaaggagcgcauccagcuccugugcaacaaccugaaccaguacucccagcacaucagccucuucgggcagacccugaccacgugccacacccagauccacugcgccaucagcaagaucgacaucgagaaggacauccaggccgucauggaggagaccgcgauccuguccaccgagaacaagagcgaguuccuccugacggacuacuucgaggaggaccccaacuccgccauggacaaggagcggcgcaagagccugcucaagcccaagcugcugcggcuccagcgcgacaucgagaaggccuccaaggacaaggagggccuggagcggaugcugaagaccuacagcuccaccagcuccuucagcgacgccaagucccagaaggacaccgccgcgcucauggacgagaacaaccugaagcuggaccuccuggaggccaacagcuacaagcuguccagcaugcucgccgagcuggagcagcgcccgcagcccucccaccccugcagcaacuccaucuuccgguggcgcgagaaggagcacacgcacagcuacgugaagaucucccggcccuuccugaugaagcgccucgagaacaucgugagcaaggccagcuccggcgggcagagcaacccgggcuccagcacccccgcccccggggcggcccagcuguccagccggcugugcaaggcccuguacuccuuccaggcccgccaggacgacgagcucaaccuggagaagggcgacaucgucaucauccacgagaagaaggagggcggguggugguucggcagccugaacgggaagaagggccacuuccccgccgcguacguggaggagcucccguccaacgccgggaacaccgccaccaaggccuga

SEQ ID NO: 33705 - RNA, 7668 nt, Artificial Sequence
  derived and/or modified sequence opt1 from NOTCH1__Homo_sapiens__NP_060087
augcccccgcugcucgccccccugcugugccucgcccugcugcccgcgcucgccgcccgcggcccccggugcagccagccgggggagaccugccugaacggcgggaagugcgaggccgccaacggcaccgaggcgugcgugugcgggggcgccuucgucggcccccgcugccaggaccccaaccccugccuguccacgccgugcaagaacgccgggaccugccacgugguggaccggcgcggcgucgccgacuacgcgugcagcugcgcccucggguucuccggcccccugugccugaccccccucgacaacgccugccugaccaaccccugccggaacgggggcacgugcgaccugcucacccugaccgaguacaagugccgcugcccgcccggcuggagcgggaaguccugccagcaggccgaccccugcgccagcaaccccugcgcgaacggcgggcagugccugccguucgaggccuccuacaucugccacugcccccccagcuuccacggccccaccugccggcaggacgugaacgagugcggccagaagccggggcucugccgccacggcgggacgugccacaacgaggugggcuccuaccggugcgucugccgcgccacccacaccgggcccaacugcgagcggcccuacgugcccugcagcccgucccccugccagaacggcggcaccugccgccccacgggggacgugacccacgagugcgccugccugcccggcuucaccgggcagaacugcgaggagaacaucgacgacugcccgggcaacaacugcaagaacgggggcgccugcgucgacggcgugaacaccuacaacugccggugcccccccgaguggacggggcaguacugcaccgaggacguggacgagugccagcugaugccgaacgcgugccagaacggcgggaccugccacaacacccacggcggguacaacugcgucugcgugaacggcuggacgggcgaggacugcagcgagaacaucgacgacugcgccuccgccgccugcuuccacggggccaccugccacgaccgcguggcgagcuucuacugcgagugcccccacggccggaccgggcuccugugccaccugaacgacgccugcaucuccaaccccugcaacgagggcagcaacugcgacaccaaccccgucaacggcaaggccaucugcacgugcccguccggguacaccggccccgccugcagccaggacguggacgagugcucccucggggccaaccccugcgagcacgcgggcaagugcaucaacacccuggggagcuucgagugccagugccugcagggcuacaccggcccccgcugcgagaucgacgugaacgagugcgucagcaacccgugccagaacgacgccacgugccucgaccagaucggggaguuccagugcaucugcaugcccggcuacgagggggugcacugcgaggugaacaccgacgagugcgccuccagccccugccugcacaacggccggugccuggacaagaucaacgaguuccagugcgagugccccaccggguucaccggccaccucugccaguacgacgucgacgagugcgccuccacgccgugcaagaacggcgcgaagugccuggacgggcccaacaccuacaccugcgugugcaccgagggcuacacggggacccacugcgagguggacaucgacgagugcgaccccgaccccugccacuacggcagcugcaaggacggggucgccaccuucaccugccugugccgcccgggcuacaccggccaccacugcgagacgaacaucaacgagugcuccagccagcccugccggcacgggggcaccugccaggaccgcgacaacgccuaccucugcuucugccugaaggggaccaccggccccaacugcgagaucaaccuggacgacugcgccuccagccccugcgacuccgggacgugccucgacaagaucgacggcuacgagugcgccugcgagccgggcuacaccgggagcaugugcaacaucaacaucgacgagugcgcgggcaaccccugccacaacgggggcaccugcgaggacggcaucaacggguucaccugccggugccccgagggcuaccacgaccccacgugccuguccgaggugaacgagugcaacagcaacccgugcguccacggggccugccgcgacucccugaacggcuacaagugcgacugcgaccccggguggagcggcaccaacugcgacaucaacaacaacgagugcgaguccaaccccugcgugaacggcgggaccugcaaggacaugaccagcggcuacgugugcacgugccgcgagggguucuccggcccgaacugccagaccaacaucaacgagugcgccagcaaccccugccucaaccaggggaccugcaucgacgacgucgccggcuacaagugcaacugccugcugcccuacaccggcgccacgugcgagguggugcucgcgcccugcgccccgucccccugccggaacgggggcgagugccgccagagcgaggacuacgagagcuucuccugcgucugccccaccggguggcagggccagaccugcgagguggacaucaacgagugcgugcugagccccugccggcacggggccuccugccagaacacccacggcggcuaccgcugccacugccaggccggguacagcggccggaacugcgagacggacaucgacgacugccgcccgaaccccugccacaacgggggcuccugcaccgacggcaucaacaccgccuucugcgacugccugcccggguuccggggcaccuucugcgaggaggacaucaacgagugcgcgagcgaccccugccgcaacggggccaacugcacggacugcgucgacuccuacaccugcaccugcccggccggcuucagcgggauccacugcgagaacaacacccccgacugcacggaguccagcugcuucaacggcggcaccugcguggacgggaucaacuccuucaccugccucugcccccccggcuucaccgggagcuacugccagcacgacgugaacgagugcgacucccagccgugccugcacggcgggacgugccaggacggcugcggcagcuaccggugcaccugcccccagggguacaccggccccaacugccagaaccugguccacuggugcgacuccagccccugcaagaacgggggcaagugcuggcagacccacacgcaguaccgcugcgagugcccguccggguggaccggccucuacugcgacgugcccagcgugagcugcgaggucgccgcgcagcggcagggcguggacguggcccgccugugccagcacgggggccugugcgucgacgccgggaacacccaccacugccggugccaggccggcuacaccggguccuacugcgaggaccugguggacgagugcagccccucccccugccagaacggcgccaccugcacggacuaccucggcggguacagcugcaagugcguggcgggcuaccacggggucaacugcuccgaggagaucgacgagugccugagccacccgugccagaacggcggcaccugccuggaccuccccaacaccuacaagugcuccugcccccgcgggacccagggcgugcacugcgagaucaacguggacgacugcaaccccccggucgaccccgugagccggucccccaagugcuucaacaacgggacgugcguggaccaggucggcggguacagcugcaccugcccgcccggcuucgugggcgagcgcugcgagggggacgugaacgagugccuguccaaccccugcgacgcccggggcacccagaacugcguccagcgcgugaacgacuuccacugcgagugccgggccgggcacaccggccgccgcugcgagagcgugaucaacgggugcaagggcaagcccugcaagaacggcgggacgugcgccgucgccuccaacaccgcgcggggcuucaucugcaagugcccggccggguucgagggcgccaccugcgagaacgacgcccgcaccugcgggagccugcggugccucaacggcggcacgugcaucuccgggccccgcagccccaccugccugugccugggccccuucaccgggccggagugccaguuccccgccuccagccccugccucggcgggaaccccugcuacaaccagggcaccugcgagccgacguccgagagccccuucuaccggugccugugccccgcgaaguucaacggccugcucugccacauccuggacuacagcuucgggggcggggccggccgcgacauccccccgccccugaucgaggaggccugcgagcuccccgagugccaggaggacgccggcaacaaggugugcucccugcagugcaacaaccacgcgugcgggugggacggcggggacugcagccugaacuucaacgaccccuggaagaacugcacccagucccuccagugcuggaaguacuucagcgacggccacugcgacucccagugcaacagcgccgggugccuguucgacggcuucgacugccagcgggccgagggccagugcaacccgcuguacgaccaguacugcaaggaccacuucuccgacgggcacugcgaccagggcugcaacagcgccgagugcgagugggacgggcucgacugcgccgagcacgugcccgagcgccuggcggccggcacccuggucguggugguccucaugccccccgagcagcugcggaacuccagcuuccacuuccugcgcgagcucucccgggugcugcacaccaacguggucuucaagcgcgacgcccacgggcagcagaugaucuucccguacuacggccgggaggaggagcugcgcaagcaccccaucaagcgggccgccgagggcugggcggcccccgacgcccuccuggggcaggugaaggccagccugcuccccggcggguccgagggcgggcgccggcgccgggagcuggacccgauggacgugcgcggcagcaucgucuaccuggagaucgacaaccggcagugcgugcaggccuccagccagugcuuccaguccgcgacggacguggccgccuuccucggcgcccuggccagccuggggucccucaacauccccuacaagaucgaggcgguccagagcgagaccguggagcccccgccccccgcccagcugcacuucauguacguggccgccgcggccuucguccugcucuucuucgugggcugcgggguccugcugagccgcaagcgccggcgccagcacggccagcucugguuccccgagggcuucaagguguccgaggccagcaagaagaagcggcgcgagccgcugggggaggacuccgugggccugaagccccucaagaacgccagcgacggggcccugauggacgacaaccagaacgaguggggcgacgaggaccuggagaccaagaaguuccgguucgaggagcccgucgugcuccccgaccuggacgaccagaccgaccaccgccaguggacgcagcagcaccuggacgcggccgaccuccggauguccgccauggccccgacccccccccagggggagguggacgccgacugcauggacgucaacgugcgcggccccgacggcuucaccccgcugaugaucgcgagcugcuccgggggcgggcuggagaccggcaacagcgaggaggaggaggacgcccccgccgugaucuccgacuucaucuaccagggggccagccuccacaaccagacggaccggaccggcgagaccgcccugcaccuggcggcccgcuacucccggagcgacgccgccaagcgccuccuggaggcguccgccgacgccaacauccaggacaacaugggccggaccccccugcacgccgccgucagcgcggacgcccaggggguguuccagauccucauccgcaaccgggccacggaccuggacgcccgcaugcacgacggcaccaccccccugauccucgccgcgcggcuggccguggaggggaugcuggaggaccucaucaacucccacgccgacgucaacgccguggacgaccugggcaagagcgcccugcacugggcggccgccgugaacaacgucgacgccgcgguggugcuccugaagaacggggccaacaaggacaugcagaacaaccgcgaggagaccccgcuguuccucgccgcccgggagggcuccuacgagacggccaagguccugcuggaccacuucgcgaaccgcgacaucaccgaccacauggaccgccucccccgggacaucgcccaggagcgcaugcaccacgacaucgugcggcugcuggacgaguacaaccucgugcgcagcccccagcugcacggcgccccccuggggggcaccccgacccucucccccccccugugcagccccaacggguaccugggcagccucaagccggggguccagggcaagaaggugcggaagcccuccagcaagggccuggccugcggguccaaggaggccaaggaccugaaggcgcgccggaagaagagccaggacggcaaggggugccuccuggacuccagcggcaugcugucccccguggacagccucgaguccccgcacggcuaccugagcgacgucgccucccccccccugcugcccagcccguuccagcagucccccagcgugccccucaaccaccugcccgggaugccggacacccaccugggcaucgggcaccucaacguggccgccaagcccgagauggccgcgcugggcgggggcggccgccuggccuucgagacggggcccccccggcucucccaccugccggucgccagcggcaccuccaccgugcuggggagcuccagcggcggggcccucaacuucaccgugggcggcagcacgucccugaacgggcagugcgaguggcugagccgccuccaguccggcaugguccccaaccaguacaacccccugcgggggagcguggcccccggcccgcuguccacccaggcgcccagccuccagcacgggauggugggcccccugcacuccagccuggccgccuccgcccucagccagaugauguccuaccagggccugcccagcacccgccuggcgacccagccgcaccucguccagacgcagcaggugcagccccagaaccugcagaugcagcagcagaaccugcagcccgccaacauccagcagcagcagucccuccagcccccgcccccccccccgcagccccaccugggggugagcuccgccgccagcggccaccuggggcgguccuuccucagcggcgagcccucccaggccgacguccagccgcugggccccagcagccuggcggugcacaccauccucccccaggagucccccgcccugccgaccagccugcccuccagccucgugccccccgucaccgccgcccaguuccugacgccgcccucccagcacagcuacuccagccccguggacaacacccccucccaccagcugcaggugccggagcaccccuuccucacccccagccccgaguccccggaccaguggagcuccagcuccccccacagcaacgucuccgacuggagcgagggggugagcuccccccccaccagcaugcagucccagaucgcccgcaucccggaggcguucaaguga

SEQ ID NO: 33706 - RNA, 7404 nt, Artificial Sequence
  derived and/or modified sequence opt1 from NOTCH2__Homo_sapiens__XP_011539821
augaacaccuaccuggugagcgccgugagccuccggugcgugagcguggagcgguacaaggcccugcagugccgcgacggcuacgagcccugcgucaacgagggcaugugcgugaccuaccacaacggcaccggcuacugcaagugccccgagggcuuccugggcgaguacugccagcaccgggaccccugcgagaagaaccgcugccagaacggcgggaccugcguggcccaggccaugcucgggaaggcgaccugccggugcgccuccggcuucaccggggaggacugccaguacagcaccucccaccccugcuucgucagccgccccugccugaacggcgggaccugccacaugcugucccgggacaccuacgagugcacgugccaggugggcuucaccggcaaggagugccaguggaccgacgccugccucagccaccccugcgccaacgggagcacgugcaccaccguggccaaccaguucagcugcaagugccugaccggcuucaccgggcagaagugcgagaccgacgucaacgagugcgacauccccggccacugccagcacggcgggaccugccugaaccuccccggcuccuaccagugccagugcccccagggguucaccggccaguacugcgacagccuguacgugccgugcgcccccucccccugcgugaacggcgggaccugccgccagaccggcgacuucaccuucgagugcaacugccugcccggguucgagggcagcacgugcgagcggaacaucgacgacugccccaaccaccgcugccagaacgggggcgucugcguggacggggugaacaccuacaacugccggugcccgccccaguggaccggccaguucugcaccgaggacgucgacgagugccuccugcagcccaacgccugccagaacggcgggaccugcgccaaccgcaacggcggguacggcugcgugugcgugaacgggugguccggcgacgacugcagcgagaacaucgacgacugcgccuucgccuccugcacccccggcuccacgugcaucgaccgggucgccuccuucagcugcaugugccccgaggggaaggccggccugcucugccaccuggacgacgcgugcaucagcaaccccugccacaagggggcccugugcgacaccaacccccucaacggccaguacaucugcacgugcccccagggcuacaagggggccgacugcaccgaggacguggacgagugcgccauggccaacuccaaccccugcgagcacgccggcaagugcgugaacaccgacggggccuuccacugcgagugccugaagggcuacgccgggccccgcugcgagauggacaucaacgagugccacagcgaccccugccagaacgacgcgaccugccuggacaagaucggcggcuucacgugccucugcaugcccggguucaagggcguccacugcgagcuggagaucaacgagugccaguccaaccccugcgugaacaacgggcagugcguggacaaggucaaccgguuccagugccugugcccgcccggcuucaccgggcccgugugccagaucgacaucgacgacugcagcuccacccccugccucaacggcgccaagugcaucgaccaccccaacggcuacgagugccagugcgccaccggguucaccggcguccugugcgaggagaacaucgacaacugcgaccccgaccccugccaccacgggcagugccaggacggcaucgacagcuacacgugcaucugcaaccccggguacaugggcgccaucugcuccgaccagaucgacgagugcuacagcucccccugccugaacgacggccgcugcaucgaccucgugaacggguaccagugcaacugccagccgggcaccagcggggugaacugcgagaucaacuucgacgacugcgccuccaaccccugcauccacggcaucugcauggacgggaucaaccgguacagcugcgucugcucccccggcuucaccggccagcgcugcaacaucgacaucgacgagugcgccagcaaccccugccggaagggggcgaccugcaucaacggcgugaacggguuccgcugcaucugcccggagggcccccaccaccccuccugcuacagccaggugaacgagugccuguccaaccccugcauccacggcaacugcaccgggggccugagcggguacaagugccucugcgacgccggcugggucgggaucaacugcgagguggacaagaacgagugccuguccaacccgugccagaacggcgggaccugcgacaaccuggugaacggguaccggugcacgugcaagaagggcuucaagggguacaacugccaggucaacaucgacgagugcgccagcaaccccugccucaaccaggggaccugcuucgacgacaucagcggcuacacgugccacugcgugcugcccuacaccggcaagaacugccagaccgugcuggcccccugcuccccgaaccccugcgagaacgccgccgucugcaaggagagccccaacuucgaguccuacacgugccucugcgcccccggcuggcaggggcagcgcugcaccaucgacaucgacgagugcaucagcaagccgugcaugaaccacggccugugccacaacacccagggguccuacaugugcgagugcccgcccggcuucagcgggauggacugcgaggaggacaucgacgacugccuggccaaccccugccagaacggcggcuccugcauggacggggugaacaccuucagcugccucugccugccgggcuucacgggggacaagugccagaccgacaugaacgagugccuguccgagcccugcaagaacggcgggaccugcagcgacuacgugaacuccuacacgugcaagugccaggccggguucgacggcguccacugcgagaacaacaucaacgagugcacggagagcuccugcuucaacggcgggaccugcguggacgggaucaacagcuucuccugccucugccccgugggguucaccggcagcuucugccugcacgagaucaacgagugcuccagccacccgugccugaacgaggggaccugcgucgacggccucgggacguaccgcugcagcugcccccugggcuacaccgggaagaacugccagacccuggugaaccucugcucccggagccccugcaagaacaaggggaccugcgugcagaagaaggccgagucccagugccugugccccagcggcugggcgggggccuacugcgacgucccgaacguguccugcgacaucgccgccagccgccggggcgugcuggucgagcaccugugccagcacuccggggugugcaucaacgccggcaacacgcacuacugccagugcccccucggguacaccggcagcuacugcgaggagcagcuggacgagugcgcguccaaccccugccagcacggcgcgaccugcagcgacuucaucgggggcuaccgcugcgagugcgugcccggguaccagggcgucaacugcgaguacgagguggacgagugccagaaccagccgugccagaacggcgggaccugcaucgaccuggugaaccacuucaagugcuccugcccgcccgggacgcgggggcuccugugcgaggagaacaucgacgacugcgcccgcggcccccacugccugaacgggggccagugcauggaccggaucggcggguacagcugccgcugccucccgggcuucgccggggagcggugcgagggcgacaucaacgagugccuguccaaccccugcagcuccgaggggagccuggacugcauccagcucaccaacgacuaccugugcgucugccgcuccgccuucaccggccggcacugcgagaccuucguggacgugugcccccagaugcccugccugaacggcgggacgugcgcggucgccagcaacaugccggacggcuucaucugccgcugcccgcccggguucuccggcgcccggugccagagcagcugcggccaggugaagugccgcaagggcgagcagugcgugcacaccgccuccggcccccggugcuucugcccgagcccccgcgacugcgaguccgggugcgcgagcucccccugccagcacggcgggagcugccacccccagcggcagccgcccuacuacuccugccagugcgcgccgcccuucagcggcucccgcugcgagcucuacaccgccccgcccagcaccccgcccgccacgugccugucccaguacugcgccgacaaggcgcgggacggggucugcgacgaggccugcaacagccacgccugccagugggacggcggcgacugcucccugaccauggagaaccccugggccaacugcagcagcccccugcccugcugggacuacaucaacaaccagugcgacgagcugugcaacaccguggagugccuguucgacaacuucgagugccaggggaacagcaagaccugcaaguacgacaaguacugcgccgaccacuucaaggacaaccacugcgaccagggcugcaacuccgaggagugcgggugggacggccucgacugcgcggccgaccagccggagaaccuggccgaggggacccuggugaucgucgugcucaugccgcccgagcagcugcugcaggacgcccgcagcuuccuccgcgcccugggcacgcugcuccacaccaaccugcggaucaagcgcgacucccagggcgagcugaugguguaccccuacuacggggagaaguccgcggccaugaagaagcagcggaugacccgccggagccuccccggcgagcaggagcaggaggucgccggguccaagguguuccuggagaucgacaaccgccagugcgugcaggacagcgaccacugcuucaagaacaccgacgccgcggccgcccugcucgccucccacgccauccagggcacgcugagcuacccccuggucuccguggugagcgagucccucacccccgagcggacccagcugcuguaccuccuggcggucgccguggugaucauccuguucaucauccuccugggcgucaucauggccaagcgcaagcggaagcacgggagccuguggcuccccgagggcuucacccugcgccgggacgccuccaaccacaagcgccgggagccgguggggcaggacgccgucggccugaagaaccucagcguccagguguccgaggcgaaccugaucgggacgggcaccagcgagcacugggucgacgacgagggcccccagcccaagaaggugaaggccgaggacgaggcccugcucuccgaggaggacgaccccaucgaccgccggccguggacccagcagcaccuggaggccgccgacauccgccggacccccagccuggcgcucacgccgccccaggccgagcaggagguggacguccuggacgugaacgugcgcgggccggacggcugcacgccccugaugcucgccucccugcgcggcggcagcuccgaccugagcgacgaggacgaggacgccgaggacuccagcgccaacaucaucaccgaccucgucuaccagggggcgagccugcaggcccagaccgaccgcacgggcgagauggcccugcaccucgccgcgcgguacucccgcgccgacgccgccaagcgccugcuggacgccggcgcggacgccaacgcccaggacaacauggggcggugcccccuccacgccgccguggcggccgacgcccagggcguguuccagauccugauccgcaaccgggucaccgaccuggacgcccgcaugaacgacgggaccacgccccucauccuggccgcgcggcuggccguggagggcaugguggccgagcucaucaacugccaggccgacgucaacgcgguggacgaccacggcaagagcgcccugcacugggccgccgccgugaacaacgucgaggcgacgcugcuccugcugaagaacggcgccaaccgcgacaugcaggacaacaaggaggagacgccccucuuccuggccgcccgggagggcuccuacgaggccgcgaagauccugcucgaccacuucgccaaccgcgacaucaccgaccacauggaccggcugccccgcgacguggcccgggaccgcaugcaccacgacaucgugcggcugcucgacgaguacaacgucacccccagcccgcccgggaccgugcugaccuccgcccugagccccgugaucugcggccccaaccgcuccuuccucagccugaagcacacccccauggggaagaagucccggcgccccagcgccaaguccaccaugcccacgagccugcccaaccucgcgaaggaggccaaggacgccaagggcucccggcgcaagaagucccuguccgagaagguccagcugagcgaguccagcgugacccucuccccgguggacagccuggagagcccccacaccuacgucuccgacaccacgagcucccccaugaucaccagccccggcauccugcaggccuccccgaaccccaugcuggcgaccgccgcgccgcccgccccggugcacgcccagcacgcgcucagcuucuccaaccugcacgagaugcagccccuggcccacggggccagcaccgugcuccccuccgucagccagcugcugucccaccaccacaucgugagccccggcuccgggagcgccggcucccucagccggcugcacccggugcccguccccgccgacuggaugaaccgcauggaggugaacgagacgcaguacaacgagauguucgggauggugcuggcgcccgccgagggcacccacccgggcaucgcgccccagucccggccgcccgaggggaagcacaucaccaccccgcgggagccccugcccccgaucgucaccuuccagcucauccccaagggcagcaucgcccagcccgccggggcgccccagccgcaguccacgugcccgcccgccguggccggcccccugcccaccauguaccagauccccgagauggcccgccuccccagcguggccuuccccaccgcgaugaugccgcagcaggacgggcaggucgcccagaccauccugcccgccuaccaccccuuccccgccagcgugggcaaguacccgacgccgcccucccagcacagcuacgcguccagcaacgccgccgagcggacccccucccacagcggccaccuccagggggagcacccguaccucacccccucccccgagagccccgaccagugguccagcuccagcccgcacuccgccagcgacugguccgacgugaccacgagccccacccccggcggggccggcgggggccagcgcggccccgggacccacauguccgagccgccccacaacaacaugcaggucuacgcguga

SEQ ID NO: 33707 - RNA, 6966 nt, Artificial Sequence
  derived and/or modified sequence opt1 from NOTCH3__Homo_sapiens__NP_000426
augggccccggggcccgcggccggcgccggcgccggcgcccgaugagccccccccccccgcccccccccgugcgggcccugccgcuccugcugcuccuggcggggcccggcgccgccgccccccccugccuggacggguccccgugcgccaacggcggccgcugcacccagcuccccagccgggaggcggccugccugugcccccccgggugggucggcgagcgcugccagcuggaggacccgugccacuccgggcccugcgccggccggggggugugccagagcuccguggucgccggcaccgcgcgcuucagcugccggugcccccgcggcuuccgggggcccgacugcucccucccggaccccugccugagcucccccugcgcccacggcgcccgcugcagcguggggcccgacggccgguuccugugcuccugcccgcccggcuaccaggggcgcagcugccgguccgacguggacgagugccgcgucggcgagcccugccggcacgggggcacgugccucaacacccccgggagcuuccgcugccagugcccggccggcuacaccggcccccugugcgagaaccccgccgugccgugcgcgcccucccccugccgcaacgggggcaccugccggcagagcggggaccugacguacgacugcgccugccuccccggcuucgaggggcagaacugcgaggugaacgucgacgacugcccgggccaccgcugccugaacggcgggaccugcguggacggcgugaacaccuacaacugccagugcccccccgaguggaccgggcaguucugcacggaggacgucgacgagugccagcugcagcccaacgccugccacaacggcgggaccugcuucaacacccucggcggccacuccugcgugugcgugaacggguggaccggcgagagcugcucccagaacaucgacgacugcgccacggccgucugcuuccacggggcgaccugccacgaccggguggccagcuucuacugcgccugcccgaugggcaagaccggccugcugugccaccucgacgacgccugcgugagcaaccccugccacgaggacgccaucugcgacaccaaccccgucaacgggcgcgcgaucugcacgugccccccgggcuucaccgggggcgccugcgaccaggacguggacgagugcuccaucggggccaaccccugcgagcaccugggccggugcgugaacacccagggcagcuuccugugccagugcgggcgcggcuacaccgggccccggugcgagacggacgucaacgagugccucuccggccccugccgcaaccaggccaccugccuggaccggaucgggcaguucaccugcaucugcauggccggcuucaccggcacguacugcgagguggacaucgacgagugccagagcuccccgugcgugaacgggggcgucugcaaggaccgcgugaacggguucagcugcaccugccccuccggcuucagcggguccaccugccagcuggacgucgacgagugcgcgagcacccccugccggaacggcgccaagugcguggaccagcccgacggcuacgagugccgcugcgccgagggguucgagggcacgcucugcgaccggaacguggacgacugcuccccggaccccugccaccacgggcgcugcgucgacggcaucgccagcuucuccugcgcgugcgcccccggguacaccggcacccggugcgagagccagguggacgagugccgcucccagcccugccggcacggcgggaagugccuggaccugguggacaaguaccucugccgcugcccgagcggcaccacgggggucaacugcgaggugaacaucgacgacugcgccuccaaccccugcaccuucggcgugugccgggacggcaucaaccgcuacgacugcgucugccagcccggguucaccggcccgcugugcaacguggagaucaacgagugcgccagcucccccugcggggagggcgggagcugcguggacggcgagaacggcuuccgcugccugugcccccccgggagccucccgccccugugccugccccccucccacccgugcgcccacgagcccugcagccacggcaucugcuacgacgcgcccgggggcuuccggugcgucugcgagcccgggugguccggcccgcgcugcagccagucccucgcccgggacgccugcgagagccagcccugccgcgccggcgggaccugcuccagcgacggcaugggguuccacugcacgugcccccccggcgugcaggggcggcagugcgagcugcuguccccgugcacccccaaccccugcgagcacggcggccgcugcgagagcgcccccgggcagcucccggugugcuccugcccccagggcuggcaggggccccggugccagcaggacgucgacgagugcgcgggccccgccccgugcggcccccacgggaucugcaccaaccuggccggcagcuucuccugcaccugccacgggggcuacaccgggcccagcugcgaccaggacaucaacgacugcgaccccaacccgugccugaacggcggcuccugccaggacggggugggcagcuucuccugcagcugccuccccggguucgccggcccccgcugcgcccgggacguggacgagugccugagcaacccgugcgggcccggcacgugcaccgaccacgucgcguccuucaccugcaccugcccccccggcuacgggggcuuccacugcgagcaggaccugccggacugcagccccuccagcugcuucaacgggggcacgugcguggacggggugaacuccuucagcugccucugccgccccggcuacaccggcgcccacugccagcacgaggccgaccccugccugucccggccgugccugcacgggggcgucugcagcgccgcgcaccccggguuccgcugcaccugccucgaguccuucaccggcccccagugccagacgcugguggacuggugcagccggcagcccugccagaacgggggccgcugcgugcagaccggcgccuacugccugugcccgcccgggugguccggccggcugugcgacauccgcagccuccccugccgggaggccgccgcccagaucgggguccgccuggagcagcugugccaggcgggcggccagugcguggacgaggacuccagccacuacugcgugugccccgaggggcggaccggcucccacugcgagcaggaggucgacccgugccucgcccagcccugccagcacgggggcaccugccgcggguacaugggcggcuacaugugcgagugccugcccggguacaacggcgacaacugcgaggacgacguggacgagugcgccagccagcccugccagcacgggggcuccugcaucgaccugguggcccgguaccucugcagcugcccgcccgggacgcugggcguccugugcgagaucaacgaggacgacugcggccccgggcccccgcucgacuccggcccccgcugccugcacaacgggaccugcguggaccuggugggcggguuccgcugcaccugcccccccggcuacaccggccuccggugcgaggccgacaucaacgagugccgcagcggggcgugccacgccgcccacacgcgggacugccugcaggacccgggcgggggcuuccgcugccugugccacgccggguucagcggcccccggugccagaccguccucucccccugcgagagccagccgugccagcacggcgggcagugccgccccucccccggccccgggggcggccugaccuucaccugccacugcgcccagccguucugggggccccggugcgagcgcguggcgcggagcugccgcgagcugcagugccccgugggcguccccugccagcagacgccgcgggggccccgcugcgccugcccccccggccucuccgggccgagcugccgguccuuccccggcagcccccccggcgccuccaacgccagcugcgcggccgccccgugccugcacgggggcuccugccgccccgccccccuggcccccuucuuccggugcgcgugcgcccagggguggaccggcccgcgcugcgaggcccccgccgccgcgcccgaggugagcgaggagccccggugcccgcgcgccgccugccaggccaagcggggggaccagcgcugcgaccgcgagugcaacucccccggcugcggcugggacgggggcgacugcagccucuccgugggggaccccuggcggcagugcgaggcccugcagugcuggcgccuguucaacaacagccggugcgacccggcgugcuccagccccgccugccucuacgacaacuucgacugccacgccggcgggcgcgagcggaccugcaaccccgucuacgagaaguacugcgccgaccacuucgccgacggccgcugcgaccagggcugcaacaccgaggagugcgggugggacggccuggacugcgcguccgaggugcccgcccugcucgcccggggggugcugguccugacggugcuccugccgcccgaggagcugcuccgcagcagcgccgacuuccugcagcggcuguccgcgauccuccgcaccagccugcgguuccgccuggacgcccacggccaggccaugguguuccccuaccaccggcccuccccgggcagcgagccccgcgcccggcgcgagcucgcccccgaggucaucggguccguggugaugcuggagaucgacaaccggcugugccuccagagccccgagaacgaccacugcuucccggacgcgcaguccgccgccgacuaccugggcgcccugagcgccgucgagcgccucgacuuccccuacccccugcgggacgugcgcggggagccccuggagccgcccgagcccuccgugccccuccugccgcugcucgucgcgggcgccgugcugcugcucgucauccuggugcugggggugauggucgcccggcgcaagcgcgagcacagcacccucugguuccccgagggcuucucccugcacaaggacguggccagcggccacaaggggcggcgcgagcccgugggccaggacgcccuggggaugaagaacauggcgaagggcgagucccucaugggggaggucgccaccgacuggauggacacggagugccccgaggccaagcggcugaagguggaggagccgggcaugggcgccgaggaggcgguggacugccgccaguggacccagcaccaccuggucgccgccgacauccggguggcccccgccauggcgcucacccccccccagggggacgccgacgccgacggcauggacgugaacguccgcgggccggacggcuucaccccccugaugcuggccagcuucugcgggggcgcccucgagcccaugccgacggaggaggacgaggcggacgacaccuccgccagcaucaucuccgaccugaucugccagggcgcccagcugggggcccggaccgaccgcaccggcgagacggcccuccaccuggcggcccgguacgcccgcgccgacgcggccaagcggcugcucgacgccggggccgacaccaacgcccaggaccacagcggccgcaccccccugcacaccgcggugaccgccgacgcccaggggguguuccagauccugauccggaaccgcuccacggaccucgacgcccggauggccgacggcagcaccgcgcugauccuggccgcccgccucgccgucgagggcaugguggaggagcugaucgccagccacgcggacgugaacgccgucgacgagcuggggaaguccgcccuccacugggccgccgcggugaacaacguggaggccacccuggcccugcucaagaacggcgccaacaaggacaugcaggacagcaaggaggagaccccccuguuccuggcggcccgggagggguccuacgaggccgccaagcuccugcuggaccacuucgccaaccgcgagaucacggaccaccucgaccggcugccccgcgacgucgcgcaggagcgccugcaccaggacaucgugcggcuccuggaccagccgagcggcccccgcuccccccccggcccgcacgggcugggcccccugcucugcccccccggggccuuccugccgggccugaaggccgcccagagcggguccaagaagagccggcgcccccccggcaaggccggccucgggccccagggcccgcgggggcgcggcaagaagcugacccuggcgugccccgggccccucgccgacuccagcgugacccugucccccgucgacagccuggacuccccgcggcccuucggcggcccccccgccagcccggggggcuucccccucgaggggcccuacgccgccgcgaccgccacggccgugucccuggcccagcugggcgggcccggccgcgcgggccucgggcggcagccgcccggcgggugcgugcugagccugggccuccugaaccccgucgccgugccgcuggacugggcccgccuccccccccccgccccgcccggccccuccuuccugcugccccucgccccggggccccagcugcugaaccccggcacccccgugagcccgcaggagcggcccccccccuaccucgcggucccggggcacggcgaggaguaccccgccgccggggcccacuccagcccccccaaggcccgcuuccugcgggugccgagcgagcaccccuaccugacccccucccccgagagcccggagcacugggcgucccccagcccccccucccucagcgacugguccgagagcaccccgucccccgccacggccaccggcgccauggccaccaccacgggcgcgcugcccgcccagccgcugccccucagcgugcccuccagccuggcccaggcccagacccagcuggggccccagccggaggucacccccaagcgccaggugcucgcguga

SEQ ID NO: 33708 - RNA, 6012 nt, Artificial Sequence
  derived and/or modified sequence opt1 from NOTCH4__Homo_sapiens__NP_004548
augcagcccccgagccugcuccugcugcuccugcugcuccugcugcucugcguguccgucgugcgcccccggggccugcugugcgggagcuuccccgagcccugcgccaacggcgggaccugccucucccugagccugggccaggggaccugccagugcgccccgggcuuccucggcgagacgugccaguuccccgaccccugccagaacgcgcagcugugccagaacgggggcuccugccaggcccugcuccccgccccgcuggggcugcccagcucccccagcccccucaccccguccuuccugugcaccugccugcccggcuucaccggggagcgcugccaggccaagcucgaggaccccugccccccgagcuucugcuccaagcggggccgcugccacauccaggccagcggccggccccagugcuccugcaugcccggguggacgggcgagcagugccagcugcgcgacuucugcagcgcgaaccccugcgugaacgggggcgucugccuggccaccuacccgcagauccagugccacugcccccccggcuucgaggggcacgccugcgagcgggacgugaacgagugcuuccaggaccccggcccgugccccaaggggaccuccugccacaacacccucggcagcuuccagugccugugccccguggggcaggagggcccccgcugcgagcugcgggccggcccgugccccccccgcgggugcuccaacggcgggacgugccagcucaugccggagaaggacagcaccuuccaccugugccugugcccccccggcuucaucgggcccgacugcgaggucaacccggacaacugcgugucccaccagugccagaacggcggcaccugccaggacgggcucgacaccuacacgugccugugccccgagaccuggaccggcugggacugcagcgaggacguggacgagugcgagacccaggggcccccccacugccggaacggcgggacgugccagaacagcgcgggcuccuuccacugcgucugcgugagcggcugggggggcaccuccugcgaggagaaccuggacgacugcaucgccgccaccugcgccccggggagcaccugcaucgaccgcgugggcuccuucagcugccucugcccccccggccggacggggcugcugugccaccucgaggacaugugccugucccagcccugccacggcgacgcccagugcagcaccaacccgcugaccggguccacccucugccugugccagcccggcuacagcgggcccacgugccaccaggaccuggacgagugccucauggcgcagcagggccccuccccgugcgagcacggcgggagcugccugaacacccccggcuccuucaacugccugugcccccccggguacaccggcagccgcugcgaggccgaccacaacgagugccucucccagccgugccaccccgggagcaccugccuggaccugcuggccacguuccacugccucugcccccccggccuggagggccagcugugcgaggucgagaccaacgagugcgccuccgccccgugccucaaccacgcggacugccacgaccugcugaacggguuccagugcaucugccuccccggcuucagcgggacccggugcgaggaggacaucgacgagugccgcuccagccccugcgccaacggcgggcagugccaggaccagccgggcgccuuccacugcaagugccugcccggcuucgaggggccccggugccagaccgagguggacgagugccugagcgaccccugcccggugggcgccuccugccucgaccugcccggggccuucuucugccugugccccagcggcuucacggggcagcucugcgaggucccccugugcgcgccgaaccugugccagcccaagcagaucugcaaggaccagaaggacaaggccaacugccucugccccgacggcucccccggcugcgccccgcccgaggacaacugcaccugccaccacgggcacugccagcgcagcuccugcgugugcgacgugggcuggaccgggcccgagugcgaggccgagcugggcggcugcaucagcgcccccugcgcgcacgggggcaccugcuacccgcagcccuccggguacaacugcacgugccccaccggcuacaccgggcccaccugcagcgaggagaugaccgccugccacuccggcccgugccugaacggcgggagcugcaaccccucccccggcggguacuacugcacgugccccccgagccacaccggcccccagugccagaccuccaccgacuacugcgucagcgcccccugcuucaacgggggcacgugcgugaaccggcccggcaccuucuccugccucugcgccaugggguuccagggcccgcgcugcgaggggaagcugcggcccagcugcgcggacucccccugccgcaaccgcgccaccugccaggacagcccgcagggcccccggugccugugccccaccggguacacgggcggcagcugccagacccucauggaccugugcgcccagaagcccugcccgcgcaacucccacugccugcagaccgggcccagcuuccacugccucugccugcagggcuggaccgggccccugugcaaccucccccuguccagcugccagaaggccgcccugucccagggcaucgacgugagcucccucugccacaacggcgggcugugcgucgacagcggcccguccuacuucugccacugcccccccggguuccagggcagccugugccaggaccacgugaaccccugcgagucccggccgugccagaacggggcgacgugcauggcccagcccagcggcuaccucugccagugcgcccccggcuacgacgggcagaacugcuccaaggagcuggacgccugccagagccagcccugccacaaccacggcaccugcaccccgaagcccgggggcuuccacugcgccugcccccccggguucgugggccugcgcugcgagggcgacgucgacgagugccucgaccagccgugccaccccaccgggacggcggccugccacucccuggccaacgccuucuacugccagugccugcccggccacaccgggcaguggugcgagguggagaucgaccccugccacagccagccgugcuuccacggcgggaccugcgaggccaccgcgggcuccccccucggcuucaucugccacugccccaagggguucgagggccccacgugcagccaccgggccccguccugcggguuccaccacugccaccacggcgggcugugccugcccagccccaagccgggcuuccccccccgcugcgccugccucagcggcuacgggggccccgacugccugaccccgcccgcccccaaggggugcggccccccgucccccugccuguacaacggcagcugcuccgagaccaccgggcucggcgggcccggcuuccggugcagcugcccccacuccagcccggggccccgcugccagaagcccggcgcgaagggcugcgaggggcgguccggcgacggggccugcgacgccggcugcagcgggcccggcggcaacugggacgggggcgacugcucccugggggucccggaccccuggaagggcugccccagccacucccgcugcuggcugcucuuccgggacgggcagugccacccccagugcgacagcgaggagugccuguucgacggcuacgacugcgagacgccgcccgccugcacccccgccuacgaccaguacugccacgaccacuuccacaacggccacugcgagaaggggugcaacaccgcggagugcggcugggacgggggcgacugccgccccgaggacggggacccggaguggggccccucccuggcccuccugguggugcugagccccccggcccucgaccagcagcuguucgcccuggcccggguccucucccugacccugcgcgugggccucugggugcggaaggaccgcgacgggcgggacauggucuaccccuaccccggcgcgcgcgccgaggagaagcuggggggcacgcgggaccccaccuaccaggagcgcgccgccccgcagacccagccccugggcaaggagaccgacagccucuccgccggguucgugguggucaugggcguggaccugagccgcugcgggcccgaccaccccgcgucccggugcccgugggaccccggccugcuccugcgcuuccuggccgccauggccgcggugggggcccucgagccccugcugcccggcccgcuccuggccguccacccccacgccggcacggccccccccgcgaaccagcugccguggcccgugcucugcagccccguggccggggucauccugcuggcccucggcgcccugcuggugcuccagcugauccggcgccggcgccgggagcacggggcccuguggcuccccccgggcuucacccgccggccccgcacccagagcgcgccccaccggcgccggcccccgcugggggaggacuccaucggccugaaggcccucaagcccaaggccgagguggacgaggacggcgucgugaugugcagcgggcccgaggagggcgaggagguggggcaggccgaggagaccggccccccguccacgugccagcuguggagccuguccgggggcugcggcgcccucccccaggcggccaugcugacccccccgcaggagagcgagauggaggcccccgaccuggacacccgcgggcccgacggcgucaccccccucauguccgccgugugcugcggggaggugcagagcggcaccuuccagggcgccuggcuggggugcccggagcccugggagccccugcuggacggcggggcgugcccccaggcccacacggucggcaccggggagaccccgcuccaccuggccgcccgguucucccgccccaccgcggcccggcgccugcucgaggccggcgccaaccccaaccagcccgaccgggccggccgcacgccgcugcacgcggccguggccgccgacgcccgggaggugugccagcugcuccugcgcagccgccagaccgcggucgacgcccggaccgaggacgggaccacgccccugaugcucgccgcccgccuggccguggaggaccugguggaggagcucaucgcggcccaggccgacgucggcgcccgggacaagugggggaagaccgcgcugcacugggccgccgccgugaacaacgcccgcgcggcccggucccugcuccaggccggcgccgacaaggacgcccaggacaaccgcgagcagaccccccuguuccuggcggcccgggagggggccguggaggucgcccagcuccugcugggccucggcgccgcgcgcgagcugcgggaccaggccgggcuggcccccgccgacguggcgcaccagcgcaaccacugggaccuccugacccugcucgagggcgccgggccgcccgaggcccggcacaaggccacgcccggccgcgaggccgggcccuucccgcgggcgcgcaccgugagcgucuccgugcccccccacggcggcggggcccugccccggugccgcacccugagcgccggcgccgggccgcggggcgggggcgccugccuccaggcgcgcaccugguccguggaccuggccgcccggggcgggggcgccuacagccacugccgcucccugagcggggucggcgccggcgggggccccacgccccgcgggcggcgcuucuccgcgggcaugcgggggccccgcccgaaccccgccaucaugcggggccgcuacggcguggccgccgggcggggcgggcgcgugagcaccgacgacuggcccugcgacugggucgcccucggcgcgugcgggagcgccuccaacaucccgauccccccccccugccugaccccgagccccgagcggggcuccccccagcuggacugcggccccccggcccuccaggagaugcccaucaaccaggggggcgaggggaagaaguga

SEQ ID NO: 33709 - RNA, 1491 nt, Artificial Sequence
  derived and/or modified sequence opt1 from NOTUM__Homo_sapiens__NP_848588
augggccgcggggugcggguccugcuccugcugagccuccugcacugcgccggcggguccgagggccgcaagaccuggcggcgccgggggcagcagcccccgcccccgccccgcaccgaggccgcgcccgccgccggccagcccguggagagcuucccccuggacuucacggccguggagggcaacauggacuccuucauggcccaggucaagagccucgcgcagucccuguaccccugcagcgcccagcagcugaacgaggaccuccggcugcaccuccugcugaacaccuccgugaccugcaacgacgggagcccggccggcuacuaccugaaggagucccgcgggagccggcgcuggcuccuguuccuggagggcgggugguacugcuucaaccgggagaacugcgacucccgcuacgacaccaugcggcgccucaugagcucccgggacuggccccgcacgcggaccggcaccggcauccugagcucccagcccgaggagaaccccuacugguggaacgccaacaugguguucaucccguacugcagcuccgacgucuggagcggggcguccagcaagagcgagaagaacgaguacgccuucaugggcgcccugaucauccaggagguggugcgcgagcuccuggggcggggccuguccggcgccaagguccuccugcuggccgggagcuccgcgggcgggaccggcgugcuccugaacguggaccgcgucgccgagcagcuggagaagcucggguaccccgccauccaggugcggggccuggccgacagcggcugguuccuggacaacaagcaguaccgccacacggacugcguggacaccaucacgugcgcccccaccgaggcgauccgccgggggauccgcuacuggaacggcgucgugcccgagcggugccgccggcaguuccaggagggggaggaguggaacugcuucuucggcuacaagguguacccgacccuccgcugccccgucuucguggugcaguggcuguucgacgaggcccagcugaccgucgacaacgugcaccucaccgggcagcccgugcaggagggccugcggcuguacauccagaaccucggccgcgagcugcggcacacccugaaggacguccccgccuccuucgccccggccugccucagccacgagaucaucauccgcucccacuggacggacgugcaggucaaggggaccagccugccccgggcgcugcacugcugggaccgcucccuccacgacagccacaaggccuccaagacgccccugaagggcugccccgugcaccugguggacagcugcccguggccccacugcaaccccuccugccccaccguccgggaccaguucaccgggcaggagaugaacguggcccaguuccucaugcacaugggcuucgacaugcagaccguggcccagccgcaggggcuggagcccagcgagcugcugggcaugcucuccaacggcagcuga

SEQ ID NO: 33710 - RNA, 1524 nt, Artificial Sequence
  derived and/or modified sequence opt1 from NOVA1__Homo_sapiens__NP_002506
augauggccgccgcgcccauccagcagaacggcacccacaccggggugccgaucgaccuggacccgcccgacagccgcaagcggccccucgaggccccgcccgaggccggcuccacgaagcgcaccaacaccggggaggacggccaguacuuccugaagguccugauccccagcuacgccgccggguccaucaucggcaagggcgggcagaccaucgugcagcuccagaaggagacgggcgcgaccaucaagcugagcaaguccaaggacuucuaccccgggaccaccgagcgggugugccugauccagggcacggucgaggcccucaacgccgugcacggguucaucgccgagaagauccgcgagaugccccagaacguggcgaagaccgagcccgucagcauccugcagccccagaccaccgugaaccccgaccggaucaagcagacgcugccguccagccccaccaccaccaaguccagccccuccgaccccaugacgaccagccgcgccaaccaggugaagaucaucgucccgaacuccaccgccggccucaucaucggcaagggcggggccaccgugaaggccgugauggagcagagcggggcguggguccagcugucccagaagcccgacggcaucaaccugcaggagcggguggugacggucagcggcgagcccgagcagaaccgcaaggccguggagcucaucauccagaagauccaggaggacccccaguccgggagcugccugaacaucuccuacgccaacgugaccggcccggucgccaacagcaaccccaccgggagccccuacgccaacaccgcggaggugcugcccacggccgccgccgccgcgggccuccuggggcacgccaaccuggccggcguggccgccuucccggcgguccucuccggcuucaccgggaacgaccugguggccaucaccagcgcccugaacacccucgccuccuacggcuacaaccugaacacgcuggggcucggccugagccaggcggccgccaccggggcccuggccgcggccgccgccuccgccaaccccgcggccgccgccgccaaccuccuggcgaccuacgccagcgaggccuccgccagcggcuccaccgcgggcgggacggccggcaccuucgcccuggggagccucgccgccgcgaccgccgccaccaacggcuacuucggggccgccagcccccuggcggccuccgccauccugggcacggagaaguccaccgacggcagcaaggacguggucgagaucgccgugcccgagaaccucgucggggccauccugggcaagggcgggaagacccugguggaguaccaggagcucaccggcgcgcggauccagaucuccaagaagggggaguucgugccgggcacccgcaaccggaaggucacgaucaccgggacccccgccgccacccaggccgcgcaguaccugaucacgcagcgcaucaccuacgagcagggcgugcgggccgccaacccccagaaggugggguga

SEQ ID NO: 33711 - RNA, 1479 nt, Artificial Sequence
  derived and/or modified sequence opt1 from NOVA2__Homo_sapiens__NP_002507
auggagcccgaggccccggacagccgcaagcggccccuggagaccccgcccgagguggucugcaccaagcgcuccaacacgggcgaggagggggaguacuuccucaaggugcugauccccagcuacgccgcgggcuccaucaucgggaagggcgggcagaccaucgugcagcugcagaaggagaccggcgccaccaucaagcucagcaaguccaaggacuucuaccccggcacgaccgagcgggucugccuggugcaggggaccgccgaggcccugaacgccgugcacagcuucaucgcggagaagguccgcgagaucccccaggccaugaccaagcccgagguggugaacauccuccagccgcagacgaccaugaaccccgaccgggccaagcaggccaagcugaucguccccaacuccaccgcgggccugaucaucgggaagggcggggccaccgugaaggccgugauggagcagagcggcgccuggguccagcucucccagaagcccgagggcaucaaccugcaggagcgcguggugacggucagcggggagccggagcagguccacaaggccguguccgcgaucgugcagaaggugcaggaggacccccagagcuccagcugccugaacaucuccuacgccaacguggccggccccgucgccaacagcaaccccaccggguccccguacgccagccccgcggacgugcuccccgccgccgccgccgcguccgccgccgccgccagcggccugcugggccccgcggggcucgccggcgugggggccuucccggccgcgcugcccgccuucagcggcaccgaccugcucgccaucuccaccgcccugaacacgcuggccagcuacggguacaacaccaacucccucggccugggccugaacagcgcggccgccuccgggguccucgccgccguggcggccggcgccaaccccgccgccgcggccgccgccaaccugcuggcgagcuacgccggggaggccggcgccgggcccgccggcggcgcggccccgcccccgccgcccccgcccggggcccucggcuccuucgcccuggccgcggccgccaacggguaccugggcgccggggccggcggcggggcgggcgggggcggcgggccccucgucgccgccgccgcggccgccggcgccgccgggggcuuccugaccgcggagaagcuggccgccgagagcgccaaggagcucguggagaucgccgugcccgagaaccuggucggggcgauccugggcaagggcgggaagacccucguggaguaccaggagcugacgggcgcccggauccagaucuccaagaagggggaguuccugcccggcacccgcaaccggcgcgugaccaucaccgggagccccgccgccacgcaggccgcgcaguaccucaucucccagcgggucaccuacgagcagggcgugcgcgccagcaacccccagaaggugggcuga

SEQ ID NO: 33712 - RNA, 1074 nt, Artificial Sequence
  derived and/or modified sequence opt1 from NOV__Homo_sapiens__NP_002505
augcagagcgugcaguccaccagcuucugccugcgcaagcagugccucugccugaccuuccugcuccugcaccuccugggccaggucgccgccacgcagcggugcccgccccagugccccgggcgcugccccgcgacgcccccgaccugcgcccccggcgugcgggccgugcuggacgggugcuccugcugccuggucugcgcccgccagcggggcgagagcugcuccgaccucgagcccugcgacgagagcuccgggcuguacugcgaccgcagcgccgaccccuccaaccagaccggcaucugcaccgcgguggagggcgacaacugcguguucgacggggucaucuaccggagcggcgagaaguuccagccguccugcaaguuccagugcacgugccgcgacgggcagaucggcugcgugccccggugccagcuggacgugcuccugcccgagcccaacugcccggcgccccgcaaggucgaggugcccggggagugcugcgagaaguggaucugcggccccgacgaggaggacagccugggcgggcucacccuggccgccuaccggccggaggccacccugggcguggaggucuccgacagcuccgugaacugcaucgagcagaccaccgaguggaccgccugcagcaaguccugcgggaugggcuucagcacccgcgugacgaaccggaaccgccagugcgagaugcucaagcagacccggcugugcaugguccgccccugcgagcaggagcccgagcagcccaccgacaagaagggcaagaagugccugcggaccaagaagucccucaaggccauccaccuccaguucaagaacugcacgagccugcacaccuacaagccgcgcuucugcggggugugcagcgacggccggugcugcacgccccacaacaccaagaccauccaggccgaguuccagugcucccccgggcagaucgugaagaagcccgucauggugaucgggaccugcacgugccacaccaacugcccgaagaacaacgaggccuuccugcaggagcuggagcugaagaccacccgcggcaagauguga

SEQ ID NO: 33713 - RNA, 1584 nt, Artificial Sequence
  derived and/or modified sequence opt1 from NOX1__Homo_sapiens__NP_001258744
augggcaacuggguggucaaccacugguucagcgugcuguuccucguggucuggcuggggcugaacguguuccucuucguggacgcguuccugaaguacgagaaggccgacaaguacuacuacacccgcaagauccugggcuucugcucccggacccuccgcaagcagcuggaccacaaccugacguuccacaagcucgucgcguacaugaucugccugcacaccgccauccacaucaucgcccaccuguucaacuucgacugcuacagccggucccgccaggccaccgacgggagccucgccuccauccugagcucccugagccacgacgagaagaagggcggguccuggcucaaccccauccagagccggaacaccacgguggaguacgugaccuucaccuccaucgcgggccugaccggcgucaucaugacgaucgcccugauccucauggugaccagcgccaccgaguucauccgccgguccuacuucgagguguucugguacacccaccaccuguucaucuucuacauccuggggcucggcauccacgggaucggcgggaucguccgcggccagacggaggagagcaugaacgagucccacccgcggaagugcgccgagagcuucgagaugugggacgaccgcgacucccacugccggcgccccaaguucgagggccacccgcccgagagcuggaaguggauccuggcgcccgugauccuguacaucugcgagcggauccuccgcuucuaccggucccagcagaagguggucaucaccaagguggugaugcaccccagcaagguccuggagcugcagaugaacaagcgcggguucagcauggaggugggccaguacaucuucgugaacugccccuccaucagccuccuggaguggcaccccuucacccugaccuccgccccggaggaggacuucuucagcauccacauccgggccgccggggacuggacggagaaccucauccgcgccuucgagcagcaguacucccccaucccccggaucgaggucgacggccccuucggcaccgcgagcgaggacguguuccaguacgagguggccguccuggugggggccggcaucggggucaccccguucgccuccauccucaagagcaucugguacaaguuccagugcgccgaccacaaccucaagaccaagaagaucuacuucuacuggaucugccgcgagacgggcgcguucuccugguucaacaaccugcugaccagccucgagcaggagauggaggagcuggggaaggugggcuuccugaacuaccggcuguuccugaccggcugggacuccaacaucguggggcacgccgcccugaacuucgacaaggccaccgacaucgucacgggccucaagcagaagaccagcuucgggcgccccaugugggacaacgaguucuccaccaucgccaccagccaccccaaguccguggugggcgucuuccugugcgggccccgcacgcuggccaagagccuccggaagugcugccaccgcuacuccagccuggacccgcggaaggugcaguucuacuucaacaaggagaacuucuga

SEQ ID NO: 33714 - RNA, 1707 nt, Artificial Sequence
  derived and/or modified sequence opt1 from NOX3__Homo_sapiens__NP_056533
augaugggcugcuggauccugaacgaggggcucagcaccauccuggugcuguccuggcucggcaucaacuucuaccuguucaucgacaccuucuacugguacgaggaggaggagagcuuccacuacacgcgcgucauccugggguccacccucgccugggcccgggcgagcgcccugugccugaacuucaacugcaugcucauccugauccccgugucccgcaaccugaucagcuucauccggggcaccuccaucugcugccgcgggccguggcggcgccagcucgacaagaaccugcgguuccacaagcugguggccuacggcaucgccgucaacgccaccauccacaucguggcgcacuucuucaaccucgagcgcuaccacuggagccaguccgaggaggcccagggccugcuggccgcccucagcaagcuggggaacacgcccaacgaguccuaccugaaccccgugcggaccuuccccaccaacaccacgaccgagcuccugcgcaccaucgcgggcgucaccgggcuggugaucagccucgcccuggugcugaucaugacguccagcaccgaguucauccggcaggccuccuacgagcuguucugguacacccaccacgucuucaucguguucuuccucagccuggccauccacggcaccgggcgcaucgugcggggccagacgcaggacucccucagccugcacaacaucaccuucugccgcgaccgguacgccgaguggcagaccgucgcgcagugcccggugccccaguucuccggcaaggagcccagcgccuggaaguggauccuggggcccgugguccucuacgccugcgagcgcaucauccgguucuggcgcuuccagcaggagguggugaucaccaaggucgugagccacccguccggcgugcuggagcugcacaugaagaagcggggguucaagauggcccccggccaguacauccucguccagugccccgccaucagcucccuggaguggcaccccuucacgcugaccagcgcgccgcaggaggacuucuucuccgugcacauccgcgccgccggcgacuggaccgccgcccuccuggaggcguucggggccgagggccaggcccugcaggagcccuggagccucccccggcuggccguggacgggcccuucggcaccgcccugacggacgucuuccacuacccggugugcgucugcguggcggccgggaucggcgugacccccuucgccgcccuccugaaguccaucugguacaagugcagcgaggcgcagacgccccugaagcucuccaaggucuacuucuacuggaucugccgcgacgcccgcgccuucgagugguucgccgaccugcugcugagccucgagacccggauguccgagcagggcaagacccacuuccugagcuaccacaucuuccugaccgggugggacgagaaccaggcccuccacaucgcgcugcacugggacgagaacaccgacgugaucaccggccugaagcagaagacguucuacgggcgccccaacuggaacaacgaguucaagcagaucgccuacaaccacccguccagcuccaucggcguguucuucugcgggcccaaggcccucagccggacccugcagaagaugugccaccuguacuccagcgccgacccccgcggcguccacuucuacuacaacaaggaguccuucuga

SEQ ID NO: 33715 - RNA, 1617 nt, Artificial Sequence
  derived and/or modified sequence opt1 from NOX4__Homo_sapiens__NP_001137308
auggccgugagcuggcgcuccuggcuggccaacgagggcgucaagcaccucugccuguucaucuggcugagcaugaacgugcuccuguucuggaagaccuuccugcucuacaaccaggggcccgaguaccacuaccugcaccagaugcugggccucgggcugugccugucccgggcgagcgccuccgugcucaaccugaacugcagccugauccuccugccgaugugccgcacccugcucgccuaccugcggggcucccagaagguccccagccgccggacgcgccggcugcucgacaagucccgcaccuuccacaucacgugcggggugaccaucugcaucuucagcggcgugcacgucgccgcccaccuggugaacgcgcugaacuucuccgugaacuacagcgaggacuucgucgagcucaacgccgcccgguaccgcgacgaggacccccggaagcugcuguucaccaccgugcccggccucaccggggugugcauggucguggugcuguuccugaugaucaccgccuccacguacgcgauccgcgucagcaacuacgacaucuucugguacacccacaaccucuucuucguguucuacaugcugcugacccuccacguguccggcgggcugcugaaguaccagaccaaccucgacacgcacccgcccggcugcaucagccugaaccggaccuccagccagaacaucucccugcccgaguacuucagcgagcacuuccacgagcccuucccggagggguucagcaagcccgccgaguucacccagcacaaguucgucaagaucugcauggaggagccccgcuuccaggccaacuucccccagaccuggcucuggaucuccggcccgcugugccuguacugcgccgagcggcucuaccgcuacauccggagcaacaagcccgugacgaucaucuccgugaucagccaccccuccgacgucauggagauccgcauggugaaggagaacuucaaggcccggcccggccaguacaucacccugcacugcccgagcguguccgcgcuggagaaccaccccuucacccucaccaugugccccacggagaccaaggccaccuucgggguccaccugaagaucgugggcgacuggaccgagcgcuuccgggaccugcuccugcccccgagcucccaggacagcgagauccugcccuucauccagucccgcaacuaccccaaggacgacuggaagcccuacaagcugcgccggcucuacuucaucugggucugccgcgacauccagagcuuccggugguucgccgaccugcugugcaugcuccacaacaaguucuggcaggagaaccgcccggacuacgugaacauccagcuguaccugucccagacggacgggauccagaagaucaucggcgagaaguaccacgcccucaacagccggcuguucaucggccgcccccgguggaagcuccuguucgacgagaucgccaaguacaaccgcgggaagaccgugggcgucuucugcugcgggcccaacucccugagcaagacccugcacaagcucuccaaccagaacaacagcuacggcacccgguucgaguacaacaaggaguccuucagcuga

SEQ ID NO: 33716 - RNA, 2214 nt, Artificial Sequence
  derived and/or modified sequence opt1 from NOX5__Homo_sapiens__NP_001171708
augaacaccagcggcgaccccgcccagaccgggccggagggcugccgcgggacgauguccgccgaggaggacgcgcgguggcugcgcugggugacccagcaguucaagaccaucgccggcgaggacggggagaucagccuccaggaguucaaggccgcccugcacgucaaggaguccuucuucgccgagcgguucuucgcgcuguucgacagcgaccgcuccggcaccaucacgcuccaggagcugcaggaggcccugacccuccugauccacggcagccccauggacaagcugaaguuccucuuccagguguacgacaucgacggguccggcagcaucgaccccgacgagcugcggaccgugcugcaguccugccuccgcgagagcgccaucucccugcccgacgagaagcuggaccagcucacccuggcccuguucgagagcgcggacgccgacgggaacggcgccaucacguucgaggagcuccgggacgagcugcagcgcuucccgggggucauggagaaccugaccaucuccgccgcccacuggcucaccgcgcccgcgccccggccccgcccgcggcgcccccggcagcugacccgcgccuacuggcacaaccaccggagccagcuguucugccucgccacguacgccggccugcacgugcugcuguucggccuggccgccuccgcccaccgcgaccugggggccagcgugauggucgccaagggcugcgggcagugccucaacuucgacugcuccuucaucgcggugcugaugcugcggcgcugccucaccuggcugcgggccaccuggcuggcccaggugcucccccuggaccagaacauccaguuccaccagcugaugggcuacgucguggugggccucagccugguccacaccguggcccacacggugaacuucguccugcaggcccaggcggaggccucccccuuccaguucugggagcuccugcugaccacccgcccggggaucggcugggugcacgggagcgccagccccaccggcguggcccuccugcugcuccugcugcugauguucaucugcuccagcuccugcauccggcgcagcgggcacuucgaggucuucuacuggacgcaccucuccuaccugcugguguggcuccugcugaucuuccacggccccaacuucuggaaguggcuccuggugcccggcauccuguucuuccucgagaaggcgaucgggcuggccgucagccgcauggccgccgugugcaucauggaggugaaccugcucccguccaaggucacccaccuccugaucaagcggccgcccuucuuccacuaccgccccggcgacuaccucuaccugaacauccccaccaucgcccgguacgaguggcaccccuucaccaucagcuccgcgcccgagcagaaggacacgaucuggcugcacauccgcagccaggggcaguggaccaaccggcucuacgaguccuucaaggccagcgacccccugggccgcggguccaagcggcugagccgcuccgugaccaugcgcaagagccagcgguccagcaagggcuccgagauccuccuggagaagcacaaguucugcaacaucaagugcuacaucgacggcccguacgggacccccacgcggcgcaucuucgccagcgagcacgccguccugaucggcgccgggaucggcaucacccccuucgcgagcauccuccaguccaucauguaccggcaccagaagcgcaagcacacgugccccagcugccagcacuccuggaucgagggggugcaggacaacaugaagcugcacaagguggacuucaucuggaucaaccgggaccagcgcagcuucgagugguucgucucccugcucaccaagcuggagauggaccaggccgaggaggcccaguacggccgguuccuggagcuccacauguacaugaccagcgcccugggcaagaacgacaugaaggccaucgggcugcagauggcgcucgaccugcuggccaacaaggagaagaaggacuccaucaccggccuccagacccgcacccagccggggcggcccgacuggagcaagguguuccagaagguggccgccgagaagaagggcaagguccagguguucuucugcggcucccccgcgcuggccaaggugcugaaggggcacugcgagaaguucggcuuccgcuucuuccaggagaacuucuga

SEQ ID NO: 33717 - RNA, 1284 nt, Artificial Sequence
  derived and/or modified sequence opt1 from NOXA1__Homo_sapiens__NP_001242997
auggccagccugggcgaccucgugcgcgccuggcaccugggggcgcaggccgucgaccggggcgacugggcccgcgcccugcaccucuucuccggggugcccgccccgcccgcgcggcugugcuucaacgccggcugcgugcaccuccuggccggggaccccgaggccgcgcugcgcgccuucgaccaggccgucaccaaggacacgugcauggccgugggcuucuuccagcggggcguggccaacuuccagcuggcgcgcuuccaggaggcccucagcgacuucuggcuggcccuggagcagcuccgggggcacgccgccaucgacuacacccagcugggccugcgcuucaagcuccaggcgugggagguccugcacaacguggccuccgcccagugccagcuggggcucuggaccgaggccgccagcucccugcgggaggcgaugagcaaguggcccgagggcucccugaacgggcucgacagcgcccuggaccaggugcagggcccgggcgccaaccacgacgcccgcucccugaucauggacagcccccgggccgggacccaccagggcccccucgacgcggagaccgaggucggggccgaccgcugcacguccaccgccuaccaggagcagcggccccagguggagcaggucggcaagcaggccccgcugagccccggccugcccgcgaugggcgggcccgggccgggccccugcgaggaccccgccggggccggcggcgccggggccggcggguccgagccccucgugaccgugaccgugcagugcgcguucacggucgcccugcgcgcccggcgcggcgccgaccugagcucccuccgggcccugcuggggcaggcgcucccgcaccaggcccagcugggccagcugagcuaccucgcccccggcgaggacgggcacugggugcccauccccgaggaggagucccugcagcgcgccuggcaggacgccgcggccugcccgcggggccugcagcuccagugccgcggggccggcgggcggcccgugcuguaccaggucguggcccagcacagcuacuccgcgcagggccccgaggaccugggcuuccgccagggggacaccguggacguccucugcgaggagcccgacgugccgcuggccguggaccaggccuggcuggagggccacugcgacgggcgcaucggcaucuuccccaagugcuucgucgugcccgccggcccccggaugagcggggccccgggccgccucccccggagccagcagggggaccagcccuga

SEQ ID NO: 33718 - RNA, 1113 nt, Artificial Sequence
  derived and/or modified sequence opt1 from NOXO1__Homo_sapiens__NP_653204
auggccggcccccgcuacccggugagcguccagggggccgcccuggugcagaucaagcggcuccagaccuucgccuucuccgugcgcuggagcgacggcuccgacaccuucguccggcgcagcugggacgaguuccggcagcugaagacgcugaaggagaccuuccccguggaggccgggcuccugcgccgguccgaccgcgugcugcccaagcuccuggacgcgccccugcucggccgggucgggcgcaccagccggggccuggcccgccugcagcuccuggagaccuacucccggcgccugcucgccacggccgagcggguggcccgcagcccgaccaucaccggcuucuucgcgccccagccccuggaccuggagcccgcccucccgcccgggucccgggugauccugcccacccccgaggagcagccgcugagccgcgccgccggccggcucuccauccacagccuggaggcccagucccugcgcugccuccagcccuucugcacgcaggacacccgggaccgccccuuccaggcccaggcgcaggagagccuggacguccugcuccgccaccccuccgggugguggcugguggagaacgaggaccggcagaccgccugguucccggcccccuaccuggaggaggccgcccccggccaggggcgcgagggcggccccagccucggguccagcggcccgcaguucugcgcgucccgggccuacgagagcagccgcgccgacgagcuguccgugcccgccggggcccggguccgcgugcuggagaccagcgaccggggcugguggcucugccgcuacggcgaccgggcggggcugcugcccgccgugcuccugcgccccgagggccugggggcccuccuguccggcacgggguuccggggcggcgacgacccggccggggaggcccgcggcuuccccgagcccagccaggcgaccgcgcccccgcccaccguccccacccggccgucccccggggccauccagagccgcugcugcacggugacccggcgcgcccuggagcggcgcccccggcgccagggccgcccccgggggugcguggacuccgucccgcaccccaccaccgagcaguga

SEQ ID NO: 33719 - RNA, 3471 nt, Artificial Sequence
  derived and/or modified sequence opt1 from NPAP1__Homo_sapiens__NP_061831
augggcaaccugcucagcaaguuccgccccgggugccggcgccggccccugcccggccccgggcgcggcgcccccgccccgcugucccgggacgccuccccgcccgggcgcgcccacuccgugcccacgccccggcccuuccgcggccucuuccggcgcaacgcccggcgccggcccagcgccgccuccaucuucgucgcccccaagcgccccugcccccugccccgggccgccgccgcgccccugggcgugcuccccgccgugggguggggccuggccauccgcaagacccccaugcugcccgcccggaacccgccccgcuucgggcaccccagcuccguccggaucccgccgcccagccgcauguucacccuccugcugcccagcccccgcgagcccgccgugaaggcgcgcaagcccauccccgccacccuccuggaggagaccgaggugugggcccaggagggcccccgccgggucaagaaggacgaggaccccgugcagaucgagggggaggacgacgagaagcgcacgccccugagcuccggcgaggccagcuccaccagccggucccagggcacccagggggacguggccagcuuccgcugcucccccggcccccucgaggggaacgucuaccacaaguucagcgagaacuccaugagcgagaaggcgcaggccagccccgccuccagcugccuggagggccccgccaugcccuccacccacagccaggccggcugcgcgcggcaccuggggaagcccgaccccgacgccaccgcgccgcccgagcccgccgugggcugcucccuccugcagcagaagcuggccgcggaggugcucaacgaggagcccccgcccagcucccuggggcugcccaucccgcucaugagcggcaagcgcaugcccgacgagaagcccuucugcaucccgccccgguccgccgccccgccccgggccgcgcggaaccgccccugcaagcggaagaugagcaucccccugcugcucccccugcccccgucccugccccuccugugggaccgcggggagcugccgccgcccgccaagcuccccugccugagcgucgagggcgaccugcacacccucgagaagucccccgaguacaagcggaacagccgcauccuggaggacaagaccgagaccaugaccaacuccagcaucacccagcccgcccccuccuucagccagcccgugcagaccaccgacucccugccccucaccaccuacaccagccaggugagcgcgccccugcccauccccgaccuggccgaccucgcgaccggcccccugauccugcccaucccgccccucuccaccacgcccaagauggacgagaagaucgccuucaccauccccaacagcccgcuggcccugcccgccgaccucguccccauccugggggaccaguccaacgagaagggcgggagcuacaacuccguggugggcgccgcgccccugaccagcgacccgcccacgccgcccuccagcacgccguccuucaagccgcccgucacccgggagagcccgaucuccaugugcguggacuccccgccgccccuguccuuccucacccugcugcccgugcccagcaccgggacguccgucaucaccagcaagcccaugaacuccaccagcgugaucagcaccgugacgaccaacgccuccgcccaccucaccagccagaccgccgucgaccccgagguggucaacauggacacgaccgccccgucccagguggugaucuucaccagcucccugagcucccgcgucagcucccugcccaacagccagauccacugcuccgcggagcagcggcaccccggcaagaccagcguguacaccagcccccucccguucaucuuccacaacacgacccccagcuucaaccagcuguucggcaaggaggccacgccccagcccaaguucgaggccccggacgggcagccccagaaggccucccugcccagcgcgugcguguuccucucccugcccaucaucccgccgcccgacaccagcacgcuggucaacuccgccagcaccgccagcuccagcaagcccccgaucgagaccaacgccaugcacaccacgccgcccuccaaggccgugauccuccagagcgcguccgugagcaagaaguaccugcccuucuaccugggccucccgggguccggcaacacccagcccagcgggaacaccgccuccguccagggcagcaccucccugcccgcccagagcgugcgcgccccggccacggcguccaaccacccccugaaccccggcgccacgccccagccgaaguucggggcccccgacggcccccagcagaagaccagccuccccuccgcccacgacuuccugagccugccgaucauggugccgcccgacaccuccacgcucgucagcuccgccagcgcggccagccuguccaagcccgccaucgacaccagcgacaugaacaccaccccgcccuccaagacggugauccugcagagcaccuucgugucccggaaggaggaguacauccgcuucuacauggggcuccccggcagcggcaacacccugcacuccgacagcaucgccuccgcgcaggucagcaccuccuuccccgcccaggccgaccgccggccgacgaccaccagcucccacccccugaacaccgggagcaucucccacagcacgcucggcgccaccgacgggcagcagaaguccgacagcuccuucauccugggcaaccccgccacccccgcgccggugaucgggcugaccagccccagcgugcagccccucuccggcagcaucaucccgcccggcuucgccgagcugacgucccccuacaccgcccuggggacccccgucaacgccgagccgguggagggccacaacgccagcgcguuccccaacgggaccgccaagacguccggcuuccgcaucgccaccgggaugcccggcaccggcgacagcacccuccugguggggaacaccauccccggcccgcaggucaucauggggcccggcacgcccauggacgggggcuccaucggcuucagcauguccgcccccgggccgagcuccaccagcggcgagcugaacaucgggcagggccaguccgggacccccagcaccacguccguguuccccuucggccaggccgcgugggaccccaccggccacagcauggccgccgccccgcagggggccuccaacauccccguguucggcuacaccagcgcggccgccuacauccccgggcucgacccgcccacccagaacuccugcagcggcaugggcggggacggcacgcggagcaucgucgggggccccugcgugcccgccuuccagcagugcauccugcagcacaccuggaccgagcgcaaguucuacaccuccagcacgcacuacuacgggcaggagaccuacgugcggcgccacgucugcuuccagcugcccuga

SEQ ID NO: 33720 - RNA, 2475 nt, Artificial Sequence
  derived and/or modified sequence opt1 from NPAS2__Homo_sapiens__NP_002509
auggacgaggacgagaaggaccgcgccaagcgggccagccgcaacaaguccgagaagaagcggcgcgaccaguucaacgugcugaucaaggagcucagcuccaugcugcccggcaacacccggaagauggacaagaccacgguccuggagaaggugaucggguuccuccagaagcacaacgaggugagcgcgcagaccgagaucugcgacauccagcaggacuggaagcccuccuuccugagcaacgaggaguucacccagcugaugcucgaggcccuggacggcuucaucaucgccgucaccacggacggguccaucaucuacgugagcgacuccaucacgccccugcucggccaccuccccagcgacgugauggaccagaaccugcugaacuuccugcccgagcaggagcacuccgaggucuacaagauccugagcucccacaugcucgugaccgacagcccgucccccgaguaccugaaguccgacagcgaccuggaguucuacugccaccuccugcgcgggagccugaaccccaaggaguuccccaccuacgaguacaucaaguucgugggcaacuuccgguccuacaacaacgucccgagccccagcugcaacggcuucgacaacacccucucccgccccugccgggugccccuggggaaggaggugugcuucaucgccaccguccgccuggccaccccgcaguuccucaaggagaugugcaucguggacgagccccuggaggaguucaccagccggcacucccuggaguggaaguuccucuuccuggaccaccgcgcgccgcccaucaucggcuaccugcccuucgaggugcucgggacgagcggcuacgacuacuaccacaucgacgaccuggagcugcucgcccggugccaccagcaccugaugcaguucgggaagggcaaguccugcugcuaccgcuuccugaccaagggccagcaguggaucuggcuccagacccacuacuacaucaccuaccaccaguggaacagcaagcccgaguucaucgucugcacgcacuccguggugagcuacgccgacguccggguggagcgccggcaggagcuggcccuggaggacccgcccuccgaggcgcuccacagcuccgcccugaaggacaaggggagcucccuggagccccgccagcacuucaacacccucgacgugggcgccagcgggcugaacaccucccacagccccuccgccagcucccggagcagccacaaguccagccacaccgccauguccgagcccacgagcacccccaccaagcugauggcggaggccuccaccccggcccucccccgcagcgccacgcugccccaggagcugcccgucccgggccucucccaggccgcgaccaugcccgcgccccugccgagccccuccagcugcgaccugacccagcagcugcucccccagaccgugcugcaguccacgcccgccccgauggcccaguucagcgcccaguucuccauguuccagaccaucaaggaccagcuggagcagcggacccgcauccuccaggccaacauccgcuggcagcaggaggagcugcacaagauccaggagcagcugugccucgugcaggacagcaacguccagauguuccugcagcagcccgccgugucccugagcuucuccagcacccagcggcccgaggcccagcagcagcuccagcagcgcagcgccgccgucacgcagccccagcugggcgcggggccgcagcugcccggccagaucuccagcgcccaggugaccucccagcaccuccugcgggagagcuccgugaucagcacccaggggcccaagcccaugcgcuccagccagcugaugcaguccagcggccgguccgggagcucccucgucagcccguucuccagcgccaccgccgcgcugccgcccucccugaaccucacgacccccgccagcaccucccaggacgccagccagugccagcccagccccgacuucucccacgaccgccagcugcggcugcuccugagccagcccauccagcccaugaugccgggcuccugcgacgcccgccagcccagcgaggugucccggaccggccgccaggugaaguacgcccagagccagaccgucuuccagaaccccgacgcgcaccccgccaacuccagcuccgccccgaugcccgugcugcucauggggcaggccgugcugcaccccagcuucccggccucccagcccagcccccugcagcccgcgcaggcccggcagcagccgccccagcacuaccuccagguccaggcccccacgucccugcacagcgagcagcaggacucccugcuccugagcaccuacucccagcagcccggcacccugggguacccgcagcccccgcccgcccagccccagccccuccgcccgccccggcgcgugagcucccugagcgagagcuccggccugcagcagccgccccgguga

SEQ ID NO: 33721 - RNA, 2802 nt, Artificial Sequence
  derived and/or modified sequence opt1 from NPAS3__Homo_sapiens__NP_001158221
auggcccccaccaagccgagcuuccagcaggaccccucccgccgggagcgcaucaccgcccagcacccccugcccaaccagagcgagugccggaagaucuaccgcuacgacggcaucuacugcgaguccacguaccagaaccuccaggcgcugcggaaggagaagagccgcgacgccgcccggucccgccgggggaaggagaacuucgaguucuacgagcuggccaagcuccugccgcugcccgccgcgaucaccagccagcucgacaaggccuccaucauccgccugaccaucagcuaccugaagaugcgggacuucgccaaccagggcgacccccccuggaaccuccgcauggaggggccgccccccaacaccuccgugaaggucaucggcgcccagcggcgccggagccccuccgcgcuggccaucgagguguucgaggcccaccuggggagccacauccuccagucccuggacggcuucguguucgcccugaaccaggagggcaaguuccucuacaucagcgagacggucuccaucuaccuggggcugagccagguggagcucaccggcuccagcguguucgacuacguccacccgggggaccacguggagauggccgagcagcugggcaugaagcugccccccgggcgcggccuccugucccagggcaccgcggaggacggggccagcagcgccuccagcuccagccaguccgagacccccgagccgguggagagcacgucccccagccugcucaccaccgacaacacccuggagcgguccuucuucauccgcaugaagagcacgcugaccaagcggggcguccacaucaaguccagcggguacaaggugauccacaucaccggccgccuccggcugcgcgugucccugagccacggccgcaccguccccucccagaucauggggcucgugguggucgcccacgcccugcccccgcccacgaucaacgaggugcggaucgacugccacauguucgugacccgcgucaacauggaccugaacaucaucuacugcgagaaccggaucagcgacuacauggaccucacccccguggacaucgugggcaagcgcugcuaccacuucauccacgcggaggacgucgaggggauccggcacucccaccuggaccugcucaacaagggccagugcgugaccaaguacuaccgcuggaugcagaagaacgggggcuacaucuggauccagagcuccgccacgaucgccaucaacgccaagaacgccaacgagaagaacaucaucugggugaacuaccugcugagcaaccccgaguacaaggacaccccgauggacaucgcgcagcucccccaccugcccgagaagaccagcgaguccagcgagaccuccgacagcgaguccgacagcaaggacacguccggcaucaccgaggacaacgagaacagcaaguccgacgagaaggggaaccagagcgagaacuccgaggaccccgagccggaccggaagaagagcggcaacgccugcgacaacgacaugaacugcaacgacgacgggcacuccagcuccaaccccgacagccgcgacuccgacgacagcuucgagcacagcgacuucgagaaccccaaggccggcgaggacggguucggcgcccugggcgccaugcagaucaaggucgagcgguacguggaguccgagagcgaccuccgccugcagaacugcgagucccugaccagcgacuccgcgaaggacagcgacuccgccggggaggccggcgcccaggcgagcuccaagcaccagaagcggaagaagcgccggaagcgccagaaggggggcagcgccucccggcgccggcucagcuccgccagcuccccggggggccuggacgccggccuggucgagcccccccgccuccugagcucccccaacagcgccuccgugcugaagaucaagaccgagaucagcgagccgaucaacuucgacaacgacagcuccaucuggaacuacccccccaaccgggagaucagccgcaacgagucccccuacagcaugacgaagccgcccuccagcgagcacuuccccuccccccaggggggcgggggcggcgggggcgggggcgggggccugcacguggcgaucccggacagcguccucaccccccccggcgccgacggggccgccgcccgcaagacccaguucggcgcguccgccaccgccgcccuggcccccguggcgagcgacccgcugucccccccccucagcgccuccccccgggacaagcacccggggaacggcgggggcggcgggggcgggggcgggggcgccggcgggggcgggcccagcgccuccaacagccugcuguacacgggcgaccucgaggcgcugcagcgccugcaggccgggaacgugguccucccccuggugcaccgggugaccggcacccuggccgccaccuccacggccgcgcagcgcgucuacaccaccggcaccauccgguacgcccccgccgaggugacccucgccaugcagagcaaccugcugccgaacgcccacgcggugaacuucgucgacgugaacucccccggguucggccucgaccccaagacgccgauggagaugcuguaccaccacgugcaccgccugaacaugagcgggcccuucggcggcgccgucagcgccgccucccucacccagaugcccgccgggaacguguucaccaccgcggagggccuguucagcacgcugcccuucccgguguacuccaacgggauccacgccgcccagacccucgagcggaaggaggacuga

SEQ ID NO: 33722 - RNA, 2409 nt, Artificial Sequence
  derived and/or modified sequence opt1 from NPAS4__Homo_sapiens__NP_849195
auguaccgcagcaccaagggcgccuccaaggcccggcgcgaccagaucaacgcggagauccggaaccugaaggagcuccugccccuggccgaggccgacaaggugcgccucagcuaccugcacaucaugucccuggccugcaucuacacccggaagggggucuucuucgccggcgggacgccgcucgcgggccccaccgggcugcugagcgcccaggagcucgaggacaucguggccgcccugcccggcuuccugcucguguucaccgcggagggcaagcugcuguaccucuccgagagcgucuccgagcaccuggggcacagcaugguggaccugguggcccagggcgacuccaucuacgacaucaucgaccccgccgaccaccucaccguccgccagcagcugacgcugccgagcgcccucgacaccgaccggcuguuccgcugccgguucaacaccuccaagagccugcgccggcaguccgccgggaacaagcucgugcugauccgcggccgguuccacgcgcacccgcccggggccuacugggccggcaaccccguguucaccgccuucugcgccccgcuggagccccgcccccggcccggcccggggcccggccccgggcccgcgagccucuuccuggccauguuccagucccgccacgccaaggaccuggcccuccuggacaucagcgaguccguccugaucuaccucggcuucgagcggagcgagcugcugugcaaguccugguacggccuccugcacccggaggaccuggcccacgcgagcgcccagcacuaccgccuccuggccgagagcggggacauccaggccgagaugguggugcggcugcaggccaagacgggcgggugggcguggaucuacugccuccuguacuccgagggccccgaggggcccaucaccgccaacaacuaccccaucagcgacauggaggccuggucccugcgccagcagcucaacagcgaggacacccaggccgcguacguccugggcaccccgacgaugcugcccuccuuccccgagaacauccucagccaggaggagugcuccagcaccaacccccuguucaccgccgcccugggcgccccgcgguccaccagcuuccccuccgcccccgagcugagcgugguguccgcgagcgaggagcucccccgcccguccaaggagcuggacuucagcuaccugacguuccccuccgggcccgagccgagccuccaggccgagcuguccaaggaccuggucugcaccccgcccuacacgccccaccagcccggcgggugcgccuuccucuucagccugcacgagcccuuccagacccaccuccccacccccagcuccacccugcaggagcagcugaccccgagcaccgccacguucuccgaccagcugacccccagcuccgccaccuuccccgacccccucaccagcccgcugcagggccagcugacggagaccuccgugcgcagcuacgaggaccagcucacccccugcaccuccacguuccccgaccagcugcugcccagcaccgcgaccuucccggagccccucgggucccccgcccacgagcagcugaccccgcccagcacggccuuccaggcccaccuggacucccccagccagaccuuccccgagcagcucucccccaaccccaccaagaccuacuucgcccaggagggcugcagcuuccuguacgagaagcugccgcccucccccagcagccccggcaacggggacugcacccuccuggcgcuggcccagcuccggggcccccuguccguggacgucccccuggugccggaggggcuccugacgcccgaggccagccccgugaagcaguccuucuuccacuacagcgagaaggagcagaacgagaucgaccgccugauccagcagaucucccagcucgcccagggcauggaccggcccuucagcgcggaggccgggaccggcggccuggagccgcucgggggccuggagccccuggacuccaaccugagccucuccggggccggcccgcccguccugagccuggaccucaagcccuggaagugccaggagcuggacuuccuggccgaccccgacaacauguuccucgaggagacccccguggaggacaucuucauggaccuguccacccccgacccgagcgaggaguggggcuccggggaccccgaggccgagggccccgggggcgcgcccagcccgugcaacaaccugucccccgaggaccacagcuuccucgaggaccuggccacguacgagaccgccuucgagaccgggguguccgccuuccccuacgacggcuucaccgacgagcugcaccagcuccagagccagguccaggacuccuuccacgaggacggcagcgggggcgagcccacguucuga

SEQ ID NO: 33723 - RNA, 4284 nt, Artificial Sequence
  derived and/or modified sequence opt1 from NPAT__Homo_sapiens__NP_002510
augcugcuccccagcgacguggcccgccugguccugggcuaccuccagcaggagaaccugaucuccacgugccagaccuucauccuggagagcuccgaccucaaggaguacgccgagcacugcacggacgagggguucaucccggcgugccugcugagccucuucggcaagaaccugaccaccauccugaacgaguacguggccaugaagaccaaggagacguccaacaacgugcccgccaucaugagcucccucuggaagaagcuggaccacacccugagccagauccgguccaugcagagcagcccccgcuucgccgggucccagcgggcccgcacccggaccggcaucgcggagaucaagcgccagcggaagcucgccucccagacggcccccgccagcgcggagcugcugacccucccguaccuguccgggcaguucaccaccccgcccagcacgggcacccaggucacccgccccuccggccagaucagcgaccccucccggagcuacuucgugguggucaaccacagccagucccaggacaccgugacgaccggggaggcccugaacgugauccccggcgcccaggagaagaaggcccacgccagccucaugucccccgggcgccgcaagagcgagucccagcgcaagagcaccacccuguccggcccccacagcacgauccggaacuuccaggacccgaacgcguucgccgucgagaagcagauggugaucgagaacgcccgcgagaagauccuguccaacaagagccuccaggagaagcuggccgagaacaucaacaaguuccugaccuccgacaacaacaucgcccaggugcccaagcagaccgacaacaaccccaccgagcccgagacgagcaucgacgaguuccucgggcugccguccgagauccacaugagcgaggaggcgauccaggacauccuggagcagaccgaguccgaccccgccuuccaggcccucuucgaccuguucgacuacggcaagaccaagaacaacaagaacaucagccaguccaucagcucccagcccauggagagcaaccccagcaucguccuggccgacgagaccaaccucgccgugaagggcuccuucgagacggaggagagcgacgggcaguccggccagccggcguucugcaccagcuaccagaacgacgacccccugaacgcccugaagaacuccaacaaccacgacgugcuccggcaggaggaccaggagaacuucagccagaucuccaccagcauccagaagaaggccuucaagaccgccguccccacggagcagaagugcgacaucgacaucaccuucgaguccgugcccaaccugaacgacuucaaccagcgcgggaacagcaacgccgagugcaacccgcacugcgcggagcuguacaccaaccagauguccaccgagaccgagauggccaucggcaucgagaagaacagccucuccagcaacgugcccuccgagagccagcugcagcccgaccagcccgacaucccgaucaccuccuucgucagccugggcugcgaggccaacaacgagaaccucauccugagcgggaaguccagccagcugcucucccaggacaccagccugaccggcaagcccuccaagaagucccaguucugcgagaacagcaacgacaccgugaagcugaagaucaacuuccacgggagcaaguccagcgacuccagcgaggugcacaaguccaagaucgagaucaacguccucgagcccgugaugagccagcuguccaacugccaggacaacagcugccugcaguccgagauccugccggugagcgucgaguccagccaccucaacgugagcggccaggucgagauccaccugggggacucccugagcuccacgaagcagcccagcaacgacuccgccagcguggagcucaaccacaccgagaacgaggcgcaggccuccaagagcgagaacucccaggagcccagcuccagcgugaaggaggagaacaccaucuuccugucccugggcggcaacgccaacugcgagaaggucgcccucacgcccccggaggggacccccguggagaacagccacucccugccgcccgagagcgugugcuccagcgucggcgacucccaccccgagagccagaacaccgacgacaagcccagcuccaacaacagcgccgagaucgacgcguccaacaucgugagccugaaggugaucaucuccgacgaccccuucgucagcuccgacaccgagcucaccagcgccguguccagcaucaacggggagaaccugcccacgaucauccuguccagcccgaccaagucccccaccaagaacgccgagcucgugaagugccugagcuccgaggagaccgucggcgccgugguguacgccgaggucggggacagcgcguccauggagcagagccugcucacguucaaguccgaggacagcgccgugaacaacacccagaacgaggacggcaucgccuucagcgccaacgugacccccugcgucuccaaggacggcggguacauccagcugaugcccgccaccagcacggcguucggcaacuccaacaacauccugaucgcgaccugcgugaccgacccgaccgcccucgggacgagcgugucccagagcaacgucguggugcugcccggcaacuccgcccccaugaccgcccagccccugccgccccagcuccagaccccgccccggagcaacuccgucuucgccgugaaccaggccgugagccccaacuucucccaggggagcgccaucaucaucgccucccccguccagcccgugcugcagggcauggugggcaugaucccggucagcgugguggggcagaacggcaacaacuucuccaccccgccccggcagguccugcacaugccccucacggcgcccgugugcaaccggagcaucccccaguuccccgugcccccgaagucccagaaggcccaggggcugcgcaacaagcccugcaucggcaagcaggucaacaaccugguggacagcuccggccacagcguggggugccacgcccagaagaccgaggucagcgacaaguccaucgccaccgaccucggcaagaaguccgaggagaccacggugcccuuccccgaggagagcaucgugccggccgcgaagcccugccaccggcgcguccugugcuucgacagcaccaccgcccccguggccaacacccaggggcccaaccacaagauggugucccagaacaaggagcgcaacgccgucagcuucccgaaccuggacucccccaacgugagcuccacgcucaagccgcccagcaacaacgccaucaagcgggagaaggagaagccgccccugcccaagauccuguccaagagcgaguccgcgaucagccgccacaccaccauccgggagacccaguccgagaagaaggugagccccacggagaucguccucgaguccuuccacaaggccaccgccaacaaggagaacgagcugugcagcgacguggagcgccagaagaaccccgagaacuccaagcugagcaucggccagcagaacgggggccuccggagcgagaaguccaucgccagccugcaggagaugaccaagaagcagggcaccuccagcaacaacaagaacgugcuguccgucgggaccgcggugaaggaccucaagcaggagcagacgaaguccgccagcagccugaucaccaccgagaugcugcaggacauccagcgccacuccagcgucucccggcucgccgacagcuccgaccugcccgugccccgcacccccggcagcggggccggcgagaagcacaaggaggagccgaucgacaucaucaaggcccccuccagccggcgcuucuccgaggacagcagcacguccaaggugauggugcccccggucacccccgaccugcccgcgugcagccccgccuccgagaccgggagcgagaacuccgugaacauggccgcccacacccucaugauccugagccgggccgcgaucucccgcacgaccagcgccaccccgcugaaggacaacacccagcaguuccgggccuccagccgcuccacgaccaagaagcggaagaucgaggagcucgacgagcgcgagcggaacagccgccccuccagcaagaaccugaccaacuccagcauccccaugaagaagaagaagaucaagaagaagaagcugcccuccagcuucccggccggcauggacgucgacaaguuccuccugucccugcacuacgacgaguga

SEQ ID NO: 33724 - RNA, 378 nt, Artificial Sequence
  derived and/or modified sequence opt1 from NPB__Homo_sapiens__NP_683694
auggcccgcagcgccacccuggcggccgccgcccucgcccugugccugcuccuggcgcccccgggccuggccugguacaagcccgccgccgggcacuccagcuacuccgugggccgggcggccgggcuccugagcggccugcgccggucccccuacgcccgccggagccagcccuaccgcggggccgagccgcccggcggcgccggggcgucccccgagcuccagcugcacccccggcugcgcagccucgccgucugcgugcaggacguggccccgaaccugcagcggugcgagcgccugcccgacggccgggggaccuaccagugcaaggccaacgucuuccucucccugcgcgccgcggacugccuggccgccuga

SEQ ID NO: 33725 - RNA, 987 nt, Artificial Sequence
  derived and/or modified sequence opt1 from NPBWR1__Homo_sapiens__NP_005276
auggacaacgccagcuucuccgagcccuggccggccaacgcgagcggccccgaccccgcccuguccugcagcaacgccuccacccucgcgccccugccggcgccccuggccguggccguccccgugguguacgccgucaucugcgccguggggcucgccggcaacagcgccgugcuguacguccugcuccgcgcgccccggaugaagaccgugaccaaccuguucauccugaaccucgccaucgccgacgagcuguucacccuggugcucccgaucaacaucgccgacuuccugcugcgccaguggcccuucggggagcucaugugcaagcugaucgucgccaucgaccaguacaacaccuucuccagccuguacuuccucaccgugauguccgccgaccgguaccuggugguccuggccacggccgagagccgccggguggcgggccgcaccuacuccgccgcccgggccgugagccucgccgucugggggaucgugacccuggugguccugcccuucgcgguguucgcccgccucgacgacgagcagggccggcgccagugcgugcuggucuucccccagccggaggccuucugguggcgggccucccgccuguacacccucgugcugggcuucgccauccccgugagcacgaucugcguccuguacaccacccuccugugccggcugcacgcgaugcgccucgacucccacgccaaggcccuggagcgggccaagaagcgcgugaccuuccuggucguggcgauccucgccgugugccugcugugcuggacgcccuaccaccucagcaccgucguggcccugaccaccgaccugccccagacgccgcucgugaucgccaucuccuacuucaucaccagccuguccuacgccaacagcugccugaaccccuuccucuacgcguuccuggacgccagcuuccggcgcaaccugcggcagcucaucacgugccgcgccgccgccuga

SEQ ID NO: 33726 - RNA, 3837 nt, Artificial Sequence
  derived and/or modified sequence opt1 from NPC1__Homo_sapiens__NP_000262
augaccgcccgcggccuggcccucgggcugcugcuccugcugcucugccccgcccagguguucagccaguccugcgucugguacggcgagugcgggaucgccuacggcgacaagcgguacaacugcgaguacagcgggccgcccaagccccugcccaaggacggcuacgaccuggugcaggagcucugcccgggcuucuucuucgggaacgugucccugugcugcgacguccgccagcugcagacccucaaggacaaccugcagcugccccuccaguuccugagccggugccccuccugcuucuacaaccugcucaaccuguucugcgagcugacgugcagcccccgccagucccaguuccucaacgugaccgccaccgaggacuacguggacccggucaccaaccagacgaagaccaacgugaaggagcugcaguacuacgugggccagagcuucgccaacgccauguacaacgcgugccgggacgucgaggcccccuccagcaacgacaaggcccuggggcuccugugcggcaaggacgccgacgcgugcaacgccaccaacuggaucgaguacauguucaacaaggacaacgggcaggcccccuucaccaucacgcccguguucuccgacuucccggugcacggcauggagcccaugaacaacgccaccaagggcugcgacgagagcgucgacgaggugaccgcccccugcuccugccaggacugcagcaucgugugcgggcccaagccgcagcccccgccgccgcccgcgcccuggaccauccugggccucgacgccauguacgucaucauguggaucacguacauggccuuccugcugguguucuucggggccuucuucgccguguggugcuaccgcaagcgguacuucgucuccgaguacacccccaucgacagcaacaucgcguucuccgugaacgccagcgacaagggcgaggccuccugcugcgaccccgugagcgccgccuucgagggcugccuccgccggcuguucacccgcugggggagcuucugcguccggaaccccggcugcgugaucuucuucucccugguguucaucaccgcgugcagcuccgggcucgucuucgugcgcgucacgaccaaccccguggaccuguggagcgcccccuccagccaggcccggcuggagaaggaguacuucgaccagcacuucggccccuucuuccgcaccgagcagcucaucauccgggcgccccugaccgacaagcacaucuaccagcccuacccguccggggccgacgugcccuucggcccgccccuggacauccagauccuccaccagguccuggaccugcagaucgcgaucgagaacaucacggccagcuacgacaacgagaccgugacccuccaggacaucugccuggcgccccugucccccuacaacaccaacugcacgauccucagcgugcugaacuacuuccagaacucccacagcguccuggaccacaagaagggcgacgacuucuucguguacgccgacuaccacacccacuuccucuacugcgugcgcgcccccgccucccugaacgacaccagccugcugcacgaccccugccucgggaccuucggcgggccggucuuccccuggcuggugcugggcggguacgacgaccagaacuacaacaacgccacggcccucgugaucaccuuccccgucaacaacuacuacaacgacaccgagaagcugcagcgggcccaggcgugggagaaggaguucaucaacuucgugaagaacuacaagaaccccaaccugaccaucuccuucacggccgagcgcagcaucgaggacgagcucaaccgggaguccgacagcgacguguucaccgucgugaucuccuacgccaucauguuccuguacaucagccuggcccucggccacaugaaguccugccgccggcugcugguggacagcaaggucagccucggcaucgccgggauccugaucgugcuguccagcguggcgugcucccucggcgucuucagcuacaucgggcugccgcugacccucaucgugaucgaggugauccccuuccugguccuggccgugggcguggacaacaucuucauccucguccaggccuaccagcgcgacgagcgccugcagggggagacccuggaccagcagcucggccgggugcugggcgagguggcccccuccauguuccugagcuccuucagcgagacggucgccuucuuccucggggcgcuguccgugaugcccgccgugcacaccuucagccuguucgccggccucgccgucuucaucgacuuccugcugcagaucacgugcuucgugucccuccuggggcuggacaucaagcgccaggagaagaaccggcucgacaucuucugcugcgugcgcggcgcggaggacggcaccagcguccaggccuccgagagcugccuguuccgguucuucaagaacuccuacagcccgcugcuccugaaggacuggaugcgccccaucgugaucgccaucuucguggggguccugagcuucuccaucgccgugcucaacaagguggacaucggccuggaccagagccuguccaugcccgacgacagcuacauggucgacuacuucaaguccaucagccaguaccuccacgccgggcccccgguguacuucgugcuggaggagggccacgacuacaccuccagcaaggggcagaacauggucugcggcggcauggggugcaacaacgacucccuggugcagcagaucuucaacgcggcccagcucgacaacuacacccggaucggcuucgcccccagcuccuggaucgacgacuacuucgacugggugaagccccagagcuccugcugccgcgucgacaacaucaccgaccaguucugcaacgccagcgugguggaccccgccugcguccggugccgcccgcugacccccgaggggaagcagcggccccagggcggggacuucaugcgcuuccugccgauguuccucuccgacaaccccaaccccaagugcggcaagggcgggcacgcggccuacagcuccgccgugaacauccugcugggccacgggacccgggucggcgccacguacuucaugaccuaccacaccgugcuccagaccagcgccgacuucaucgacgcgcugaagaaggcccgccugaucgccuccaacgugacggagaccauggggaucaacggcagcgccuaccgggucuuccccuacagcguguucuacguguucuacgagcaguaccucaccaucaucgacgacaccaucuucaaccugggcgucucccugggggcgaucuuccucgugacgauggugcugcugggcugcgagcucuggagcgccgucaucaugugcgccaccaucgccauggugcuggugaacauguucggggucauguggcuguggggcaucucccucaacgccgugagccuggugaaccuggucauguccugcgggaucagcguggaguucugcucccacaucacccgcgcguucaccgugagcaugaagggcucccgggucgagcgcgccgaggaggcccucgcccacaugggcagcuccguguucagcgggaucacgcugaccaaguucggcgggaucgugguccuggccuucgcgaagucccagaucuuccagaucuucuacuuccggauguaccucgccauggugcugcugggcgccacccacggccucaucuuccugccggugcugcucagcuacaucgggcccuccgucaacaaggccaagagcugcgccaccgaggagcgcuacaagggcacggagcgcgagcggcugcugaacuucuga

SEQ ID NO: 33727 - RNA, 3999 nt, Artificial Sequence
  derived and/or modified sequence opt1 from NPC1L1__Homo_sapiens__NP_001095118
auggccgaggccggccugcgcggguggcuccugugggcgcugcuccugcggcuggcccagagcgagcccuacaccaccauccaccagccgggcuacugcgccuucuacgacgagugcgggaagaaccccgagcucuccggcagccugaugacgcuguccaacgugagcugccucuccaacacccccgcccgcaagaucaccggggaccaccugauccugcuccagaagaucugcccccggcuguacaccggcccgaacacgcaggccugcugcagcgcgaagcagcuggucucccucgaggccagccuguccaucaccaaggcccugcucacccgcugccccgccugcagcgacaacuucgugaaccugcacugccacaacacgugcucccccaaccagagccuguucaucaacgugacccgggucgcgcagcucggcgccgggcagcugcccgccgugguggccuacgaggccuucuaccagcacuccuucgcggagcagagcuacgacuccugcagccgcguccgggugccggccgccgccacccuggccgugggcaccaugugcggggucuacggcuccgcgcucugcaacgcccagcgcuggcugaacuuccagggggacaccggcaacggccuggccccgcucgacaucacguuccaccuccuggagcccgggcaggccgugggcagcgggauccagccccucaacgagggcguggcccggugcaacgagucccagggcgacgacgucgcgaccugcagcugccaggacugcgccgccagcugccccgccaucgcccgcccccaggcgcuggacuccaccuucuaccuggggcagaugcccggcagccucgugcugaucaucauccugugcuccguguucgccgucgugaccauccuccuggugggguuccgggucgcccccgcccgcgacaagagcaagaugguggacccgaagaagggcacgucccugagcgacaagcucuccuucagcacccacacccugcuggggcaguucuuccagggcuggggcaccuggguggcguccuggccccucacgauccugguccugagcgugauccccguggucgcccucgccgccgggcugguguucaccgagcugaccaccgaccccgucgagcucugguccgccccgaacagccaggcgcgguccgagaaggccuuccacgaccagcacuucggccccuucuuccgcacgaaccaggugauccugaccgcccccaaccggagcuccuaccgcuacgacagccugcugcucgggcccaagaacuucuccggcauccuggaccuggaccuccugcuggagcuccuggagcugcaggagcggcuccgccaccuccagguguggagcccggaggcccagcggaacaucucccugcaggacaucugcuacgcgccccucaaccccgacaacaccagccuguacgacugcugcaucaacagccugcuccaguacuuccagaacaaccgcacccugcugcuccugacggccaaccagacccugauggggcagaccucccaggucgacuggaaggaccacuuccucuacugcgccaacgcgccccugaccuucaaggacggcacggcccuggcccucagcugcauggccgacuacggcgccccgguguuccccuuccuggccaucgggggcuacaaggggaaggacuacuccgaggccgaggcgcugaucaugaccuucagccucaacaacuaccccgccggcgacccgcggcuggcccaggccaagcugugggaggaggccuuccucgaggagaugcgcgcguuccagcgccggauggccgggauguuccaggugaccuucauggccgagcgcucccuggaggacgagaucaaccggaccacggccgaggaccugcccaucuucgccaccagcuacaucgucaucuuccucuacaucucccuggcgcugggcagcuacuccagcuggucccgcgugaugguggacagcaaggccacccucggccucgggggcgucgccguggugcugggggccgucauggccgcgaugggcuucuucuccuaccugggcauccggagcucccuggugauccuccaggugguccccuuccuggugcugagcgugggggccgacaacaucuucaucuucguccuggaguaccagcgccucccccggcgcccgggcgagccccgggaggugcacaucgggcgcgcccugggccggguggcccccuccaugcugcucugcagccugagcgaggcgaucugcuucuuccugggggcccucacccccaugccggccguccgcaccuucgcccugacguccggccuggccgugauccucgacuuccugcugcagaugagcgcguucguggcccuccugucccuggacagcaagcggcaggaggccucccgccucgacgucugcugcugcgugaagccccaggagcugcccccgcccggccagggggagggccugcuccugggguucuuccagaaggccuacgcccccuuccugcuccacuggaucacccggggcgugguccugcugcuguuccuggcgcuguucggggugagccucuacuccaugugccacaucagcgugggccuggaccaggagcuggcccuccccaaggacuccuaccugcuggacuacuuccucuuccugaaccgcuacuucgaggucggcgcccccguguacuucgugaccacccugggguacaacuucagcuccgaggccggcaugaacgccaucugcagcuccgcggggugcaacaacuucagcuucacgcagaagauccaguacgccaccgaguucccggagcaguccuaccucgccauccccgccagcuccugggucgacgacuucaucgacuggcugacccccagcuccugcugccggcuguacaucagcggccccaacaaggacaaguucugcccgagcaccgugaacucccucaacugccugaagaacugcaugagcaucacgaugggguccgugcgccccagcgucgagcaguuccacaaguaccugcccugguuccucaacgaccggcccaacaucaagugcccgaagggcggccuggccgcguacuccaccagcgugaaccugaccuccgacggccaggugcucgccagccgcuucauggccuaccacaagccccugaagaacucccaggacuacaccgaggcccugcgcgcggcccgggagcucgccgccaacaucacggccgaccugcgcaagguccccgggaccgacccggcguucgagguguuccccuacaccaucaccaacguguucuacgagcaguaccugacgauccugcccgaggggcuguucaugcugagccugugccucguccccaccuucgccguguccugccugcugcucggccuggaccugcggagcgggcuccugaaccugcucuccaucgugaugauccuggucgacaccgugggcuucauggcccuguggggcaucagcuacaacgccgugucccucaucaaccuggucagcgccguggggauguccguggaguucgucagccacaucacccgcuccuucgcgaucagcacgaagccgaccuggcuggagcgggccaaggaggccaccaucagcaugggcuccgccguguucgccggggucgcgaugaccaaccuccccggcauccuggugcugggccucgccaaggcccagcugauccagaucuucuucuuccgccugaaccuccugaucacgcugcucgggcugcugcacggccucguguuccugcccgucauccugagcuacguggggcccgacgugaacccggcccucgcgcuggagcagaagcgggccgaggaggccgucgccgccgugaugguggcguccugccccaaccaccccagccgcgucuccaccgccgacaacaucuacgugaaccacagcuucgagggcuccaucaagggggccggcgccaucagcaacuuccugcccaacaacggccggcaguucuga

SEQ ID NO: 33728 - RNA, 456 nt, Artificial Sequence
  derived and/or modified sequence opt1 from NPC2__Homo_sapiens__NP_006423
augcgcuuccuggccgccaccuuccuccugcuggcgcucagcaccgccgcccaggccgagcccgugcaguucaaggacugcggcuccgucgacggggugaucaaggaggugaacgucagcccgugccccacgcagcccugccagcuguccaagggccagagcuacuccgugaacgugaccuucaccagcaacauccaguccaagagcuccaaggccgucgugcacgggauccugaugggcgugcccgucccguuccccauccccgagcccgacgggugcaagagcggcaucaacugcccgauccagaaggacaagaccuacuccuaccucaacaagcugcccgucaagagcgaguaccccuccaucaagcuggugguggaguggcagcuccaggacgacaagaaccagagccuguucugcugggagauccccgugcagaucgugucccaccuguga

SEQ ID NO: 33729 - RNA, 978 nt, Artificial Sequence
  derived and/or modified sequence opt1 from NPDC1__Homo_sapiens__NP_056207
auggccacgccccugccgccgcccagcccccgccaccuccggcugcugcgccuccugcuguccggccucgugcugggggccgcgcugcggggcgccgccgccgggcacccggacgucgccgcgugccccggcagccucgacugcgcccugaagcgccgggcccgcugcccgcccggggcccacgcgugcggccccugccugcagcccuuccaggaggaccagcagggccucugcgugccccggaugcgccggccgcccgggggcgggcgcccccagccccggcuggaggacgagaucgacuuccuggcccaggagcucgcccgcaaggaguccggccacagcacgccgccccugcccaaggaccggcagcgccugcccgagcccgccacccucggguucuccgcccggggccagggccuggagcuggggcuccccagcacccccggcacccccacccccaccccgcacaccucccuggggagccccguguccagcgaccccguccacaugagcccccuggagccgcgcggcggccagggggacggccucgcgcuggugcugauccucgccuucugcguggccggggccgccgcgcuguccgucgccucccugugcuggugccggcuccagcgcgagauccggcugacccagaaggccgacuacgccaccgccaaggcgcccggcagccccgccgccccgcgcaucucccccggggaccagcggcuggcccagagcgccgagauguaccacuaccagcaccagcgccagcagaugcucugccuggagcgccacaaggagccgcccaaggagcuggacacggcguccagcgacgaggagaacgaggacggcgacuucaccguguacgagugccccggccucgcccccaccggggagauggaggugcggaacccccuguucgaccacgccgcccuguccgcgccccucccggcccccagcagcccgcccgcccugcccuga

SEQ ID NO: 33730 - RNA, 1488 nt, Artificial Sequence
  derived and/or modified sequence opt1 from NPEPL1__Homo_sapiens__NP_001191801
auggagcugcacggcgggaaccgcggcggguaccagcccaaggcccucgagcagagcggcugcuggcuguggcaggccgcgcuguccacccucaacccgaaccccaccgacagcugcccccuguaccugaacuacgccacgguggccgcccuccccugccgggucucccgccacaacagcccguccgccgcgcacuucaucacccggcuggugcgcacgugccugccgcccggggcccaccggugcaucgugauggucugcgagcagcccgagguguucgccagcgccugcgcgcucgcccgcgccuucccccuguucacccaccgguccggcgccagccgccggcuggagaagaagacggugaccgucgaguucuuccucgugggccaggacaacgggcccguggaggucuccacccugcagugccuggccaacgcgaccgacggcgugcgccucgccgcccggaucguggacacgcccugcaacgagaugaacaccgacaccuuccuggaggagaucaacaaggucgggaaggagcugggcaucauccccaccaucauccgcgacgaggagcucaagacgcggggguucggcggcaucuacggggugggcaaggccgcccugcacccgcccgcgcuggccgugcucagccacacccccgacggggccacccagaccaucgccugggucggcaagggcaucguguacgacaccgggggccuguccaucaaggggaagaccaccaugcccggcaugaagcgcgacugcgggggcgccgcggccgugcugggcgccuuccgggccgccaucaagcagggguucaaggacaaccuccacgcggucuucugccuggccgagaacagcgugggcccgaacgccacccgccccgacgacauccaccuccuguacuccgggaagacgguggagaucaacaacaccgacgccgagggccggcugguccuggcggacggggugagcuacgccugcaaggaccucggcgccgacaucauccuggacauggccacccugaccggcgcccaggggaucgcgacgggcaaguaccacgccgccgugcucaccaacuccgccgagugggaggccgcgugcgucaaggccgggcgcaagugcggcgaccuggugcacccccuggucuacugccccgagcuccacuucagcgaguucaccuccgccguggccgacaugaagaacagcguggccgaccgggacaacuccccgagcagcugcgcggggcuguucaucgccucccacaucggcuucgacuggcccggcgucugggugcaccuggacaucgccgcccccgugcacgcgggggagcgcgccaccggcuucggggucgcccuccugcuggcccucuucggccgggccagcgaggacccccugcugaaccucguguccccgcugggcugcgagguggacgucgaggagggggaccugggccgcgacagcaagcgccggcgccucguguga

SEQ ID NO: 33731 - RNA, 2760 nt, Artificial Sequence
  derived and/or modified sequence opt1 from NPEPPS__Homo_sapiens__NP_006301
auguggcuggccgccgcggcccccagccucgcccgccggcugcuguuccucggcccgcccccgccgccccugcugcuccugguguucucccgcagcucccggcgccggcugcacagccucgggcuggccgccaugcccgagaagcgccccuucgagcggcugcccgcggacgucucccccaucaacuacagccucugccugaagcccgaccugcucgacuucaccuucgagggcaagcuggaggccgccgcccaggugcgccaggcgaccaaccagaucgugaugaacugcgccgacaucgacaucaucacggccuccuacgcccccgagggggacgaggagauccacgccaccggcuucaacuaccagaacgaggacgagaaggucacccugagcuuccccuccacccuccagacggggaccggcacccugaagaucgacuucgugggcgagcugaacgacaagaugaagggguucuaccggagcaaguacaccacgccguccggcgaggugcgcuacgcggccgucacccaguucgaggccaccgacgcccggcgcgccuuccccugcugggacgagcccgcgaucaaggccaccuucgacaucagccucguggugcccaaggaccgggucgcccuguccaacaugaacgugaucgaccgcaagccguaccccgacgacgagaaccugguggaggucaaguucgcccggacgcccgugaugagcaccuaccucguggccuucgucgugggggaguacgacuucguggagacccgcuccaaggacggcgucugcgugcggguguacacccccgucgggaaggcggagcagggcaaguucgcccuggagguggccgccaagacgcugccguucuacaaggacuacuucaacgugcccuacccccuccccaagaucgaccugaucgccaucgcggacuucgccgccggcgccauggagaacugggggcuggucaccuaccgcgagaccgcgcuccugaucgacccgaagaacagcugcuccagcucccggcaguggguggcccuggucgugggccacgagcucgcccaccagugguucgggaaccuggugaccauggagugguggacgcaccuguggcucaacgagggcuucgccagcuggaucgaguaccugugcgucgaccacugcuuccccgaguacgacaucuggacccaguucgugagcgccgacuacacccgcgcgcaggagcuggacgcccucgacaacucccaccccaucgaggugagcgucggccaccccuccgagguggacgagaucuucgacgccaucagcuacuccaagggggccagcgugauccggaugcugcacgacuacaucggcgacaaggacuucaagaaggggaugaacauguaccugaccaaguuccagcagaagaacgccgcgacggaggaccucugggagucccuggagaacgccagcggcaagccgaucgccgccgucaugaacaccuggaccaagcagaugggguucccccugaucuacguggaggccgagcaggucgaggacgaccgccuccugcgccugucccagaagaaguucugcgcgggcggcagcuacgugggggaggacugcccccaguggauggugccgaucaccaucuccacgagcgaggaccccaaccaggccaagcucaagauccugauggacaagcccgagaugaacgugguccugaagaacgugaagcccgaccagugggugaagcugaaccucggcaccgucggguucuaccggacccaguacuccagcgccaugcuggagucccugcucccgggcauccgcgaccugagccugccgcccguggaccggcucgggcugcagaacgaccuguucucccucgcccgcgcgggcaucaucagcaccguggagguccugaaggugauggaggccuucgugaacgagcccaacuacacggucugguccgaccugagcugcaaccucggcauccugagcacccugcucucccacaccgacuucuacgaggagauccaggaguucgugaaggacguguucagccccaucggggagcggcugggcugggaccccaagcccggggagggccaccuggacgcccuccugcgcgggcugguccucggcaagcugggcaaggccgggcacaaggccacccuggaggaggcgcggcgccgguucaaggaccacguggagggcaagcagauccucuccgccgaccugcgcagccccguguaccugacgguccucaagcacggggacggcaccacccuggacaucaugcugaagcuccacaagcaggccgacaugcaggaggagaagaaccggaucgagcgcgugcugggcgccacccugcucccggaccugauccagaaggugcugaccuucgcccucuccgaggagguccggccccaggacacggugagcgugaucgggggcgucgccgggggcuccaagcacgggcgcaaggcggccuggaaguucaucaaggacaacugggaggagcuguacaaccgguaccagggcggcuuccugaucagccgccucaucaagcuguccguggagggguucgccguggacaagauggccggcgaggucaaggcguucuucgagagccaccccgcccccuccgccgagcggaccauccagcagugcugcgagaacauccugcucaacgccgcguggcugaagcgcgacgccgagagcauccaccaguaccugcuccagcggaaggccuccccgcccaccguguga

SEQ ID NO: 33732 - RNA, 342 nt, Artificial Sequence
  derived and/or modified sequence opt1 from NPFF__Homo_sapiens__NP_003708
auggacagccgccaggccgccgcccugcucgugcugcugcuccugaucgacggcgggugcgccgagggccccgggggccagcaggaggaccagcuguccgccgaggaggacagcgagccgcucccgccccaggacgcccagaccuccgggagccugcugcacuaccuccugcaggccauggagcggcccggccgcucccaggcguuccuguuccagccccagcgguucggccgcaacacccaggggagcuggcggaacgaguggcucagcccccgcgccggcgaggggcugaacucccaguucuggucccuggccgcgccccagcgguucggcaagaaguga

SEQ ID NO: 33733 - RNA, 1272 nt, Artificial Sequence
  derived and/or modified sequence opt1 from NPFFR2__Homo_sapiens__NP_001138228
auguucaucaugaacgagaagugggacaccaacagcuccgagaacuggcaccccaucuggaacgugaacgacaccaagcaccaccuguacagcgacaucaacaucacguacgucaacuacuaccuccaccagccccagguggccgccaucuucaucaucuccuacuuccugaucuucuuccugugcaugaugggcaacaccguggucugcuucaucgugaugcggaacaagcacaugcacaccgugaccaaccucuucauccugaaccuggcgaucagcgaccuccuggucgggaucuucugcaugccgaucacgcugcucgacaacaucaucgccggcuggcccuucgggaacaccaugugcaagaucuccggccuggugcaggggaucagcguggccgccuccgucuucacccugguggccaucgcgguggaccgguuccagugcgucguguaccccuucaagccgaagcucaccaucaagacggccuucgugaucaucaugaucaucuggguccuggccaucaccaucaugagccccuccgccgugaugcugcacgugcaggaggagaaguacuaccgcguccggcucaacagccagaacaagaccucccccguguacuggugccgcgaggacuggcccaaccaggagaugcggaagaucuacaccacggugcuguucgcgaacaucuaccuggccccgcucagccugaucgucaucauguacggccgcaucggcaucucccuguuccgggccgccgugccccacaccgggcgcaagaaccaggagcaguggcacguggucagccggaagaagcagaagaucaucaagaugcuccugaucguggcccuccuguucauccuguccuggcugccccucuggacccugaugaugcugagcgacuacgcggaccucucccccaacgagcugcagaucaucaacaucuacaucuacccguucgcccacuggcuggccuucggcaacagcuccgucaaccccaucaucuacggguucuucaacgagaacuuccgccggggcuuccaggaggccuuccagcuccagcugugccagaagcgcgccaagcccauggaggcguacgcccugaaggccaagagccacgugcucaucaacaccagcaaccagcuggugcaggaguccacguuccagaacccccacggggagacccugcucuaccgcaagagcgccgagaagccgcagcaggagcuggucauggaggagcugaaggagaccaccaacuccagcgagaucuga

SEQ ID NO: 33734 - RNA, 2202 nt, Artificial Sequence
  derived and/or modified sequence opt1 from NPHP1__Homo_sapiens__NP_000263
augcuggcccgccggcagcgcgacccccuccaggcccugcggcgccggaaccaggagcugaagcagcaggucgacagccuccuguccgagagccagcugaaggaggcgcucgagccgaacaagcgccagcacaucuaccagcggugcauccagcugaagcaggccaucgacgagaacaagaacgcccugcagaagcucuccaaggccgacgagagcgcccccguggcgaacuacaaccagcgcaaggaggaggagcacacccugcuggacaagcucacccagcagcugcagggccuggccgugacgaucucccgggagaacaucaccgaggugggggcccccaccgaggaggaggaggagagcgaguccgaggacagcgaggacuccggcggggaggaggaggacgccgaggaggaggaggaggagaaggaggagaacgagagccacaagugguccaccggcgaggaguacaucgcggucggggacuucacggcccagcaggucggcgaccucaccuucaagaagggcgagauccugcuggugaucgagaagaagcccgacgggugguggaucgccaaggacgccaagggcaacgaggggcucgugccgcgcaccuaccuggagcccuacagcgaggaggaggagggccaggaguccagcgaggagggguccgaggaggacguggaggccguggacgagaccgcggacggcgccgaggucaagcagcggacggacccccacuggagcgccgugcagaaggccaucuccgaggccggcaucuucugccuggugaaccacgucagcuucugcuaccucaucgugcugaugcgcaaccggauggagaccguggaggacaccaacggguccgagaccggcuuccgcgcguggaacguccagagccgggggcgcaucuuccuggugagcaagcccgugcuccagcagaucaacacggucgacgugcugaccaccaugggcgccaucccggccggcuuccggcccuccacccugagccagcuccuggaggaggggaaccaguuccgcgccaacuacuuccugcagcccgagcucaugcccucccagcuggccuuccgggaccugaugugggacgcgacggagggcaccauccgcagccggccgucccgcaucagccucauccugacccugugguccugcaagaugaucccccuccccgggaugagcauccaggugcugucccgccacguccggcugugccucuucgacggcaacaaggugcugagcaacauccacaccgugcgcgccacguggcagcccaagaagccgaagaccuggaccuucagcccccaggucacccggauccugcccugccuccuggacggggacugcuucauccgcagcaacuccgccagccccgaccugggcauccucuucgagcugggcaucuccuacauccggaacagcacgggggagcgcggcgagcuguccugcggguggguguuccucaagcuguucgacgccagcggcgucccgauccccgccaagaccuacgagcuguuccugaacgggggcacccccuacgagaagggcaucgagguggaccccuccaucagccggcgcgcgcacgggagcguguucuaccagaucaugaccaugcggcgccagccgcagcuccuggucaagcugcggucccucaaccgccggagccgcaacgugcugucccugcuccccgagacgcugaucggcaacaugugcagcauccaccuccugaucuucuaccggcagauccugggggacgugcugcucaaggaccgcaugucccugcagagcaccgaccugaucucccaccccaugcucgccaccuuccccaugcugcuggagcagccggacgucauggacgcccuccggagcuccugggccggcaaggagagcacccugaagcgcuccgagaagcgggacaaggaguuccugaaguccacguuccuccugguguaccacgacugcgugcugccccuccugcacuccacccgccugcccccguuccgcugggcggaggaggagaccgagaccgcccgguggaaggucaucacggacuuccucaagcagaaccaggagaaccagggggcccugcaggcccugcucagccccgacggcgugcacgagcccuucgaccuguccgagcagaccuacgacuuccugggcgagaugcgcaagaacgccguguga

SEQ ID NO: 33735 - RNA, 3993 nt, Artificial Sequence
  derived and/or modified sequence opt1 from NPHP3__Homo_sapiens__NP_694972
augggcaccgccagcucccuggugagccccgccgggggcgaggucaucgaggacaccuacggggcgggcgggggcgaggccugcgagaucccgguggaggugaagcccaaggcccgccuccugcggaacuccuuccgccggggcgccggggccgcggccggcgccgggcccggcagccugccccgcggggucggcgccggcgggcuccugggcgcguccuucaagagcacgggguccagcgugccggagcuggaguacgccgccgccgaguacgagcggcuccgcaaggaguacgagaucuuccggguguccaagaaccaggagcugcugagcaugggccgccgggaggccaagcucgacaccgagaacaagcgccugcgggcggagcugcaggcccuccagaagaccuaccagaagauccugcgcgagaaggaguccgcccuggaggccaaguaccaggccauggagcgggcggccaccuucgagcacgaccgcgacaaggucaagcggcaguucaagaucuuccgcgagacgaaggagaacgagauccaggaccuccugcgggccaagcgcgagcuggagagcaagcuccagcggcugcaggcccagggcauccagguguucgaccccggggaguccgacagcgacgacaacugcaccgacgugaccgccgcgggcacccagugcgaguacuggaccgggggcgcccugggguccgagcccagcaucggcuccaugauccagcuccagcagagcuuccgcggccccgaguucgcccacuccagcaucgacgucgaggggccguucgccaacgugaaccgggacgacugggacaucgccguggcgagccugcugcaggucacgccccucuucucccacagccugugguccaacaccgugcgcugcuaccugaucuacaccgacgagacgcagcccgagauggaccucuuccugaaggacuacagccccaagcugaagcgcaugugcgagaccaugggcuacuucuuccacgccguguacuucccgaucgacgucgagaaccaguaccucaccgugcggaagugggagaucgagaaguccagccuggugauccuguucauccaccucacccugcccucccugcuccuggaggacugcgaggaggccuuccugaagaaccccgaggggaagccccgccucaucuuccaccggcuggaggacggcaaggucagcuccgacagcgugcagcagcugaucgaccagguguccaaccucaacaagacgagcaaggccaagaucaucgaccacuccggggacccggcggagggcgucuacaagaccuacaucugcguggagaagaucaucaagcaggacauccugggcuucgagaacaccgaccuggagaccaaggaccucgggagcgaggacuccauccccgaggaggacgacuucggcgacgugcugugggacauccacgacgagcaggagcagauggagacguuccagcaggccagcaacuccgcccacgagcugggguucgagaaguacuaccagcgccucaacgaccuggucgccgcccccgcgcccaucccgccccugcuggugagcggcgggcccggcuccggcaagagccuccugcugagcaaguggauccagcuccagcagaagaacucccccaacacccugauccugagccacuucgucgggcggccgauguccaccagcuccgagagcucccucaucaucaagcgccugacccugaagcucaugcagcacagcugguccgugagcgcccugacgcuggaccccgccaagcuccuggaggaguucccccgguggcuggagaagcucuccgcccgccaccagggcagcaucaucaucgugaucgacuccaucgaccagguccagcaggucgagaagcacaugaaguggcugaucgacccccugccggugaacgugcgggugaucgugagcgucaacguggagaccugcccgcccgccuggcgccucuggcccacccugcaccuggacccccucucccccaaggacgccaagagcaucaucaucgcggagugccacuccguggacaucaagcugagcaaggagcaggagaagaagcuggagcggcacugccgcagcgccaccacgugcaacgcccucuacgucacccuguucgggaagaugaucgcccgggcgggccgcgccggcaaccuggacaagauccuccaccagugcuuccagugccaggacacccugucccuguaccggcucgugcugcacagcauccgcgaguccauggccaacgacguggacaaggagcugaugaagcagauccucugccuggucaacgugagccacaacgggguguccgagagcgagcugauggagcucuaccccgagauguccuggaccuuccugacgagccugauccacucccucuacaagaugugccugcugaccuacggcugcgggcuccugcgguuccagcaccuccaggccugggagaccguccgccucgaguaccuggagggcccgaccgugacgagcuccuaccggcagaagcugaucaacuacuucacccuccagcugagccaggaccgcgugaccuggcgcuccgcggacgagcugcccuggcuguuccagcagcaggggagcaagcagaagcugcacgacugccugcucaaccuguucgucucccagaaccuguacaagcggggccacuucgccgagcuccugagcuacuggcaguucgugggcaaggacaaguccgccauggccaccgaguacuucgacagccugaagcaguacgagaagaacugcgagggggaggacaacauguccugccucgccgaccuguacgagacccugggccgcuuccucaaggaccuggggcugcucagccaggcgaucgugccccugcagcggagccuggagauccgcgagacggcccucgaccccgaccacccgcgggucgcccagucccugcaccagcuggccagcguguacgugcaguggaagaaguucggcaacgccgagcagcucuacaagcaggcgcuggagaucuccgagaacgccuacggggccgaccaccccuacaccgcccgcgagcuggaggcccucgcgacccuguaccagaagcagaacaaguacgagcaggccgagcacuuccggaagaaguccuucaagauccaccagaaggccaucaagaagaagggcaaccuguacggcuucgcccuccugcgccggcgcgcgcugcagcucgaggagcugacccuggggaaggacacgcccgacaacgcccggacccucaacgagcugggcguccuguacuaccuccagaacaaccuggagaccgccgaccaguuccugaagcgcagccucgagaugcgggagcgcgugcuggggcccgaccacccggacugcgcccagagccugaacaaccucgccgcgcugugcaacgagaagaagcaguacgacaaggccgaggagcuguacgagcgggcccuggacauccgccggcgcgcccucgcccccgaccaccccucccuggcguacaccgugaagcaccuggccauccucuacaagaagaugggcaagcuggacaaggccgucccccuguacgagcucgccguggagauccggcagaaguccuucgggccgaagcaccccagcguggccacggcgcuggucaaccuggccgugcucuacagccagaugaagaagcacguggaggcccugccccuguacgagcgcgcccucaagaucuacgaggacucccugggccggaugcacccccgcgucggcgagacccugaagaaccucgccgugcugagcuacgagggcggggacuucgagaaggcggccgagcuguacaagcgcgccauggagaucaaggaggccgagaccucccuccucgggggcaaggcgccgagccggcacuccagcuccggggacaccuucagccugaagacggcccacucccccaacguguuccugcagcagggccagcgcuga

SEQ ID NO: 33736 - RNA, 2742 nt, Artificial Sequence
  derived and/or modified sequence opt1 from NPHP4__Homo_sapiens__NP_001278522
augcacccccgcagccuguccguggccccgaaguggagcggcgggcuccccggcaaccacccccggccccugcgcgaguucccgcuggaggccgggaucucccaccucgaggcggaccugagccagaccucccugguccucgagaccagcaucgccgagcagcugcaggagcugcccuucacgccccuccacgcccccaucguggugggcacccagacccgguccagcgccgggcagccgucccgcgccagcaugguccugcugcaguccagcggcuuccccgagauccucgacgcgaacaagcagcccgccgaggccguguccgccaccgagcccgugacguucaacccgcagaaggaggagagcgacugccugcaguccaacgagaugguccugcaguuccucgcguucagccggguggcccaggacugccgcggcaccuccuggcccaagaccguguacuucaccuuccaguucuaccgguucccgcccgccacgacgccccgccugcagcugguccagcucgacgaggccgggcagcccagcuccggcgcccugacccacauccuggugcccgugagccgggacgggaccuucgacgcgggcagccccggguuccagcuccgcuacauggucggcccgggcuuccugaagcccggggagcggcgcugcuucgcccgguaccuggccgugcagacccuccagaucgacgugugggacggcgacucccugcugcucaucgggagcgccgccguccagaugaagcaccuccugcgccagggccggcccgcggugcaggccucccacgagcucgagguggucgccaccgaguacgagcaggacaacaugguggugagcggcgacaugcugggguucggccgcgucaagcccaucggggugcacuccguggucaagggccggcugcaccucacccuggccaacguggggcacccgugcgagcagaagguccgcggcugcagcacccugccgcccucccggagccgcgugaucuccaacgacggcgccagccgguucuccgggggcagccuccugacgaccggguccagccgccgcaagcacgugguccaggcgcagaagcuggccgacguggacuccgagcucgccgccaugcugcugacccacgcccggcagggcaaggggccccaggacgugagccgcgaguccgacgcgacccggcgccggaagcucgagcgcaugcggagcguccgccugcaggaggccggcggcgaccuggggcggcgcggcacguccgugcucgcccagcagagcgugcggacccagcaccuccgcgaccugcaggucaucgccgcguaccgggagcgcaccaaggccgagagcaucgccucccugcugagccuggccaucaccacggagcacacccugcacgccacccucgggguggcggaguucuucgaguucgugcugaagaacccccacaacacccagcacacggucaccguggagaucgacaaccccgagcuguccgugaucgucgacagccaggaguggcgggacuucaagggcgccgccgggcuccacacccccguggaggaggacauguuccaccuccgcggcucccuggccccgcagcuguaccugcggccccacgagaccgcccacgugcccuucaaguuccagagcuucuccgcgggccagcuggccaugguccaggccagccccgggcucuccaacgagaagggcauggacgccgugagcccguggaaguccagcgccgugcccacgaagcacgcgaagguccuguuccgcgccuccgggggcaagcccaucgccgugcugugccucaccguggagcugcagccccacgucguggaccagguguuccgguucuaccacccggagcugagcuuccucaagaaggccauccgccugccgcccuggcacaccuuccccggcgcgcccgucgggaugcugggcgaggacccgcccgugcacgugcgcugcuccgaccccaacgucaucugcgagacccagaacguggggcccggcgagccccgggacaucuuccucaagguggccagcgggcccucccccgagaucaaggacuucuucgucaucaucuacagcgaccgcuggcuggccacgccgacccagaccuggcaggucuaccugcacagccuccagcggguggacguguccugcguggccggccagcugacccgccugagccucgugcugcggggcacccagacgguccgcaaggugcgggccuucaccucccacccccaggagcugaagaccgaccccaaggggguguucguccugcccccgcgcggcgugcaggaccugcacguggggguccggccccugcgcgcgggcagccgguucgugcaccucaaccugguggacgucgacugccaccagcugguggccuccuggcucgugugccugugcugccgccagccccugaucagcaaggccuucgagaucaugcucgccgccggggagggcaagggcgucaacaagcggaucaccuacacgaacccguaccccucccgccggaccuuccaccuccacagcgaccaccccgagcugcugcgcuuccgggaggacuccuuccaggucgggggcggggagaccuacaccaucggccugcaguucgcgcccagccagcgcgugggggaggaggagauccugaucuacaucaacgaccacgaggacaagaacgaggaggccuucugcgugaaggugaucuaccaguga

SEQ ID NO: 33737 - RNA, 3726 nt, Artificial Sequence
  derived and/or modified sequence opt1 from NPHS1__Homo_sapiens__NP_004637
auggcccugggcaccacccuccgcgccagccugcugcuccuggggcugcucacggagggccuggcgcagcuggccauccccgccuccgugccgcggggguucugggcccuccccgagaaccugaccgucguggagggcgccagcguggagcugcgcugcggggucuccacccccggcagcgcggugcagugggccaaggacggccuccugcuggggcccgacccgcggauccccggcuucccccgcuaccggcucgagggggaccccgcccgcggcgaguuccaccugcacaucgaggccugcgaccuguccgacgacgcggaguacgagugccagguggggcggagcgagaugggcccggagcucgucuccccccgcgugauccugagcauccuggugccccccaagcuccugcugcucaccccggaggccggcacgauggucaccuggguggccgggcaggaguacguggucaacugcguguccggcgacgccaagcccgcccccgacaucaccauccugcugagcgggcagaccaucuccgacaucagcgcgaacgugaacgagggcucccagcagaagcucuucacggucgaggccaccgcccgggugaccccccgcagcuccgacaaccggcagcugcuggugugcgaggccagcuccccggcccucgaggcgcccaucaaggccagcuucaccgucaacgugcuguucccccccggcccgcccgugaucgaguggcccgggcuggacgagggccacguccgcgccgggcagucccucgagcugcccugcguggcccggggcgggaacccgcuggccacgcuccaguggcugaagaacggccagcccgugagcaccgcguggggcaccgagcacacccaggccgucgcccgcagcgugcuggucaugacggugcggcccgaggaccacggggcccagcucuccugcgaggcccacaacagcguguccgcgggcacccaggagcacgggaucacccugcaggucaccuuccccccgagcgccaucaucauccugggcuccgccagccagacggagaacaagaacgugacccucuccugcgugagcaaguccagccgcccccggguccugcugcgcugguggcucggguggcggcagcugcugcccauggaggagaccgugauggacggccuccacggcgggcacaucuccaugagcaaccugaccuuccuggcccgccgggaggacaacggccugacgcucaccugcgaggcguucuccgaggccuucaccaaggagaccuucaagaagagccugauccugaacgugaaguacccggcccagaagcucuggaucgaggggccccccgagggccagaagcugcgcgccgggacgcgcguccggcuggugugccucgccaucggcggcaaccccgagccgucccugaugugguacaaggacagccgcaccgugaccgagucccggcugccccaggagagccgccggguccaccucggguccguggagaagagcggcagcaccuucucccgcgagcuggugcuggucacggggcccagcgacaaccaggcgaaguucaccugcaaggccggccagcucuccgccagcacccagcuggccgugcaguuccccccgaccaacgugacgauccuggccaacgcguccgcccuccggcccggcgacgcccugaaccugaccugcgucagcguguccagcaacccccccgugaaccucuccugggacaaggagggggagcgccuggagggcgucgccgccccgccccggcgcgcgcccuucaaggggagcgccgccgcccgguccgugcugcuccaggugagcucccgcgaccacggccagcgggucaccugccgcgcgcacagcgccgagcugcgggagaccguguccagcuucuaccgccugaacgugcucuaccggcccgaguuccugggggagcagguccugguggugaccgccgucgagcagggcgaggcccuccugccgguguccgugagcgccaaccccgcgcccgaggccuucaacuggacguuccgcggcuaccggcugagccccgccgggggcccgcgccaccgcauccucuccagcggggcccugcaccuguggaacgucacccgggccgacgacggccucuaccagcugcacugccagaacuccgaggggaccgcggaggcccgccugcggcucgacgugcacuacgcccccaccauccgcgcccugcaggaccccacggaggugaacgucggcggcagcguggacaucgugugcaccgucgacgccaaccccauccugccggggauguucaacugggagcggcucggcgaggacgaggaggaccagucccuggacgacauggagaagaucagccgcgggcccaccggccggcugcgcauccaccacgcgaagcucgcccaggccggggccuaccagugcaucguggacaacggcguggcgcccccggcccggcgccugcugcggcucgucgugcgcuucgccccccagguggagcaccccaccccccugacgaaggucgccgccgcgggcgacuccaccagcuccgccacccugcacugccgggcccgcggggugccgaacaucguguucaccuggacgaagaacggcgucccccucgaccugcaggacccccgguacaccgagcacaccuaccaccaggggggcgugcacagcucccugcucaccaucgccaacgugagcgccgcgcaggacuacgcccuguucacgugcaccgccaccaacgcccugggguccgaccagaccaacauccagcucgucagcaucucccgccccgacccgcccagcggccugaagguggucucccugacgccccacagcgugggccucgaguggaagcccggguucgacggcgggcugccgcagcgguucugcauccgcuacgaggcccugggcacccccggcuuccacuacguggacgucgugcccccccaggcgaccaccuucacgcucaccgggcugcagccguccacccgguaccgcguguggcugcucgccagcaacgcccugggcgacagcgggcuggccgacaagggcacccagcuccccaucacgacccccgggcugcaccagcccuccggcgagccggaggaccagcugcccaccgagccccccagcggcccguccgggcucccccugcugcccguccucuucgcccugggcgggcugcuccugcugagcaacgcguccugcgugggcggggugcucuggcagcggcgccugcgccggcuggccgagggcaucagcgagaagaccgaggccggcuccgaggaggaccgcguccggaacgaguacgaggagagccaguggacgggggagcgcgacacccaguccagcaccguguccaccacggaggccgagcccuacuaccggagccuccgcgacuucuccccgcagcugccccccacccaggaggaggugagcuacucccggggcuucaccggggaggacgaggacauggcguucccgggccaccuguacgacgaggucgagcgcaccuacccccccagcggggccuggggcccccucuacgacgaggugcagaugggcccgugggaccugcacuggcccgaggacaccuaccaggacccccgggggaucuacgaccagguggccggcgaccuggacacgcucgagcccgacucccugccguucgagcugcgcgggcaccucgucuga

SEQ ID NO: 33738 - RNA, 948 nt, Artificial Sequence
  derived and/or modified sequence opt1 from NPHS2__Homo_sapiens__NP_001284504
auggagcgccgggcccgcagcuccagccgggagucccgcggccgcgggggccggacgccccacaaggagaacaagcgggccaaggcggagcgcagcgggggcgggcggggccgccaggaggccggcccggagcccuccgggagcggccgggccgggacccccggcgagccccgcgccccggccgcgaccguggucgacguggacgaggugcggggguccggcgaggagggcaccgaggucguggcccugcucgagagcgagcgccccgaggaggggaccaaguccagcggccugggggccugcgaguggcugcucgugcugaucucccugcuguucaucaucaugaccuuccccuucagcaucugguucugcgucaagguggugcaggaguacgagcgggucaucaucuuccgccugggccaccuccuccccggccgggccaaggggccgggccuguucuucuuccugcccugccucgacacguaccacaagguggaccugcgccugcagacccucgagauccccuuccacgagguggcgcuggacuccgugaccugcaucugggggaucaaggucgagcggaucgagaucaaggacgugcgccugcccgccggccuccagcacagccuggccgucgaggccgaggcccagcggcaggcgaaggugcgcaugaucgccgccgaggccgagaaggccgcguccgagagccugcgcauggccgccgagauccucuccgggaccccggccgccgugcagcugcgguaccugcacacgcuccagagccuguccaccgagaagcccagcaccgucgugcugccccuccccuucgaccugcugaacugccucagcuccccgagcaaccgcacccagggcucccugcccuuccccagccccuccaagccgguggagccccugaaccccaagaagaaggacagccccaugcucuga

SEQ ID NO: 33739 - RNA, 906 nt, Artificial Sequence
  derived and/or modified sequence opt1 from NPL__Homo_sapiens__NP_001186979
augagccgcgcccccggcauccuggccuccuggcggcgcgcgccgagccucuccgugcagaaggggagccagaccgcccggcacacgugccaccccgaggucccccugggcaacugcuuccugcccguguacaaggccuccccgcucaccgugacccgccugugggccgagcggcuggaccaggucaucauccacgugggggcccucagccugaaggagucccaggagcuggcgcagcacgccgccgagaucggcgccgacgggaucgcggugaucgcccccuucuuccucaagcccuggaccaaggacauccugaucaacuuccugaaggaggucgccgccgccgcgcccgcccucccguucuacuacuaccacauccccgcccugaccggcgugaagauccgcgccgaggagcugcucgacggcauccuggacaagauccccacguuccaggggcugaaguucagcgacaccgaccuccuggacuucggccagugcguggaccagaaccggcagcagcaguucgccuuccuguucggggucgacgagcagcuccuguccgcgcuggugaugggcgccaccggggccgugggcagcaccuacaacuaccucggcaagaagacgaaccagaugcuggaggccuucgagcagaaggacuucucccuggcccucaacuaccaguucugcauccagcgcuucaucaacuucgucgugaagcugggguucggcgugagccagaccaaggcgaucaugacccuggucuccgggauccccaugggcccgccccggcucccccugcagaaggccagccgcgaguucaccgacuccgccgaggccaagcucaagagccuggacuuccuguccuucacggaccugaaggacggcaaccucgaggccgggagcuga

SEQ ID NO: 33740 - RNA, 1827 nt, Artificial Sequence
  derived and/or modified sequence opt1 from NPLOC4__Homo_sapiens__NP_060391
auggccgagagcaucaucauccgcgugcagucccccgacggcgucaagcggaucaccgccaccaagcgcgagacggcggccaccuuccugaagaagguggccaaggaguucggguuccagaacaacggcuucagcguguacaucaaccggaacaagaccggggagaucaccgccuccagcaacaagucccucaaccugcugaagaucaagcacggcgaccuccuguuccuguucccgagcucccucgccgggcccagcuccgagauggagacgagcgugccgcccggcuucaagguguucggcgcgcccaacguggucgaggacgagaucgaccaguaccuguccaagcaggacgggaagaucuaccgcagccgggacccccagcugugccgccacggcccccucgggaagugcgugcacugcgugccccuggagccguucgacgaggacuaccugaaccaccucgagccgcccgucaagcacauguccuuccacgccuacauccggaagcugaccggcggggccgacaagggcaaguucguggcccuggagaacaucagcugcaagaucaaguccggcugcgaggggcaccuccccuggcccaacggcaucugcaccaagugccagcccagcgcgaucacccugaaccgccagaaguaccggcacguggacaacaucauguucgagaaccacacggucgccgaccgcuuccuggacuucuggcggaagaccgggaaccagcacuucggcuaccucuacggccgcuacaccgagcacaaggacaucccccuggggauccgggccgagguggccgccaucuacgagcccccgcagaucggcacccagaacucccuggagcuccuggaggaccccaaggcggagguggucgacgagaucgccgccaagcuggggcuccgcaaggugggcuggaucuucacggaccuggugagcgaggacacccggaaggggaccguccgcuacucccggaacaaggacaccuacuuccugagcagcgaggagugcaucacggccggcgacuuccagaacaagcaccccaacaugugccgccucucccccgacggccacuucgggagcaaguucgugaccgccguggcgaccggcgggccggacaaccagguccacuucgagggcuaccagguguccaaccagugcauggcccuggugcgggacgagugccugcuccccugcaaggacgcccccgagcugggguacgccaaggagagcuccagcgagcaguacguccccgacguguucuacaaggacgucgacaaguucggcaacgagaucacccagcuggcccgcccgcuccccguggaguaccugaucaucgacaucacgaccaccuuccccaaggaccccguguacaccuucuccaucagccagaacccguuccccaucgagaaccgggacguccugggcgagacgcaggacuuccacucccucgcgaccuaccugagccagaacaccuccagcguguuccuggacaccaucuccgacuuccaccuccugcuguuccucgugacgaacgaggucaugccccugcaggacagcaucucccugcuccuggaggccgugcgcacccgcaacgaggagcuggcccagaccuggaagcggagcgagcagugggccaccaucgagcagcucugcuccacggucgggggccagcugccggggcugcacgaguacggcgccgucgggggcagcacccacaccgcgaccgccgccaugugggccugccagcacugcacguucaugaaccagcccggcaccgggcacugcgagaugugcucccugccccgcaccuga

SEQ ID NO: 33741 - RNA, 780 nt, Artificial Sequence
  derived and/or modified sequence opt1 from NPM1__Homo_sapiens__NP_001032827
auggaggacagcauggacauggacaugagcccccugcgcccgcagaacuaccucuucggcugcgagcugaaggccgacaaggacuaccacuucaagguggacaacgacgagaacgagcaccagcugagccuccggaccgucucccugggggccggcgcgaaggacgagcugcacaucguggaggccgaggccaugaacuacgaggggagccccaucaaggugacccucgccacgcugaagauguccguccagcccaccgugagccugggcggguucgagaucaccccgcccgugguccuccgccugaagugcggcuccggccccgugcacaucagcgggcagcaccugguggccgucgaggaggacgcggaguccgaggacgaggaggaggaggacgugaagcuccugagcaucuccggcaagcggagcgcccccgggggcggguccaaggugccccagaagaaggucaagcuggccgccgacgaggacgacgacgacgacgacgaggaggacgacgacgaggacgacgacgacgacgacuucgacgacgaggaggcggaggagaaggccccggugaagaaguccauccgcgacacccccgccaagaacgcccagaaguccaaccagaacggcaaggacagcaagcccuccagcacgccccgguccaagggccaggagagcuucaagaagcaggagaagaccccgaagacccccaaggggcccagcuccguggaggacaucaaggccaagaugcaggcgagcaucgagaaggcccacuga

SEQ ID NO: 33742 - RNA, 411 nt, Artificial Sequence
  derived and/or modified sequence opt1 from NPM2__Homo_sapiens__NP_001273610
augaaccugagcuccgccagcuccaccgaggagaaggccgugaccacgguccucuggggcugcgagcugagccaggagcgccggaccuggaccuuccgcccccagcuggaggggaagcaguccugccggcuccugcugcacaccaucugccucggcgagaaggcgaaggaggagaugcaccgcguggagauccugccgcccgccaaccaggaggacaagaagaugcagcccgugacgaucgccagccugcaggccuccguccuccccauggugagcaugguggggguccagcuguccccgcccgugaccuuccagcugcgggccggcagcgggcccguguuccucuccggccaggagcgcuacgagaagaaggcgggcaagcggcgccgggggaacaagagccagcgcuga

SEQ ID NO: 33743 - RNA, 1698 nt, Artificial Sequence
  derived and/or modified sequence opt1 from NPNT__Homo_sapiens__NP_001028219
auggacuuccugcucgcccuggugcuggucagcucccucuaccugcaggccgcggccgaguucgacggccgcuggccccggcagaucgugagcuccaucgggcugugccgcuacggcgggcggaucgacugcugcuggggcugggcccgccagagcugggggcagugccagccggugugccagccccggugcaagcacggcgagugcaucggccccaacaagugcaagugccaccccggguacgccggcaagaccugcaaccaggaccucaacgagugcgggcugaagccgcgccccugcaagcaccggugcaugaacaccuacggcuccuacaagugcuacugccugaacggguacaugcucaugcccgacggcagcugcuccagcgcccugacgugcuccauggcgaacugccaguacggcugcgacgucgugaaggggcagauccgcugccagugccccagcccgggccugcagcucgcccccgacgggcggaccugcguggacgucgacgagugcgccaccggccgcgccuccugcccccgguuccgccagugcgugaacaccuucggcagcuacaucugcaagugccacaagggguucgaccugauguacaucggcgggaaguaccagugccacgacaucgacgagugcucccugggccaguaccagugcagcuccuucgcgcggugcuacaacauccgcgggagcuacaagugcaagugcaaggagggcuaccagggcgacgggcucacgugcguguacauccccaaggucaugaucgagccguccggccccauccacgugcccaaggggaacggcaccauccugaagggggacaccggcaacaacaacuggauccccgacgugggcagcaccugguggccgcccaagacgcccuacaucccgcccaucaucaccaaccggcccaccuccaagcccaccacgcgccccaccccgaagcccacccccauccccaccccgccgccgcccccgccccugcccacggagcuccggacgccccugccgcccaccacccccgagcgccccaccaccgggcugaccaccaucgcccccgccgccagcacgccgcccggcgggaucaccgucgacaaccgggugcagaccgacccccagaagccccgcggcgacguguucaucccccggcagcccagcaacgaccucuucgagaucuucgagaucgagcgcggggucuccgccgacgacgaggcgaaggacgaccccggcgugcuggugcacagcugcaacuucgaccacggccugugcggguggauccgcgagaaggacaacgaccuccacugggagcccauccgggaccccgccggcgggcaguaccugaccgucuccgccgccaaggcccccggcggcaaggcggcccgccuggugcucccgcuggggcggcugaugcacagcggcgaccucugccuguccuuccgccacaaggugacggggcugcacagcggcacccuccaggucuucgugcggaagcacggggcccacggcgccgcccuguggggccgcaacgggggccacggguggcggcagacccagaucacccugcgcggcgcggacaucaaguccguggucuucaagggggagaagcggcgcggccacacgggcgagaucgggcucgacgacgugagccugaagaagggccacugcuccgaggagcgguga

SEQ ID NO: 33744 - RNA, 381 nt, Artificial Sequence
  derived and/or modified sequence opt1 from NPPC__Homo_sapiens__NP_077720
augcaccugagccagcuccuggccugcgcccugcuccugacgcugcucucccugcgccccagcgaggcgaagccgggcgccccgcccaaggugccccggaccccgcccgccgaggagcuggccgagccccaggccgccgggggcgggcagaagaagggcgacaaggcgcccgggggcggcggggccaaccucaagggcgaccgcucccggcugcugcgcgaccuccgggucgacaccaagagccgcgccgcgugggcccggcugcugcaggagcaccccaacgcccgcaaguacaagggggccaacaagaagggccucuccaaggggugcuucggccugaagcuggaccggaucggcagcauguccgggcucggcugcuga

SEQ ID NO: 33745 - RNA, 3186 nt, Artificial Sequence
  derived and/or modified sequence opt1 from NPR1__Homo_sapiens__NP_000897
augcccggcccgcgccggcccgccgggagccgccugcggcuccugcugcuccugcugcucccgccccugcugcuccugcugcgcggcucccacgccgggaaccucaccguggcggucgugcugccccuggccaacaccagcuaccccugguccugggcccgggugggccccgccgucgagcucgcccuggcccaggugaaggcgcgccccgaccugcucccgggguggacggugcggaccguccugggcagcuccgagaacgcccugggcgugugcagcgacaccgccgcgccccucgccgccguggaccugaagugggagcacaaccccgccgucuuccuggggcccggcugcguguacgccgcggccccgguggggcgcuucaccgcccacuggcgggucccccuccugacggccggcgcccccgcgcugggguucggcgugaaggacgaguacgcccucaccacccgcgccggccccuccuacgccaagcugggggacuucguggccgcgcugcaccggcgccucggcugggagcggcaggcccugaugcuguacgccuaccgcccgggggacgaggagcacugcuucuuccucgucgagggccuguucaugcgggugcgcgaccggcugaacaucaccguggaccaccucgaguucgccgaggacgaccugagccacuacacgcgccugcuccggaccaugccccgcaagggccgggucaucuacaucugcuccagccccgacgccuuccgcacccugaugcugcucgcgcuggaggccgggcugugcggcgaggacuacguguucuuccaccucgacaucuucgggcagucccugcagggcgggcagggccccgccccgcgccggcccugggagcgcggcgacgggcaggacgugagcgcccggcaggcguuccaggccgccaagaucaucaccuacaaggaccccgacaaccccgaguaccuggaguuccucaagcagcugaagcaccuggccuacgagcaguucaacuucacgauggaggacggccuggucaacaccaucccggccuccuuccacgacgggcuccugcuguacauccaggcggugaccgagacccucgcccacggcgggacggugaccgacggcgagaacaucacccagcgcauguggaaccggagcuuccagggcgucaccggguaccugaagaucgacuccagcggcgaccgcgagacggacuucucccugugggacauggaccccgagaacggggccuuccgggugguccucaacuacaacggcaccagccaggagcugguggccguguccgggcgcaagcugaacuggccccucggcuacccgccgcccgacauccccaagugcggcuucgacaacgaggaccccgccugcaaccaggaccaccugagcacccuggagguccucgcgcugguggggagccugucccuccugggcauccugaucgugagcuucuucaucuaccggaagaugcagcucgagaaggagcuggccuccgagcuguggcgcguccggugggaggacguggagcccagcucccucgagcgccaccuccggagcgccgggucccgccugacccugagcggccggggcuccaacuacgggagccugcugacgaccgagggccaguuccagguguucgccaagaccgccuacuacaaggggaaccucgucgcggugaagcgcgugaaccggaagcgcaucgagcugacccggaagguccuguucgagcucaagcacaugcgcgacgugcagaacgagcaccugacgcgcuucgugggcgccugcaccgacccgcccaacaucugcauccugaccgaguacugcccccgggggucccuccaggacauccuggagaacgagagcaucacccuggacuggauguuccgcuacucccucacgaacgacaucgucaagggcaugcuguuccugcacaacggcgccaucugcagccacgggaaccucaaguccagcaacugcgugguggacggccgguucguccugaagaucaccgacuacgggcuggaguccuuccgcgaccucgaccccgagcagggccacaccguguacgccaagaagcuguggaccgcgcccgagcugcuccggauggccagcccgcccgugcgcgggucccaggccggcgacgucuacagcuucggcaucauccugcaggagaucgcccugcggagcgggguguuccacguggagggccucgaccugucccccaaggagaucaucgagcgcgucacgcgcggggagcagccgcccuuccggcccagccuggcccuccagucccaccuggaggagcugggccuccugaugcagcggugcugggcggaggacccccaggagcgcccgcccuuccagcagauccggcugacccuccgcaaguucaaccgggagaacagcuccaacauccuggacaaccugcucagccgcauggagcaguacgccaacaaccuggaggagcugguggaggagcggacccaggccuaccucgaggagaagcgcaaggccgaggcccugcuguaccagauccucccccacuccguggcggagcagcugaagcgcggggagaccguccaggccgaggccuucgacagcgugaccaucuacuucuccgacaucgugggcuucacggcccugagcgccgaguccacccccaugcaggucgugacccuccugaacgaccuguacacgugcuucgacgcggugaucgacaacuucgacgucuacaagguggagaccaucggcgacgccuacaugguggucagcgggcuccccgugcggaacggccggcugcacgccugcgagguggcccgcauggcgcuggcccuccuggacgccguccgcuccuuccggauccgccaccggccccaggagcagcugcgccuccggaucgggauccacaccggcccggugugcgccgggguggucggccugaagaugccccgcuacugccuguucggcgacaccgugaacaccgccagccggauggaguccaacggggaggcgcucaagauccaccugagcuccgagacgaaggccgugcuggaggaguucggcggguucgagcucgagcugcgcggcgacgucgagaugaagggcaaggggaaggugcggaccuacuggcugcucggcgagcgcgggagcagcacccggggcuga

SEQ ID NO: 33746 - RNA, 3144 nt, Artificial Sequence
  derived and/or modified sequence opt1 from NPR2__Homo_sapiens__NP_003986
auggcccugcccagccuccugcugcucguggccgcgcuggccggcgggguccgcccgcccggcgcccggaaccugacccucgccguggugcugcccgagcacaaccuguccuacgccugggcguggccccgcgucgggcccgccguggcccucgccguggaggcgcugggccgggcccugcccgucgaccuccgcuucgugagcuccgagcuggagggggccugcagcgaguaccuggcgccccucuccgccguggaccugaagcuguaccacgaccccgaccuccugcugggcccgggcugcgucuaccccgccgccagcguggcccgguucgccucccacuggcgccucccccugcugaccgccggggcgguggccagcggcuucuccgccaagaacgaccacuaccggacgcucguccgcaccgggcccagcgccccgaagcugggcgaguucguggugacccugcacgggcacuucaacuggaccgcccgggcggcccuccuguaccuggacgcccgcacggacgaccggccccacuacuucaccaucgagggcgucuucgaggcccuccagggcuccaaccugagcgugcagcaccagguguacgcccgcgagcccgggggccccgagcaggcgacccacuucauccgggccaacgggcgcaucgucuacaucugcggcccgcuggagaugcuccacgagauccugcugcaggcccagcgggagaaccucaccaacggcgacuacguguucuucuaccuggacguguucggggagucccugcgcgccggccccacgcgggcgaccgggcgccccuggcaggacaaccggacccgcgagcaggcccaggcccuccgggaggccuuccagaccguccuggugaucacguaccgcgagcccccgaaccccgaguaccaggaguuccagaaccgccugcucauccgggcccgcgaggacuucggcguggagcuggggcccagccugaugaaccucaucgcgggcugcuucuacgacggcauccugcuguacgccgagguccucaacgagaccauccaggagggcgggacccgggaggacgggcugcgcaucguggagaagaugcagggccggcgcuaccacggggucaccggccugguggugauggacaagaacaacgaccgggagacggacuucguccugugggccaugggcgaccucgacuccggggacuuccagcccgccgcccacuacagcggcgcggagaagcagaucugguggaccgggcgcccgauccccugggugaagggcgccccgcccuccgacaacccgcccugcgccuucgaccuggacgaccccagcugcgacaagacgccccuguccacccucgccaucguggcccuggggaccggcaucaccuucaucauguucggcgucagcagcuuccugaucuuccggaagcucaugcuggagaaggagcuggcguccaugcucuggcgcauccggugggaggagcugcaguucgggaacagcgagcgcuaccacaagggcgccgggucccggcugacccucagccugcgcggcuccagcuacggcucccugaugaccgcccacgggaaguaccagaucuucgccaacacgggccacuucaaggggaacgugguggcgaucaagcacgucaacaagaagcggaucgagcucacccgccaggugcuguucgagcugaagcacaugcgggacgugcaguucaaccaccucacccgcuucaucggcgccugcaucgacccgcccaacaucugcaucgucaccgaguacugcccccgggggagccugcaggacauccuggagaacgacuccaucaaccucgacuggauguuccgcuacagccugaucaacgaccuggugaagggcauggccuuccuccacaacuccaucaucagcucccacggcagccugaaguccagcaacugcguggucgacucccgcuucgugcugaagaucacggacuacgggcucgccagcuuccgguccaccgccgagcccgacgacagccacgcgcuguacgccaagaagcuguggaccgcccccgagcuccugagcggcaacccccugcccaccacggggaugcagaaggccgacguguacuccuucggcaucauccuccaggagaucgcccugcgcagcgggccguucuaccuggagggccucgaccugucccccaaggagaucguccagaaggugcggaacggccagcgccccuacuuccggcccagcaucgaccgcacccagcugaacgaggagcucgugcugcugauggagcggugcugggcgcaggacccggccgagcgccccgacuucgggcagaucaagggcuucauccggcgcuucaacaaggagggcgggaccuccauccucgacaaccugcugcuccggauggagcaguacgccaacaaccuggagaagcuggucgaggagcgcacccaggccuaccucgaggagaagcggaaggccgaggcgcugcuguaccagauccucccccacagcguggccgagcagcugaagcgcggggagacggugcaggccgaggccuucgacuccgucaccaucuacuucagcgacaucgugggcuucaccgcgcuguccgccgagagcacccccaugcaggucgugacccuccugaacgaccuguacacgugcuucgacgccaucaucgacaacuucgacguguacaagguggagaccaucggcgacgccuacauggucguguccgggcucccgggccggaacgggcagcgccacgcccccgagaucgcgcggauggcccuggcccugcucgacgccgugagcuccuuccgcauccggcaccgcccccacgaccagcugcggcugcgcaucggcguccacaccgggcccgugugcgccggcguggucggccucaagaugccgcgcuacugccuguucggggacaccgugaacacggcgagccggauggaguccaacggccaggcccugaagauccacgugagcuccaccaccaaggacgcccucgacgagcuggggugcuuccagcuggagcuccgcggcgacgucgagaugaagggcaaggggaagaugcggaccuacuggcugcugggcgagcgcaaggggccgcccggccuccuguga

SEQ ID NO: 33747 - RNA, 1623 nt, Artificial Sequence
  derived and/or modified sequence opt1 from NPR3__Homo_sapiens__NP_000899
augcccagccugcucgugcugaccuucuccccgugcguccugcucggcugggcccugcuggccgggggcaccgggggcgggggcgugggcgggggcgggggcggggcgggcaucggcgggggccgccaggagcgggaggcccucccgccccagaagaucgaggugcugguccugcucccccaggacgacagcuaccuguucucccugacgcgcgugcggcccgccaucgaguacgcccuccgcagcguggaggggaacggcaccggccggcgccugcugccgcccgggacccgguuccaggucgccuacgaggacuccgacugcggcaaccgcgcccucuucagccugguggaccggguggcggccgcccgcggggcgaagcccgaccugauccucggccccgucugcgaguacgccgccgcccccguggcccggcuggcgucccacugggaccugcccaugcucagcgccggggcccuggccgccggcuuccagcacaaggacuccgaguacagccaccugacccgcguggcgcccgccuacgccaagaugggcgagaugaugcucgcccuguuccggcaccaccacuggucccgcgccgcgcuggucuacagcgacgacaagcucgagcggaacugcuacuucacgcuggagggggugcacgagguguuccaggaggagggccugcacaccuccaucuacagcuucgacgagaccaaggaccucgaccuggaggacaucguccgcaacauccaggccuccgagcggguggugaucaugugcgccagcuccgacaccauccgcagcaucaugcuggucgcccaccggcacgggaugacguccggcgacuacgccuucuucaacaucgagcuguucaacagcagcuccuacggggacggcagcuggaagcgcggcgacaagcacgacuucgaggcgaagcaggccuacuccagccuccagaccgugacccugcuccggaccgugaagccggaguucgagaaguucuccauggaggucaagagcuccguggagaagcaggggcugaacauggaggacuacgugaacauguucgucgagggcuuccacgacgccauccugcucuacgugcuggcccugcacgagguccuccgcgcgggguacagcaagaaggacggcgggaagaucauccagcagacguggaaccgcaccuucgagggcaucgccggccagguguccaucgacgccaacggggaccgguacggcgacuucagcgugaucgccaugaccgacgucgaggccgggacccaggaggugaucggcgacuacuucggcaaggaggggcgcuucgagaugcggcccaacgugaaguaccccuggggcccccugaagcugcgcaucgacgagaaccggaucgucgagcacacgaacuccagcccgugcaaguccugcgggcucgaggagagcgcggugaccggcaucguggucggggcccugcugggcgccggccuccugauggccuucuacuucuuccgcaagaaguaccggaucaccaucgagcgccggacccagcaggaggaguccaaccuggggaagcaccgcgagcugcgggaggacagcauccgcucccacuucagcguggccuga

SEQ ID NO: 33748 - RNA, 1143 nt, Artificial Sequence
  derived and/or modified sequence opt1 from NPRL2__Homo_sapiens__NP_006536
augggcagcgggugccgcaucgagugcaucuucuucuccgaguuccaccccacccugggcccgaagaucaccuaccaggugcccgaggacuucaucagccgggagcuguucgacacgguccagguguacaucaucaccaagcccgagcuccagaacaagcugaucaccgugaccgccauggagaagaagcucaucgggugccccgucugcaucgagcacaagaaguacucccgcaacgcccugcuguucaaccucggcuucgugugcgacgcgcaggccaagacgugcgcccuggagccgaucgugaagaagcuggccggguaccucaccacccuggagcuggagagcuccuucgucagcauggaggaguccaagcagaagcucgugcccaucaugaccauccugcuggaggagcucaacgccagcggccggugcacgcugcccaucgacgaguccaacaccauccaccugaaggugaucgagcagcgccccgacccgcccgucgcgcaggaguacgacgugcccguguucaccaaggacaaggaggacuucuucaacagccagugggaccucaccacgcagcagauccugcccuacaucgacggcuuccggcacauccagaagaucuccgccgaggccgacgucgagcugaaccucgugcgcaucgccauccagaaccugcuguacuacgggguggucacccucgugagcauccugcaguacuccaacguguacugcccgacccccaagguccaggaccugguggacgacaagagccuccaggaggcgugccuguccuacgugaccaagcagggccacaagcgggccagccugcgcgacgucuuccagcucuacugcucccugagccccgggacgaccgugcgggaccugaucggccgccacccccagcagcuccagcacguggacgagcggaagcugauccaguucgggcugaugaagaaccucauccgccggcugcagaaguacccgguccgcgugacccgggaggagcagucccaccccgcccgccuguacaccggcugccacagcuacgacgagaucugcugcaagacgggcaugagcuaccacgagcucgacgagcggcuggagaacgaccccaacaucaucaucugcuggaaguga

SEQ ID NO: 33749 - RNA, 1173 nt, Artificial Sequence
  derived and/or modified sequence opt1 from NPRL3__Homo_sapiens__NP_001034565
auggccgacggcaacgaggggccccagagcccguuccaccacauccugcccaagugcaagcucgcccgcgaccugaaggaggcguacgacucccugugcaccagcggcgugguccggcuccacaucaacuccuggcuggaggugagcuucugccugccccacaagauccacuacgccgccuccagccucaucccgcccgaggccaucgagcgcucccugaaggccauccggcccuaccacgcgcugcuccugcugagcgacgagaagucccuccugggggagcugcccaucgacugcagccccgcccucgugcgcgucaucaagaccacguccgccgugaagaaccugcagcagcuggcccaggacgcggaccucgcccugcuccagguguuccagcuggccgcccaccuggucuacuggggcaaggccaucaucaucuacccgcugugcgagaacaacguguacaugcucagccccaacgcguccgugugccuguacagcccccuggccgagcaguucucccaccaguuccccagccacgaccucccguccguccuggccaaguucagccugcccgugucccucagcgaguuccggaacccccuggcccccgccgugcaggagacccagcugauccagauggucguguggaugcuccagcgccggcugcugauccagcuccacaccuacgugugccugauggcgagcccguccgaggaggagccccgcccccgggaggacgacguccccuucaccgcccgcgucgggggccggagccuguccacgccgaacgcccucagcuucggcucccccaccagcuccgacgacaugacccugaccagccccuccauggacaacagcuccgccgagcugcuccccagcggggacuccccgcugaaccagcgcaugacggagaaccugcucgccagccuguccgagcacgagcgggcggccauccugagcgugcccgccgcccagaaccccgaggaccuccgcauguucgcccggcugcugcacuacuuccgcggccggcaccaccuggaggagaucauguacaacgagaacacccgccggucccagcuccugaugcuguucgacaaguuccgcagcgugcucguggugaccacccacgaggaccccgucaucgcgguguuccaggcccugcugccguga

SEQ ID NO: 33750 - RNA, 270 nt, Artificial Sequence
  derived and/or modified sequence opt1 from NPS__Homo_sapiens__NP_001025184
augaucagcuccgugaagcugaaccucauccugguccugagccucuccaccaugcacguguucuggugcuaccccgugccgagcuccaaggucagcggcaaguccgacuacuuccugauccugcucaacagcugccccacccgccuggaccgguccaaggagcuggccuuccucaagcccauccuggagaagauguucgugaagcgcagcuuccggaacggggugggcacggggaugaagaagaccuccuuccagcgcgccaagagcuga

SEQ ID NO: 33751 - RNA, 918 nt, Artificial Sequence
  derived and/or modified sequence opt1 from NPSR1__Homo_sapiens__NP_001287863
augcccgccaacuucaccgagggcagcuucgacuccagcgggaccggccagacgcuggacuccagcccgguggccugcaccgagaccgucaccuucacggaggugguggaggggaaggaguggggcuccuucuacuacagcuucaagaccgagcagcucaucacccuguggguccuguucguguucaccaucguggggaacuccgucguccucuucagcacguggcgccggaagaagaagucccgcaugaccuucuucgugacccagcuggcgaucaccgagaagcaggcccgggugcugaucgugaucgccuggagccucuccuuccuguucagcauccccacgcugaucaucuucggcaagcgcacccucuccaacggcgaggugcagugcugggcccuguggcccgacgacagcuacuggacccccuacaugaccaucgucgccuuccugguguacuucaucccgcucacgaucaucuccaucauguacgggaucgugauccggaccaucuggaucaagagcaagaccuacgagaccgucaucuccaacugcagcgacggcaagcugugcuccagcuacaaccgcgggcugaucagcaaggcgaagaucaaggccaucaaguacuccaucaucaucauccucgccuucaucugcugcuggagccccuacuuccuguucgacauccuggacaacuucaaccuccugcccgacacgcaggagcgguucuacgccuccgugaucauccagaaccugcccgcgcucaacagcgccaucaacccgcugaucuacugcguguucuccagcuccaucagcuuccccugccgcgagcagcggucccaggacagccgcaugaccuuccgggagcgcaccgagcggcacgagaugcagauccuguccaagcccgaguucaucuga

SEQ ID NO: 33752 - RNA, 1185 nt, Artificial Sequence
  derived and/or modified sequence opt1 from NPTN__Homo_sapiens__NP_001154835
augagcggcuccagccugcccuccgcccucgcccugagccugcuccugguguccgggagccugcucccgggccccggggcggcccagaacgccggcuucgucaagucccccaugagcgagaccaagcugaccggggacgccuucgagcuguacugcgacguggugggcucccccacgccggagauccaguggugguacgccgaggucaaccgcgcggagagcuuccggcagcucugggacggcgcccgcaagcggcgcgugaccgugaacaccgccuacggguccaacggcgucagcgugcugcggaucacccgccugacgcucgaggacuccgggaccuacgagugccgggccagcaacgaccccaagcgcaacgaccugcggcagaaccccuccaucaccuggauccgcgcgcaggccaccaucagcgugcugcagaagccccggaucgucacguccgaggaggugaucauccgcgacagcccggugcuccccgucacccugcagugcaaccugaccuccagcagccacacccucacguacuccuacuggaccaagaacggcguggagcugagcgccacccggaagaacgccuccaacauggaguaccgcaucaacaagccccgggccgaggacagcggggaguaccacugcguguaccacuucgucuccgcgcccaaggccaacgccaccaucgaggugaaggccgccccggacaucacgggccacaagcgcagcgagaacaagaacgagggccaggacgcgaccauguacugcaaguccgugggguacccccaccccgacuggaucuggcggaagaaggagaacggcaugcccauggacaucgucaacaccagcgggcgcuucuucaucaucaacaaggagaacuacaccgagcugaacaucgugaaccuccagaucacggaggacccgggcgaguacgagugcaacgccaccaacgccaucggcuccgccagcguggucaccgugcugcgggugcgcucccaccuggcgccccucuggcccuuccuggggauccuggccgagaucaucauccucgucgugaucaucgucguguacgagaagcggaagcgccccgacgaggugccggacgccggccccaugaagaccaacagcacgaacaaccacaaggacaagaaccugcgccagcggaacaccaacuga

SEQ ID NO: 33753 - RNA, 1299 nt, Artificial Sequence
  derived and/or modified sequence opt1 from NPTX1__Homo_sapiens__NP_002513
augcccgccggccgcgccgcgcggaccugcgcccugcucgcccugugccugcucggggccggcgcccaggacuucgggccgacccgcuucaucugcacgagcgugcccgucgacgcggacaugugcgccgccuccguggccgcgggcggggccgaggagcugcggagcuccgugcugcagcuccgcgagaccguccugcagcagaaggagaccauccugagccagaaggagaccauccgggagcucacggccaagcugggccgcugcgagucccagagcacccuggaccccggcgccggggaggcccgggcgggcgggggccgcaagcagcccggguccggcaagaacaccaugggcgaccucagccggaccccggccgccgagacgcugucccagcuggggcagacccuccagagccugaagacccgccuggagaaccucgagcaguacucccggcugaacagcuccagccagaccaacucccugaaggaccuccugcagagcaagaucgacgagcuggagcgccaggugcucucccgggugaacacgcuggaggagggcaagggcgggccccgcaacgacaccgaggagcgggucaagaucgagaccgcccugaccagccuccaccagcgcaucuccgagcuggagaagggccagaaggacaaccggcccggggacaaguuccagcugacguucccccuccgcaccaacuacauguacgccaaggugaagaagucccugccggagauguacgcguucaccgugugcauguggcucaagagcagcgccacccccggcgucgggacgcccuucagcuacgccgugcccggccaggccaacgagcuggugcugaucgagugggggaacaacccgauggagauccugaucaacgacaaggucgccaagcuccccuucgugaucaacgacggcaaguggcaccacaucugcgugaccuggaccacccgggacggcgucugggaggcguaccaggacgggacgcagggcggguccggcgagaaccuggcccccuaccaccccaucaagccgcagggggugcuggugcucggccaggagcaggacacccugggcgggggcuucgacgccacccaggccuucgucggggagcuggcccacuucaacaucugggaccgcaagcucacccccggcgagguguacaaccuggcgacgugcagcaccaaggcccuguccgggaacgugaucgccugggccgagagccacaucgagaucuacggcggcgcgaccaaguggaccuucgaggccugccggcagaucaacuga

SEQ ID NO: 33754 - RNA, 1296 nt, Artificial Sequence
  derived and/or modified sequence opt1 from NPTX2__Homo_sapiens__NP_002514
augcuggcccuccuggccgcgagcguggcccuggccgucgccgccggcgcgcaggacucccccgccccggggagccgcuucgugugcaccgcccucccgcccgaggccgugcacgcgggcugcccccugccggccaugcccaugcagggcggggcccagucccccgaggaggagcugcgggccgccguccuccagcugcgcgagaccguggugcagcagaaggagacgcugggggcgcagcgggaggccauccgcgagcucaccggcaagcuggcccggugcgagggccuggccgggggcaaggcccgcggggcgggcgccaccgggaaggacaccaugggcgaccucccccgggacccgggccacgucguggagcagcugagccgcucccugcagacgcucaaggaccggcuggagagccuggagcaccagcuccgcgccaacguguccaacgccgggcugcccggcgacuuccgggagguccugcagcagcgccucggggagcuggagcggcagcugcuccgcaagguggccgagcuggaggacgagaagucccugcuccacaacgagaccagcgcgcaccggcagaagaccgagagcacccugaacgcccugcuccagcgcgugacggagcuggagcggggcaacuccgccuucaagagccccgacgccuucaaggucucccugccccuccgcaccaacuaccuguacggcaagaucaagaagacccugccggagcucuacgccuucaccaucugccuguggcugcggagcuccgcgagccccgggaucggcacgcccuucuccuacgccgugcccgggcaggccaacgagaucgugcucaucgaguggggcaacaacccgaucgagcugcugaucaacgacaaggucgcccagcucccccuguucgugagcgacgggaaguggcaccacaucugcgugaccuggaccacccgcgacggcaugugggaggcguuccaggacggcgagaagcuggggacgggcgagaaccucgcccccuggcaccccaucaagcccgggggcguccugauccuggggcaggagcaggacaccgugggcggccgguucgacgccacccaggccuucgugggggagcucucccaguucaacaucugggaccgcguccugcgcgcccaggagaucgugaacaucgcgaacugcagcaccaacaugcccggcaacaucauccccuggguggacaacaacgucgacguguucgggggcgccagcaaguggcccgucgagacgugcgaggagcggcugcuggaccucuga

SEQ ID NO: 33755 - RNA, 1503 nt, Artificial Sequence
  derived and/or modified sequence opt1 from NPTXR__Homo_sapiens__NP_055108
augaaguuccuggccgugcuccuggccgcgggcaugcuggccuuccucggggccgucaucugcaucaucgccagcgugccccuggccgcguccccggcccgcgcccugcccggcggggccgacaacgcgagcguggccuccggcgccgccgccagccccgggccccagcggucccucagcgcgcugcacggcgccggcggguccgccggcccgcccgcccugcccggggcccccgcggccagcgcccacccgcucccgcccggcccccuguucucccgcuuccugugcaccccgcucgccgccgcgugccccagcggggcccagcagggcgacgccgccggcgccgcgcccggggagcgggaggagcugcugcuccugcaguccaccgccgagcagcugcgccagacggcccuccagcaggaggcccggauccgcgcggaccaggacaccauccgggagcugaccggcaagcuggggcgcugcgagagcggccucccccggggccugcagggggccggcccgcgccgggacaccauggccgacgggcccugggacucccccgcccugauccucgagcuggaggacgccguccgcgcgcugcgggaccgcaucgaccggcucgagcaggagcugcccgcccgcgugaaccugagcgccgccccggcccccguguccgcgguccccacgggccuccacagcaagauggaccagcuggaggggcagcugcucgcccaggugcuggcccuggagaaggagcggguggcccucucccacagcucccgccggcagcgccaggaggucgagaaggagcuggacgugcugcagggccggguggccgagcucgagcacggcagcagcgcguacuccccgcccgacgccuucaagaucagcauccccauccgcaacaacuacauguacgcccgcguccggaaggcccugcccgagcuguacgcguucaccgccugcauguggcuccgcucccggagcuccgggaccggccaggggacccccuucagcuacuccgugcccggccaggccaacgagaucgugcugcuggaggccgggcacgagcccauggagcuccugaucaacgacaaggucgcccagcugccccucagccugaaggacaacggcuggcaccacaucugcaucgcguggacgacccgcgacggccugugguccgccuaccaggacggggagcugcagggcagcggggagaaccucgccgccuggcacccgaucaagccccacggcauccugauccuggggcaggagcaggacacccucggcggccgguucgacgccacccaggcguucgugggggacaucgcccaguucaaccugugggaccacgcccugacgcccgcccaggugcucggcaucgccaacugcaccgcgccccugcuggggaacguccucccgugggaggacaagcugguggaggccuucggcggcgccaccaaggccgcguucgacgugugcaaggggcgcgccaaggccuga

SEQ ID NO: 33756 - RNA, 591 nt, Artificial Sequence
  derived and/or modified sequence opt1 from NPVF__Homo_sapiens__NP_071433
auggagaucaucagcuccaagcuguucauccuccugacccuggccaccagcucccuccugacgagcaacaucuucugcgccgacgagcuggugauguccaaccuccacagcaaggagaacuacgacaaguacuccgagccccgcggcuacccgaagggggagcggagccugaacuucgaggagcugaaggacuggggccccaagaacgucaucaagauguccacccccgcggugaacaagaugccccacagcuucgccaaccucccgcugcgcuucgggcggaacgugcaggaggagcgcuccgccggcgccaccgccaaccugccccuccggagcgggcgcaacauggaggucucccuggugcggcgcgugcccaaccugccccagcgguucggccgcaccacgaccgccaagagcgucugccggaugcucuccgaccugugccagggcagcaugcacuccccgugcgcgaacgaccuguucuacagcaugaccugccagcaccaggagauccagaaccccgaccagaagcagucccgccggcuccuguucaagaagaucgacgacgccgagcugaagcaggagaaguga

SEQ ID NO: 33757 - RNA, 498 nt, Artificial Sequence
  derived and/or modified sequence opt1 from NPW__Homo_sapiens__NP_001092926
auggccuggcgccccggcgagcgcggggccccggcgagccggccccggcuggcccuccugcugcuccugcugcuccugccccugcccuccggcgccugguacaagcacguggccagcccgcgcuaccacaccgucgggcgggccgcgggccuccugauggggcugcgccggucccccuaccucuggcgccgggcccugcgcgccgccgcgggcccccuggcccgggacacccucagccccgagccggccgcccgcgaggcgccccugcugcuccccuccugggugcaggagcugugggagacgcggcgccggagcucccaggccggcauccccgugcgcgccccgcggagcccccgcgcccccgagcccgcccuggagccggagucccucgacuucagcggggccggccagcggcugcgccgggacgucucccgccccgcgguggaccccgccgccaaccgccuggggcuccccugccuggccccgggccccuucuga

SEQ ID NO: 33758 - RNA, 1155 nt, Artificial Sequence
  derived and/or modified sequence opt1 from NPY1R__Homo_sapiens__NP_000900
augaacagcacccuguucucccagguggagaaccacagcguccacuccaacuucagcgagaagaacgcccagcuccuggccuucgagaacgacgacugccaccucccccucgcgaugaucuucacccuggcccuggccuacggcgccgugaucauccucgggguguccggcaaccuggcccugaucaucaucauccucaagcagaaggagaugcgcaacgucacgaacauccugaucgugaaccugagcuucuccgaccuccugguggcgaucaugugccugccguucaccuucgucuacacccucauggaccacuggguguucggggaggccaugugcaagcugaaccccuucgugcagugcgucagcaucaccguguccaucuucagccuggugcucaucgccgucgagcggcaccagcugaucaucaacccccgcggcuggcggcccaacaaccgccacgccuacguggggaucgcggugaucuggguccuggccguggccuccagccucccguuccugaucuaccaggugaugacggacgagcccuuccagaacgucacccuggacgccuacaaggacaaguacgugugcuucgaccaguuccccuccgacagccaccggcucuccuacaccacccugcugcucgugcugcaguacuucggcccccugugcuucaucuucaucugcuacuucaagaucuacauccgccucaagcggcgcaacaacaugauggacaagaugcgggacaacaaguaccgcagcuccgagacgaagcggaucaacaucaugcugcugagcaucgucguggccuucgcggugugcuggcucccgcugaccaucuucaacaccgucuucgacuggaaccaccagaucaucgcgaccugcaaccacaaccugcuguuccugcugugccaccucacggccaugaucuccacgugcgugaaccccaucuucuacggcuuccugaacaagaacuuccagcgcgaccugcaguucuucuucaacuucugcgacuuccggagccgcgacgacgacuacgagaccaucgccaugagcaccaugcacaccgacgucuccaagaccagccucaagcaggccucccccguggccuucaagaagaucaacaacaacgacgacaacgagaagaucuga

SEQ ID NO: 33759 - RNA, 1146 nt, Artificial Sequence
  derived and/or modified sequence opt1 from NPY2R__Homo_sapiens__NP_000901
augggccccaucggggccgaggccgacgagaaccagaccguggaggagaugaaggucgagcaguacggcccgcagaccacgccccgcggggagcuggugcccgaccccgagccggagcucaucgacagcaccaagcugaucgaggugcaggucgugcugauccucgcguacugcuccaucauccugcugggcgugaucgggaacagccucgucauccacguggugaucaaguucaaguccaugcggaccgucaccaacuucuucaucgccaaccuggccguggccgaccugcucgugaacacgcugugccugcccuucacccucaccuacacccugaugggcgaguggaagaugggccccguccugugccaccucgugcccuacgcccaggggcuggcggugcaggucagcacgaucacccugaccgugaucgcccucgaccgccaccggugcaucguguaccaccuggaguccaagaucagcaagcgcaucuccuuccugaucaucggccucgccugggggaucagcgcccugcuggcguccccgcucgccaucuuccgggaguacagccugaucgagaucauccccgacuucgagaucgucgccugcaccgagaaguggcccggcgaggagaaguccaucuacgggacgguguacagccuguccagccuccugauccuguacgugcucccccugggcaucaucuccuucagcuacacccgcaucugguccaagcugaagaaccacgucagcccgggcgccgccaacgaccacuaccaccagcggcgccagaagaccaccaagaugcucgugugcguggucguggucuucgcgguguccuggcugccccugcacgccuuccagcucgccguggacaucgacagccagguccuggaccugaaggaguacaagcucaucuucacgguguuccacaucaucgccaugugcagcaccuucgccaacccccugcuguacggguggaugaacuccaacuaccggaaggcguuccucagcgccuuccgcugcgagcagcggcuggacgccauccacuccgaggugagcgucaccuucaaggccaagaagaaccuggaggugcgcaagaacuccggccccaacgacagcuucaccgaggccacgaacguguga

SEQ ID NO: 33760 - RNA, 1362 nt, Artificial Sequence
  derived and/or modified sequence opt1 from NPY5R__Homo_sapiens__XP_011530316
auggacagcaagcaggacuacaacauggaccuggagcucgacgaguacuacaacaagacccuggccaccgagaacaacacggccgcgacccgcaacuccgacuuccccgugugggacgacuacaagagcuccgucgacgaccugcaguacuuccucaucggccuguacaccuucgugagccugcucggguucaugggcaaccugcugauccucauggcccugaugaagaagcggaaccagaagaccacggugaacuuccugaucgggaaccucgccuucuccgacauccuggucgugcuguucugcagcccguucacccucaccuccgugcugcuggaccaguggauguucggcaaggucaugugccacaucaugcccuuccuccagugcgugagcgugcuggucuccacccugauccucaucagcaucgccaucgugcgcuaccacaugaucaagcaccccaucuccaacaaccugacggccaaccacggguacuuccugaucgcgaccguguggacccucggcuucgccaucugcagcccccugccggucuuccacucccugguggagcuccaggagaccuucggcagcgcccugcuguccagccgguaccucugcguggaguccuggcccagcgacuccuaccgcaucgccuucacgaucagccugcugcucguccaguacauccugccccuggugugccucaccgugagccacaccuccgucugccggagcaucuccugcgggcugagcaacaaggagaaccgccuggaggagaacgagaugaucaaccucacccugcaccccuccaagaaguccggcccccaggugaagcugagcgggagccacaagugguccuacagcuucaucaagaagcaccggcgccgguacuccaagaagacggcgugcgugcuccccgcccccgagcgccccagccaggagaaccacucccggauccugccggagaacuucggcagcguccgcucccagcugagcuccagcuccaaguucauccccggggugccgaccugcuucgagaucaagcccgaggagaacagcgacgugcacgagcuccgggucaagcgcagcgugacccggaucaagaagcgcucccggagcgucuucuaccgccugaccauccugauccucguguucgccguguccuggaugccgcugcaccuguuccacgucgugacggacuucaacgacaaccugaucagcaaccggcacuucaagcucguguacugcaucugccaccuccugggcaugauguccugcugccugaaccccauccuguacggcuuccugaacaacgggaucaaggccgaccucgucagccugauccacugccugcacauguga

SEQ ID NO: 33761 - RNA, 294 nt, Artificial Sequence
  derived and/or modified sequence opt1 from NPY__Homo_sapiens__NP_000896
augcugggcaacaagcgccucgggcugagcggccugacccucgcccugucccugcucgugugccugggggcccuggcggaggccuaccccagcaagccggacaaccccggcgaggacgcccccgccgaggacauggcccgguacuacuccgcgcuccgccacuacaucaaccugaucacccggcagcgcuacgggaagcggagcucccccgagacgcugaucagcgaccuccugaugcgcgaguccaccgagaacgucccgcggacccgccuggaggaccccgccaugugguga

SEQ ID NO: 33762 - RNA, 825 nt, Artificial Sequence
  derived and/or modified sequence opt1 from NQO1__Homo_sapiens__NP_000894
augguggggcgccgggcccugaucguccucgcccacagcgagcgcaccuccuucaacuacgcgaugaaggaggccgccgccgccgcgcugaagaagaaggggugggaggugguggagagcgaccuguacgccaugaacuucaaccccaucaucucccggaaggacaucaccggcaagcucaaggacccggccaacuuccaguaccccgccgagagcguccuggcguacaaggaggggcaccugucccccgacaucguggccgagcagaagaagcucgaggccgccgaccuggugaucuuccaguucccccugcagugguucggcgucccggccauccucaaggggugguucgagcgcguguucaucggcgaguucgcguacaccuacgccgccauguacgacaagggccccuuccggagcaagaaggccgugcuguccaucaccaccgggggcagcggguccauguacagccugcagggcauccacggggacaugaacgucauccucuggcccauccaguccggcauccugcacuucugcggcuuccaggugcuggagccccagcucaccuacagcaucgggcacacgccggccgacgcgcgcauccagauccuggagggcuggaagaagcggcuggagaacaucugggacgagacgccccucuacuucgcccccuccagccuguucgaccugaacuuccaggccggguuccucaugaagaaggaggugcaggacgaggagaagaacaagaaguucggccuguccgucggccaccaccugggcaagagcauccccaccgacaaccagaucaaggcccgcaaguga

SEQ ID NO: 33763 - RNA, 582 nt, Artificial Sequence
  derived and/or modified sequence opt1 from NQO2__Homo_sapiens__NP_001277151
auggccggcaagaaggugcugaucgucuacgcccaccaggagcccaagagcuucaacgggucccucaagaacguggcgguggacgagcugagccgccagggcugcaccgucaccguguccgaccuguacgccaugaaccucgagccgcgggccacggacaaggacaucaccgggacccugagcaaccccgagguguucaacuacggcgucgagacccacgaggccuacaagcagcgcucccuggccagcgacaucacggacgagcagaagaaggugcgggaggcggaccucgugaucuuccaggggaagcuggcccugcucuccgucaccaccggcggcaccgccgagauguacacgaagaccggggugaacggcgacagccgcuacuuccuguggccccugcagcacgggacccuccacuucugcggcuucaaggugcuggcgccccagaucuccuucgccccggagaucgccagcgaggaggagcggaaggggauggucgccgccuggucccagcgccugcagaccaucuggaaggaggagcccauccccugcacggcccacuggcacuucggccaguga

SEQ ID NO: 33764 - RNA, 1413 nt, Artificial Sequence
  derived and/or modified sequence opt1 from NR0B1__Homo_sapiens__NP_000466
auggccggcgagaaccaccaguggcaggggagcauccuguacaacaugcucauguccgccaagcagacccgcgcggcccccgaggccccggagacccggcugguggaccagugcuggggcugcagcugcggggacgagcccggcgucgggcgcgagggccugcucggcgggcggaacguggcccugcuguaccgcugcugcuucugcggcaaggaccacccccggcagggguccauccucuacagcaugcugacguccgccaagcagaccuacgcggcccccaaggccccggaggccacccugggccccugcugggggugcagcugcggcuccgaccccggcguggggcgcgcgggccuccccgggggccggccggucgcccugcuguaccgcugcugcuucugcggcgaggaccacccccggcaggggagcauccucuacucccugcugaccagcuccaagcagacgcacguggcccccgccgcccccgaggcgcgcccgggcggggccuggugggaccggagcuacuucgcccagcgccccggcgggaaggaggcccuccccggcggccgggccaccgcgcugcuguaccgcugcugcuucugcggggaggaccacccccagcagggcuccacccucuacugcgugccgaccagcacgaaccaggcccaggccgcccccgaggagcggccccgcgcccccuggugggacaccuccagcggggcgcugcggccggucgcccucaagagcccccagguggugugcgaggccgccuccgccggccugcugaagacccugcgcuucgucaaguaccuccccugcuuccaggugcugccccuggaccagcagcucgugcugguccggaacugcugggcgucccugcucaugcuggagcuggcccaggaccgccuccaguucgagaccguggaggugagcgagccgagcaugcugcagaagauccugacgacccggcgccgcgagaccgggggcaacgagccccuccccguccccacccugcagcaccaccuggccccgcccgccgaggcgcggaaggugcccuccgccagccaggugcaggccaucaagugcuuccucuccaagugcuggagccugaacaucuccacgaaggaguacgccuaccugaagggcaccguccucuucaacccggacgugcccgggcugcagugcgugaaguacauccagggccugcagugggggacccagcagauccucagcgagcacacccgcaugacgcaccagggcccccacgaccgguucaucgagcugaacuccacccuguuccuccugcgcuucaucaacgccaacgucaucgcggagcuguucuuccggcccaucaucgggaccgugagcauggacgacaugaugcuggagaugcucugcaccaagaucuga

SEQ ID NO: 33765 - RNA, 1845 nt, Artificial Sequence
  derived and/or modified sequence opt1 from NR1D1__Homo_sapiens__NP_068370
augaccacccuggacagcaacaacaacacgggcggggugaucaccuacaucggcuccagcggguccagccccucccgcaccagcccggagucccucuacagcgacaacuccaacggcagcuuccagucccugacccaggggugccccacguacuucccgcccagccccaccggcucccugacccaggaccccgcccggagcuucggcuccaucccgcccagccucuccgacgacgggagccccuccagcagcuccagcuccagcuccagcuccagcuccuucuacaacggcagcccgcccgggucccugcaggucgccauggaggacagcucccgcgugagccccuccaagagcaccuccaacaucacgaagcugaacggcauggugcuccugugcaaggucugcggggacguggcgagcggcuuccacuacggcgugcacgccugcgaggggugcaagggcuucuuccggcgcuccauccagcagaacauccaguacaagcggugccugaagaacgagaacugcagcaucguccgcaucaaccggaaccgcugccagcagugccgguucaagaagugccucagcguggggaugucccgcgacgccgugcgguucggccgcauccccaagcgggagaagcagcgcaugcuggccgagaugcagagcgccaugaaccuggcgaacaaccagcucuccagccagugcccccuggagaccucccccacccagcaccccaccccgggccccauggggcccagcccgccgcccgcccccguccccagcccccuggugggcuucucccaguucccccagcagcucacgccgccccggucccccagccccgagcccaccguggaggacgucaucucccagguggcccgcgcccaccgggagaucuucaccuacgcgcacgacaagcuggggagcuccccgggcaacuucaacgccaaccacgccagcggguccccgcccgccaccacgccccaccgcugggagaaccagggcugcccgcccgcccccaacgacaacaacacccuggcggcccagcggcacaacgaggcccucaacggccugcgccaggcccccagcuccuacccgcccaccuggccgcccgggcccgcccaccacagcugccaccagagcaacuccaacggccaccggcugugccccacccacguguacgcggcccccgaggggaaggcccccgccaacagcccccgccagggcaacuccaagaacguccuccuggccugccccaugaacauguacccccacgggcgcagcggccggacggugcaggagaucugggaggacuucuccaugagcuucacccccgcggugcgcgaggucguggaguucgccaagcacaucccgggcuuccgggaccugucccagcacgaccaggugacccuccugaaggccgggaccuucgagguccugauggugcgcuucgccagccucuucaacgugaaggaccagacggucauguuccugucccggaccaccuacagccugcaggagcucggcgccauggggaugggcgaccugcuguccgcgauguucgacuucagcgagaagcucaacucccuggcccugaccgaggaggagcucgggcuguucacggccgugguccuggugagcgccgaccgcuccggcauggagaacagcgcguccguggagcagcuccaggagacccugcugcgggcccuccgcgcccugguccugaagaaccggccccucgagaccagccgcuucaccaagcugcugcucaagcugcccgaccugcggacgcugaacaacaugcacuccgagaagcuccugagcuuccgcguggacgcccaguga

SEQ ID NO: 33766 - RNA, 1740 nt, Artificial Sequence
  derived and/or modified sequence opt1 from NR1D2__Homo_sapiens__NP_005117
auggaggugaacgccggcggggucaucgccuacaucagcuccagcuccagcgcguccagccccgccuccugccacagcgagggcuccgagaacagcuuccaguccagcuccagcuccgugccgagcucccccaacagcuccaacagcgacaccaacgggaaccccaagaacggcgaccuggccaacaucgaggggauccucaagaacgaccgcaucgacugcagcaugaagaccuccaagagcuccgcccccggcaugaccaagagccacuccggcgugacgaaguucagcgggaugguccugcugugcaaggugugcggcgacguggccuccggguuccacuacggcguccacgcgugcgaggggugcaagggcuucuuccggcgcagcauccagcagaacauccaguacaagaagugccucaagaacgagaacugcuccaucaugcggaugaaccgcaaccggugccagcagugccgcuucaagaagugccugagcgugggcaugucccgggacgccgugcgcuucgggcggaucccgaagcgcgagaagcagcggaugcugaucgagaugcagagcgccaugaagaccaugaugaacucccaguucagcggccaccuccagaacgacacccuggucgagcaccacgagcagacggcccugcccgcgcaggagcagcuccgccccaagccccagcuggagcaggagaacaucaaguccagcuccccgcccagcuccgacuucgccaaggaggaggugaucgggauggugacccgggcccacaaggacaccuucauguacaaccaggagcagcaggagaacagcgccgagagcaugcagccccagcgcggcgagcggauccccaagaacauggagcaguacaaccugaaccacgaccacugcggcaacgggcucuccagccacuucccgugcuccgagagccagcagcaccugaacggccaguucaaggggcgcaacaucaugcacuaccccaacggccacgccaucugcaucgcgaacgggcacugcaugaacuucuccaacgccuacacccagcgggucugcgaccgcgugcccaucgacggcuucagccagaacgagaacaagaacuccuaccugugcaacacgggcgggcggaugcaccucgugugccccaugagcaaguccccguacgucgacccccacaagagcggccacgagaucugggaggaguucuccaugagcuucacccccgccgugaaggagguggucgaguucgccaagcgcauccccggguuccgggaccugucccagcacgaccaggugaaccugcucaaggccggcaccuucgaggugcugaugguccgcuucgcgagccuguucgacgccaaggagcgcaccgugacguuccucuccgggaagaaguacagcguggacgaccugcacuccaugggcgccggcgaccugcucaacagcauguucgaguucagcgagaagcugaacgcccugcagcucuccgacgaggagaugagccuguucaccgccgucgugcuggucuccgcggaccggagcgggaucgagaacgugaacuccguggaggcccuccaggagacccugauccgcgcccugcggacccucaucaugaagaaccacccgaacgaggccagcaucuucacgaagcugcugcucaagcugcccgaccugcgcucccucaacaacaugcacagcgaggagcugcuggccuucaagguccaccccuga

SEQ ID NO: 33767 - RNA, 1095 nt, Artificial Sequence
  derived and/or modified sequence opt1 from NR1H2__Homo_sapiens__NP_001243576
augagcucccccaccaccagcucccuggacacgccgcuccccggcaacgggccgccccagccgggcgcccccagcuccagccccaccgugaaggaggaggggcccgagccguggcccggcgggcccgaccccgacgucccgggcaccgacgaggccuccagcgcgugcuccaccgacuggggcgugcugagcgaggagcagauccgcaagaagaagauccggaagcagcagcagcaggagucccagagccagucccagagccccguggggccccagggcuccagcuccagcgccuccgggcccggcgccagccccgggggcagcgaggccggcucccaggggagcggcgagggggagggcguccagcugacggccgcgcaggagcucaugauccagcagcugguggccgcccagcugcagugcaacaagcgcuccuucagcgaccagcccaaggugacccccuggccccucggcgccgacccgcagucccgggacgcgcgccagcagcgguucgcccacuucaccgagcuggccaucaucagcguccaggagaucguggacuucgccaagcagguccccggguuccugcagcucggccgcgaggaccagaucgcccugcugaaggcguccaccaucgagaucaugcuccuggagacggcccggcgcuacaaccacgagaccgagugcaucaccuuccugaaggacuucaccuacagcaaggacgacuuccaccgggccgggcuccagguggaguucaucaaccccaucuucgaguucucccgcgccaugcggcgccugggccuggacgacgccgaguacgcgcuccugaucgccaucaacaucuucagcgccgaccggcccaacgugcaggagccggggcgcguggaggcccugcagcagcccuacgucgaggcccuccuguccuacacgcggaucaagcgcccccaggaccagcugcgguucccccgcaugcucaugaagcuggugagccugcggacccucuccagcgugcacuccgagcaggucuucgcgcugcgccugcaggacaagaagcucccgccccugcugagcgagaucugggacgugcacgaguga

SEQ ID NO: 33768 - RNA, 1164 nt, Artificial Sequence
  derived and/or modified sequence opt1 from NR1H3__Homo_sapiens__NP_001123573
augagccuguggcucggcgcccccgugccggacaucccgcccgacuccgccguggagcuguggaagcccggggcgcaggacgccagcucccaggcccagggcgggagcuccugcauccugcgcgaggaggcccggaugccccacagcgccggcgggaccgcgggcgugggccucgaggccgccgagcccaccgcccugcugacgcgcgcggagccgcccuccgagcccaccgagauccggccccagaagcgcaagaaggggcccgcccccaagaugcucggcaacgagcugugcagcgugugcggggacaaggccuccggcuuccacuacaacguccugagcugcgaggggugcaagggcuucuuccggcgcuccgugaucaagggcgcccacuacaucugccacagcgggggccacugcccgauggacaccuacaugcggcgcaagugccaggagugccggcuccgcaagugccggcaggccgggaugcgcgaggagugcgugcuguccgaggagcagauccggcugaagaagcucaagcgccaggaggaggagcaggcgcacgccaccagccugccgccccgggccuccagcccgccccagauccugccccagcucucccccgagcagcugggcaugaucgagaagcuggucgccgcccagcagcagugcaaccgccggagcuucuccgaccgccuccgggugacggugaugcugcuggagaccagccgccgguacaaccccggcagcgaguccaucaccuuccucaaggacuucagcuacaaccgcgaggacuucgcgaaggccgggcugcaggucgaguucaucaaccccaucuucgaguucucccgcgccaugaacgagcugcagcucaacgacgccgaguucgcccugcugaucgcgaucagcaucuucuccgccgaccggcccaacgugcaggaccagcuccagguggagcgccugcagcacaccuacgucgaggcccugcacgccuacgugagcauccaccacccccacgaccggcucauguucccccgcaugcugaugaagcuggugucccuccggacgcugagcuccguccacagcgagcaggucuucgcccugcgccuccaggacaagaagcugccgccccugcucuccgagaucugggacgugcacgaguga

SEQ ID NO: 33769 - RNA, 1278 nt, Artificial Sequence
  derived and/or modified sequence opt1 from NR1H4__Homo_sapiens__NP_001193907
augggcagcaagaugaaccugaucgagcacucccaccuccccaccaccgacgaguucagcuucuccgagaaccuguucggggugcugaccgagcaggucgccggcccgcucgggcagaaccuggagguggagcccuacagccaguacuccaacgugcaguucccccagguccagccccagaucagcuccagcuccuacuacagcaaccugggcuucuacccgcagcagcccgaggagugguacucccccgggaucuacgagcuccgccggaugcccgccgagacccuguaccagggcgagaccgagguggcggagaugccggugaccaagaagccccgcaugggcgccagcgccgggcggaucaagggcgacgagcugugcgucgugugcggggaccgcgccuccggcuaccacuacaacgcccucacgugcgaggggugcaagggccugcugaccgagauccagugcaagagcaagcggcuccgcaagaacgugaagcagcacgcggaccagaccgucaacgaggacuccgagggccgggaccugcgccaggugaccagcacgaccaaguccugccgggagaagaccgagcugacccccgaccagcagacgcuccugcacuucaucauggacagcuacaacaagcagcgcaugccccaggagaucaccaacaagauccugaaggaggaguucuccgccgaggagaacuuccucauccugaccgagauggccaccaaccacgugcagguccugguggaguucacgaagaagcucccgggguuccagacccuggaccacgaggaccagaucgcccugcucaagggcagcgcgguggaggccauguuccugcggagcgccgagaucuucaacaagaagcugcccuccgggcacagcgaccuccuggaggagcgcauccggaacuccggcaucagcgacgaguacaucacccccauguucuccuucuacaagagcaucggcgagcugaagaugacccaggaggaguacgcccuccugacggccaucgucauccugucccccgaccgccaguacaucaaggaccgggaggcgguggagaagcuccaggagccgcugcuggacgugcuccagaagcugugcaagauccaccagcccgagaacccccagcacuucgccugccugcucgggcgccugaccgagcugcggaccuucaaccaccaccacgccgagaugcucaugagcuggcgcgucaacgaccacaaguucacgccccugcugugcgagaucugggacgugcaguga

SEQ ID NO: 33770 - RNA, 1422 nt, Artificial Sequence
  derived and/or modified sequence opt1 from NR1I2__Homo_sapiens__NP_071285
augaccgugacccgcacgcaccacuucaaggagggcagccugcgggcccccgccaucccgcuccacuccgcggccgccgagcuggccagcaaccacccccgcgggcccgaggccaaccuggagguccggcccaaggaguccuggaaccacgcggacuucgugcacugcgaggacaccgagagcgugccgggcaagcccuccgucaacgccgacgaggaggucgggggcccccagaucugccgcgugugcggggacaaggccaccggcuaccacuucaacgugaugaccugcgagggcugcaagggguucuuccggcgcgccaugaagcggaacgcgcgccuccggugccccuuccgcaagggcgccugcgagaucacgcggaagacccgccggcagugccaggccugccgccugcggaagugccuggagagcgggaugaagaaggagaugaucauguccgacgaggccguggaggagcgccgggcccucaucaagcgcaagaaguccgagcggaccggcacccagccgcugggggugcagggccugacggaggagcagcgcaugaugauccgggagcucauggacgcgcagaugaagaccuucgacaccaccuucagccacuucaagaacuuccgccugcccggcguccugagcuccgggugcgagcuccccgagagccugcaggcccccucccgcgaggaggccgccaaguggagccaggugcggaaggaccugugcucccucaaggugagccugcagcugcgcggcgaggacggguccgucuggaacuacaagccgcccgccgacagcggcggcaaggagaucuucucccuccugccccacauggcggacaugagcacguacauguucaaggggaucaucagcuucgccaaggugaucuccuacuuccgggaccugcccaucgaggaccagaucagccuccugaagggcgccgccuucgagcugugccagcuccgcuucaacaccguguucaacgccgagaccgggaccugggagugcggccggcuguccuacugccuggaggacacggccgggggcuuccagcagcuccugcuggagccgaugcucaaguuccacuacaugcugaagaagcugcagcuccacgaggaggaguacguccugaugcaggcgaucagccuguucucccccgaccgccccggcgugcuccagcaccggguggucgaccagcugcaggagcaguucgccaucacccucaagagcuacaucgagugcaaccgcccccagccggcccaccgguuccuguuccugaagaucauggccaugcugaccgagcuccgcuccaucaacgcgcagcacacccagcggcugcugcgcauccaggacauccaccccuucgccacgccccucaugcaggagcuguucgggaucaccggcagcuga

SEQ ID NO: 33771 - RNA, 1023 nt, Artificial Sequence
  derived and/or modified sequence opt1 from NR1I3__Homo_sapiens__NP_001070937
auggccagccgcgaggacgagcugcggaacugcguggucugcggcgaccaggccaccggguaccacuucaacgcgcugaccugcgagggcugcaagggguucuuccgccggacgguguccaagagcaucggcccgaccugccccuucgccggguccugcgaggugagcaagacccagcgccggcacugccccgccugccgccuccagaagugccuggacgccggcaugcggaaggacaugauccucuccgccgaggcgcuggcccugcgccgggccaagcaggcccagcgccgggcgcagcagacccccguccagcucagcaaggagcaggaggagcugauccgcacgcugcucggcgcccacacccggcacauggggaccauguucgagcaguucgugcaguuccggcccccggcccaccuguucauccaccaccagccccugcccacccucgcccccgugcugccgcuggucacgcacuucgccgacaucaacaccuucauggugcuccaggugaucaaguucaccaaggaccugcccgucuuccgcucccugcccaucgaggaccagaucagccuccugaagggcgcggccguggagaucugccacaucgugcugaacaccacguucugccuccagacccagaacuuccugugcgggccccugcgcuacaccaucgaggacggcgcccgggucggguuccagguggaguuccucgagcugcuguuccacuuccacggcacccuccgcaagcugcagcugcaggagccggaguacgugcuccuggccgccauggcgcuguucucccccgcccccuaccucacggaccggcccggcgucacccagcgcgacgagaucgaccagcugcaggaggagauggcccugacccuccagagcuacaucaaggggcagcagcggcgcccgcgcgaccggucccccggcacccccuggauccacuggagcgggaagaugcugggccccaagaucggcccgggguccaagggcgcccaguggcugcaguga

SEQ ID NO: 33772 - RNA, 1404 nt, Artificial Sequence
  derived and/or modified sequence opt1 from NR2C1__Homo_sapiens__NP_001027458
auggccaccaucgaggagaucgcccaccagaucaucgagcagcagaugggcgagaucgugaccgagcagcagacggggcagaagauccagaucgucaccgcgcuggaccacaacacccagggcaagcaguucauccucaccaaccacgacgggagcacgcccuccaaggugauccuggcccgccaggacagcaccccgggcaagguguuccugaccacccccgacgccgccggggucaaccagcuguucuucacgacccccgaccuguccgcccagcaccuccagcuccugaccgacaacagccccgaccagggcccgaacaagguguucgaccugugcguggucugcggcgacaaggcguccgggcggcacuacggcgccgugaccugcgaggggugcaagggcuucuucaagcgcagcauccggaagaaccucguguacuccugccgcgggagcaaggacugcaucaucaacaagcaccaccggaaccgcugccaguacugccggcugcagcgcugcaucgccuucggcaugaagcaggacuccguccagugcgagcggaagcccaucgaggugagccgcgagaaguccagcaacugcgccgcguccacggagaagaucuacauccggaaggaccugcgcagcccccucaccgccacccccaccuucgugacggacuccgagagcacccgguccaccggccugcuggacagcgggauguucaugaacauccacccguccggcgucaagaccgagagcgccgugcucaugacgagcgacaaggccgaguccugccagggggaccugagcacccuggccaacguggucaccucccucgcgaaccugggcaagaccaaggaccugagccagaacuccaacgagaugagcaugaucgagucccucagcaacgacgacacgucccugugcgaguuccaggagaugcagaccaacggcgacgugagccgcgccuucgacacccuggccaaggcccucaaccccggggaguccaccgccugccagagcuccguggcgggcauggaggggagcguccaccugaucacgggcgacuccagcaucaacuacaccgagaaggaggggccccugcucuccgacagccacguggccuuccggcugaccaugcccuccccgaugcccgaguaccugaacgugcacuacaucggcgagagcgccagccgccuccuguuccuguccaugcacugggcccucagcauccccuccuuccaggcccugggccaggagaacagcaucucccuggucaaggcguacuggaacgagcuguucacccucgggcuggcccagugcuggcaggucaugaacguggccacgauccucgccaccuucgugaacugccugcacaacagccugcagcaggccgagggcuga

SEQ ID NO: 33773 - RNA, 1791 nt, Artificial Sequence
  derived and/or modified sequence opt1 from NR2C2__Homo_sapiens__NP_001278623
augaccagccccuccccgcgcauccagaucaucagcaccgacuccgccguggccagcccccagcggauccagaucgucacggaccagcagaccggccagaagauccagaucgugaccgcgguggacgccuccgggagccccaagcagcaguucauccugaccucccccgacggcgccgggacgggcaaggucauccucgccagcccggagaccuccagcgccaagcagcugaucuucaccaccuccgacaaccuggugcccgggcgcauccagaucgugacggacagcgcguccgucgagcggcuccugggcaagaccgacgugcagcgcccccagguggucgaguacugcguggugugcggcgacaaggccagcgggcggcacuacggcgccgucuccugcgaggggugcaagggcuucuucaagcgcagcgugcggaagaaccugaccuacuccugccgcagcaaccaggacugcaucaucaacaagcaccaccggaaccgcugccaguucugccggcucaagaagugccuggagauggggaugaagauggaguccgugcagagcgagcgcaagcccuucgacguccagcgggagaagccgagcaacugcgccgcguccaccgagaagaucuacauccgcaaggaccugcggagcccccucaucgccacgcccaccuucguggccgacaaggacggcgcccgccagaccggccugcuggaccccgggaugcucgugaacauccagcagccgcugauccgggaggacggcaccguccugcucgccacggacuccaaggcggagaccagccagggggcccugggcacccuggccaacguggugaccucccucgccaaccugagcgagucccugaacaacggcgacacgagcgagauccagcccgaggaccaguccgccagcgagaucacccgcgcguucgacacccucgccaaggcccugaacaccacggacuccagcuccagccccucccuggccgacgggaucgacaccagcggcgggggcuccauccacgucaucagccgggaccaguccacccccaucaucgagguggaggggccgcuccugagcgacacccacgugacguucaagcugaccaugcccagccccaugcccgaguaccucaacguccacuacaucugcgaguccgccagccgccugcuguuccucuccaugcacugggcgcggagcaucccggccuuccaggcccugggccaggacugcaacaccucccuggugcgcgccugcuggaacgagcuguucacccugggccuggcccagugcgcgcaggucaugagccucuccacgauccuggccgccaucgugaaccaccuccagaacagcauccaggaggacaagcucuccggggaccgcaucaagcaggucauggagcacaucuggaagcugcaggaguucugcaacagcauggccaagcuggacaucgacggcuacgaguacgcguaccucaaggccaucgugcuguucucccccgaccaccccgggcugaccagcaccucccagaucgagaaguuccaggagaaggcccagauggagcuccaggacuacgugcagaagaccuacagcgaggacacguaccggcuggcccgcauccuggugcggcuccccgcccugcgccugauguccagcaacaucaccgaggagcuguucuucaccggccucaucgggaacgucuccaucgacagcaucaucccguacauccugaagauggagaccgcggaguacaacggccagaucaccggcgccagccuguga

SEQ ID NO: 33774 - RNA, 1269 nt, Artificial Sequence
  derived and/or modified sequence opt1 from NR2E1__Homo_sapiens__NP_001273031
auguuccgcgccggcgccgagggggcggagaaggagcccagcccgcggcccgagugccgcgccgaccccggccccgggcugggcuucccgcucggguccggccugcccuggcccagccugcucgagucccccggcgggcggauccuggacaucccgugcaaggugugcggcgaccgcagcuccgggaagcacuacggcgucuacgccugcgacgggugcagcggcuucuucaagcgguccauccgccggaaccgcaccuacgugugcaagagcggcaaccagggcgggugccccguggacaagacccaccggaaccagugccgcgccugccggcugaagaagugccucgaggucaacaugaacaaggacgccgugcagcacgagcgcgggccccggacguccaccauccgcaagcaggucgcgcuguacuuccggggccacaaggaggagaacggcgccgccgcccacuuccccagcgcggcccugccggcccccgccuucuucaccgccgugacccagcucgagccccacgggcuggagcuggcggccguguccacgacccccgagcgccagacccucgugagccuggcccagccgacccccaaguacccccacgaggucaacggcacgcccauguaccuguacgagguggccaccgaguccgugugcgagagcgccgcgcggcuccuguucauguccaucaagugggccaagagcgucccggccuucuccacccugagccuccaggaccagcugaugcugcucgaggacgccuggcgcgagcuguucgugcuggggaucgcccagugggcgauccccguggacgccaacacccuccuggccgucuccggcaugaacggggacaacacggacagccagaagcugaacaagaucaucagcgagauccaggcccuccaggaggugguggcccgguuccgccagcugcggcuggacgcgaccgaguucgccugccucaagugcaucgucaccuucaaggccgugcccacccacuccggcagcgagcugcgcuccuuccgcaacgccgcggccaucgccgcccugcaggacgaggcccagcucacgcugaacagcuacauccacacccgguaccccacccagccgugccgcuucggcaagcugcuccugcugcuccccgcgcugcgguccaucagccccuccaccaucgaggagguguucuucaagaagacgaucgggaacguccccaucacccgccugcucagcgacauguacaaguccagcgacaucuga

SEQ ID NO: 33775 - RNA, 1233 nt, Artificial Sequence
  derived and/or modified sequence opt1 from NR2E3__Homo_sapiens__NP_055064
auggagacccgccccaccgcccugaugagcuccacgguggccgcggccgccccggccgccggcgcggccagccggaaggagucccccgggcgcuggggccucggggaggaccccaccggcgucagccccucccugcagugccgggugugcggggacagcuccagcggcaagcacuacggcaucuacgccugcaacgggugcuccggcuucuucaagcgcagcgugcggcgccggcugaucuaccgcugccaggucggggccggcaugugcccgguggacaaggcgcaccggaaccagugccaggccugccgccucaagaagugccugcaggccgggaugaaccaggacgccgugcagaacgagcggcagccccgcuccaccgcccagguccaccuggacagcauggaguccaacaccgagagccggcccgagucccucguggcgcccccggcccccgccggccgcagcccccggggccccacgccgauguccgccgcccgcgcgcuggggcaccacuucauggccagccugaucaccgccgagaccugcgccaagcucgagcccgaggacgccgacgagaacaucgacgugaccuccaacgaccccgaguuccccagcagcccguacuccagcuccagccccugcggccuggacuccauccacgagacgagcgcgcggcuccuguucauggccgucaagugggccaagaaccugcccguguucuccagccugcccuuccgcgaccaggugauccuccuggaggaggccugguccgagcuguuccuccugggggccauccaguggagccugccgcucgacuccugcccccugcuggcgccgcccgaggccagcgccgccggcggcgcgcaggggcggcucacccuggccuccauggagacccgcguccugcaggagaccaucagccgguuccgcgcccucgccguggaccccacggaguucgccugcaugaaggcgcuggugcuguucaagcccgagacccgcggccucaaggaccccgagcacgucgaggcccugcaggaccagucccaggugaugcugagccagcacuccaaggcccaccaccccagccagccggugcgguucgggaagcuccugcugcuccugcccucccugcgcuucaucaccgccgagcggaucgagcuccuguucuuccgcaagaccaucggcaacacgcccauggagaagcugcucugcgacauguucaagaacuga

SEQ ID NO: 33776 - RNA, 1272 nt, Artificial Sequence
  derived and/or modified sequence opt1 from NR2F1__Homo_sapiens__NP_005645
auggccaugguggucagcuccuggcgcgacccccaggacgacguggccggcgggaacccgggcgggcccaaccccgcggcccaggccgcccggggcgggggcggcggggccggcgagcagcagcagcaggcggggagcggcgcgccccacaccccgcagacccccgggcagcccggcgcccccgccacgccgggcaccgccggggacaagggccaggggccgcccggcuccggccagagccagcagcacaucgagugcguggucugcggggacaaguccagcggcaagcacuacgggcaguucacgugcgagggcugcaaguccuucuucaagcgcagcgugcggcgcaaccugaccuacacgugccgggccaaccgcaacugccccaucgaccagcaccaccggaaccagugccaguacugccgccucaagaagugccugaagguggggaugcggcgcgaggccguccagcggggccgcaugccgcccacccagcccaaccccggccaguacgcccugaccaacggggacccccucaacggccacugcuaccuguccggguacaucagccugcuccugcgggccgagcccuaccccaccucccgcuacggcagccagugcaugcagcccaacaacaucauggggaucgagaacaucugcgagcuggcggcccggcuccuguucuccgccguggagugggcccgcaacaucccguucuuccccgaccugcagaucaccgaccaggugagccuccugcggcugaccugguccgagcuguucguccucaacgccgcgcagugcagcaugccccugcacguggcgccccuccuggccgccgccggccugcacgccuccccgaugagcgccgaccgcguggucgccuucauggaccacauccggaucuuccaggagcaggucgagaagcucaaggcccugcacguggacuccgccgaguacagcugccugaaggcgaucguccucuucaccagcgacgccugcggccuguccgacgccgcccacaucgagagccugcaggagaagucccagugcgcgcucgaggaguacgugcgcagccaguaccccaaccagcccucccgguucgggaagcugcugcuccgccugcccagccugcgcaccguguccagcuccgugaucgagcagcuguucuucgugcggcucgugggcaagacgccgaucgagacccugauccgcgacaugcuccugagcggguccagcuucaacuggcccuacauguccauccagugcagcuga

SEQ ID NO: 33777 - RNA, 846 nt, Artificial Sequence
  derived and/or modified sequence opt1 from NR2F2__Homo_sapiens__NP_001138627
augcaggccgugugggaccuggagcagggcaaguacggguucgccguccagcgcggccggaugcccccgacccagcccacccacgggcaguucgcgcucacgaacggcgacccccugaacugccacagcuaccuguccggguacaucagccuccugcugcgcgccgagcccuacccgaccucccgguucggcagccagugcaugcagcccaacaacaucaugggcaucgagaacaucugcgagcucgccgcccgcaugcuguucuccgccguggagugggcgcggaacauccccuucuuccccgaccugcagaucaccgaccagguggcccuccugcgccugaccuggagcgagcuguucguccucaacgccgcccagugcuccaugccgcugcacguggcgccccuccuggccgccgccgggcugcacgccagccccauguccgcggaccggguggucgccuucauggaccacauccgcaucuuccaggagcaggucgagaagcucaaggcccugcacguggacagcgccgaguacuccugccugaaggccaucguccucuucacgagcgacgcgugcggccuguccgacguggcccacguggagagccugcaggagaagucccagugcgcccucgaggaguacgugcggagccaguaccccaaccagccgacccgcuucgggaagcugcugcuccggcugcccucccugcgcaccgugagcuccagcgugaucgagcagcuguucuucguccggcucgugggcaagacccccaucgagacgcugauccgcgacaugcuccugagcggguccagcuucaacuggcccuacauggccauccaguga

SEQ ID NO: 33778 - RNA, 1215 nt, Artificial Sequence
  derived and/or modified sequence opt1 from NR2F6__Homo_sapiens__NP_005225
auggccauggugaccggcggguggggcgggcccggcggggacaccaacggcgucgacaaggccggcggguacccgcgcgcggccgaggacgacagcgccuccccgcccggcgccgccagcgacgcggagcccggggacgaggagcggcccggccuccagguggacugcguggucugcggggacaaguccagcggcaagcacuacggcguguucacgugcgaggggugcaaguccuucuucaagcgcagcauccggcgcaaccucuccuacacgugccggagcaaccgcgacugccagaucgaccagcaccaccggaaccagugccaguacugccgccugaagaagugcuuccgggugggcaugcgcaaggaggccguccagcgggggcgcaucccccacucccugcccggcgccguggccgcgagcuccggcagcccgcccggguccgcccucgccgccguggccagcggcggggaccuguuccccggccagcccgucuccgagcugaucgcgcagcuccugcgggccgagcccuacccggccgccgccgggcgcuucggcgcgggcgggggcgccgccggggccgugcugggcaucgacaacgugugcgagcucgccgcgcggcugcuguucagcaccgucgagugggcccgccacgcccccuucuuccccgagcuccccguggccgaccagguggcccugcugcggcucuccuggagcgagcuguucguccugaacgcggcccaggccgcccucccgcugcacaccgcgccccugcucgccgccgccgggcugcacgccgcgcccauggccgccgagcgcgccguggccuucauggaccaggugcgggcguuccaggagcaggucgacaagcugggccgccuccagguggacuccgccgaguacggcugccugaaggccaucgcccuguucacccccgacgccugcgggcucagcgacccggcgcacguggagagccugcaggagaaggcccaggucgcccugaccgaguacgugcgggcccaguaccccucccagccccagcgcuucggccgccuccugcugcggcuccccgcgcugcgcgccgugccggccagccugaucucccagcuguucuucaugcggcuggucgggaagacccccaucgagacccugauccgcgacaugcuccugagcggcuccacguucaacuggcccuacgggagcggccaguga

SEQ ID NO: 33779 - RNA, 2334 nt, Artificial Sequence
  derived and/or modified sequence opt1 from NR3C1__Homo_sapiens__NP_001018085
auggacagcaaggagucccugacccccggccgcgaggagaacccgagcuccgugcucgcccaggagcgcggggacgucauggacuucuacaagacccugcggggcggggccacggugaaggugagcgcguccagccccucccuggccgucgccagccaguccgacagcaagcagcggcgccuccugguggacuuccccaagggcuccgugagcaacgcccagcagcccgaccuguccaaggccgucagccucuccauggggcuguacaugggcgagaccgagaccaaggugaugggcaacgaccugggguucccgcagcagggccagaucagccucuccagcggggagaccgaccugaagcugcucgaggaguccaucgcgaaccugaaccggagcacgagcgugcccgagaaccccaaguccagcgccuccaccgccgucagcgccgcgcccaccgagaaggaguucccgaagacccacuccgacgugagcuccgagcagcagcaccugaagggccagacggggaccaacggcggcaacgugaagcucuacaccaccgaccagagcacguucgacauccugcaggaccuggaguucuccagcgggucccccggcaaggagaccaacgagagccccuggcgcuccgaccuccugaucgacgagaacugccugcucagcccccuggccggggaggacgacuccuuccugcucgagggcaacagcaacgaggacugcaagccgcugauccugcccgacaccaagcccaagaucaaggacaacggcgaccucguccuguccagccccuccaacgugacccugccccaggugaagacggagaaggaggacuucaucgagcucugcacccccggggucaucaagcaggagaagcugggcaccguguacugccaggccagcuuccccggggccaacaucaucggcaacaagaugagcgccaucuccgugcacggggucagcaccuccggcggccagauguaccacuacgacaugaacacggcgagccugucccagcagcaggaccagaagcccaucuucaacgugaucccgcccauccccguggggagcgagaacuggaaccggugccagggcuccggggacgacaaccucaccagccugggcacccugaacuuccccgggcgcaccgucuucuccaacggcuacagcuccccgagcaugcggcccgacguguccagcccgcccuccagcuccagcacggccaccaccggcccgccgcccaagcucugccuggugugcagcgacgaggccuccgggugccacuacggcguccugaccugcgggagcugcaagguguucuucaagcgcgccgucgagggccagcacaacuaccucugcgccgggcggaacgacugcaucaucgacaagauccgccggaagaacugccccgcgugccgcuaccggaagugccugcaggccggcaugaaccuggaggcccgcaagacgaagaagaagaucaagggcauccagcaggccaccaccggggugucccaggagaccagcgagaaccccggcaacaagacgaucgugcccgccacccucccccagcugaccccgacccuggucucccuccuggaggugaucgagcccgaggugcuguacgcgggguacgacagcuccguccccgacagcacguggcggaucaugaccacccucaacaugcugggcggccgccaggugaucgccgccgugaagugggccaaggccauccccggguuccggaaccugcaccuggacgaccagaugacccuccugcaguacuccuggauguuccugauggcguucgcccucggcuggcgcagcuaccggcaguccagcgccaaccugcugugcuucgccccggaccucaucaucaacgagcagcgcaugacccugcccugcauguacgaccagugcaagcacaugcuguacgucuccagcgagcuccaccgccuccagguguccuacgaggaguaccugugcaugaagacgcuccugcugcucagcuccgugcccaaggacgggcucaagagccaggagcuguucgacgagauccggaugaccuacaucaaggagcugggcaaggcgaucgucaagcgcgaggggaacuccagccagaacuggcagcgguucuaccagcugaccaagcugcucgacagcaugcacgaggugguggagaaccugcugaacuacugcuuccagaccuuccucgacaagacgauguccaucgaguuccccgagaugcuggccgagaucaucaccaaccagaucccgaaguacagcaacggcaacaucaagaagcugcuguuccaccagaaguga

SEQ ID NO: 33780 - RNA, 2955 nt, Artificial Sequence
  derived and/or modified sequence opt1 from NR3C2__Homo_sapiens__NP_000892
auggagaccaagggcuaccacagccugcccgaggggcucgacauggagcgccgguggggccaggugucccaggccgucgagcgcagcucccuggggccgaccgagcggacggacgagaacaacuacauggagaucgugaacgugagcugcgucuccggcgccauccccaacaacagcacccagggguccagcaaggagaagcaggagcugcuccccugccugcagcaggacaacaaccgccccggcauccugaccuccgacaucaagaccgagcucgagagcaaggagcuguccgcgacgguggccgagagcaugggccuguacauggacuccgugcgggacgccgacuacagcuacgagcagcagaaccagcagggguccaugagcccggccaagaucuaccagaacgucgagcagcucgugaaguucuacaagggcaacgggcaccgccccuccacccugagcugcgugaacacgccccugcgguccuucaugagcgacagcggcuccagcgucaacgggggcgugaugcgcgccguggucaagucccccaucaugugccacgagaaguccccguccgugugcagcccccucaacaugaccuccagcgugugcucccccgcgggcaucaacagcgucuccagcaccaccgccuccuucgggagcuuccccgugcacuccccgaucacccagggcacgccccugaccugcagccccaacguggagaaccgggggucccgcagccacucccccgcccacgccagcaacgucggcagcccgcuguccagcccccucuccagcaugaaguccagcaucuccagcccgcccucccacugcagcgugaagucccccgugagcucccccaacaacgucacccugcggagcuccgugagcucccccgcgaacaucaacaacagccgcugcagcguguccagccccuccaacaccaacaaccggagcacccuguccagcccggccgccuccacggucggcagcaucugcagccccgugaacaacgccuucagcuacaccgccuccgggaccagcgcgggcuccagcacccuccgcgacgucgugcccucccccgacacgcaggagaagggggcccaggaggugccguuccccaagaccgaggaggucgagagcgccaucuccaacggcgugaccgggcagcugaacaucgugcaguacaucaagcccgagccggacggcgccuucagcuccagcugccugggcgggaacagcaagaucaacuccgacagcuccuucagcguccccaucaagcaggaguccaccaagcacagcugcuccggcacgagcuucaaggggaaccccaccgugaaccccuucccguucauggacggcuccuacuucagcuucauggacgacaaggacuacuacucccucagcgggauccugggcccgcccgugcccggcuucgacgggaacugcgagggcuccggguuccccgucggcaucaagcaggagcccgacgacgggagcuacuaccccgaggccuccauccccagcuccgcgaucgugggcgugaacagcggcgggcaguccuuccacuaccggaucggcgcccaggggaccaucagccugagccgcuccgcccgggaccagagcuuccagcaccucuccagcuucccgcccgucaacacccugguggaguccuggaagucccacggcgaccugagcagccgccgguccgacggcuaccccgugcucgaguacauccccgagaacgucagcuccagcacgcugcgcuccgugagcaccggguccagccggccguccaagaucugccuggugugcggcgacgaggccagcgggugccacuacggcgucgugaccugcggguccugcaagguguucuucaagcgcgccgucgagggccagcacaacuaccucugcgcgggccgcaacgacugcaucaucgacaagauccggcgcaagaacugccccgccugccggcugcagaagugccugcaggccgggaugaaccucggcgcccgcaagagcaagaagcuggggaagcugaagggcauccacgaggagcagccccagcagcagcagcccccgcccccgccgcccccgccccagagccccgaggaggggaccacguacaucgcccccgcgaaggagcccuccgugaacaccgcccucgugccccagcugagcaccaucucccgggcccugacccccagccccgucauggugcucgagaacaucgagcccgagaucguguacgccggcuacgacuccagcaagcccgacacggcggagaaccugcuguccacccucaaccgccuggccggcaagcagaugauccaggucgugaagugggccaaggugcugccgggguucaagaaccucccccuggaggaccagaucacccugauccaguacagcuggaugugccucuccagcuucgcccuguccuggcggagcuacaagcacaccaacucccaguuccuguacuucgcccccgaccuggucuucaacgaggagaagaugcaccagagcgcgauguacgagcucugccagggcaugcaccagaucucccugcaguucgugcgccugcagcucaccuucgaggaguacacgaucaugaaggugcugcugcuccugagcaccauccccaaggacgggcugaagucccaggccgccuucgaggagaugcggaccaacuacaucaaggagcuccgcaagauggucaccaagugcccgaacaacagcggccaguccuggcagcgguucuaccagcugacgaagcugcucgacagcaugcacgaccuggugagcgaccugcucgaguucugcuucuacaccuuccgcgagucccacgcccugaagguggaguuccccgccaugcuggucgagaucaucagcgaccagcuccccaagguggaguccgggaacgcgaagccccuguacuuccaccggaaguga

SEQ ID NO: 33781 - RNA, 1836 nt, Artificial Sequence
  derived and/or modified sequence opt1 from NR4A1__Homo_sapiens__NP_001189162
auguggcuggccaaggccugcuggagcauccaguccgagaugcccugcauccaggcgcaguacggcaccccggcccccagccccgggccccgcgaccaccucgccuccgacccgcugacccccgaguucaucaagcccacgauggaccuggccagccccgaggccgcgccggccgcccccaccgcccuccccuccuucagcaccuucauggacggcuacaccggggaguucgacacguuccuguaccagcugcccggcaccgugcagccgugcuccagcgcguccagcuccgccagcuccaccagcuccagcuccgccaccagccccgccuccgccagcuucaaguucgaggacuuccaggucuacgggugcuaccccggcccccucagcggcccgguggacgaggcgcuguccagcuccgggagcgacuacuacggcucccccugcagcgcccccucccccagcacgccguccuuccagccgccccagcugagccccugggacggguccuucggccacuucagccccucccagaccuacgaggggcuccgggccuggaccgagcagcugcccaaggccagcggcccgccccagccgcccgccuucuucuccuucagcccgcccaccggccccucccccagccuggcgcagagcccccucaagcuguuccccucccaggccacgcaccagcugggggagggcgagagcuacuccaugcccaccgccuuccccgggcucgcccccaccagcccgcaccuggagggcuccggcauccuggacacccccgugacgagcaccaaggcccgcuccggggcgcccggcgggagcgagggccggugcgccgucugcggggacaacgccuccugccagcacuacggcgugcggaccugcgagggcugcaagggguucuucaagcgcaccgugcagaagaacgccaaguacaucugccucgccaacaaggacugccccgucgacaagcgccggcgcaaccggugccaguucugccgcuuccagaagugccuggcggugggcauggugaaggaggucgugcggacggacagccugaaggggcgccggggccgccucccguccaagcccaagcagccgcccgacgccagccccgccaaccugcugaccucccucgugcgggcccaccuggacagcgggcccuccaccgcgaagcuggacuacagcaaguuccaggagcucguccugccccacuucggcaaggaggacgccggcgacgugcagcaguucuacgaccugcucuccgggagccuggaggugauccgcaagugggccgagaagauccccggcuucgccgagcuguccccggccgaccaggaccuccugcuggagagcgcguuccucgagcuguucauccugcggcucgccuaccgcagcaagcccggggagggcaagcugaucuucugcuccgggcugguccuccaccggcugcagugcgcccgcggcuucggcgacuggaucgacagcauccuggccuucucccggagccuccacucccugcugguggacgugcccgccuucgcgugccucagcgcccugguccugaucaccgaccgccacgggcugcaggagccccgccggguggaggagcuccagaaccgcaucgccuccugccugaaggagcacguggccgccgucgcgggcgagccgcagcccgccagcugccugucccggcuccuggggaagcugcccgagcuccgcacgcugugcacccagggccugcagcggaucuucuaccucaagcuggaggaccuggugccgcccccgcccaucaucgacaagaucuucauggacacccuccccuucuga

SEQ ID NO: 33782 - RNA, 1797 nt, Artificial Sequence
  derived and/or modified sequence opt1 from NR4A2__Homo_sapiens__NP_006177
augcccugcguccaggcccaguacggcagcuccccgcagggggccagccccgcgucccagagcuacuccuaccacagcuccggcgaguacagcuccgacuuccugacccccgaguucgucaaguucagcauggaccucaccaacacggagaucaccgccaccaccucccugcccagcuucuccacguucauggacaacuacagcaccggguacgacgugaagccgcccugccuguaccagaugccccucuccggccagcagagcuccaucaagguggaggacauccagaugcacaacuaccagcagcacagccaccucccgccccaguccgaggagaugaugccccacagcgggagcgucuacuacaagcccuccagcccgccgacccccaccacgcccggcuuccaggugcagcacucccccaugugggacgacccgggcagccugcacaacuuccaccagaacuacguggccaccacccacaugaucgagcagcgcaagacccccgucucccggcucagccuguucuccuucaagcagagcccgcccgggacgcccguguccagcugccagaugcgcuucgacggcccccugcacgugcccaugaaccccgagccggccgggucccaccacgucguggacggccagaccuucgccgugcccaaccccauccggaagcccgcgagcaugggguucccgggccuccagaucggccacgccucccagcugcuggacacccagguccccagcccgcccucccgcgggagccccuccaacgagggccucugcgccgugugcggggacaacgccgcgugccagcacuacggcgugcggaccugcgagggcugcaagggguucuucaagcgcacgguccagaagaacgccaaguacgugugccuggccaacaagaacugccccguggacaagcggcgccggaaccgcugccaguacugccgguuccagaagugccuggccgucggcauggugaaggaggugguccgcaccgacagccucaaggggcggcgcggccggcugcccuccaagcccaagagcccccaggagcccagcccgcccuccccgcccgugagccugaucuccgcccucgugcgcgcgcacgucgacagcaaccccgccaugaccucccuggacuacagccgguuccaggccaaccccgacuaccagauguccggggacgacacccagcacauccagcaguucuacgaccugcucacgggcagcauggagaucauccgcggcugggccgagaagauccccggguucgccgaccugcccaaggcggaccaggaccuccuguucgaguccgccuuccuggagcuguucgugcuccggcuggccuaccgcagcaaccccgucgagggcaagcugaucuucugcaacgggguggugcuccaccggcugcagugcguccgcggcuucggggaguggaucgacuccaucguggaguucagcuccaaccugcagaacaugaacaucgacaucagcgccuucuccugcaucgccgcgcucgccauggugaccgagcgccacggccugaaggagccgaagcgggucgaggagcugcagaacaagaucgugaacugccucaaggaccacgugaccuucaacaacggcgggcugaaccgccccaacuaccugagcaagcuccugggcaagcugcccgagcuccggacccugugcacgcaggggcugcagcgcaucuucuaccucaagcuggaggaccuggugcccccgcccgccaucaucgacaagcuguuccuggacacccugcccuucuga

SEQ ID NO: 33783 - RNA, 1881 nt, Artificial Sequence
  derived and/or modified sequence opt1 from NR4A3__Homo_sapiens__NP_008912
augcccugcgugcaggcccaguacagccccuccccgcccggcagcuccuacgccgcgcagaccuacagcuccgaguacaccacggagaucaugaaccccgacuacaccaagcugaccauggaccucgggagcaccgagaucacggccaccgccaccaccucccugcccagcaucuccacguucgucgagggcuacagcuccaacuacgagcugaagcccagcugcguguaccagaugcagcgcccccucaucaagguggaggaggggcgggcccccuccuaccaccaccaccaccaccaccaccaccaccaccaccaccaccaccagcagcagcaccagcagccgagcaucccgcccgccuccagccccgaggacgagguccugcccuccaccagcauguacuucaagcaguccccgcccagcacccccaccacgcccgcguucccgccccaggccggcgcccugugggacgaggcccuccccagcgcgcccgggugcaucgcccccggcccccugcuggacccgcccaugaaggccgugcccaccguggccggcgcccgcuucccccucuuccacuucaagcccuccccgccccacccgcccgcgcccagccccgccgggggccaccaccugggguacgaccccaccgccgccgccgcgcugucccucccgcugggcgccgccgccgccgcggggagccaggccgccgcccuggagucccaccccuacggccucccccuggccaagcgggcggcgccccuggccuucccgccccucggccugacccccagccccacggccuccagccugcucggggaguccccgagccugcccuccccgcccagccgcuccagcuccagcggcgaggggaccugcgccgucugcggcgacaacgccgccugccagcacuacggcgugcggaccugcgaggggugcaagggcuucuucaagcgcaccgugcagaagaacgccaaguacgucugccuggccaacaagaacugccccguggacaagcggcgccggaaccgcugccaguacugccgguuccagaagugccucuccguggggauggucaaggagguggugcgcacggacagccugaagggccggcgcgggcggcugcccuccaagcccaagagcccccuccagcaggagccgagccagcccuccccgcccagcccgcccaucugcaugaugaacgcgcugguccgcgcccugaccgacuccacgccccgggaccucgacuacagccgcuacugccccaccgaccaggccgccgccggcaccgacgcggagcacgugcagcaguucuacaaccugcugaccgccuccaucgacgugagccgguccugggccgagaagauccccggcuucaccgaccuccccaaggaggaccagacccugcugaucgagagcgccuuccucgagcuguucguccugcgccucuccauccggagcaacacggccgaggacaaguucguguucugcaacgggcuggugcugcaccgccuccagugccugcgcggcuucggggaguggcuggacuccaucaaggacuucagccucaaccugcagucccugaaccucgacauccaggcgcuggccugccugagcgcccuguccaugaucaccgagcggcacggccucaaggagcccaagcgcgucgaggagcugugcaacaagaucaccagcucccugaaggaccaccagagcaaggggcaggcccucgagccgaccgagagcaaggugcugggcgcgcugguggagcuccggaagaucugcacgcugggccugcagcgcaucuucuaccucaagcuggaggaccuggucuccccgcccagcaucaucgacaagcuguuccucgacacccugcccuucuga

SEQ ID NO: 33784 - RNA, 1386 nt, Artificial Sequence
  derived and/or modified sequence opt1 from NR5A1__Homo_sapiens__NP_004950
auggacuacagcuacgacgaggaccuggacgagcucugccccgugugcggcgacaaggucuccggguaccacuacggccugcugaccugcgagagcugcaagggguucuucaagcgcaccgugcagaacaacaagcacuacacgugcaccgagucccagagcugcaagaucgacaagacccagcggaagcgcugcccguucugccgguuccagaagugccucaccgugggcaugcgccuggaggccguccgggccgaccgcaugcgcgggggccggaacaaguucggccccauguacaagcgggaccgcgcgcugaagcagcagaagaaggcccagauccgggccaacggguucaagcucgagacgggcccgcccaugggggugcccccgcccccgccgcccgcccccgacuacgugcugccgcccucccugcacggccccgagcccaaggggcucgccgcggggccgcccgccggcccccugggcgacuucggcgcccccgcccugcccauggcgguccccggggcccacggcccccucgccggcuaccuguaccccgccuuccccgggcgcgccaucaagagcgaguaccccgagcccuacgcguccccgccccagcccggccugcccuacggguaccccgagccguucagcggcgggcccaacgugcccgagcucauccugcagcugcuccagcuggagcccgacgaggaccaggugcgggcccgcauccugggcugccuccaggagccgaccaagucccggcccgaccagcccgccgccuucggccugcugugccgcauggccgaccagaccuucaucagcaucgucgacugggcgcggcgcugcaugguguucaaggagcucgagguggccgaccagaugacccugcugcagaacugcugguccgagcuccuggucuucgaccacaucuaccgccaggugcagcacgggaaggagggcagcauccugcucgugacggggcaggaggucgagcugaccaccguggccacccaggccggcucccugcuccacagccuggugcugcgggcccaggagcucguccugcagcugcucgcgcugcagcuggaccggcaggaguucgugugccucaaguucaucauccuguucucccuggaccucaaguuccugaacaaccacauccuggugaaggacgcccaggagaaggccaacgccgcccuccuggacuacacgcugugccacuacccccacugcggggacaaguuccagcagcugcuccugugccuggucgaggugcgcgcgcucagcaugcaggccaaggaguaccuguaccacaagcaccugggcaacgagaugccgcgcaacaaccuccugaucgagaugcugcaggccaagcagaccuga

SEQ ID NO: 33785 - RNA, 1410 nt, Artificial Sequence
  derived and/or modified sequence opt1 from NR5A2__Homo_sapiens__NP_001263393
auggugaacuacagcuacgacgaggaccuggaggagcucugccccgucugcggcgacaagguguccggguaccacuacggccugcugaccugcgagagcugcaagggguucuucaagcgcaccgugcagaacaacaagcgguacacgugcaucgagaaccagaacugccagaucgacaagacccagcgcaagcggugcccguacugccgcuuccagaagugccucuccgucggcaugaagcuggaggccgugcgggccgaccgcaugcgcgggggccggaacaaguucggccccauguacaagcgggaccgcgcgcugaagcagcagaagaaggcccucauccgggccaacgggcugaagcuggaggccaugagccaggugauccaggccaugcccuccgaccucaccaucagcuccgcgauccagaacauccacagcgccuccaagggccugccccugaaccacgccgcccucccgcccaccgacuacgaccgcagccccuucgucacgucccccaucagcaugaccaugccgccccacgggucccugcagggcuaccagaccuacgggcacuuccccagccgggcgaucaaguccgaguaccccgacccguacaccagcucccccgagagcaucaugggcuacuccuacauggacagcuaccagacgagcucccccgccagcaucccccaccugauccucgagcugcugaagugcgagccggacgagccccaggugcaggccaagaucauggccuaccuccagcaggagcaggccaaccgcuccaagcacgagaagcugagcaccuucggccugaugugcaagauggcggaccagacccucuucuccaucguggagugggcccggagcuccaucuucuuccgcgagcugaaggucgacgaccagaugaagcugcuccagaacugcuggagcgagcugcugauccucgaccacaucuaccgccagguggugcacgggaaggagggcuccaucuuccuggucaccgggcagcaggucgacuacagcaucaucgccucccaggccggcgccacgcugaacaaccucaugagccacgcgcaggagcugguggccaagcugcggucccuccaguucgaccagcgggaguucgugugccugaaguuccugguccucuucagccuggacgugaagaaccuggagaacuuccagcucguggagggcgugcaggagcaggucaacgccgcccugcuggacuacaccaugugcaacuacccccagcagaccgagaaguucgggcagcuccugcugcgccuccccgagauccgggccaucuccaugcaggcggaggaguaccuguacuacaagcaccugaacggcgacgugccguacaacaaccuccugaucgagaugcugcacgccaagcgcgccuga

SEQ ID NO: 33786 - RNA, 1431 nt, Artificial Sequence
  derived and/or modified sequence opt1 from NR6A1__Homo_sapiens__NP_001265475
auggagcgcgacgagcccccgcccagcggcgggggcgggggcgggggcuccgccggcuuccuggagccgcccgccgcgcugcccccgccgccccggaacggguucugccaggacgagcucgccgagcuggaccccggcaccaacgaccgcgccgagcagcggaccugccucaucugcggggaccgcgccacgggccugcacuacgggaucaucagcugcgagggcugcaagggcuucuucaagcgguccaucugcaacaagcgcguguaccggugcagccgcgacaagaacugcgucaugucccggaagcagcgcaaccggugccaguacugccgccugcucaagugccugcagauggggaugaaccggaaggccauccgcgaggacggcaugcccgggggccggaacaagagcaucggccccgugcagaucuccgaggaggagaucgagcgcaucaugagcgggcaggaguucgaggaggaggcgaaccacugguccaaccacggcgacagcgaccacuccagccccgggaaccgggccuccgagagcaaccagcccucccccggcagcacccuguccagcucccgcagcguggagcucaacggguucauggccuuccgggagcaguacaugggcaugagcgucccgccccacuaccaguacaucccccaccuguucuccuacagcggccacagcccccugcucccccagcaggcccgcucccuggacccccaguccuacagccugauccaccagcuccuguccgcggaggaccuggagccgcucgggacccccaugcugaucgaggacggcuacgccgugacccaggccgagcuguucgcccuccugugccggcuggccgacgagcuccuguuccgccagaucgcguggaucaagaagcugcccuucuucugcgagcucagcaucaaggacuacacgugccugcuguccagcaccuggcaggagcucauccugcuguccagccucaccguguacuccaagcagaucuucggggagcuggccgacgucaccgccaaguacagccccuccgacgaggagcugcaccgcuucagcgacgagggcauggaggugaucgagcggcucaucuaccuguaccacaaguuccaccagcugaagguguccaacgaggaguacgccugcaugaaggccaucaacuuccucaaccaggacauccgcgggcugacgagcgcgucccagcuggagcagcucaacaagcgguacugguacaucugccaggacuucaccgaguacaaguacacccaccagccgaaccgcuuccccgaccugaugaugugccugcccgagauccgguacaucgccggcaagauggucaacgugccccucgagcagcugccgcuccuguucaaggugguccugcacagcugcaagaccagcgugggcaaggaguga

SEQ ID NO: 33787 - RNA, 5088 nt, Artificial Sequence
  derived and/or modified sequence opt1 from NRAP__Homo_sapiens__NP_006166
augaacgugcagcccugcagccgcugcggcuacggggucuacccggccgagaagaucuccugcaucgaccagaucuggcacaaggccugcuuccacugcgaggugugcaagaugaugcugagcgugaacaacuucgucucccaccagaagaagcccuacugccacgcgcacaaccccaagaacaacaccuucaccagcguguaccacacgccccucaaccugaacgugcggaccuucccggaggccaucuccggcauccacgaccaggaggacggggagcagugcaagagcgucuuccacugggacaugaaguccaaggacaaggagggcgcccccaaccgccagccccuggccaacgagcgggccuacuggaccggguacggcgagggcaacgcguggugccccggggcccucccggaccccgagaucgugcgcaugguggaggcccggaagagccugggcgaggaguacaccgaggacuacgagcagccccgcgggaagggcuccuuccccgccaugaucacgccggcguaccagcgggccaagaaggccaaccagcuggccagccaggucgaguacaagcgcgggcacgacgagcggaucucccgcuucagcaccgugguggacacccccgagcuccugcgguccaaggccggcgcgcagcugcagagcgacguccgcuacaccgaggacuacgagcagcagcggggcaagggguccuuccccgccaugaucacgcccgccuaccagaucgccaagcgcgccaacgagcucgcgagcgacgugcgguaccaccagcaguaccagaaggagaugcgcggcauggccgggccggccaucggcgccgagggcauccugacccgggagugcgccgaccaguacgggcagggcuaccccgaggaguacgaggagcaccgcgggaagggcuccuuccccgcgaugaucacccccgccuaccagaacgccaagaaggcccacgagcuggccagcgacaucaaguaccggcaggacuucaacaagaugaagggggcggcccacuaccacucccucccggcccaggacaaccuggugcugaagcaggcccagagcgucaacaagcucgugagcgagaacaaguacaaggagaacuaccagaaccacaugcgcggccgguacgagggcguggggauggaccgccgcacccugcacgcgaugaaggucggcucccuggccagcaacguggccuacaaggccgacuacaagcacgacaucguggacuacaacuaccccgccacgcucacccccuccuaccagaccgcgaugaagcuggucccccugaaggacgccaacuaccggcagagcaucgacaagcucaaguacuccagcgugaccgacacgccgcagaucgugcaggccaagaucaacgcccagcagcugucccacgucaacuaccgcgccgacuacgagaagaacaagcugaacuacacccucccccaggacgugccccagcuggucaaggcgaagaccaacgccaagcuguucagcgaggugaaguacaaggaggggugggagaagaccaagggcaagggguucgagaugaagcucgacgccaugucccugcuggccgccaaggcgagcggcgagcucgccuccaacaucaaguacaaggaggaguacgagaagacgaagggcaaggccauggggaccgccgacagccggcugcugcacucccuccagaucgcgaagaugagcuccgagguggaguacaagaagggcuucgaggagagcaagacccgcuuccaccugcccauggacauggucaacauccggcacgccaagaaggcccagacccuggccuccgaccucgacuaccgcaagaagcugcacgaguacacggugcugccggaggacaugaagacccagugggccaagaaggcguacgggcuccagagcgagcugcaguacaaggccgaccuggccuggaugaagggcgugggguggcucaccgagggcucccugaaccuggagcaggccaagaaggccggccagcucgucagcgagaagaacuaccggcagcgcguggacgagcugaaguucaccagcgugacggacuccagccagauggagcacgcgaagaagucccaggagcugcagagcggggucgccuacaaggccggcaacgagcaguccgugcaccaguacaccaucagcaaggacgagccccucuuccugcaggcccgggccaacgcggccaaccuguccgagaagcuguacaagagcuccugggagaaccagaaggccaagggguucgagcuccgccuggacagccugaccuuccucgccgcgaaggccaagcgggaccuggccuccgaggugaaguacaaggaggacuacgagcgcagccggggcaagcugaucggcgccaaggacguccagggggacucccagaugagccacucccuccagaugagcaagcugcaguccgagcuggaguacaagaagggcuucgaggacaccaagagccagugccacgugagccucgacauggugcaccugguccacgcccgcaaggcgcagcaccuggccacggacgugggguacaagaccgccgagcaccacuucaccgcccuccccaccgacaugaagguggagugggccaagaaggcguacggccugcaguccgacaaccaguaccgggccgacgucaaguggaugaaggggaugggcuggguggccacgggcagccugaacguggagcaggccaagaaggccggggagcucaucuccgagaagaaguaccgccagcacccggacgcgcugaaguucaccagcaucaaggacacccccgagaugguccaggcccggaucuccuacacccaggccguggaccgccuguaccgggagcagggcgagaacaucaagcaccacuacacccccacggccgaccuccccgaggugcugcuggccaagcucaacgcgaugaacaucagcgagacccgcuacaaggaguccuggagcaagcugcgcgacgggggcuacaagcugcggcucgacgcccugccguuccaggccgccaaggcguccggggagaucaucagcgacuacaaguacaaggaggccuucgagaagaugaagggccagaugcugggcucccgcagccucgaggacgacaucucccuggcccacagcgucuacgccaccucccugcagagcgacgugaacuacaagaagggguucgagcacuccaaggcccaguuccaccucccccuggacauggcggcccuggugcacgccaagaaggcccagacccucgccagcaaccaggacuacaagcacccccugccccaguacacgucccuggcggaggaccuccggcugagcugcgccaagaaggcccacaagcugcagagcgagaaccucuaccgcuccgaccugaacuucaugcggggcgucgccugcgugaucccggggacccuggagaucgagggccgcaagaaggccagcgagcucaucuccgagagcaaguaccggcagcacccccacuccuucaaguacaccgcggugaccgacacgcccaaccugcugcacgccaaguucagcaaccagaucaccaacgagcgccucuacaaggccgccggggaggacgcgcggcacgaguacaccaugacccugggccugcccgaguucauccgcgccaagacgaacgccgccaaccucuccgacgcccgguacaaggagagcuggcgcaaccugcgggcgcagggcuacaagcugaccaucgaggcccucccguuccaggccgcccgcgccuccggggacaucgcgagcgacuuccuguaccggcacgacuucgucaaggagcgcggcaagcugaucgggccccaguccgugcgggacgacccccgcauccagcacugccggcgcaugggccagcuccagagcgagcugcaguaccggcgcggggccaccuccagccaggcccaguuccaccugcccauggacauggugcaccucguccacgccaagaacgcccaggcgcuggccuccgaccacgacuaccgcacccaguaccacaaguucacggcccugccggaggaccucaagauggccugggcgaagaaggcccacgcccugcagagcgagcugcgguacaaguccgaccucaucggcaugaagggcaucggguggcuggcccugcgcagcccccagauggaguccgccaagaaggcgggcgagcucaucagcgagaccaaguaccggaagaagcccgacagcaucaaguucaccaccgugguggacucccccgaccugguccacgccaagaacagcuacaugcacugcaacgagcgcauguaccgguccggggacgccgagagccugcaccgcuacacgcucaucccggaccaccccgacuucacccgggcccgccugaacgcccugcaccucuccgacaagguguaccggaacagcugggagcagacccgcgcgggcuccuacgacuuccggcuggacgccauccccuuccagaccgcccgcgccagccgggagaucgccuccgacuuccgcuacaaggaggcguuccugcgggaccgcggccuccagaucggguaccggagcguggacgacgacccccgcaugaagcacuuccugaacgucggccggcugcaguccgacaacgaguacaagaaggacuucgccaagagccgcucccaguuccacagcuccacggaccagccggggcuccugcaggccaagcgcagccagcagcuggccuccgacgugcacuaccggcagccccucccccagccgaccugcgaccccgagcagcugggccugcgccacgcccagaaggcgcaccagcuccagagcgacgugaaguacaaguccgaccugaaccugacccggggggucggcuggaccccccccggcagcuacaagguggagauggcccgccgggccgccgagcucgcgaacgcccgcgggcugggccugcagggggccuaccggggcgccgaggccguggaggcgggggaccaccagagcggcgaggucaacccggacgccacggagauccuccacgugaagaagaagaaggcccugcugcucuga

SEQ ID NO: 33788 - RNA, 345 nt, Artificial Sequence
  derived and/or modified sequence opt1 from NRARP__Homo_sapiens__NP_001004354
augagccaggccgagcuguccacgugcagcgcgccccagacccagcgcaucuuccaggaggccgugcggaagggcaacacccaggagcuccagucccugcugcagaacaugaccaacugcgaguucaacgucaacagcuucgggccggagggccagaccgcccuccaccaguccgugaucgacgggaaccuggagcuggugaagcuccuggucaaguucggcgccgacauccgccuggccaaccgggacggguggagcgcccuccacaucgcggccuucggcggccaccaggacaucgugcuguaccugaucaccaaggccaaguacgccgcguccgggcgcuga

SEQ ID NO: 33789 - RNA, 1608 nt, Artificial Sequence
  derived and/or modified sequence opt1 from NRBP1__Homo_sapiens__XP_005264331
augagcgagggcgagucccagaccgugcugagcuccgggagcgaccccaaggucgaguccagcuccagcgccccgggccucaccuccgugagcccgcccgugacguccaccaccagcgccgcgucccccgaggaggaggaggagagcgaggacgaguccgagauccuggaggagagccccugcgggcgcuggcagaagcggcgcgaggaggucaaccagcggaacgugcccggcaucgacuccgccuaccuggccauggacaccgaggaggggguggaggucguguggaacgaggugcaguucagcgagcgcaagaacuacaagcuccaggaggagaagguccgggccguguucgacaaccugauccagcuggagcaccucaacaucgugaaguuccacaaguacugggccgacaucaaggagaacaaggcgcgcgucaucuucaucacggaguacauguccagcggcagccugaagcaguuccugaagaagaccaagaagaaccacaagaccaugaacgagaaggccuggaagcgguggugcacccagauccucuccgcccugagcuaccugcacuccugcgacccgcccaucauccacggcaaccucacgugcgacaccaucuucauccagcacaacgggcugaucaagaucggcagcguggcccccgacaccaucaacaaccacgugaagaccugccgcgaggagcagaagaaccugcacuucuucgcgcccgaguacggggaggucacgaacgugaccaccgccguggacaucuacuccuucggcaugugcgcccucgagauggccguccuggagauccaggggaacggcgagagcuccuacgugccccaggaggccaucagcuccgcgauccagcugcucgaggacccccugcagcgggaguucauccagaagugccugcagagcgagccggcccgccggcccaccgcccgcgagcuccuguuccaccccgcccuguucgaggugcccucccucaagcugcuggccgcgcacugcaucgucggccaccagcacaugaucccggagaacgcccucgaggagaucacgaagaacauggacaccagcgccgugcuggccgagauccccgccgggcccggccgggagcccgugcagacccuguacucccagagcccggcgcucgagcuggacaaguuccuggaggacguccgcaacgggaucuacccccucaccgccuucggccugccccggccccagcagccgcagcaggaggaggugacgucccccgucgugccgcccagcgugaagacccccacccccgagcccgccgaggucgagacccgcaagguggugcugaugcagugcaacaucgaguccgucgaggagggcgugaagcaccaccucacgcugcugcucaagcuggaggacaagcugaaccggcaccucagcugcgaccugaugccgaacgagaacauccccgagcuggccgccgagcucgugcagcugggguucaucuccgaggcggaccagagccgccugaccagccuccuggaggagacccugaacaaguucaacuucgcccggaacuccacccugaacagcgccgccgucacgguguccagcuga

SEQ ID NO: 33790 - RNA, 1506 nt, Artificial Sequence
  derived and/or modified sequence opt1 from NRBP2__Homo_sapiens__NP_848659
auggccgcccccgagccggcgccccgccgggcccgcgagcgggagcgcgagcgggaggacgagagcgaggacgaguccgacauccuggaggagagccccugcggccgcuggcagaagcggcgcgagcaggucaaccaggggaacaugcccggccuccaguccaccuuccuggccauggacaccgaggaggggguggaggugguguggaacgagcugcacuucggcgaccggaaggccuucgccgcgcacgaggagaagauccagacggucuucgagcagcucgugcugguggaccacccgaacaucgucaagcugcacaaguacuggcucgacaccagcgaggccugcgcccgcgugaucuucaucaccgaguacguguccagcgggucccugaagcaguuccugaagaagaccaagaagaaccacaaggccaugaacgcgcgggccuggaagcgcuggugcacgcagauccucagcgcccuguccuuccugcacgccugcagcccgcccaucauccacggcaaccucaccuccgacaccaucuucauccagcacaacggccugaucaagaucgggagcgucuggcaccggaucuucuccaacgcccugcccgacgaccuccgcagccccauccgggcggagcgcgaggagcugcggaaccugcacuucuucccgcccgaguacggcgagguggccgacgggaccgccguggacaucuucuccuucggcaugugcgcccucgagauggccguccuggagauccagacgaacggggacacccgcgugaccgaggaggcgaucgcccgggcccgccacagccuguccgaccccaacaugcgggaguucauccucugcugccuggcccgcgaccccgcccgccggcccagcgcgcacucccuccuguuccaccgcgugcuguucgagguccacagccugaagcuccuggccgcccacugcuucauccagcaccaguaccugaugcccgagaacgugguggaggagaagaccaaggccauggaccuccacgccguccuggcggagcugccccggccgcgccggccgccccuccaguggcgcuacagcgagguguccuucauggagcuggacaaguuccuggaggacgugcggaacggcaucuacccccucaugaacuucgccgccacgcgcccccugggccugccccggguccucgccccgccgcccgaggaggugcagaaggcgaagacccccacccccgagcccuucgacagcgagacccgcaaggugauccagaugcagugcaaccuggagcgguccgaggacaaggcccgcuggcaccugacgcuccugcugguccucgaggaccggcugcaccgccagcugaccuacgaccuccugcccaccgacagcgcccaggaccuggccuccgagcuggugcacuacggguuccuccacgaggacgaccggaugaagcuggccgcguuccuggagagcaccuuccucaaguaccgcggcacgcaggccuga

SEQ ID NO: 33791 - RNA, 3915 nt, Artificial Sequence
  derived and/or modified sequence opt1 from NRCAM__Homo_sapiens__NP_001032209
augcagcugaagaucaugcccaagaagaagcgccucagcgccggccgggugccgcugauccuguuccucugccagaugaucuccgcccuggaggucccccuggaccccaagcuccuggaggaccuggugcagcccccgaccaucacccagcagagccccaaggacuacaucaucgacccccgcgagaacaucgugauccagugcgaggcgaaggggaagcccccgcccuccuucagcuggacgcggaacggcacccacuucgacaucgacaaggacccccucgucaccaugaagcccgggaccggcacgcugaucaucaacaucauguccgaggggaaggccgagaccuacgagggcguguaccagugcaccgcccgcaacgagcggggcgccgccgugagcaacaacaucgucgugcgcccgucccggagcccccuguggaccaaggagaagcucgagcccaucacgcugcaguccgggcagagccuggugcuccccugccgcccgcccaucggccugcccccgcccaucaucuucuggauggacaacuccuuccagcggcugccccagagcgagcgcgucucccaggggcucaacggcgaccuguacuucagcaacgugcugcccgaggacacccgggaggacuacaucugcuacgcgcgcuucaaccacacccagaccauccagcagaagcagcccaucuccgugaaggucaucagcguggacgagcucaacgacacgaucgccgccaaccuguccgacaccgaguucuacggggccaagagcucccgggagcgcccgcccaccuuccugacccccgagggcaacgcgagcaacaaggaggagcuccggggcaacgugcugagccuggagugcaucgccgaggggcuccccacgccgaucaucuacugggccaaggaggacggcaugcugcccaagaaccgcaccgucuacaagaacuucgagaagacccugcagaucauccacguguccgaggccgacagcgggaacuaccagugcaucgccaagaacgcgcucggcgccauccaccacaccaucuccgugcgggucaaggccgcccccuacuggaucacggccccgcagaaccuggugcugagccccggcgaggacgggacccucaucugccgcgcgaacggcaaccccaagccccggaucuccuggcugaccaacggggugccgaucgagaucgcccccgacgaccccagccgcaagaucgacggcgacaccaucaucuucuccaacguccaggagcggagcuccgccguguaccagugcaacgccagcaacgaguacggguaccugcucgccaacgcguucgugaacguccuggccgagcccccgcgcauccugacgcccgccaacacccucuaccaggugaucgccaaccgccccgcccugcuggacugcgcguucuucggcagcccccucccgaccaucgagugguucaagggcgccaaggggagcgcccugcacgaggacaucuacguccugcacgagaacggcacccucgagauccccguggcccagaaggacuccacggggaccuacacgugcguggcgcggaacaagcugggcauggccaagaacgagguccaccuggagaucaaggaccccaccuggaucgugaagcagcccgaguacgccgugguccagcgcgggagcaugguguccuucgagugcaaggugaagcacgaccacacccucagccugaccguccuguggcugaaggacaaccgggagcucccguccgacgagcgcuucaccguggacaaggaccaccugguggucgccgacgugagcgacgacgacuccggcaccuacacgugcguggccaacaccacccuggacagcgucagcgcguccgccgugcucagcguggucgcccccacccccacccccgccccgguguacgacgugcccaacccgcccuucgaccuggagcugacggaccagcucgacaaguccguccagcugagcuggacccccggcgacgacaacaacucccccaucaccaaguucaucaucgaguacgaggacgccaugcacaagcccgggcuguggcaccaccagaccgaggugagcggcacgcagaccaccgcgcagcucaagcuguccccguacgugaacuacagcuuccgggucauggccgugaacuccaucgggaagucccugcccuccgaggccagcgagcaguaccucaccaaggccuccgagcccgacaagaaccccacggccguggagggccuggggagcgagccggacaaccuggucaucaccuggaagccccucaacggcuucgaguccaacggccccgggcugcaguacaaggugagcuggcgccagaaggacggcgacgacgaguggaccuccguggucguggcgaacgugagcaaguacaucgucagcgggacccccacguucgugccguaccugaucaaggugcaggcccucaacgacaugggcuucgcccccgagcccgccgucgugaugggccacuccggggaggaccugcccaugguggcgccgggcaacguccgggugaacguggucaacagcacccuggccgaggugcacugggaccccgugccccucaaguccauccgcgggcaccuccagggcuaccggaucuacuacuggaagacccagagcuccagcaagcgcaaccggcgccacaucgagaagaagauccugaccuuccagggguccaagacgcacggcaugcugcccggccuggagccguucagccacuacacccugaacguccggguggugaacgggaagggcgaggggcccgccucccccgaccgcgucuucaacacccccgagggcgugccgagcgcccccuccagccucaagaucgugaaccccacccuggacucccugacgcucgagugggacccgcccagccaccccaacgggauccugaccgaguacacccugaaguaccagcccaucaacuccacccacgagcucggcccccuggucgaccugaagaucccggccaacaagacgcgguggacccucaagaaccugaacuucagcacccgcuacaaguucuacuucuacgcgcagaccuccgccggcagcgggucccagaucacggaggaggccgugaccaccgucgacgaggccggcauccugccgcccgacgugggggccggcaaggugcaggcggucaacccccggaucagcaaccucaccgccgccgccgccgagacguacgcgaacaucagcugggaguacgaggggcccgagcacgugaacuucuacguggaguacggcgucgccggcuccaaggaggaguggcgcaaggagaucgugaacgggagccgguccuucuucggccugaaggggcugaugcccggcaccgccuacaaggugcgcgucggggccgugggcgacagcggcuucguguccagcgaggacgucuucgagaccgggcccgcgauggccucccgccagguggacaucgccacccagggcugguucaucgggcucaugugcgccguggcccugcugauccucauccugcugaucgucugcuucauccggcgcaacaagggcggcaaguacccggugaaggagaaggaggacgcgcacgccgaccccgagauccagcccaugaaggaggacgacgggacguucggcgaguacagcgacgccgaggaccacaagccccucaagaaggggucccggaccccgagcgaccgcaccgugaagaaggaggacuccgacgacagccuggucgacuacggcgagggggugaacggccaguucaacgaggacggcuccuucaucgggcaguacagcggcaagaaggagaaggagcccgccgaggggaacgaguccagcgaggcccccucccccgugaacgcgaugaacagcuucgucuga

SEQ ID NO: 33792 - RNA, 3564 nt, Artificial Sequence
  derived and/or modified sequence opt1 from NRD1__Homo_sapiens__XP_011539823
augcugcgccgggugaccgucgccgccgugugcgcgacccgccggaagcucugcgaggccggccgcgagcuggccgcccugugggggaucgagacgcggggccgcugcgaggacagcgccgcggcccggcccuucccgauccucgccaugcccgggcgcaacaaggccaaguccacgugcagcugccccgaccugcagcccaacggccaggaccugggggagaacucccggguggcgcgccucggcgccgacgagagcgaggaggagggccggcgcgggucccugagcaacgccggcgacccggagaucgucaagucccccagcgaccccaagcaguaccgguacaucaagcugcagaacgggcuccaggcccugcugaucuccgaccucagcaacauggagggcaagaccgggaacaccacggacgacgaggaggaggaggagguggaggaggaggaggaggacgacgacgaggacuccggcgccgagaucgaggacgacgacgaggagggcuucgacgacgaggacgaguucgacgacgagcacgacgacgaccuggacaccgaggacaacgagcuggaggagcucgaggagcgcgcggaggcccggaagaagaccaccgagaagcagcagcugcagagccuguuccuccugugguccaagcugacggaccgccucugguucaagagcaccuacuccaagaugagcuccacccugcugguggagacccggaaccucuacggggucgugggcgccgagagccgcuccgcccccgugcagcaccuggccggguggcaggcggaggagcagcagggcgagacggacaccguccugagcgccgccgcccucugcgugggcguggggagcuucgccgacccggacgaccugcccggccuggcgcacuuccucgagcacauggucuucauggggucccugaaguaccccgacgagaacggcuucgacgccuuccugaagaagcacgggggcagcgacaacgccuccaccgacugcgagcggaccguguuccaguucgacgugcagcgcaaguacuucaaggaggcccucgaccggugggcccaguucuucauccacccccugaugauccgcgacgcgaucgaccgcgaggucgaggccguggacagcggcaacgccgagacgcugaagcacgagccgcggaagaacaacaucgacacccacgcccgccuccgggaguucuggaugcgcuacuacuccagccacuacaugacccuggugguccaguccaaggagacccuggacacgcucgagaagugggugaccgagaucuucagccagauccccaacaacgggcugccccggcccaacuucggccaccugaccgacccguucgacacccccgcguucaacaagcucuaccgcgugguccccauccggaagauccacgcccugacgaucaccugggcccugcccccgcagcagcagcacuaccgcgugaagccccuccacuacaucuccuggcugguggggcacgagggcaaggggagcauccuguccuuccuccggaagaagugcugggcccuggcccuguucggcggcaacggggagaccggcuucgagcagaacagcaccuacuccgucuucagcaucuccaucacgcugaccgacgagggguacgagcacuucuacgagguggcguacaccgucuuccaguaccucaagaugcugcagaagcugggccccgagaagcgcaucuucgaggagauccggaagaucgaggacaacgaguuccacuaccaggagcagaccgaccccguggaguacguggagaacaugugcgagaacaugcagcucuacccgcugcaggacauccugacgggggaccagcuccuguucgaguacaagcccgaggucaucggcgaggcccugaaccagcucgugccccagaaggccaaccuggugcugcucagcggcgccaacgaggggaagugcgaccugaaggagaagugguucggcacccaguacuccaucgaggacaucgagaacagcugggccgagcuguggaacuccaacuucgagcucaaccccgaccugcaccucccggcggagaacaaguacaucgccaccgacuucacccucaaggccuucgacugccccgagacggaguaccccgucaagaucgugaacaccccgcaggggugccugugguacaagaaggacaacaaguucaagauccccaaggccuacauccgcuuccaccugaucagcccccucauccagaaguccgccgcgaacgugguccuguucgacaucuucgugaacauccugacccacaaccucgccgagcccgccuacgaggccgacguggcgcagcuggaguacaagcuggucgccggcgagcacggccucaucauccgggugaagggguucaaccacaagcugccgcugcuguuccagcugaucaucgacuaccuggccgaguucaacuccacccccgccguguucaccaugaucacggagcagcucaagaagaccuacuucaacauccugaucaagcccgagacccuggccaaggacguccgccuccugauccuggaguacgcgcgguggagcaugaucgacaaguaccaggcccucauggacggccugucccuggagagccuccuguccuucgugaaggaguucaagagccagcuguucguggaggggcucguccagggcaacgugaccuccacggagagcauggacuuccugaaguacguggucgacaagcugaacuucaagccccucgagcaggagaugccggugcaguuccagguggucgagcugcccuccgggcaccaccugugcaaggugaaggcccucaacaagggcgacgccaacagcgaggugaccgucuacuaccaguccggcacccgcagccugcgggaguacacccugauggagcuccuggugaugcacauggaggagcccugcuucgacuuccugcgcacgaagcagacccucggguaccacguguacccgaccugccggaacaccuccggcauccugggguucagcgucacggugggcacccaggccaccaaguacaacuccgagguggucgacaagaagaucgaggaguuccugagcuccuucgaggagaagaucgagaaccucaccgaggaggcguucaacacccaggugaccgcccugaucaagcugaaggagugcgaggacacccaccucggggaggagguggaccgcaacuggaacgaggucgugacccagcaguaccuguucgaccgccuggcccacgagaucgaggcccucaagagcuucagcaaguccgaccuggugaacugguucaaggcccaccggggccccggcagcaagaugcuguccguccacguggugggguacggcaaguacgagcucgaggaggacgggacgcccagcuccgaggacagcaacuccagcugcgaggucaugcagcugaccuaccugcccaccagcccccuccuggcggacugcaucaucccgaucaccgacauccgcgccuucacgaccacccugaaccuccugcccuaccacaagaucgugaaguga

SEQ ID NO: 33793 - RNA, 3495 nt, Artificial Sequence
  derived and/or modified sequence opt1 from NRDE2__Homo_sapiens__NP_060440
auggcccuguuccccgccuucgcgggccucagcgaggccccggacgggggcuccagccgcaaggagcuggacuggcuguccaaccccagcuucugcgugggguccaucaccagccucucccagcagaccgaggccgcccccgcccacgucagcgagggccugccccugacgcggucccaccucaagagcgaguccagcgacgaguccgacaccaacaagaagcugaagcagaccagccgcaagaagaagaaggagaagaagaagaagcggaagcaccagcaccacaagaagaccaagcgcaagcacgggccguccagcuccagccgguccgagacggacaccgacagcgagaaggacaagcccagccgcggcgugggcggguccaagaaggagagcgaggagcccaaccagggcaacaacgcggccgccgacaccgggcaccgguucguguggcuggaggacauccaggccgucaccggcgagacguuccgcaccgacaagaagcccgacccggcgaacugggaguacaagucccucuaccgcggggacaucgcccgguacaagcggaagggcgacagcugccugggcaucaaccccaagaagcagugcaucuccugggaggggaccagcaccgagaagaagcacucccgcaagcaggucgagcgguacuucacgaagaaguccgugggccugaugaacaucgacgggguggccaucagcagcaagaccgagccgcccuccagcgagcccaucuccuucauccccgugaaggaccucgaggacgccgcccccgugaccaccuggcugaacccccugggcaucuacgaccagagcacgacccacuggcuccagggccaggggccgcccgagcaggaguccaagcagcccgacgcgcagcccgacagcgaguccgccgcccugaaggccaaggucgaggaguucaaccgccgggugcgcgagaacccgcgggacacccagcuguggauggccuucguggcguuccaggacgaggucaugaagucccccggccucuacgccaucgaggagggggagcaggagaagcgcaagcggagccugaagcugauccucgagaagaagcuggccauccuggagcgcgccaucgagagcaaccagagcuccguggaccucaagcuggccaagcugaagcucugcaccgaguucugggagcccagcacgcuggugaaggaguggcagaagcugaucuuccuccaccccaacaacaccgcgcuguggcagaaguaccuccucuucugccagucccaguucagcaccuucuccaucagcaagauccacucccuguacggcaagugccugagcacccucuccgccgucaaggacgggagcauccugucccacccggcccugcccggcacggaggaggccauguucgcccucuuccugcagcagugccacuuccugcggcaggcgggccacagcgagaaggccaucucccucuuccaggccaugguggacuucaccuucuucaagcccgacagcgugaaggaccugcccaccaaggggcaggucgaguucuucgagccguucugggacuccggcgagccccgcgccggggagaagggcgcgcgcggguggaaggccuggaugcaccagcaggagcggggcggcuggguggugaucaaccccgacgaggacgacgacgagccggaggaggacgaccaggagaucaaggacaagacccugccccgcuggcagaucuggcucgccgccgagcggagccgcgaccagcggcacuggcgccccuggcggcccgacaagacgaagaagcagaccgaggaggacugcgaggacccggagcgccagguccuguucgacgacaucgggcagucccugauccggcucagcagccacgaccugcaguuccagcugguggaggccuuccugcaguuccucggcgugcccuccggguucaccccgcccgcgagcugccuguaccuggccauggacgagaacuccaucuucgacaacggccucuacgacgagaagccccugaccuucuucaacccccuguucagcggggccuccugcgucggccgcauggaccggcucggcuacccccgcuggacgcgggggcagaaccgcgagggcgaggaguucauccggaacguguuccaccuggucaugccccuguucagcgggaaggagaagucccagcucugcuucagcuggcugcaguacgagaucgccaaggugaucuggugccugcacaccaagaacaagaagcgccucaagucccagggcaagaacugcaagaagcuggccaagaaccugcucaaggagccggagaacugcaacaacuucugccuguggaagcaguacgcgcaccuggaguggcuccugggcaacaccgaggacgcccggaagguguucgacaccgcccuggggauggccggcagccgcgagcucaaggacuccgaccugugcgagcugagccuccuguacgccgagcuggaggucgagcucucccccgaggugcggcgcgcggccacggcccgcgccgugcacauccugaccaagcugaccgagagcucccccuacgggcccuacaccggccagguccucgcggugcacauccugaaggcccggaaggccuacgagcacgcccugcaggacugccucggggacagcugcguguccaacccggcccccaccgacagcugcucccgccugaucagccuggcgaagugcuucaugcuguuccaguaccugacgaucggcaucgacgccgccguccagaucuacgagcaggucuucgccaagcugaacagcuccguguuccccgagggcagcggggagggcgacuccgccagcucccagagcuggaccuccgugcucgaggcgaucacccugaugcacaccagccugcuccgguuccacaugaagguguccguguacccccuggccccgcugcgcgaggcccucagccaggcccugaagcuguaccccgggaaccagguccucuggcgguccuacgugcagauccagaacaagagccacuccgccagcaagacgcgccgguucuucgacaccaucacccgcuccgcgaagccccuggagcccuggcuguucgccaucgaggccgagaagcuccggaagcgccugguggagaccguccagcggcuggacggccgcgagauccacgccacgaucccggagaccgggcucaugcaccggauccaggcgcuguucgagaacgccaugcgcagcgacuccggcagccagugcccccugcucuggcggauguaccugaacuuccuggugucccucggcaacaaggagcgcagcaaggggguguucuacaaggcccugcagaacugccccugggccaagguccuguaccucgacgccguggaguacuucccggacgagaugcaggagauccuggaccugaugaccgagaaggagcuccgggugcgccugccccuggaggagcucgagcugcugcucgaggacuga

SEQ ID NO: 33794 - RNA, 339 nt, Artificial Sequence
  derived and/or modified sequence opt1 from NREP__Homo_sapiens__NP_001135947
augaagggcguguggaacuacagcgcccugucccgccgggaggacgagacccgcacccagcggagccgcaugaccgaccggguccccugcuccaagugcuuccaggugcacugccagaucagcgugcucaacugcgucuacuacccggagcuguucgugugggugucccaggagcccuuccccaacaaggacauggaggggcgccugcccaagggccggcucccgguccccaaggaggugaaccgcaagaagaacgacgagaccaacgccgcgagccugacgccccugggguccagcgagcuccggagcccccgcaucuccuaccugcacuucuucuga

SEQ ID NO: 33795 - RNA, 1569 nt, Artificial Sequence
  derived and/or modified sequence opt1 from NRF1__Homo_sapiens__NP_001280092
auggaggagcacggcgugacccagaccgagcacauggccacgaucgaggcccacgcggucgcccagcagguccagcagguccacguggccaccuacaccgagcacagcaugcuguccgccgacgaggacagccccuccagcccggaggacaccuccuacgacgacagcgacauccucaacuccacggccgcggacgaggugaccgcccaccuggccgccgcggggcccgugggcauggccgccgccgccgcgguggccaccgggaagaagcgcaagcggccccacguguucgagagcaaccccuccauccgcaagcggcagcagacccgccugcuccggaagcugcgcgccacgcuggacgaguacaccacccgggugggccagcaggccaucguccucugcaucagcccguccaagcccaaccccguguucaagguguucggggccgcgccccuggagaacgucgugcgcaaguacaagagcaugauccuggaggaccucgaguccgcccuggccgagcacgccccggcgccccaggaggugaacagcgagcugccgccccucaccaucgacggcauccccgucuccguggacaagaugacgcaggcccagcugcgggccuucauccccgagaugcugaaguacagcaccggccgcgggaagcccggcugggggaaggaguccugcaagcccaucugguggccggaggacauccccugggccaacgugcggagcgacguccgcaccgaggagcagaagcagcggguguccuggacccaggcccuccgcacgaucgugaagaacugcuacaagcagcacggccgggaggaccugcuguacgccuucgaggaccagcagacccagacccaggcgaccgccacgcacagcaucgcccaccucguccccagccagaccguggugcagaccuucuccaaccccgacgggaccgucagccugauccaggugggcacgggcgccaccgucgcgacccuggccgacgccuccgagcucccgaccacggugaccguggcccaggucaacuacagcgccguggcggacggggagguggagcagaacugggccacccugcagggcggggagaugaccauccagacgacccaggccuccgaggccacccaggccgucgcgagccuggccgaggccgccguggccgcgucccaggagaugcagcagggcgccaccgugacgauggcccucaacagcgaggccgcggcccacgccgucgccacccuggccgaggcgacccugcagggcgggggccagaucgugcucuccggggagaccgccgccgccgugggcgcccugaccgggguccaggacgcgaacggccuguucauggccgaccgcgccggccggaaguggauccucacggacaaggccaccgggcuggugcagauccccgugagcauguaccagaccgucgugaccucccuggcccagggcaacgggcccgugcaggucgcgauggcccccgugacgacccgcaucagcgacuccgccgugaccauggacggccaggccgucgagguggugacccucgagcaguga

SEQ ID NO: 33796 - RNA, 1824 nt, Artificial Sequence
  derived and/or modified sequence opt1 from NRG1__Homo_sapiens__NP_001153467
augggcaaggggcgcgccggccggguggggaccaccgcccugcccccgcgccucaaggagaugaagucccaggaguccgcggccggcagcaagcugguccugcggugcgagacguccagcgaguacuccagccuccgcuucaagugguucaagaacgggaacgagcugaaccggaagaacaagccccagaacaucaagauccagaagaagcccggcaaguccgagcugcgcaucaacaaggccagccucgccgacuccggcgaguacaugugcaaggugaucagcaagcuggggaacgacuccgccagcgcgaacaucaccaucguggaguccaacgagaucaucaccggcaugcccgccagcaccgagggggccuacgucuccagcgccacguccaccagcaccaccggcacgucccaccuggugaagugcgcggagaaggagaagaccuucugcgugaacgggggcgagugcuucauggucaaggaccucagcaacccgagccgguaccugugcaagugccccaacgaguucaccggcgaccgcugccagaacuacgugauggccuccuucuacaagcaccuggggaucgaguucauggaggccgaggagcucuaccagaagcgggugcugaccaucacgggcaucugcaucgcccugcucgucguggggaucaugugcguggucgccuacugcaagaccaagaagcagcgcaagaagcugcacgaccggcugcgccagagccuccgguccgagcgcaacaacaugaugaacaucgcgaacggcccccaccaccccaacccgccgcccgagaacgugcagcuggugaaccaguacgucagcaagaacgugaucuccagcgagcacaucguggagcgggaggccgagaccuccuucagcaccucccacuacacgagcaccgcccaccacuccaccaccgucacgcagacccccagccacuccuggagcaacggccacaccgaguccauccugagcgagucccacagcgugaucgugauguccagcgucgagaacagccgccacuccagccccaccgggggcccccgggggcgccucaacggcaccgggggcccccgggagugcaacuccuuccugcgccacgcccgggagacgcccgacagcuaccgcgacuccccgcacagcgagcgcuacguguccgccaugaccacccccgcgcggaugagccccguggacuuccacacgcccuccagcccgaaguccccgcccagcgagaugagcccgcccgucagcuccaugaccgugagcaugcccuccauggccgucagccccuucauggaggaggagcgcccccugcuccuggugaccccgccccggcugcgcgagaagaaguucgaccaccacccccagcaguucagcuccuuccaccacaaccccgcccacgacagcaacucccuccccgccagcccccugcggaucguggaggacgaggaguacgagaccacgcaggaguacgagcccgcccaggagccggucaagaagcuggcgaacucccgccgggccaagcgcaccaagcccaacggccacaucgccaaccggcucgagguggacagcaacaccuccagccaguccagcaacuccgagagcgagaccgaggacgagcgcgugggggaggacacgcccuuccugggcauccagaacccccuggccgccucccucgaggcgaccccggccuuccggcuggccgacagccgcaccaaccccgccgggcgguucuccacccaggaggagauccaggcgcgccugagcuccgucaucgccaaccaggaccccaucgccguguga

SEQ ID NO: 33797 - RNA, 2355 nt, Artificial Sequence
  derived and/or modified sequence opt1 from NRG2__Homo_sapiens__NP_001171864
augcgccaggugugcugcagcgcccugcccccgccgccccucgagaagggccggugcuccagcuacuccgacagcuccagcuccagcuccgagcgcagcuccagcuccagcuccagcuccagcgaguccggcagcagcucccggagcuccagcaacaacuccagcaucucccgccccgccgccccgcccgagccccggccccagcagcagccgcagccccgcagccccgccgcccggcgcgccgccgcgcggucccgcgccgccgccgcgggcgggaugcggcgcgaccccgccccgggcuucagcaugcugcuguucggggucucccucgccugcuacagccccucccucaagagcgugcaggaccaggccuacaaggcccccguggucguggagggcaaggugcagggccugguccccgccgggggcuccagcuccaacagcacccgggagccgcccgccuccgggcgcguggcccucgugaagguccuggacaaguggccccugcggagcggcgggcuccagcgcgagcaggucaucagcgugggcuccugcgucccccuggagcggaaccagcgcuacaucuucuuccuggagccgaccgagcagccccucguguucaagacggccuucgcgccccuggacaccaacggcaagaaccugaagaaggagguggggaagauccucugcaccgacugcgcgacccggcccaagcugaagaagaugaagucccagacgggccaggucggggagaagcagucccugaagugcgaggccgccgccggcaacccgcagcccagcuaccgcugguucaaggacggcaaggagcugaaccggagccgcgacauccgcaucaaguacgggaacggccggaagaacagccgccugcaguucaacaaggugaagguggaggacgccggggaguacgugugcgaggcggagaacauccugggcaaggacaccgugcgggggcgccucuacgugaacuccgaggccgaggagcuguaccagaagcggguccugaccaucaccggcaucugcguggcccuccugguggucggcaucgugugcgucguggccuacugcaagacgaagaagcagcgcaagcagaugcacaaccaccuccggcagaacaugugccccgcccaccagaaccgcagccuggcgaacgggcccucccacccgcggcuggaccccgaggagauccagauggccgacuacaucagcaagaacgugcccgccaccgaccacgucauccgccgggagaccgagaccacguucuccggcagccacuccugcagcccgucccaccacugcagcaccgccacccccaccuccagccaccgccacgagagccacacguggucccuggagcggagcgagucccucaccagcgacucccagagcgggaucaugcuguccagcgugggcaccuccaagugcaacagccccgcgugcguggaggcccgcgcccggcgcgccgccgcguacaaccuggaggagcggcgccgggccaccgccccgcccuaccacgacuccgucgacagccuccgcgacagcccccacuccgagcgcuacguguccgcccugacgacccccgcccggcugagccccguggacuuccacuacucccucgcgacccagguccccaccuucgagaucacgagccccaacuccgcccacgccgugagccugccgcccgccgcccccaucagcuaccgccuggcggagcagcagccccuccugcggcaccccgcgcccccggggcccggccccggccccgggccgggccccgggcccggcgccgacaugcagcgcuccuacgacagcuacuacuaccccgccgccgggccgggcccccggcgcgggaccugcgcccugggcggcucccucgggagccugcccgccuccccguuccggauccccgaggacgacgaguacgagaccacccaggagugcgcgcccccgcccccgccccgcccccgggcccgcggcgccagccggcgcacguccgccggcccccggcgcuggcggcgcagccggcugaacgggcucgccgcccagcgcgcccgggcggcccgcgacucccugagccuguccagcggcuccgggggcgggagcgccuccgccagcgacgacgacgccgacgacgcggacggcgcccucgccgccgaguccacccccuuccugggccugcgcggggcgcacgacgcccugcggagcgacuccccgccccucugccccgccgccgacagccgcaccuacuacagccuggacucccacagcacccgggccuccagccgccacucccgggggcccccgccccgcgcgaagcaggacagcgcgccccuguga

SEQ ID NO: 33798 - RNA, 2091 nt, Artificial Sequence
  derived and/or modified sequence opt1 from NRG3__Homo_sapiens__NP_001010848
augagcgagggcgccgccgcggccuccccgcccggggccgccagcgccgcggccgccuccgccgaggagggcaccgcggccgccgccgccgcggccgccgccgggggcgggcccgacggcggcggggagggcgccgcggagccgccccgcgagcugcggugcagcgacugcaucguguggaaccgccagcagaccuggcucugcgucgugccccuguucaucggguucaucggccuggggcucucccugaugcugcucaaguggaucguggucggcagcgugaaggaguacgugcccacggaccuggucgacuccaagggcauggggcaggaccccuucuuccugagcaagcccuccagcuucccgaaggccauggagaccaccaccacgaccaccuccaccacgagccccgccacccccuccgccggcggggccgcgagcucccggacccccaaccgcaucagcacccggcucacgaccaucacccgcgccccgacccgguuccccggccaccgcgugcccauccgggccagcccccgcagcacgaccgcccggaacaccgccgcgccggccaccgugcccuccacgaccgcccccuucuucagcagcuccacccugggcagccggcccccgguccccgggacccccuccacgcaggccaugcccagcuggccgaccgcggccuacgccaccuccagcuaccugcacgacuccacccccagcuggacgcucucccccuuccaggacgccgccagcuccagcuccagcuccagcuccagcgcgaccaccaccacgcccgagaccuccaccagcccgaaguuccacaccacgaccuacagcaccgagcgguccgagcacuucaagcccugccgcgacaaggaccuggccuacugccugaacgacggcgagugcuucgugaucgagacccucaccgggagccacaagcacugccggugcaaggagggcuaccagggggugcgcugcgaccaguuccugcccaagacggacuccauccugagcgacccgaccgaccaccucggcaucgaguucauggaguccgaggaggucuaccagcgccaggugcugagcaucuccugcaucaucuucggcaucgugaucgucgggauguucugcgccgccuucuacuucaagagcaagaagcaggccaagcagauccaggagcagcugaaggugccccagaacggcaaguccuacagccucaaggcguccagcaccauggccaaguccgagaaccuggugaagucccacguccagcugcagaacuacuccaagguggagcgccaccccgugaccgcccucgagaagaugauggagagcuccuucgucgggccccagagcuucccggaggugcccagccccgaccggggcucccagagcgugaagcaccaccgcucccugagcuccugcugcagccccgggcagcgguccggcaugcugcaccgcaacgccuuccgccggacgccgcccagcccccgcucccggcucggcgggaucgucggccccgccuaccagcagcuggaggagagccgcaucccggaccaggacaccauccccugccagggguacuccagcuccggccugaagacccagcggaacaccagcaucaacaugcagcuccccucccgcgagacgaaccccuacuucaacagccuggagcagaaggaccuggugggguacuccagcacccgggcguccagcgucccgaucauccccagcgugggccucgaggagaccugccugcagaugcccggcaucuccgaggucaagagcaucaaguggugcaagaacuccuacagcgccgacguggugaacguguccauccccgucagcgacugccugaucgccgagcagcaggaggugaagauccuccuggagaccgugcaggagcagauccgcauccugacggacgcccggcgcuccgaggacuacgagcucgcgagcgucgagaccgaggacuccgccagcgagaacaccgccuuccugccgcugucccccaccgccaagagcgagcgggaggcccaguucgugcuccgcaacgagauccagcgggacuccgcgcugacgaaguga

SEQ ID NO: 33799 - RNA, 348 nt, Artificial Sequence
  derived and/or modified sequence opt1 from NRG4__Homo_sapiens__NP_612640
augcccaccgaccacgaggagccgugcggccccagccacaaguccuucugccugaacgggggccucugcuacgugauccccaccauccccagcccguucugccgcugcgucgagaacuacacgggggcccggugcgaggagguguuccugcccggcuccagcauccagaccaaguccaaccuguucgaggccuucguggcgcucgccguccuggugacccugaucaucggggccuucuacuuccucugccgcaagggccacuuccagcgggccagcuccgugcaguacgacaucaaccuggucgagaccagcuccacgagcgcccaccacucccacgagcagcacuga

SEQ ID NO: 33800 - RNA, 237 nt, Artificial Sequence
  derived and/or modified sequence opt1 from NRGN__Homo_sapiens__NP_001119653
auggacugcugcaccgagaacgccugcagcaagcccgacgacgacauccuggacaucccgcucgacgaccccggcgccaacgcggccgccgccaagauccaggccuccuuccgcgggcacauggcgcggaagaagaucaagagcggcgagcgcgggcggaagggccccgggcccggcggccccgggggcgccgggguggcccgcggcggggccggcggcgggccguccggcgacuga

SEQ ID NO: 33801 - RNA, 3477 nt, Artificial Sequence
  derived and/or modified sequence opt1 from NRIP1__Homo_sapiens__XP_005261122
augacccacggcgaggagcuggggagcgacgugcaccaggacuccaucguccucaccuaccuggagggccugcucaugcaccaggccgccgggggcagcgggacggcgguggacaagaaguccgccggccacaacgaggaggaccagaacuucaacaucagcggcuccgccuucccgaccugccagagcaacgggcccgugcugaacacccacaccuaccagggcuccgggaugcugcaccucaagaaggcccgccugcugcagagcuccgaggacuggaacgccgcgaagcggaagcgccucagcgacuccaucaugaaccugaacgucaagaaggaggcccugcucgccggcaugguggacagcgugcccaaggggaagcaggacuccacgcugcuggccagccuccugcaguccuucagcucccggcugcagaccgucgcgcucagccagcagauccgccagucccugaaggagcagggcuacgcccugagccacgacagccucaagguggagaaggaccugcggugcuacggcguggccuccagccaccugaagacccuccugaagaaguccaaggucaaggaccagaagcccgacaccaaccugcccgacgugacgaagaaccucauccgcgaccgguucgccgagagcccgcaccacguggggcaguccggcaccaaggucaugagcgagccccuguccugcgccgcgcgccugcaggccguggccagcaugguggagaagcgggccucccccgccaccagccccaagccguccgucgcgugcagccagcucgcccugcugcucuccagcgaggcccaccuccagcaguacucccgcgagcacgcccugaagacccagaacgccaaccaggcggccagcgagcggcuggccgccauggcccgccugcaggagaacgggcagaaggacgugggcuccuaccagcugcccaagggcaugagcucccaccucaacgggcaggcgcggacgagcagcuccaagcugauggccagcaaguccagcgccaccguguuccagaaccccaugggcaucauccccuccagcccgaagaacgccggguacaagaacucccuggagcgcaacaacaucaagcaggcggccaacaacagccuccugcugcaccuccugaagucccagaccauccccaagcccaugaacggccacagccacuccgagcgggggagcaucuucgaggaguccagcacccccacgaccaucgacgaguacuccgacaacaacccgagcuucaccgacgacuccagcggcgacgagagcuccuacagcaacugcguccccaucgaccuguccugcaagcaccgcaccgagaaguccgaguccgaccagcccgugagccucgacaacuucacgcagucccugcugaacaccugggaccccaaggugccggacgucgacaucaaggaggaccaggacaccagcaagaacuccaagcugaacagccaccagaaggugacccuccugcagcugcuccugggccacaagaacgaggagaacguggagaagaacacgagcccccaggggguccacaacgacgugagcaaguucaacacccagaacuacgcccggaccuccgucaucgagagccccuccaccaaccgcacgacccccgugagcaccccgccccugcucaccuccagcaaggccggcucccccaucaaccugagccagcacagccuggugaucaaguggaacuccccgcccuacgucugcagcacgcaguccgagaagcucaccaacaccgccagcaaccacuccauggaccugaccaagagcaaggacccgcccggggagaagcccgcgcagaacgagggcgcccagaacuccgccacguucagcgccuccaagcugcuccagaaccuggcccagugcgggaugcagagcuccaugagcguggaggagcagcggcccuccaagcagcugcucaccggcaacaccgacaagcccaucggcaugaucgaccgccugaacagcccccugcucuccaacaagaccaacgcgguggaggagaacaaggccuucagcucccagccgaccgggcccgagcccggccugagcggguccgagaucgagaaccugcucgagcggcgcacgguccugcagcugcuccugggcaaccccaacaaggggaaguccgagaagaaggagaagaccccgcugcgcgacgagagcacccaggagcacuccgagcgggcccucagcgagcagauccugauggugaagaucaaguccgagcccugcgacgaccugcagauccccaacaccaacgugcaccucagccacgacgccaaguccgcccccuuccugggcauggcgccggccguccagcgcagcgcccccgcccugcccguguccgaggacuucaagagcgagcccguguccccgcaggacuucagcuucuccaagaacggccuccugagccggcugcuccgccagaaccaggacuccuaccuggcggacgacagcgaccggucccaccgcaacaacgagauggcccugcucgagagcaagaaccugugcaugguccccaagaagcggaagcuguacacggagccccucgagaaccccuucaagaagaugaagaacaacaucguggacgccgccaacaaccacuccgccccggaggugcuguacgggagccugcucaaccaggaggagcugaaguucucccgcaacgaccuggaguucaaguaccccgcgggccacgggagcgccagcgaguccgagcaccggagcugggcccgcgaguccaagagcuucaacguccucaagcagcugcugcucuccgagaacugcgugcgggaccugagcccccaccgcuccaacagcguggccgacuccaagaagaagggccacaagaacaacgucaccaacagcaagcccgaguucuccaucagcucccugaacggccucauguacagcuccacccagccgagcuccugcauggacaaccggaccuucagcuaccccgggguggugaagacgcccgucuccccgaccuuccccgagcaccugggcugcgccgggagccgccccgagagcggccugcucaacgggugcuccaugcccagcgagaagggcccgaucaagugggugaucaccgacgcggagaagaacgaguacgagaaggacagcccccggcugaccaagacgaaccccauccuguacuacaugcuccagaagggcgggaacagcgugaccucccgcgagacccaggacaaggacaucuggcgggaggccagcuccgccgagagcgucucccaggugaccgccaaggaggagcugcugcccacggccgagaccaaggcgagcuucuucaaccuccgcuccccguacaacagccacaugggcaacaacgccucccggccccacagcgccaacggggagguguacggccugcugggguccguccucaccaucaagaaggagagcgaguga

SEQ ID NO: 33802 - RNA, 846 nt, Artificial Sequence
  derived and/or modified sequence opt1 from NRIP2__Homo_sapiens__NP_113662
augcuguucaucuucccccucagccugccguggcgccccuccugcuggaaggagagcugcuccaccggccagcggcaggccgggcgcagccgggaggacuccgugaccccgccgcccagcucccccuggcccacgccgcccgccggcgcgaugagcaccaagcaggaggcccgccgggacgagggggaggcccgcacccggggccaggaggcccagcugcgcgaccgggcccaccucucccagcagcgccggcugaagcaggcgacccaguuccugcacaaggacagcgccgaccuccugccccuggacucccucaagcgccuggggacgagcaaggaccugcagccccgguccgucauccagcgccggcucguggagggcaaccccaacuggcugcagggcgagccgccccgcaugcaggaccugauccacgggcaggagagccggcgcaagaccucccggaccgagauccccgcccuccuggugaacugcaagugccaggaccagcugcuccgcgucgccguggacaccggcacgcaguacaaccggaucagcgcggggugccugucccgccugggccucgagaagcgcgugcugaaggccagcgccggggaccuggcccccggcccgcccacccaggucgagcagcucgagcugcagcugggccaggagaccguggugugcuccgcccaggucguggacgcggagagccccgaguucugccucgggcugcagacccugcucagccugaagugcugcaucgaccuggagcacggcgugcuccggcugaaggcccccuucuccgagcugcccuuccucccccuguaccaggagcccgggcaguga

SEQ ID NO: 33803 - RNA, 4749 nt, Artificial Sequence
  derived and/or modified sequence opt1 from NRK__Homo_sapiens__NP_940867
auggccggccccgggggcuggcgcgaccgggaggugaccgaccuggggcaccucccggaccccaccggcaucuucagccuggacaagacgaucgggcugggcaccuacggccgcaucuaccucgggcugcacgagaagaccggcgccuucaccgcggucaaggugaugaacgcccggaagacgccccugcccgagaucgggcgccgggugcgcgucaacaaguaccagaaguccgugggcuggcgguacagcgacgaggaggaggaccuccgcaccgagcugaaccugcuccggaaguacuccuuccacaagaacaucgugagcuucuacggggccuucuucaagcuguccccgcccggccagcgccaccagcuguggauggucauggagcucugcgccgccggcagcgugaccgacgugguccggaugaccuccaaccagagccugaaggaggacuggaucgcguacaucugccgcgagauccugcaggggcucgcccaccugcacgcccaccgggugauccaccgcgacaucaagggccagaacgugcugcucacgcacaacgccgaggucaagcugguggacuucgggguguccgcgcaggucagccggaccaacggccgccggaacuccuucaucggcacccccuacuggauggcccccgaggugaucgacugcgacgaggacccgcgccggagcuacgacuaccgcuccgacguguggagcgucgggaucaccgccaucgagauggccgagggcgcccccccccugugcaaccuccagccccuggaggcgcuguucgugauccuccgggaguccgccccgacggugaagagcuccggguggagccgcaaguuccacaacuucauggagaagugcaccaucaagaacuuccuguuccgccccaccuccgccaacaugcugcagcaccccuucguccgggacaucaagaacgagcgccacgugguggagagccucacccggcaccugacgggcaucaucaagaagcgccagaagaaggggaucccccugaucuucgagcgggaggaggccaucaaggagcaguacaccguccgccgguuccgcggcccgagcugcacccacgagcuccugcggcugcccaccuccagccgcugccggccccuccgcgugcugcacggcgagcccucccagccgcgguggcugcccgaccgcgaggagccccagguccaggcccuccagcagcugcagggggcggcccggguguucaugccccugcaggcccucgacagcgccccgaagccccugaagggccaggcccaggcgccccagcgccugcagggggccgcccggguguucaugccccuccaggcccaggucaaggccaaggcguccaagccgcugcagaugcagaucaaggcccccccccgccugcggcgcgccgcccgcgugcucaugccgcugcaggcgcaggugcgggccccccgccugcuccagguccagagccagguguccaagaagcagcaggcccagacgcagaccagcgagccccaggaccuggaccaggugcccgaggaguuccagggccaggaccaggucccggagcagcagcggcaggggcaggcccccgagcagcagcagcgccacaaccaggugcccgagcaggagcuggagcagaaccaggcccccgagcagccggaggugcaggagcaggcggccgagcccgcccaggccgagaccgaggccgaggagcccgagucccugcgggucaacgcgcagguguuccucccccugcugagccaggaccaccacgugcuccugccgcugcaccucgacacccagguccugauccccguggagggccagacggagggcuccccccaggcccaggccuggacccuggagcccccgcaggccaucgggagcgugcaggcccucaucgagggccugucccgcgaccugcuccgggcgcccaacagcaacaacuccaagccccuggggccccugcagacccucauggagaaccugagcuccaaccgcuucuacagccagccggagcaggcccgggagaagaaguccaaggucagcacccugcgccaggcccucgccaagcggcugagccccaagcgcuuccgggcgaaguccagcuggcgccccgagaagcuggagcucuccgaccuggaggcccggcgccagcggcgccagcggcgcugggaggacaucuucaaccagcacgaggaggagcugcggcagguggacaaggacaaggaggacgagagcuccgacaacgacgagguguuccacagcauccaggccgagguccagaucgagccccucaagccguacaucuccaaccccaagaagaucgaggugcaggagcgcagccccuccgugccgaacaaccaggaccacgcccaccacgucaaguucagcuccagcgugccccagcgcucccugcuggagcaggcccagaagcccaucgacauccggcagcgcagcucccagaaccggcagaacuggcucgcggccagcgaguccagcagcgaggaggagucccccgugacgggccgccggagccaguccagcccgcccuacuccaccaucgaccagaagcugcuggucgacauccacgugcccgacggguucaaggugggcaagaucagccccccggucuaccucaccaacgagugggugggcuacaacgcccuguccgagaucuuccgcaacgacuggcugacccccgcccccgugauccagcccccggaggaggacggggacuacgucgagcucuacgacgccagcgcggacacggacggcgacgacgacgacgaguccaacgacaccuucgaggacaccuacgaccacgccaacgggaacgacgaccuggacaaccagguggaccaggccaacgacgugugcaaggaccacgacgacgacaacaacaaguucgucgacgacgugaacaacaacuacuacgaggcccccagcugcccccgggccuccuacggccgcgacggcagcugcaagcaggacggguacgacggcucccgggggaaggaggaggcguaccgcggcuacgggagccacaccgccaaccggucccacggcggcagcgccgccuccgaggacaacgcggccaucggggaccaggaggagcacgccgccaacaucggcagcgagcgccggggguccgagggcgacgggggcaagggcgugguccgcacgagcgaggagagcggggcccugggccucaacggggaggagaacugcuccgagaccgacggccccgggcugaagcggccggcgagccaggacuucgaguaccugcaggaggagcccggcggcgggaacgaggccuccaacgccaucgacagcggcgccgcccccuccgcgcccgaccacgagagcgacaacaaggacaucuccgagagcuccacccagagcgacuucuccgccaaccacagcuccccgagcaagggguccggcaugagcgccgacgccaacuucgccuccgcgauccucuacgccggguucguggaggugcccgaggagagccccaagcagcccuccgaggucaacgugaacccgcuguacgugagccccgccugcaagaagccccugauccacauguacgagaaggaguucaccagcgagaucugcugcggcucccucuggggcgucaaccugcugcucgggacccgcagcaaccuguaccugauggaccgguccggcaaggccgacaucacgaagcucauccgccggcgccccuuccgccagauccaggugcuggagccgcugaaccuccugaucaccaucagcgggcacaagaaccggcugcgcguguaccaccucaccuggcugcggaacaagauccugaacaacgaccccgaguccaagcgccggcaggaggagaugcucaagaccgaggaggccugcaaggcgaucgacaagcugacgggcugcgagcacuucagcguccugcagcacgaggagaccaccuacaucgccaucgcccucaaguccagcauccaccuguacgccugggcgcccaaguccuucgacgagagcaccgccaucaaggugugcaucgaccaguccgccgacagcgagggcgacuacauguccuaccaggccuacauccgcauccuggccaagauccaggcggccgacccggugaaccgguucaagcgccccgacgagcuccugcaccugcucaagcugaaggucuuccccacgcuggaccacaagcccgugaccgucgaccucgccaucgggagcgagaagcggcugaagaucuucuucuccagcgccgacggcuaccaccugaucgacgccgaguccgaggugaugagcgacgugacccucccgaagaacccccuggagaucaucaucccccagaacaucaucauccugcccgacugccucgggaucggcaugaugcugaccuucaacgcggaggcccuguccgucgaggccaacgagcagcucuucaagaagauccuggagauguggaaggacaucccgagcagcaucgccuucgagugcacgcagcgcaccaccggguggggccagaaggccaucgaggugcggucccugcagagccgcgugcucgaguccgagcugaagcggcgcagcaucaagaagcugcgguuccucugcacccgcggcgacaagcuguucuucacguccacccugcggaaccaccacagccgcgucuacuucaugacccucgggaagcuggaggagcugcaguccaacuacgacguguga

SEQ ID NO: 33804 - RNA, 813 nt, Artificial Sequence
  derived and/or modified sequence opt1 from NRL__Homo_sapiens__XP_011535103
augggcaaccuggccgaggccgagagccgccgggcgccccucgccgccccgcgcgggcgggcccagcgcaaggugcacuccagccagcccuccagccggauggcccugccgcccagcccccuggcgauggaguacgucaacgacuucgaccucaugaaguucgaggugaagcgcgagcccuccgagggccggcccgggcccccgaccgccucccugggcagcacccccuacuccagcgugccgcccucccccacguucagcgagcccgggauggucggcgccaccgagggcacccgccccgggcuggaggagcucuacuggcuggccacccugcagcagcagcucggcgcgggggaggcccugggccugucccccgaggaggccauggagcuccugcaggggcagggcccggugcccguggacggcccccacggguacuaccccggcagcccggaggagacgggggcccagcacguccagcuggccgagcgguucuccgacgcggcccucgugagcauguccgugcgcgagcugaaccggcagcugcgcggcugcggccgggacgaggcccuccgccugaagcagcggcgccggacccugaagaaccgcggguacgcccaggccugccggagcaagcgccuccagcagcggcgcggccuggaggcggagcgcgcccggcuggccgcccagcucgacgcccugcgcgcggaggucgcccggcuggcccgcgagcgggaccucuacaaggcccgcugcgaccggcugaccuccagcgggcccggcagcggggaccccucccaccuguuccucuga

SEQ ID NO: 33805 - RNA, 612 nt, Artificial Sequence
  derived and/or modified sequence opt1 from NRM__Homo_sapiens__NP_001257638
auggcccccgcccugcuccugaucccggcggcccuggccagcuucauccucgccuucggcaccgggguggaguucguccgcuucaccucccugcggccccugcucggcgggauccccgagagcggcgggcccgacgcccgccagggcuggcuggcggcccugcaggaccgguccauccucgccccgcuggccugggaccugggccuccugcugcuguucguggggcagcacagccugauggcggccgagcgcgugaaggccuggacgucccgguacuucggcguccugcagcgcagccucuacguggccugcaccgcccuggcgcuccagguguacuaccacguccucgggcugggcgagccccuggcccucaagagcccccgggcccugcgccuguucucccaccuccggcaccccgugugcguggagcugcugaccguccucuggguggugccgacccuggggacggaccgccugcuccuggccuuccugcucacccuguaccugggccucgcccacggccuggaccagcaggaccugcgguaccuccgcgcgcagcugcagcggaagcugcaccuccugucccgcccccaggacggggaggccgaguga

SEQ ID NO: 33806 - RNA, 429 nt, Artificial Sequence
  derived and/or modified sequence opt1 from NRN1__Homo_sapiens__NP_001265639
augggccugaagcucaacgggcgcuacaucagccugauccuggccgugcagaucgccuaccucguccaggcggugcgggccgccggcaagugcgacgccguguucaagggguucuccgacugccugcugaagcucggcgacagcauggccaacuacccccaggggcuggacgacaagaccaacaucaagaccgucugcacguacugggaggacuuccacuccugcaccgugaccgcgcugaccgacugccaggagggcgccaaggacaugugggacaagcuccgcaaggagagcaagaaccugaacauccagggcucccuguucgagcucugcgggagcggcaacggggccgccggcucccugcugccggcguuccccgugcuccuggucagccuguccgccgcccucgccacguggcugagcuucuga

SEQ ID NO: 33807 - RNA, 1935 nt, Artificial Sequence
  derived and/or modified sequence opt1 from NRP1__Homo_sapiens__NP_001019799
auggagcgcggccugccccuccugugcgccgugcuggcccucguccuggcgccggccggggccuuccggaacgacaagugcggcgacaccaucaagaucgagagccccggguaccugaccucccccggcuacccccacagcuaccacccguccgagaagugcgaguggcucauccaggcccccgaccccuaccagcgcaucaugaucaacuucaacccccacuucgaccuggaggaccgggacugcaaguacgacuacguggagguguucgacggggagaacgagaacggccacuuccgcggcaaguucugcgggaagaucgccccgccgcccgucgugagcuccggccccuuccuguucaucaaguucgugagcgacuacgagacgcacggggcgggcuucuccauccgguacgagaucuucaagcgcgggccggagugcagccagaacuacaccacccccuccggcgucaucaagagccccggcuuccccgagaaguacccgaacucccucgagugcaccuacaucguguucgcccccaagaugagcgagaucauccuggaguucgaguccuucgaccuggagcccgacagcaacccgcccgggggcauguucugccgguacgaccgccucgagaucugggacggguuccccgacgugggcccccacaucggccgguacugcgggcagaagacgcccggccgcauccgguccagcuccgggauccugagcauggucuucuacaccgacuccgccaucgccaaggagggcuucagcgcgaacuacagcgugcugcaguccagcguguccgaggacuucaagugcauggaggcccucgggauggagagcggcgagauccacuccgaccagaucaccgccagcucccaguacagcaccaacugguccgccgagcgcagccggcugaacuaccccgagaacggcuggacgcccggggaggacuccuaccgcgaguggauccaggucgaccugggccuccugcgguucgugaccgccguggggacccagggcgcgaucagcaaggagaccaagaagaaguacuacgucaagacguacaagaucgacguguccagcaacggggaggacuggaucaccaucaaggagggcaacaagcccgugcuguuccagggcaacaccaaccccaccgacgucgugguggccgucuucccgaagccccucaucacgcgcuucgugcggaucaagcccgccaccugggagaccgggaucuccaugcgcuucgagguguacggcugcaagaucaccgacuacccgugcagcgggaugcugggcauggucuccgggcugaucagcgacucccagaucacgagcagcaaccagggcgaccggaacuggaugcccgagaacauccgccucgugaccucccggagcggcugggcccugccgcccgcgccccacuccuacaucaacgaguggcugcagaucgaccucggggaggagaagaucguccgcggcaucaucauccagggcgggaagcaccgcgagaacaagguguucaugcggaaguucaagaucggcuacagcaacaacggguccgacuggaagaugaucauggacgacagcaagcgcaaggccaaguccuucgagggcaacaacaacuacgacacccccgagcugcggaccuuccccgcccugagcacgcgcuucauccggaucuaccccgagcgcgccacccacgggggccucgggcugcggauggagcugcucggcugcgagguggaggccccgaccgccggccccaccacgcccaacgggaaccuggucgacgagugcgacgacgaccaggcgaacugccacuccggcaccggggacgacuuccagcugaccggcgggaccacggugcucgccaccgagaagcccaccgugaucgacagcaccauccaguccggcaucaaguga

SEQ ID NO: 33808 - RNA, 2781 nt, Artificial Sequence
  derived and/or modified sequence opt1 from NRP2__Homo_sapiens__NP_003863
auggacauguucccccugaccuggguguuccucgcccuguacuucagccgccaccagguccggggccagccggacccgcccugcgggggccgccugaacuccaaggacgccggguacaucaccagccccggcuacccccaggacuaccccucccaccagaacugcgaguggaucguguacgcgcccgagcccaaccagaagaucgugcucaacuucaacccgcacuucgagaucgagaagcacgacugcaaguacgacuucaucgagauccgggacggggacagcgaguccgccgaccugcugggcaagcacugcggcaacaucgccccgcccacgaucaucagcuccgggagcaugcucuacaucaaguucaccuccgacuacgcccgccagggcgccggguucagccugcgguacgagaucuucaagaccggcuccgaggacugcagcaagaacuucaccucccccaacgggacgaucgagagccccggcuuccccgagaaguacccccacaaccuggacugcaccuucaccauccucgcgaagcccaagauggagaucauccugcaguuccugaucuucgaccucgagcacgacccgcugcaggucggcgagggggacugcaaguacgacuggcuggacaucugggacggcaucccccacguggggccccucaucggcaaguacugcggcaccaagacgcccuccgagcugcgcagcuccaccgggauccugagccucaccuuccacaccgacauggccguggccaaggacggcuucuccgcccgguacuaccugguccaccaggagccgcuggagaacuuccagugcaacgugccccucgggauggagagcggccgcaucgcgaacgagcagaucagcgccuccagcacguacuccgacgggcgguggacgccccagcagagccgccugcacggcgacgacaacggcuggacccccaaccuggacuccaacaaggaguaccuccagguggaccugcgguuccugaccaugcucaccgccaucgccacccagggggccaucagccgcgagacccagaacggcuacuacgucaaguccuacaagcuggaggugagcaccaacggggaggacuggaugguguaccggcacggcaagaaccacaaggucuuccaggcgaacaacgacgccacggagguggugcugaacaagcuccacgccccgcugcugacccgcuucguccggauccgcccccagaccuggcacuccgggaucgcccuccggcuggagcuguucggcugccgcgugaccgacgcccccugcagcaacaugcucggcaugcuguccgggcugaucgcggacagccagaucuccgccagcuccacgcaggaguaccucuggagccccuccgccgcccggcuggugagcucccgcagcggcugguucccgcggaucccccaggcccagcccggggaggaguggcugcaggucgaccucggcaccccgaagaccgugaagggggugaucauccagggcgcgcgcggcggggacagcaucaccgccgucgaggcccgcgccuucgugcggaaguucaagguguccuacagccugaacggcaaggacugggaguacauccaggacccccgcacgcagcagcccaagcuguucgaggggaacaugcacuacgacacccccgacauccggcgcuucgacccgauccccgcccaguacguccggguguaccccgagcgcuggucccccgcgggcaucggcaugcggcucgagguccuggggugcgacuggaccgacagcaagccgaccguggagacgcugggccccaccgugaaguccgaggagaccaccacgcccuaccccaccgaggaggaggccaccgagugcggggagaacugcagcuucgaggacgacaaggaccuccagcugccguccggcuucaacugcaacuucgacuuccuggaggagcccugcggguggauguacgaccacgccaaguggcugcgcaccaccugggccagcuccagcucccccaacgaccggacguuccccgacgaccgcaacuuccuccggcugcagagcgacucccagcgcgagggccaguacgcgcggcugaucagcccgcccguccaccucccccgcucccccgugugcauggaguuccaguaccaggccaccggcgggcggggcguggcccugcaggucgugcgcgaggccagccaggaguccaagcugcucugggugauccgggaggaccagggcggggaguggaagcacgggcgcaucauccugccgagcuacgacauggaguaccagaucgucuucgagggcgugaucggcaaggggcggagcggcgagaucgccaucgacgacauccgcaucuccaccgacgugccccuggagaacugcauggagcccaucagcgcguucgccgucgacauccccgagauccacgagcgcgagggguacgaggacgagaucgacgacgaguacgagguggacugguccaacagcuccagcgccaccuccggcagcggggccccguccacggacaaggagaaguccuggcucuacacccuggaccccauccugaucaccaucaucgccaugagcagccucggcgugcugcugggcgcgaccugcgccgggcuccugcuguacugcacgugcuccuacagcggccucuccagccgguccugcaccacccuggagaacuacaacuucgagcuguacgacgggcucaagcacaaggucaagaugaaccaccagaagugcugcagcgaggccuga

SEQ ID NO: 33809 - RNA, 588 nt, Artificial Sequence
  derived and/or modified sequence opt1 from NRSN1__Homo_sapiens__NP_542454
augagcuccugcagcaacgugugcggcucccgccaggcccaggccgcggccgagggcggguaccagcgguacgggguccgcagcuaccugcaccaguucuacgaggacugcaccgccuccaucugggaguacgaggacgacuuccagauccagcggagccccaaccgcugguccagcguguucuggaaggugggccucaucuccgggaccgucuucgugauccugggccugacggugcucgccgucggcuuccuggugccgcccaagaucgaggccuucggggaggcggacuucguggucguggacacccacgccgugcaguucaacagcgcccuggacauguacaagcucgccggcgcgguccuguucugcaucgggggcaccuccauggccgggugccugcucaugagcguguucgugaaguccuacagcaaggaggagaaguuccugcagcagaaguucaaggagcggaucgccgacaucaaggcccacacccagcccgucacgaaggcccccggcccgggcgagaccaagauccccgugacccugucccgcgugcagaacguccagccccuccuggcgaccuga

SEQ ID NO: 33810 - RNA, 615 nt, Artificial Sequence
  derived and/or modified sequence opt1 from NRSN2__Homo_sapiens__NP_079234
augaugcccagcugcaaccgcuccugcagcugcucccggggcccgagcguggaggacgggaagugguacggcguccgcuccuaccugcaccucuucuacgaggacugcgccgggaccgcccugagcgacgaccccgagggcccgcccgugcugugcccccggcgccccuggcccucccucugcuggaagaucagccuguccagcgggacccugcuccugcugcucggcguggcggcccugacgaccggcuacgccgugcccccgaagcuggaggggaucggcgagggggaguuccucguccuggaccagcgggccgccgacuacaaccaggcgcuggggaccugccgccucgccggcaccgcccugugcguggccgcgggcguccugcucgccaucugccuguucugggccaugaucggcuggcugucccaggacacgaaggccgagccccucgaccccgaggccgacagccacguggagguguucggggacgagcccgagcagcagcuguccccgaucuuccggaacgcgagcggccaguccugguucagcccgcccgccucccccuucgggcagagcuccguccagaccauccagcccaagcgcgacagcuga

SEQ ID NO: 33811 - RNA, 594 nt, Artificial Sequence
  derived and/or modified sequence opt1 from NRTN__Homo_sapiens__XP_011526343
augcagcgcuggaaggccgccgcgcuggccagcgugcucugcuccagcguccuguccaucuggaugugccgggagggccugcuccugagccaccgccuggggcccgcccucgugccgcugcaccggcugccccgcacccucgacgcccggaucgcccgccuggcgcaguaccgggcccugcuccagggcgcccccgacgccauggagcugcgcgagcugacccccugggcggggcggccgcccggcccccgccggcgcgccgggccccggcgccggcgcgcccgggcccgccucggcgcccggccgugcggccugcgcgagcuggaggugcgggucuccgagcucgggcugggcuacgcgagcgacgagacggugcuguuccgcuacugcgccggggccugcgaggccgccgcgcgcguguacgaccucggccugcggcgccugcggcagcgccggcgccuccggcgcgagcggguccgcgcccagcccugcugccggcccaccgccuacgaggacgagguguccuuccuggacgcccacagccgcuaccacaccgugcacgagcuguccgcccgggagugcgcgugcgucuga

SEQ ID NO: 33812 - RNA, 4644 nt, Artificial Sequence
  derived and/or modified sequence opt1 from NRXN1__Homo_sapiens__NP_001129131
augggcaccgcccugcuccagcgcgggggcugcuuccugcugugccucagccugcugcuccuggggugcugggccgagcugggcuccgggcucgaguuccccggcgcggagggccaguggacccgguucccgaaguggaacgccugcugcgagagcgagauguccuuccagcugaagacgcgcagcgcccgggggcuggugcucuacuucgacgacgagggcuucugcgacuuccuggagcugauccucacccgcgggggccggcugcagcuguccuucagcaucuucugcgccgagcccgccacccuccuggcggacacccccgucaacgacggggccuggcacuccgugcgcauccggcgccaguuccggaacacgacccuguucaucgaccagguggaggccaagugggucgaggucaagagcaagcgccgggacaugaccguguucuccggccucuucgugggcgggcugcccccggagcugcgcgccgcggcccucaagcugacccuggccagcgugcgggagcgcgagcccuucaagggcuggauccgggacgugcgcgucaacuccagccaggugcuccccguggacuccggggaggucaagcuggacgacgagcccccgaacagcggcggcgggucccccugcgaggccggcgaggagggggagggcggggugugccugaacggcggcgugugcagcgucguggacgaccaggccgugugcgacugcucccggacgggguuccgcggcaaggacugcagccaggagaucaaguucgggcuccagugcguccugcccgugcugcuccacgacaacgaccagggcaaguacugcugcaucaacaccgcgaagccccugaccgagaaggacaacaacguggaggggcuggcccaccucaugaugggcgaccagggcaaguccaaggggaaggaggaguacaucgccaccuucaagggcagcgaguacuucugcuacgaccugagccagaacccgauccaguccagcuccgacgagaucacgcugagcuucaagacccuccagcggaacgggcugaugcugcacaccggcaaguccgccgacuacgucaaccucgcccugaagaacggggcggugagccuggugaucaaccucggcuccggcgccuucgaggcccuggucgagcccgugaacgggaaguucaacgacaacgccuggcacgacgucaaggugacccgcaaccugcggcagcacagcggcaucgggcacgccauggugaacaagcuccacugcuccgucacgaucagcguggacggcauccugaccaccaccggcuacacgcaggaggacuacaccaugcugggguccgacgacuucuucuacgugggcgggagccccuccaccgcggaccugcccggcagcccggucuccaacaacuucauggggugccucaaggaggugguguacaagaacaacgacguccgccuggagcugagccgccucgccaagcagggcgaccccaagaugaagauccacggcgugguggccuucaagugcgagaacgucgccacccuggaccccaucacguucgagacccccgaguccuucaucagccugccgaaguggaacgccaagaagaccggguccaucagcuucgacuuccggaccacggagcccaacggccucauccuguucagccacgggaagccccgccaccagaaggacgcgaagcacccccagaugaucaagguggacuucuucgccaucgagaugcuggacggccaccucuaccugcugcucgacaugggguccggcaccaucaagaucaaggcccugcugaagaaggugaacgacggcgagugguaccacgucgacuuccagcgggacgggcgcagcggcaccaucuccgugaacacccuccggacgccguacaccgcccccggggagagcgagauccuggaccuggacgacgagcucuaccugggcgggcugcccgagaacaaggcgggccucguguuccccaccgaggucuggaccgcccugcugaacuacggcuacguggggugcauccgcgaccucuucaucgacggccaguccaaggacauccggcagauggccgaggugcagagcacggccggggucaagccguccugcagcaaggagaccgccaagcccugccuguccaaccccugcaagaacaacggcaugugccgcgacggguggaaccgguacgugugcgacugcagcggcaccggcuaccuggggcgcuccugcgagcgggaggcgaccgugcucagcuacgacggcuccauguucaugaagauccagcugccggucgugaugcacaccgaggccgaggacgugagccugcgcuuccggucccagcgcgccuacgggauccucauggccacgaccagccgggacuccgccgacacccugcgccuggagcucgacgcgggccgggucaagcugaccgugaaccuggacugcauccgcaucaacugcaacagcagcaagggccccgagacccucuucgccggguacaaccugaacgacaacgaguggcacaccgugcgggucgugcgccgcggcaagucccugaagcucaccguggacgaccagcaggccaugaccgggcagauggccggcgaccacacgcggcuggaguuccacaacaucgagaccgggaucaucaccgagcgccgguaccugagcuccguccccagcaacuucaucggccaccuccagucccugaccuucaacggcauggccuacaucgaccugugcaagaacggggacaucgacuacugcgagcucaacgcgcgcuucggcuuccggaacaucaucgccgaccccgugacguucaagaccaagagcuccuacguggcccuggccacccugcaggcguacaccagcaugcaccucuucuuccaguucaagacgaccucccuggacgggcugauccucuacaacagcggcgacgggaacgacuucaucgucguggagcuggugaagggcuaccugcacuacgucuucgaccucggcaacggggccaaccugaucaagggcuccagcaacaagccgcugaacgacaaccaguggcacaacgugaugaucucccgcgacaccagcaaccuccacaccgugaagaucgacacgaagaucaccacccagaucaccgccggggcccggaaccuggaccugaaguccgaccucuacaucggcggggucgccaaggagacguacaagagccugcccaagcuggugcacgcgaaggagggcuuccagggcugccucgccuccguggaccugaacgggcgccugcccgaccucaucagcgacgcccuguucugcaacggccagaucgagcgggggugcgagggccccuccacgaccugccaggaggacagcugcagcaaccagggcgucugccugcagcagugggacggguucuccugcgacugcagcaugaccuccuucagcggcccgcucugcaacgaccccgggacgaccuacaucuucuccaagggcgggggccagaucaccuacaaguggccgcccaacgaccgccccagcacccgggccgaccgccuggccaucggcuucuccacggugcagaaggaggcggugcugguccggguggacagcuccagcgggcucggcgacuaccuggagcugcacauccaccaggggaagaucggcgugaaguucaacgucgggaccgacgacaucgccaucgaggaguccaacgccaucaucaacgacggcaaguaccacgugguccgcuucacccggagcggcgggaacgccacccuccagguggacuccuggcccgugaucgagcgcuaccccgccggcaacaacgacaacgagcggcuggcgaucgcccgccagcggauccccuaccgccuggggcgggucguggacgaguggcuccuggacaagggccgccagcugacgaucuucaacagccaggccaccaucaucaucgggggcaaggagcagggccagccguuccaggggcagcucuccggccuguacuacaacgggcugaaggugcucaacauggccgcggagaacgacgccaacaucgccaucgucggcaacgugcgccuggugggggagguccccagcuccaugaccaccgagagcaccgccacggccaugcaguccgagaugagcaccagcaucauggagaccaccacgacccuggcgaccuccaccgcccggcgcggcaagccgcccacgaaggagcccaucagccagaccaccgacgacauccucguggccuccgccgagugccccagcgacgacgaggacaucgaccccugcgagcccuccagcggcgggcuggccaacccgacccgggcgggcgggcgcgagcccuaccccggcuccgccgaggugauccgggagagcuccagcacgaccggcauggucguggggaucguggccgccgccgcgcugugcauccucauccugcuguacgccauguacaaguaccgcaaccgggacgagggcuccuaccacgucgacgagagccgcaacuacaucuccaacagcgcccaguccaacggggccguggugaaggagaagcagccgagcuccgccaagagcuccaacaagaacaagaagaacaaggacaaggaguacuacgucuga

SEQ ID NO: 33813 - RNA, 5139 nt, Artificial Sequence
  derived and/or modified sequence opt1 from NRXN2__Homo_sapiens__NP_055895
auggccuccggcucccgcuggcgccccacgcccccgccccugcuccugcugcuccugcuggcccucgcggcccgcgccgacgggcuggaguucggcgggggccccgggcagugggcccgguacgcccgcugggcgggcgccgccagcuccggcgagcugagcuucucccuccggaccaacgccacccgcgcgcugcugcucuaccuggacgacgggggcgacugcgacuuccuggagcuccugcugguggacgggcggcuccgccugcgguucacccugagcugcgccgagcccgccacccuccagcuggacacccccguggccgacgaccgcuggcacauggugcugcucacgcgggacgcccgccggaccgcgcuggccguggacggcgaggcccgcgccgccgaggugcgguccaagcgccgggagaugcaggucgcgagcgaccuguucgucgggggcaucccgcccgacguccgccucuccgcccugacccugagcaccgugaaguacgagccgcccuuccggggccuccuggccaaccugaagcucggggagcggccgcccgcccugcugggcucccaggggcuccggggcgccacggcggacccccugugcgcccccgcccgcaaccccugcgccaacggcgggcugugcaccgugcucgcccccggcgaggucgggugcgacugcagccacaccggcuucgggggcaaguucugcuccgaggaggagcaccccauggagggccccgcgcaccugacccugaacagcgagguggggucccuccuguucagcgagggcggggccggccgcgggggcgccggcgacgugcaccagcccacgaaggggaaggaggaguucgucgccaccuucaagggcaacgaguucuucugcuacgaccugucccacaaccccauccagagcuccaccgacgagaucacccucgcguuccggacgcugcagcgcaacgggcugaugcuccacaccggcaagagcgccgacuacgugaaccugagccugaaguccggggccguguggcuggucaucaaccucggcagcggcgccuucgaggcccugguggagcccgugaacgggaaguucaacgacaacgcguggcacgacguccgggugacccgcaaccugcggcagcacgccggcaucgggcacgccauggugaacaagcuccacuaccuggucaccaucuccguggacggcauccugacgaccaccggcuacacccaggaggacuacacgaugcucgggagcgacgacuucuucuacaucggcgggucccccaacaccgccgaccugcccggcagccccguguccaacaacuucauggggugccugaaggacgucguguacaagaacaacgacuucaagcucgagcugagccgccuggccaaggagggcgaccccaagaugaagcuccagggcgaccuguccuuccggugcgaggacgucgcggcccuggaccccgugaccuucgagagccccgaggccuucguggcccucccccgcugguccgccaagcggaccgggagcaucucccuggacuuccgcacgaccgagccgaacggccugcuccuguucagccaggggcggcgcgcgggcgggggcgccggcucccacagcuccgcccagcgggccgacuacuucgcgauggagcugcucgacgggcaccuguaccugcuccuggacaugggcagcgggggcaucaagcugcgcgccuccagccggaaggucaacgacggggaguggugccacguggacuuccagcgcgacggccggaagggcagcaucuccgugaacagccgcuccacccccuuccucgccaccggggacagcgagauccuggaccuggaguccgagcucuaccugggcgggcugcccgagggcgggcgggucgaccucccgcugccgcccgagguguggacggccgcccugcgcgcgggcuacgugggcugcguccgcgaccucuucaucgacgggcggagccgcgaccugcggggccuggccgaggcccagggggccgugggcguggcccccuucugcucccgcgagacccucaagcagugcgcgagcgccccgugccggaacggcggggucugccgcgagggcuggaaccgguucaucugcgacugcaucgggaccggcuuccuggggcgcgugugcgagcgggaggccaccgugcuguccuacgacggcagcauguacaugaagaucaugcuccccaacgccaugcacacggaggccgaggacgucucccugcgcuucaugagccagcgggcguacggccugaugauggccaccaccucccgcgagagcgccgacacccuccggcuggagcuggacgggggccagaugaagcucaccgugaaccuggacugccugcgcguggggugcgcccccuccaagggccccgagacccuguucgcggggcacaagcugaacgacaacgaguggcacaccguccggguggugcgccggggcaagagccugcagcucuccgucgacaacgugaccguggagggccagauggccggggcccacaugcgccuggaguuccacaacaucgagaccggcaucaugacggagcggcgcuucaucagcgucgugccgagcaacuucaucgggcaccuguccggccucguguucaacgggcagcccuacauggaccagugcaaggacggcgacaucaccuacugcgagcugaacgcccgguucggccugcgcgccaucgucgcggaccccgugaccuucaagagccgcuccagcuaccucgcccuggccacccugcaggccuacgccuccaugcaccucuucuuccaguucaagacgaccgcgcccgacgggcugcuccuguucaacagcggcaacgggaacgacuucaucgugaucgagcuggucaagggcuacauccacuacguguucgaccugggcaacgggccgucccucaugaagggcaacagcgacaagcccgugaacgacaaccaguggcacaacgucguggugucccgggaccccgggaacguccacacccugaagaucgacagccgcaccgugacgcagcacuccaacggcgcccggaaccuggaccucaagggggagcuguacaucggcggccugagcaagaacauguucuccaaccuccccaagcugguggccagccgcgacggguuccagggcugccuggccuccgucgaccucaacgggcggcugccggaccugaucgccgacgcgcuccaccgcaucggccagguggagcgggggugcgacggccccagcacgaccugcaccgaggaguccugcgccaaccagggcgugugccugcagcagugggacggguucacgugcgacugcaccaugaccagcuacggcgggcccgucugcaacgaccccggcaccacguacaucuucgggaagggcggcgcccugaucaccuacaccuggccgcccaacgaccgccccuccacccggauggaccgccucgccgugggguucagcacgcaccagcggagcgccgugcugguccgcguggacuccgcgagcggccugggggacuaccuccagcugcacaucgaccagggcaccgugggggucaucuucaacgugggcaccgacgacaucaccaucgacgagcccaacgccaucguguccgacggcaaguaccacgucgugcgguucacgcgcagcgggggcaacgccacccugcaggucgacuccuggccggugaacgagcgguaccccgccgggaacuucgacaacgagcgccucgcgaucgcccggcagcgcauccccuaccggcugggccgcguggucgacgaguggcugcucgacaagggccgccagcugaccaucuucaacagccaggccgccaucaagaucgggggccgggaccaggggcgcccguuccagggccagguguccgggcuguacuacaacggccugaaggugcucgcccuggcggccgagagcgaccccaacguccggaccgagggccaccuccgccucgugggggagggccccuccgugcugcugagcgccgagacgaccgccaccacccuccuggccgacauggcgacgaccaucauggagaccaccaccacgauggccaccaccaccacgcggcgcgggcggucccccacccugcgcgacagcaccacccagaacacggacgaccuccuggucgccuccgccgagugcccgagcgacgacgaggaccuggaggagugcgagcccuccaccggcggggagcucauccugcccaucaucaccgaggacagccuggacccgccgcccguggccacccggucccccuucgugcccccgccgcccacguucuaccccuuccucaccggcgucggcgcgacccaggacacccugcccccgcccgccgcccgccggccgcccagcgggggccccugccaggccgagcgcgacgacuccgacugcgaggagcccaucgaggcgagcggguucgccagcggcgagguguucgacuccagccugccgcccacggacgacgaggacuucuacaccaccuucccccucgugaccgaccggacgacccugcugagcccccgcaagcccgcgccccggcccaaccuccgcaccgacggggccaccggcgcccccggcguccuguucgccccgagcgcccccgcccccaaccugcccgccgggaagaugaaccaccgggacccgcuccagccccugcuggagaacccgccccugggcccgggggcccccacguccuucgagccccgccggcccccgccccugcgccccggcgugaccagcgcgcccggguucccgcaccuccccaccgccaaccccaccggccccggcgagcgggggccgcccggcgccguggaggucauccgcgaguccagcuccacgaccgggaugguggugggcaucgucgccgccgcggcccucugcauccugauccugcucuacgccauguacaaguaccgcaaccgggacgagggcagcuaccagguggaccagucccgcaacuacaucagcaacuccgcccagagcaacggggcgguggucaaggagaaggcccccgccgcccccaagaccccguccaaggccaagaagaacaaggacaaggaguacuacguguga

SEQ ID NO: 33814 - RNA, 1380 nt, Artificial Sequence
  derived and/or modified sequence opt1 from NRXN3__Homo_sapiens__NP_001098720
augcaccuccgcauccacgcccggcgcagcccgccccggcgccccgccuggacccugggcaucugguuccuguucugggggugcaucguguccagcgucugguccagcuccaacguggcgagcuccagcuccaccagcuccagccccggcucccacagccagcacgagcaccacuuccacggguccaagcaccacagcgugcccaucuccaucuaccggagcccggucucccugcgcggcgggcacgccggcgccacguacaucuucggcaagagcgggggccucauccuguacaccuggcccgccaacgaccggcccagcacccgcuccgaccggcuggccgugggguucagcaccacggugaaggacggcauccucguccgcaucgacuccgcgcccgggcugggcgacuuccugcagcuccacaucgagcagggcaagaucggggugguguucaacaucggcaccgucgacaucagcaucaaggaggagcggaccccggugaacgacgggaaguaccacgugguccgcuucacccggaacggcggcaacgccacgcuccagguggacaacuggcccgugaacgagcacuaccccaccgggaacaccgacaacgagcgcuuccagauggucaagcagaagauccccuucaaguacaaccggccgguggaggaguggcugcaggagaagggccgccagcugaccaucuucaacacgcaggcccagaucgccaucgggggcaaggacaaggggcggcuguuccagggccagcuguccggccucuacuacgacgggcugaaggugcugaacauggcggccgagaacaaccccaacaucaagaucaacggcagcguccgccucgugggggaggugcccuccauccugggcaccacccagaccacgagcaugcccccggagauguccaccaccgucauggagaccacgaccaccauggccaccacgaccacccggaagaaccgcagcaccgccuccauccagcccacgagcgacgaccugguguccagcgccgagugcuccagcgacgacgaggacuucguggagugcgagcccuccaccgcgaaccccaccgagccggggauccggcgcguccccggcgccagcgaggugauccgcgaguccagcagcaccacgggcauggucguggggaucguggccgccgccgcgcucugcauccugauccugcucuacgccauguacaaguaccggaaccgcgacgagggcuccuaccaggucgacgagacccggaacuacaucagcaacuccgcccagagcaacgggacccugaugaaggagaagcagcaguccagcaaguccggccacaagaagcagaagaacaaggaccgcgaguacuacguguga

SEQ ID NO: 33815 - RNA, 783 nt, Artificial Sequence
  derived and/or modified sequence opt1 from NSA2__Homo_sapiens__NP_055701
augccccagaacgaguacaucgagcugcaccgcaagcgguacggcuaccgccucgacuaccacgagaagaagcggaagaaggagagccgcgaggcccacgagcgguccaagaaggccaagaagaugaucgggcugaaggcgaagcuguaccacaagcagcgccacgccgagaagauccagaugaagaagaccaucaagaugcacgagaagcggaacaccaagcagaagaacgacgagaagacgccgcagggcgccgugcccgccuaccuccuggaccgcgaggggcagagccgggccaagguccuguccaacaugaucaagcagaagcgcaaggagaaggcgggcaagugggaggugccccuccccaaggugcgggcccagggggagaccgagguccugaaggugauccgcaccggcaagcggaagaagaaggccuggaagcgcauggugaccaaggucugcuucgugggcgacggguucacgcggaagccgcccaaguacgagcgcuucauccggcccaugggccugcgcuucaagaaggcccacgugacccaccccgagcucaaggcgaccuucugccugccgauccugggggucaagaagaaccccagcagcccccucuacaccacgcugggcgugaucaccaaggggaccgugaucgaggucaacguguccgagcugggccucgugacccagggcgggaaggucaucuggggcaaguacgcccaggugacgaacaaccccgagaacgacgggugcaucaacgccgugcugcuggucuga

SEQ ID NO: 33816 - RNA, 7284 nt, Artificial Sequence
  derived and/or modified sequence opt1 from NSD1__Homo_sapiens__XP_005266018
augccccugaagacccggaccgcccucuccgacgaccccgacuccagcaccuccacccugggcaacaugcuggagcuccccgggaccagcuccagcuccaccagccaggagcugcccuucugccagcccaagaagaaguccacgccccugaaguacgaggugggcgaccucaucugggccaaguucaagcggcgccccugguggcccugccggaucugcagcgacccccugaucaacacccacuccaagaugaaggugagcaaccgccggcccuaccgccaguacuacguggaggcguucggggaccccuccgagcgggccuggguggccggcaaggccaucgugauguucgaggggcgccaccaguucgaggagcugcccgugcuccggcgccggggcaagcagaaggagaagggcuaccgccacaaggugccccagaagauccugagcaagugggaggccuccguggggcuggcggagcaguacgacgugcccaagggcagcaagaaccggaagugcauccccggguccaucaagcucgacagcgaggaggacaugcccuucgaggacugcaccaacgaccccgaguccgagcacgaccugcugcucaacggcugccugaagucccuggccuucgacagcgagcacuccgccgacgagaaggagaagcccugcgccaagagccgcgcgcggaaguccagcgacaaccccaagcgcaccuccgugaagaaggggcacauccaguucgaggcccacaaggacgagcggcgcggcaagauccccgagaaccucggccugaacuucaucagcggggacaucuccgacacccaggccagcaacgagcugucccggaucgccaacagccucaccggcuccaacaccgcccccgggagcuuccuguucuccagcugcggcaagaacaccgcgaagaaggaguucgagaccuccaacggcgacagccugcucgggcugcccgagggcgcccugaucuccaagugcagccgcgagaagaacaagccccagcggucccucgucugcgggagcaaggugaagcugugcuacaucggcgccggggacgaggagaagcgcagcgacuccaucagcaucugcaccaccuccgacgacggcagcuccgaccuggaccccaucgagcacagcuccgagagcgacaacuccgugcucgagauccccgacgccuucgaccgcaccgagaacaugcugagcaugcagaagaacgagaagaucaaguacucccgguucgccgcgaccaacacccgcgucaaggccaagcagaagccccugaucagcaacucccacaccgaccaccucaugggcugcaccaagagcgccgagcccgggacggagaccucccaggugaaccugagcgaccugaaggccuccacccucgugcacaagccccagagcgacuucaccaacgacgcccugagccccaaguucaaccuguccagcuccaucagcuccgagaacagccucaucaagggcggggcggccaaccaggcccugcugcacuccaagagcaagcagccgaaguuccgguccaucaagugcaagcacaaggagaaccccgucauggccgagcccccggugaucaacgaggagugcagccucaagugcugcuccagcgacacgaagggcagcccccuggccagcaucuccaagagcgggaagguggacggccugaagcuccugaacaacaugcacgagaagacccgcgacuccagcgacaucgagaccgcggucgugaagcacgugcuguccgagcucaaggagcugagcuaccggagccugggcgaggacgucuccgacagcgggaccuccaagcccagcaagccccuccuguucuccagcgccuccagccagaaccacaucccgaucgagcccgacuacaaguucuccacgcugcugaugaugcucaaggacaugcacgacagcaagaccaaggagcagcgccugaugaccgcccagaaccugguguccuaccggagccccggccgcggggacugcuccaccaacagccccgugggcgucuccaaggugcucgucagcgggggcuccacgcacaacagcgagaagaagggcgacgggacccagaacuccgccaacccgagccccagcggcggggacuccgcgcugagcggcgagcuguccgccagccuccccggccugcuguccgacaagcgggaccuccccgccagcgggaagucccgcagcgacugcgugacccggcgcaacugcggccgguccaagccgagcuccaagcugcgcgacgccuucagcgcccagauggugaagaacaccgucaaccggaaggcgcugaagacggagcgcaagcggaagcucaaccagcugcccuccgugacccuggacgccgugcuccagggggaccgcgagcggggcgggagccugcgcggcggcgccgaggaccccuccaaggaggacccccugcagaucauggggcaccucaccagcgaggacggcgaccacuucuccgacguccacuucgacagcaaggugaagcaguccgacccggggaagaucagcgagaagggccugagcuucgagaacgggaagggccccgagcuggacuccgugaugaacagcgagaacgacgagcucaacggcgucaaccagguggugcccaagaagcgcuggcagcggcugaaccagcgccggaccaagccccgcaagcggaugaaccgcuucaaggagaaggagaacuccgagugcgccuuccggguccugcucccgagcgaccccgugcaggaggggcgcgacgaguuccccgagcaccggacccccuccgccagcauccuggaggagccgcugacggagcagaaccacgcggacugccucgacuccgccggcccccgccugaacgugugcgacaagagcuccgccagcaucggggacauggagaaggagcccggcaucccgucccugacgccccaggccgagcuccccgagcccgccguccggagcgagaagaagcgccugcggaagccguccaaguggcugcucgaguacaccgaggaguacgaccagaucuucgcgcccaagaagaagcagaagaaggugcaggagcagguccacaaggucagcucccgcugcgaggaggagagccugcuggcccgggggcgcuccagcgcccagaacaagcaggucgacgagaacucccucaucagcaccaaggaggagccgcccgugcuggagcgggaggccccguuccuggagggcccccucgcgcagagcgagcugggcgggggccacgccgagcugccccagcucacgcuguccguccccguggccccggaggugagcccccgccccgcccuggaguccgaggagcuccuggucaagacccccgggaacuacgagagcaagcggcagcgcaagccgaccaagaagcugcucgaguccaacgaccuggaccccggcuucaugcccaagaagggggaccugggccucagcaagaagugcuacgaggccggccaccuggagaacgggaucaccgaguccugcgcgacgagcuacuccaaggacuucggcgggggcaccaccaagaucuucgacaagccccggaagcgcaagcgccagcggcacgccgccgccaagaugcagugcaagaaggugaagaacgacgacagcuccaaggagaucccgggcagcgagggggagcugaugccccaccgcaccgccacgucccccaaggagaccguggaggagggcgucgagcacgaccccgggaugccggcgagcaagaagaugcagggcgagcgcggcgggggcgccgcccucaaggagaacgugugccagaacugcgagaagcugggggagcugcuccugugcgaggcccagugcugcggcgccuuccaccuggagugccucgggcugaccgagaugccccgcggcaaguucaucugcaacgagugccggaccgggauccacacgugcuucgugugcaagcaguccggcgaggacgucaagcgcugccugcucccccugugcggcaaguucuaccacgaggagugcgugcagaaguacccgcccaccgugaugcagaacaagggguuccggugcagccugcacaucugcaucacgugccacgcggccaaccccgccaacgucuccgccagcaagggccgccucaugcggugcgugcgcugccccguggcguaccacgccaacgacuucugccuggccgccggguccaagauccuggccagcaacagcaucaucugccccaaccacuucacgccccggcgcggcugccggaaccacgagcacgucaacguguccuggugcuucgugugcagcgagggcggcucccuccugugcugcgacagcugccccgcggccuuccaccgcgagugccugaacaucgacauccccgagggcaacugguacugcaacgacugcaaggccgggaagaagccgcacuaccgggagaucgucugggugaaggugggccgcuaccggugguggcccgccgagaucugccacccccgcgccguccccuccaacaucgacaagaugcggcacgacgugggggaguucccgguccucuucuucggcagcaacgacuaccuguggacgcaccaggcgcgcgucuuccccuacauggagggcgacguguccagcaaggacaagauggggaagggcguggacgggaccuacaagaaggcccugcaggaggccgccgcccgcuucgaggagcucaaggcgcagaaggagcugcggcagcugcaggaggaccgcaagaacgacaagaagccgccgcccuacaagcacaucaaggucaaccggcccaucggccgcgugcagaucuucaccgccgaccucuccgagaucccccggugcaacugcaaggccaccgacgagaaccccugcgggaucgacagcgagugcaucaaccgcaugcugcuguacgagugccaccccacggugugccccgccggcggccggugccagaaccagugcuucuccaagcgccaguaccccgaggucgagaucuuccggacccuccagcgcggguggggccugcggaccaagaccgacaucaagaagggggaguucgugaacgaguacgucggcgagcugaucgacgaggaggagugccgcgcccggauccgcuacgcgcaggagcacgacaucacgaacuucuacaugcucacccuggacaaggaccggaucaucgacgccgggcccaagggcaacuacgcccgcuucaugaaccacugcugccagccgaacugcgagacccagaaguggagcgugaacggcgacacccggguggggcuguucgcccucuccgacaucaaggcgggcacggagcugaccuucaacuacaaccuggagugccucgggaacggcaagaccgucugcaagugcggggcccccaacugcagcggcuuccugggcgugcgccccaagaaccagcccaucgccaccgaggagaaguccaagaaguucaagaagaagcagcaggggaagcggcgcacgcagggcgagaucaccaaggagcgggaggacgagugcuucagcugcggggacgccggccagcugguguccugcaagaagccggggugccccaaggucuaccacgccgacugccugaaccucaccaagcgccccgcgggcaagugggagugccccuggcaccagugcgacaucugcggcaaggaggccgccagcuucugcgagaugugcccgagcuccuucugcaagcagcaccgcgaggggaugcuguucaucagcaagcuggacggccggcucuccugcaccgagcacgaccccugcgggcccaacccgcuggagcccggcgagauccgcgaguacgugccgccgcccgugccccugccgcccggccccagcacccaccucgccgagcaguccacggggauggccgcgcaggcccccaagaugagcgacaagccgcccgccgacaccaaccagaugcugucccugagcaagaaggcccucgccgggaccugccagcggccgcugcugcccgagcgcccccucgagcggaccgacucccgcccccagccgcuggacaagguccgggaccuggcggggagcggcacgaagucccagagccucguguccagccagcgcccccuggaccggccgcccgccguggccgggccgcgcccccagcuguccgacaagcccagccccgucaccuccccgagcuccagccccagcgugcggucccagccccucgagcgcccgcugggcaccgccgacccccggcuggacaagagcaucggcgcggccagcccccgcccccagagccucgagaagaccuccgugccgacggggcugcggcugccgccgcccgaccgccuccugaucaccagcuccccgaagccccagaccagcgaccggcccaccgacaagccccacgccucccugagccagcgccucccgccgcccgagaagguccuguccgccguggugcagacgcuggucgccaaggagaaggcgcuccggcccguggaccagaacacccagagcaagaaccgcgccgcccuggugauggaccugaucgaccucaccccgcgccagaaggagcgggccgccagcccccaccaggucacgccccaggcggacgagaagaugcccgugcuggagagcuccagcuggccggccuccaagggccuggggcacaugccccgcgccguggagaagggcugcgucagcgacccccuccagacguccgggaaggccgccgcgcccagcgaggacccguggcaggccgugaagucccugacccaggcccggcugcucucccagccgcccgccaaggcguuccuguacgagcccaccacccaggccagcggccgcgccuccgccggcgccgagcagacgccggggccccugagccagucccccggccucgugaagcaggcgaagcagauggucgggggccagcagcugccggcccuggccgccaagagcgggcaguccuuccggagccucggcaaggcccccgcgucccugcccaccgaggagaagaagcuggugaccaccgagcagagccccugggcccucggcaaggccuccagccgcgccgggcuguggccgaucguggccggccagacgcuggcgcaguccugcuggagcgccggguccacccagacccucgcccagaccugcuggagccugggccgggggcaggaccccaagcccgagcagaacacgcugcccgcccucaaccaggccccguccagccacaagugcgcggaguccgagcagaaguga

SEQ ID NO: 33817 - RNA, 1122 nt, Artificial Sequence
  derived and/or modified sequence opt1 from NSDHL__Homo_sapiens__XP_011529480
auggagcccgccgugagcgagccgaugcgcgaccaggucgcccggacccaccugaccgaggacacgcccaaggugaacgcggacaucgagaaggugaaccagaaccaggccaagcgcugcaccgucaucggcggguccggcuuccuggggcagcacaugguggagcagcugcuggcccggggcuacgccgugaacgucuucgacauccagcagggguucgacaacccccaggugcgcuucuuccucggcgaccugugcagccggcaggaccuguaccccgcccucaagggcgugaacaccgucuuccacugcgcguccccgccgcccagcuccaacaacaaggagcuguucuaccgcgugaacuacaucgggaccaagaacgugaucgagacgugcaaggaggccggcguccagaagcugauccucaccagcuccgccagcgugaucuucgaggggguggacaucaagaacggcaccgaggaccugcccuacgccaugaagcccaucgacuacuacaccgagacgaagauccugcaggagcgggcgguccucggggccaacgaccccgagaagaacuuccugaccaccgccauccgcccccacggcaucuucggcccccgggacccgcagcuggugcccauccucaucgaggccgcccgcaacgggaagaugaaguucgugaucggcaacgggaagaaccuggucgacuucaccuucguggagaacgugguccacggccacauccuggcggccgagcagcucucccgggacagcacgcugggcgggaaggccuuccacaucaccaacgacgagcccauccccuucuggaccuuccugucccgcauccucaccggccugaacuacgaggccccgaaguaccacauccccuacuggguggccuacuaccuggcgcuccugcugagccuccuggugauggucaucucccccgugauccagcugcagcccacguucaccccgaugcgggucgcccucgccgggaccuuccacuacuacagcugcgagcgcgccaagaaggccaugggcuaccagccccuggugaccauggacgacgcgauggagcggacggugcaguccuuccgccaccuccggcgcgucaaguga

SEQ ID NO: 33818 - RNA, 2235 nt, Artificial Sequence
  derived and/or modified sequence opt1 from NSF__Homo_sapiens__NP_006169
auggccggccgcagcaugcaggccgcgcggugccccaccgacgagcugucccucaccaacugcgccguggucaacgagaaggacuuccagagcgggcagcacgugaucgugcgcacguccccgaaccaccgguacaccuucacccugaagacccaccccagcgucgugcccggcuccaucgccuucagccugccccagcgcaagugggccgggcucuccaucggccaggagaucgaggugagccuguacacguucgacaaggccaagcagugcaucgggaccaugaccaucgagaucgacuuccugcagaagaaguccaucgacagcaacccguacgacaccgacaagauggcggccgaguucauccagcaguucaacaaccaggccuucuccgucggccagcagcucguguucagcuucaacgagaagcuguucggccugcucgugaaggacaucgaggccauggaccccuccauccugaagggggagcccgcgacgggcaagcggcagaagaucgaggucgggcugguggugggcaacagccaggucgccuucgagaaggccgagaacuccagccucaaccugaucgggaaggccaagaccaaggagaaccgccaguccaucaucaaccccgacuggaacuucgagaagaugggcaucggcgggcuggacaaggaguucagcgacaucuuccggcgcgccuucgcgucccggguguucccgcccgagaucguggagcagaugggcugcaagcacgucaaggggauccuccuguacggcccgcccggcugcgggaagacccugcucgcccgccagaucggcaagaugcugaacgcccgggagcccaagguggugaacgggcccgagauccugaacaaguacgucggcgagagcgaggccaacauccgcaagcuguucgccgacgcggaggaggagcagcggcgccugggggccaacagcggccugcacaucaucaucuucgacgagaucgacgccaucugcaagcagcggggcuccauggccgggagcaccggcgugcacgacacgguggucaaccagcuccuguccaagaucgacgggguggagcagcugaacaacauccucgugaucggcaugaccaaccgccccgaccugaucgacgaggcccugcuccggcccgggcgccuggaggucaagauggagaucggccugccggacgagaagggccggcuccagauccugcacauccacaccgcgcgcaugcgggggcaccagcugcucagcgccgacguggacaucaaggagcuggccgucgagaccaagaacuucuccggcgccgagcuggaggggcucgugcgcgccgcgcagagcacggccaugaaccgccacaucaaggccuccaccaagguggaggucgacauggagaaggccgagagccuccaggugacccggggcgacuuccuggcgucccucgagaacgacaucaagcccgccuucgggaccaaccaggaggacuacgccagcuacaucaugaacggcaucaucaaguggggcgaccccgugacgcgcguccuggacgacggggagcugcucgugcagcagaccaagaacuccgaccggacgccccuggugagcguccugcucgagggcccgccccacuccgggaagaccgcccuggccgcgaagaucgccgaggagagcaacuuccccuucaucaagaucugcucccccgacaagaugaucggcuucagcgagaccgccaagugccaggccaugaagaagaucuucgacgacgccuacaagucccagcugagcugcgugguggucgacgacaucgagcgccugcucgacuacgugccgaucggcccccgguucuccaaccuggugcugcaggcgcuccugguccugcucaagaaggccccgccccaggggcgcaagcugcugaucaucggcaccaccagccggaaggacgugcuccaggagauggagaugcugaacgccuucagcaccacgauccacgugcccaacaucgccaccggggagcagcugcucgaggcccuggagcugcucggcaacuucaaggacaaggagcgcaccaccaucgcgcagcaggucaaggggaagaagguguggaucggcaucaagaagcugcugaugcucaucgagaugucccugcagauggaccccgaguaccgggugcgcaaguuccuggcccuccugcgggaggagggcgccagcccccuggacuucgacuga

SEQ ID NO: 33819 - RNA, 1119 nt, Artificial Sequence
  derived and/or modified sequence opt1 from NSFL1C__Homo_sapiens__NP_001193665
auggccgccgagcgccaggaggcgcugcgggaguucguggccgucaccggcgccgaggaggaccgcgcccgguucuuccucgagagcgccgggugggaccugcagaucgcgcuggccuccuucuacgaggacggcggggacgaggacaucgugaccaucagccaggccacgcccuccagcgugucccgcggcaccgccccgagcgacaaccgggucaccuccuuccgcgaccucauccacgaccaggacgaggacgaggaggaggaggaggggcagcggagccgcuucuacgcgggcggcuccgagcggagcgggcagcagaucgugggcccgccccgcaagaagucccccaacgagcugguggacgaccuguucaagggggccaaggagcacggcgccgucgccguggagcgggugaccaagagccccggggagacguccaagccccgccccuucgccggcggcggguaccggcucggcgcggcccccgaggaggagagcgccuacgucgccggggagaagcgccagcacuccagccaggacgugcacgugguccugaagcuguggaaguccggcuucagccucgacaacggcgagcugcgguccuaccaggacccgagcaacgcccaguuccuggagagcauccgccgcggggaggugcccgcggagcuccggcggcuggcccacggcggccaggugaaccuggacauggaggaccaccgcgacgaggacuucgucaagcccaagggggccuucaaggccuucaccggggagggccagaagcucggcuccaccgcgccccaggugcugagcaccuccagcccggcccagcaggccgagaacgaggccaaggccuccagcuccauccugaucgacgagagcgagcccacgaccaacauccagauccggcucgccgacgggggccgccuggugcagaaguucaaccacucccaccgcaucagcgacauccggcuguucaucgucgacgcgcgccccgccauggccgccaccuccuucauccucaugaccacguuccccaacaaggagcuggcggacgagagccagacccugaaggaggccaaccuccugaacgccgugaucgugcagcggcugaccuga

SEQ ID NO: 33820 - RNA, 558 nt, Artificial Sequence
  derived and/or modified sequence opt1 from NSG1__Homo_sapiens__NP_001274692
auggugaagcugggcaacaacuucgccgagaaggggaccaagcagccccuccuggaggacggcuucgacaccaucccccugaugacgccccucgacgucaaccagcugcaguucccgccgcccgacaaggugguggucaagaccaagaccgaguacgagcccgaccgcaagaaggggaaggcccggccgccccagaucgcggaguucaccgugagcaucacggagggcgugaccgagcgcuucaaggucuccgugcugguccucuucgcccuggccuuccugaccugcgugguguuccucguggucuacaagguguacaaguacgaccgggccugccccgacggguucgugcugaagaacacccagugcauccccgagggccuggagagcuacuacgccgagcaggacuccagcgcgcgcgagaaguucuacacggucaucaaccacuacaaccucgccaagcaguccaucacccggagcgugucccccuggaugagcgugcuguccgaggagaagcugagcgagcaggagaccgaggccgccgagaaguccgcguga

SEQ ID NO: 33821 - RNA, 2847 nt, Artificial Sequence
  derived and/or modified sequence opt1 from NSMAF__Homo_sapiens__NP_001138244
augaccggccaggcccgcuuccaccgcggggccgaggcgugccgggccauccggcagugccgcagccggcgcccccgggccgcccacccggagggccgcgccggguccggccgggggagccgccacgcgucccccggcgugcggcgcggcggguucagccugcuccugcugaaccucgaggaguacuacuucgagcagcaccgggccaaccacauccugcacaagggcucccaccacgagcgcaagauccgggggagccugaagaucugcuccaagagcgucaucuucgagcccgacuccaucagccagcccaucaucaagaucccgcuccgcgacugcaucaagaucggcaagcacggggagaacggcgccaaccggcacuucaccaaggccaaguccggcgggaucagccugaucuucucccagguguacuucaucaaggagcacaacguggucgcgcccuacaagaucgagcgcggcaagauggaguacguguucgagcuggacgugcccgggaaggucgaggacgugguggagacgcuccugcagcugcaccgggccagcugccucgacaagcugggcgaccagaccgccaugaucaccgccauccugcagucccgccucgcccggaccagcuucgacaagaaccgcuuccagaacaucuccgagaagcugcacauggagugcaaggcggagauggucacgccccuggugaccaacccgggccacgugugcaucaccgacaccaaccucuacuuccagccccugaacggguaccccaagcccgucgugcagaucacgcugcaggacgugcgccggaucuacaagcgccggcacggccucaugccgcuggggcuggaggucuucugcaccgaggacgaccucugcagcgacaucuaccugaaguucuacgagccccaggaccgcgacgaccuguacuucuacaucgccaccuaccucgagcaccacguggccgagcacaccgccgaguccuacaugcugcaguggcagcggggccaccugagcaacuaccaguaccuccugcaccugaacaaccucgccgaccgcagcugcaacgaccugucccaguaccccguguuccccuggaucauccacgacuacagcuccagcgagcuggaccucuccaacccggggacguuccgggaccugagcaagcccgucggcgcgcugaacaaggagcgccucgagcggcugcugacccgcuaccaggagaugcccgagcccaaguucauguacggcucccacuacagcuccccgggguacguccucuucuaccuggugcggaucgcccccgaguacaugcugugccuccagaacggccgcuucgacaacgccgaccggauguucaacagcaucgccgagaccuggaagaacugccuggacggggccaccgacuucaaggagcugauccccgaguucuacggcgacgacguguccuuccucgugaacagccugaagcuggaccuggggaagcgccagggcggccagaugguggacgacgucgagcugcccccgugggcguccagccccgaggacuuccuccagaaguccaaggacgcccuggagagcaacuacguguccgagcaccuccacgaguggaucgaccugaucuucggguacaagcagaagggcagcgacgccgucggggcccacaacguguuccacccccugacguacgagggcgggguggaccucaacuccauccaggaccccgacgagaaggucgccaugcugacccagauccuggaguucggccagaccccgaagcagcuguucgugacgccccacccccggcgcaucacgccgaaguucaagagccucagccagaccuccagcuacaacgcguccauggccgacagccccggcgaggaguccuucgaggaccugaccgaggagagcaagacccucgccuggaacaacaucacgaagcugcagcugcacgagcacuacaagauccacaaggaggccgugaccgggaucaccgucucccggaacggcagcuccguguucaccacgagccaggacuccacccucaagauguucagcaaggaguccaagaugcugcagcgcagcaucuccuucagcaacauggcgcuguccagcugccuccugcugcccggggacgccaccgugaucaccagcuccugggacaacaacgucuacuucuacagcaucgccuucggccggcgccaggacacgcucaugggccacgacgacgccguguccaagaucugcuggcacgacaaccgccuguacagcgccuccugggacagcaccgugaaggucugguccggggugcccgcggagaugccgggcaccaagcggcaccacuucgaccugcucgccgagcuggagcacgacgugagcgucgacaccaucucccugaacgccgccagcacgcuccugguguccgggaccaaggagggcaccgugaacaucugggaccugaccaccgccacgcucaugcaccagauccccugccacagcgggaucgucugcgacaccgcguucucccccgacagccgccacgugcuguccaccggcaccgacggcugccugaacgugaucgacguccagacggggaugcucaucagcuccaugaccagcgacgagccccagcggugcuucgugugggacggcaacuccgugcugagcgggagccaguccggcgagcugcucgucugggaccugcugggggccaagaucagcgagcgcauccagggccacaccggcgccgugaccugcaucuggaugaacgagcagugcuccagcaucaucaccgggggcgaggaccggcagaucaucuucuggaagcuccaguacuga

SEQ ID NO: 33822 - RNA, 744 nt, Artificial Sequence
  derived and/or modified sequence opt1 from NSMCE2__Homo_sapiens__NP_775956
augcccggccgcagcuccagcaacuccgggagcaccggcuucaucuccuucagcgggguggaguccgcccugagcucccucaagaacuuccaggccugcaucaacagcggcauggacaccgcguccagcgucgcccuggaccugguggagucccagacggaggugagcuccgaguacagcauggacaaggccauggucgaguucgccacccucgaccggcagcugaaccacuacgugaaggccgugcaguccaccaucaaccacgucaaggaggagcgcccggagaagauccccgaccugaagcuccugguggagaagaaguuccuggcgcuccagagcaagaacuccgacgccgacuuccagaacaacgagaaguucgugcaguucaagcagcagcugaaggagcugaagaagcagugcgggcuccaggccgaccgggaggccgacggcaccgagggcgucgacgaggacaucaucgugacgcagagccagaccaacuucacgugccccaucaccaaggaggagaugaagaagcccgugaagaacaaggucugcgggcacaccuacgaggaggacgcgaucgugcgcaugaucgagagccggcagaagcgcaagaagaaggccuacugcccgcagaucggcugcucccacaccgacauccgcaagagcgaccugauccaggacgaggcccugcggcgggccaucgagaaccacaacaagaagcgccaccggcacuccgaguga

SEQ ID NO: 33823 - RNA, 1593 nt, Artificial Sequence
  derived and/or modified sequence opt1 from NSMF__Homo_sapiens__NP_001124441
augggcgccgccgcgagccgccggcgcgcccugcgguccgaggccaugagcuccguggccgccaagguccgcgcggcccgggccuucggggaguaccucagccagucccaccccgagaaccgcaacggcgccgaccaccuccuggcggacgccuacagcgggcacgacggcuccccggagaugcagcccgcgccccagaacaagcggcgccugagccugguguccaacgggugcuacgagggcagccuguccgaggagcccagcauccggaagccggccggcgaggggccccagccccgcguguacaccaucuccggcgagcccgcccuccugccgagccccgaggccgaggccaucgagcuggccgucgugaaggggcggcgccagcggcacccccaccaccacucccagccccuccgcgccagcccgggcgggucccgggaggacgugagccgccccugccaguccugggccggcagccggcagggcagcaaggagugccccgggugcgcgcagcuggcccccggcccgacgccccgcgccuucgggcuggaccagccgccccuccccgagaccuccggccggcgcaagaagcuggagcggauguacagcgucgaccgcguguccgacgacauccccauccgcaccugguuccccaaggagaaccuguucagcuuccagaccgccaccacgaccaugcaggccaucuccguguuccggggcuacgcggagcgcaagcggcgcaagcgggagaacgacagcgccuccgucauccagcgcaacuuccggaagcaccuccgcaugguggggagccggcgcgugaaggcccagaccuucgccgagcggcgcgagcgguccuucagccgcuccuggagcgaccccaccccgaugaaggccgacacgucccacgacagccgggacuccagcgaccugcaguccagccacugcacccuggacgaggcguucgaggaccucgacugggacaccgagaagggccuggaggccgucgccugcgacaccgagggguucgugccgcccaaggugaugcugaucuccagcaagguccccaaggccgaguacauccccacgaucauccgccgggacgaccccagcaucauccccauccucuacgaccacgagcacgcgaccuucgaggacauccuggaggagaucgagcgcaagcugaacguguaccacaagggcgccaagaucuggaagaugcucaucuucugccagggcgggccgggccaccuguaccugcucaagaacaagguggccaccuucgccaaggucgagaaggaggaggacaugauccacuucuggaagcggcugucccgccugaugagcaaggugaaccccgagcccaacgugauccacaucauggggugcuacauccucggcaaccccaacggggagaagcuguuccagaaccugcgcacccucaugacgccguaccgggucaccuucgagagcccccuggagcuguccgcccagggcaagcagaugaucgagaccuacuucgacuuccgccucuaccggcuguggaagucccgccagcacagcaagcugcucgacuucgacgacgugcuguga

SEQ ID NO: 33824 - RNA, 1515 nt, Artificial Sequence
  derived and/or modified sequence opt1 from NSRP1__Homo_sapiens__NP_001248396
augaagcagaccaagcuggagauccagaaggcccucgccgaggacgcgaccguguacgaguacgacagcaucuacgacgagaugcagaagaagaaggaggagaacaaccccaagcugcugcucggcaaggaccgcaagcccaaguacauccacaaccugcugaaggccgucgagauccggaagaaggagcaggagaagcgcauggagaagaagauccagcgggagcgcgagauggagaagggggaguucgacgacaaggaggccuucgugacguccgccuacaagaagaagcuccaggagcgggccgaggaggaggagcgcgagaagcgggcggccgcccuggaggccugccuggacgugaccaagcagaaggaccucagcggcuucuaccgccaccuccugaaccaggcggucggggaggaggaggugcccaagugcuccuuccgggaggcccgcagcggcaucaaggaggagaagucccggggguucagcaacgagguguccagcaagaaccgcaucccccaggagaagugcauccugcagaccgacgucaagguggaggagaaccccgacgccgacuccgacuucgacgccaagagcuccgccgacgacgagaucgaggagacccgggugaacugccgccgggagaaggucaucgagacgccggagaacgacuucaagcaccaccgcagccagaaccacucccggagccccuccgaggagcgcggccacagcacccggcaccacaccaagggcucccgcaccagccgggggcacgagaagcgcgaggaccagcaccagcagaagcagucccgcgaccaggagaaccacuacacggaccgggacuaccgcaaggagcgggacagccaccgccaccgggaggcgagccaccgcgacucccacuggaagcggcacgagcaggaggacaagccccgcgcccgggaccagcgcgagcggagcgaccgcguguggaagcgggagaaggaccgcgagaaguacucccagcgggagcaggagcgcgaccggcagcagaacgaccagaaccgccccagcgagaagggcgagaaggaggagaaguccaaggccaaggaggagcacaugaaggugcggaaggagcgcuacgagaacaacgacaaguaccgcgaccgggagaagcgcgaggucggggugcagagcuccgagcggaaccaggaccgcaaggagagcuccccgaacagccgggccaaggacaaguuccuggaccaggagcgcuccaacaagaugcggaacauggccaaggacaaggagcgcaaccaggagaagcccagcaacuccgagagcucccugggcgcgaagcaccggcucaccgaggaggggcaggagaagggcaaggagcaggagcgcccgcccgaggccgugagcaaguucgccaagcggaacaacgaggagaccgucauguccgcccgcgaccgguaccuggcccgccagauggcgcgggugaacgccaagaccuacaucgagaaggaggacgacuga

SEQ ID NO: 33825 - RNA, 2199 nt, Artificial Sequence
  derived and/or modified sequence opt1 from NSUN2__Homo_sapiens__NP_001180384
augggccgccggagccgcgggcggcgccugcagcagcagcagcggcccgaggacgccgaggacggcgccgagggcggcgggaagcgcggcgaggcgggcugggagggcggguacccggagaucgugaaggagaacaagcuguucgagcacuacuaccaggagcucaagaucguccccgagggggaguggggccaguucauggacgcccugcgggagccccuccccgccacccugcgcaucaccggguacaagcgguacccggaggagcuggccuggcacacgaaccucucccgcaagauccugcgcaagagcccccaccuggagaaguuccaccaguuccucguguccgagaccgagagcggcaacaucucccggcaggaggccgugagcaugaucccgccccugcugcucaacguccggccccaccacaagauccuggacaugugcgcggcccccggcuccaagaccacccagcugaucgagaugcuccacgccgacaugaacgugcccuuccccgagggguucgugaucgccaacgacgucgacaacaagcgcugcuaccugcuggugcaccaggcgaagcggcucagcuccccgugcaucaugguggucaaccacgacgccagcuccaucccccgccugcagaucgacguggacggccggaaggagauccuguucuacgaccgcauccucugcgacgugcccugcagcggggacggcacgaugcggaagaacaucgacgucuggaagaaguggaccacccugaacucccugcagcuccacggccugcagcugcgcaucgccacccgcggggccgagcagcucgccgagggcgggcggaugguguacagcacgugcucccugaaccccaucgaggacgaggcggugaucgccagccugcucgagaaguccgagggcgcccuggagcuggccgacgucagcaacgagcucccggggcugaaguggaugcccggcaucacccaguggaaggugaugaccaaggacggccagugguucaccgacugggacgccgugccccacucccgccacacgcagauccggcccaccauguucccgcccaaggaccccgagaagcugcaggcgaugcaccucgagcgcugccugcggauccugccccaccaccagaacaccgggggcuucuucgucgccgugcucgugaagaaguccagcaugccguggaacaagcgccagcccaagcugcagggcaagagcgccgagacccgggagagcacgcagcugucccccgccgaccucaccgaggggaagcccaccgacccgagcaagcuggagucccccagcuucaccgggacgggcgacaccgagaucgcccacgcgaccgaggaccuggagaacaacggcuccaagaaggacggggucugcgggcccccgcccagcaagaagaugaagcuguucggguucaaggaggaccccuucguguucauccccgaggacgacccccucuucccgccgaucgagaaguucuacgcccuggaccccuccuucccccgcaugaaccuccugacccggacgaccgagggcaagaagcgccagcuguacauggugagcaaggagcugcggaacguccuccugaacaacuccgagaagaugaaggugaucaacaccgggaucaaggucuggugccgcaacaacagcggcgaggaguucgacugcgccuuccggcuggcccaggagggcaucuacacccucuaccccuucaucaacucccgcaucaucacggugagcauggaggacgugaagauccugcugacccaggagaaccccuucuuccggaagcucuccagcgagaccuacucccaggccaaggaccuggcgaaggggagcaucguccugaaguacgagcccgacuccgccaacccggacgcccuccagugccccaucgugcugugcggcuggcgcgggaaggccagcauccggaccuucgugcccaagaacgagcgccugcacuaccuccggaugaugggccuggagguccugggcgagaagaagaaggagggggugauccucacgaacgagagcgcggccuccaccggccagcccgacaacgacgugaccgaggggcagcgcgccggcgagccgaacagccccgacgccgaggaggccaacucccccgacgucaccgcggggugcgaccccgccggcgugcacccgccccgguga

SEQ ID NO: 33826 - RNA, 1023 nt, Artificial Sequence
  derived and/or modified sequence opt1 from NSUN3__Homo_sapiens__NP_071355
augcugacccagcucaaggccaagagcgagggcaagcuggccaagcagaucugcaaggugguccuggaccacuucgagaagcaguacuccaaggagcucggggacgcguggaacaccgugcgcgagauccugacgagccccuccugcuggcaguacgccgugcugcucaaccgcuucaacuacccguucgagcuggagaaggaccugcaccucaagggcuaccacacccugagccaggggucccugcccaacuaccccaagagcgucaagugcuaccucucccgcacccccggccggaucccgagcgagcgccaccagaucgggaaccugaagaaguacuaccugcucaacgccgccucccugcugcccgugcucgcccuggagcugcgggacggcgagaaggugcucgaccugugcgcggcccccggcggcaagagcaucgcccugcuccagugcgccugccccggguaccugcacugcaacgaguacgacucccugcgccuccgguggcugcgccagacccuggagagcuucaucccgcagccccucaucaacgucaucaagguguccgagcuggacgggcggaagaugggcgacgcgcagcccgagauguucgacaaggugcuggucgacgcccccugcagcaacgaccgcuccuggcuguucagcuccgacagccagaaggccuccugccggaucagccagcgccggaaccucccgcugcuccagaucgagcugcugcgcagcgccaucaaggcccuccggcccgggggcauccugguguacuccacgugcacccugagcaaggcggagaaccaggacgugaucuccgagauccucaacagccacggcaacaucaugcccauggacaucaaggggaucgcccggaccugcucccacgacuucaccuucgcccccacgggccaggagugcgggcugcuggucaucccggacaagggcaaggccuggggccccauguacguggccaagcucaagaaguccuggagcaccgggaagugguga

SEQ ID NO: 33827 - RNA, 1413 nt, Artificial Sequence
  derived and/or modified sequence opt1 from NSUN5__Homo_sapiens__NP_001161819
augggccuguacgccgccgcggccggggugcucgccggcgucgagagccgccagggguccaucaagggccugguguacagcuccaacuuccagaacgugaagcagcuguacgcccucgucugcgagacccagcgguacagcgccgugcuggacgcggugaucgccuccgccgggcugcuccgcgccgagaagaagcugcggccccaccuggcgaagguccucguguacgagcugcugcucggcaagggcuuccgcgggggcgggggccgguggaaggcccugcuggggcgccaccaggcccggcucaaggccgagcuggcccgccugaaggugcaccggggcgucagccgcaacgaggaccuccuggaggugggcucccggccggggcccgcgagccagcugccccgcuucgugcgggucaacacccucaagacgugcuccgacgacgugguggacuacuucaagcgccagggcuucagcuaccaggggcgggccuccagccuggacgaccugcgcgcccucaagggcaagcacuuccugcuggacccccucaugccggagcugcuggucuuccccgcccagaccgaccuccacgagcacccccuguaccgggccggccaccugauccuccaggaccgcgcguccugccugcccgccaugcugcucgacccgccgcccgggagccacgugaucgacgccugcgccgcccccggcaacaagaccucccaccuggcggcccugcucaagaaccaggggaagaucuucgccuucgaccuggacgccaagcggcuggccagcauggcgacccuccuggcccgcgccggcguguccugcugcgagcuggccgaggaggacuuccucgcggucagccccuccgacccccgguaccacgaggugcacuacauccugcuggaccccagcugcagcggguccggcaugcccagccgccagcucgaggagccgggcgccgggacgcccucccccgugcgccugcacgcccuggccggcuuccagcagcgggcccugugccacgcgcucaccuuccccagccugcagcgccuggucuacuccacgugcagccucugccaggaggagaacgaggacguggugcgggacgcccugcagcagaacccgggggccuuccgccuggcccccgcccuccccgcguggccccaccggggccuguccaccuucccgggggccgagcacugccugcgcgccagccccgagaccacccucuccagcggcuucuucgucgccgugaucgagcgggucgaggugcccucccugaccggccagagcaucuccacccgcacgcacacccagcccagcccgaaggagaaggaggagaccgccaagucccggagccgcugccugcacaccgcgcuccacaucgccgaggcccccggguga

SEQ ID NO: 33828 - RNA, 2157 nt, Artificial Sequence
  derived and/or modified sequence opt1 from NSUN7__Homo_sapiens__NP_078953
augcugaacagcaccggcgagcucgaguucuccaacgaggaggaccccgagaucaucagccagcugaccucccugccgcucagcgggggcaaguccagcgccggggugcccgagaagacgggcuaccccgacuccgucuacgugauggccgcgaacaucuuccaggggauccgcaucgagaaguccgcccagaaggugcugaucaaguacggcaacgagccccugcggagccucagcgaguccgaggaccagagcuuccagcgccuguccuacgagcuggccuucagcgcccucaaguaccaggacauccuggagaccauccugaucgacuccugcaucuucccgagcaccaccauccccgaccaccucuccagccugaucaucgucaugcuguacgacuuccaggaccggaaguuccagacgcgcgugcucuccgacaacgaggagcccaucagcgaggugcaggaggucgagaaccugcugaacagcuucaagaucaagcucgccgcggcccuggcccggugccgcaucaagcacgacgcccuguccaucuaccacauccuccccgagaccgugcggaagcaggagcugcgcgcgagcacccugccgcucuacgccuggaucaacacgugcaagaucucccccgaggagguguacaacaaccugaagcggcgcggcuacaacaaggucaagagcgugcugcacaucgacgacaagguguucgccgucgaccagcacugcuacgacgugcucaucuuccccucccaccugaagaacgaccugaucaacaucgaccucuucaaggacuacaagcugaucuuccaggacaagagccggucccuggccgugcacagcgucaaggcccuccugaacauggacgacgacgugcugauggugaacaccggguccugguacaccgucagccacauguccauccucaccaacaacaacaccagcaagguguucgugugcggcguccagucccaggcgaaggaccccgaccugaagacgcuguucaccaagaucgggugcaagaacaucgagauccuccacgagaaguucaucaacaucgagagcaaggaccaccgccugcagaaggugaaggugauccugcuccugccgcggugcuccggccugggggucagcaaccccguggaguucauccucaacgagcacgaggacaccgaguuccugaaggaccacucccagggcggcaucagcgucgacaagcugcacgugcucgcccagcagcaguacgagcagcugacccacgccaugaaguucacgaaggcccaggccguggucuacugcacgugcuccguguuccccgaggagaacgaggcgguggucaagaaggcccuggaguuccaggaccuggggaacaagggccagcccuaccgccucagcccgcccgugcugccccugugcagccucaaggagauccagcuguccaccgacaaguucuuccggauggagcccagcgagaucaccaacgggugcuuccuguccauccucacccgcgagcgggacccgagcgagaccguguccgucaacgacgugcuggcccgcgccgccgcgaagggccugcucgacggcaucgagcugggcaagagcuccaagcgggagaagaagaagaagaaguccaagaccagccugaccaagggggccacgaccgacaacgggauccagaugaagaucgccgaguuccucaaccgcgagaccaaggccagcgccaaccuguccgagaccgugacgaagccgccccugccccagaagaacaccgcgcaggucggcgccagcucccagacccggaagcccaacaagcucgcgccccaccccgccgugcccgccuucgugaagaacacgugcccgagccgcccccgcgagcggcagacccacuuccugcgcccccggccggaggaccgcauggucgcccugaagcccaucgagaucgugcucccgcccguguucaugcccuucuccagcccccaggggauccggucccgcaugcccacccagcaccuguacugccggugggucgcccccaaggcccuggugccgaccugccuccccacccacagccugagccgcaaggaggagaagcccaaggacgacacgcccuccagccugcuccggccgccccgccgguggcuguga

SEQ ID NO: 33829 - RNA, 1833 nt, Artificial Sequence
  derived and/or modified sequence opt1 from NT5C1B__Homo_sapiens__NP_001002006
augagccagaccucccugaagcagaagaagaacgagcccggcaugcgcagcuccaaggagagccucgaggccgagaagcggaaggaguccgacaagaccggggugcgccugagcaaccagaugcggcgcgccgucaacccgaaccacucccugcggugcugccccuuccagggccacagcuccugccgccggugccucugcgcggccgaggggacggcccugggccccugccacaccauccgcaucuacauccacaugugccugcucugggagcaggggcagcagaucaccaugaugcggggcagccaggaguccagccugcgcaagaccgacucccggggcuaccuggugcgcagccaguggucccggaucagccgcucccccagcacgaaggccccguccaucgacgagccccggagccgcaacaccagcgccaagcuccccuccagcuccaccagcucccggacccccagcacguccccgagccugcacgacuccagcccgccgccccuguccgggcagcccagccuccagccgcccgcgagcccccagcugccccgcagccuggacucccggccgcccaccccgcccgagcccgaccccggcagccgccgguccaccaagaugcaggagaaccccgaggccugggcccaggggaucgugcgcgagauccgccagacccgggacagccagccccucgaguacucccgcacgagccccaccgaguggaaguccuccagccagcggcgcggcaucuaccccgccuccacccagcuggaccggaacagccuguccgagcagcagcagcagcagcgcgaggacgaggacgacuacgaggcggccuacugggccagcaugcgguccuucuacgagaagaaccccagcugcucccgcccguggccgcccaagcccaagaacgccaucaccaucgcccucagcuccugcgcgcuguucaacauggucgacgggcggaagaucuacgagcaggagggccuggagaaguacauggaguaccagcucacgaacgagaacgugauccugacccccggccccgccuuccgcuucgugaaggcccugcaguacgucaacgcccggcuccgcgaccuguaccccgacgagcaggaccuguucgacaucgugcucaugaccaacaaccacgcccagguggggguccggcugaucaacagcgugaaccacuacggccugcucaucgaccgcuucugccugaccgggggcaaggacccgaucggcuaccugaaggcguaccucacgaaccuguacaucgccgccgacuccgagaaggugcaggaggccauccaggaggggaucgccagcgcgaccauguucgacggcgccaaggacauggccuacugcgacacccagcugcgggucgccuucgacggggacgccguccucuucuccgacgagagcgagcacuucaccaaggagcacggccuggacaaguucuuccaguacgacacgcugugcgaguccaagccccucgcgcaggggccccugaagggcuuccuggaggaccucggccgccugcagaagaaguucuacgccaagaacgagcggcugcucugccccauccgcaccuaccuggugaccgcccggagcgccgcgagcuccggggcccgcgugcugaagacccuccgccgguggggccuggagaucgacgaggcccuguuccuggccggggcccccaagagccccauccucgugaagauccgcccccacaucuucuucgacgaccacauguuccacaucgagggcgcgcagcggcugggguccaucgccgccuacggcuucaacaagaaguucagcuccuga

SEQ ID NO: 33830 - RNA, 1953 nt, Artificial Sequence
  derived and/or modified sequence opt1 from NT5C1B-RDH14__Homo_sapiens__NP_001186032
augagccagaccucccugaagcagaagaagaacgagcccggcaugcgcagcuccaaggagagccucgaggccgagaagcggaaggaguccgacaagaccggggugcgccugagcaaccagggcucccaggagagcucccugcggaagacggacagccgcggguaccucguccggucccaguggagccgcaucucccggagcccguccaccaaggcccccagcaucgacgagccccgcucccggaacaccagcgcgaagguggagcugcccuccagcagcaccuccagccgcacgccguccaccagccccucccugcacgacagcuccccgcccccgcucagcggccagcccucccugcagccgcccgccagcccccagcugccccggucccucgacagccgcccgcccaccccgcccgagcccgaccccgggucccggcgcagcaccaagaugcaggagaaccccgaggccugggcccagggcaucgugcgggagauccgccagacgcgggacucccagccccuggaguacagccgcaccucccccaccgaguggaaguccagcagccagcggcgcggcaucuaccccgccagcacccagcuggaccggaacucccucagcgagcagcagcagcagcagcgcgaggacgaggacgacuacgaggcggccuacugggccuccaugcgcagcuucuacgagaagaacccguccugcagccggcccuggccgcccaagcccaagaacgccaucacgaucgcgcuguccagcugcgcccuguucaacauggucgacgggcgcaagaucuacgagcaggagggccucgagaaguacauggaguaccagcugaccaacgagaacgugauccugacccccgggcccgccuuccgguucgugaaggcccuccaguacgucaacgcccgccugcgggaccuguacccggacgagcaggaccucuucgacaucgugcugaugaccaacaaccacgcccaggugggcguccgccugaucaacuccgugaaccacuacgggcuccugaucgaccgguucugccugacgggcggcaaggaccccaucggguaccucaaggcguaccugaccaaccuguacaucgccgccgacagcgagaaggugcaggaggccauccaggagggcaucgcguccgccaccauguucgacggggccaaggacauggccuacugcgacacccagcuccgcgucgccuucgacggcgacgcggugcuguucagcgacgaguccgagcacuucacgaaggagcacggccuggacaaguucuuccaguacgacacccucugcgagagcaagccccuggcccaggaggagccccggcuggacgugcucaucaacaacgccgggaucuuccagugcccguacaugaagaccgaggacggcuucgagaugcaguucggggucaaccaccugggccacuuccugcucaccaaccugcugcucgggcugcugaaguccagcgcccccucccgcaucgugguggucagcagcaagcucuacaaguacggcgacaucaacuucgacgaccugaacuccgagcagagcuacaacaaguccuucugcuacagccgguccaagcuggccaacauccucuucacgcgcgagcuggcgcggcgccuggagggcaccaacgugaccgugaacguccugcaccccgggaucgugcggaccaaccucggccgccacauccacaucccccugcuggugaagccccucuucaaccuggucagcugggccuucuucaagacgcccguggagggggcccagaccuccaucuaccuggccagcucccccgaggucgagggcgugagcgggcgguacuucggcgacugcaaggaggaggagcuccugcccaaggcgauggacgaguccguggcccgcaagcugugggacaucagcgaggucauggugggccuccugaaguga

SEQ ID NO: 33831 - RNA, 1686 nt, Artificial Sequence
  derived and/or modified sequence opt1 from NT5C2__Homo_sapiens__NP_036361
augagcaccuccuggagcgaccgccugcagaacgccgccgacaugcccgccaacauggacaagcacgcccucaagaaguaccggcgcgaggccuaccaccggguguucgucaaccgcucccuggccauggagaagaucaagugcuucggcuucgacauggacuacacccuggccguguacaagagcccggaguacgagucccucggguucgagcugacgguggagcggcuggucagcaucggcuacccccaggagcuccuguccuucgcguacgacagcaccuuccccacccgcgggcugguguucgacacccucuacggcaaccugcugaagguggacgccuacgggaaccuccuggucugcgcccacggcuucaacuucauccggggccccgagacgcgcgagcaguacccgaacaaguucauccagcgggacgacaccgagcgcuucuacauccugaacacccucuucaaccugcccgagaccuaccugcucgccugccugguggacuucuucacgaacugcccccgguacaccuccugcgagaccggguucaaggacggcgaccuguucaugagcuaccgcuccauguuccaggacgugcgggacgcggucgacugggugcacuacaaggggagccucaaggagaagaccguggagaaccuggagaaguacgucgugaaggacggcaagcugccccuccugcugucccgcaugaaggagguggggaaggucuuccucgccacgaacagcgacuacaaguacaccgacaagaucaugaccuaccuguucgacuucccgcacggccccaagcccggcuccagccaccggcccuggcaguccuacuucgaccugauccucguggacgcccgcaagccgcuguucuucggggagggcaccgugcugcggcaggucgacacgaagaccgggaagcucaagaucggcaccuacaccggcccccugcagcacgggaucguguacagcggcggguccagcgacacgaucugcgaccugcucggcgccaaggggaaggacauccuguacaucggcgaccacaucuucggcgacauccucaagagcaagaagcgccagggguggcggaccuuccuggugauccccgagcuggcccaggagcugcacgucuggaccgacaaguccagccucuucgaggagcugcagucccuggacaucuuccucgcggagcuguacaagcaccuggacagcuccagcaacgagcgccccgacaucuccagcauccagcggcgcaucaagaaggugacccacgacauggacaugugcuacggcaugauggggucccucuuccgcagcggcucccggcagacgcuguucgccagccaggugaugcgcuacgccgaccuguacgccgccuccuucaucaaccugcucuacuacccguucagcuaccuguuccgggcggcccacguccugaugccccacgaguccaccguggagcacacccacgucgacaucaacgagauggagagcccccucgccacccgcaaccggacguccguggacuucaaggacaccgacuacaagcgccaccagcugacccggagcaucuccgagaucaagcccccgaaccuguucccccucgcgccccaggagaucacccacugccacgacgaggacgacgacgaggaggaggaggaggaggaggaguga

SEQ ID NO: 33832 - RNA, 1011 nt, Artificial Sequence
  derived and/or modified sequence opt1 from NT5C3A__Homo_sapiens__NP_001002010
augcgcgcccccagcauggaccgggccgcgguggcccgcgucggcgccguggccuccgccagcgugugcgcgcuggucgccgggguggugcucgcccaguacaucuucacccugaagcggaagaccggccgcaagacgaagaucaucgagaugaugccggaguuccagaaguccagcguccggaucaagaaccccacccgcguggaggagaucaucugcgggcugaucaagggcggggccgcgaagcuccagaucaucaccgacuucgacaugacccugucccgguucagcuacaagggcaagcgcugccccacgugccacaacaucaucgacaacugcaagcuggugaccgacgagugccggaagaagcuccugcagcugaaggagaaguacuacgccaucgaggucgaccccgugcucaccguggaggagaaguacccguacauggucgagugguacaccaagucccacggccugcuggugcagcaggcccuccccaaggccaagcugaaggagaucguggccgagagcgacgucaugcugaaggagggguacgagaacuucuucgacaagcuccagcagcacuccauccccguguucaucuucagcgcgggcaucggggacgugcuggaggaggucauccgccaggccggcguguaccaccccaacgugaaggucguguccaacuucauggacuucgacgagacgggggugcugaagggcuucaagggcgagcucauccacgucuucaacaagcacgacggggcccugcggaacaccgaguacuucaaccagcugaaggacaacagcaacaucauccuccugggcgacucccagggggaccugcgcauggccgacggcguggccaacgucgagcacauccucaagaucggcuaccugaacgaccggguggacgagcugcucgagaaguacauggacagcuacgacaucgugcugguccaggacgagucccuggagguggcgaacagcauccuccagaagauccuguga

SEQ ID NO: 33833 - RNA, 486 nt, Artificial Sequence
  derived and/or modified sequence opt1 from NT5C__Homo_sapiens__NP_001239306
auggcccgcagcgugcggguccugguggacauggacggcgugcucgccgacuucgaggcggggcugcugcgcggcuuccggcgccgguuccccgaggagccccacgucccccucgagcagcgccggggguuccuggcccgcgagcaguaccgggcccugcgccccgaccucgccgacaagguggccuccguguacgaggcgcccggcuucuuccuggaccuggagccgauccccggggcccucgacgccguccgggagaugaacgaccugcccgacacccagguguucaucugcaccagcccccugcucaaguaccaccacugcgugggcgagaaggaggagaccccguccugggagcacauccuguucacgugcugccacaaccgccaccugguccucccgcccacccggcgccggcugcugagcugguccgacaacuggcgcgagauccucgacagcaagcggggcgccgcgcagcgcgaguga

SEQ ID NO: 33834 - RNA, 1368 nt, Artificial Sequence
  derived and/or modified sequence opt1 from NT5DC1__Homo_sapiens__NP_689942
auggcccagcacuucagccuggccgcgugcgacguggucggcuucgaccucgaccacacccugugccgcuacaaccugcccgaguccgcgccccucaucuacaacagcuucgcccaguuccuggugaaggagaagggguacgacaaggagcugcucaacgugacccccgaggacugggacuucugcugcaagggccuggcccuggaccucgaggacgggaacuuccugaagcuggccaacaacggcacgguccuccgggccucccacgggaccaagaugaugacccccgaggugcuggccgaggccuacggcaagaaggaguggaagcacuuccugagcgacaccggcauggccugccgcuccgggaaguacuacuucuacgacaacuacuucgaccuccccggcgcgcugcugugcgcccggguggucgacuaccucacgaagcugaacaacgggcagaagaccuucgacuucuggaaggacaucguggccgccauccagcacaacuacaagaugagcgccuucaaggagaacugcggcaucuacuucccggagaucaagcgcgaccccgggcgguaccugcacuccugccccgagagcgugaagaaguggcuccgccagcugaagaacgcgggcaagauccugcuccugaucaccuccagccacuccgacuacugccggcugcucugcgaguacauccugggcaacgacuucaccgaccuguucgacaucgucaucacgaacgcccucaagcccggguucuucagccaccucccgucccagcgccccuuccggacccuggagaacgacgaggagcaggaggcccugcccagccuggacaagcccggcugguacucccaggggaacgccgugcaccuguacgagcuccugaagaagaugaccggcaagccggagcccaagguggucuacuucggcgacagcaugcacuccgacaucuuccccgcccgccacuacagcaacugggagaccgugcugauccucgaggagcugcgcggggacgagggcacgcggucccagcggcccgaggagagcgagccgcuggagaagaaggggaaguacgagggccccaaggcgaagccccucaacaccagcuccaagaagugggggagcuucuucaucgacuccgugcugggccuggagaacaccgaggacagccucgucuacaccugguccugcaagcgcaucagcacguacuccaccaucgccauccccagcaucgaggccaucgccgagcugccgcuggacuacaaguucacccgguucuccagcuccaacagcaagaccgccggcuacuaccccaacccgccccucgugcuguccagcgacgagacgcugaucuccaaguga

SEQ ID NO: 33835 - RNA, 1647 nt, Artificial Sequence
  derived and/or modified sequence opt1 from NT5DC3__Homo_sapiens__NP_001026871
augaccauggccgccgcggccguggucgcccgcggcgccggggcccgggcggccaccgccgccgcgcugcgcggcgggugcggcaccgccgcccgggggcgccccugcgccggcccggcccggccccucugcaccgcgcccggcaccgcccccgacaugaagcgcuaccugugggagcgguaccgcgaggccaagcggagcaccgaggagcuggugccguccaucaugagcaaccuccugaaccccgacgccaucuucuccaacaacgagaugagccuguccgacaucgagaucuacggguucgacuacgacuacacgcucguguucuacagcaagcaccuccacacccugaucuucaacgccgcgcgcgaccugcugaucaacgagcaccgguaccccgccgagauccgcaaguacgaguacgaccccaacuucgccauccggggccugcacuacgacguccagcgcgccgugcucaugaagaucgacgccuuccacuacauccagcuggggaccguguaccggggccuguccgucgugccggacgaggaggugaucgagauguacgaggggagccacgucccccucgagcagauguccgacuucuacggcaagagcucccacggcaacaccaugaagcaguucauggacaucuucagccugcccgagaugacgcugcucuccugcgugaacgaguacuuccugaagaacaacaucgacuacgagcccgugcaccuguacaaggacgucaaggacagcauccgcgacgugcacaucaaggggaucauguaccgggcgaucgaggccgacaucgagaaguacaucugcuacgccgagcagacccgcgccgugcucgccaagcuggcggaccacggcaagaagauguuccugaucaccaacuccccgagcuccuucgucgacaaggggaugagcuacaucgugggcaaggacuggcgggaccucuucgacguggucaucgugcaggccgagaagcccaacuucuucaacgacaagcgccggcccuuccgcaagaugaacgagaagggcgugcugcugugggacaagauccacaagcuccagaaggggcagaucuacaagcagggcaaccuguacgaguuccugaagcucaccggguggcgcggcucccggguccuguacuucggggaccacaucuacagcgaccuggccgaccucacgcugaagcacggcuggcgcaccggcgccaucauccccgagcugcggagcgagcucaagaucaugaacaccgagcaguacauccagaccaugacguggcugcagacccugaccgggcuccuggagcagaugcagguccaccgcgacgcggagucccagcuggugcuccaggaguggaagaaggagcggaaggagaugcgcgagaugaccaagagcuucuucaacgcccaguucggcucccuguuccggacggaccagaacccgaccuacuuccugcgccggcucagccgcuucgccgacaucuacauggccucccugagcugccugcucaacuacgacgugucccacaccuucuacccccggcgcacgccccugcagcacgagcugcccgccuggagcgagcggccgcccaccuucgggacgccccugcuccaggaggcgcaggccaaguga

SEQ ID NO: 33836 - RNA, 1575 nt, Artificial Sequence
  derived and/or modified sequence opt1 from NT5E__Homo_sapiens__NP_001191742
augugcccccgcgccgcccgggcgccggccacccugcuccuggcccugggcgccgugcucuggcccgccgcgggggccugggagcugaccauccugcacacgaacgacguccacagccgccucgagcagaccuccgaggacagcuccaagugcgugaacgccagccggugcaugggcgggguggcccgccuguucaccaagguccagcagauccggcgcgcggagcccaacgugcugcuccuggacgccggcgaccaguaccaggggaccaucugguucacgguguacaagggcgccgaggucgcccacuucaugaacgcccugcgguacgacgcgauggcccucggcaaccacgaguucgacaacgggguggagggccugaucgagccccugcucaaggaggccaaguucccgauccuguccgccaacaucaaggccaaggggccccuggcgagccagaucuccggccucuaccugcccuacaaggugcugcccgucggggacgagguggugggcaucgucggcuacaccagcaaggagaccccguuccucuccaaccccgggaccaaccugguguucgaggacgagaucacggcccugcagcccgagguggacaagcucaagacccugaacgucaacaagaucaucgcccugggccacagcggguucgagauggacaagcucaucgcccagaaggugcgcggcguggacgucguggugggcgggcacuccaacaccuuccuguacaccggcaacccgcccagcaaggagguccccgccgggaaguaccccuucaucgugacguccgacgacggccggaaggugcccgucgugcaggcguacgccuucgggaaguaccugggcuaccucaagaucgaguucgacgagcgcggcaacgucaucagcucccacgggaacccgauccugcugaacagcuccauccccgaggaccccagcaucaaggccgacaucaacaaguggcggaucaagcucgacaacuacuccacccaggagcugggcaagaccaucguguaccuggacgggagcagccaguccugccgcuuccgggagugcaacaugggcaaccucaucugcgacgccaugaucaacaacaaccugcgccacaccgacgagauguucuggaaccacgugagcaugugcauccugaacgggggcggcauccggucccccaucgacgagcgcaacaacgggauccacgucguguacgaccucagccggaagccgggcgaccgcguggucaagcuggacgugcugugcacgaagugccgggugcccuccuacgacccccucaagauggacgaggucuacaaggugauccugcccaacuuccuggccaacgggggcgacggguuccagaugaucaaggacgagcuccugcgccacgacagcggcgaccaggacaucaacguggucuccaccuacaucagcaagaugaaggugaucuacccggcgguggagggccggaucaaguucuccaccgggagccacugccacggcuccuucagccugaucuuccucucccugugggccgucaucuucgugcuguaccaguga

SEQ ID NO: 33837 - RNA, 687 nt, Artificial Sequence
  derived and/or modified sequence opt1 from NT5M__Homo_sapiens__NP_064586
augauccgccugggcggguggugcgcccggcgccucugcagcgccgcggugcccgccggccggcgcggggccgccggcgggcugggccuggccggcgggcgggcgcuccgcguccugguggacauggacggcgugcuggccgacuucgagggcggguuccuccggaaguuccgcgcccgguucccggaccagcccuucaucgcccuggaggaccgccggggguucugggucuccgagcaguacggccgccugcggcccggccucagcgagaaggcgaucuccaucugggagagcaagaacuucuucuucgagcuggagccccugccgggggccguggaggccgugaaggagauggccucccuccagaacaccgacgucuucaucugcaccagccccaucaagauguucaaguacugccccuacgagaaguacgccuggguggagaaguacuucggccccgacuuccuggagcagaucgugcugacgcgcgacaagaccgucguguccgcggaccuccugaucgacgaccggccggacaucaccggggccgagcccacccccagcugggagcacgugcuguucacggccugccacaaccagcaccuccagcugcagcccccgcgccggcgccugcacuccugggccgacgacuggaaggccauccucgacagcaagcggcccugcuga

SEQ ID NO: 33838 - RNA, 933 nt, Artificial Sequence
  derived and/or modified sequence opt1 from NTAN1__Homo_sapiens__NP_775745
augccccugcucguggagggccgccggguccgccugccgcagagcgccggggaccuggugcgggcccacccgccccucgaggagcgcgcgcggcugcugcgcggccaguccgugcagcaggucgggccccagggccuccuguacgugcagcagcgggagcuggccgugaccagccccaaggacggguccaucagcauccucggcuccgacgacgccaccacgugccacaucgucgugcugcgccacaccggcaacggggcgaccugccugacccacugcgacggcacggacaccaaggccgaggugccccucaucaugaacagcaucaaguccuucagcgaccacgcccagugcgggcggcuggagguccaccuggugggcggguucuccgacgaccgccagcucagccagaagcugacccaccagcugcucuccgaguucgaccggcaggaggacgacauccaccuggugacccugugcgucacggagcucaacgaccgcgaggagaacgagaaccacuuccccgugaucuacggcaucgccgugaacaucaagaccgccgagaucuaccgggccagcuuccaggaccgcggccccgaggagcagcugcgggcggcccgcacccuggccgggggcccgaugaucuccaucuacgacgccgagaccgagcagcuccggaucgggcccuacagcuggacgcccuucccccacgucgacuucuggcugcaccaggacgacaagcagauccuggagaaccucuccaccagcccgcuggccgagccgccccacuucguggagcacauccgcuccacccugauguuccucaagaagcaccccagccccgcgcacacccuguucuccggcaacaaggcccugcucuacaagaagaacgaggacggccugugggagaagaucagcagccccggguccuga

SEQ ID NO: 33839 - RNA, 813 nt, Artificial Sequence
  derived and/or modified sequence opt1 from NTF3__Homo_sapiens__NP_001096124
auggugaccuucgccaccauccugcaggucaacaaggugaugagcauccucuucuacgugaucuuccuggccuaccugcgcggcauccaggggaacaacauggaccagcggucccuccccgaggacagccugaacucccugaucaucaagcucauccaggcggacauccugaagaacaagcugagcaagcagauggucgacgugaaggagaacuaccaguccacgcucccgaaggccgaggcgccccgcgagcccgagcggggcgggcccgccaagagcgccuuccagccggugaucgccauggacaccgagcugcugcgccagcagcggcgcuacaacagcccccggguccuccuguccgacuccacgccccuggagcccccgccccucuaccugauggaggacuacgugggcagccccguggucgccaaccgcaccucccggcgcaagcgguacgccgagcacaagagccaccgcggggaguacuccgugugcgacagcgagucccugugggugaccgacaagagcuccgccaucgacauccggggccaccaggucaccgugcucggcgagaucaagaccgggaacagccccgugaagcaguacuucuacgagacccgcugcaaggaggcgcggccggucaagaacggcugccgcgggaucgacgacaagcacuggaacucccagugcaagacgagccagaccuacgugcgggcccugaccagcgagaacaacaagcuggugggcuggcgcuggauccggaucgacaccuccugcgucugcgcccucagccgcaagaucgggcggacguga

SEQ ID NO: 33840 - RNA, 663 nt, Artificial Sequence
  derived and/or modified sequence opt1 from NTF4__Homo_sapiens__XP_011525310
augcgccaccacacccgggugcugcgcgagaugcucccccugccgagcugcucccugcccauccuccugcuguuccuccugcccagcguccccaucgagucccagccgccgcccagcacccugcccccguuccucgcccccgagugggaccugcugagcccccggguggugcucagccgcggcgcccccgcggggccgccccugcuguuccuccuggaggccggcgccuuccgggaguccgccggggcccccgcgaaccgcucccggcgcggcgucuccgagacggcccccgccagccggcgcggggagcuggccgugugcgacgcgguguccggcugggucaccgaccggcgcaccgccguggaccuccggggccgcgagguggagguccugggggaggugcccgccgccggcgggagcccccugcggcaguacuucuucgagacccgcugcaaggccgacaacgcggaggagggcgggcccggcgccggcgggggcgggugccggggcguggaccgccggcacugggucuccgagugcaaggccaagcagagcuacgugcgcgcccucacggccgacgcgcagggccgggugggguggcgcuggauccgcaucgacaccgccugcgucugcacccugcugucccggaccggccgcgccuga

SEQ ID NO: 33841 - RNA, 939 nt, Artificial Sequence
  derived and/or modified sequence opt1 from NTHL1__Homo_sapiens__NP_002519
augugcagcccccaggaguccggcaugaccgcccugagcgcccgcaugcucacccggucccgcagccuggggccgggcgcggggccccggggcugccgcgaggagcccgggccccugcggcgccgggaggccgccgccgaggcccgcaagucccacagcccggugaagcggccccgcaaggcgcagcggcuccgcgucgccuacgagggcuccgacagcgagaagggcgagggggccgagccccugaaggugcccgugugggagccgcaggacuggcagcagcagcuggucaacauccgggccaugcgcaacaagaaggacgcgcccguggaccaccucggcacggagcacugcuacgacuccagcgccccgcccaaggugcggcgcuaccagguccugcugucccucaugcugagcucccagaccaaggaccaggugaccgccggggccaugcagcggcugcgcgcccggggccucaccguggacagcauccugcagacggacgacgcgacccuggggaagcucaucuaccccgucggcuucuggcgcuccaaggugaaguacaucaagcagaccagcgccauccugcagcagcacuacggcggggacauccccgccuccguggccgagcuggucgcccuccccggcguggggcccaagauggcgcaccuggccauggccguggccuggggcaccgucagcggcaucgccguggacacgcacgugcaccggaucgcgaaccgccugcgcuggaccaagaaggccaccaaguccccggaggagacccgggccgcccucgaggaguggcugccccgcgagcuguggcacgagaucaacgggcuccuggucggcuucgggcagcagacgugccugcccgugcacccccggugccacgccugccucaaccaggcgcugugcccggccgcccagggccuguga

SEQ ID NO: 33842 - RNA, 1035 nt, Artificial Sequence
  derived and/or modified sequence opt1 from NTM__Homo_sapiens__NP_001041674
augaagaccauccagcccaagaugcacaacagcaucuccugggccaucuucaccggccuggccgcgcucugccuguuccagggggugccgguccgcagcggcgacgccacguuccccaaggccauggacaacgugaccgugcggcagggggaguccgccacccugcgcugcaccaucgacaaccgggucacgcgcguggccuggcucaaccggagcaccauccuguacgcgggcaacgacaaguggugccuggacccccgcgugguccuccuguccaacacccagacccaguacagcaucgagauccagaacguggacguguacgacgaggggcccuacacgugcuccguccagaccgacaaccacccgaagaccagccgggugcaccugaucgugcaggucucccccaagaucguggagaucagcuccgacaucagcaucaacgagggcaacaacaucucccugaccugcaucgccacgggccgccccgagcccaccgugaccuggcggcacaucagcccgaaggccgucggguucguguccgaggacgaguaccuggagauccagggcaucacccgcgagcagagcggggacuacgagugcuccgccagcaacgacguggcggcccccgucgugcggcgcgugaaggucacggugaacuacccgcccuacaucuccgaggccaagggcaccggggugcccgucggccagaagggcacccugcagugcgaggccagcgccgugcccagcgcggaguuccagugguacaaggacgacaagcggcucaucgaggggaagaagggcgucaagguggagaaccgccccuuccuguccaagcugaucuucuucaacgugagcgagcacgacuacgggaacuacacgugcgucgccuccaacaagcucggccacaccaacgccagcaucaugcuguucggccccggggccguguccgaggugagcaacggcaccucccggcgcgccgggugcgucuggcugcucccgcugcuggugcuccaccuccugcucaaguucuga

SEQ ID NO: 33843 - RNA, 1815 nt, Artificial Sequence
  derived and/or modified sequence opt1 from NTN1__Homo_sapiens__XP_006721658
augaugcgcgccgugugggaggcccuggcggcccucgccgccgucgccugccuggugggcgcggugcgcgggggccccgggcugagcauguucgccggccaggccgcccagccggaccccugcuccgacgagaacgggcacccccggcggugcauccccgacuucgucaacgcggccuucggcaaggacgugcgcgugagcuccacgugcggccggccgcccgcccgcuacugcgucgugagcgagcgcggggaggagcggcuccgguccugccaccugugcaacgccagcgaccccaagaaggcccacccgcccgcguuccugaccgaccucaacaacccccacaaccugaccugcuggcaguccgagaacuaccugcaguucccccacaacgugacccucacccugagccugggcaagaaguucgaggucaccuacgugucccuccaguucugcagcccccgcccggaguccauggccaucuacaagagcauggacuacgggcggacgugggugcccuuccaguucuacuccacccagugccgcaagauguacaaccggccccaccgcgcccccaucaccaagcagaacgagcaggaggccgucugcaccgacagccacacggacaugcggccgcuguccggcgggcugaucgccuucagcacccucgacggccgccccuccgcgcacgacuucgacaacagccccgugcugcaggacugggugaccgccaccgacauccgggucgccuucucccgccugcacacguucggcgacgagaacgaggacgacagcgagcucgcccgggacagcuacuucuacgccguguccgaccugcaggucgggggccgcugcaagugcaacgggcacgcggcccggugcgugcgcgaccgcgacgacagccuggugugcgacugccggcacaacaccgccggccccgagugcgaccgcugcaagccguuccacuacgaccggcccuggcagcgcgccaccgcccgggaggcgaacgagugcguggccugcaacugcaaccuccacgcccgccggugccgcuucaacauggagcuguacaagcuguccggccgcaagagcgggggcgucugccucaacugccggcacaacaccgccgggcggcacugccacuacugcaaggagggcuacuaccgcgacauggggaagcccaucacgcaccggaaggcgugcaaggccugcgacugccaccccgugggcgccgccggcaagaccugcaaccagaccaccgggcagugcccgugcaaggacggcgugacggggaucacgugcaaccgcugcgccaagggcuaccagcagucccggagccccaucgcgcccugcaucaagauccccgucgccccgcccaccaccgccgccuccagcguggaggagcccgaggacugcgacuccuacugcaaggccagcaaggggaagcugaagaucaacaugaagaaguacugcaagaaggacuacgcgguccagauccacauccugaaggccgacaaggccggcgacugguggaaguucaccgugaacaucaucuccguguacaagcagggcaccagccgcauccggcgcggggaccagucccucuggauccggagccgcgacaucgccugcaagugcccgaagaucaagccccugaagaaguaccugcuccugggcaacgccgaggacucccccgaccagagcgggaucgucgcggacaaguccagccuggugauccaguggcgcgacaccugggcccggcgccuccggaaguuccagcagcgcgagaagaagggcaagugcaagaaggccuga

SEQ ID NO: 33844 - RNA, 1887 nt, Artificial Sequence
  derived and/or modified sequence opt1 from NTN4__Homo_sapiens__NP_067052
augggcagcugcgcccgccugcuccugcugugggggugcaccguggucgccgcgggccucuccgggguggccggcgugagcucccggugcgagaaggccugcaacccccgcauggggaaccuggcccugggccggaagcucugggccgacaccacgugcggccagaacgcgaccgagcuguacugcuucuacagcgagaacaccgaccugaccugccgccagccgaagugcgacaagugcaacgccgccuacccccaccucgcccaccuccccuccgcgauggccgacagcuccuuccgguucccccgcacgugguggcagagcgccgaggacguccaccgggagaagauccagcuggaccuggaggccgaguucuacuucacccaccugaucgugauguucaaguccccgcgccccgccgcgauggugcuggaccggagccaggacuucgggaagaccuggaagcccuacaaguacuucgccaccaacugcuccgccacguucggccucgaggacgacgucgugaagaagggggccaucugcaccagcaaguacuccagccccuucccgugcaccggcggggaggugaucuucaaggcccuguccccgcccuacgacaccgagaaccccuacagcgcgaagguccaggagcagcugaagaucacgaaccuccgcgugcagcugcugaagcggcaguccugccccugccagcgcaacgaccucaacgaggagccccagcacuucacccacuacgccaucuacgacuucaucgugaagggcagcugcuucugcaacggccacgccgaccagugcauccccguccacggguuccggcccgugaaggccccgggcaccuuccacauggugcacgggaagugcaugugcaagcacaacaccgccggcucccacugccagcacugcgcgccccuguacaacgaccgccccugggaggccgccgacggcaagacgggggcccccaacgagugccggaccugcaagugcaacggccacgccgacacgugccacuucgacgucaacgugugggaggcgagcgggaaccgcagcggcggggugugcgacgacugccagcacaacaccgagggccaguacugccagcggugcaagccgggcuucuaccgcgaccugcggcgccccuucuccgcccccgacgccugcaagcccugcagcugccacccggucggguccgccgugcuccccgcgaacagcgugaccuucugcgaccccuccaacggcgacugccccugcaagccgggggucgccggccggcgcugcgaccgcugcauggugggguacuggggcuucggcgacuacgggugccggcccugcgacugcgccggcagcugcgaccccaucaccggggacugcaucuccagccacaccgacaucgacugguaccacgaggugccggacuuccgccccguccacaacaaguccgagcccgccugggagugggaggacgcccagggcuucagcgcgcugcugcacuccgggaagugcgagugcaaggagcagacccucggcaacgccaaggccuucugcggcaugaaguacagcuacgugcugaagaucaagauccuguccgcccacgacaaggggacgcacgucgaggugaacgugaagaucaagaagguccucaagagcaccaagcugaagaucuuccggggcaagcgcacccuguaccccgaguccuggaccgaccgggggugcacgugcccgauccucaaccccggccuggaguaccugguggccggccacgaggacauccgcaccgggaagcucaucgugaacaugaaguccuucguccagcacuggaagcccagccugggccggaaggugauggacauccugaagcgcgagugcaaguga

SEQ ID NO: 33845 - RNA, 1578 nt, Artificial Sequence
  derived and/or modified sequence opt1 from NTNG1__Homo_sapiens__XP_011539324
auguaccugagccgcuuccucuccauccacgcccugugggugaccgucagcuccgugaugcagcccuacccccugguguggggccacuacgaccucugcaagacccagaucuacacggaggaggggaaggucugggacuacauggccugccagcccgagagcaccgacaugaccaaguaccugaaggugaagcuggacccgcccgacaucacgugcggcgacccgcccgagaccuucugcgcgauggggaaccccuacaugugcaacaacgagugcgacgccuccacccccgagcucgcccacccgcccgagcugauguucgacuucgagggccggcaccccagcaccuucuggcaguccgccaccuggaaggaguaccccaagccgcuccaggugaacaucacgcugagcugguccaagaccaucgagcugaccgacaacaucgucaucaccuucgagagcgggcgccccgaccagaugauccuggagaagucccucgacuacggccggacguggcagcccuaccaguacuacgccaccgacugccuggacgcguuccacauggaccccaagagcgugaaggaccugucccagcacaccgugcucgagaucaucugcaccgaggaguacagcacgggcuacaccaccaacuccaagaucauccacuucgagaucaaggaccgcuucgccuucuucgccgggccgcggcugcgcaacauggccagccuguacggccagcucgacaccacgaagaagcugcgggacuucuucaccgucaccgaccugcgcauccggcuccugcgccccgcggugggggagaucuucguggacgagcugcaccucgcccgguacuucuacgccaucuccgacaucaagguccgcggccggugcaagugcaaccugcacgccaccgugugcguguacgacaacagcaagcugacgugcgagugcgagcacaacaccaccgggcccgacugcggcaagugcaagaagaacuaccagggccgccccugguccccggggagcuaccuccccauccccaagggcaccgccaacacgugcauccccagcaucuccagcaucgggaacccgcccaaguucaaccggaucuggcccaacaucuccagccuggaggucuccaaccccaagcaggucgcgccgaagcuggcccucagcaccguguccagcguccagguggccaaccacaagcgcgagugcuacugcaacccccugggcuccauccacgaccggugcaacggcagcggguucugcgagugcaagaccggcaccacggggcccaagugcgacgagugccugccgggcaacuccuggcacuacgggugccagcccaacgugugcgacaacgagcuccugcacugccagaacggcgggaccugccacaacaacgugcgcugccugugccccgccgccuacaccggcauccucugcgagaagcugcggugcgaggaggcgggcagcugcggguccgacagcggccagggggccccgccccacggcucccccgcccugcuccugcugaccacgcuccugggcaccgccagcccccugguguucuga

SEQ ID NO: 33846 - RNA, 1593 nt, Artificial Sequence
  derived and/or modified sequence opt1 from NTNG2__Homo_sapiens__NP_115925
augcugcaccuccuggcccuguuccuccacugccugccccuggccagcggcgacuacgacaucugcaaguccugggugaccaccgacgaggggccgacgugggaguucuacgcgugccagcccaaggucaugcgccucaaggacuacgugaaggugaaggucgagcccagcggcaucacgugcggggacccgcccgagcgguucugcucccacgagaaccccuaccugugcagcaacgagugcgacgccuccaaccccgaccuggcccacccgccccgccucauguucgacaaggaggaggagggccuggccaccuacuggcagagcaucaccuggucccgguaccccagcccccuggaggccaacaucacccucuccuggaacaagaccguggagcugaccgacgacguggucaugaccuucgaguacgggcgccccacggugauggugcuggagaagucccucgacaacggccggaccuggcagccguaccaguucuacgcggaggacugcauggaggccuucggcaugagcgcccgccgggcccgcgacaugagcuccagcuccgcgcaccggguccugugcaccgaggaguacagccgcugggccggguccaagaaggagaagcacgugcgguucgaggugcgcgaccgguucgccaucuucgccggccccgaccugcgcaacauggacaaccucuacacccggcuggagagcgccaaggggcugaaggaguucuucacgcucaccgaccugcgcaugcggcugcuccgccccgcgcugggcgggaccuacguccagcgggagaaccuguacaaguacuucuacgccaucuccaacaucgaggugaucggccgcugcaagugcaaccuccacgccaaccugugcagcaugcgggagggcagccugcagugcgagugcgagcacaacaccacggggcccgacugcggcaagugcaagaagaacuuccgcacccgcuccuggcgggccgggagcuaccucccgcugccccacggcucccccaacgccugcgcgaccgccggcagcuucgggaacugcgagugcuacggccacuccaaccgcugcagcuacaucgacuuccugaacguggugaccugcgucuccugcaagcacaacacgcgggggcagcacugccagcacugccgccucggcuacuaccggaacgggagcgccgagcuggacgacgagaacgugugcaucgagugcaacugcaaccagaucggcuccguccacgaccgcugcaacgagaccggcuucugcgagugccgggagggggccgccggccccaagugcgacgacugccugccgacccacuacuggcgccaggggugcuaccccaacgugugcgacgacgaccagcuccugugccagaacggcgggaccugccugcagaaccagcggugcgcgugcccccgcggcuacacgggcgugcggugcgagcagccccgcugcgacccggccgacgacgacgggggccucgacugcgaccgggcccccggggccgcgccccgccccgccacccugcugggcugccuccugcugcucgggcuggccgcccggcugggccgcuga

SEQ ID NO: 33847 - RNA, 573 nt, Artificial Sequence
  derived and/or modified sequence opt1 from NTPCR__Homo_sapiens__NP_115700
auggcccgccacguguuccugaccgggcccccgggggucggcaagaccacgcucauccacaaggccagcgaggugcugaaguccagcggggugcccgucgacggcuucuacaccgaggaggugcggcagggcggccgccggaucggcuucgacguggucacccuguccgggacccgcggcccccucagccggguggggcuggagcccccgcccggcaagcgcgagugccggguggggcaguacgucguggaccugacguccuucgagcagcucgcgcugcccgugcugcgcaacgccgacugcagcuccggccccggccagcgggucugcgugaucgacgagaucgggaagauggagcuguucagccagcuguucauccaggccgugcgccagacccucuccaccccgggcaccaucauccucgggacgauccccguccccaagggcaagccccuggcccugguggaggagauccggaaccgcaaggacgugaaggucuucaacgugaccaaggagaaccggaaccaccuccugccggacaucgugaccugcguccagagcucccgcaaguga

SEQ ID NO: 33848 - RNA, 2283 nt, Artificial Sequence
  derived and/or modified sequence opt1 from NTRK1__Homo_sapiens__NP_001007793
augaaggaggccgcccugaucugccucgcgcccagcgugccgcccauccugaccgucaaguccugggacaccaugcagcugcgcgccgcccggagccgcugcacgaaccuccuggccgccuccuacaucgagaaccagcagcaccuccagcaccuggagcugcgggaccugcgcggccucggggagcugcggaaccugaccaucgucaagagcggccuccgcuucguggcgcccgacgccuuccacuucacgccccggcugucccgccugaaccucagcuucaacgcccuggagucccugagcuggaagaccguccaggggcucucccugcaggagcuggugcucagcggcaacccccugcacugcuccugcgcccugcgguggcuccagcgcugggaggaggaggggcugggcggcgugcccgagcagaagcugcagugccacgggcagggcccccucgcgcacaugcccaacgccagcugcggggucccgacccugaagguccaggugcccaacgccuccguggacgugggcgacgacgugcugcuccggugccaggucgaggggcgcggccuggagcaggccggcuggauccugaccgagcucgagcagagcgccaccgugaugaaguccgggggccugcccagccuggggcucacccuggcgaacgugacguccgaccugaaccggaagaacgugaccugcugggccgagaacgacgugggccgcgccgaggugagcguccaggugaacguguccuuccccgccagcguccagcuccacaccgccguggagaugcaccacuggugcaucccguucagcguggacggccagcccgcgcccucccugcgguggcuguucaacgggagcguccucaacgagaccuccuucaucuucacggaguuccuggagcccgccgccaacgagaccgugcgccacggcugccugcggcucaaccagccgacccacgucaacaacgggaacuacacccugcuggccgccaaccccuucggccaggcgagcgccuccaucauggccgccuucauggacaaccccuucgaguucaaccccgaggacccgauccccgacacgaacagcaccuccggggaccccguggagaagaaggacgagacccccuucggcgugagcgucgccgugggccucgcgguguucgccugccuguuccuguccacccugcuccugguccugaacaagugcgggcgccggaacaaguucggcaucaaccgcccggccgugcucgcccccgaggacgggcuggcgaugagccugcacuucaugacgcucggcggguccagccugucccccaccgagggcaagggcagcgggcugcagggccacaucaucgagaacccccaguacuucuccgacgccugcgugcaccacaucaagcggcgcgacaucguccucaagugggagcugggggagggcgccuucgggaagguguuccuggccgagugccacaaccuccugccggagcaggacaagaugcugguggccgucaaggcgcucaaggaggccagcgaguccgcccgccaggacuuccagcgggaggccgagcugcugaccaugcuccagcaccagcacaucgugcgcuucuucggcgugugcaccgagggccggccccugcugauggucuucgaguacaugcgccacggggaccucaaccgguuccugcgcagccacggccccgacgccaagcugcucgccgggggcgaggacguggcgccgggcccccuggggcugggccagcuccuggccguggccucccaggucgccgcggggaugguguaccuggccggccuccacuucgugcaccgggaccuggccacgcgcaacugccuggucgggcagggccucguggugaagaucggcgacuucgggaugagccgggacaucuacagcaccgacuacuaccgcgucggcgggcggaccaugcugcccauccgcuggaugcccccggaguccauccuguaccggaaguucaccacggagagcgacgugugguccuucggcgugguccucugggagaucuucaccuacgggaagcagcccugguaccagcugagcaacaccgaggccaucgacugcaucacccagggccgcgagcuggagcggccccgcgcgugcccgcccgagguguacgccaucaugcggggcugcuggcagcgcgagccccagcagcggcacuccaucaaggacgugcacgcccgccuccaggcccuggcccaggcgccgcccgucuaccuggacgugcucggguga

SEQ ID NO: 33849 - RNA, 1662 nt, Artificial Sequence
  derived and/or modified sequence opt1 from NTRK2__Homo_sapiens__NP_001018075
augagcuccuggauccgcuggcacggccccgccauggcccggcuguggggguucugcuggcucguggucggcuucuggcgcgcggccuucgccugcccgaccagcugcaagugcuccgccagccggaucuggugcuccgaccccagccccgggaucguggccuucccccgccuggagccgaacuccguggaccccgagaacaucaccgagaucuucaucgcgaaccagaagcggcuggagaucaucaacgaggacgacgucgaggccuacgugggccuccgcaaccugacgaucguggacagcgggcugaaguucgucgcccacaaggccuuccucaagaacuccaaccugcagcacaucaacuucacccggaacaagcugaccagccucucccgcaagcacuuccggcaccuggaccugagcgagcucauccuggugggcaaccccuucacgugcuccugcgacaucauguggaucaagacccugcaggaggccaagagcucccccgacacccaggaccucuacugccugaacgagagcuccaagaacaucccgcuggcgaaccuccagauccccaacugcggccugcccagcgccaaccuggccgcccccaaccucaccguggaggaggggaaguccaucacccugagcugcagcgucgcgggcgacccggugcccaacauguacugggacguggggaaccuggucuccaagcacaugaacgagacgagccacacccagggcucccuccgcaucaccaacaucagcuccgacgacagcgggaagcagaucuccugcguggccgagaaccuggugggcgaggaccaggacagcgucaaccugaccgugcacuucgcccccacgaucaccuuccucgagucccccaccagcgaccaccacuggugcaucccguucaccgugaagggcaaccccaagcccgcccugcagugguucuacaacggggccauccugaacgaguccaaguacaucugcacgaagauccacgucaccaaccacaccgaguaccacggcugccuccagcuggacaaccccacccacaugaacaacggggacuacacgcugaucgcgaagaacgaguacggcaaggacgagaagcagaucagcgcccacuucaugggcuggccggggaucgacgacggcgccaaccccaacuaccccgacgugaucuacgaggacuacgggaccgccgccaacgacaucggcgacaccaccaaccgguccaacgagauccccagcacggacgugaccgacaagaccgggcgcgagcaccucuccgucuacgcggugguggucaucgccagcguggucggcuucugccugcuggugaugcuguuccuccugaagcucgcccggcacuccaaguucggcaugaaggacuucagcugguucggguucggcaaggugaagucccgccagggggucggcccggccagcgugaucagcaacgacgacgacuccgccagcccccugcaccacaucuccaacgggagcaacacccccuccagcuccgagggcggccccgacgcggugaucaucgggaugacgaagaucccggucaucgagaacccccaguacuucggcaucaccaacagccagcugaagcccgacaccuggccgcgggggucccccaagaccgccuga

SEQ ID NO: 33850 - RNA, 1839 nt, Artificial Sequence
  derived and/or modified sequence opt1 from NTRK3__Homo_sapiens__NP_001007157
auggacgugagccugugccccgccaagugcuccuucuggcgcaucuuccuccugggcagcgucuggcuggacuacgugggguccgugcucgccugcccggcgaacugcgucugcagcaagaccgagaucaacugccggcgccccgacgacggcaaccuguucccccugcucgaggggcaggacuccggcaacagcaacgggaacgccuccaucaacaucaccgacaucagccggaacaucacguccauccacaucgagaacuggcgcagccugcacacccugaacgccguggacauggagcucuacaccggccugcagaagcugaccaucaagaacuccggccuccggagcauccagccccgcgccuucgccaagaacccgcaccuccgguacaucaaccuguccagcaaccgccugacgacccuguccuggcagcuguuccagacccucagccugcgggagcugcagcucgagcagaacuucuucaacugcuccugcgacauccgcuggaugcagcuguggcaggagcagggggaggcgaagcugaacagccagaaccucuacugcaucaacgccgacggcucccagcugccccuguuccggaugaacaucagccagugcgaccuccccgagaucagcgugucccacgucaaccugaccgugcgcgagggggacaacgccgugaucacgugcaacggcagcgggagcccccugccggacgucgacuggaucgugaccggccuccaguccaucaacacccaccagaccaaccugaacuggacgaacgugcacgccaucaaccugacccucgucaacgugaccuccgaggacaacggcuucacccugacgugcaucgcggagaacguggucgggaugagcaacgccuccguggcccugaccguguacuacccgccccgggucgugagccucgaggagcccgagcugcgccuggagcacugcaucgaguucgugguccggggcaacccgccgcccacccuccacuggcugcacaacgggcagccccugcgcgaguccaagaucauccacguggaguacuaccaggagggcgagaucagcgagggcugccuccuguucaacaagcccacccacuacaacaacgggaacuacacgcugaucgccaagaacccccucggcaccgccaaccagaccaucaacgggcacuuccugaaggagcccuuccccgaguccaccgacaacuucauccuguucgacgaggugagccccacgccgcccaucaccgucacccacaagcccgaggaggacaccuucggcguguccaucgcggucgggcucgccgccuucgccugcgugcugcuggugguccuguucgugaugaucaacaaguacggccggcgcagcaaguucggcaugaaggggcccguggccgucaucuccggcgaggaggacagcgcgagcccccuccaccacaucaaccacgggaucacgacccccuccucccuggacgccggccccgacaccguggugaucgggaugacccggaucccggucaucgagaacccccaguacuuccgccagggccacaacugccacaagcccgacacguggguguucagcaacaucgacaaccacggcauccugaaccucaaggacaaccgggaccaccuggugccgagcacccacuacaucuacgaggagcccgagguccaguccggggaggugagcuacccccgcucccacggcuuccgcgagaucaugcugaaccccaucagccucccggggcacuccaagccccugaaccacggcaucuacguggaggacgucaacguguacuucagcaaggggcggcacggcuucuga

SEQ ID NO: 33851 - RNA, 513 nt, Artificial Sequence
  derived and/or modified sequence opt1 from NTS__Homo_sapiens__NP_006174
augauggccggcaugaagauccagcuggugugcaugcuccugcuggccuucagcuccuggagccucugcuccgacagcgaggaggagaugaaggcgcuggaggccgacuuccugaccaacaugcacaccuccaagaucagcaaggcccacguccccuccuggaagaugacgcuccugaacgugugcagccuggugaacaaccucaacuccccggccgaggagaccggggagguccacgaggaggagcugguggcccgccggaagcugcccaccgcgcucgacggcuucagccuggaggccaugcugaccaucuaccagcuccacaagaucugccacucccgcgccuuccagcacugggagcugauccaggaggacauccuggacacggggaacgacaagaacggcaaggaggaggugaucaagcggaagauccccuacauccucaagcgccagcuguacgagaacaagccccggcgcccguacauccugaagcgggacagcuacuacuacuga

SEQ ID NO: 33852 - RNA, 1257 nt, Artificial Sequence
  derived and/or modified sequence opt1 from NTSR1__Homo_sapiens__NP_002522
augcgccugaacagcuccgcccccggcaccccggggacccccgccgcggaccccuuccagcgggcccaggccggccucgaggaggcccugcuggcccccggguucggcaacgcgagcgggaacgccuccgagcgcgugcucgccgccccgagcuccgagcuggacgucaacacggacaucuacagcaaggugcuggugaccgcggucuaccucgcccuguucguggugggcaccgucggcaacaccgugacggccuucacccuggcccggaagaagucccuccagagccugcaguccaccgugcacuaccaccuggggagccucgcccuguccgaccugcucacccugcugcucgcgaugcccgucgagcuguacaacuucaucugggugcaccaccccugggccuucggcgacgccgggugccgcggcuacuacuuccugcgggacgccugcacguacgccaccgcgcucaacguggccagccuguccgucgagcgcuaccuggccaucugccaccccuucaaggccaagacccucaugagccggucccgcaccaagaaguucaucagcgccaucuggcuggcguccgcccugcucgccgugccgaugcuguucacgaugggggagcagaaccggagcgccgacggccagcacgccggcgggcuggugugcacccccaccauccacaccgcgacggucaagguggugauccaggucaacaccuucauguccuucaucuuccccaugguggugaucagcguccucaacaccaucaucgccaacaagcugaccgugauggugcgccaggccgccgagcagggccaggucugcacggucgggggcgagcacagcaccuucuccauggcgaucgagcccggccgggugcaggcccugcgccacggggugcgggugcuccgcgccgucgugaucgccuucguggucugcuggcugccguaccacgugcggcgccugauguucugcuacaucagcgacgagcaguggacccccuuccucuacgacuucuaccacuacuucuacauggugaccaacgcccuguucuacgucuccagcacgaucaaccccauccuguacaaccucguguccgcgaacuuccggcacaucuuccuggccacccuggccugccucugccccguguggcgccggcgccggaagcgcccggccuucagccgcaaggccgacuccgucagcuccaaccacacccugagcuccaacgcgacccgggagacgcuguacuga

SEQ ID NO: 33853 - RNA, 1233 nt, Artificial Sequence
  derived and/or modified sequence opt1 from NTSR2__Homo_sapiens__NP_036476
auggagaccagcagcccccgcccgccccggcccuccuccaaccccggccugagccucgacgcccgccuggggguggacacccggcugugggccaagguccucuucacggcgcuguacgcccugaucugggcccucggcgccgccgggaacgcgcuguccgugcacgugguccugaaggcccgcgccggccgggccgggcgccuccggcaccacgugcugagccuggcgcucgccggccugcugcuccugcuggugggcgucccgguggagcucuacuccuucgugugguuccacuaccccugggucuucggggaccugggcugccgcggguacuacuucgugcacgagcugugcgccuacgccaccgugcucagcgucgccggccuguccgcggagcggugccuggccgugugccagccccuccgcgcccggagccugcugacgccccgccggacccgcuggcucguggcccuguccugggccgcgagccuggggcucgcccugccgauggccgucaucaugggccagaagcacgagcuggagaccgccgacggcgagcccgagcccgccucccgggugugcaccgugcucgucagccgcaccgcgcuccagguguucauccaggugaacguccugguguccuucgugcugccccuggcccugaccgccuuccucaacggggucacggugagccaccuccuggcccugugcucccaggucccgagcaccuccacccccggcagcagcacccccucccggcuggagcugcucagcgaggaggggcugcuguccuucaucguguggaagaagacguucauccagggcggccaggugagccucguccgccacaaggacgugcggcgcauccggucccugcagcgcagcgugcagguccugcgcgccaucguggugauguacgucaucugcuggcugcccuaccacgcgcggcgccucauguacugcuacgugccggacgacgccuggaccgacccccuguacaacuucuaccacuacuucuacauggugaccaacacccuguucuacgucuccagcgccgugacgccccuccuguacaacgccguguccagcuccuuccggaagcuguuccucgaggcggucagcucccugugcggggagcaccaccccaugaagcgccugccgcccaagccccagagccccacccucauggacaccgccuccggcuucggggacccgcccgagacccggacguga

SEQ ID NO: 33854 - RNA, 1986 nt, Artificial Sequence
  derived and/or modified sequence opt1 from NUAK1__Homo_sapiens__NP_055655
auggagggcgccgccgcgcccguggccggggaccgcccggaccugggccucggggcccccggcagcccccgggaggccgucgccggggcgaccgccgcccuggagccccgcaagccgcacggcgugaagcggcaccaccacaagcacaaccugaagcaccgcuacgagcuccaggagacccugggcaaggggacguacggcaaggugaagcgggccaccgagcgcuucuccgggcgggucguggcgaucaagagcauccgcaaggacaagaucaaggacgagcaggacauggugcacauccggcgcgagaucgagaucauguccagccugaaccacccccacaucaucuccaucuacgaggucuucgagaacaaggacaagaucgugaucaucauggaguacgccagcaagggcgagcucuacgacuacaucuccgagcggcgccggcugagcgagcgcgagacccggcacuucuuccgccagaucguguccgccguccacuacugccacaagaacgggguggugcaccgggaccugaagcucgagaacauccugcuggacgacaacugcaacaucaagaucgccgacuucggccucagcaaccuguaccagaaggacaaguuccugcagaccuucugcggcagcccccucuacgccucccccgagaucgucaacgggcgcccguaccggggccccgagguggacuccugggcgcugggggugcugcucuacacgcuggucuacggcaccaugcccuucgacggcuucgaccacaagaaccugauccgccagaucagcuccggggaguaccgggagcccacccagccgagcgacgcccgcggccucauccgcuggaugcugauggugaaccccgaccggcgcgccaccaucgaggacaucgccaaccacuggugggugaacuggggguacaaguccagcgucugcgacugcgacgcccugcacgacuccgagagcccccuccuggcgcggaucaucgacuggcaccaccgcagcacgggccugcaggccgacaccgaggccaagaugaaggggcucgccaagcccaccaccuccgaggugaugcuggagcggcagcgcagccugaagaaguccaagaaggagaacgacuucgcccagagcggccaggacgcggugccggagucccccagcaagcucuccagcaagcggcccaagggcauccugaagaagcgcuccaacagcgagcaccggucccacagcacgggguucaucgagggcgucguggggcccgcccugccguccaccuucaagauggagcaggaccucugccgcaccggcgugcugcugcccagcucccccgaggccgagguccccgggaagcucagcccgaagcaguccgccaccaugcccaagaagggcauccugaagaagacgcagcagcgggagagcggcuacuacuccagccccgagcgcagcgaguccagcgagcugcucgacuccaacgacgugauggggagcuccauccccagcccguccccgcccgaccccgcccgggucaccagccacucccugagcugccgccggaagggcauccugaagcacuccagcaaguacuccgcggggaccauggaccccgcccucgugagccccgagaugcccacccuggagucccugagcgagccgggcgugcccgccgaggggcucucccgcagcuacagccggcccuccagcgucaucuccgacgacagcgugcuguccagcgacuccuucgaccugcucgaccugcaggagaaccgccccgcccggcagcgcauccgcagcugcguguccgcggagaacuuccugcagauccaggacuucgagggccugcagaaccggccgcgcccccaguaccucaagcgguaccgcaaccggcuggccgacagcuccuucagccugcucacggacauggacgacgucacccagguguacaagcaggcccuggagaucugcuccaagcugaacuga

SEQ ID NO: 33855 - RNA, 2019 nt, Artificial Sequence
  derived and/or modified sequence opt1 from NUAK2__Homo_sapiens__NP_112214
augcugugcuucaccgcccgcagcggcaccgccguggcgccccggcccggggccggccccgucccccgcgccuccgcccuccccgcccagccgacggacagccccgcggcccuggcccaccuccugcuggccauggagucccugguguucgcgcggcgcagcgggcccacccccuccgccgccgagcucgcccggccgcuggccgagggccugaucaagagccccaagccccucaugaagaagcaggcggugaagcgccaccaccacaagcacaaccugcggcaccgcuacgaguuccuggagacccucgggaagggcaccuacggcaaggucaagaaggcccgggaguccagcgggcgccugguggccaucaaguccauccggaaggacaagaucaaggacgagcaggaccugaugcacauccgccgggagaucgagaucaugagcucccucaaccacccccacaucaucgccauccacgagguguucgagaacagcuccaagaucgucaucgugauggaguacgccagccgcggcgaccuguacgacuacaucuccgagcggcagcagcugagcgagcgcgaggcgcggcacuucuuccgccagaucguguccgccguccacuacugccaccagaaccggguggugcaccgcgaccucaagcuggagaacauccugcucgacgccaacgggaacaucaagaucgccgacuucggccugagcaaccuguaccaccaggggaaguuccuccagacguucugcggcuccccgcuguacgccagccccgagaucgucaacggcaagcccuacaccgggcccgagguggacagcuggucccugggcgugcuccuguacauccugguccacgggaccaugccguucgacggccacgaccacaagauccucgugaagcagaucagcaacggcgcguaccgggagccgcccaagcccuccgacgccugcgggcugauccgcuggcugcucauggugaacccgacccgccgggccacgcuggaggacgucgccagccacuggugggugaacuggggcuacgccacccgcgugggggagcaggaggcgccccacgagggcgggcaccccggcuccgacagcgcccgggccuccauggccgacuggcugcgccggagcucccgcccccuccuggagaacggcgcgaaggucugcagcuucuucaagcagcacgcccccgggggcggguccaccacccccggccuggagcggcagcacagccucaagaagucccgcaaggagaacgacauggcccagagccugcacuccgacacggccgacgacaccgcccaccggcccggcaagagcaaccugaagcuccccaaggggauccugaagaagaagguguccgcgagcgccgagggcgugcaggaggacccgcccgagcugucccccaucccggccagccccgggcaggccgcgccccuccugcccaagaagggcauccugaagaagccgcgccagcgggagagcggguacuacuccagccccgagcccuccgagagcggcgagcuccuggacgccggggacgucuucguguccggcgaccccaaggagcagaagccgccccaggccagcggccugcugcuccaccgcaaggggauccugaagcugaacggcaaguucucccagaccgcccucgagcuggccgcccccaccacguucgggagccuggacgagcucgcgcccccgcggccccuggcccgcgccucccggcccagcggcgccgucuccgaggacagcauccuguccagcgaguccuucgaccagcucgaccugcccgagcgccugccggagccgccccuccggggcugcgugagcguggacaaccugaccgggcuggaggagccgcccuccgagggccccgggagcugccuccgccgguggcgccaggacccccugggcgacagcugcuucucccugaccgacugccaggaggucaccgcgacguaccgccaggcccuccgggugugcagcaagcugaccuga

SEQ ID NO: 33856 - RNA, 1920 nt, Artificial Sequence
  derived and/or modified sequence opt1 from NUB1__Homo_sapiens__NP_001230280
augaagaccaacggcgggcgcugccggauccgcgcccugugcuggagccggcgcgaguggcggggcgccgggauggcgcagaagaaguaccuccaggccaagcugacccaguuccugcgcgaggaccggauccagcucuggaagcccccguacacggacgagaacaagaaggugggccuggcccugaaggaccucgccaagcaguacuccgaccgccuggagugcugcgagaacgaggucgagaaggugaucgaggagauccggugcaaggccaucgagcgcgggaccggcaacgacaacuaccggaccaccggcaucgcgacgaucgagguguuccugccgccccgccucaagaaggaccggaagaaccugcuggagacccgccuccacaucaccgggcgggagcugcgcagcaagaucgccgagaccuucggccugcaggagaacuacaucaagaucgucaucaacaagaagcagcuccagcuggggaagacgcuggaggagcagggcguggcccacaacgugaaggccaugguccucgagcugaagcaguccgaggaggacgcgcggaagaacuuccagcuggaggaggaggagcagaacgaggccaagcucaaggagaagcagauccagcgcaccaagcgggggcuggagauccuggccaagcgcgccgccgagaccgugguggaccccgagaugacccccuaccucgacaucgcgaaccagacgggccggagcauccgcaucccgcccuccgagcgcaaggcccugaugcuggccaugggcuaccacgagaaggggcgggccuuccucaagcgcaaggaguacggcaucgcccugcccugccugcucgacgcggacaaguacuucugcgagugcugccgggagcugcuggacaccgucgacaacuacgccgugcuccagcuggacaucguguggugcuacuuccgccuggagcagcucgagugccuggacgacgccgagaagaagcugaaccucgcccagaagugcuucaagaacugcuacggggagaaccaccagcggcugguccacaucaagggcaacugcggcaaggagaaggugcuguuccuccgccuguaccugcuccaggggauccggaacuaccacagcggcaacgacguggaggccuacgaguaccugaacaaggcgcgccagcuguucaaggagcucuacaucgaccccuccaaggucgacaaccugcugcagcugggguucaccgcccaggaggcccggcucggccugcgcgccugcgacgggaacguggaccacgccgcgacccacaucacgaaccggcgcgaggagcuggcccagauccggaaggaggagaaggagaagaagcgccggcgccucgagaacauccgguuccugaagggcaugggcuacagcacccacgccgcccagcagguccugcacgcggccuccgggaaccucgacgaggcccugaagauccugcucagcaacccccagaugugguggcugaacgacuccaaccccgagaccgacaaccgccaggagagccccucccaggagaacaucgaccggcugguguacaugggcuucgacgcccucguggccgaggcggcccugcgcguguuccgcgggaacguccagcuggccgcccagacccucgcccacaacggcgggagccugccgcccgagcugccccucucccccgaggacagccuguccccgcccgcgacgagccccuccgacagcgccggcaccagcuccgccagcaccgacgaggacauggagaccgaggccgugaacgagauccuggaggacauccccgagcacgaggaggacuaccucgacuccacgcuggaggacgaggagaucaucaucgccgaguaccugagcuacguggagaaccggaaguccgcgaccaagaagaacuga

SEQ ID NO: 33857 - RNA, 930 nt, Artificial Sequence
  derived and/or modified sequence opt1 from NUBP1__Homo_sapiens__NP_001265435
auggaggaggugccccacgacugcccgggcgccgacagcgcccaggcggggcgcggcgccuccugccaggggugccccaaccagcggcugugcgccagcggcgccggggccacccccgacaccgcgaucgaggagaucaaggagaagaugaagacggucaagcacaagauccucgugcuguccggcaagggcggggugggcaagagcaccuucuccgcccaccuggcccacgggcucgccgaggacgagaacacccagaucgcgcugcuggacaucgacaucugcggccccagcaucccgaagaucauggggcucgagggcgagcaguacgucgaggacaaccugggcgugauguccgugggguuccugcucagcucccccgacgacgccgucaucuggcgcggccccaagaagaacgggaugaucaagcaguuccugcgggacguggacuggggcgagguggacuaccugaucgucgacacgcccccgggcaccagcgacgagcaccucuccguggugcgcuaccuggccaccgcccacaucgacggggccgucaucaucaccacgccccaggaggugagccugcaggacgugcggaaggagaucaacuucugccgcaaggucaagcuccccaucaucggcgugguggagaacauguccggguucaucugccccaagugcaagaaggagagccagaucuucccgcccaccaccggcggggcggagcugaugugccaggaccuggaggucccccuccugggccgggugccccuggacccgcucaucggcaagaacugcgacaaggggcaguccuucuucaucgacgcccccgacagccccgccacccuggccuaccgcuccaucauccagcggauccaggaguucugcaaccugcaccagagcaaggaggagaaccucaucuccagcuga

SEQ ID NO: 33858 - RNA, 816 nt, Artificial Sequence
  derived and/or modified sequence opt1 from NUBP2__Homo_sapiens__NP_036357
auggaggccgccgcggagcccggcaaccuggccggggugcgccacaucauccucguccugagcggcaagggcgggguggggaaguccaccaucagcaccgagcuggcccucgcccugcggcacgccggcaagaaggugggcauccuggacgucgaccucugcgggccguccaucccccgcaugcugggcgcgcaggggcgggccgugcaccagugcgaccgcggcugggcccccguguuccuggaccgggagcagagcaucucccucaugagcgucggguuccugcuggagaagcccgacgaggccgugguguggcgcggcccgaagaagaacgcgcucaucaagcaguucgucuccgacguggccuggggcgagcuggacuaccugguggucgacacgccgcccgggaccagcgacgagcacauggccaccaucgaggcccuccggcccuaccagccccugggcgcccugguggugaccacgccccaggcggucuccgugggggacgugcgccgggagcucaccuucugccgcaagaccggccugcgggucaugggcaucguggagaacaugagcggguucacgugcccccacugcaccgagugcaccuccguguucagccgcggcgggggcgaggagcuggcccagcucgccgggguccccuuccugggcuccgugccgcuggaccccgcccucaugcggacccuggaggagggccacgacuucauccaggaguuccccgggagccccgccuucgcggcccugaccuccaucgcccagaagauccucgacgccacgccggccugccugcccuga

SEQ ID NO: 33859 - RNA, 672 nt, Artificial Sequence
  derived and/or modified sequence opt1 from NUBPL__Homo_sapiens__NP_001188502
augagcaaggccaucggccugcucgacguggacgucuacgggcccuccgugccgaagaugaugaaccugaagggcaaccccgagcugagccaguccaaccucaugcgcccccugcugaacuacgggaucgccugcaugagcaugggcuuccucguggaggaguccgagcccgucguguggcgggggcugauggugaugagcgcgaucgagaagcugcuccgccaggucgacuggggccagcuggacuaccuggugguggacaugccgcccggcaccggggacguccagcucuccgugagccagaacauccccaucaccggcgccgugaucgucuccacgccccaggacaucgcccugauggacgcccacaagggggccgagauguuccggcgcgugcacgugccgguccugggccucgugcagaacaugagcguguuccagugccccaagugcaagcacaagacccacaucuucggggcggacggcgcccggaagcuggcccagacccugggccucgagguccugggggacaucccccugcaccucaacauccgcgaggccuccgacaccggccagcccaucguguucagccagccggaguccgacgaggcgaaggccuaccugcggaucgccguggaggucgugcgccggcugcccagccccuccgaguga

SEQ ID NO: 33860 - RNA, 1386 nt, Artificial Sequence
  derived and/or modified sequence opt1 from NUCB1__Homo_sapiens__NP_006175
augcccccgagcggcccccgcgggacccugcuccugcugccccuccugcugcuccugcugcuccgggccgugcuggccgucccccuggagcgcggcgcgccgaacaaggaggagacccccgccacggagucccccgacaccgggcucuacuaccaccgguaccugcaggaggugaucgacgugcuggagaccgacggccacuuccgcgagaagcuccaggccgccaacgccgaggacaucaagagcgggaagcugucccgggagcuggacuucgucagccaccacgugcgcaccaagcucgacgagcugaagcggcaggaggugucccgccugcggaugcuccugaaggcgaagauggacgccgagcaggaccccaacguccagguggaccaccugaaccuccugaagcaguucgagcaccuggacccgcagaaccagcacacguucgaggcccgcgaccucgagcugcugauccagaccgccacccgggaccucgcgcaguacgacgccgcccaccacgaggaguucaagcgcuacgagaugcugaaggagcacgagcggcgccgguaccuggagagccucggcgaggagcagcgcaaggaggccgagcggaagcuggaggagcagcagcgccggcaccgcgagcaccccaaggugaacguccccggcucccaggcccagcugaaggaggugugggaggagcucgacgggcuggaccccaaccgguucaacccgaagaccuucuucauccugcacgacaucaacagcgacggcgugcucgacgagcaggagcuggaggcgcuguucacgaaggagcucgagaaggucuacgaccccaagaacgaggaggacgacaugcgcgagauggaggaggagcgccugcggaugcgcgagcacgugaugaagaacguggacaccaaccaggaccggcuggucacccucgaggaguuccuggccuccacccagcgcaaggaguucggggacacgggcgaggggugggagaccguggagaugcaccccgccuacaccgaggaggagcugcggcgcuucgaggaggagcucgccgcccgggaggcggagcugaacgccaaggcccagcgccugagccaggagaccgaggcccugggccggucccagggccgccucgaggcccagaagcgggagcugcagcaggcggugcugcacauggagcagcgcaagcagcagcagcagcagcagcaggggcacaaggcccccgccgcccacccggagggccagcucaaguuccaccccgacacggacgacguccccgugcccgccccggcgggggaccagaaggagguggacaccagcgagaagaagcugcuggagcggcuccccgaggucgaggugccccagcaccuguga

SEQ ID NO: 33861 - RNA, 1263 nt, Artificial Sequence
  derived and/or modified sequence opt1 from NUCB2__Homo_sapiens__NP_005004
augcgcuggcggaccauccugcuccaguacugcuuccugcugaucacgugccuccugaccgcccuggaggccgugcccaucgacaucgacaagaccaagguccagaacauccacccgguggagagcgcgaagaucgagccgcccgacaccggccucuacuacgacgaguaccugaagcaggucaucgacgugcuggagaccgacaagcacuuccgcgagaagcuccagaaggccgacaucgaggagaucaaguccgggcggcugagcaaggagcuggaccucgugucccaccacgugcgcacgaagcuggacgagcugaagcggcaggaggucggccgccuccggaugcugaucaaggccaagcuggacagccuccaggacaucgggauggaccaccaggcccugcugaagcaguucgaccaccucaaccaccugaaccccgacaaguucgaguccaccgaccuggacaugcucaucaaggccgcgaccagcgaccuggagcacuacgacaagacccgccacgaggaguucaagaaguacgagaugaugaaggagcacgagcggcgcgaguaccugaagacgcucaacgaggagaagcggaaggaggaggaguccaaguucgaggagaugaagaagaagcacgagaaccaccccaaggugaaccaccccggcagcaaggaccagcugaaggaggugugggaggagaccgacgggcuggaccccaacgacuucgaccccaagaccuucuucaagcuccacgacgucaacuccgacggcuuccuggacgagcaggagcuggaggcccucuucaccaaggagcuggagaagguguacgacccgaagaacgaggaggacgacaugguggagauggaggaggagcgccugcggaugcgcgagcacgucaugaacgagguggacacgaacaaggaccggcucgugacccuggaggaguuccugaaggccaccgagaagaaggaguuccucgagcccgacagcugggagacccuggaccagcagcaguucuucacggaggaggagcugaaggaguacgagaacaucaucgcccuccaggagaacgagcugaagaagaaggcggacgagcugcagaagcagaaggaggagcuccagcgccagcacgaccagcuggaggcccagaagcuggaguaccaccaggucauccagcagauggagcagaagaagcuccagcagggcaucccgcccuccgggcccgccggcgagcugaaguucgagccccacaucuga

SEQ ID NO: 33862 - RNA, 732 nt, Artificial Sequence
  derived and/or modified sequence opt1 from NUCKS1__Homo_sapiens__NP_073568
augagccgccccgugcggaaccgcaaggucguggacuacucccaguuccaggagagcgacgacgccgacgaggacuacggccgggacuccgggccgcccaccaagaagauccgcagcagcccccgggaggccaagaacaagcgccggagcggcaagaacucccaggaggacagcgaggacuccgaggacaaggacgugaagaccaagaaggacgacagccacuccgcggaggacagcgaggacgagaaggaggaccacaagaacguccgccagcagcggcaggccgccuccaaggccgccagcaagcagcgcgagaugcugauggaggacgugggguccgaggaggagcaggaggaggaggacgaggcgcccuuccaggagaaggacagcggcuccgacgaggacuuccucauggaggacgacgacgacagcgacuacggguccagcaagaagaagaacaagaagauggugaagaaguccaagcccgagcggaaggagaagaagaugcccaagccccgccugaaggccacggucacccccucccccgugaagggcaagggcaagguggggcggcccaccgccagcaaggccuccaaggagaagacccccagccccaaggaggaggacgaggagccggaguccccgcccgagaagaagacgagcaccagcccgccgcccgagaaguccggcgacgagggguccgaggacgaggcgcccagcggcgaggacuga

SEQ ID NO: 33863 - RNA, 1665 nt, Artificial Sequence
  derived and/or modified sequence opt1 from NUDCD1__Homo_sapiens__NP_001121683
augcuguaccuccagggcuggagcaugcccgccguggccgaggucaagcugcgcgacgaccaguacacccuggagcacaugcacgcguucgggauguacaacuaccuccacugcgacuccugguaccaggacagcguguacuacaucgacacccugggccggaucaugaaccugacggugaugcucgacaccgcccuggggaagccgcgcgaggucuuccggcugcccaccgaccucaccgccugcgacaaccgccugugcgccuccauccacuucagcuccagcacgugggugacccuguccgacggcaccgggcggcucuacgugaucggcaccggcgagcgcgggaacagcgccuccgagaagugggagaucauguucaacgaggagcugggcgaccccuucaucaucauccacagcaucucccugcucaacgcggaggagcacagcaucgccacgcugcugcuccggaucgagaaggaggagcuggacaugaagggguccggcuucuacgucagccuggagugggugaccaucuccaagaagaaccaggacaacaagaaguacgagaucaucaagcgcgacauccuccggggcaagagcgugccccacuacgccgccaucgagccggacgggaacggccugaugaucgucuccuacaagagccugaccuucgugcaggcggggcaggaccucgaggagaacauggacgaggacaucuccgagaagaucaaggagccccuguacuacuggcagcagaccgaggacgaccugacggugaccauccgccuccccgaggacagcaccaaggaggacauccagauccaguuccugcccgaccacaucaacaucguccugaaggaccaccaguuccucgagggcaagcuguacagcuccaucgaccacgagagcuccaccuggaucaucaaggagagcaacucccuggagaucagccucaucaagaagaacgaggggcugacguggccggagcuggugaucggcgacaagcagggcgagcucauccgggacuccgcccagugcgccgccaucgccgagcgccugaugcaccugaccagcgaggagcucaaccccaaccccgacaaggagaagcccccgugcaacgcgcaggagcuggaggagugcgacaucuucuucgaggaguccagcucccugugccgguucgacgggaacacccucaagaccacgcacguggucaaccugggcagcaaccaguaccuguucuccgugaucguggaccccaaggagaugcccugcuucugccuccgccacgacgucgacgcccugcuguggcagccccacagcuccaagcaggacgacaugugggagcacaucgccaccuucaacgcccucggguacgugcaggccagcaagcgggacaagaaguucuucgcgugcgccccgaacuacuccuacgccgcccugugcgagugccugcgccggguguucaucuaccgccagcccgcccccaugagcaccguccuguacaaccggaaggagggccgccaggugggccagguggcgaagcagcaggucgccucccucgagaccaacgaccccauccugggguuccaggccacgaacgagcggcuguucgugcucaccaccaagaaccuguuccugaucaaggucaacaccgagaacuga

SEQ ID NO: 33864 - RNA, 1086 nt, Artificial Sequence
  derived and/or modified sequence opt1 from NUDCD3__Homo_sapiens__NP_056147
auggagaccggcgccgccgagcuguacgaccaggcgcuccuggggauccugcagcacgugggcaacguccaggacuuccuccgcgugcuguucggguuccuguaccggaagaccgacuucuaccgccuccugcggcaccccagcgaccgcaugggcuucccgcccggggccgcccaggcccuggugcuccaggucuucaagacguucgaccacauggcccggcaggacgacgagaagcgccggcaggagcuggaggagaagauccgccggaaggaggaggaggaggcgaagaccguguccgccgccgccgcggagaaggagcccgugcccgucccggugcaggagaucgagaucgacagcaccaccgagcuggacggccaccaggagguggagaagguccagccgcccggccccgugaaggagauggcccacgggucccaggaggccgaggcccccggcgccguggcgggggccgccgaggucccccgcgagccgcccauccucccccggauccaggagcaguuccagaagaaccccgacagcuacaacggcgccgugcgcgagaacuacacguggucccaggacuacaccgaccuggaggugcggguccccgugcccaagcacguggucaaggggaagcaggucagcguggcccuguccagcuccagcauccgcguggcgaugcucgaggagaacggcgagcgggugcugauggagggcaagcugacccacaagaucaacaccgaguccagccucuggucccuggagccggggaagugcgugcuggucaaccucagcaaggugggcgaguacugguggaacgccauccuggagggggaggagcccaucgacaucgacaagaucaacaaggagcgcuccauggccacggucgacgaggaggagcaggccgugcuggaccggcucaccuucgacuaccaccagaagcugcagggcaagccccagagccacgagcugaaggugcacgagaugcucaagaagggcugggacgccgaggggucccccuuccgcggccagcgguucgacccggcgauguucaacaucagccccggggccguccaguucuga

SEQ ID NO: 33865 - RNA, 1008 nt, Artificial Sequence
  derived and/or modified sequence opt1 from NUDC__Homo_sapiens__XP_011538831
augaucagcaacuaccgcaacggcuccgagcuggugugcuucaacagcggggucggcugcuuccucaucgggugcgacugggccuucaccgugcuggugaacaccuucuucuccuuccugcggcgcaagacggacuucuucaucggcggggaggagggcauggccgagaagcucaucacccagaccuucagccaccacaaccagcuggcgcagaagacccggcgcgagaagcgggcccgccaggaggccgagcggcgcgagaaggccgagcgggccgcgcgccuggccaaggaggccaaguccgagacgagcggcccccagaucaaggagcucaccgacgaggaggccgagcggcugcagcuggagaucgaccagaagaaggacgcggagaaccacgaggcccagcucaagaacgggucccuggacagcccgggcaagcaggacaccgaggaggacgaggaggaggacgagaaggacaaggggaagcugaagcccaaccucggcaacggggccgaccugcccaacuaccgcuggacccagacgcuguccgagcucgaccuggccguccccuucugcgugaacuuccggcugaagggcaaggacaugguggucgacauccagcgccggcaccuccgcgugggccugaaggggcagccggccaucaucgacggcgagcuguacaacgaggugaaggucgaggagagcuccuggcucaucgaggacgggaagguggugaccguccaccuggagaagaucaacaagauggagugguggagccggcugguguccagcgaccccgagaucaacaccaagaagaucaaccccgagaacuccaagcucagcgaccuggacuccgagacccgcagcaugguggagaagaugauguacgaccagcggcagaaguccaugggccugcccacgagcgacgagcagaagaagcaggagauccucaagaaguucauggaccagcacccggagauggacuucagcaaggcgaaguucaacuga

SEQ ID NO: 33866 - RNA, 495 nt, Artificial Sequence
  derived and/or modified sequence opt1 from NUDT10__Homo_sapiens__NP_001291892
augaagugcaagcccaaccagacccgcaccuacgacccggagggcuucaagaagcgggccgccugccugugcuuccgcagcgagcgggaggacgaggugcuccuggucuccagcucccgcuaccccgaccgguggaucgugcccgggggcgggauggagcccgaggaggagccgggcggggcggccgugcgcgaggucuacgaggaggccggcgugaagggcaagcuggggcggcuccugggcguguucgagcagaaccaggaccccaagcaccgcacguacgucuacgugcugaccgugaccgagcuccuggaggacugggaggacagcgucuccaucgggcggaagcgcgagugguucaagguggaggacgccaucaaggugcugcagugccacaagcccguccacgccgaguaccucgagaagcugaagcugggcgggagccccaccaacggcaacuccauggcgccgagcucccccgacagcgaccccuga

SEQ ID NO: 33867 - RNA, 495 nt, Artificial Sequence
  derived and/or modified sequence opt1 from NUDT11__Homo_sapiens__NP_060629
augaagugcaagcccaaccagacccgcaccuacgacccggagggcuucaagaagcgggccgccugccugugcuuccgcagcgagcgggaggacgaggugcuccuggucuccagcucccgcuaccccgaccgguggaucgugcccgggggcgggauggagcccgaggaggagccgggcggggcggccgugcgcgaggucuacgaggaggccggcgugaagggcaagcuggggcggcuccugggcguguucgagcagaaccaggaccgcaagcaccggacguacgucuacgugcugaccgugaccgagcuccuggaggacugggaggacagcgucuccaucgggcgcaagcgggagugguucaagguggaggacgccaucaaggugcugcagugccacaagcccguccacgccgaguaccucgagaagcugaagcugggcgggagccccaccaacggcaacuccauggcgcccagcuccccggacagcgaccccuga

SEQ ID NO: 33868 - RNA, 495 nt, Artificial Sequence
  derived and/or modified sequence opt1 from NUDT15__Homo_sapiens__NP_060753
augaccgccagcgcccagccccgcggccggcgcccgggggugggcgucggggugguggucaccuccugcaagcacccccggugcgugcugcucggcaagcgcaaggggagcgugggcgcgggcuccuuccagcugcccgggggccaccuggaguucggggagacgugggaggagugcgcccagcgggagaccugggaggaggccgcccuccaccugaagaacguccacuucgccagcguggugaacuccuucaucgagaaggagaacuaccacuacgucaccauccugaugaagggcgagguggacgugacccacgacagcgagcccaagaacgucgagccggagaagaacgaguccugggagugggugcccugggaggagcucccgccccuggaccagcuguucugggggcuccgcugccugaaggagcagggcuacgaccccuucaaggaggaccugaaccaccucgugggcuacaaggggaaccaccuguga

SEQ ID NO: 33869 - RNA, 1128 nt, Artificial Sequence
  derived and/or modified sequence opt1 from NUDT19__Homo_sapiens__NP_001099040
augagcuccagccugcggcccggcccgucccgguggcgccgggccgccagcaucgugcucgcggccggguggucccgccccgagaccgccaccccgcccagccggcccccgcccgccgagggcuuccgccugcugcuccugcagcggagcccccaccagggguucaugcccggcgcccacgucuucuccgggggcgugcuggacgcggccgaccgcuccgccgacuggcucggccuguucgcgccccaccacgggccgccccgguucggccuggggcccgcccccuucagccgcacggccuuccccucccuccccgacaccgacgaccacaagaccgacaacaccggcacgcugccggaggacguggccuuccggaucugcgccguccgcgaggccuucgaggaggcgggggugcugcuccugcggccccgcaccagcccgcccggccccgcccccggccccgggcuggcccucgagcccccgcccggccuggccuccuggcgggaccgcgugcggcaggacccccgccacuuccugcggcucugcgcccaccuggacugcacccccgacaucugggcgcugcacaacuggagcgccuggcucaccccguuccugcgcgggacgacccggcgcuucgacaccgccuucuuccugugcugccuccgcgagcccccgcccgucuaccccgaccuggccgagguggugggcuaccagugguccagccccuccgaggccaccgagagcuuccuguccaaggagaucuggcugcccccgccccaguucuacgagguccggcgccuggcgaacuucgccagccugagcgaccuccacaaguucugccugggccgggcccuggaggggcucgagcgcuggcugcccaucauccugcucacggccgacggcauggugcaccuccugcccggggacgagcucuaccuggaggacuccgacuuccuggagaaccucaugagcaccgagaagaagaccgaggagaucaugaaggagggcaagcaguuccaccggaucgugaccuaccaccgccaccuguacgacauccacgucacggugcagccgaaguacaagcacguguaccccaagaacuccgucgugcgcaagagccaccuguga

SEQ ID NO: 33870 - RNA, 471 nt, Artificial Sequence
  derived and/or modified sequence opt1 from NUDT1__Homo_sapiens__NP_945191
augggcgccagccgccuguacacccucgugcugguccugcagccccagcgggugcuccuggggaugaagaagcgcggcuucggggccggccgguggaacggguucggcggcaaggugcaggagggggagaccaucgaggacggcgcgcgccgggagcugcaggaggaguccgggcucacggucgacgcccugcacaaggugggccagaucguguucgaguucgucggggagccggagcugauggacgugcacguguucugcaccgacagcauccagggcacccccgucgaguccgacgagaugcgccccugcugguuccagcucgaccagauccccuucaaggacauguggccggacgacagcuacugguucccccugcugcuccagaagaagaaguuccacggcuacuucaaguuccaggggcaggacaccauccuggacuacacgcugcgggagguggacaccguguga

SEQ ID NO: 33871 - RNA, 684 nt, Artificial Sequence
  derived and/or modified sequence opt1 from NUDT21__Homo_sapiens__NP_008937
augagcguggugcccccgaaccgcucccagaccggcuggccccgcggggucacccaguucggcaacaaguacauccagcagacgaagccccugacccucgagcggaccaucaaccuguacccccugaccaacuacacguucgggaccaaggagccgcucuacgagaaggacagcuccguggccgcccgguuccagcgcaugcgggaggaguucgacaagaucggcaugcgccggaccgucgagggggugcugaucgugcacgagcaccgccugccccacguccuccugcugcagcucggcaccacguucuucaagcugcccggcggggagcugaaccccggcgaggacgagguggaggggcucaagcggcugaugaccgagauccugggccgccaggacggggugcuccaggacugggucaucgacgacugcaucggcaacugguggcggccgaacuucgagccgccccaguaccccuacauccccgcgcacaucaccaagcccaaggagcacaagaagcuguuccuggugcagcuccaggagaaggcccuguucgccgugcccaagaacuacaagcuggucgccgcgccccucuucgagcuguacgacaacgccccgggcuacgggcccaucaucagcucccugccccagcuccugagccgcuucaacuucaucuacaacuga

SEQ ID NO: 33872 - RNA, 444 nt, Artificial Sequence
  derived and/or modified sequence opt1 from NUDT2__Homo_sapiens__NP_671702
auggcccugcgcgccugcggccucaucaucuuccggcgcugccugauccccaagguggacaacaacgcgaucgaguuccugcuccugcaggccagcgacgggauccaccacuggaccccgcccaagggccacgucgagcccggggaggacgaccuggagaccgcccuccgggagacgcaggaggaggccggcaucgaggccgggcagcugaccaucaucgagggcuucaagcgcgagcugaacuacguggcgcggaacaagcccaagaccgugaucuacuggcucgccgaggucaaggacuacgacguggagauccgccugucccacgagcaccaggccuaccgguggcugggccucgaggaggccugccagcuggcgcaguucaaggagaugaaggccgcccugcaggaggggcaccaguuccucugcagcaucgaggccuga

SEQ ID NO: 33873 - RNA, 519 nt, Artificial Sequence
  derived and/or modified sequence opt1 from NUDT3__Homo_sapiens__NP_006694
augaugaagcucaagagcaaccagacccgcaccuacgacggcgacggguacaagaagcgggccgccugccugugcuuccgcuccgagagcgaggaggaggugcugcuggucuccagcucccggcaccccgaccgcuggaucgugccgggcgggggcauggagcccgaggaggagcccagcguggcggccguccgggaggugugcgaggaggccggggugaagggcacgcucggccgccuggucgggaucuucgagaaccaggagcggaagcaccgcaccuacguguacgugcugaucgucaccgaggugcucgaggacugggaggacuccgugaacaucggccggaagcgcgagugguucaagaucgaggacgccaucaagguccugcaguaccacaagcccgugcaggccagcuacuucgagacccugcggcagggguacuccgcgaacaacggcacgccgguggucgccaccaccuacagcguguccgcccagagcuccaugagcgggauccgcuga

SEQ ID NO: 33874 - RNA, 951 nt, Artificial Sequence
  derived and/or modified sequence opt1 from NUDT6__Homo_sapiens__NP_009014
augcgccagccccugagcuggggccgguggcgcgccaugcucgcccggaccuacgggccgggccccuccgcgggguaccgcugggccagcggcgcccagggguacgugcggaacccgcccgucggcgccugcgaccugcagggcgagcuggaccgcuucgggggcaucuccgugcggcucgcccgccuggacgcgcuggaccggcucgacgccgccgccuuccagaaggggcugcaggcggccgugcagcaguggcgcagcgagggccggaccgccgucuggcugcacaucccgauccuccagucccgcuucaucgcccccgccgcgagccugggguucugcuuccaccacgccgaguccgacagcuccacgcugacccucuggcugcgggagggccccagccgccugcccggcuacgccucccaccagguggggguggccggcgccgucuucgacgagagcacccggaagauccucguggugcaggaccgcaacaagcugaagaacauguggaaguuccccgggggccuguccgagcccgaggaggacaucggcgacaccgcgguccgggagguguucgaggagacggggaucaagagcgaguuccgcuccgugcucagcauccggcagcagcacaccaaccccggcgccuucgggaaguccgacauguacaucaucugccgccugaagcccuacagcuucaccaucaacuucugccaggaggagugccugcggugcgaguggauggaccucaacgaccuggccaagaccgagaacacgaccccgaucaccucccgcgucgcccgccugcuccuguacggcuaccgggagggguucgacaagaucgaccugaccguggaggagcuccccgccguguacacgggccuguucuacaagcuguaccacaaggagcuccccgagaacuacaagaccaugaagggcaucgacuga

SEQ ID NO: 33875 - RNA, 717 nt, Artificial Sequence
  derived and/or modified sequence opt1 from NUDT7__Homo_sapiens__NP_001099133
augagccgccugggccuccccgaggagccggugcggaacucccugcuggacgacgccaaggcccgccuccggaaguacgacaucgggggcaaguacagccaccuccccuacaacaaguacuccguccugcucccccugguggcgaaggaggggaagcugcaccuccuguucaccgugcgcagcgagaagcugcggcgcgcccccggcgaggucugcuuccccgggggcaagcgggacccgaccgacauggacgacgccgccacggcccuccgcgaggcgcaggaggaggugggccugcggccccaccagguggaggucgugugcugccuggugcccugccucaucgacaccgacacccugaucaccccguucgucgggcugaucgaccacaacuuccaggcccagcccaaccccgccgaggugaaggacguguuccucgucccccuggccuacuuccugcacccccaggugcacgaccagcacuacgugacgcgccucggccaccgguucaucaaccacaucuucgaguacaccaacccggaggacggggucaccuaccagaucaagggcaugaccgcgaaccuggccgugcugguggccuucaucauccucgagaagaagcccacguucgagguccaguucaaccugaacgacgugcuggccuccagcgaggagcuguuccugaaggugcacaagaaggccaccucccgccuguga

SEQ ID NO: 33876 - RNA, 1395 nt, Artificial Sequence
  derived and/or modified sequence opt1 from NUF2__Homo_sapiens__NP_663735
auggagacccugagcuucccccgcuacaacguggccgagaucgucauccacauccggaacaagauccucaccggcgccgacgggaagaaccugacgaagaacgaccuguacccgaaccccaagcccgaggugcuccacaugaucuacaugcgcgcgcugcagaucguguacggcauccggcuggagcacuucuacaugaugcccgucaacuccgaggugauguacccgcaccucauggagggguuccugcccuucagcaaccuggugacccaccucgacuccuuccugcccaucugccgcgucaacgacuucgagaccgccgacauccugugccccaaggccaagcggaccagccgcuuccucuccggcaucaucaacuucauccacuuccgggaggccugccgcgagacguacauggaguuccuguggcaguacaagagcuccgccgacaagaugcagcagcugaacgcggcccaccaggaggcccucaugaagcuggagcggcuggacagcgugccgguggaggagcaggaggaguucaagcagcucuccgacgggauccaggagcugcagcagagccugaaccaggacuuccaccagaagaccaucguccuccaggagggcaacucccagaagaaguccaacaucagcgagaagaccaagcgccugaacgagcugaagcucagcguggugucccugaaggagauccaggagagccugaagaccaagaucgucgacucccccgagaagcucaagaacuacaaggagaagaugaaggacacggugcagaagcugaagaacgcccggcaggagguggucgagaaguacgagaucuacggcgacagcguggacugccugcccuccugccagcucgaggugcagcuguaccagaagaagauccaggaccugagcgacaaccgcgagaagcucgcgagcauccugaaggagucccugaaccucgaggaccagaucgagagcgacgaguccgagcugaagaagcugaagaccgaggagaacagcuucaagcggcucaugaucgucaagaaggagaagcuggccaccgcccaguucaagaucaacaagaagcacgaggacgugaagcaguacaagcgcaccgugaucgaggacugcaacaagguccaggagaagcgcggggccguguacgagcgggugacgaccaucaaccaggagauccagaagaucaagcugggcauccagcagcucaaggacgccgcggagcgggagaagcugaagucccaggagaucuuccugaaccucaagaccgcccuggagaaguaccacgacgggaucgagaaggccgccgaggacagcuacgccaagaucgacgagaagaccgcggagcugaagcgcaagauguucaagauguccacguga

SEQ ID NO: 33877 - RNA, 1488 nt, Artificial Sequence
  derived and/or modified sequence opt1 from NUFIP1__Homo_sapiens__NP_036477
auggccgagcccaccagcgacuucgagaccccgaucggcuggcacgccucccccgagcugacgcccacccucgggccccugagcgacaccgcgccgccccgcgacuccuggauguucugggccaugcugcccccgcccccgccgccccucaccagcucccugcccgccgccggcagcaagcccuccagcgagucccagccgcccauggaggcccagagccugcccggggcgcccccgcccuucgacgcccagauccuccccggcgcccagccgcccuucgacgcccagagcccccuggacucccagccccagcccuccgggcagcccuggaacuuccacgcgagcacguccugguacuggcggcagagcuccgaccgcuucccccggcaccagaaguccuucaaccccgccgugaagaacuccuacuacccccgcaaguacgacgccaaguucaccgacuucagccugcccccgagccggaagcagaagaagaagaagcgcaaggagcccgucuuccacuucuucugcgacacgugcgaccggggcuucaagaaccaggagaaguacgacaagcacaugagcgagcacaccaagugccccgagcucgacugcagcuucaccgcccacgagaagaucgugcaguuccacuggcgcaacaugcacgcccccggcaugaagaagaucaagcuggacaccccggaggagaucgcgcgguggcgcgaggagcggcgcaagaacuaccccacccuggccaacaucgagcggaagaagaagcucaagcuggagaaggagaagcgcggggccgugcugaccacgacccaguacggcaagaugaaggggaugucccggcacagccagauggccaagauccgcucccccggcaagaaccacaaguggaagaacgacaacagccggcagcgcgccgucaccggguccggcagccaccucugcgaccugaagcuggaggggcccccggaggcgaacgccgacccccucggcgugcugaucaacuccgacagcgaguccgacaaggaggagaagccccagcacagcgugauccccaaggaggucaccccggcccugugcucccucaugagcuccuacggcagccuguccgggagcgaguccgagcccgaggagacgcccaucaagaccgaggccgacgugcuggccgagaaccaggugcucgacagcagcgcgcccaaguccccgagccaggacgucaaggccaccgugcggaacuucuccgaggccaagagcgagaaccgcaagaaguccuucgagaagaccaaccccaagcggaagaaggacuaccacaacuaccagacgcuguucgagccccgcacccaccaccccuaccugcucgagaugcugcuggccccggacauccgccacgagcggaacgugauccuccagugcguccgcuacaucaucaagaaggacuucuucggccuggacaccaacagcgccaaguccaaggacguguga

SEQ ID NO: 33878 - RNA, 2088 nt, Artificial Sequence
  derived and/or modified sequence opt1 from NUFIP2__Homo_sapiens__NP_065823
auggaggagaagcccggccagccgcagccccagcaccaccacagccaccaccacccccaccaccacccccagcagcagcagcagcagccgcaccaccaccaccacuacuacuucuacaaccacucccacaaccaccaccaccaccaccaccaccagcagccccaccaguaccugcagcacggggccgagggcagccccaaggcccagcccaagccgcucaagcacgagcagaagcacacccugcagcagcaccaggagacccccaagaagaagacgggguacggcgagcugaacgggaacgcgggcgagcgcgagaucucccucaagaaccugagcuccgacgaggccaccaaccccaucagccgggugcugaacggcaaccagcaggucguggacaccucccucaagcagaccgugaaggccaacacguucgggaaggccggcaucaagaccaagaacuucauccagaagaacagcauggacaagaagaacgggaaguccuacgagaacaagagcggcgagaaccaguccgucgacaagagcgacaccauccccaucccgaacgggguggugaccaacaacuccggcuacaucacgaacggcuacauggggaagggcgccgacaacgacgggagcggcuccgagagcggcuacaccacccccaagaagcgcaaggcgcggcgcaacuccgccaaggggugcgagaaccugaacaucguccaggacaagaucaugcagcaggagaccagcgugcccacgcugaagcagggccucgagaccuucaagcccgacuacuccgagcagaaggggaaccggguggacggcagcaagccgaucuggaaguacgagaccgggcccggcggcaccagccgcgggaagcccgccgucggcgacaugcugcggaaguccagcgacuccaagcccggggugagcuccaagaaguucgacgaccgcccgaagggcaagcacgccagcgcgguggccuccaaggaggacagcuggacgcuguucaagcccccgcccgucuuccccguggacaacuccagcgccaagaucgugcccaagaucuccuacgccagcaaggucaaggagaaccucaacaagaccauccagaacuccagcgugucccccaccagcuccagcuccagcagcuccagcaccggggagacgcagacccaguccagcucccggcugagccaggugcccauguccgcccugaaguccgucaccuccgcgaacuucagcaacggcccggugcucgccggcaccgacgggaacguguacccgcccggcgggcagccccugcugacgaccgccgccaacacccucacccccaucuccagcggcacggacuccguccugcaggacaugagccugaccuccgccgcgguggagcagaucaagaccagccucuucaucuaccccuccaacaugcagaccaugcugcugagcacggcccagguggaccuccccagccagaccgaccagcagaaccugggggacaucuuccagaaccaguggggccuguccuucaucaacgagccgagcgccggccccgagaccgucaccgggaaguccagcgagcacaaggugauggaggucacguuccagggcgaguaccccgccacccucgugucccagggggccgagaucauccccagcggcaccgagcacccgguguuccccaaggcguacgagcuggagaagcgcaccagcccccagguccugggcagcauccucaaguccgggaccacgagcgaguccggcgcccugagccuggagcccucccacaucggggaccuccagaaggccgacaccagcucccagggcgcccugguguuccugagcaaggacuacgagaucgagucccagaacccgcucgccagccccaccaacacccugcugggguccgcgaaggagcagcgguaccagcgcggccucgagcggaacgacagcuggggcagcuucgaccugcgcgccgccaucguguaccacacgaaggagauggaguccaucuggaaccugcagaagcaggaccccaagcggaucaucaccuacaacgaggccauggacagccccgaccaguga

SEQ ID NO: 33879 - RNA, 2391 nt, Artificial Sequence
  derived and/or modified sequence opt1 from NUGGC__Homo_sapiens__NP_001010906
auggccgagaccaaggacguguucggccaggagccccacccggucgaggacgaccuguacaaggagcgcacccggaagcgccgcaagagcgaccgggaccagcgguuccgcgccuuccccuccauggagcagagcgcgcucaaggaguacgagaagcuggagucccggacgcgccgggugcugagcaacaccuaccagaagcucauccaguccguguuccuggacgacagcauccccaacggggucaaguaccugaucaaccgccuccuggcccugaucgagaagcccaccguggacccgaucuacaucgcccucuucggcuccaccggggccggcaagagcucccugaucaacgccaucauccagcaggcgauguuccugcccgugagcggggaguccaucugcacgagcugcaucguccagguguccagcggcugcugcgugcaguacgaggccaagauccaccuccuguccgaccaggaguggcgggaggagcugaagaaccucaccaagcugcugcaccgcaccgaggagcucagccgggaggaggccgacgccuggaaccgcgacgaggcggucgaggaggccaccuggaagcugcagaugaucuacggcaacggggccgaguccaagaacuacgaggagcugcuccgggccaagcccaagcgcaagauccccacgagccgggugaucacccugaaggccgaggaggcggaggagcuguccaucaagcucgacccguacauccgcacccagcggcgcgacugggacggcgaggccgccgagaugcggaucuggccccugaucaagcacguggaggucacccugcccaagagcgaccucauccccgaggggguggugcuggucgacaucccgggcacgggggacuucaacagcaagcgcgacgagauguggaagaagaccaucgacaagugcuccgugaucugggugaucagcgacaucgagcgcgucuccggcggccaggcccacgaggaccugcucaacgagagcaucaaggccugccagcggggguucugccgcgacguggcgcugguggucaccaagauggacaagcugcaccuccccgaguaccugcgggagcgcaaggccggcaaccaggccauccagucccagcgggaggccgugcuggagcgcaacgagaugaucaagcuccagcggacccgcauccugaaggagaagcugaagcggaagcuccccgccgacuucaaggugcuggaggcgagcgaccuggucuacacgguguccgcccaggaguacuggcagcaggcccuccugaccgaggaggagaccgagauccccaagcugcgcgaguacauccgcaagagccuccuggacaagaagaagcggaccgucacgaaguacgugaccgaggccuucgggcugcuccugcugaccgacuccuucaacagcacccagaaccugccgaacgagcaccuccacauguccgugcugcggcgcuucgccgaggagaaggucgagcugcucgagaaggcgaucgcccagugcuucgccugcauggagcagccccugcaggagggcgugcggacggcccgcaccagcuaccggugcauccugcgcgcgugccucgugcgguccaagggcaaccagggguuccaccagacccugaaggccgucugccugaagaacggcaucuacgccagccgcacccucgcccgcaucgaccugaacgaggcccugacgcagcccguguacgaccagaucgaccccguguucggguccaucuuccggaccggcaagccgaccgggagcgcgcucaugccccacaucgacgccuucaagcagucccugcaggagaagaugaccgagaucggcauccgcagcggcuggaaguacgacuccugcaagaagaacuuccugauccaggagaucagcgccauccucgggggccuggaggaccacauccugcggcgcaagcggcgcaucuacgagagccucacggccuccguccagagcgaccugaagcugugcuacgaggaggccgcgcagaucaccgggaagaaggccugcgagcggaugaaggacgccauccgccggggcguggaccgccagguggccgaggggauguucgagcgggcccaggagcgcaugcagcaccaguuccagcagcucaagaccggcaucgucgagaaggugaagggcuccaucaccacgaugcuggcgcuggccagcucccagggggacggccucuacaaggagcuggccgacguggggagcgaguacaaggagauggagaagcugcaccggucccuccgcgaggucgccgagaacgcgcggcugcgcaagggcaugcaggaguuccugcuccgggccagccccuccaaggccgggcccccgggcaccagccuguga

SEQ ID NO: 33880 - RNA, 6306 nt, Artificial Sequence
  derived and/or modified sequence opt1 from NUMA1__Homo_sapiens__NP_001273490
augacccugcacgccacccgcggcgccgcgcuccugagcugggugaacucccugcacgucgccgaccccguggaggccgugcuccagcugcaggacugcagcaucuucaucaagaucaucgaccggauccacgggacggaggagggccagcagauccugaagcagccggucuccgagcgccucgacuucgugugcagcuuccugcagaagaaccggaagcaccccuccagccccgagugccugguguccgcccagaagguccucgaggggagcgagcuggagcuggccaagaugaccaugcuccugcuguaccacuccaccaugagcuccaagagcccccgcgacugggagcaguucgaguacaagauccaggcggagcucgccgugauccugaaguucgugcuggaccacgaggacggccucaaccugaacgaggaccuggagaacuuccuccagaaggccccgguccccuccaccugcagcuccacguuccccgaggagcugagccccccgucccaccaggccaagcgggagauccgcuuccuggagcuccagaagguggcgagcuccagcagcgggaacaacuuccuguccggcagccccgccucccccaugggcgacauccugcagaccccccaguuccagaugcggcgccucaagaagcagcuggccgacgagcggagcaaccgcgacgagcuggagcucgagcuggccgagaaccggaagcugcucaccgagaaggacgcccagaucgcgaugaugcagcagcgcaucgaccggcuggcccugcucaacgagaagcaggccgccuccccgcuggagcccaaggagcuggaggagcuccgcgacaagaacgagagccugaccaugcggcugcacgagacgcucaagcagugccaggaccugaagaccgagaagucccagauggaccgcaagaucaaccagcugagcgaggagaacggggaccucuccuucaagcugcgggaguucgccagccaccugcagcagcuccaggacgcgcugaacgagcugaccgaggagcacuccaaggccacccaggaguggcuggagaagcaggcccagcucgagaaggagcugagcgccgcccugcaggacaagaagugccucgaggagaagaacgagauccugcagggcaagcugucccagcucgaggagcaccugagccagcugcaggacaaccccccccaggagaagggggaggugcucggcgacguccugcagcuggagacgcucaagcaggaggcggccacccuggccgccaacaacacccagcugcaggcccgcguggagaugcucgagaccgagcgggggcagcaggaggcgaagcugcuggccgagcgcggccacuucgaggaggagaagcagcagcucuccagccugaucacggaccugcaguccagcaucuccaaccucagccaggccaaggaggagcuggagcaggccagccaggcgcacggcgcccggcugaccgcccagguggccucccucaccagcgagcugaccacgcugaacgccaccauccagcagcaggaccaggagcucgcggggcugaagcagcaggccaaggagaagcaggcccagcuggcccagacccuccagcagcaggagcaggccucccagggccugcgccaccaggucgagcagcugagcuccagccucaagcagaaggagcagcagcugaaggagguggcggagaagcaggaggccacccgccaggaccacgcccagcagcuggccacggccgcggaggagcgggaggccucccuccgcgagcgggacgccgcccugaagcagcuggaggcgcucgagaaggagaaggccgccaagcuggagauccugcagcagcagcuccagguggccaacgaggcccgcgacagcgcgcagaccuccgucacccaggcccagcgggagaaggccgagcugagccgcaagguggaggagcugcaggccugcguggagaccgcccggcaggagcagcacgaggcgcaggcccaggucgccgagcucgagcugcagcugcgcuccgagcagcagaaggccacggagaaggagcggguggcccaggagaaggaccagcuccaggagcagcugcaggcgcugaaggagagccucaaggugaccaaggggucccuggaggaggagaagcgccgggccgccgacgcccuggaggagcagcagcgcugcaucagcgagcucaaggcggagacccggucccuggucgagcagcacaagcgcgagcggaaggagcuggaggaggagcgcgccggccggaagggccucgaggcccgccugcagcagcugggggaggcccaccaggccgagaccgaggugcuccggcgcgagcuggcggaggccauggccgcccagcacacggccgagagcgagugcgagcagcuggucaaggagguggcggccuggcgcgagcgguacgaggacucccagcaggaggaggcccaguacggcgccauguuccaggagcagcucaugacccugaaggaggagugcgagaaggcccgccaggagcugcaggaggcgaaggagaagguggccgggaucgagagccacagcgagcuccagaucucccggcagcagaacgagcuggccgagcugcacgccaaccucgcccgcgcgcugcagcagguccaggagaaggaggugcgggcccagaagcuggccgacgaccucagcacccugcaggagaagauggccgcgaccuccaaggagguggcccgccuggagacgcucguccggaaggccggcgagcagcaggagaccgccagccgcgagcuggugaaggagccggcccgggcgggggaccgccagcccgaguggcuggaggagcagcagggccggcaguucugcuccacccaggccgcccuccaggccauggagcgcgaggccgagcagaugggcaacgagcuggagcggcugcgcgcggcccucauggagagccaggggcagcagcaggaggagcggggccagcaggagcgcgagguggcccggcugacccaggagcgcgggcgggcccaggccgaccuggcgcucgagaaggccgcccgcgccgagcuggagaugcggcugcagaacgcgcucaacgagcagcgcgucgaguucgccacccugcaggaggcccuggcccacgcccucacggagaaggagggcaaggaccaggagcuggcgaagcugcgcgggcucgaggccgcccagaucaaggagcuggaggagcugcggcagaccgugaagcagcugaaggagcagcucgccaagaaggagaaggagcacgccuccggcagcggcgcgcaguccgaggccgccgggcgcaccgagcccaccggccccaagcuggaggcccugcgggccgaggugagcaagcucgagcagcagugccagaagcagcaggagcaggcggacucccuggagcgcagccuggaggccgagcgggccucccgcgccgagcgggacagcgcgcucgagacgcugcaggggcagcuggaggagaaggcccaggagcucggccacucccagagcgcccuggccuccgcccagcgcgagcuggcggccuuccggaccaagguccaggaccacagcaaggccgaggacgaguggaaggcccagguggcccgcgggcggcaggaggcggagcgcaagaacucccucaucagcagccuggaggaggagguguccauccugaaccggcagguccucgagaaggagggcgagagcaaggagcugaagcgccuggugauggccgaguccgagaagagccagaagcucgaggagcggcugcgccugcuccaggccgagaccgccuccaacagcgcccgggcggccgagcgcuccagcgcccugcgggaggaggugcagucccugcgcgaggaggccgagaagcagcgcgucgccagcgagaaccuccggcaggagcugaccucccaggcggagcgcgccgaggagcugggccaggagcucaaggccuggcaggagaaguucuuccagaaggagcaggcccugagcacgcugcagcucgagcacaccuccacccaggcgcuggugagcgagcugcucccggccaagcaccugugccagcagcugcaggccgagcaggccgccgcggagaagcggcaccgcgaggagcucgagcaguccaagcaggccgccgggggccugcgggccgagcugcuccgcgcccagcgggagcugggggagcugaucccccuccgccagaagguggcggagcaggagcggaccgcccagcagcugcgcgccgagaaggccagcuacgccgagcagcuguccaugcucaagaaggcgcacggccugcuggccgaggagaaccggggccucggggagcgcgccaaccugggccggcaguuccuggaggucgagcucgaccaggcccgcgagaaguacgugcaggagcuggcggccgugcgggccgacgccgagacgcgccuggccgagguccagcgggaggcgcagagcaccgcccgcgagcucgaggugaugaccgccaaguacgagggggccaaggugaagguccuggaggagcggcagcgcuuccaggaggagcggcagaagcugaccgcccagguggaggagcucuccaagaagcuggcggacagcgaccaggccagcaaggugcagcagcagaagcugaaggccguccaggcccagggcggggagucccagcaggaggcccagcgccuccaggcgcagcugaacgagcugcaggcccagcucagccagaaggagcaggccgccgagcacuacaagcugcagauggagaaggcgaagacgcacuacgacgccaagaagcagcagaaccaggagcugcaggagcagcuccgcucccuggagcagcugcagaaggagaacaaggagcuccgggccgaggccgagcgccugggccacgagcugcagcaggccggccucaagaccaaggaggcggagcagaccugccggcaccugaccgcccaggugcgcagccuggaggcccagguggcccacgccgaccagcagcuccgggaccuggggaaguuccaggucgcgacggacgcccugaagucccgcgagccccaggccaagccccagcucgaccugagcaucgacucccuggaccucagcugcgaggagggcaccccgcuguccaucaccagcaagcugccccggacccagcccgacgggacguccgugcccggcgagccggccagccccaucucccagcgccuccccccgaagguggagagccuggagucccuguacuucacccccauccccgcccggagccaggcgccccucgaguccagccuggacucccugggggacgucuuccucgacagcggccgcaagacccggagcgcccgccggcgcaccacgcagaucaucaacaucaccaugaccaagaagcuggacguggaggagccggacuccgccaacagcuccuucuacagcacccgguccgcccccgccagccaggcgucccugcgcgccacgagcuccacccagagccucgcccggcugggcucccccgacuacgggaacagcgcccugcucucccugcccggcuaccgcccgaccacccggagcuccgcgcgccgcagccaggccgggguguccagcggcgccccccccgggcggaacuccuucuacaugggcacgugccaggacgagcccgagcagcuggacgacuggaaccgcaucgccgagcuccagcagcggaaccgcgucugcccgccccaccugaagaccugcuacccccuggagagccggcccagccugucccucggcaccaucaccgacgaggagaugaagaccggggacccgcaggagacgcugcgccgggccagcaugcagcccauccagaucgcggagggcaccgggaucaccacccgccagcagcggaagcgcgugucccuggagccccaccagggccccgggacgccggagagcaagaaggccaccuccugcuucccccggcccaugaccccccgcgaccggcacgagggccgcaagcagagcaccacggaggcccagaagaaggccgccccggcguccaccaagcaggccgaccggcgccagagcauggccuucuccauccucaacacccccaagaagcugggcaacagccugcuccggcgcggggccuccaagaaggcccugagcaaggcgucccccaacacccggagcggcacgcgccgguccccgcgcaucgccaccaccaccgccagcgccgcgacggccgccgccaucggggccaccccccgcgcgaagggcaaggccaagcacuga

SEQ ID NO: 33881 - RNA, 1779 nt, Artificial Sequence
  derived and/or modified sequence opt1 from NUMB__Homo_sapiens__NP_001005745
augaacaagcugcgccagagcuuccggcgcaagaaggacguguacguccccgaggccucccggccgcaccaguggcagaccgacgaggagggcgugcgcaccggcaagugcagcuuccccgugaaguaccucggccacgucgagguggacgagucccgggggaugcacaucugcgaggacgccgugaagcgccugaaggcgacgggcaagaaggccgucaaggccgugcugugggugagcgccgacgggcuccgggucguggacgagaagaccaaggaccugaucguggaccagaccaucgagaaggucuccuucugcgcccccgaccgcaacuucgaccgggcguucagcuacaucugccgcgacggcaccacgcggcgcuggaucugccacugcuucauggccgugaaggacaccggcgagcggcugucccacgccguggggugcgccuucgcggccugccucgagcgcaagcagaagcgggagaaggagugcggcgucaccgccaccuucgacgccagccgcacgaccuucacccgggagggguccuuccgcgugaccacggccaccgagcaggcggagcgggaggagaucaugaagcagaugcaggacgccaagaaggccgagaccgacaagaucguggucggcagcuccguggcccccgggaacaccgccccgagccccuccagccccacgucccccaccagcgacgcgaccaccucccuggagaugaacaacccgcacgccaucccccgccggcacgcccccaucgagcagcuggcccgccagggcagcuuccgcggcuuccccgcccucucccagaagaugagcccguucaagcggcagcugagccugcgcaucaacgagcuccccuccacgaugcagcggaagaccgacuuccccaucaagaacgcggugcccgaggucgagggggaggccgagagcaucuccagccugugcucccagaucaccaacgccuucagcaccccggaggaccccuucuccagcgcccccaugacgaagcccgugaccguggucgccccgcagucccccaccuuccagggcaccgagugggggcagagcuccggcgcggccagccccggccuguuccaggccgggcaccgccggacgcccuccgaggccgaccgcuggcucgaggaggugagcaaguccguccgggcgcagcagccgcaggccagcgccgcgccccugcagcccgugcugcagcccccgccgcccaccgccaucucccagcccgccagccccuuccagggcaacgccuuccucaccucccagcccgugcccgucgggguggugccggcccugcagcccgccuucguccccgcccagagcuaccccguggcgaacggcaugccguaccccgcccccaacgugcccgucguggggaucaccccgagccagaugguggccaacgucuucggcacggccggccacccccaggccgcgcacccccaccagucccccagccuggugcgccagcagaccuucccgcacuacgaggccuccagcgccaccaccucccccuucuucaagccgcccgcccagcaccucaacgggagcgcggccuucaacggcguggacgacgggcggcuggccuccgccgaccgccacacggagguccccaccgggaccugccccguggaccccuucgaggcccagugggcggcccuggagaacaagagcaagcagcggaccaaccccuccccgaccaaccccuucagcuccgaccuccagaagacguucgagaucgagcuguga

SEQ ID NO: 33882 - RNA, 1707 nt, Artificial Sequence
  derived and/or modified sequence opt1 from NUMBL__Homo_sapiens__NP_001276909
augaacaagcugcgccagagccuccggcgccggaagcccgccuacgugccggaggccucccgcccccaccaguggcaggcggacgaggacgccguccggaaggggaccugcagcuuccccgugcgcuaccuggggcacguggaggucgaggagucccggggcaugcacgugugcgaggacgccgugaagaagcugaaggccauggggcgcaagagcgucaaguccgugcucugggugagcgccgacggccugcgggucguggacgacaagaccaaggaccugcucguggaccagacgaucgagaaggucuccuucugcgcgcccgaccgcaaccuggacaaggccuucagcuacaucugccgggacgggaccacccgccgguggaucugccacugcuuccuggcccucaaggacuccggcgagcgccugagccacgccgugggcugcgcguucgccgccugccuggagcggaagcagcgccgggagaaggagugcggggugaccgccgccuucgacgcgucccgcacgagcuucgcccgggagggcuccuuccgccucagcgggggcgggcggccggccgagcgcgaggcccccgacaagaagaaggccgaggcggccgccgcccccaccgucgcccccggcccggcgcagcccggccacgugucccccacccccgccaccacgagcccgggggagaagggcgaggccgggacccccguggccgccggcaccaccgcggccgccaucccccgccggcacgcgccccuggagcagcugguccgccagggcuccuuccggggguucccggcccucagccagaagaacucccccuucaagcgccagcugagccugcggcucaacgagcugcccagcacgcugcagcgccggaccgacuuccaggugaagggcaccgugcccgagauggagccgcccggggccggcgacuccgacagcaucaacgcccucugcacccagaucuccagcuccuucgccagcgccggggcgcccgcccccggcccgccgcccgccacgaccggcaccuccgccuggggcgagcccagcgucccgcccgccgcggccuuccagcccggccacaagcgcaccccguccgaggccgagcgguggcuggaggaggugagccagguggccaaggcccagcagcagcagcagcagcagcagcagcagcagcagcagcagcagcagcagcagcagcaggcggccuccgucgcccccgugcccacgaugcccccggcccugcagcccuuccccgcgcccgucgggccguucgacgccgcccccgcccagguggccguguuccucccgccgccccacaugcagccgcccuucguccccgcguaccccggccugggguacccgcccaugccccgcgugcccguggucggcaucacccccagccagaugguggccaacgccuucugcuccgccgcccagcugcagccccagcccgcgacccuccugggcaaggccggggccuucccgccgcccgccauccccagcgcccccggcucccaggcgcggccccgccccaacggggcccccuggccgcccgagcccgcccccgcccccgcgcccgagcuggaccccuucgaggcccagugggccgcccucgagggcaaggccaccguggagaagcccagcaaccccuucuccggggaccugcagaagacguucgagaucgagcuguga

SEQ ID NO: 33883 - RNA, 4521 nt, Artificial Sequence
  derived and/or modified sequence opt1 from NUP153__Homo_sapiens__NP_001265138
auggccagcggcgccgggggcgucgggggcgggggcggcgggaagauccgcacccggcgcugccaccagggccccaucaagccguaccagcaggggcggcagcagcaccagggcauccugucccgcgugaccgagagcgugaagaacaucgugcccggguggcuccagcgguacuucaacaagaacgaggacgucugcuccugcagcacggacaccuccgaggugccccgcuggcccgagaacaaggaggaccaccugguguacgcggacgaggagagcuccaacaucaccgacggccggaucaccccggagcccgccgucagcaacacggaggagcccuccaccaccagcaccgccuccaacuaccccgacgugcugacgcgcccgagccuccaccggucccaccugaacuucagcaugcuggagucccccgcccuccacugccagcccagcaccuccagcgccuuccccaucggcuccagcggguucagccuggugaaggagaucaaggacuccaccagccagcacgacgacgacaacaucuccaccacgagcggcuucuccagccgcgcguccgacaaggacaucaccgucagcaagaacaccucccugccgccccucuggagccccgaggccgagcggucccacagccugucccagcacaccgccacgagcuccaagaagcccgccuucaaccugagcgcguucgggacccucuccccgagccugggcaacuccagcauccugaagaccagccagcucggcgacucccccuucuaccccgggaagaccacguacggcggggccgccgccgccgugcgccagagcaagcugcggaacacccccuaccaggcgccggugcgccggcagaugaaggccaagcagcuguccgcccagagcuacggcgucaccuccagcaccgcccgccggauccuccagucccuggagaagaugagcagcccccuggccgacgcgaagcgcauccccuccaucguguccagcccccucaacuccccgcuggaccggagcgggaucgacaucacggacuuccaggccaagcgcgagaagguggacucccaguacccgcccguccagcggcugaugacccccaagcccgugagcaucgccaccaaccgcuccguguacuucaagcccagccucacccccagcggcgaguuccgcaagacgaaccagcggaucgacaacaagugcuccaccggcuacgagaagaacaugaccccggggcagaaccgcgagcagcgggagagcggcuucuccuaccccaacuucagccugcccgccgccaacgggcuguccagcggcgucgggggcggcgggggcaagaugcgccgggagcgcacccgguucguggcguccaagccccucgaggaggagcgccaggggcugacggugcugccgaagcucaucagcuccagcugcgcccaggccaucauccccuccuggccccugaagguccugcggcuccaggagauggaggugcccgugcugccgaagaucagccugcccaucaccuccagcucccuccccaccuucaacuucagcucccccgagaucaccacgagcuccccgagccccaucaacagcucccaggcccugaccaacaagguccagaugaccagccccuccagcaccggcucccccauguucaaguucagcuccccgaucgucaagagcaccgaggccaacgugcugccgcccuccagcaucggguucacguucuccgugcccguggcgaagaccgccgagcucagcggcuccagcuccacccuggagcccaucaucagcuccagcgcccaccacgucaccacggugaacuccaccaacugcaagaagaccccgcccgaggacugcgagggccccuuccgccccgccgagauccugaaggaggggagcgugcucgacauccucaagagccccggcuucgcgucccccaagaucgacagcgucgccgcccagccgaccgccacgucccccgugguguacacccggcccgccaucagcuccuucagcuccagcgggaucggcuucggcgagucccugaaggcggggagcuccuggcagugcgacacgugccugcugcagaacaaggucaccgacaacaagugcaucgccugccaggccgccaagcugagcccccgcgacaccgccaagcagaccggcaucgagaccccgaacaaguccgggaagaccacgcucagcgcguccggcaccggguucggcgacaaguucaagcccgugaucggcaccugggacugcgacacgugccuggugcagaacaagcccgaggccaucaagugcgucgccugcgagacccccaagccggggaccugcgugaagcgggcccugacccugaccguggucagcgaguccgccgagacgaugaccgcgagcuccagcagcugcaccgugaccacgggcacccucggguucggcgacaaguucaagcgccccaucggguccugggagugcagcgugugcugcgucuccaacaacgccgaggacaacaagugcgugagcugcauguccgagaagcccggcagcuccgugcccgccagcuccagcuccaccgucccggugagccugcccuccggcgggagccugggccucgagaaguucaagaagcccgagggguccugggacugcgagcugugccuggugcagaacaaggccgacagcaccaagugccucgcgugcgaguccgccaagcccggcacgaaguccggguucaagggcuucgacaccagcagcagcuccagcaacuccgccgccagcuccagcuucaaguucggcgucuccagcuccagcuccgggccgagccagacccugaccuccacgggcaacuucaaguucggggaccagggcggguucaagaucggcgugagcuccgacagcggcuccaucaaccccaugagcgagggguucaaguucuccaagcccaucggcgacuucaaguucggggugagcagcgaguccaagcccgaggaggucaagaaggacagcaagaacgacaacuucaaguucggccuguccagcggccucuccaacccggugagccugacccccuuccaguucgggguguccaaccugggccaggaggagaagaaggaggagcuccccaagagcuccagcgccggguucuccuucggcaccggggucaucaacagcacccccgcgccggccaacaccaucgugacguccgagaacaagagcuccuucaaccugggcaccaucgagaccaagagcgccuccguggcccccuucacgugcaagaccagcgaggccaagaaggaggagaugcccgcgaccaagggcggguucagcuucggcaacgucgagcccgccucccugccgagcgccuccguguucgugcucgggcggaccgaggagaagcagcaggagcccgucaccagcacgucccugguguucggcaagaaggccgacaacgaggagcccaagugccagccgguguucagcuucgggaacuccgagcagaccaaggacgagaacagcuccaagagcaccuucuccuucagcaugaccaagcccuccgagaaggagagcgagcagcccgccaaggcgacguucgccuucggcgcccagaccuccaccaccgccgaccagggcgcggccaagcccgucuucagcuuccugaacaacuccagcuccagcagcuccacgccggccaccagcgccgggggcgggaucuucggcuccagcaccuccagcuccaacccgcccguggccaccuucguguucgggcagagcuccaaccccgucagcuccagcgcguucggcaacacggccgaguccagcaccucccagagccuccuguucucccaggacagcaagcuggccaccaccuccagcacgggcaccgccgugacccccuucguguucgggcccggcgccagcuccaacaacaccacgaccagcggguucggcuucggcgcgaccaccacguccagcuccgccgggagcuccuucgucuucggcaccgggcccagcgcccccuccgccagcccggccuucggcgcgaaccagacccccaccuucgggcagucccagggcgccagccagcccaacccgcccggcuucggguccaucagcuccagcacggcccucuuccccaccggcucccagcccgcgcccccgaccuucgggaccgugagcuccagcagccagccgcccguguucggccagcagcccucccagagcgccuucggguccggcaccacgcccaacagcuccagcgccuuccaguucggcuccagcaccaccaacuucaacuucaccaacaacucccccagcggggucuucacguucggcgccaacuccagcacccccgccgccuccgcgcagcccagcggguccggcggguucccguucaaccagagccccgccgccuucaccgugggcuccaacggcaagaacguguucagcuccagcgggaccagcuucuccggccgcaagaucaagacggccguccggcgccggaaguga

SEQ ID NO: 33884 - RNA, 3984 nt, Artificial Sequence
  derived and/or modified sequence opt1 from NUP155__Homo_sapiens__NP_001265241
augcccagcucccugcucggcgccgccaugccggcgagcaccuccgccgccgcccugcaggaggcccuggagaacgcggggcgccucaucgaccggcagcugcaggaggaccgcauguaccccgaccugagcgagcuccugaugguguccgcccccaacaaccccaccgucagcggcauguccgacauggacuacccgcugcaggggcccggccuccugagcgugcccaaccugcccgagaucuccagcauccggcgcgugccgcucccccccgagcuggucgagcaguucgggcacaugcagugcaacugcaugaugggcguguuccccccgaucucccgggccuggcugacgaucgacagcgacaucuucauguggaacuacgaggacggcggggaccucgccuacuucgacggccuguccgagaccauccuggcgguggggcucgucaagcccaaggccggcaucuuccagccccacgugcgccaccugcuggugcucgccacccccgucgacaucgugauccuggggcugagcuacgccaaccuccagaccggcuccggcgugcugaacgacagccuguccgggggcaugcagcuccugccggacccccuguacagccuccccacggacaacaccuaccugcugaccaucaccuccacggacaacgggcggaucuuccucgccggcaaggacggcugccuguacgaggucgcguaccaggccgaggccgggugguucagccagcgcugccggaagaucaaccacagcaaguccagccuguccuuccucgugcccagccugcugcaguucaccuucuccgaggacgacccgauccuccagaucgccaucgacaacagccgcaacauccuguacacccgguccgagaagggcgugauccaggucuacgaccuggggcaggacggccaggggaugagccgcguggccuccgugagccagaacgcgaucgucuccgccgccggcaacaucgcccggaccaucgaccgcagcguguucaagcccaucgugcagaucgccgucaucgagaacuccgagagccucgacugccagcugcuggcggugacgcacgccggcgugcggcucuacuucuccaccugccccuuccgccagccccuggcccggccgaacacccugacccucguccacgugcgccugccccccggguucagcgccuccagcacggucgagaagcccuccaaggugcaccgggcccuguacagcaagggcauccugcucauggcggccagcgagaacgaggacaacgacauccuguggugcgugaaccacgacaccuucccguuccagaagcccaugauggagacccagaugaccgccggggucgacggccacuccugggcccugagcgcgaucgacgagcucaagguggacaagaucaucacgccccugaacaaggaccacaucccgaucaccgacucccccguggucgugcagcagcacaugcugccccccaagaaguucgugcuccugagcgcccaggggucccugauguuccacaagcuccgcccggucgaccagcugcggcaccugcucgugagcaacgugggcggcgacggggaggagaucgagcgcuucuucaagcugcaccaggaggaccaggccugcgccaccugccugauccucgccugcuccaccgcggccugcgaccgcgaggucagcgccugggccacgcgggccuucuuccgcuacggcggggaggcgcagaugcgguuccccaccacccugccccccccguccaacgugggccccauccuggggagccccguguacuccagcucccccgucccgagcggcucccccuaccccaaccccagcuuccucggcaccccgucccacgggauccagccccccgccaugagcacgcccgugugcgcccugggcaacccggccacccaggccaccaacaugagcugcgugaccgggcccgagaucgucuacuccggcaagcacaacggcaucugcaucuacuucagccgcaucauggggaacaucugggacgcgucccuggugguggagcggaucuucaagagcggcaaccgcgagaucacggccaucgaguccagcguccccugccagcuccuggaguccgugcugcaggagcucaaggggcugcaggaguuccuggaccggaacagccaguucgccggcgggccccucggcaacccgaacaccaccgccaaggugcagcagcgccugaucggcuucaugcggcccgagaacgggaacccccagcagaugcagcaggagcugcagcgcaaguuccacgaggcgcagcucuccgagaagaucagccugcaggccauccagcagcugguccggaaguccuaccaggcccucgcccuguggaagcugcucugcgagcaccaguucaccaucaucguggccgagcugcagaaggcgaacgagcugcuccagcgcagccggcaggugcagaacaagacggagaaggagcgcaugcugcgggagucccugaaggaguaccagaagaucagcaaccaggucgaccucuccaacgugugcgcccaguaccgccaggugcgguucuacgagggcgucguggagcugagccugaccgccgccgagaagaaggacccgcaggggcucggccugcacuucuacaagcacggggagcccgaggaggacaucgugggccugcaggccuuccaggagcgccucaacuccuacaagugcaucaccgacacccugcaggagcuggucaaccagagcaaggcggccccccagucccccagcgugccgaagaagcccggcccccccgugcucagcuccgacccgaacaugcugagcaacgaggaggccgggcaccacuucgagcagaugcugaagcucucccagcggagcaaggacgagcuguucuccaucgcccuguacaacuggcucauccaggucgaccuggccgacaagcugcuccagguggcgagccccuuccuggagccccaccuggugcgcauggccaaggucgaccagaaccgcgugcgguacauggaccuccuguggcgcuacuacgagaagaaccgguccuucagcaacgccgcccgcgugcugucccggcucgcggacaugcacagcaccgagaucucccugcagcagcgccuggaguacaucgcccgggccauccucagcgccaaguccagcacggccaucuccagcaucgcggccgacggcgaguuccugcacgagcuggaggagaagauggaggucgcccgcauccagcuccagauccaggagacccugcagcggcaguacucccaccacagcuccgugcaggacgccgugagccagcuggacagcgagcucauggacaucaccaagcuguacggggaguucgccgaccccuucaagcuggcggagugcaagcucgccaucauccacugcgccggcuacuccgacccgauccugguccagacccuguggcaggacaucaucgagaaggagcucagcgacuccgugacgcugagcuccagcgaccgcaugcacgcccugucccucaagaucgugcugcuggggaagaucuacgccggcaccccccgguucuucccccucgacuucaucguccaguuccuggagcagcaggugugcacccugaacugggacgugggcuucgucauccagaccaugaacgagaucggggugccccucccgcgccugcuggaggucuacgaccagcucuucaagagccgggaccccuucuggaaccgcaugaagaagccccugcaccugcuggacugcauccacgugcuccugauccgguacguggagaaccccucccagguccugaacugcgagcgccggcgcuucacgaaccucugccuggacgcggugugcggcuaccugguggagcuccagagcauguccagcuccgucgccgugcaggccaucaccgggaacuucaagagccugcaggccaagcuggagcggcuccacuga

SEQ ID NO: 33885 - RNA, 6039 nt, Artificial Sequence
  derived and/or modified sequence opt1 from NUP205__Homo_sapiens__NP_055950
auggccacgccccuggccgugaacagcgcggccucccucuggggccccuacaaggacaucuggcacaagguggggaacgcccuguggcgccgccagcccgaggccgugcaccuccuggacaagauccugaagaagcacaagcccgacuucaucagccuguucaagaacccgcccaagaacgugcagcagcacgagaagguccagaaggccuccaccgagggcguggcgauccaggggcagcagggcacccgccugcugcccgagcagcugaucaaggaggccuucauccucagcgaccuguucgacaucggggagcuggccgccguggagcuccugcuggcgggcgagcaccagcagccccacuuccccggccucacccgggggcuggucgccgugcugcucuacugggacggcaagcgcugcaucgccaacucccugaaggcccugauccagagccggcgcgggaagaccuggacccucgagcuguccccggagcuggccagcaugaccacccgguucaccgacgagcucauggagcagggccugaccuacaaggugcugacgcucgucucccagaucgacgugaacaacgaguucgagaagcugcagcgcgagcgggggcugggcagcgagaagcaccgcaaggagguguccgaccucaucaaggagugccggcagagccuggcggagucccuguucgccugggccugccagagcccccucggcaaggaggacacccugcugcucaucgggcaccuggagcgcgucaccguggaggccaacggcucccuggacgccgugaaccucgcgcugcugauggcccuccuguacugcuucgacaucagcuucaucgagcaguccaccgaggagcgggacgacaugauccaccagcugccccuccugacggagaagcaguacaucgccaccauccacagccgccugcaggacucccagcucuggaagcugcccgggcugcaggccaccguccggcuggccugggcgcucgcccugcgcggcaucagccagcugcccgacgugaccgcccucgccgaguucacggaggccgacgaggcgauggccgagcuggccaucgccgacaacguguuccuguuccucauggagagcgucgugguguccgaguacuucuaccaggaggaguucuacauccggcgcguccacaaccugaucaccgacuuccuggcgcucaugcccaugaaggugaagcagcugcggaaccgcgccgacgaggacgcccggaugauccacaugagcaugcagaugggcaacgagccgcccaucucccugcgccgcgaccucgagcaccugaugcugcucaucggggagcuguacaagaagaaccccuuccaccuggagcucgcccuggaguacuggugccccaccgagccccugcagacccccacgaucaugggcagcuaccucgggguggcccaccagcggccgccccagcgccaggucgugcuguccaaguucguccggcagaugggcgaccugcugccgcccaccaucuacauccccuaccugaagaugcugcaggggcucgcgaacggcccccagugcgcccacuacugcuucagccugcugaaggugaacggcuccagccacguggagaacauccagggggccggcgggucccccgucagcugggagcacuucuuccacucccucaugcuguaccacgagcaccuccgcaaggaccuccccagcgccgacuccgugcaguaccggcaccuccccagccgcggcaucacccagaaggagcaggacgggcugaucgccuuccugcagcugaccuccacgaucaucaccuggagcgagaacgcgcggcuggcccucugcgagcacccccaguggacccccguggucgugauccugggccugcuccagugcuccaucccgcccgugcugaaggccgagcugcucaagacccuggccgccuucggcaagagccccgagaucgcggccucccuguggcagagccucgaguacacgcagauccugcagaccguccgcauccccagccagcggcaggccaucgggaucgagguggagcugaacgagaucgagucccgcugcgaggaguacccccucacccgggccuucugccagcugaucagcacccugguggaguccagcuuccccuccaaccucggcgcggggcugcggccgcccggcuucgaccccuaccugcaguuccuccgggacagcgucuuccugcgcuuccggacgcgcgccuaccggcgcgccgccgagaagugggagguggccgaggugguccuggagguguucuacaagcuccugcgggacuacgagccccagcuggaggacuucguggaccaguucgucgagcuccagggggaggagaucaucgcguacaagccgcccggcuucucccugauguaccaccuccugaacgagagcccgaugcuggagcuggcccucucccugcuggaggagggcgugaagcagcucgacaccuacgcccccuuccccgggaagaagcaccuggagaaggccgugcagcacugccuggcccuccugaaccugacccuccagaaggagaaccuguucauggaccugcuccgcgagagccagcuggcgcugaucgucugcccccucgagcagcugcugcagggcaucaacccgcgcaccaagaaggccgacaacguggugaacaucgcccgguaccucuaccacgggaacacgaaccccgagcuggccuucgaguccgccaagauccugugcugcaucagcugcaacuccaacauccagaucaagcucgucggcgacuucacccacgaccagagcaucucccagaagcugauggcgggcuucguggagugccuggacugcgaggacgccgaggaguucgugcgccucgaggaggggagcgagcuggagaagaagcuggucgccauccggcacgagacccgcauccacauccugaaccuccugaucaccucccuggagugcaacccgcccaaccucgcccuguaccugcucggcuucgagcugaagaagccggugagcaccacgaaccugcaggaccccggggugcucggcugcccccggaccugccugcacgcgauccugaacauccucgagaaggggaccgagggccgcaccggccccgucgccgugcgggagagcccgcagcuggccgagcugugcuaccaggugaucuaccagcucugcgccugcuccgacacgagcgggcccaccaugcgcuaccugcggaccucccaggacuuccuguucagccagcuccaguaccugcccuucuccaacaaggaguacgagaucagcaugcugaaccagauguccuggcucaugaagaccgccagcaucgagcugcgcgucacgucccugaaccggcagcgcagccacacccagcggcuccugcaccuccugcuggacgacaugccggugaagcccuacuccgacggcgagggcgggaucgaggacgagaaccgcagcguguccggguuccugcacuucgacaccgcgaccaagguccggcgcaagauccucaacauccuggacagcaucgacuucucccaggagauccccgagccccugcagcucgacuucuucgaccgggcccagaucgagcaggucaucgccaacugcgagcacaagaaccugcgcggccagacggugugcaacgucaagcugcuccaccgggugcugguggccgaggucaacgcccugcagggcauggcggccaucgggcagcgcccgcuccugauggaggagaucagcaccgugcugcaguacguggucggccggaacaagcuccugcagugccugcacgccaagcgccacgcccucgaguccuggcgccagcugguggagaucauccugaccgccugcccccaggaccucauccaggcggaggaccggcagcugaucauccgcgacauccugcaggacgugcacgacaagauccucgacgacgaggccgcccaggagcugaugcccgucguggccggggccguguucacccugacggcgcaccucagccaggccguccugaccgagcagaagcagaccuccgugcugggccccgccgaggcccacuacgcguucaugcucgacagcugcuucaccagcccgccgcccgaggagaacccccuggucggguucgccuccaucggcgacagcucccuguacaucauccucaagaagcugcuggacuucauccucaagacgggcgggggcuuccagcgggugcgcacccaccuguacgggagccugcucuacuaccugcagaucgcccagcggccggacgagcccgacacccuggaggccgccaagaagaccaugugggagcgccucacggcgcccgaggacguguucuccaagcugcagcgggagaacaucgccaucaucgagagcuacggcgccgcccugauggaggucgugugccgcgacgccugcgacgggcacgagaucggccggaugcucgcgcuggcccugcucgaccgcaucguguccgucgacaagcagcagcaguggcugcuguaccucagcaacuccggcuaccugaaggugcugguggacagccucgucgaggacgaccggacccugcagucccugcucacgccccagccgccccugcugaaggcccucuacaccuacgagagcaagauggccuuccugacgcgcguggccaagauccagcagggggcgcuggagcuccugcgguccggcgugaucguccgccuggcccagugccagguguacgacaugcggcccgagaccgacccccagagcauguucgggaugcgcgacccgcccauguucauccccacccccguggaccgguaccgccagauccuccugccggcccugcagcucugccaggucauccugaccuccagcauggcccagcaccuccaggcggccggccaggugcuccaguuccugaucucccacagcgacacgauccaggccauccugcggugccaggacguguccgccggcagccugcaggagcucgcccugcugaccgggaucaucagcaaggcggcccuccccggcauccuguccgagcuggacgucgacgugaacgaggggagccucauggagcugcagggccacaucgggcgcuuccagcgccagugccugggccuccugucccgguucggcgggagcgaccgccugcggcaguucaaguuccaggacgacaacguggagggcgacaaggucuccaagaaggacgagaucgagcucgccaugcagcagaucugcgccaacgugauggaguacugccagagccugaugcugcaguccagccccaccuuccagcacgccgugugccucuucacccccucccugagcgagacggucaaccgcgacgggccgcggcaggacacccaggcgcccguggugcccuacuggcgccugccgggccucgggaucaucaucuaccugcugaagcaguccgccaacgacuucuucagcuacuacgacucccaccggcagagcgucuccaagcuccagaacguggagcagcugccgcccgacgagaucaaggagcugugccagagcgugaugcccgccggcgucgacaagaucuccaccgcccagaaguacgugcucgcccgccggcgccuggugaaggucaucaacaaccgggcgaagcugcucagccugugcuccuucaucaucgagaccugccuguucauccucuggcgccaccuggaguacuaccugcuccacugcaugccgaccgacagccaggacagccuguucgccucccggacgcuguucaagagccgccggcuccaggacuccuucgccagcgagaccaaccuggacuuccgcuccggccuggccaucgugagccagcacgaccucgaccagcugcaggcggacgccaucaacgccuucggggagucccugcagaagaagcuccuggacaucgagggccuguacagcaaggugcggucccgcuacagcuucauccaggcccucguccggcgcauccgggggcugcugcgcaucucccgcaacuga

SEQ ID NO: 33886 - RNA, 5664 nt, Artificial Sequence
  derived and/or modified sequence opt1 from NUP210__Homo_sapiens__NP_079199
auggccgcccgcgggcgggggcugcugcugcugacccugagcgugcugcuggcggccggccccagcgccgccgccgcgaagcucaacauccccaaggugcugcugcccuucacccgcgccacccgggugaacuucacccucgaggccagcgaggggugcuaccgcuggcugagcacccggcccgagguggccagcaucgagccccugggccucgacgagcagcagugcucccagaaggcgguggugcaggcccgccugacccagccggcccggcugaccagcaucaucuucgccgaggacaucaccaccggccaggugcuccgcugcgacgccaucgucgaccugauccacgacauccagaucguguccaccacgcgggagcuguaccucgaggacagcccccuggagcugaagauccaggcgcucgacuccgagggcaacaccuucagcacccuggccggccugguguucgaguggaccaucgucaaggacuccgaggccgaccgcuucagcgacucccacaacgcccuccggauccugacguuccuggagagcaccuacaucccgcccuccuacaucagcgagauggagaaggccgcgaagcagggggacaccauccucguguccggcaugaagaccgggagcuccaagcugaaggcccgcauccaggaggccguguacaagaacguccggccggccgaggugcgccugcucauccuggagaacauccugcucaaccccgccuacgacguguaccugauggucggcacgagcauccacuacaaggugcagaagauccggcaggggaagaucaccgagcugagcaugcccuccgaccaguacgagcuccagcugcagaacagcauccccggcccggagggcgaccccgcgcgccccguggccguccuggcccaggacaccuccauggugaccgcccuccagcuggggcagagcucccuggugcucggccaccggagcauccgcaugcagggggccucccggcugcccaacagcacgaucuacgucguggagccgggcuaccugggcuucaccgugcaccccggggaccgcuggguccucgagaccggccggcuguacgagaucaccaucgagguguucgacaaguucuccaacaaggucuacgugagcgacaacauccgcaucgagacggugcugcccgcggaguucuucgagguccucuccagcucccagaacgggagcuaccaccgcauccgggcccugaagcgcggccagaccgccaucgacgccgcgcugaccuccgugguggaccaggacgggggcguccacauccuccaggugcccguguggaaccagcaggaggucgagauccacaucccgaucacccucuaccccagcauccugacguuccccuggcagcccaagaccggcgccuaccaguacaccauccgggcccacgggggcuccgggaacuucagcugguccagcagcucccaccugguggccaccgugacggucaagggcgugaugaccaccgggagcgacaucggcuucuccgugauccaggcccacgacguccagaacccgcuccacuucggcgagaugaagguguacgugaucgagccccacagcauggaguucgcgcccugccaggucgaggcccgcguggggcaggcccuggagcugccccuccggaucuccggccugaugcccgggggcgccagcgagguggucacccuguccgacugcagccacuucgaccucgccguggagguggagaaccagggggucuuccagccccugcccggccgccugccgcccggcuccgagcacugcagcgggauccgggugaaggcggaggcccagggcuccacgacccuccuggugagcuaccgccacgggcacguccaccuguccgccaagaucaccaucgccgccuaccucccccugaaggcgguggaccccagcuccguggcccuggucacccucggcagcuccaaggagaugcuguucgagggcgggccgcggcccuggauccuggagcccagcaaguucuuccagaacgugaccgccgaggacacggacagcaucggccucgcccuguucgcgccccacuccagccgcaacuaccagcagcacuggauccuggugaccugccaggcccucggggagcaggucaucgcccuguccgugggcaacaagccgagccugaccaaccccuuccccgccguggagcccgccgucgugaaguucgugugcgcgccgcccucccggcucacccuggcccccgucuacacgagcccccagcuggacauguccugcccgcuccugcagcagaacaagcaggucgugcccgucagcucccaccgcaacccccggcuggaccucgccgccuacgaccaggaggggcgccgguucgacaacuucagcucccugagcauccagugggaguccacccgccccgugcuggccagcaucgagccggagcuccccaugcagcuggugucccaggacgacgagagcggccagaagaagcugcacggccuccaggcgauccugguccacgaggccuccgggaccaccgccaucacggccaccgccaccggcuaccaggagagccaccuguccagcgcgcggaccaagcagccccacgacccccucgugccgcugagcgccuccaucgagcugauccucguggaggacguccgcgugagccccgaggaggugacgaucuacaaccaccccgggauccaggccgagcugcggauccgcgagggcuccggguacuucuuccugaacaccagcaccgccgacgucgugaaggucgcguaccaggaggcccgcggcguggccauggugcacccgcuccugcccggcuccagcaccaucaugauccacgaccugugccucgucuuccccgcccccgccaaggcggugguguacgucuccgacauccaggagcuguacauccgggugguggacaaggucgagaucgggaagacggugaaggccuacgugcgcguccuggaccuccacaagaagccguuccuggccaaguacuuccccuucauggaccugaagcuccgggccgccagccccaucaucacccugguggcgcuggacgaggcccucgacaacuacaccaucaccuuccugauccgcggcguggccaucgggcagacgucccugaccgccagcgucaccaacaaggccggccagcggaucaacuccgcgccccagcagaucgagguguucccgcccuuccgccucaugccccggaaggugacccugcugaucggggccacgaugcaggucaccagcgagggcggcccccagccgcaguccaacauccucuucagcaucuccaacgagagcguggcccugguguccgccgccgggcugguccagggccucgcgaucgggaacggcaccgugagcgggcuggugcaggccgucgacgccgagaccggcaagguggugaucaucucccaggaccugguccagguggaggugcuccugcugcgcgccguccggauccgcgcgcccaucaugcggaugcgcacgggcacccagaugcccaucuacgugaccgggaucaccaaccaccagaaccccuucagcuucggcaacgccgugccggggcucacguuccacuggagcgucaccaagcgggacgugcuggaccugcgcggccggcaccacgaggccuccauccgccuccccagccaguacaacuucgccaugaacgugcugggccgggucaaggggcgcaccggccugcgggugguggucaaggccguggaccccaccuccgggcagcucuacggccuggcgcgcgagcugagcgacgagauccaggugcaggucuucgagaagcuccagcugcugaaccccgagaucgaggccgagcagauccucauguccccgaacagcuacaucaagcugcagacgaaccgggacggggccgccucccugagcuaccgcgugcucgacggccccgagaaggugcccgucgugcacguggacgagaagggcuuccuggccuccgggagcaugaucggcaccuccaccaucgaggucaucgcgcaggagcccuucggggccaaccagaccaucaucguggccgugaaggucagcccgguguccuaccugcgcgucagcaugucccccgugcuccacacccagaacaaggaggcccugguggccgucccccugggcaugacggugaccuucaccgugcacuuccacgacaacagcggggacgucuuccacgcgcacuccagcgugcugaacuucgccaccaaccgggacgacuucgugcagaucggcaagggccccacgaacaacacgugcgucgugcgcaccguguccgucgggcucacccugcugcgggugugggacgccgagcacccgggccucagcgacuucaugccccugcccgugcugcaggccaucagcccggagcucuccggggcgauggucgugggcgacgugcugugccuggccacgguccucaccagccuggaggggcuguccggcaccuggagcuccagcgccaacuccauccuccacaucgaccccaagaccggcguggccguggcccgcgcggucgggagcgugacgguguacuacgaggucgccggccaccuccggaccuacaaggaggugguggucuccgugccccagcgcaucauggcccggcaccuccaccccauccagaccagcuuccaggaggccaccgccuccaaggugaucgucgcggugggggaccgcagcuccaaccuccggggcgagugcacgccgacccagcgcgaggugauccaggcccugcaccccgagacccugaucagcugccagucccaguucaagcccgccgucuucgacuuccccagccaggacguguucaccguggagccgcaguucgacacggcccucggccaguacuucugcuccaucaccaugcaccggcugaccgacaagcagcgcaagcaccugagcaugaagaagaccgcccucgucguguccgcgagccugagcuccagccacuucuccacggagcaggucggggccgagguccccuucagccccggccuguucgccgaccaggccgagauccuccuguccaaccacuacaccagcuccgagauccggguguucggggcgcccgaggugcuggagaaccucgaggucaagagcggcuccccggccgugcuggccuucgccaaggagaaguccuucggguggcccuccuucaucaccuacaccgugggcguccuggaccccgccgcgggcagccaggggccccucuccacgacccugaccuucagcuccccggugaccaaccaggccaucgccauccccgugacggucgccuucgugguggaccgccggggccccgggcccuacggcgccagccuguuccagcacuuccucgacuccuaccaggucauguucuucacccuguucgcgcugcucgccgggaccgccgugaugaucaucgccuaccacaccgucugcacgccgcgcgaccuggccgugcccgcggcccugacgccccgggccagccccggccacuccccgcacuacuucgccgccagcagccccaccucccccaacgcgcugccgcccgcccgcaaggccuccccgcccuccggccuguggagcccggccuacgcgucccacuga

SEQ ID NO: 33887 - RNA, 6273 nt, Artificial Sequence
  derived and/or modified sequence opt1 from NUP214__Homo_sapiens__NP_005076
augggcgacgagauggacgccaugauccccgagcgcgagaugaaggacuuccaguuccgggcccugaagaagguccgcaucuucgacagccccgaggagcugcccaaggagcggagcagccugcuggccgucagcaacaaguacgggcucguguucgccggcggggccagcggccugcagaucuuccccaccaagaaccugcucauccagaacaagcccggggacgaccccaacaagaucguggacaagguccagggccugcuggugcccaugaaguuccccauccaccaccucgcccuguccugcgacaaccugacccucagcgccugcaugauguccagcgaguacggcuccaucaucgccuucuucgacgugcgcaccuucagcaacgaggccaagcagcagaagcggcccuucgccuaccacaagcugcugaaggacgccgggggcauggucaucgacaugaaguggaaccccaccgugcccuccaugguggccgucugccucgccgacgggagcaucgccgugcugcaggucaccgagaccgucaaggugugcgccacccugcccuccaccguggccgucaccagcgugugcuggucccccaagggcaagcagcucgccguggggaagcagaacggcaccgucgugcaguaccugcccacccugcaggagaagaaggugauccccugcccgcccuucuacgagagcgaccaccccguccgcgugcucgacgugcuguggaucggcaccuacgucuucgccaucguguacgccgccgccgacgggacccuggagaccucccccgacgucgugauggcccuccugcccaagaaggaggagaagcaccccgagaucuucgugaacuucauggagcccugcuacggcagcugcaccgagcggcagcaccacuacuaccuguccuacaucgaggagugggaccucguccuggccgccagcgccgccagcaccgagguguccauccuggcgcgccagagcgaccagaucaacugggaguccuggcuccuggaggacagcucccgggccgagcugcccgugaccgacaagagcgacgacucccuccccaugggggucgugguggacuacaccaaccaggucgagaucaccaucagcgacgagaagacccugccgcccgcccccgugcugaugcuccuguccaccgacggcgugcugugccccuucuacaugaucaaccagaaccccggcgucaagagccucaucaagacccccgagcgccugucccuggagggggagcggcagcccaagagccccggcuccacgccgaccacccccaccagcucccaggcgccccagaagcucgacgccagcgcggccgccgcccccgcgucccugccgcccagcucccccgccgcccccaucgccacguucagccugcucccggccgggggcgcgcccaccguguucagcuucggguccagcucccugaaguccuccgccaccgugaccggcgagccgcccagcuacuccagcggcuccgacagcuccaaggccgccccggggcccggccccagcacguucuccuucgugcccccgagcaaggccucccuggcgcccacccccgccgccagccccguggccccguccgccgcgagcuucagcuucggguccagcggcuucaagcccacccucgaguccacccccgugcccagcgucuccgccccgaacaucgccaugaagcccagcuucccgcccuccacgagcgccgugaaggugaaccuguccgagaaguucaccgcggccgccaccagcacccccgucuccagcucccagagcgcgccgcccaugucccccuucagcuccgccagcaagcccgcggccuccgggccccugagccaccccacgccgcugagcgcgccgcccuccagcgugccccucaaguccagcgugcugccgucccccagcggccgcuccgcccagggcagcuccagccccguccccuccauggugcagaaguccccgcggaucacgccgcccgccgcgaagcccggguccccgcaggccaagagccugcagcccgccguggccgagaagcagggccaccaguggaaggacuccgaccccgucauggccgggaucggcgaggagaucgcgcacuuccagaaggagcucgaggagcugaaggcccgcaccagcaaggccugcuuccagguggggaccuccgaggagaugaagaugcugcggaccgagagcgacgaccuccacacguuccugcuggagaucaaggagaccaccgagucccuccacggcgacaucagcagccugaagaccacgcugcucgagggcuucgccgggguggaggaggcgcgcgagcagaacgagcggaaccgcgacuccggcuaccugcaccuccuguacaagcggccccuggaccccaagagcgaggcccagcugcaggagauccgccggcuccaccaguacgucaaguucgccgugcaggacgugaacgacguccuggaccuggagugggaccagcaccucgagcagaagaagaagcagcgccaccuccuggugcccgagcgcgagacccucuucaacacccuggccaacaaccgggagaucaucaaccagcagcgcaagcggcugaaccaccucguggacucccugcagcagcugcgccucuacaagcagaccagccuguggucccugagcuccgccguccccagccaguccagcauccacuccuucgacagcgaccucgagucccugugcaacgcgcugcucaagacgaccaucgagagccacaccaagucccugcccaaggugccggccaagcugagccccaugaagcaggcccagcuccggaacuuccuggccaagcgcaagacgccgcccgugcgguccacggcccccgcgagccugucccgcagcgccuuccucagccagcgguacuacgaggaccuggacgaggucuccagcaccuccagcgugucccagagccuggaguccgaggacgcccgcaccagcugcaaggacgacgaggccgugguccaggcgccccggcacgcgcccguggugcgcacccccuccauccagcccagccuccugccccacgccgcccccuucgccaagucccaccugguccacgggagcuccccgggcgugaugggcacgagcguggccaccuccgcgagcaagaucaucccccagggggccgacuccaccaugcucgccaccaagacggucaagcacggcgcccccagccccucccacccgaucagcgcgccccaggccgccgccgccgcggcccugcggcgccagauggccagccaggcccccgccgugaacacccugaccgaguccacccucaagaacgugccccaggucgugaacguccaggagcugaagaacaacccggcgacgcccagcaccgccaugggguccagcgugcccuacuccaccgccaagacgccccacccggugcugacgcccgucgccgccaaccaggcgaagcagggcagccucaucaacucccugaagcccagcgggcccaccccggccuccggccagcugagcuccggcgacaaggccagcgggaccgccaagaucgagaccgcggugacguccacccccagcgccuccggccaguucagcaagcccuucuccuucagccccuccgggaccggcuucaacuucgggaucaucaccccgacgcccagcagcaacuucaccgccgcccagggcgccacccccuccaccaaggagagcucccagccggacgcguucagcuccggcgggggcagcaagcccuccuacgaggccauccccgagagcagcccgcccagcgggaucaccuccgccagcaacacgacccccggcgagcccgccgccuccagcucccggcccguggcgcccagcgggaccgcccucuccaccacgagcagcaagcuggagacgccgcccuccaagcugggcgagcuccuguuccccagcucccuggccggcgagacccucgggagcuucuccggccugcgcgucgggcaggccgacgacagcaccaagccgacgaacaaggccuccagcaccucccugaccagcacccagcccacgaagaccuccggcgugcccagcggguucaacuucaccgcgcccccggugcucggcaagcacaccgagccgcccgucacguccagcgccaccaccaccuccguggcgccgcccgccgcgacgagcaccuccagcaccgccguguucggcucccugcccgucaccagcgccgggagcuccggcgugaucagcuucgggggcacgucccugagcgccggcaagaccuccuucagcuucgggucccagcagaccaacagcaccgugccgcccuccgcgcccccgcccacgaccgccgccaccccgcuccccaccagcuuccccacgcuguccuucggcagccugcucuccagcgccaccacccccucccugccgaugagcgccgggcgguccaccgaggaggccacgagcuccgcgcugcccgagaagcccggcgacagcgaggucagcgccuccgccgccagccuccuggaggagcagcaguccgcccagcugccccaggcgccgccccagaccagcgacuccgugaagaaggagcccgugcucgcccagcccgccgucagcaacuccgggaccgccgccagcuccaccagccugguggcgcuguccgccgaggccaccccggccacgaccggcgugcccgacgcgcgcaccgaggccgugccgcccgccagcuccuucagcgugccgggccagaccgccgugacggccgcggccaucuccagcgccgggcccgucgccguggagaccuccagcacccccaucgccuccagcaccacgagcaucguggcgcccggcccguccgccgaggccgccgccuucgggaccgucaccagcggcuccagcguguucgcgcagccgcccgccgccuccagcuccagcgccuucaaccagcucaccaacaacacggcgaccgcccccuccgccaccccgguguucgggcaggucgccgccagcaccgcgcccucccuguucggccagcagacgggcagcaccgccuccaccgccgccgccacgccccaggugagcuccagcggguucuccagccccgcguucggcacgaccgccccggggguguucggccagaccaccuucgggcaggccuccgucuucggccagagcgccagcuccgccgcgagcguguucuccuucagccagcccggcuucuccagcgugcccgccuucgggcagccggccuccagcacgcccaccuccaccagcggcuccgucuucggggccgcgagcuccaccagcuccagcuccagcuucuccuucggccagagcagccccaacacgggcgggggccuguucgggcaguccaacgcccccgccuucggccagagcccgggguucggccagggcggguccguguucggcgggaccagcgccgccaccaccacggcggccaccuccggcuucagcuucugccaggccuccggguucggcagcuccaacaccggcagcguguucgggcaggccgccuccaccggcgggaucgucuucggccagcagagcuccagcuccagcggguccguguucggcagcggcaacacggggcggggcgggggcuucuucagcgggcucggcggcaagcccucccaggacgcggccaacaagaaccccuucagcuccgccagcgggggcuucggguccaccgccaccagcaacaccuccaaccuguucggcaacagcggcgccaagacguucgggggcuucgcguccagcuccuucggggagcagaagcccaccggcaccuucagcuccgggggcggcagcguggccucccagggguucggcuucagcuccccgaacaagaccgggggcuucggggccgcccccgucuucggcuccccgcccaccuucggcggguccccgggcuucgggggcgugcccgccuucgggagcgcgcccgccuucacgagcccccugggcuccaccggcgggaagguguucggcgaggggaccgccgccgcgagcgccggcggguucggcuucggcuccagcuccaacaccacgagcuucgggacccucgccucccagaacgccccgaccuucggcagccugucccagcagaccagcggguucggcacgcaguccagcggcuucuccggguucggcagcgggaccggcggguucuccuucggcagcaacaacuccagcguccagggcuucgggggcuggcgcuccuga

SEQ ID NO: 33888 - RNA, 930 nt, Artificial Sequence
  derived and/or modified sequence opt1 from NUP35__Homo_sapiens__NP_001274513
augaugcugggcagccccaccuccccgaagcccggggugaacgcccaguuccuccccggcuuccugaugggggaccugcccgccccggucacgccccagccccgcagcaucuccggccccagcgugggggugauggagaugcgguccccgcuccuggcgggcggcagcccgccccagcccgucgugcccgcccacaaggacaaguccggggccccgcccgugcgcagcaucuacgacgacaucuccagccccggccugggguccacgccccucaccagccggcgccagcccaacaucuccgucaugcagagcccccuggugggcgugaccuccacccccgggaccggccagagcauguucuccccggccagcaucggccagccccggaagaccacccugucccccgcccagcucgaccccuucuacacccagggggacagccugacgagcgaggaccaccuggacgacuccugggucaccguguucggcuucccgcaggcgagcgccuccuacauccuccugcaguucgcccaguacgggaacauccugaagcacgugaugagcaacaccggcaacuggaugcacauccgcuaccaguccaagcuccaggcccggaaggcgcugagcaaggacggccgcaucuucggggaguccaucaugaucggcgucaagcccugcaucgacaagagcgugauggaguccagcgaccggugcgcccuguccagccccucccucgccuucacgcccccgaucaagacccuggggacccccacccagcccggcagcaccccgcgcaucuccacgaugcggccccuggccaccgccuacaaggcgagcaccuccgacuaccaggugaucagcgaccgccagacccccaagaaggacgagucccucgucagcaaggccauggaguacauguucgggugguga

SEQ ID NO: 33889 - RNA, 981 nt, Artificial Sequence
  derived and/or modified sequence opt1 from NUP37__Homo_sapiens__NP_076962
augaagcaggacgccagccgcaacgccgcguacaccguggacugcgaggacuacguccacgugguggaguucaaccccuucgagaacggcgacuccgggaaccugaucgccuacggcgggaacaacuacgucgugaucgggaccugcacguuccaggaggaggaggccgacguggagggcauccaguacaagacccuccggaccuuccaccacggcguccgcguggacggcaucgccuggagcccggagacccggcuggacucccugccgcccgugaucaaguucugcacgagcgccgcggacaugaagauccgccucuucaccuccgaccugcaggacaagaacgaguacaagguccuggaggggcacaccgacuucaucaacggccucguguucgaccccaaggaggggcaggagaucgccagcguguccgacgaccacacgugccggaucuggaaccuggagggcguccagaccgcccacuucgugcugcacagccccgggauguccgugugcuggcaccccgaggagaccuucaagcucauggucgccgagaagaacggcaccauccgcuucuacgaccugcuggcgcagcaggccauccucagccuggaguccgagcaggucccccugaugagcgcccacuggugccucaagaacaccuucaaggugggcgccguggccgggaacgacuggcugaucugggacaucacgcgguccagcuacccccagaacaagcgcccggugcacauggaccgggcgugccuguuccgcugguccaccaucagcgagaaccucuucgccaccaccggcuaccccgggaagauggccucccaguuccagauccaccaccugggccacccccagcccauccugaugggcagcguggccgucggguccggccucagcuggcaccggacgcugccgcugugcgugaucgggggcgaccacaagcuccuguucugggugaccgaggucuga

SEQ ID NO: 33890 - RNA, 1143 nt, Artificial Sequence
  derived and/or modified sequence opt1 from NUP43__Homo_sapiens__NP_942590
auggaggagaucuacgccaaguucgugagccagaagaucuccaagacccgcuggcggccccugccgcccggcagccuccagaccgccgagacguucgcgaccggguccugggacaacgaggagaacuacaucagccugugguccaucggcgacuucgggaaccuggacagcgacggcggguucgagggcgaccaccagcuccugugcgacauccgccaccacggcgacgucauggaccugcaguucuucgaccaggagcggaucguggccgccuccagcaccgggugcgugaccgucuuccuccaccaccccaacaaccagacgcuguccgugaaccagcaguggaccaccgcccacuaccacaccggccccgggagcccguccuacagcuccgcccccugcacgggcguggucugcaacaaccccgagaucgugaccgugggggaggacggccgcaucaaccuguuccgggcggaccacaaggaggccguccgcaccaucgacaacgccgacagcuccacccuccacgccgugacguuccugcggacccccgagauccugaccgugaacagcaucggccagcucaagaucugggacuuccgccagcaggggaacgagccgucccagauccugagccugaccggcgaccgggucccccuccacugcguggaccgccaccccaaccagcagcacguggucgcgaccgggggccaggacggcaugcuguccaucugggacgugcggcaggggaccaugcccgugagccugcucaaggcccacgaggccgagaugugggagguccacuuccacccgagcaaccccgagcaccuguucacgugcuccgaggacggcagccuguggcacugggacgccuccaccgacgugcccgagaaguccagccucuuccaccagggcgggcgcagcuccacguuccugagccacuccaucagcaaccaggccaacgugcaccaguccgucaucagcuccuggcugagcaccgaccccgcgaaggaccggaucgagaucaccucccuccugccgagccgcucccugagcgugaacacccucgacgugcuggggcccugccuggucugcggcacggacgccgaggccaucuacgugacccggcaccucuucuccuga

SEQ ID NO: 33891 - RNA, 1323 nt, Artificial Sequence
  derived and/or modified sequence opt1 from NUP50__Homo_sapiens__XP_005261370
auggccagcgaggaggugcugaagaaccgcgccaucaagaaggcgaagcggcgcaacgucggcuucgaguccgacaccgggggcgccuucaagggguucaagggccucguggugcccagcgggggcggccgguucuccggguucggcagcggggccggcgggaagccccuggagggccuguccaacggcaacaacaucaccagcgccccgcccuucgccuccgcgaaggccgccgccgaccccaaggucgcguucgggagccucgccgccaacggccccacgacccugguggacaagguguccaaccccaagaccaacggggacagccagcagcccuccagcuccggccuggccagcuccaaggccugcgucggcaacgcguaccacaagcagcucgccgcccugaacugcagcgugcgcgacuggaucgugaagcacgucaacaccaacccccugugcgaccucacgccgaucuucaaggacuacgagaaguaccuggccaacaucgagcagcagcacgggaacuccggccggaacagcgaguccgagagcaacaagguggccgcggagacccagagccccucccuguucgggagcaccaagcuccagcaggaguccaccuuccuguuccacggcaacaagacggaggacacccccgacaagaagauggagguggccagcgagaagaagaccgaccccuccagccugggggccaccuccgccagcuucaacuucggcaagaaggucgacuccagcgugcucggcucccugagcuccgugccgcugacgggguucagcuucucccccggcaacagcucccucuucgggaaggacaccacccagagcaagcccgucuccagccccuucccgaccaagccccuggagggccaggccgagggggacagcggcgagugcaagggcggggacgaggaggagaacgacgagccgcccaaggugguggucacggaggugaaggaggaggacgcguucuacuccaagaagugcaagcuguucuacaagaaggacaacgaguucaaggagaagggcaucgggacccuccaccugaagcccaccgccaaccagaagacccagcugcucgugcgcgccgacacgaaccugggcaacauccugcucaacguccugaucccgcccaacaugcccugcacccggaccgggaagaacaacgugcugaucgugugcguccccaacccgcccaucgacgagaagaacgccaccaugcccgugacgaugcucauccgcgucaagaccagcgaggacgccgacgagcugcacaagauccugcucgagaagaaggacgcguga

SEQ ID NO: 33892 - RNA, 1569 nt, Artificial Sequence
  derived and/or modified sequence opt1 from NUP62__Homo_sapiens__NP_001180286
augagcggcuucaacuucgggggcaccggggcccccaccggcggguucacguucggcaccgccaagaccgcgaccacgaccccggccaccggcuucuccuucagcaccuccgggacgggcggguucaacuucggcgcccccuuccagcccgccaccagcacccccuccaccgggcuguucagccucgccacgcagaccccggcgacccagaccacgggcuucaccuucggcaccgccacccuggccuccgggggcacgggguucagccugggcaucggcgccuccaagcucaaccugagcaacaccgcggccacccccgccauggccaaccccuccggguucggccuggggagcuccaaccucaccaacgccaucagcuccacggugaccagcucccagggcaccgcgcccaccggguucgucuucggcccgagcacgaccuccguggcccccgccaccaccagcggcggguucagcuucacgggcggguccaccgcccagcccagcggcuucaacaucggguccgccggcaacagcgcgcagcccaccgccccggccacccugcccuucacgcccgccacccccgccgcgaccaccgccggcgccacccagccggccgcccccacgcccaccgcgaccaucaccuccacggggcccagccuguucgccuccaucgccaccgccccgaccagcuccgcgaccacgggccucagccugugcacccccgugaccaccgccggggcccccacggccggcacccagggguucucccugaaggcccccggcgcggccagcggcaccuccaccacgaccagcaccgccgccaccgccacggcgaccaccaccuccagcuccagcacgaccggguucgcccucaaccugaagccgcuggcccccgccggcauccccuccaacaccgccgcggccgucaccgcgcccccggggcccggcgccgccgccggcgccgccgccagcagcgcgaugacguacgcccagcucgagucccugaucaacaaguggagccuggagcucgaggaccaggagcgccacuuccugcagcaggccacccaggugaacgccugggaccggacccugaucgagaacggggagaagaucaccucccuccaccgcgagguggagaaggucaagcuggaccagaagcggcuggaccaggagcucgacuucauccugagccagcagaaggagcuggaggaccuccugagcccccuggaggagcucgugaaggagcaguccggcacgaucuaccugcagcacgccgacgaggagcgcgagaagaccuacaagcuggcggagaacaucgacgcccagcucaagcggauggcccaggaccugaaggacaucaucgagcaccugaacaccuccggggccccggccgacaccagcgacccccuccagcagaucugcaagauccugaacgcgcacauggacucccugcaguggaucgaccagaacagcgcccuccugcagcgcaagguggaggaggucacgaaggugugcgagggccggcgcaaggagcaggagcgguccuuccgcaucaccuucgacuga

SEQ ID NO: 33893 - RNA, 1833 nt, Artificial Sequence
  derived and/or modified sequence opt1 from NUP85__Homo_sapiens__NP_001290205
auggugcccagcugcccguucaucuacaucauccgcaaggacgucgacguguacucccagauccugcggaagcuguucaacgagagccacggcaucuuccucgggcugcagcgcaucgacgaggagcucaccggcaagucccgcaagagccagcuggugcgggucuccaagaacuaccggagcgugauccgcgccugcauggaggagaugcaccagguggccaucgcggccaaggaccccgccaacgggcggcaguucuccagccaggucuccauccugagcgccauggagcucaucuggaaccugugcgagauccuguucaucgagguggcccccgcgggcccccuccugcugcaccuccuggacugggugcgccugcacgucugcgagguggacucccucagcgccgacgugcugggguccgagaacccgagcaagcacgacuccuucuggaaccuggucaccauccucgugcugcagggccggcuggacgaggcccgccagaugcucagcaaggaggccgacgcgucccccgccagcgccggcaucugccggaucaugggggaccugaugcgcacgaugcccauccugucccccggcaacacccagacccucaccgagcuggagcugaaguggcagcacuggcacgaggagugcgagcgguaccuccaggacagcacguucgccaccagcccgcaccuggagucccugcucaagaucaugcugggggacgaggccgcgcugcucgagcagaaggagcugcugagcaacugguaccacuuccucgugacccgccugcuguacuccaaccccaccgucaagcccaucgaccuccacuacuacgcccagagcucccuggaccuguuccucggcggggagagcucccccgagccgcuggacaacauccugcucgccgccuucgaguucgacauccaccaggugaucaaggagugcagcaucgcccuguccaacuggugguucguggcgcaccugacggaccuccuggaccacugcaagcugcugcagagccacaaccucuacuucggcuccaacaugcgggaguuccugcugcucgaguacgccagcggccuguucgcccaccccucccuguggcagcucggggucgacuacuucgacuacugccccgagcugggccgcgugagccuggagcuccacaucgagcggaucccccugaacaccgagcagaaggcccugaaggugcuccgcaucugcgagcagcggcagaugaccgagcagguccgcuccaucugcaagauccuggccaugaaggcggugcggaacaaccgccuggggagcgcccucuccuggagcauccgcgccaaggacgccgccuucgcgacccugguguccgaccgguuccugcgcgacuacugcgagcggggcugcuucagcgaccucgaccugaucgacaaccugggcccggccaugaugcucagcgaccgccugacguuccuggggaaguaccgggaguuccaccgcauguacggcgagaagcgguucgccgacgccgcgucccuccugcugagccucaugaccucccgcaucgcgccccggagcuucuggaugacccugcugaccgacgcccucccccugcuggagcagaagcaggucaucuucuccgccgagcagacguacgagcucaugcgcugccuggaggaccugaccagccggcgccccgugcacggggaguccgacaccgagcagcuccaggacgacgacaucgagaccacgaaggucgagaugcugcggcugagccucgcccgcaaccuggcccgggccaucauccgcgagggcucccuggaggggagcuga

SEQ ID NO: 33894 - RNA, 2226 nt, Artificial Sequence
  derived and/or modified sequence opt1 from NUP88__Homo_sapiens__NP_002523
auggccgccgcggagggccccgugggggacggcgagcuguggcagaccuggcucccgaaccacgucguguuccugcgccugcgggaggggcucaagaaccagagccccaccgaggccgagaagcccgccuccagcucccugcccagcuccccgcccccccagcugcucacgcgcaacguggucuucggccuggggggcgagcuguuccucugggacggcgaggacagcuccuuccugguggugcggcugcgcgggcccagcggcgggggcgaggagccggcccucucccaguaccagcggcugcugugcaucaaccccccccucuucgagaucuaccagguccugcugagccccacccagcaccacguggcccucaucgggaucaagggccugauggugcuggagcucccgaagcgcuggggcaagaacuccgaguucgaggggggcaagagcaccgucaacugcuccaccacgcccguggcggagcgguucuucaccagcuccaccagccugacccugaagcacgccgccugguaccccuccgagauccucgacccccacgugguccugcugacgagcgacaacgugauccgcaucuacucccuccgggagccgcagacccccaccaacgugaucauccugagcgaggccgaggaggagagccugguccucaacaaggggcgcgcguacaccgccucccugggcgagacggccguggccuucgacuucggcccccuggccgcggugcccaagacccucuucgggcagaacggcaaggacgaggucguggccuacccgcuguacauccuguacgagaacggggagaccuuccucaccuacaucagccugcugcacucccccggcaacaucgggaagcuccugggcccccugcccaugcacccggccgccgaggacaacuacggcuacgacgccugcgcggugcucugccugcccugcguccccaacauccuggugaucgccacggagagcgggaugcucuaccacugcgugguccuggagggcgaggaggaggacgaccacaccuccgagaagagcugggacucccggaucgaccugauccccagccucuacguguucgagugcgucgagcuggagcuggcccugaagcucgccuccggggaggacgacccguucgacagcgacuucuccugccccgugaagcugcaccgcgaccccaagugcccgagccgguaccacugcacccacgaggccggcgugcacuccgucgggcugaccuggauccacaagcuccacaaguuccugggcagcgacgaggaggacaaggacucccugcaggagcucagcacggagcagaagugcuucguggagcacauccugugcaccaagccccugcccugccgccagcccgcgccgauccggggcuucuggaucgugcccgacauccucgggcccaccaugaucugcaucaccuccacguacgagugccugaucuggccccugcucagcaccguccacccggccucccccccccugcugugcacccgcgaggacguggagguggccgagagcccccuccggguccuggccgagaccccggacagcuucgagaagcacauccgcuccauccugcagcggagcguggccaaccccgcguuccucaaggccuccgagaaggacaucgccccccccccggaggagugccugcagcugcucagccgcgccacgcagguguuccgggagcaguacauccugaagcaggaccuggcgaaggaggagauccagcgccgcgucaagcuccugugcgaccagaagaagaagcagcuggaggaccucuccuacugccgggaggagcgcaagagccugcgggagauggccgagcgccuggccgacaaguacgaggaggccaaggagaagcaggaggacaucaugaaccggaugaagaagcuccugcacuccuuccacagcgagcugcccgugcucuccgacagcgagcgcgacaugaagaaggagcugcagcugauccccgaccagcuccggcaccugggcaacgccaucaagcaggugaccaugaagaaggacuaccagcagcagaagauggagaagguccugucccuccccaagccgaccaucauccugagcgcguaccagcgcaagugcauccaguccauccugaaggaggagggggagcacauccgggagauggugaagcagaucaacgacauccgcaaccacgugaacuucuga

SEQ ID NO: 33895 - RNA, 2460 nt, Artificial Sequence
  derived and/or modified sequence opt1 from NUP93__Homo_sapiens__XP_005256320
auggacaccgagggcuucggggagcugcuccagcaggccgagcagcuggccgcggagaccgagggcaucagcgagcugccccacguggagcgcaaccuccaggagauccagcaggccggggagcggcugcgcucccggacgcugacccgcaccagccaggagaccgccgacgucaaggccuccgugcuccugggcagccgggggcuggacaucucccacaucagccagcgccucgagucccugagcgccgcgacgaccuucgagccgcuggagcccgugaaggacaccgacauccagggcuuccucaagaacgagaaggacaacgcccugcuguccgccaucgaggagagccggaagcgcaccuucggcauggccgaggaguaccaccgggaguccaugcucgucgagugggagcaggucaagcagcgcauccugcacacgcugcucgcgagcggggaggacgcccuggacuucacccaggaguccgagcccagcuacaucuccgacguggggcccccgggccggagcucccuggacaacaucgagauggccuacgcccgccagaucuacaucuacaacgagaagaucgugaacggccaccuccagcccaaccugguggaccugugcgccagcguggcggagcucgacgacaaguccaucagcgacauguggaccauggucaagcagaugaccgacgugcugcugacgcccgccaccgacgcccucaagaaccggagcuccguggagguccgcauggaguucgugcggcaggcccuggccuaccuggagcagagcuacaagaacuacacccucgugaccgucuucgggaaccugcaccaggcgcagcugggcggcgugcccgggacguaccagcucgugcgcuccuuccugaacaucaagcugccggcgccccuccccggccugcaggacggggaggucgagggccaccccgugugggcccugaucuacuacugcaugcggugcggcgaccuccuggccgccagccagguggucaaccgcgcccagcaccagcugggggaguucaagaccugguuccaggaguacaugaacuccaaggaccggcgccucagcccggccaccgagaacaagcugcggcugcacuaccgccgcgcccuccggaacaacaccgaccccuacaagcgcgccguguacugcaucaucggccggugcgacgugacggacaaccaguccgaggucgccgacaagaccgaggacuaccuguggcugaagcucaaccaggugugcuucgacgacgacgggaccagcagcccccaggaccgccugacccugagccaguuccagaagcagcugcucgaggacuacggcgagucccacuucacggucaaccagcagcccuuccuguacuuccaggugcuguuccucaccgcgcaguucgaggccgccguggccuuccuguuccggauggagcgccugcggugccacgcgguccacguggcccucgugcuguucgagcugaagcuccugcugaaguccuccgggcagagcgcccagcuccugucccacgagccgggcgacccgcccugccugcgccggcucaacuucguccgccugcugaugcucuacacccggaaguucgagagcaccgacccccgcgaggcccugcaguacuucuacuuccugcgggacgagaaggacucccagggcgagaacauguuccuccgcugcgugagcgagcuggugaucgagucccgggaguucgacaugauccuggggaagcucgagaacgacggcagccgcaagcccggggucaucgacaaguucacgagcgacaccaagcccaucaucaacaagguggccuccguggcggagaacaagggccuguucgaggaggccgccaagcuguacgaccucgccaagaacgccgacaagguccuggagcugaugaacaagcuccugagccccguggugccccagaucuccgcgccgcagagcaacaaggagcggcugaagaacauggcccucuccaucgccgagcgcuaccgggcccaggggaucagcgccaacaaguucgucgacuccaccuucuaccugcugcucgaccugaucaccuucuucgacgaguaccacagcggccacaucgaccgcgcguucgacaucaucgagcgccugaagcucgugccccugaaccaggaguccguggaggagcgggucgccgccuuccgcaacuucagcgacgagauccggcacaaccuguccgaggugcuccuggccacgaugaacauccuguucacccaguucaagcgccucaagggcaccagccccuccagcuccagccggccccagcgcgugaucgaggaccgggacucccagcugcgcagccaggcgcggacccugaucacguucgccgggaugaucccguaccgcaccagcggcgacaccaacgcccggcucguccagauggaggugcugaugaacuga

SEQ ID NO: 33896 - RNA, 2814 nt, Artificial Sequence
  derived and/or modified sequence opt1 from NUP98__Homo_sapiens__NP_005378
auguucaacaagagcuucggcacccccuucgggggcgggaccggcggguucggcaccaccuccaccuucggccagaacaccggguucggcacgaccagcgggggcgccuucgggaccuccgccuucggcagcuccaacaacaccggcgggcuguucggcaacagccagacgaagcccgggggccucuucggcaccuccagcuucucccagcccgccaccagcaccuccacgggguucggcuucgggaccagcaccggcaccgccaacacgcuguucgggaccgccuccaccggcaccagccuguucuccagccagaacaacgccuucgcccagaacaagcccacgggcuucgggaacuucggcaccuccaccagcuccgggggccucuucgggaccacgaacaccaccagcaaccccuucggcagcaccuccggcagccuguucgggccguccagcuucacggcggcccccaccggcaccaccaucaaguucaacccgcccacggggaccgacaccauggugaaggccggcgucuccaccaacaucagcacgaagcaccagugcaucaccgccaugaaggaguacgaguccaagagccuggaggagcuccgccuggaggacuaccaggcgaaccggaaggggccgcagaaccaggugggcgccggcaccaccaccgggcuguucggcuccagccccgccacguccagcgccaccggccucuucuccagcuccaccaccaacagcggguucgccuacggccagaacaagacggcguucgggaccuccaccaccggcuucgggacgaaccccggcgggcuguucggccagcagaaccagcagaccaccagccuguucuccaagcccuucggccaggccaccacgacccagaacaccggguucagcuucggcaacaccagcacgaucgggcagccguccaccaacaccaugggccucuucggggugacccaggccagccagcccggcggccuguucgggacggccaccaacaccuccaccggcacggccuucgggaccggcaccgggcuguucggccagaccaacacgggcuucggggcggucggcagcacccucuucgggaacaacaagcugaccaccuucggcuccagcacgaccuccgcccccagcuucgggaccaccuccggcggccuguucgggaacaagcccacgcucacccugggcaccaacaccaacaccagcaacuucggguucggcacgaacaccuccggcaacagcaucuucggguccaagccggcccccggcacccuggggaccggccucggggccggcuucggcacggcccugggggcgggccaggccagccuguucgggaacaaccagcccaagaucggcgggccccucggcaccggcgccuucggggccccgggcuucaacaccaccacggccacccugggguucggcgcgccccaggcccccguggcccugaccgaccccaacgccuccgcggcccagcaggccgugcuccagcagcacaucaacagccugaccuacuccccguucggggacagcccccuguuccgcaaccccaugagcgaccccaagaagaaggaggagcggcucaagccgacgaaccccgccgcccagaaggcgcugaccacccccacccacuacaagcugacgccgcgccccgccacccggguccgccccaaggcccuccagaccaccggcacggccaagucccaccuguucgacggccuggacgacgacgagcccagccucgccaacggggcguucaugccgaagaaguccaucaagaagcuggugcugaagaaccucaacaacagcaaccuguucucccccgugaaccgggacagcgagaaccuggccucccccagcgaguaccccgagaacggcgagcgcuucuccuuccucagcaagccggucgacgagaaccaccagcaggacggggacgaggacucccuggugagccacuucuacaccaaccccaucgccaagcccaucccccagaccccggaguccgccggcaacaagcacagcaacuccaacagcguggacgacaccaucgucgcccugaacaugcgggcggcccuccgcaacggccuggagggguccagcgaggagacguccuuccacgacgagagccugcaggacgaccgggaggagaucgagaacaacagcuaccacaugcaccccgccggcaucauccucaccaaggugggguacuacaccauccccuccauggacgaccuggccaagaucaccaacgagaagggcgagugcaucgugagcgacuucacgaucgggcgcaagggcuacggcuccaucuacuucgagggggacgucaaccugaccaaccugaaccucgacgacaucgugcacauccggcgcaaggagguggucguguaccuggacgacaaccagaagcccccggugggcgaggggcugaaccggaaggcggaggucacccucgacggcguguggcccaccgacaagacgagccgcugccugaucaagucccccgaccggcuggccgacaucaacuacgaggggcgccucgaggccgugagccggaagcagggcgcccaguucaaggaguaccgccccgagaccggcuccugggucuucaaggugagccacuucuccaaguacgggcugcaggacagcgacgaggaggaggaggagcacccguccaagaccagcaccaagaagcugaagacggcgccccugccgcccgccucccagaccacgccccuccagauggcccugaacggcaagcccgcgcccccgccccaggucgagaagaaggggcaguga

SEQ ID NO: 33897 - RNA, 1272 nt, Artificial Sequence
  derived and/or modified sequence opt1 from NUPL2__Homo_sapiens__NP_031368
auggccaucugccaguucuuccugcagggccgcugccgguucggggaccgcugcuggaacgagcaccccggcgcccgcggggcgggcgggggccggcagcagccgcagcagcagcccagcggcaacaaccggcgcggguggaacaccaccucccagcgguacagcaacgugauccagcccuccagcuucuccaagagcacgcccuggggcgggucccgcgaccaggagaagccguacuucagcuccuucgacagcggcgccuccaccaaccggaaggagggguucggccucagcgagaaccccuucgccucccugagccccgacgagcagaaggacgagaagaagcugcucgagggcaucgucaaggacauggaggugugggaguccagcgggcaguggauguucuccguguacagccccgucaagaagaagccgaacaucuccggcuucaccgacaucagccccgaggagcugcgccuggaguaccacaacuuccucaccagcaacaaccugcaguccuaccugaacagcgugcagcggcucaucaaccaguggcgcaaccgggugaacgagcugaagucccugaacaucagcacgaaggucgcccuccuguccgacgugaaggacggggugaaccaggccgcgcccgccuucggcuucggcagcucccaggccgccaccuucaugagccccggguucccggucaacaacuccagcuccgacaacgcgcagaacuucagcuucaagaccaacuccggcuucgccgccgccagcuccgggagccccgccggcuucggguccagccccgcguucggcgccgccgccuccaccagcagcggcaucuccacgagcgcccccgcguucggguucggcaagccggaggugaccuccgccgccagcuucuccuucaagagccccgccgccuccagcuucgggucccccggcuucagcgggcugcccgcgucccucgccaccggcccggugcgcgcccccgucgcccccgccuucggcgggggcagcuccguggcgggguucggcagccccgggucccacagccacaccgccuucuccaagccgagcagcgacacguucggcaacuccagcaucuccaccagccuguccgccagcuccagcaucaucgccaccgacaacgugcuguucacgccccgggacaagcucaccgucgaggagcuggagcaguuccaguccaagaaguucacccugggcaagaucccccucaagcccccgccccuggagcugcucaacguguga

SEQ ID NO: 33898 - RNA, 303 nt, Artificial Sequence
  derived and/or modified sequence opt1 from NUPR1__Homo_sapiens__NP_001035948
auggccaccuucccgcccgccaccagcgcgccccagcagccgcccggccccgaggacgaggacuccagccuggacgaguccgaccucuacagccuggcccacuccuaccuggggccccucaucaugcccaugcccacgagcccgcugacccccgcccuggugaccggcgggggcgggcgcaagggccggaccaagcgcgaggccgccgcgaacacgaaccggcccucccccggcgggcacgagcgcaagcucgucaccaagcugcagaacagcgagcggaagaagcgcggcgcccggcgcuga

SEQ ID NO: 33899 - RNA, 882 nt, Artificial Sequence
  derived and/or modified sequence opt1 from NUS1__Homo_sapiens__NP_612468
augaccggccuguacgagcucguguggcgcguccugcacgcccugcucugccugcaccggacccugacgagcuggcuccgcgugcgguucgggaccuggaacuggaucuggcgccggugcugccgcgccgcguccgccgccgugcuggcgccccugggcuucacccuccggaagccgcccgccgucgggcgcaaccggcgccaccaccggcacccccgcggcgggagcugccuggccgccgcccaccaccggaugcgcuggcgggccgacggccgcucccuggagaagcuccccgugcacaugggccuggugaucaccgaggucgagcaggagccgagcuucuccgacaucgcgagccuggugguguggugcauggccgucgggaucuccuacaucagcguguacgaccaccagggcaucuucaagcggaacaacucccgccucauggacgagauccugaagcagcagcaggagcugcucgggcuggacugcagcaaguacucccccgaguucgccaacagcaacgacaaggacgaccaggugcugaacugccaccucgccgucaaggugcugucccccgaggacggcaaggccgacaucgugcgggcggcccaggacuucugccagcuggucgcccagaagcagaagcgccccacggaccucgacguggacacccuggccagccugcucuccagcaacgggugcccggaccccgaccuggugcugaaguucggccccgucgacuccacccucggcuuccugcccuggcacauccggcugaccgagaucgugagccucccgucccaccugaacaucagcuacgaggacuucuucagcgcccugcgccaguacgcggccugcgagcagcgccucgggaaguga

SEQ ID NO: 33900 - RNA, 1320 nt, Artificial Sequence
  derived and/or modified sequence opt1 from NUSAP1__Homo_sapiens__NP_001230071
augaucauccccagccuggaggagcucgacucccugaaguacagcgaccugcagaaccucgccaagucccugggccugcgcgccaaccuccgggcgaccaagcugcugaaggcccucaagggguacaucaagcacgaggcccgcaagggcaacgagaaccaggacgagagccagaccuccgccagcuccugcgacgagacggagauccagaucagcaaccaggaggaggccgagcggcagccgcuggggcacgugaccaagacccgccggcgcugcaagaccguccggguggaccccgacucccagaaccacagcgagaucaagaucuccaaccccacggaguuccagaaccacgagaagcaggagagccaggaccugcgcgcgaccgccaaggugcccuccccgcccgacgagcaccaggaggccgagaacgccgucagcuccggcaaccgggacagcaaggugcccuccgaggggaagaagucccucuacaccgacgagagcagcaagcccggcaagaacaagcgcaccgcgaucacgaccccgaacuucaagaagcugcacgaggcccacuucaaggagauggagagcaucgaccaguacaucgagcggaagaagaagcacuucgaggagcacaacuccaugaacgagcugaagcagcccaucaacaagggcggggugcgcacccccgugcccccgcggggccgccucagcgucgccuccacccccaucagccagcggcgcucccaggggcggagcugcggccccgccucccagagcacgcuggggcugaagggcucccucaagcgcagcgccaucuccgcggccaagaccggcgugcgguucagcgccgccaccaaggacaacgagcacaagcgcucccugaccaagacgcccgcccgcaagagcgcgcacgucaccguguccgggggcaccccgaagggggaggccgugcugggcacccacaagcucaagacgaucaccggcaacagcgccgccgucaucacccccuucaagcugaccacggaggccacccagacccccguguccaacaagaagcccguguucgaccugaaggcgagccucucccggccgcugaacuacgagccccacaaggggaagcugaagcccuggggccagagcaaggagaacaacuaccucaaccagcacgucaaccgcaucaacuucuacaagaagaccuacaagcagccccaccuccagacgaaggaggagcagcggaagaagcgcgagcaggagcggaaggagaagaaggccaaggugcuggggaugcgccggggccugauccuggccgaggacuga

SEQ ID NO: 33901 - RNA, 384 nt, Artificial Sequence
  derived and/or modified sequence opt1 from NUTF2__Homo_sapiens__XP_005255828
augggcgacaagcccaucugggagcagaucgggagcuccuucauccagcacuacuaccagcuguucgacaacgaccgcacccagcucggcgccaucuacaucgacgccagcugccugaccugggaggggcagcaguuccagggcaaggcggccaucguggagaagcuguccagccucccguuccagaagauccagcacuccaucacggcccaggaccaccagcccacccccgacagcugcaucaucuccauggucguggggcagcugaaggccgacgaggaccccaucaugggcuuccaccagauguuccugcucaagaacaucaacgacgccugggugugcaccaacgacauguuccggcuggcgcugcacaacuucggcuga

SEQ ID NO: 33902 - RNA, 3483 nt, Artificial Sequence
  derived and/or modified sequence opt1 from NUTM1__Homo_sapiens__NP_001271221
augguggucacccugggccccggccccgacugccucauccuggaggccucccgccagccccagcuggugcccaagcccgagcggauggccuccgacggcgccuccgcccuccccgggcccgacauguccaugaagcccagcgccgcccugucccccagccccgcccugcccuuccugccgcccaccuccgacccgcccgaccacccgccccgcgagcccccgccccagcccaucaugcccagcguguucucccccgacaacccccugaugcugagcgccuuccccuccagccuccuggucaccggcgacgggggccccugccuguccggcgccggggccggcaaggugaucgugaaggucaagaccgagggcggcagcgccgagcccucccagacccagaacuucauccucacccagacggcccugaacagcaccgcccccgggacccccugcggcggccuggaggggcccgcgccgcccuucgugaccgccuccaacgugaagacgauccucccgagcaaggccgucggcgugucccaggaggggccgcccggccugccgccccagcccccgccgcccguggcccagcugguccccaucgugccccucgagaaggccuggcccggcccccacgggaccaccggcgagggcgggcccguggccacccugagcaagcccagccugggggaccgguccaagaucagcaaggacgucuacgagaacuuccgccaguggcagcgguacaaggcccucgcccgccggcaccugucccagagccccgacacggaggcgcuguccugcuuccucauccccgugcugcgcagccuggcccggcucaagcccaccaugacccuggaggagggccugccccucgccgugcaggagugggagcacaccuccaacuucgaccgcaugaucuucuacgagauggccgagcgguucauggaguucgaggccgaggagaugcagauccagaacacgcagcugaugaacggcagccaggggcugucccccgcgacgccccucaagcuggacccccugggcccccucgccagcgaggucugccagcagcccguguacaucccgaagaaggccgccuccaagacccgcgcgccccggcgccggcagcgcaaggcccagcggcccccggcccccgaggcccccaaggagaucccgcccgaggccgugaaggaguacgucgacaucauggaguggcugguggggacccaccuggcgaccggcgagagcgacgggaagcaggaggaggagggccagcagcaggaggaggagggcauguaccccgaccccgggcuccuguccuacaucaacgagcugugcagccagaagguguucgucuccaagguggaggccgucauccacccccaguuccucgccgaccugcugagccccgagaagcagcgcgacccccucgcccugaucgaggagcuggagcaggaggagggccucacccuggcccagcuggugcagaagcggcugauggcgcucgaggaggaggaggacgccgaggcgccgcccuccuucagcggggcccagcuggacuccagcccgagcggcuccguggaggacgaggacggggacggccgccugcggcccagccccggccuccagggggccggcggggcggccugccugggcaaggucuccagcuccggcaagcgcgcccgcgaggugcacgggggccaggagcaggcccuggacagcccccgggggaugcaccgcgacggcaacacccucccgucccccagcuccugggaccugcagcccgagcuggccgcgccccaggggaccccgggcccccucggcguggagcggcgcgggagcggcaaggucaucaaccaggugucccugcaccaggacgggcaccugggcggggccgggccgcccggccacugccucguggccgaccggacgagcgaggcccugccgcugugcuggcagggcggguuccagcccgaguccacccccagccucgacgcggggcuggccgagcuggcgccccuccaggggcaggggcuggagaagcagguccugggccuccagaagggccagcagaccgggggccgcggggugcugccgcagggcaaggagccccuggccgugcccugggagggguccagcggcgccauguggggcgacgaccgggggaccccgauggcgcaguccuacgaccagaaccccagcccccgcgccgccggcgagcgggacgacgucugccucagccccgggguguggcuguccagcgagauggacgccgugggccuggagcucccgguccagaucgaggaggugaucgaguccuuccagguggagaagugcgucacggaguaccaggagggcugccaggggcugggcagccgcgggaacaucucccugggccccggggagacccucgugcccggcgacaccgagagcuccgugauccccugcggcgggaccgucgccgcggccgcccuggagaagcggaacuacugcagccugccgggcccccuccgcgccaacagcccgccccuccggagcaaggagaaccaggagcaguccugcgagacgguggggcacccgagcgaccugugggccgagggcugcuucccccuccuggaguccggggacagcacccugggcuccagcaaggagacccugccgccgaccugccagggcaaccugcugaucauggggacggaggacgcguccagccucccggaggccucccaggaggccggcagccgcgggaacagcuucagcccccuccuggagaccaucgagcccgugaacauccucgacgucaaggacgacugcggccugcagcugcggguguccgaggacacgugcccccucaacgugcacuccuacgacccgcagggggagggccgcgucgaccccgaccugagcaagcccaagaaccuggcgccccuccaggagucccaggagagcuacaccaccggcacgccgaaggcgaccuccagccaccaggggcugggcuccacccugccccggcgcgggacccggaacgccaucgugccccgcgagacgagcguguccaagacccaccgcagcgccgaccgggccaagggcaaggagaagaagaagaaggaggccgaggaggaggacgaggagcucuccaacuucgcguaccugcuggccagcaagcucucccugagcccccgcgagcacccgcugagcccccaccacgccagcggcgggcagggcucccagcgggccagccaccuccugcccgccggggcgaagggcccgagcaagcugcccuaccccgucgccaaguccgggaagcgcgcccucgccggcggccccgccccgaccgagaagacgccccacagcggggcgcagcugggcgugccccgggagaagccccuggcccucggggugguccgcccgucccagccccggaagcgccggugcgacagcuucgugaccggccgccggaagaagcgccggcgcucccaguga

SEQ ID NO: 33903 - RNA, 2637 nt, Artificial Sequence
  derived and/or modified sequence opt1 from NUTM2A__Homo_sapiens__XP_011538424
auggaggugaagggccccagcggccgcagcuucugcugcgagagcgagggccaguucaaguccugccugaagcggcacacccccagccuccugcugcccuccagcuggaagggcaacuccggcagcugccucauggccaaggcccugcaccgcaugucccccacccccaacagcugcccccugccccucccccugugccggauguccgggguccugugcagccgcaaccucuucaccuucaaguucucccuguuccagcuggacagcggcgccuccggcgagcccgggcacagccucggccugacccugggguucucccacugcggcaacugccagaccgccguggugagcgcccagcccgaggggauggccuccaacggcgccuaccccgcgcucggccccggggucaccgccaaccccggcaccagccugagcguguucaccgcccugcccuucaccacccccgcccccgggcccgcgcacggcccccuccuggugacggccggcgcgccgcccgggggcccccugguccucuccacccugcccagcacgccccucgugaccgagcaggacgggugcggccccuccggggccggcgccagcaacguguucguccagaugcggacggaggugggccccgugaaggcggcccaggcccagacccucguccugacccaggccccgcugguguggcaggcccccggggcgcucugcggcgggguggucugcccgccgccccugcugcucgccgccgcccccguggugcccgucauggccgcccagguggugggcgggacccaggccugcgagggcggcuggucccaggggcugccgcugccgccgccgcccccgcccgccgcccagcugccgcccaucgucagccagggcaacgccgggcccuggccccagggcgcgcacggggagggcucccuggccagcucccaggccaaggcgccgcccgacgacagcugcaacccccgcuccguguacgagaacuuccggcuguggcagcacuacaagccccucgcgcgccggcaccucccccagagccccgacacggaggcccuguccugcuuccucauccccgugcugcgcagccuggcccggcgcaagcccaccaugacccucgaggagggccuguggcgggccaugcgcgaguggcagcacaccuccaacuucgaccggaugaucuucuacgagauggccgagaaguuccuggaguucgaggcggaggaggagaugcagauccagaagucccaguggaugaaggggccccagugccugcccccgcccgccacgccccgccucgagccgcgggggccgcccgccccggaggucgugaagcagcccgucuaccugcccuccaaggccgggcccaaggccccgaccgcgugccugccgccgccccgcccgcagcggcccgugaccaaggcccgccggccgccgccccgcccccaccgccgggccgagaccaaggcccgccugcccccgccccggccccagcgccccgccgagacgaaggugcccgaggagaucccgcccgaggucgugcaggaguacguggacaucauggaggagcugcugggccccagccucggcgcgaccggggagcccgagaagcagcgggaggagggcgaggucaagcagccccaggaggaggacuggaccccgcccgaccccgggcugcuguccuacaccgacaagcucugcagccagaaggacuucgugacgaagguggaggccgucauccacccccaguuccuggaggagcugcucagccccgacccccagauggacuuccuggcccugucccaggagcucgagcaggaggagggccugacccuggcccagcucguggagaagcgccugcugccgcucaaggagaagcagcacgcgcgggccgcccccagccgcgggaccgcccggcuggacuccagcuccagcaaguucgccgcgggccagggcgccgagcgcgacgugcccgucccccagcagggggugggcauggagaccugcccgccccagacgaccgcccgggacucccaggggcgcggccgggcccacaccgggauggcccgcagcaaggacuccgugguccugcucggcugccaggacagccccggccugcgggcggcccgccccaccuccccgccccaggaccaccggcccacgugccccggggugggcaccaaggacgcccuggaccuccccggcgggagccccgugcgcgagucccacgggcuggcccaggggagcuccgaggaggaggagcugcccagccucgccuuccugcugggcucccagcacaagcuccugcccugguggcugccgcagagccccguccccgcgagcgggcuccugucccccgagaaguggggcccgcaggggacccaccaguuccccagcgccgagcggcgcggccugaaccucgcccccucccccgccaacaaggcgaagaagcgcccgcuguucgggagccugucccccgccgagaagacgccccaccccggcccgggccuccgggugagcggggagcagucccugaccuggggccucgggggccccagccagucccagaagcgcaagggcgacccccuggugagccggaaggagaagaagcagcgcugcucccaguga

SEQ ID NO: 33904 - RNA, 2637 nt, Artificial Sequence
  derived and/or modified sequence opt1 from NUTM2B__Homo_sapiens__XP_005270192
auggaggugaagggccccagcgggcgcagcuucugcugcgagagcgagggccaguucaaguccugccugaagcggcacacccccagccuccugcugcccuccagcuggaaggggaacuccggcagcugccucauggccgaggcccugcaccgcaccucccccacccccaacagcugcccccugccccucccccugugccggauguccgggguccugugcagccgcaaccucuucaccuucaaguucucccuguuccagcuggacagcggcgccuccggcgagcccgggcacagccucggccugacccugggguucuccuacugcggcaacugccagaccgccguggugagcgcccagcccgaggggauggccuccaacggcgccuaccccguccucggccccggggugaccgccaaccccggcaccagccugagcguguucaccgcccugcccuucaccacgcccgcccccgggcccgcccacggcccccuccuggucaccgcgggcgcgccgcccgggggcccccuggugcucuccaccuuccccagcacgccccucgugacggagcaggacgggugcggccccuccggggccggcgccagcaacgucuucgugcagaugcggaccgaggugggccccgucaaggccgcgcaggcccagacccuggugcucacccaggcgccccugguguggcaggcccccggggcccugugcggcggggucgugugcccgccgccccuccugcuggccgccgcccccgugguccccgugauggccgcccagguggucggcgggacgcaggcgugcgagggcggcuggucccaggggcucccccugcccccgcccccgccgcccgccgcccagcugccgcccaucgugagccagggcaacgccgggcccuggccccagggcgcccacggggaguccagccucgcguccagccaggccaaggcgccgcccgacgacuccugcaacccccgcagcguguacgagaacuuccggcuguggcagcacuacaagccccuggcccgccggcaccucccccagucccccgacaccgaggcgcugagcugcuuccugauccccguccuccgcucccuggcccggcgcaagcccaccaugacccuggaggagggccucuggcgggccaugcgcgaguggcagcacacgagcaacuucgaccggaugaucuucuacgagauggccgagaaguuccuggaguucgaggccgaggaggagaugcagauccagaagucccaguggaugaagggcccccagugccugcccccgcccgcgacgccccgccucgagccccgggggccgcccgccccggagguggucaagcagcccguguaccugcccagcaaggccggccccaaggccccgaccgccugccugccgccgccccgcccgcagcggcccgugaccaaggcgcgccggccgccgccccgcccccaccgccgggccgagacgaaggcccgccugcccccgccccggccccagcgccccgccgagaccaagguccccgaggagaucccgcccgagguggugcaggaguacgucgacaucauggaggagcugcuggggcccucccugggcgccaccggcgagcccgagaagcagcgggaggaggggaaggugaagcagccccaggaggaggacuggacgcccccggaccccggccuccugagcuacaucgacaagcugugcagccagaaggacuucgugaccaaggucgaggcggugauccacccgcaguuccucgaggagcugcugucccccgacccccagauggacuuccucgcccugagccaggaccuggagcaggaggaggggcucacccuggcccagcugguggagaagcgccucccgccccugaaggagaagcagcacgcccgggcggcccccucccgcggcaccgcccggcuggacagcuccagcuccaaguucgccgccgggcagggcgcggagcgcgacguccccgacccgcagcagggcguggggauggagaccugcccgccccagaugacggcccgggacagccagggccgcgggcgggcccacaccggcauggcccgcuccgaggacagcgugguccuccuggggugccaggacucccccggccugcgggccgcguggccgaccuccccgccccaggaccaccgcccgaccugccccggcguggggacgaaggacgcccucgaccugcccggcgggucccccgugcgggagagccacggccuggcccagggguccagcgaggaggaggagcuccccucccuggccuuccugcucggcagccagcacaagcugcugccgugguggcucccccagagccccguccccgccuccggccugcugagcccggagaagugggggccccagggcacccaccagucccccagcgcggagcgccgggggcucaaccuggcccccuccccggccaacaaggccaagaagcgcccccuguucggcagccucucccccgcggagaagacccccuacccggggcccggccugcgcgugagcggcgagcagucccugaccugggggcucggcgggcccagccagucccagaagcggaagggcgacccgcuggugagccgcaaggagaagaagcagcacugcucccaguga

SEQ ID NO: 33905 - RNA, 2004 nt, Artificial Sequence
  derived and/or modified sequence opt1 from NVL__Homo_sapiens__NP_001230075
augaagcgcaagggcaagcugaagaacaaggggagcaagcggaagaaggaggaccuccaggagguggacggcgagaucgaggccguccugcagaagaaggccaaggcgcgcgggcuggaguuccagaucuccaacgugaaguucgaggacgugggcgggaacgacaugacccucaaggaggucugcaagaugcugauccacaugcggcaccccgagguguaccaccaccugggcguggucccgccccgcggcgugcuccugcacgggccgcccggcugcgggaagacccugcucgcccacgccaucgccggcgccgagugcagcgggaugaucacggcgcacugcuccuucgacuucagcggcuccaacgacccgcccgccagcgccucccaggagcuggaccugcccauccucaagguggccgcgcccgagaucgucagcggcguguccggggagagcgagcagaagcugcgggagcuguucgagcaggccguguccaacgcccccugcaucaucuucaucgacgagaucgacgccaucacccccaagcgcgaggucgccagcaaggacauggagcggcgcaucguggcgcagcuccugaccugcauggacgaccugaacaacguggccgccaccgcccggguccucgugaucggcgccacgaaccgccccgacucccuggaccccgcgcugcggcgcgccgggcgguucgaccgcgagaucugccucggcauccccgacgaggccagccgggagcgcauccugcagacccugugccggaagcuccgccugccccaggccuucgacuucugccaccuggcccaccucacccccggcuucgugggggcggaccugauggcccugugccgggaggccgccaugugcgccgucaaccgcgugcucaugaagcugcaggagcagcagaagaagaaccccgagauggaggaccugccguccaagggcgugcaggaggagcggcucgggaccgagcccacgagcgagacccaggacgagcugcagcgccugcucggccugcugcgcgaccaggacccccucuccgaggagcagaugcaggggcugugcaucgagcugaacgacuucaucgucgcgcucagcuccgugcagcccagcgccaagcgggagggcuucgugaccgucccgaacgugaccugggccgacaucggcgcccuggaggacauccgcgaggagcugacgauggcgauccucgcccccguccggaaccccgaccaguucaaggcccuggggcuggugacccccgccggcgugcuccuggccgggccgcccggcugcgggaagacccugcuggcgaaggccgucgccaacgagagcggccucaacuucaucuccgugaagggccccgagcugcugaacauguacgugggggagagcgagcgcgccguccgccagguguuccagcgggccaagaacuccgcgcccugcgugaucuucuucgacgaggucgacgcccucugcccgcggcgcagcgaccgggagaccggcgccuccgugcgcguggucaaccagcugcugacggagauggacgggcucgaggcccggcagcaggucuucaucauggccgcgaccaaccgccccgacaucaucgaccccgccauccugcggccgggccgccuggacaagacccucuucguggggcugcccccgcccgccgaccggcuggccauccucaagaccaucacgaagaacggcaccaagccgccccuggacgcggacgugaaccuggaggccaucgccggcgaccuccgcugcgacugcuacaccggggccgaccugagcgcccuggugcgggaggcguccaucugcgcccuccgccaggagauggcccggcagaaguccggcaacgagaagggggagcugaaggugagccacaagcacuucgaggaggccuucaagaagguccgcagcuccaucagcaagaaggaccagaucauguacgagcgccugcaggagucccucagccgguga

SEQ ID NO: 33906 - RNA, 4299 nt, Artificial Sequence
  derived and/or modified sequence opt1 from NWD1__Homo_sapiens__NP_001007526
augcagcgcggcaagcccugccgggcccugccgacccucaagugccagaccuucugccagcgccacgggcugauguucgagguggucgaccugcgguggggcauccgcaacaucgaggccacggaccaccucaccaccgagcugugccuggaggagguggaccggugcuggaagaccagcaucgggcccgcguucguggcccucaucggcgaccaguacgggcccugccugauccccucccgcaucgacgagaaggagugggagguccugcgggaccaccucacggcccgcccgagcgaccuggagcugguggcccgguacuuccagcgcgacgagaacgccuucccgcccaccuacgugcuccaggcgcccggcaccggcgaggccugcgagccggaggaggccacccugacguccguccugcggagcggggcccaggaggcgcgccggcucggccugaucacccaggagcaguggcagcacuaccaccgcuccgugaucgagugggagaucgagcggagccugcucuccagcgaggaccgcgagcagggggccaccguguuccugcgggagauccaggaccugcacaagcacauccucgaggacugcgcccugcgcauggucgaccggcuggccgacggcugccucgacgccgacgcgcagaaccugcuguccagccucaagucccacaucaccgacaugcaccccggggugcugaagacgcaccgccugcccuggagccgggaccucgugaaccccaagaacaagacccacgccugcuaccugaaggagcugggcgagcaguucgucgugcgcgccaaccaccaggugcucacccgccugcgggagcuggacaccgccggccaggagcucgccuggcuguaccaggagauccgccaccaccuguggcaguccagcgaggucauccagacguucugcgggcggcaggagcuccuggcgcgccugggccagcagcuccggcacgacgacuccaagcagcacaccccgcuggugcuguucgggccgcccggcaucggcaagaccgcccucaugugcaagcuggccgagcagaugccccgccugcucgggcacaagaccgugacgguccugcggcugcugggcaccagccagauguccagcgacgcccgcgggcuccugaaguccaucugcuuccaggugugccuggccuacggccucccccugccgcccgcccaggugcuggacgcccacacccgggucgugcaguucuuccacacccuccugcacacggugagcugccgcaacuucgagagccugguccuccugcuggacgccauggacgaccucgacuccgugcggcacgcccgccggguccccuggcugccccugaacugcccgccccgcgugcaccucauccugagcgccugcuccggggcgcugggcgugcucgacacccugcagcggguccugcucgaccccgaggcguacugggaggugaagccccugagcggcaaccaggggcagcagaugauccagcugcuccuggccgccgcgcgccggacccugucccccgugcacaccgaccuccugugggccagccugcccgagugcggcaaccccgggcgccuccggcuggccuucgaggaggcccgcaagugggccuccuucacggucccggugccccuggcgaccaccgccgaggaggccacccaccagcucugcacgcgccuggagcagacccacggccagcugcucguggcccacguccugggguacaucgugagcucccggcacggccugagcgaggccgagcucaaggacgugcugucccuggacgacgagguccuccaggacguguaccgcgacuggacgcccccgagcaaggagcugcugcgguucccgccccuccugugggugcgccugcggcgcgaccucggcuacuaccuggcgcggcgccccgucgacggguucacccugcucgccaucgcccaccggcagcugguggaggugguccgcgagcgguaccuguccggcagcgagcgcgccaagcggcacggggugcucgccgacuucuucuccggcaccuggagccaggggaccaagaagcugaucacccugccccucgugggcaagccccugaaccuggaccgcaaggucgcgccccagccccucugguucucccacaccguggccaaccugcggaagcugaaggagcucccguaccaccuccugcacagcggccgccuggaggagcugaagcaggaggugcugggguccaugagcuggaucagcugccggggcaucuccgggggcaucgaggaccuccuggacgacuucgaccugugcgcgccccaccucgacagccccgaggucggccuggugcgcgaggcccugcagcucugccggcccgccguggagcugcgcgggauggagcggucccugcucuacaccgagcugcuggcccgccuccacuucuucgccacgagccacccggcccuggucggccagcugugccagcaggcccaguccugguuccagcucugcgcgcaccccgugcuggugccccucgggggcuuccugcagccgcccgggggcccccugcgcgccacccugagcggcugccacaaggggaucaccgccauggccuggggcgucgaggagaagcuccuggugaucgggacccaggacggcaucauggccgugugggacauggaggagcagcacgucauccacaugcugacggggcacaccggcgaggugcggugcgugaagaucuucgcgaagggcacccucgccaacuccgccagcaaggacuacacccugcaccuguggaaccugcucuccgggcaggagaaguucacgaucugggacggcgggagcaagaaccccgccgagccccagaucuggaaccugcacgucgacgaggcccacaaggugguguacuccgcgagcggcuccaagaucaacgccuggaaccuggagaccgccgagcccgucuuccacauccucggggacgccagcgaccccuggaugugcauggcggugcuggccucccaggccacccugcucaccgugagccgcgacggcgucgugucccuguggagcagcgccacgggcaagcugcaggggaagcagcacauguccagcaucaaggaggagaccccgaccugcgccguguccguccagaagcagggcaagcucgugaccggguucagcaacggcuccaucagccugguguccagcaagggggaccggcugcucgagaagcugcccgacgcgguccgcuuccuggugguguccgaggacgagagccuccuggccgccggcuucggccgguccguccgcaucuuccuggccgacagccggggguuccgccgguucauggccauggaccucgagcacgaggacaugguggagacggcggucuucggcaccgagaacaaccugaucaucaccgggucccuggacgcccucauccagguguggagccuguccgagcagggcacccugcucgacauccuggagggcgugggggcccccgucagccugcucgcccgcggcggggcccugguggcguccgccagcccccaguccagcagcuucaaggugugggaccuguccgacgcccaccggagccgcguccccgccccguuccucgaccggacgggccugaccgccgugucccacaacgggagcuacguguacuuccccaagaucggcgacaagaacaaggucaccaucugggaccuggcggagggcgaggagcaggacucccucgacaccagcuccgagauccgcugccuggagguggccgagcagcggaagcuccuguucacggggcuggugagcggcgucgugcugguguucccccucaacucccgccaggacgucaucugcaucccgccgcccgaggcccggaaggccaucaacugcaugagccuguccaagugcgaggaccgccuggcgaucgccuacgacaacaucgugcucgugcuggacaucaccagcggggaccccugccccgucaucgacggcccccgguacaccuucuacacccagcugcccgagacgcucuccagcguggccauccugaccgacuaccgcguggucuacuccaugaccaacggggaccuguuccucuacgagugcgccaccagcaaggccuucccccuggagacgcaccgcucccggguggcgugcguggaggucagccacaaggagcagcuggugguguccggcagcgaggacgcccuccugugccugugggaccuccaggcccgcaaguggaaguucgagaugagcuacaccgcccccugcuga

SEQ ID NO: 33907 - RNA, 1071 nt, Artificial Sequence
  derived and/or modified sequence opt1 from NXF1__Homo_sapiens__NP_001074960
auggccgacgagggcaagagcuacuccgagcacgacgacgagcgcgugaacuucccccagcggaagaagaaggggcgcggcccguuccgguggaaguacggggagggcaaccgccggagcgggcgcggcggcuccgggauccggagcucccgccuggaggaggacgacggcgacgucgccaugagcgacgcgcaggacgggccccgggugcgcuacaaccccuacaccacccggcccaaccgccggggcgacacguggcacgaccgcgaccggauccacgugaccguccgccgggaccgcgccccgcccgagcgcgggggcgccggcaccucccaggacgggaccagcaagaacugguucaagaucacgauccccuacggccggaaguacgacaaggccuggcuccuguccaugauccagagcaagugcuccgugcccuucaccccgaucgaguuccacuacgagaacacccgggcccaguucuucguggaggacgcgagcaccgccuccgcccugaaggccgucaacuacaagauccucgaccgcgagaaccgccggaucagcaucaucaucaacuccagcgcgccgccccacacgauccugaacgagcugaagcccgagcaggucgagcagcucaagcugaucauguccaagcgcuacgacgggagccagcaggcccuggaccucaagggccugcgguccgaccccgaccugguggcccagaacaucgacguggugcucaaccgccggagcugcauggccgccacccugcgcaucaucgaggagaacauccccgagcugcucagccugaaccuguccaacaaccggcucuaccgccuggacgacaugagcuccaucgugcagaaggcgcccaaccugaagauccucaaccugagcggcaacgagcugaaguccgagcgggagcucgacaagaucaaggggcugaagcuggaggagcucuggcuggacggcaacagccugugcgacaccuuccgcgaccaguccaccuacauccggagcgucguggccugcguguccccgcccggggaccuccacccccugggcggguga

SEQ ID NO: 33908 - RNA, 1881 nt, Artificial Sequence
  derived and/or modified sequence opt1 from NXF2B__Homo_sapiens__NP_001093156
augugcagcacccugaagaagugcggcaccuaccgcacggagguggccgagugccacgaccacggguccaccuuccagggccggaagaagggcgggagcuccuuccgcgacaacuucgacaagcggagcugccacuacgagcacgggggcuacgagcggcccccgucccacugccaggagaacgacggcagcgucgagaugcgcgacgugcacaaggaccagcagcuccgccacacccccuacuccauccggugcgagcgccggaugaaguggcacagcgaggacgagauccgcaucaccacguggcggaaccgcaagccgcccgagcggaagaugucccagaacacccaggacggguacacccgcaacugguucaaggugaccauccccuacggcaucaaguacgacaaggccuggcugaugaacagcauccagucccacugcagcgaccgguucacgcccgucgacuuccacuacgugcgcaaccgggcgugcuucuucgugcaggacgccuccgccgccagcgcccugaaggacgucuccuacaagaucuacgacgacgagaaccagaagaucugcaucuucgugaaccacagcaccgcgcccuacuccgugaagaacaagcucaagcccgggcagauggagaugcugaagcugaccaugaacaagcgcuacaacgucagccagcaggcccucgaccugcagaaccugcgguucgacccggaccucaugggccgcgacaucgacaucauccugaaccggcgcaacugcauggccgccacccugaagaucaucgagcgcaacuuccccgagcuccugucccugaaccucugcaacaacaagcuguaccagcuggacgggcucagcgacaucacggagaaggcgcccaaggugaagacccugaaccugagcaagaacaagcucgaguccgccugggagcugggcaaggugaagggccugaagcucgaggagcuguggcuggaggggaacccccucugcagcaccuucuccgaccagagcgccuacgucuccgccauccgggacugcuucccgaagcugcugcgccucgacggccgggagcugagcgcccccgugaucguggacaucgacuccagcgagaccaugaagcccugcaaggagaacuucacgggguccgagacccugaagcaccucguccugcaguuccugcagcaguacuacagcaucuacgacuccggcgaccgccagggccuccugggggcguaccacgacgaggccugcuucagccuggccauccccuucgacccgaaggacuccgcccccagcucccucugcaaguacuucgaggacagccggaacaugaagacccugaaggaccccuaccugaagggcgagcuccugcgccggaccaagcgcgacaucguggacucccugagcgcccuccccaagacgcagcacgaccuguccagcauccugguggacgucuggugccagaccgagcggaugcucugcuucagcgugaacgggguguucaaggaggucgagggccagucccaggggagcgugcuggcguucacccgcaccuucaucgccacgccgggcuccagcuccagccugugcaucgugaacgacgagcuguucguccgggacgccagcccccaggagacccaguccgccuucuccauccccgugagcacccucuccagcuccagcgagcccucccugagccaggagcagcaggagaugguccaggccuucuccgcgcagagcggcaugaagcuggaguggagccagaagugccuccaggacaacgaguggaacuacacccgcgccgggcaggccuucacgaugcugcagaccgagggcaagaucccggccgaggccuucaagcagaucuccuga

SEQ ID NO: 33909 - RNA, 1596 nt, Artificial Sequence
  derived and/or modified sequence opt1 from NXF3__Homo_sapiens__NP_071335
augagccugcccuccggccacaccaccgggcacacggaccaggugguccagcgccgggcccgcugcugggacaucuaccagcggcgcuucagcucccggagcgagccggugaaccccggcaugcacuccagcucccaccagcagcaggacggggacgccgcgaugcacggcgcccacauggacagccccgugcgcuacacccccuacaccaucuccccguacaaccggaaggggagcuuccgcaagcaggaccagacccacgucaacauggagcgggagcagaagccgcccgagcgccggauggagggcaacaugcccgacggcacgcucggguccugguucaagaucaccgugcccuucggcaucaaguacaacgagaaguggcugcugaaccucauccagaacgagugcagcgugcccuucguccccguggaguuccacuacgagaacaugcacgccuccuucuucguggagaacgccagcaucgccuacgcgcugaagaacgucuccgggaagaucugggacgaggacaacgagaagaucagcaucuucgugaaccccgccggcaucccgcacuucgugcaccgcgagcugaaguccgagaaggucgagcagaucaagcucgccaugaaccagcagugcgacgugagccaggaggcccuggacauccagcggcugcccuucuaccccgacauggugaaccgcgacaccaagauggcguccaacccccggaagugcauggccgccagccucgacguccacgaggagaacaucccgaccgugaugagcgccggggagauggacaaguggaagggcaucgagcccggcgagaagugcgccgaccgcucccccgugugcacgaccuucagcgacaccuccagcaacaucaacuccauccuggagcuguuccccaagcuccugugccuggacgggcagcagagcccgcgggcgacccucugcggcacggaggcccacaagcgccugccgaccugcaagggguccuucuucggcagcgagaugcugaagaaccucguccugcaguuccugcagcaguacuaccucaucuacgacuccggcgaccggcaggggcugcugagcgccuaccacgacgaggccugcuucucccucagcauccccuucaaccccgaggacuccgcccccagcuccuucugcaaguucuucaaggacagccgcaacaucaagauccugaaggaccccuaccugcggggcgagcuccugaagcacaccaagcuggacaucguggacucccucagcgcgcugcccaagacccagcacgaccuguccagcuuccucguggacaugugguaccagacggaguggaugcugugcuucagcgucaacgggguguucaaggagguggagggccagucccaggggagcguccuggccuucacccgcaccuucaucgccacccccggcuccagcuccagccucugcaucgugaacgacaagcuguucguccgcgacacgucccaccagggcacccagagcgcccuguucacccucgugccgaccgccuucuccagcuccgugcccgcguucagccaggagcagcagaagaugcugcccuccuga

SEQ ID NO: 33910 - RNA, 1098 nt, Artificial Sequence
  derived and/or modified sequence opt1 from NXF5__Homo_sapiens__NP_116564
augcgccggaacacccaggacgagaacaugcgcaagugguucaaggugaccauccccuacggcaucaaguacgacaaggccuggcugaugaacagcauccaguccaacugcagcgucccguucacccccguggacuuccacuacauccggaaccgcgccugcuucuucgugcaggucgcguccgccgccagcgcccucaaggacguguccuacaagaucuacgacgacgagaaccagaagaucugcaucuucgugagccacuucaccgcccccuacuccgucaagaacaagcugaagcccgggcagauggagaugcugaagcucaccaugaacaagcgguacaacgugagccagcaggcgcuggaccugcagaaccuccgcuucgacccggaccugaugggccgggacaucgacaucauccugaaccgccggaacugcauggccgccacccucaagaucacggagcgcaacuuccccgagcugcugucccucaaccugugcaacaacaagcuguaccagcucgacgggcugagcgacaucaccgagaaggcccccaaggugaagacccugaaccucuccaagaacaagcuggagagcgcgugggagcugggcaaggucaaggggcucaagcuggaggagcuguggcucgagggcaacccccugugcuccaccuucagcgaccaguccgccuacgugagcgccauccgggacugcuucccgaagcugcuccgccuggacggccgggagcuguccgcccccgugaucgucgacaucgacagcuccgagacgaugaagcccugcaaggagaacuucaccgggagcgagacccucaagcaccuggugcugcaguuccuccagcagagcaaccugugcaaguacuucaaggacucccgcaacaucaagauccugaaggaccccuaccuccagcggaagcugcugaagcacaccaagugcccgcgcaacguggacagccucuccgcccugcccgagacgcagcacgacuucaccagcauccuggucgacaugugguaccagaccgugaacacgugcuuccucccccgggcgggccccgagucccagagccugcgcccgcuguga

SEQ ID NO: 33911 - RNA, 984 nt, Artificial Sequence
  derived and/or modified sequence opt1 from NXN__Homo_sapiens__NP_001192248
auggccgacgugagccugcaccgcaaccccgccacccucaagcuguggaacaaguaccggaucuccaacaucccgagccugaucuuccucgacgcgaccacgggcaaggucgugugccgcaacgggcugcuggugauccgggacgaccccgagggccucgaguuccccugggggcccaagccguuccgcgaggucaucgccggcccccugcugcggaacaacgggcagucccucgagagcuccagccuggagggcucccacgugggcguguacuucagcgcccacuggugcccgcccugccgcucccugacccggguccucguggagagcuaccgcaagaucaaggaggccgggcagaacuucgagaucaucuucguguccgccgaccggagcgaggaguccuucaagcaguacuucagcgagaugcccuggcuggcgguccccuacaccgacgaggcccgccggucccgccugaaccggcucuacggcauccaggggauccccacccugaucaugcuggacccccagggcgaggugaucacgcgccaggggcggguggagguccucaacgacgaggacugccgcgaguucccguggcaccccaagcccgugcuggagcugagcgacuccaacgccgcccagcucaacgagggccccugccuggugcuguucgucgacagcgaggacgacggcgaguccgaggcggccaagcagcucauccagccgaucgccgagaagaucaucgccaaguacaaggccaaggaggaggaggcgccccugcuguucuucguggccggggaggacgacaugaccgacagccuccgggacuacaccaaccugcccgaggccgcgccccugcucaccauccuggacaugagcgcccgcgccaaguacgugauggacgucgaggagaucacgccggccaucguggaggccuucgugaacgacuuccuggccgagaagcucaagcccgagcccaucuga

SEQ ID NO: 33912 - RNA, 639 nt, Artificial Sequence
  derived and/or modified sequence opt1 from NXNL1__Homo_sapiens__NP_612463
auggccagccuguucuccggccgcauccucauccggaacaacagcgaccaggacgagcuggacaccgaggccgaggugucccgccggcuggagaaccgccucguccugcuguucuucggggcgggcgccugcccccagugccaggccuucgugccgauccucaaggacuucuucgugcggcugaccgacgaguucuacguccugcgcgccgcccagcucgcgcugguguacgugagccaggacuccacggaggagcagcaggaccuguuccucaaggacaugcccaagaaguggcuguuccugcccuucgaggacgaccuccggcgcgaccuggggcggcaguucagcgucgagcgccugcccgccguggugguccucaagccggacggcgacgugcugacccgggacggggccgacgagauccagcgccugggcaccgccugcuucgcgaacuggcaggaggccgccgaggugcucgaccggaacuuccagcugcccgaggaccuggaggaccaggagccccgcucccucaccgagugccugcggcgccacaaguaccgggucgagaaggccgcccgcggcgggcgggaccccggcgggggcgggggcgaggagggcggggcgggcgggcuguucuga

SEQ ID NO: 33913 - RNA, 471 nt, Artificial Sequence
  derived and/or modified sequence opt1 from NXNL2__Homo_sapiens__NP_001155097
augguggacauccugggcgagcgccaccucgugaccugcaagggggccaccgucgaggccgaggcggcccugcagaacaagguggucgcccuguacuucgccgccgcgcggugcgcccccagccgcgacuucacgccgcuccugugcgacuucuacaccgcccugguggccgaggcgcggcgccccgcccccuucgagguggucuucguguccgccgacggcagcucccaggagaugcucgacuucaugcgggagcugcacggggccuggcuggcccuccccuuccacgacccguaccgccacgagcugcggaagcgcuacaacgugaccgcgauccccaagcuggucaucgugaagcagaacggcgaggugaucaccaacaaggggcggaagcagauccgcgagcggggccucgccugcuuccaggacugggucgaggccgccgacaucuuccagaacuucagcguguga

SEQ ID NO: 33914 - RNA, 1218 nt, Artificial Sequence
  derived and/or modified sequence opt1 from NXPE1__Homo_sapiens__NP_689528
augagcucccccgcccugaccgccggcgcgagcgggaaggugauggacuucaacaacggcaccuaccucgucuccuucacgcuguucugggagggccaggugagccugucccuccugcugauccacccgagcgagggggccuccgcccucuggcgcgcccggaaccagggguacgacaagaucaucuucaagggcaaguucgugaacggcaccagccacgucuucaccgagugcgggcugacccugaacuccaacgccgagcucugcgaguaccuggacgaccgcgaccaggaggcguucuacugcaugaagccccagcacaugcccugcgaggcccugacguacaugaccacccggaaccgcgaggugagcuaccucaccgacaaggagaacucccuguuccaccggagcaaggugggcgucgagaugaugaaggaccgcaagcacaucgacgugacgaacugcaacaagcgggagaagaucgaggagaccugccagguggggaugaagcccccgguccccggcggguacacccugcagggcaaguggaucaccacguucugcaaccaggugcagcucgacaccaucaagaucaacggcugccugaaggggaagcugaucuaccuccugggcgacuccacccugcgccaguggaucuacuacuuccccaagguggucaagacccucaaguucuucgaccugcacgagacggggaucuucaagaagcaccuccugcuggacgccgagcggcacacccagauccaguggaagaagcacagcuaccccuucgugaccuuccagcuguacucccucaucgaccacgacuacaucccgcgcgagaucgaccggcugagcggcgacaagaacaccgccaucgugaucacguucggccagcacuuccgccccuuccccaucgacaucuucauccggcgcgcgaucgggguccagaaggccaucgagcggcuguuccuccgcucccccgccaccaaggugaucaucaagaccgagaacauccgggagaugcacaucgagaccgagcgcuucggcgacuuccacggguacauccacuaccugaucaugaaggacaucuucaaggaccugaacgugggcaucaucgacgccugggacaugacgaucgccuacgggaccgacaccauccacccgcccgaccacgucaucggcaaccagaucaacauguuccucaacuacaucugcuga

SEQ ID NO: 33915 - RNA, 1680 nt, Artificial Sequence
  derived and/or modified sequence opt1 from NXPE2__Homo_sapiens__NP_872301
augguggagaagauccugauccaccgcauccucacccuguuccccaacgccaucgcccggaagcugcuccugaugcugaccuucauccucaucuucuggaucaucuaccuggcgagcaaggaccacacgaaguucuccuucaaccuggagaaccacaucauccucaaccagggcaacaucuucaagaaguacagccacuccgagaccccgcugugccccgccgucagccccaaggagaccgagcugcgcaucaaggacaucauggagaagcucgaccagcagaucccgccccggcccuucacccacgugaacacgaccaccuccgccacccacagcacggccaccauccugaacccccaggacaccuacugccgcggggaccagcuggacauccuccuggaggugcgggaccaccugggccaccgcaagcaguacgggggcgacuuccuccgggcccgcauguacuccaccgcgcugauggccggggccagcggcaaggucacggacuucaacaacggcaccuaccugguguccuucacccucuucugggagggccaggugagccugucccugcuccugauccaccccagcgagggggucuccgcccuguggcgggcgcgcaaccaggggugcgaccggaucaucuucaccggccucuucgccaaccgcagcuccaacguguucacggagugcgggcugacccugaacaccaacgccgagcucugccaguacauggacgaccgggaccaggaggccuucuacugcgugcgcccgcagcacaugcccugcgaggcccugacccacaugacgacccggacccgcaacaucagcuaccuguccaaggaggaguggcgccucuuccaccggagcaacaucggcgucgagaugaugaagaacuucacccccaucgaggugauccccugcaacaaguccgagaacaucaagaagaacugccagaucggcaugaagacgccguuccccagcggguacacccugaagaagauguggaucaccgcguucugcaagcagaucaaguucaacgagaccaagaacaucaacgacugccuggagcggaagcucaucuaccugaugggcgacagcacgcugcaccaguggaucuacuaccuccagaaggccgugaagacccugaaguacuucgaccaccacggggccggcaucuucaagacccacguccugcucgacguggagcgccacauccugauccaguggaagaagcacggccaccccuucgugaccaagaagcuguucuccgucaaggacgagaacuacaucccccgggagaucgaccagguggccggggacaagaacacggccaucgugaucacccucggccagcacuuccgcccguuccccaucaacaucuucauccgccgggcgaucaacauccagaaggccaucgagcgccuguuccugcggagccccgagaccaaggucauccucaagaccgagaacacgcgcgagaucgagcagaacgccgagauguucuccgacuuccacggguacauccagaaccugaucauccgggacaucuucguggaccugaacgugggcaucaucgacgccugggacaugaccaucgccuacugcaccaacaacgcgcacccgcccgacuacgucauccagaaccagaucgggauguuccugaacuacaucugcuga

SEQ ID NO: 33916 - RNA, 1635 nt, Artificial Sequence
  derived and/or modified sequence opt1 from NXPE4__Homo_sapiens__NP_001071107
augaagaucagcaugaucaacuacaagucccugcucgcccugcuguucauccucgccagcuggaucaucuucaccguguuccagaacuccaccaaggucuggagcgcgcugaaccuguccaucagccuccacuacuggaacaacuccaccaagagccuguuccccaagacgccgcugaucucccucaagccccugaccgagaccgagcugcgcaucaaggagaucaucgagaagcucgaccagcagaucccgccccggcccuucacgcacgugaacaccaccaccagcgccacgcacuccaccgccaccauccugaacccccgcgacaccuacugccggggcgaccagcugcacauccuccuggaggugcgcgaccaccuggggcggcgcaagcaguacggcggggacuuccuccgggcccgcaugagcucccccgcccugauggcgggcgccagcgggaaggucacggacuucaacaacggcaccuaccugguguccuucacccucuucugggagggccaggugagccugucccugcuccugauccaccccagcgagggggucuccgcccuguggagcgcccggaaccagggcuacgaccgcgugaucuucaccgggcaguucgugaacggcacgagccagguccacuccgagugcgggcucauccugaacaccaacgcggagcugugccaguaccucgacaaccgggaccaggagggcuucuacugcgugcgcccgcagcacaugcccugcgccgcccugacccacauguacagcaagaacaagaagguguccuaccugagcaagcaggagaagucccucuucgagcggagcaacgucggcguggagaucauggagaaguucaacaccaucuccgugagcaagugcaacaaggagacggucgccaugaaggagaagugcaaguucgggaugaccuccaccauccccagcggccacguguggcgcaacaccuggaaccccguguccugcagccuggccacggucaagaugaaggagugccugcgggggaagcucaucuaccugaugggcgacuccaccauccgccaguggauggaguacuucaaggcgagcaucaacacccugaaguccguggaccuccacgagagcggcaagcugcagcaccagcuggccguggaccucgaccggaacaucaacauccaguggcagaaguacugcuacccgcugaucggguccaugaccuacagcgucaaggagauggaguaccugacgcgcgccaucgaccggaccggcggggagaagaacaccgugaucgugaucucccucggccagcacuuccgccccuuccccaucgacgucuucauccggcgcgcccugaacgugcacaaggccauccagcaccuccugcugcgcagccccgacaccauggucaucaucaagacggagaacauccgggagauguacaacgacgcggagcgcuucagcgacuuccacggguacauccaguaccugaucaucaaggacaucuuccaggaccuguccgugagcaucaucgacgccugggacaucaccaucgccuacggcaccaacaacgugcacccgccccagcacgucgugggcaaccagaucaacauccuccugaacuacaucugcuga

SEQ ID NO: 33917 - RNA, 816 nt, Artificial Sequence
  derived and/or modified sequence opt1 from NXPH1__Homo_sapiens__NP_689958
augcaggccgccugcugguacgugcuguuccuccugcagcccaccgucuaccuggugaccugcgcgaaccucacgaacggcggcaagagcgagcugcugaaguccgggagcuccaagagcacccucaagcacaucuggaccgaguccagcaaggaccuguccaucagccgccugcucucccagaccuuccgggggaaggagaacgacacggaccuggaccugcgcuacgacaccccggagcccuacagcgagcaggaccucugggacuggcugcggaacuccaccgaccugcaggagccccgcccccgggccaagcgccggccgaucgugaagaccggcaaguucaagaagauguucggguggggcgacuuccacagcaacaucaagacggucaagcucaaccugcugaucaccggcaagaucguggaccacgggaacggcaccuucuccguguacuuccgccacaacagcaccgggcagggcaacgucuccgugagccucgugccgcccacgaagaucgucgaguucgaccuggcccagcagaccgugaucgacgccaaggacuccaagagcuucaacugccggaucgaguacgagaagguggacaaggccaccaagaacacccugugcaacuacgaccccuccaagacgugcuaccaggagcagacccagagccacgucagcuggcucugcuccaagcccuucaaggugaucugcaucuacaucagcuucuacuccaccgacuacaagcuggugcagaaggucugccccgacuacaacuaccacagcgacacccccuacuuccccuccggguga

SEQ ID NO: 33918 - RNA, 795 nt, Artificial Sequence
  derived and/or modified sequence opt1 from NXPH2__Homo_sapiens__NP_009157
augcgccugcggccccucccgcugguggucgugcccggccugcuccagcugcuguucugcgacagcaaggaggugguccacgccaccgaggggcucgacugggaggacaaggacgcccccggcacccugguggggaacgugguccacucccgcaucaucagcccccugcgccucuucgugaagcaguccccggugcccaagcccggccccauggcguacgccgacagcauggagaacuucugggacuggcuggccaacaucacggagauccaggagccgcuggcccggaccaagcggcgccccaucgucaagaccgggaaguucaagaagauguucggcuggggcgacuuccacuccaacaucaagaccgugaagcucaaccugcugaucacggggaagaucguggaccacggcaacgggaccuucagcgucuacuuccggcacaacuccaccggccucgggaacgugagcgugucccuggucccgcccagcaaggugguggaguucgaggucagcccccaguccacccuggagacgaaggaguccaagagcuucaacugccgcaucgaguacgagaagaccgaccgggccaagaagaccgcgcucugcaacuucgaccccuccaagaucugcuaccaggagcagacccagagccacguguccuggcugugcagcaagcccuucaaggugaucugcaucuacaucgccuucuacuccgucgacuacaagcuggugcagaaggugugccccgacuacaacuaccacagcgagacgccguaccucagcuccggcuga

SEQ ID NO: 33919 - RNA, 423 nt, Artificial Sequence
  derived and/or modified sequence opt1 from NXT1__Homo_sapiens__XP_011527532
auggccagcguggacuucaagaccuacgucgaccaggccugccgcgcggccgaggaguucgugaacguguacuacaccacgauggacaagcggcgccggcugcucucccgccuguacaugggcaccgccacccuggucuggaacgggaacgccgugagcggccaggagucccucagcgaguucuucgagaugcugcccuccagcgaguuccagaucuccguggucgacugccagccggugcacgacgaggccacccccagccagacgaccgugcuggucgugaucugcggguccgugaaguucgagggcaacaagcagcgggacuucaaccagaacuucauccucaccgcgcaggccagccccuccaacaccgucuggaagaucgccagcgacugcuuccgcuuccaggacugggccuccuga

SEQ ID NO: 33920 - RNA, 429 nt, Artificial Sequence
  derived and/or modified sequence opt1 from NXT2__Homo_sapiens__NP_001229546
auggccaccagccuggacuucaagaccuacguggaccaggccugccgcgcggccgaggaguucgucaacaucuacuacgagacgauggacaagcggcgccgggcccucacccgccuguaccuggacaaggccacccucaucuggaacggcaacgccguguccgggcuggacgcgcugaacaacuucuucgacacccuccccagcuccgaguuccaggugaacaugcuggacugccagccgguccacgagcaggccacgcagagccagaccaccgugcugguggucaccuccggcacggugaaguucgacgggaacaagcagcacuucuucaaccagaacuuccuccugaccgcccagagcacccccaacaacaccguguggaagaucgccuccgacugcuuccgguuccaggacuggagcuccagcuga

SEQ ID NO: 33921 - RNA, 1962 nt, Artificial Sequence
  derived and/or modified sequence opt1 from NYAP2__Homo_sapiens__NP_065915
augaucagcuccaagaugaugagcuccaaccccgaggaggacccgcuggacaccuuccuccaguacaucgaggacaugggcaugaaggccuacgacgggcuggugauccagaacgccagcgacaucgcgcgcgagaacgaccggcugcgcaacgagaccaaccucgccuaccugaaggagaagaacgagaagcggcgccggcaggaggaggccaucaagcgcaucggcggggaggucggccgggggcacgagggcuccuacgugggcaagcacuuccgcaugggguucaugaccaugcccgcgccccaggaccggcugccccacccgugcagcuccggcuucagcgugcgcucccagagccuccacuccgucgggggcaccgacgacgacagcuccugcgggagccggcgccagcccccgcccaagcccaagcgggaccccuccaccaagcugagcaccuccagcgagacgguguccagcaccgccgccagcaaguccggcaagacccccgagcgcaccgaggccagcgccaagccccggccgcacuccgacgaguacagcaagaagaucccgccgcccaagcccaagcgcaaccccaacacgcagcuguccaccagcuucgacgagaccuacaucaagaagcacggcccccggcgcaccucccucccccgggacagcucccugagccagauggggucccccgccggcgaccccgaggaggaggagcccguguacaucgagauggucgggaacauccugcgcgacuuccggaaggaggacgacgaccagagcgaggcgguguacgaggagaugaaguaccccaucuucgacgaccucggccaggacgccaagugcgacuucgaccaccacuccugcagcucccagugcgccacgccgaccgugcccgaccuggacuucgccaaggccagcguccccugcccgcccaagggccugcucugcgacaucccgccgcccuuccccaaccugcugucccaccgcccgccccuccugguguucccgcccgcgcccgugcacugcagccccaacuccgacgagagcccccugacgccccucgaggucaccaagcugcccgugcuggagaacgugagcuacaugaagcagcccgccggggccucccccagcacccuccccucccacguccccggccacgccaagcuggagaaggagcaggccgcggcccuggggcccgccagcgccaccccggcccucuccagcuccccgcccccgcccagcacccuguaccgcacccagagcccccacggcuaccccaagucccacuccacgagccccucccccgugagcauggggcggucccugacgccccucagccugaagcggcccccgcccuacgacgcggugcacuccggcagccugagccgcuccagccccuccgucccccacagcaccccgcgccccgugucccaggacggcgccaagauggugaacgccgccgucaacaccuacggggccgcgcccggcgggagccggucccgcacccccaccagcccgcucgaggagcugaccucccuguucagcuccggccggagccuccugcgcaaguccagcuccgggcggcgcagcaaggagcccgccgagaaguccaccgaggagcugaaggugcggagccacuccacggagccccuccccaagcuggacaacaaggagcgcggccaccacggcgccagcagcucccgggagccggugaaggcccaggagugggacgggacccccggcacccccgucgugaccagccgccuggggcggugcuccgucagccccacgcuccuggcgggcaaccacuccagcgagccgaagguguccugcaagcuggggcgcagcgccuccaccagcggcgugcccccgcccuccgucacgccccuccggcagagcuccgaccugcagcagagccaggugcccuccagccuggccaaccgcgacuga

SEQ ID NO: 33922 - RNA, 1446 nt, Artificial Sequence
  derived and/or modified sequence opt1 from NYX__Homo_sapiens__NP_072089
augaagggccgcgggaugcuggugcuccugcugcacgccgucgugcucggccugcccagcgccugggcggugggggccugcgcccgggccugcccggccgcgugcgccugcuccacggucgagcgcggcugcagcgugcggugcgaccgcgccgggcugcuccgggugcccgccgagcugcccugcgaggcggucuccaucgaccuggaccgcaacggccuccgguuccugggcgagcgcgccuucgggacccugcccagccuccggcgccugucccugcggcacaacaaccucagcuucaucacgccgggcgccuucaaggggcugccccgccuggccgagcuccggcuggcccacaacggcgaccugcgcuaccuccacgcgcggaccuucgccgcccugucccgccugcggcgccucgaccuggccgccugccggcuguucagcgugcccgagcgccuccuggcggagcugcccgcccuccgggagcuggccgccuucgacaaccuguuccgccgcgugccgggggcccuccggggccuggcgaaccugacccacgcccaccucgagcgcggccggaucgaggccgucgccuccagcucccugcaggggcugcgccggcuccgcagccugucccugcaggccaaccgggugcgcgcggugcacgccggcgccuucggggacugcggcguccucgagcaccuccugcucaacgacaaccugcuggccgagcuccccgcggacgccuuccggggccugcgccggcugcgcacccugaaccucgggggcaacgcccuggaccggguggcccgcgccugguucgcggaccuggccgagcucgagcugcuguaccucgaccggaacagcaucgccuucguggaggagggggccuuccagaaccuguccggccugcucgcccugcaccugaacgggaaccgccucacgguccuggcguggguggccuuccagcccggcuucuuccugggccggcuguuccuguuccgcaaccccuggugcugcgacugccggcuggaguggcuccgcgacuggauggaggggagcggccgcgugaccgacgucccgugcgccucccccgggagcguggccggccuggaccugucccaggugaccuucgggcggagcagcgacggccucugcgucgaccccgaggagcugaaccugaccacguccagccccggcccgucccccgagcccgccgcgaccaccgugagccgcuucuccagccuccuguccaagcugcucgcgccccgggugccggucgaggaggccgccaacaccaccgggggccuggccaacgccagccuguccgacagccucuccagccgcggggugggcggggccggccggcagcccugguuccugcuggccuccugccuccugcccagcgucgcccagcacgugguguucggccugcagauggacuga

SEQ ID NO: 33923 - RNA, 459 nt, Artificial Sequence
  derived and/or modified sequence opt1 from OARD1__Homo_sapiens__NP_659500
auggccagcucccugaacgaggaccccgagggcagccgcaucaccuacgugaagggggaccucuucgccugcccgaagaccgacucccuggcgcacugcaucagcgaggacugccggaugggcgccgggaucgccguccuguucaagaagaaguucggcggggugcaggagcuccugaaccagcagaagaaguccggcgagguggccguccugaagcgcgacggccgguacaucuacuaccucaucacgaagaagcgcgccagccacaagcccaccuacgagaaccugcagaagucccuggaggcgaugaagucccacugccucaagaacggggugaccgaccugagcaugccccggaucggcugcgggcuggaccgccuccagugggagaacgugagcgccaugaucgaggaggucuucgaggccaccgacaucaagaucacgguguacacccuguga

SEQ ID NO: 33924 - RNA, 1245 nt, Artificial Sequence
  derived and/or modified sequence opt1 from OAS1__Homo_sapiens__NP_001027581
augauggaccugcgcaacacccccgccaagagccucgacaaguucaucgaggacuaccugcugccggacacgugcuuccggaugcagaucaaccacgccaucgacaucaucugcggcuuccucaaggagcgcugcuuccggggguccagcuaccccgugugcgucuccaagguggugaagggcgggagcuccggcaaggggacgacccugcgcggccggagcgacgcggaccuggucguguuccucagcccccugaccaccuuccaggaccagcugaaccgccggggcgaguucauccaggagauccgccggcagcucgaggccugccagcgcgagcgggccuucuccgugaaguucgagguccaggcgccccgcugggggaacccgcgggcccuguccuucgugcugagcucccuccagcugggcgaggggguggaguucgacguccugcccgccuucgacgcccucggccagcugaccgggggcuacaagcccaacccccagaucuacgugaagcugaucgaggagugcaccgaccuccagaaggagggcgaguucagcacgugcuucaccgagcugcagcgcgacuuccugaagcagcggccgaccaagcucaagucccugauccgccuggugaagcacugguaccagaacugcaagaagaagcucgggaagcugccgccccaguacgcccuggagcuccugaccgucuacgccugggagcggggcagcaugaagacccacuucaacaccgcgcagggguuccgcacggugcuggagcucgugaucaacuaccagcagcugugcaucuacuggaccaaguacuacgacuucaagaaccccaucaucgagaaguaccugcggcgccagcucaccaagccccggcccgucauccuggaccccgccgaccccaccggcaaccugggcgggggcgacccgaagggguggcgccagcucgcccaggaggccgaggccuggcugaacuaccccugcuucaagaacugggacggcucccccgugagcuccuggauccugcucacgcagcacacccccgggagcauccacccgaccggccgccggggccuggaccugcaccacccccucaacgcguccgccagcugggggaagggccugcagugcuaccuggaccaguuccuccacuuccagguggggcugcugauccagcgcggccagagcuccagcgucuccuggugcaucauccaggaccggacccaggugagcuga

SEQ ID NO: 33925 - RNA, 519 nt, Artificial Sequence
  derived and/or modified sequence opt1 from OAS2__Homo_sapiens__NP_001027903
augggcaacggggagagccagcuguccagcgugcccgcccagaagcucggcugguucauccaggaguaccugaagccguacgaggagugccagacccugaucgacgagauggucaacaccaucugcgacgugcuccaggagcccgagcaguucccccuggugcagggggucgccaucggcggguccuacggccgcaagacggugcugcggggcaacagcgacgggacccucgugcuguucuucuccgaccugaagcaguuccaggaccagaagcgcagccagcgggacauccucgacaagaccggcgacaagcugaaguucugccuguucaccaaguggcucaagaacaacuucgagauccagaagucccuggacggguucacgauccaggucuucaccaagaaccagcgcaucagcuucgaggugcuggcggccuucaacgcccucuccaagcacugcugggugagcggcgagaagucccagcggagcgggugccagaccgcccugugcaaccuguga

SEQ ID NO: 33926 - RNA, 3264 nt, Artificial Sequence
  derived and/or modified sequence opt1 from OAS3__Homo_sapiens__NP_006178
auggaccuguacagcacccccgccgccgcgcucgaccgcuucguggcccggcgccugcagccgcggaaggaguucgucgagaaggcccgccgggcccugggcgcccucgcggccgcccugcgcgagcgcgggggccggcugggggccgcggcgccccgggugcucaagaccgugaagggcggguccagcggccgcggcacggcccugaagggcgggugcgacuccgagcuggucaucuuccucgacugcuucaagagcuacguggaccagcgggcccgccgggccgagauccuguccgagaugcgcgccagccuggaguccugguggcagaaccccgugcccgggcuccggcugaccuucccggagcagagcguccccggcgcccugcaguuccgccucaccuccguggaccuggaggacuggauggacgugagccugguccccgccuucaacgugcucgggcaggccggcuccggcgugaagcccaagccgcaggucuacagcacccugcugaacuccgggugccagggcggggagcacgccgcgugcuucacggagcuccggcgcaacuucgugaacauccggcccgccaagcugaagaaccugauccuccuggugaagcacugguaccaccaggucugccugcagggccucuggaaggagacccugccgcccguguacgcccuggagcuccugaccaucuucgccugggagcagggcugcaagaaggacgccuucagccuggcggaggggcuccgcaccgugcugggccugauccagcagcaccagcaccucugcgucuucuggacggugaacuacggguucgaggaccccgccgugggccaguuccugcagcggcagcugaagcgcccccgccccgucauccucgaccccgccgacccgaccugggaccuggggaacggcgccgccuggcacugggaccugcucgcgcaggaggccgccuccugcuacgaccaccccugcuuccugcggggcaugggggaccccgugcagagcuggaagggccccgggcugccgcgcgccggcugcuccgggcucggccaccccauccagcuggaccccaaccagaagacccccgagaacagcaagucccugaacgcgguguacccgcgggccggcagcaagccgcccagcugccccgcccccgggcccaccggcgccgccuccaucguccccagcgugccggggauggcgcucgaccugucccagauccccacgaaggagcuggaccgcuucauccaggaccaccugaagcccagcccccaguuccaggagcaggucaagaaggccaucgacaucauccuccggugccugcacgagaacugcgugcacaaggccucccgcgugagcaagggcggguccuucggccggggcaccgaccugcgcgacgggugcgacgucgagcucaucaucuuccugaacugcuucaccgacuacaaggaccagggcccgcggcgcgccgagauccuggacgagaugcgggcccagcucgagagcugguggcaggaccaggugcccucccugagccugcaguuccccgagcagaacgugcccgaggcgcuccaguuccagcuggucuccaccgcccucaagagcuggacggacgugucccugcugccggccuucgacgccguggggcagcugagcuccggcaccaagcccaacccccaggucuacagccgccuccugaccuccggcugccaggagggggagcacaaggccugcuucgcggagcugcggcgcaacuucaugaacauccggcccgugaagcucaagaaccugauccugcucgugaagcacugguaccgccaggucgccgcccagaacaagggcaaggggccggcccccgcgagccugccgcccgccuacgcccuggagcuccugaccaucuucgccugggagcagggcugccggcaggacugcuucaacauggcccagggguuccgcacggugcugggccucgugcagcagcaccagcagcugugcgucuacuggaccgugaacuacuccaccgaggaccccgcgaugcggaugcaccuccugggccagcugcgcaagccccgcccccuggugcucgaccccgccgacccgaccuggaacgucgggcacggcagcugggagcugcuggcccaggaggccgccgcgcucgggaugcaggccugcuuccugagccgggacggcacguccgugcagcccugggacgugaugcccgcccugcucuaccagacccccgccggggaccuggacaaguucaucagcgaguuccugcagccgaaccgccaguuccucgcccaggucaacaaggcgguggacaccaucugcuccuuccugaaggagaacugcuuccggaacagccccaucaaggugaucaaggucgugaagggcggcuccagcgccaaggggaccgcccugcgcggccgguccgacgccgaccucguggucuuccugagcugcuucucccaguucacggagcaggggaacaagcgcgcggagaucaucagcgagauccgggcccagcuggaggccugccagcaggagcgccaguucgaggugaaguucgagguguccaagugggagaacccccggguccucagcuucucccugaccagccagaccaugcuggaccaguccguggacuucgacgugcucccggccuucgacgcccugggccagcuggucagcgggucccgccccagcagccagguguacguggaccucauccacuccuacagcaacgcgggcgaguacuccacgugcuucaccgagcugcagcgggacuucaucaucagccgccccaccaagcugaagucccucauccggcuggucaagcacugguaccagcagugcaccaagaucagcaagggccgcgggucccugcccccgcagcacggccucgagcugcugaccguguacgccugggagcagggcgggaaggacagccaguucaacauggccgagggguuccggacggugcucgagcuggucacccaguaccgccagcugugcaucuacuggaccaucaacuacaacgccaaggacaagaccgugggcgacuuccucaagcagcagcugcagaagccccggcccaucauccuggaccccgccgacccgaccggcaaccucgggcacaacgcgcgcugggaccugcuggccaaggaggccgccgccugcacguccgcgcucugcugcaugggccggaacgggauccccauccagcccuggcccgugaaggccgccgucuga

SEQ ID NO: 33927 - RNA, 1545 nt, Artificial Sequence
  derived and/or modified sequence opt1 from OASL__Homo_sapiens__NP_003724
auggcccugaugcaggagcucuacagcacccccgccucccgccuggacagcuucguggcgcaguggcugcagccgcaccgggaguggaaggaggagguccucgacgccgugcgcaccguggaggaguuccugcggcaggagcacuuccagggcaagcgcgggcuggaccaggacguccgggugcucaagguggucaaggugggcuccuucgggaacggcacggugcugcgcagcacccgggaggucgagcugguggccuuccucuccugcuuccacagcuuccaggaggccgccaagcaccacaaggacgugcugcgccugaucuggaagaccauguggcagucccaggaccuccuggaccuggggcucgaggaccugcggauggagcagcgcguccccgacgcgcugguguucaccauccagacgcggggcaccgccgagcccaucaccgugaccaucguccccgccuaccgcgcccucggcccgagccugcccaacucccagcccccgcccgagguguacgugagccugaucaaggcgugcgggggccccgggaacuucugccccuccuucagcgagcuccagcggaacuucgucaagcaccgccccacgaagcugaagucccugcuccggcuggugaagcacugguaccagcaguacgugaaggcccgcagcccgcgggccaaccugccgccccucuacgcccuggagcugcucaccaucuacgccugggagaugggcaccgaggaggacgagaacuucaugcuggacgagggguucaccacggucauggaccugcuccuggaguacgaggugaucugcaucuacuggaccaaguacuacacccugcacaacgcgaucaucgaggacugcgugcgcaagcagcucaagaaggagcggcccaucauccuggaccccgccgaccccacccugaacgucgccgagggcuaccgcugggacaucguggcccagcgggccucccagugccucaagcaggacugcugcuacgacaaccgcgagaaccccaucagcuccuggaacgucaagcgcgcgcgggacauccaccugacgguggagcagcgcggcuaccccgacuucaaccugaucgugaacccguacgagcccauccggaaggucaaggagaagauccgccggacccgcggguacagcggccuccagcggcuguccuuccaggugcccgggagcgagcgccagcugcucagcucccggugcagccuggccaaguacggcaucuucucccacacccacaucuaccugcucgagaccauccccagcgagauccagguguucgucaagaacccggacggcggguccuacgccuacgccaucaaccccaacagcuucauccugggccugaagcagcagaucgaggaccagcaggggcugcccaagaagcagcagcagcucgaguuccagggccaggugcugcaggacuggcuggggcucggcaucuacggcauccaggacuccgacacgcugauccugagcaagaagaagggggaggcccucuuccccgcguccuga

SEQ ID NO: 33928 - RNA, 906 nt, Artificial Sequence
  derived and/or modified sequence opt1 from OAT__Homo_sapiens__NP_001165285
augaacaccggcguggaggccggggagaccgccugcaagcuggcgcgcaaguggggcuacacggucaaggggauccagaaguacaaggccaagaucguguucgccgccggcaacuucugggggcggacccucagcgccaucuccagcuccaccgaccccaccagcuacgacggcuucggccccuucaugcccggguucgacaucauccccuacaacgaccugcccgcgcuggagcgcgcccuccaggacccgaacguggccgccuucauggucgagcccauccagggcgaggcggggguggugguccccgaccccggcuaccugaugggggugcgggagcugugcacgcgccaccagguccucuucaucgccgacgagauccagaccggccuggcccggaccggccgcuggcuggccguggacuacgagaacgugcggccggacaucgugcuccuggggaaggcccuguccggcgggcucuaccccgucagcgcggugcugugcgacgacgacaucaugcugaccaucaagcccggcgagcacggcuccacguacgggggcaacccccucgggugccgcguggccaucgccgcccuggagguccuggaggaggagaaccucgccgagaacgcggacaagcugggcaucauccugcggaacgagcucaugaagcugccgagcgacguggugaccgccguccgcgggaagggccugcucaacgccaucgugaucaaggagaccaaggacugggacgccuggaaggugugccugcggcugcgcgacaacggccuccuggccaagcccacccacggggacaucauccgguucgcgccgccccuggucaucaaggaggacgagcuccgcgaguccaucgagaucaucaacaagacgauccugagcuucuga

SEQ ID NO: 33929 - RNA, 681 nt, Artificial Sequence
  derived and/or modified sequence opt1 from OAZ1__Homo_sapiens__NP_001287949
auggucaagagcucccugcagcgcauccucaacagccacugcuucgcccgggagaaggagggcgacaagcccuccgccaccauccacgcgagccgcaccaugccgcugcugucccuccacagccgcgggggcuccagcuccgagcgggugagccugcacugcugcuccaaccccgggcccggcccccgguggugcagcgacgccccgcacccgccccugaagauccccgggggccgcggcaacucccagcgggaccacaaccucagcgccaaccuguucuacuccgacgaccgccugaacgugacggaggagcucaccagcaacgacaagacccggauccugaacgugcagucccgccugaccgacgccaagcggaucaacuggcgcacgguccucagcgggggcucccuguacaucgagauccccgggggcgcccugcccgaggggagcaaggacagcuucgcggugcuccuggaguucgccgaggagcagcugcgggccgaccacguguucaucugcuuccacaagaaccgcgaggaccgggccgcgcuccugcgcaccuucuccuuccugggcuucgagaucguccggcccggccacccccucgugccgaagcgccccgacgccugcuucauggccuacaccuucgagcgggagagcuccggggaggaggaggaguga

SEQ ID NO: 33930 - RNA, 570 nt, Artificial Sequence
  derived and/or modified sequence opt1 from OAZ2__Homo_sapiens__NP_002528
augaucaacacccaggacagcuccauccugccccucagcaacugcccgcagcugcagugcugccgccacaucgugcccggcccccuguggugcuccgacgccccgcacccccucagcaagauccccgggggccgcgggggcgggcgggaccccucccugagcgcccugaucuacaaggacgagaagcucaccgucacgcaggaccugcccgugaacgacggcaagccgcacaucgugcacuuccaguacgaggucaccgaggugaagguguccagcugggacgccguccuguccagccagucccucuucguggagauccccgacggccugcuggccgacgggagcaaggagggccuccuggcccugcucgaguucgccgaggagaagaugaaggugaacuacgucuucaucugcuuccggaaggggcgcgaggaccgggcgccccugcugaagaccuucuccuuccucggcuucgagaucgugcgccccgggcacccgugcgugcccagccggcccgacgucauguucaugguguacccccuggaccagaaccuguccgacgaggacuga

SEQ ID NO: 33931 - RNA, 1107 nt, Artificial Sequence
  derived and/or modified sequence opt1 from OBFC1__Homo_sapiens__XP_006718039
augcagcccggcagcucccgcugcgaggaggagaccccgagccugcucugggggcuggaccccguguuccuggccuucgccaagcucuacauccgggacauccuggacaugaaggagucccgccagguccccggcguguuccuguacaacgggcaccccaucaagcaggucgacgugcucggcaccgugaucggggugcgggagcgcgacgcguucuacagcuacggcgucgacgacuccacgggcgugaucaacugcaucugcuggaagaagcugaacaccgagagcguguccgccgccccgagcgccgcccgggagcugucccucaccagccagcugaagaagcugcaggagaccaucgagcagaagacgaagaucgagaucggggacaccauccgcguccggggcuccauccgcaccuaccgggaggagcgcgagauccacgcgaccacguacuacaagguggacgaccccguguggaacauccagaucgcccggaugcucgagcugcccaccaucuaccgcaaggucuacgaccagcccuuccacagcuccgcccuggagaaggaggaggcccucagcaacccgggggcgcuggaccugcccucccucaccagccugcuguccgagaaggccaaggaguuccucauggagaaccgggugcagagcuucuaccagcaggagcuggagaugguggagucccugcucagccuggccaaccagcccgucauccacagcgccuccagcgaccaggugaacuucaagaaggacaccacguccaaggccauccacagcaucuucaagaacgcgauccagcugcuccaggagaagggccugguguuccagaaggacgacggguucgacaaccuguacuacgucacccgcgaggacaaggaccuccaccggaagauccaccgcaucauccagcaggacugccagaagcccaaccacauggagaagggcugccacuuccugcacauccuggccugcgcccggcucuccauccgcccgggccugagcgaggccgugcugcagcagguccucgagcugcuggaggaccaguccgacaucgugagcaccauggagcacuacuacaccgccuucuga

SEQ ID NO: 33932 - RNA, 687 nt, Artificial Sequence
  derived and/or modified sequence opt1 from OBP2A__Homo_sapiens__NP_001280118
augaagacccuguuccucggcgugacccuggggcuggccgccgcgcucagcuucacgcuggaggaggaggacaucaccggcaccugguacgucaaggccauggugguggacaaggacuuccccgaggaccgccggccccgcaaggucucccccgugaaggugaccgcccucgggggcgggaaccuggaggccacguucaccuucaugcgggaggaccgcugcauccagaagaagauccugaugcggaagaccgaggagcccggcaaguucagcgccuacggcgggcgcaagcugaucuaccuccaggagcugcccggcaccgacgacuacgucuucuacugcaaggaccagcggcgcgggggccugcgguacauggggaagcucguggcguccgcccccugccgcgccgugccccugagcccgcccuggcugacguggccgccccaccuccaggucggcauccugauccccaccuggcggcccuggaagaaccugcgcaacuggugcuccacccgggacagccgccggcgcaccuucuccugcccgugccggcgcgaggccgcguucagcaacacgcggcagccgcccggccuccaccuccaguccccgcccuaccaccagacccagagccccgaccaccuggaccugcccuccagccacgaccccucccugcugccgcccaccuga

SEQ ID NO: 33933 - RNA, 23907 nt, Artificial Sequence
  derived and/or modified sequence opt1 from OBSCN__Homo_sapiens__NP_001092093
auggaccagccccaguucuccggcgccccgcgcuuccugacccggcccaaggccuucgugguguccguggggaaggacgccacccuguccugccagaucgugggcaaccccaccccgcaggucuccugggagaaggaccagcagcccguggccgccggggcccgcuuccggcuggcccaggacggcgaccuguaccgccugaccauccuggaccuggcccugggggacuccggccaguacgugugccgggcccgcaacgccaucggcgaggccuucgccgccgucgggcugcaggucgacgccgaggccgccugcgccgagcaggcgccccacuuccugcugcggcccaccuccauccgcgugcgggagggcagcgaggccaccuuccgcugccgggucgggggcagcccccggcccgccgugagcugguccaaggacgggcggcgccugggcgagcccgacggcccccgggugcgcgucgaggagcugggggaggccagcgcgcugcggauccgcgccgcccggccccgcgacggcgggaccuacgaggugcgggccgagaacccccugggcgccgccuccgccgccgccgcccugguggucgacagcgacgcggccgacaccgccucccgccccggcaccagcaccgccgcgcugcuggcccaccuccagcgccggcgcgaggccaugcgggccgagggggcccccgcgagcccgcccagcaccggcacccggaccugcaccgugaccgaggggaagcacgcccggcucuccugcuacgugaccggcgagcccaagcccgagaccgucuggaagaaggacgggcagcuggugaccgagggccgccggcacguggucuacgaggacgcccaggagaacuucgugcugaagauccucuucugcaagcagagcgaccgcggccuguacacgugcaccgccuccaaccugguggggcagaccuacagcagcguccucguggucgugcgggagcccgccgugcccuucaagaagcgccugcaggaccuggagguccgggagaaggaguccgcgaccuuccucugcgaggugccccagcccagcaccgaggccgccugguucaaggaggagacccgccugugggccuccgccaaguacggcaucgaggaggaggggaccgagcggcgccugaccgugcggaacgucagcgcggacgacgacgccguguacaucugcgagacgcccgagggcucccgcaccguggccgagcucgccguccaggggaaccugcugcggaagcucccccgcaagaccgcggugcgggugggcgacaccgccauguucugcgucgagcuggccgugcccgugggccccguccacuggcugcgcaaccaggaggaggugguggccgggggccgcgucgccaucagcgcggaggggacccggcacacccucaccaucucccagugcugccuggaggacgugggccagguggccuucauggccggggacugccagaccagcacccaguucugcgucuccgcgccccgcaagccgccccugcagccgcccguggaccccguggucaaggcccggauggagagcuccgugauccucagcuggagcccgccgccccacggcgagcgccccgugaccaucgacggcuaccuggucgagaagaagaagcuggggaccuacaccuggauccggugccacgaggcggaguggguggccacccccgagcucaccguggccgacgucgccgaggagggcaacuuccaguuccgcgugagcgcccugaacuccuucgggcagagccccuaccuggaguuccccggcaccgugcaccucgcgcccaagcuggccguccggacgccccugaaggccgugcaggccguggagggcggggaggucaccuucuccguggaccucaccguggcgagcgccggcgagugguuccuggacgggcaggcccugaaggccuccagcgucuacgagauccacugcgaccgcacccggcacacccugaccauccgcgaggugcccgccagccuccacggcgcgcagcugaaguucguggccaacgggaucgaguccagcauccggauggagguccgcgccgcccccggccugacggccaacaagccgcccgcggccgccgcccgggaggugcucgcccgccugcacgaggaggcgcagcugcucgccgagcuguccgaccaggccgccgccgugaccuggcugaaggacggccggacccucagccccgggcccaaguacgagguccaggcguccgccggccgccgggugcugcuggugcgcgacgucgcccgggacgacgccgggcucuacgagugcgugagccgcggcgggcggaucgcguaccagcuguccgugcagggccuggcccgcuuccuccacaaggacauggccggcagcugcgucgacgccguggccgggggccccgcgcaguucgagugcgagaccuccgaggcccacguccacgugcacugguacaaggacgggauggagcugggccacagcggggagcgcuuccugcaggaggacgugggcacgcggcaccgccucgucgccgccaccgugacccggcaggacgagggcaccuacuccugccgcgugggggaggacagcgucgacuuccggcugcgcguguccgagcccaagguggucuucgccaaggagcagcuggcgcggcgcaagcuccaggccgaggccggcgccagcgccacgcuguccugcgagguggcgcaggcccagaccgaggugaccugguacaaggacgggaagaagcugagcuccagcagcaaggucugcauggaggccaccggcugcacgcggcgccucguggugcagcaggccgggcaggcggacgccggcgaguacuccugcgaggccggcgggcagcggcugagcuuccaccuggacgucaaggagcccaaggugguguucgccaaggaccaggucgcccacuccgaggugcaggcggaggccggcgccagcgccacccucuccugcgagguggcccaggcgcagaccgaggucaugugguacaaggacgggaagaagcugagcuccagccugaaggugcacguggaggccaagggcugccgccggcgccucgucgugcagcaggccggcaagaccgacgccggggacuacuccugcgaggcccggggccagcgcgugagcuuccggcugcacaucacggagcccaagaugauguucgcgaaggagcaguccguccacaacgaggugcaggccgaggccggggccagcgcgaugcuguccugcgagguggcccaggcccagaccgaggucaccugguacaaggacggcaagaagcucagcuccagcuccaagguggggauggaggugaagggcugcacccgccggcugguccugccccaggccggcaaggccgacgcgggggaguacagcugcgaggccggcgggcagcgcguguccuuccaccuccacaucacggagcccaagggcguguucgccaaggagcagagcguccacaacgaggugcaggccgaggccgggaccaccgcgaugcugagcugcgagguggcccagccccagaccgaggucacgugguacaaggacggcaagaagcuguccagcuccagcaaggugcgcauggaggugaagggcugcacccggcgccucgucgugcagcaggucgggaaggccgacgccggcgaguacuccugcgaggccgggggccagcgggucagcuuccagcugcacaucaccgagcccaaggcgguguucgccaaggagcagcuggugcacaacgagguccgcaccgaggccggggccuccgccacgcucagcugcgagguggcgcaggcccagaccgaggugaccugguacaaggacggcaagaagcuguccagcuccagcaagguccggaucgaggccgccggcugcaugcgccagcuggugguccagcaggcggggcaggccgacgccggcgaguacacgugcgaggccgggggccagcggcucuccuuccaccuggacgugagcgagcccaaggccguguucgcgaaggagcagcuggcccaccgcaagguccaggccgaggccggcgccaucgcgacgcucuccugcgagguggcccaggcccagaccgaggugaccugguacaaggacgggaagaagcugagcuccagcuccaagguccggauggaggccgugggcugcacccgccggcuggugguccagcaggccugccaggcggacaccggggaguacagcugcgaggccggcgggcagcgccucagcuucucccuggacguggccgagcccaagguggucuucgccaaggagcagccggugcaccgggaggugcaggcgcaggccggcgccagcacgacccuguccugcgaggucgcccaggcccagaccgaggugaugugguacaaggacggcaagaagcucagcuucuccagcaaggugcgcauggaggcggucgggugcacccggcgccugguggugcagcaggccggccaggccgucgccggggaguacuccugcgaggccggcagccagcggcuguccuuccaccuccacguggcggagcccaaggccguguucgccaaggagcagcccgccagccgcgagguccaggccgaggcggggacguccgccacccugagcugcgagguggcccaggcccagaccgaggugaccugguacaaggacggcaagaagcuguccagcuccagcaagguccggauggaggcggugggcugcacgcgccggcucgugguccaggaggccgggcaggccgacgccggcgaguacuccugcaaggccggggaccagcgccugagcuuccaccuccacguggcggagcccaagguggucuucgccaaggagcagccggcccaccgcgaggugcaggccgaggccggcgcguccgccacccucagcugcgagguggcccaggcccagaccgaggucaccugguacaaggacgggaagaagcugagcuccagcuccaaggugcggguggaggccgucggcugcacgcgccggcugguggugcagcaggcgggccaggccgaggccggggaguacagcugcgaggccggcgggcagcagcucuccuuccgccugcaggucgccgagcuggagccccagaucagcgagcggcccugccgccgggagccccucguggugaaggagcacgaggacaucauccugaccgcgacccuggccaccccguccgccgccacggucaccuggcucaaggacggcguggagauccgccggagcaagcgccacgagaccgcgucccagggggacacccacacgcugaccgugcacggcgcccagguccuggacagcgccaucuacuccugccgggugggcgccgaggggcaggacuuccccgugcaggucgaggagguggccgcgaaguucugccgccuccuggagcccgucugcggcgagcugggcgggaccgugacccucgccugcgagcugagccccgccugcgccgagguggucuggcggugcggcaacacgcagcugcgcguggggaagcgguuccagaugguggccgagggcccgguccgcucccucaccgugcuggggcugcgggcggaggacgccggcgaguacgugugcgagagccgcgacgaccacaccuccgcccagcucaccgucagcgugccccggguggucaaguucauguccgggcugagcacggugguggccgaggagggcggcgaggccaccuuccagugcgucgugucccccagcgacguggcggucgugugguuccgcgacggggcccugcuccagcccagcgagaaguucgccaucucccagagcggcgccucccacagccugaccaucuccgaccuggugcucgaggacgcggggcagaucaccgucgaggccgagggcgccagcuccagcgccgcccugcgcgugcgggaggcgccggugcuguucaagaagaagcucgagccccagacggucgaggagcgcuccagcgugacccuggagguggagcugacccggcccuggcccgagcugcgcuggacccggaacgccacggcccucgccccggggaagaacgucgagauccacgccgagggcgcgcgccaccggcuggugcugcacaacgugggcuucgccgaccgcggguucuucggcugcgagacccccgacgacaagacccaggccaagcucaccgucgagaugcgccaggugcgccuggugcgggggcugcaggccgucgaggcccgcgagcagggcaccgcgacgauggaggugcagcucucccacgccgacguggacgggagcuggacccgggacggccugcgcuuccagcagggcccgaccugccaccuggccguccgggggcccaugcacacccucacgcuguccggccugcgcccggaggacagcgggcucaugguguucaaggccgagggcgugcacaccuccgcccggcuggucgugaccgagcugcccgugagcuucucccgcccccuccaggacgucgugaccacggagaaggagaaggugacccuggagugcgagcugagccggcccaacgucgacgugcgcuggcucaaggacgggguggagcugcgggcgggcaagaccauggccaucgccgcccagggcgcgugccgcucccugaccaucuaccgcugcgaguucgccgaccagggggucuacgugugcgacgcccacgacgcccagagcagcgccuccgugaagguccagggccggacguacacccucaucuaccgccgggugcuggcggaggacgccggggagauccaguucgucgccgagaacgccgagagccgcgcccagcugcgggugaaggagcucccggugacccugguccgcccccugcgggacaagaucgcgauggagaagcaccgcggcgugcucgagugccaggugucccgggccagcgcccagguccgcugguucaagggcucccaggagcugcagcccgggccgaaguacgagcuggugagcgacggccucuaccggaagcugaucaucuccgacgugcacgccgaggacgaggacaccuacacgugcgacgccggggacgucaagaccagcgcgcaguucuucguggaggagcaguccaucaccaucgugcgcggccugcaggacgucaccgugauggagcccgcccccgccugguucgagugcgagacgagcauccccuccgugcggccgcccaaguggcuccuggggaagaccguccugcaggccggcggcaacguggggcucgagcaggagggcaccgugcaccgccugaugcugcggcggaccugcagcacgaugaccgggcccguccacuucaccgugggcaagucccggagcuccgcgcgccucguggucagcgacauccccguggugcugacccggccgcuggagcccaagacggggcgcgagcuccaguccgucgugcugagcugcgacuuccgccccgcccccaaggccgugcagugguacaaggacgacaccccgcugagccccuccgagaaguucaagaugagccucgagggccagauggccgagcugcggauccugcgccucaugcccgccgacgcgggcgucuaccggugccaggccggguccgcccacagcuccaccgaggugaccguggaggcccgcgaggucacggugaccggcccccugcaggacgccgaggcgaccgaggaggggugggccagcuucuccugcgagcugagccacgaggacgaggagguggaguggucccucaacggcaugccgcuguacaacgacagcuuccacgagaucucccacaaggggcggcgccacacccugguccucaagagcauccagcgggccgacgccggcaucgugcgcgccuccagccugaagguguccacgagcgcgcggcuggagguccgcgugaagcccguggucuuccucaaggcccuggacgaccuguccgccgaggagcggggcacccucgcccugcagugcgaggugagcgaccccgaggcgcacguggucuggcgcaaggacggggugcagcugggccccuccgacaaguacgacuuccuccacaccgccgggacccggggccuggugguccacgacgugagccccgaggacgccggccuguacacgugccacguggggagcgaggagacccgcgcccggguccgcgugcacgaccuccacgugggcaucaccaagcggcugaagaccauggagguccuggagggggaguccugcagcuucgagugcgugcucucccacgagagcgccuccgaccccgcgauguggaccgucggcgggaagaccgugggcagcuccagccgcuuccaggccacccggcagggccgcaaguacauccuggugguccgggaggccgcccccuccgacgccggggaggugguguucagcguccgcggccugaccuccaaggcgagccucaucgugcgcgagcggcccgccgccaucaucaagccgcuggaggaccaguggguggcccccggggaggacgucgagcugcgcugcgagcucucccgggccggcacccccgugcacuggcugaaggaccgcaaggcgauccgcaagucccagaaguacgacguggucugcgaggggacgauggccaugcuggugauccgcggcgccucccucaaggacgccggcgaguacacgugcgagguggaggccagcaaguccaccgcgagccugcacgucgaggagaaggccaacugcuucaccgaggagcugacgaaccuccagguggaggagaaggggaccgccguguucacgugcaagaccgagcaccccgccgcgacggucaccuggcggaagggccugcuggagcuccgcgccuccgggaagcaccagccgagccaggagggccugacccugcggcucaccaucagcgcccuggagaaggccgacuccgacacguacacgugcgacaucgggcaggcccagagccgcgcgcagcugcucgugcagggccggcgcgugcacaucaucgaggaccuggaggacgucgacgugcaggagggcuccagcgccaccuuccggugccgcaucucccccgccaacuacgagcccgugcacugguuccuggacaagaccccgcuccacgccaacgagcugaacgagaucgacgcccagcccgggggcuaccacguccugacgcuccggcagcuggcgcugaaggacagcgggaccaucuacuucgaggccggcgaccagcgcgccuccgccgcccuccgggugaccgagaagcccagcguguucucccgcgagcugaccgacgcgacgaucaccgagggggaggaccugacccuggucugcgagaccagcacgugcgacauccccgugugcuggaccaaggacggcaagacccuccggggcuccgcccgcugccagcugagccacgaggggcaccgcgcccagcugcucaucaccggcgccacgcugcaggacuccgggcgguacaagugcgaggcgggcggcgccugcagcuccagcaucgugcgcguccacgcccggccggugcgcuuccaggaggcccugaaggaccucgaggugcuggagggcggggccgcgacccugcggugcguccucuccagcguggccgcccccgugaaguggugcuacgggaacaacguccugcgccccggcgacaaguacucccugcggcaggagggggccaugcucgagcugguggugcgcaaccugcggccccaggacagcggccgcuacagcugcuccuucggcgaccagaccaccagcgccacgcucaccgucaccgcgcugccggcccaguucaucgggaagcugcggaacaaggaggccaccgagggcgccaccgccacgcuccgcugcgagcuguccaaggcggcccccguggaguggcggaaggggagcgagacccugcgcgacggcgaccgguacugccuccgccaggacggggccaugugcgagcugcagauccggggccuggccaugguggacgcggccgaguacuccugcgucugcggcgaggagcgcaccagcgccucccucaccauccggcccaugcccgcccacuucaucgggcgccugcggcaccaggagagcaucgagggcgccacggcgacccugcgcugcgagcucuccaaggccgccccgguggaguggcgcaaggggcgggagagccugcgcgacggcgaccggcacucccugcgccaggacggggccgugugcgagcuccagaucugcggccuggccgucgcggacgccggcgaguacagcugcgugugcggggaggagcggaccuccgccacccugacggugaaggcccuccccgccaaguucaccgagggccugcgcaacgaggaggcggucgagggggccaccgccaugcuguggugcgagcucagcaagguggcccccguggaguggcggaagggccccgagaaccugcgcgacggcgaccgguacauccugcgccaggaggggacccggugcgagcuccagaucugcggccuggccauggcggacgccggggaguaccugugcgucugcggccaggagcgcacguccgccacccucaccauccgggcccugccggcgcgcuucaucgaggacgugaagaaccaggaggcccgggagggggccaccgccguccugcagugcgagcucaacagcgccgcgcccguggaguggcgcaagggcuccgagacgcugcgggacggcgaccgcuacagccugcggcaggacgggaccaagugcgagcuccagauccgcggccuggccauggccgacaccggggaguacuccugcgugugcggccaggagcgcaccagcgccaugcugacgguccgggcccuccccaucaaguucaccgaggggcugcgcaacgaggaggcgaccgagggcgccaccgccgugcugcggugcgagcucagcaagauggcccccguggagugguggaagggccacgagacgcugcgcgacggggaccggcacucccugcgccaggacggcgcccggugcgagcuccagauccgcgggcuggucgcggaggacgccggcgaguaccugugcaugugcgggaaggagcggaccagcgccaugcucaccgugcgcgccaugccguccaaguucaucgagggccugcggaacgaggaggcgaccgagggcgacacggccacccuguggugcgagcucagcaaggccgcccccguggaguggcgcaaggggcacgagacccugcgggacggcgaccgccacucccugcggcaggacgggagccgcugcgagcuccagauccggggccuggccgucguggacgcgggggaguacuccugcgugugcggccaggagcgcaccagcgccacgcugaccguccgggcccuccccgcccgcuucaucgaggacgugaagaaccaggaggcccgggagggcgcgaccgccgugcugcagugcgagcuguccaaggccgcccccgucgaguggcgcaaggggagcgagacccuccgcggcggggaccgguacucccugcgccaggacggcacgcggugcgagcugcagauccacggccucagcguggccgacaccggggaguacuccugcgugugcggccaggagcgcaccagcgcgacccugaccguccgggccccgcagcccguguuccgcgagccccugcagucccuccaggccgaggaggggagcacggccacccugcagugcgagcuguccgagccgaccgccaccguggucuggagcaagggcgggcuccagcugcaggcgaacggccggcgcgagccccggcugcagggcugcacggccgagcucgugcugcaggaccugcagcgcgaggacaccggggaguacacgugcacgugcggcucccaggccacgagcgccacccucaccgugaccgcggcccccguccgguuccugcgcgagcugcagcaccaggagguggacgagggcgggacggcccaccucugcugcgagcugagccgggccggggccuccguggaguggcgcaagggcagccugcagcuguuccccugcgcgaaguaccagaugguccaggacggcgccgccgccgagcugcuggugcgcggcguggagcaggaggacgccggcgacuacacgugcgacaccgggcacacccaguccauggcgagccucuccguccgcgugccgcggcccaaguucaagacgcgccugcagagccuggagcaggagaccggcgacaucgcccggcugugcugccagcucuccgacgccgagagcggggccgugguccaguggcugaaggagggcguggagcugcacgccggccccaaguacgagaugcgcucccagggggcgacccgcgagcuccugauccaccagcuggaggccaaggacaccggcgaguacgccugcgugaccggcgggcagaagaccgccgcgagccuccgggucaccgagcccgaggugaccaucgugcgcgggcuggucgacgccgaggugacggccgacgaggacguggaguucuccugcgaggucagccgggccggggccaccggcgugcaguggugccugcaggggcucccgcugcaguccaacgaggugaccgaggucgcggugcgcgacggccggauccacacccugcgccucaagggggugacgcccgaggacgccggcaccgucagcuuccaccugggcaaccacgccuccagcgcccagcugaccgugcgggcccccgaggugaccauccucgagccccugcaggacguccagcuguccgaggggcaggacgcgagcuuccagugccgccucagccgggccuccggccaggaggcccgcugggcccucgggggcgugccgcugcaggccaacgagaugaacgacaucacggucgagcaggggacccuccaccuccugacccuccacaaggugacccuggaggacgcgggcacggugagcuuccacgucgggaccugcuccagcgaggcccagcugaaggugaccgccaagaacaccgugguccgggggcucgagaacguggaggcccuggagggcggggaggcgcuguucgagugccagcucucccagcccgagguggccgcccacaccuggcugcuggacgacgagcccguccacacgagcgagaacgccgaggugguguucuucgagaacggccuccgccaccuccugcuccugaagaaccugcggccccaggacuccugccgcgucaccuuccucgccggggacauggugaccagcgcguuccugaccgugcggggcuggcgccuggagauccucgagccgcugaagaacgccgccguccgggccggcgcccaggcgugcuucacgugcacccuguccgaggccgugcccgugggggaggccagcugguacaucaacggcgccgccguccagcccgacgacuccgacuggaccgugaccgcggacgggagccaccacgcccuccugcugcgcuccgcccagccccaccacgccggcgaggugacguucgccugccgggacgcggucgccagcgcccgccucaccgugcuggggcugccggacccgcccgaggacgccgagguggucgcgcgguccagccacaccgugacccucuccugggccgcccccaugagcgacggcggcgggggccugugcggguaccgcguggaggucaaggagggcgccacgggccaguggcgccugugccacgagcucgugccggggcccgagugcguggucgacggccuggcccccggggagaccuaccgguuccgcguggcggccgugggccccgucggggccggcgagccggugcaccucccccagaccgugcggcucgccgagcccccgaagcccgugccgccccagccguccgcccccgagagccgccagguggcggccggcgaggacgugagccuggagcuggaggucguggccgaggccggggaggugaucuggcacaagggcauggagcggauccagcccgggggccgcuucgaggucgugucccaggggcggcagcagaugcucgugaucaagggcuucaccgccgaggaccagggcgaguaccacugcgggcuggcgcagggcagcaucugccccgccgccgccacguuccaggucgcgcuguccccggccagcguggacgaggcgccccagcccucccugccgcccgaggccgcccaggagggggaccugcaccuccugugggaggcgcuggcccgcaagcggcgcaugagccgggagcccacccuggacuccaucagcgagcugcccgaggaggacggccgcucccagcggcugccccaggaggccgaggagguggcccccgaccugagcgagggguacuccaccgccgacgagcucgcgcgcaccggcgacgccgaccugagccacacguccagcgacgacgagucccgggccggcacccccagccuggucaccuaccucaagaaggccgggcgccccggcaccagcccccuggccagcaaggugggggcgccggccgcccccuccgugaagccccagcagcagcaggagccccuggccgcgguccggccgccccucggcgaccugagcacgaaggaccugggggaccccagcauggacaaggccgccgugaagauccaggccgccuucaagggcuacaaggugcgcaaggagaugaagcagcaggagggccccauguucucccacaccuucggggacaccgaggcgcaggucggcgacgcccuccggcuggagugcguggucgccagcaaggccgacgugcgcgcccgcuggcugaaggacgggguggagcucaccgacggccggcaccaccacaucgaccagcugggcgacgggacgugcucccugcucaucaccggccuggaccgcgcggacgccgggugcuacacgugccaggucagcaacaaguucggccaggugacccacuccgccugcguggucgugagcggguccgagagcgaggccgaguccagcuccggcggcgagcuggacgacgccuuccggcgcgcggcccggcgccuccaccggcuguuccgcaccaaguccccggccgagguguccgacgaggagcuguuccucagcgccgacgaggggcccgccgagcccgaggagccggcggacuggcagaccuaccgggaggacgagcacuucaucugcauccgcuucgaggcccugaccgaggcccggcaggccgucacccgcuuccaggagauguucgcgacgcugggcaucgggguggagaucaagcugguggagcagggcccccggcgcgucgagaugugcaucuccaaggagacccccgcccccguggugccgcccgagccccuccccagccugcugaccuccgacgccgccccggucuuccucaccgagcugcagaaccaggaggugcaggacggguaccccgugagcuucgacugcgucgugaccggccagcccaugcccuccgugcggugguucaaggacggcaagcugcucgaggaggacgaccacuacaugaucaacgaggaccagcagggcggccaccagcugaucaucacggccgucgugccggcggacauggggguguaccgcugccuggccgagaacagcaugggcgucagcuccaccaaggccgagcuccggguggaccugaccagcaccgacuacgacacggccgccgacgcgaccgaguccagcuccuacuucagcgcccagggguaccuguccagccgcgagcaggagggcaccgaguccaccacggacgagggccagcucccccagguggucgaggagcugcgggaccuccagguggcccccgggacccgccucgccaaguuccagcugaaggugaagggcuaccccgccccgcggcuguacugguucaaggacgggcagccccucaccgcgagcgcccacauccgcaugaccgacaagaagauccugcacacgcuggagaucaucuccgucacccgcgaggacagcggccaguacgccgccuacaucuccaacgcgaugggcgccgccuacagcuccgcccggcuccuggugcgcgggcccgacgagcccgaggagaagccggccagcgacgugcacgagcagcuggugccgccccggaugcucgagcgcuucacccccaagaaggugaagaagggcuccagcaucaccuucuccgugaaggucgaggggcggccggugcccacggugcacuggcugcgcgaggaggcggagcggggcguccuguggaucgggcccgacacccccggcuacaccguggccagcagcgcccagcagcacucccucgugcugcuggacgucggccgccagcaccaggggaccuacacgugcaucgccagcaacgccgcgggccaggcccucugcuccgccagccugcacguguccgggcugccgaagguggaggagcaggagaaggucaaggaggcccucaucagcaccuuccugcagggcaccacccaggccaucuccgcgcaggggcuggagacggccagcuucgccgaccucggcggccagcggaaggaggagccccuggccgcgaaggaggcccuggggcaccucucccuggccgaggugggcaccgaggaguuccugcagaagcucaccagccagaucaccgagaugguguccgccaagaucacgcaggccaagcugcagguccccgggggcgacagcgacgaggacuccaagaccccgagcgcgagcccccgccacgggcggagccgccccuccagcuccauccaggagagcagcuccgagagcgaggacggcgacgcccggggcgagaucuucgacaucuacguggugaccgccgacuaccugccccucggggccgagcaggacgccaucacccugcgcgagggccaguacgucgaggugcuggacgcggcccacccgcuccgguggcugguccgcacgaagcccaccaaguccagccccucccggcaggggugggugagccccgccuaccuggaccgccggcucaagcuguccccggaguggggcgccgccgaggcgcccgaguuccccggggaggccgugagcgaggacgaguacaaggcccgccuguccagcgucauccaggagcuccuguccagcgagcaggccuucguggaggagcugcaguuccuccagucccaccaccuccagcaccuggagcgcugcccccacgugccgaucgccgucgcgggccagaaggccgugaucuuccggaacgugcgcgacaucggccgguuccacagcuccuuccuccaggagcugcagcagugcgacaccgacgacgacgucgccaugugcuucaucaagaaccaggccgcguucgagcaguaccuggaguuccucguggggcgcgugcaggccgagagcgucgugguguccaccgccauccaggaguucuacaagaaguacgccgaggaggcccugcuggcgggcgaccccagccagccgccgccgccgccccugcagcacuaccuggagcagcccgucgagcgggugcagcgcuaccaggcccugcucaaggagcugauccggaacaaggcccgcaaccggcagaacugcgcccugcucgagcaggccuacgcgguggucagcgcccugccccagcgcgccgagaacaagcugcacgugucccucauggagaacuaccccgggacgcugcaggcccugggcgagcccauccggcagggccacuucaucgugugggagggggcccccggcgcgcgcaugcccuggaaggggcacaaccggcacgucuuccucuuccgcaaccaccuggugaucugcaagccccggcgcgacagccggaccgacaccguguccuacgucuuccgcaacaugaugaagcugagcuccaucgaccucaacgaccagguggagggcgacgaccgggccuucgagguguggcaggagcgcgaggacagcguccggaaguaccugcugcaggcccgcaccgccaucaucaaguccagcugggugaaggagaucugcgggauccagcagcgccucgcgcugcccguguggcggccgcccgacuucgaggaggagcuggccgacugcacggccgagcucggcgagaccgucaagcuggccugccgcgugaccggcacccccaagcccgugaucuccugguacaaggacgggaaggccguccagguggacccgcaccacauccugaucgaggaccccgacggcagcugcgcgcucauccuggacucccugaccgggguggacagcggccaguacaugugcuucgccgccuccgccgccgggaacugcagcacgcucggcaagauccugguccaggugccgccccgguucgugaacaagguccgcgcguccccguucguggagggcgaggacgcccaguucacgugcaccaucgagggggcccccuacccccagauccggugguacaaggacggcgcccugcucaccacggggaacaaguuccagacccugagcgagccccgcuccggccugcuggugcucgucauccgggccgcgagcaaggaggaccuggggcuguacgagugcgagcucgugaaccgccugggcuccgcccgggccagcgccgagcugcgcauccagagcccgaugcuccaggcccaggagcagugccaccgggagcagcugguggcggccgucgaggacaccacccuggagcgcgccgaccaggaggugacguccgugcucaagcggcugcugggccccaaggcccccgggcccagcaccggcgaccucaccgggccgggccccugcccccgcggcgcgcccgcccugcaggagaccgggucccagccgcccgucacgggcaccagcgaggcccccgccgugcccccgcgggugccccagccccugcuccacgaggggcccgagcaggagccggaggccaucgcgcgcgcccaggaguggaccguccccauccggauggagggcgccgccuggcccggggccggcaccggcgagcugcugugggacgugcacucccacgucgugcgcgagacgacccagcggaccuacaccuaccaggcgaucgacacgcacaccgcccgcccgcccagcaugcaggucaccaucgaggacgugcaggcccagaccgggggcacggcccaguucgaggccaucaucgagggggacccccagcccuccgugaccugguacaaggacagcgugcagcucgucgacuccacccgccugagccagcagcaggagggcaccacguacucccuggugcuccggcacguggcgagcaaggacgccggggucuacacgugccuggcccagaacaccggcggccaggugcugugcaaggccgagcuccuggugcucgggggcgacaacgagccggacuccgagaagcagagccaccgccggaagcuccacuccuucuacgaggucaaggaggagaucgggcgcggcguguucggguucgugaagcggguccagcacaagggcaacaagauccugugcgcggccaaguucaucccccugcgcagccggacccgcgcccaggccuaccgggagcgcgacauccucgccgcgcugucccacccccuggugacgggccuccuggaccaguucgagacccggaagacccugauccucauccuggagcugugcagcuccgaggagcuccuggaccgccuguaccggaaggggguggucaccgaggccgaggugaagguguacauccagcagcucgucgagggccugcacuaccugcacagccacggggugcuccaccuggacaucaagcccagcaacauccugauggugcacccggcccgcgaggacaucaagaucugcgacuucggcuucgcccagaacaucacgcccgccgagcuccaguucucccaguacgggagccccgaguucgucucccccgagaucauccagcagaacccggugagcgaggcguccgacaucugggccaugggcgugaucagcuaccugucccugaccugcagcucccccuucgccggcgagagcgaccgggccacccuccugaacguccuggaggggcgcguguccuggagcucccccauggccgcgcaccucagcgaggacgccaaggacuucaucaaggccacccugcagcgggcgccccaggcgcgcccguccgccgcccagugccugagccaccccugguuccucaaguccaugcccgccgaggaggcccacuucaucaacaccaagcagcugaaguuccugcucgcgcggagccgcuggcagcggucccugaugagcuacaagagcauccuggugaugcgcuccauccccgagcuccugcgcggcccgcccgacagccccucccugggggucgcccggcaccucugccgcgacacgggcggcagcuccagcuccagcuccagcuccgacaacgagcuggcccccuucgcccgggccaagagccugccgcccucccccgugacccacagcccccuccugcacccgcgcggguuccugcggcccuccgcgagccuccccgaggaggccgaggccuccgagcgcagcaccgaggccccggcgccgcccgcgucccccgagggcgccgggccgcccgccgcccagggcugcgugccccggcacagcgucauccgcagccuguucuaccaccaggccggggagucccccgagcacggcgcgcuggccccgggcagccggcgccaccccgcccggcgccggcaccuccugaagggcggcuacaucgccggggcgcugcccggccuccgcgagccccugauggagcaccgggugcuggaggaggaggccgcccgcgaggagcaggccacccuccuggccaaggcgccguccuucgagacggcccugcggcuccccgccagcgggacccaccuggcccccggccacucccacagccuggagcacgacucccccagcaccccgcgccccuccagcgaggccugcggcgaggcgcagcggcuccccuccgcccccagcgggggcgccccgauccgcgacauggggcacccccagggcuccaagcagcugcccagcaccgggggccaccccggcacggcccagccggagcgccccucccccgacagcccgugggggcagcccgcccccuucugccaccccaagcagggcuccgcgccgcaggaggggugcagcccccaccccgccguggcccccugcccgcccggcuccuucccgcccggcagcugcaaggaggccccgcugguccccagcucccccuuccucgggcagccccaggcgccgcccgcccccgccaaggccuccccgccccuggacuccaagaugggccccggggacaucagccugcccggccggcccaagcccgggcccugcuccagccccggcuccgccagccaggcguccagcucccaggugagcucccuccgcgugggcagcucccaggucgggaccgagcccggcccgagccuggacgccgagggguggacccaggaggccgaggaccuguccgacagcacccccacgcuccagcggccccaggagcaggccaccaugcgcaaguucagccugggcgggcggggcggcuacgccgggguggcgggcuacgggaccuucgccuucggcggggacgccggcggcaugcuggggcagggcccgaugugggcccgcaucgccugggcggugucccagagcgaggaggaggagcaggaggaggcccgggccgagucccagagcgaggagcagcaggaggcccgcgcggagagcccccugccccaggucagcgcccggcccgugccggagguggggcgcgcccccacccgguccagccccgagcccacgccgugggaggacaucggccaggucucccucgugcagauccgcgaccugagcggggacgccgaggccgcggacaccaucucccuggacaucagcgagguggaccccgccuaccucaaccuguccgaccuguacgacaucaaguaccuccccuucgaguucaugaucuuccggaagguccccaagagcgcccagccggagccgcccucccccauggccgaggaggagcuggccgaguucccggagcccaccuggcccuggcccggcgagcugggcccgcacgcggggcucgagaucaccgaggagagcgaggacguggacgcccugcuggccgaggccgccgugggccgcaagcggaagugguccagccccucccgcagccucuuccacuuccccgggcggcaccucccccuggacgagccggcggagcucggccugcgcgagcgggucaaggccagcguggagcacaucucccgcauccugaagggccggcccgaggggcucgagaaggaggggccgccccgcaagaagccggggcuggccagcuuccgccuguccggccucaagagcugggaccgggcccccacguuccugcgcgagcuguccgacgagaccgucgugcucgggcagagcgugacccuggccugccaggucuccgcgcagcccgccgcccaggccaccuggagcaaggacggcgcgccgcuggaguccagcucccgggugcucaucagcgccacgcugaagaacuuccagcugcucaccauccugguggucguggccgaggaccugggcguguacacgugcuccgucagcaacgcccucgggaccgugacgaccaccggcgugcugcgcaaggccgagcggcccuccagcucccccugccccgacaucggggaggucuacgcggacggcgugcugcucguguggaagccggucgagagcuacgggcccgugaccuacaucgugcagugcucccuggagggcggcagcuggacgacccuggccagcgacaucuucgacugcugcuaccucaccuccaagcugagccgcgggggcaccuacacguuccggaccgccugcgucuccaaggccgggaugggccccuacagcucccccagcgagcagguccugcucgggggcccgucccaccuggccagcgaggaggagucccagggccgcagcgcgcagccccugcccuccaccaagaccuucgccuuccagacccagauccagcgggggcgcuucagcgugguccggcagugcugggagaaggccuccggccgcgcccucgccgcgaagaucauccccuaccacccgaaggacaagacggccgugcugcgggaguacgaggcccugaaggggcuccgccacccccaccuggcccagcugcacgcggccuaccucagcccccggcaccuggugcugauccucgagcugugcuccggccccgagcugcucccgugccuggccgagcgcgccagcuacuccgagagcgaggucaaggacuaccuguggcagaugcucuccgccacccaguaccugcacaaccagcacauccugcaccucgaccugcggagcgagaacaugaucaucaccgaguacaaccugcucaaggugguggaccugggcaacgcgcagagccugucccaggagaagguccuccccagcgacaaguucaaggacuaccuggagaccauggcccccgagcugcucgaggggcagggcgccgugccccagacggacaucugggccaucggggugaccgccuucaucaugcuguccgcggaguacccggucagcuccgagggcgcccgcgaccugcagcgggggcuccgcaagggccuggugcgccugagccggugcuacgccggccucuccgggggcgccguggccuuccugcgcagcacccugugcgcgcagcccugggggcggcccugcgccuccagcugccuccagugccccuggcugaccgaggagggcccggccugcucccgccccgcccccgucacguucccgaccgcgcggcugcgcguguucgugcggaaccgcgagaagcggcgcgcccuccuguacaagcggcacaaccuggcccagguccgcuga

SEQ ID NO: 33934 - RNA, 3078 nt, Artificial Sequence
  derived and/or modified sequence opt1 from OBSL1__Homo_sapiens__NP_001166879
augaaggccagcuccggcgaccaggggagcccgcccugcuuccugcgcuucccccggcccgugcgcgucguguccggcgccgaggcggagcucaagugcgugguccugggggagcccccgcccgugguggucugggagaagggcgggcagcagcuggccgccagcgagcggcucuccuuccccgccgacggcgccgagcacggccugcugcucaccgcggcccugcccaccgacgccgggguguacgugugccgcgcccggaacgcggccggcgaggccuacgccgccgcggccgucacggugcuggagccgcccgccagcgaccccgagcuccagcccgccgagcgcccgcugcccucccccgggagcggcgagggggcccccguguuccugaccggcccgcggucccaguggguccuccgcggcgcggagguggugcugaccugccgggccgggggccugcccgagcccacccucuacugggagaaggacgggauggcccuggacgaggucugggacagcucccacuucgcccugcagcccggccgcgccgaggacggcccgggggcgagccucgcccugcggauccuggccgcccgccuccccgacuccggcguguacgugugccacgcccggaacgcgcacgggcacgcccaggccggcgcccugcugcagguccaccagccgcccgagagcccgcccgcggaccccgacgaggcccccgcccccgugguggagccccucaagugcgcccccaagacguucugggucaacgaggggaagcacgccaaguuccgcugcuacgugaugggcaagccggagcccgagaucgaguggcacugggagggccggccccugcugcccgaccgccggcgccucauguaccgggaccgcgacgggggcuucgugcugaagguccuguacugccaggcgaaggaccgggggcucuacgugugcgccgcccgcaacuccgccggccagacccugagcgccguccagcugcacgugaaggagccgcgccuccgguucacccgcccccugcaggacguggaggggcgggagcacggcaucgcgguccuggagugcaaggugcccaacucccgcauccccaccgccugguuccgggaggaccagcgccuccugccgugccggaaguacgagcagaucgaggagggcacggugcgccggcugaucauccaccgccucaaggccgacgacgacgggaucuaccugugcgagaugcggggccgcguccggaccguggccaacgugaccgucaaggggcccauccugaagcgccucccccggaagcuggacgugcuggagggcgagaacgccgugcuccuggucgagacccuggaggcggggguggagggccgcuggagccgggacggcgaggagcuccccgugaucugccaguccagcagcgggcacaugcacgcccugguccugccgggcgugacgcgcgaggacgccggggaggugaccuucucccugggcaacagccggaccaccacgcuccugcgcgucaagugcgugaagcacuccccgcccggcccgcccauccuggccgagauguucaaggggcacaagaacaccgugcuccugaccuggaagccgcccgagcccgcgcccgagacccccuucaucuaccgccuggagcggcaggaggucggcagcgaggacuggauccagugcuucuccaucgagaaggccggggccguggaggugcccggcgacugcguccccagcgagggggacuaccgcuuccggaucugcacgguguccggccacggccgcagcccccacguggucuuccacggguccgcccaccucgugcccaccgcccggcugguggcgggccuggaggacguccagguguacgacggggaggacgccguguucagccucgaccuguccaccaucauccagggcaccugguuccugaacggggaggagcucaagagcaacgagcccgagggccaggucgagccgggcgcccugcgcuaccggaucgagcagaaggggcugcagcaccgccucauccugcacgccgugaagcaccaggacuccggcgcccuggugggguucagcugccccggcguccaggacuccgcggcccucacgauccaggagagccccgugcacauccugagcccccaggaccgggugucccugaccuucaccaccuccgagcgcgucgugcucacgugcgagcugagccggguggacuucccggccaccugguacaaggacgggcagaaggucgaggagagcgagcugcucguggugaagauggacggccgcaagcaccggcugauccugcccgaggccaagguccaggacuccggcgaguucgagugccgcaccgagggggugagcgccuucuucggcgugaccguccaggacccgcccgugcacaucguggacccccgggagcacgucuucgugcacgcgaucacguccgagugcgucaugcucgccugcgagguggaccgcgaggacgcccccgugcggugguacaaggacgggcaggaggucgaggagagcgacuucguggugcuggagaacgagggcccccaccgccggcugguccuccccgccacccagccguccgacgggggcgaguuccagugcguggcgggcgacgagugcgccuacuucaccgugaccaucacggacgucagcuccuggaucguguaccccagcgggaagguguacgucgccgccgugcgccuggagcgggugguccugaccugcgagcucugccgccccugggccgaggugcgcuggaccaaggacggcgaggagguggucgagucccccgcgcugcugcuccagaaggaggacaccgugcggcgccuggugcugccggccguccagcucgaggacagcggggaguaccugugcgagaucgacgacgaguccgccagcuucaccgugacggugaccgaguccuaccagagccaggacuccagcaacaacaaccccgagcugugcguccuccugaagaagcccaagacccggcgccuguggucccgguucccgcccuggcgccggaccgccggcacggaguga

SEQ ID NO: 33935 - RNA, 1434 nt, Artificial Sequence
  derived and/or modified sequence opt1 from OC90__Homo_sapiens__NP_001073868
augaucgccuuccugcucaccagcgugcugaugaucccccacgccggcgggcacccgcuggacacgccccaccucccccaggagcugcccccgggccugcccaacaacaucaacaucaccuucuucuccgggauguucaagaacgucgagagcguggcggagaucuucgacugccucggcccccacuucaccuggcugcaggccguguucaccaacuuccccguccugauccaguucgugaacgggaugaagugcguggccggccucugcccgcgcgacuucgaggacuacggcugcacgugccgguucgagauggaggggcugcccgucgacgaguccgacagcugcugcuuccagcaccgccggugcuacgaggaggccgccgagauggacugccugcaggaccccgcgaagcucuccaccgaggugaacugcgugagcaagaagaucaucugcgaguccaaggacaacugcgagcaccuccugugcacgugcgacaaggccgccaucgagugccuggcccgcagcucccugaacagcucccugaaccuccuggacaccagcuucugccuggcgcagacccccgagaccaccaucaaggaggaccucaccacccugcugccgcgggucgugcccguggagcccacggacaccucccucaccgcccugagcggcgaggaggccgggcacgaccaggagggcgucggggccgcccgcgcgaccuccccgcccggcagcgccgagaucguggccacgcgggugaccgccaagaucgucacccuggugcccgccggcaucaagucccucgggcuggcggugagcuccgucgagaacgaccccgaggagaccacggagaaggccugcgaccgcuucaccuuccugcaccucggcagcggggacaacaugcaggucaugccccagcugggcgagaugcuguucugccucaccagccggugcccggaggaguucgaguccuacggcugcuacugcgggcaggagggccgcggggagccccgggacgaccuggaccgcugcugccugagccaccacugcugccucgagcagguccggcgccugggcugccugcucgagcggcugcccuggucccccguggugugcguggaccacaccccgaagugcgggggccagagccugugcgagaagcuccugugcgccugcgaccagacggccgccgagugcaugaccuccgcgagcuucaaccagucccucaagagccccucccgccugggcugccccgggcagcccgccgccugcgaggacagccugcacccggugcccgccgcccccacccugggcuccagcuccgaggaggacagcgaggaggacccgccccaggaggaccucgggcgggcgaagcgcuuccugcggaagucccugggcccccuggggaucggcccccuccacggccgcuga

SEQ ID NO: 33936 - RNA, 2517 nt, Artificial Sequence
  derived and/or modified sequence opt1 from OCA2__Homo_sapiens__NP_000266
augcaccuggagggccgcgacgggcggcgcuaccccggcgcccccgccguggagcuccugcagaccagcguccccuccgggcuggcggagcucguggccggcaagcggcgccugccccggggcgccgggggcgccgaccccagccacuccugcccgcgcggggccgcgggccagagcuccugggcccccgccgggcaggaguucgccagcuuccugaccaagggccggucccacagcucccucccccagaugagcuccagccgcuccaaggacagcugcuucacggagaacacgccccugcugcggaacucccuccaggagaaggggagccgcugcaucccgguguaccaccccgaguucaucaccgcggaggaguccugggaggacagcuccgccgacugggagcggcgcuaccugcugagccgggaggucagcggccucuccgccagcgccuccagcgagaagggcgaccugcuggacagcccccacauccgccuccggcuguccaagcugcgccggugcgugcaguggcucaaggugauggggcuguucgccuucgucgugcugugcuccauccucuucagccuguaccccgaccagggcaagcuguggcagcuccuggcgcuguccccgcucgagaacuacagcgugaaccuguccagccacgucgacuccacccugcuccagguggaccuggccggggcccugguggccagcggccccucccgccccggccgggaggagcacaucgucguggagcucacccaggccgacgcgcuggggagccgcuggcggcgcccccagcaggucacccacaacuggaccguguaccugaacccgcgccgguccgagcacagcgugaugucccgcaccuucgaggugcucacgcgggagaccgucagcaucagcauccgcgccucccugcagcagacccaggccgugccccugcucauggcccaccaguaccugcggggcagcguggagacccaggucacgaucgccaccgcgauccuggccgggguguacgcccucaucaucuucgagaucgugcaccgcacccuggccgccaugcugggcucccucgcggcccuggccgcccuggcggucaucggggaccggcccagccucacccacguggucgaguggaucgacuucgagacgcuggcccugcuguucggcaugaugauccucguggccaucuucuccgagaccggcuucuucgacuacugcgccgugaaggccuaccgccugagccgggggcgcgucugggcgaugaucaucaugcugugccucaucgccgccgugcuguccgccuuccuggacaacgugaccaccaugcuccuguucacgcccgucaccauccggcugugcgaggugcucaaccuggacccgcgccaggugcugaucgccgaggucaucuucaccaacaucggcggggcggccaccgccaucggcgacccgcccaacgugaucaucgugagcaaccaggagcuccggaagauggggcuggacuucgccggcuucacggcccacauguucaucggcaucugccugguccuccuggugugcuucccccugcuccgccugcuguacuggaaccggaagcucuacaacaaggagcccuccgagaucguggagcugaagcacgagauccacgucuggcgccugaccgcgcagcggaucagccccgccucccgcgaggagaccgccgugcggcgccuccugcuggggaaggugcucgcccuggagcaccuccuggcgcgccggcugcacaccuuccaccgccagaucagccaggaggacaagaacugggagacgaacauccaggagcugcagaagaagcaccggaucuccgacggcauccuccuggccaagugccugaccguccucggguucgugaucuucauguucuuccugaacagcuucgugcccggcauccaccuggaccucggguggaucgccauccugggcgccaucuggcugcucauccuggccgacauccacgacuucgagaucauccugcaccgcgucgagugggcgacccuccuguucuucgccgcccuguucgugcucauggaggcccuggcccaccuccaccugaucgaguacgugggcgagcagaccgcgcugcugaucaagaugguccccgaggagcagcggcucaucgccgccaucgugcugguggucuggguguccgcccuggccagcucccucaucgacaacaucccguucacggcgaccaugauccccgugcugcugaaccucagccacgaccccgaggucgggcugccggccccgccccugauguacgcccucgccuucggcgcgugccucgggggcaacggcacccugaucggggccagcgccaacguggugugcgccggcaucgccgagcagcacggguacggcuucuccuucauggaguucuuccgccugggguuccccaugauggucgugagcugcaccgugggcaugugcuaccugcuggucgcgcacgugguggucggcuggaacuga

SEQ ID NO: 33937 - RNA, 738 nt, Artificial Sequence
  derived and/or modified sequence opt1 from OCIAD1__Homo_sapiens__NP_001073308
augaacggccgcgccgacuuccgggagcccaacgccgaggugccgcgccccaucccccacaucgggcccgacuacaucccgaccgaggaggagcggcgcgucuucgcggagugcaacgacgagagcuucugguuccgguccgugccccuggccgccaccagcaugcucaucacgcagggccugaucuccaaggggauccugagcucccaccccaaguacggcagcauccccaagcucauccuggccugcaucaugggguacuucgccggcaagcuguccuacgugaagaccugccaggagaaguucaagaagcucgagaacagcccgcugggcgaggcgcugcgcuccgggcaggcccggcgcagcuccccgcccggccacuacuaccagaaguccaaguacgacagcagcgucuccgggcagagcuccuucgugaccagccccgccgccgacaacaucgagaugcucccccacuacgagcccauccccuucuccagcagcaugaacgaguccgcgcccaccggcaucacggaccacaucgugcaggggccggaccccaaccuggaggagagccccaagcggaagaacaucaccuacgaggagcugcgcaacaagaaccgggaguccuacgaggucagccucacccagaagaccgaccccuccgugcgcccgaugcacgagcgggugcccaagaaggaggucaaggugaacaaguacggcgacacgugggacgaguga

SEQ ID NO: 33938 - RNA, 465 nt, Artificial Sequence
  derived and/or modified sequence opt1 from OCIAD2__Homo_sapiens__NP_001014446
auggccagcgccuccgcgcgcggcaaccaggacaaggacgcccacuucccgccgcccagcaagcagucccuccuguucugccccaagagcaagcugcacauccaccgggccgagaucuccaagaucaugcgcgagugccaggaggagagcuucuggaagcgggcccugcccuucucccucgugagcaugcuggucacccaggggcugguguaccagggcuaccucgccgcgaacucccgcuucgggagccugcccaagguggcccuggccggccuccugggguucggccugggcaaggucuccuacaucggggugugccagagcaaguuccacuucuucgaggaccagcuccggggcgccggguucggcccccagcacaaccgccacugccugcugaccugcgaggagugcaagaucaagcacgggcucuccgagaagggcgacagccagcccuccgcgagcuga

SEQ ID NO: 33939 - RNA, 135 nt, Artificial Sequence
  derived and/or modified sequence opt1 from OCLM__Homo_sapiens__NP_071770
augggcauguacccgccccugcuccugaagaucuaccugagccgccacaucuccauccucuucuaccugaagauccuguacaagagcgggaucaucuggcucuccugguacagcuucauccugcuggugcucuga

SEQ ID NO: 33940 - RNA, 1569 nt, Artificial Sequence
  derived and/or modified sequence opt1 from OCLN__Homo_sapiens__NP_001192183
augagcucccgcccccuggagagcccgccgcccuaccggcccgacgaguucaagcccaaccacuacgcccccuccaacgacaucuacggcggggagaugcacgugcgccccaugcucagccagcccgccuacuccuucuacccggaggacgagauccugcacuucuacaaguggaccagcccgcccggcgucauccggauccuguccaugcucaucaucgugaugugcaucgcgaucuucgccugcguggccagcacccuggccugggaccgcggguacggcacgucccugcucgggggcagcgucggcuaccccuacgggggcuccggguucggcagcuacggguccggcuacggcuacggguacggcuacggguacggcuacggcggguacaccgacccccgggccgcgaagggcuucaugcuggccauggccgccuucugcuucaucgcggcccuggugaucuucgugaccagcgucauccgcuccgagaugagccggacccgccgguacuaccucuccgugaucaucgugagcgccauccuggggaucauggucuucaucgccacgaucguguacaucaugggcgugaaccccaccgcccaguccagcgggagccuguacggcucccagaucuacgcgcucugcaaccaguucuacacccccgccgccaccggccuguacgucgaccaguaccuguaccacuacugcgugguggacccccaggaggccaucgccaucguccucggguucaugaucaucguggcguucgcccugaucaucuucuucgccgugaagacgcgccggaagauggaccgcuacgacaagagcaacauccugugggacaaggagcacaucuacgacgagcagccgcccaacgucgaggagugggugaagaacguguccgccggcacccaggacguccccagcccgcccuccgacuacguggagcggguggacagccccauggccuacuccagcaacgggaaggucaacgacaagcgcuucuaccccgaguccagcuacaaguccacccccgugccggaggucgugcaggagcucccccugaccagccccguggacgacuuccggcagccccgcuacuccagcggcgggaacuucgagacgccguccaagcgggcgcccgccaagggccgcgccggccggagcaagcgcaccgagcaggaccacuacgagaccgacuacaccaccgggggcgaguccugcgacgagcuggaggaggacuggauccgggaguacccgcccaucacgagcgaccagcagcgccagcucuacaagcgcaacuucgacaccgggcugcaggaguacaagucccugcagagcgagcucgacgagaucaacaaggagcugagccggcuggacaaggagcucgacgacuaccgcgaggaguccgaggaguacauggccgccgcggacgaguacaaccggcugaagcaggucaagggcagcgccgacuacaaguccaagaagaaccacugcaagcagcucaagagcaagcugucccacaucaagaagauggugggggacuacgaccgccagaagaccuga

SEQ ID NO: 33941 - RNA, 330 nt, Artificial Sequence
  derived and/or modified sequence opt1 from OCM2__Homo_sapiens__NP_006179
augagcaucaccgacgugcuguccgccgacgacaucgccgcggcccuccaggagugccaggaccccgacaccuucgagccgcagaaguucuuccagacgagcggccuguccaagaugagcgccucccaggucaaggacguguuccgcuucaucgacaacgaccagagcggguaccuggacgaggaggagcucaaguucuuccugcagaaguucgaguccggcgcccgggagcugaccgagagcgagaccaagucccucauggccgcggccgacaacgacggggacggcaagaucggggccgaggaguuccaggagauggugcacagcuga

SEQ ID NO: 33942 - RNA, 330 nt, Artificial Sequence
  derived and/or modified sequence opt1 from OCM__Homo_sapiens__XP_011513787
augagcaucaccgacgugcuguccgccgacgacaucgccgcggcccuccaggagugccgcgaccccgacaccuucgagccgcagaaguucuuccagacgagcggccuguccaagaugagcgccaaccaggucaaggacguguuccgguucaucgacaacgaccaguccggguaccuggacgaggaggagcucaaguucuuccugcagaaguucgagagcggcgcccgcgagcugaccgaguccgagaccaagagccucauggccgcggccgacaacgacggggacggcaagaucggggccgaggaguuccaggagauggugcacuccuga

SEQ ID NO: 33943 - RNA, 2706 nt, Artificial Sequence
  derived and/or modified sequence opt1 from OCRL__Homo_sapiens__NP_000267
auggagcccccgcugcccgugggcgcccagccccucgccaccgucgaggggauggagaugaagggcccccugcgcgagccgugcgcgcugacccucgcccagcggaacgggcaguacgagcugaucauccagcugcacgagaaggagcagcacgugcaggacaucauccccaucaacagccacuuccgcugcgugcaggaggccgaggagacgcuccugaucgacaucgccuccaacagcggcugcaagauccggguccagggggacuggauccgcgagcggcgcuucgagauccccgacgaggagcacugccugaaguuccucuccgccgugcuggcggcccagaaggcccagagccagcugcucgugcccgagcagaaggacuccagcuccugguaccagaagcuggacaccaaggacaagccgagcgucuucuccggccugcucggcuucgaggacaacuucagcuccaugaaccuggacaagaagaucaacagccagaaccagcccaccgggauccaccgggagcccccgcccccgcccuucuccgugaacaagaugcugccccgcgagaaggaggccagcaacaaggagcagcccaaggugaccaacacgaugcggaagcuguucguccccaacacccaguccggccagcgcgaggggcucaucaagcacauccuggcgaagcgggagaaggaguacgugaacauccagaccuuccgcuucuucgugggcaccuggaacgucaacgggcagagccccgacuccggccucgagcccuggcugaacugcgacccgaacccgcccgacaucuacugcaucggcuuccaggagcuggaccucagcacggaggccuucuucuacuucgaguccgugaaggagcaggaguggagcauggccguggagcgggggcugcacagcaaggccaaguacaagaagguccagcuggugcgccucgugggcaugaugcugcugaucuucgcccggaaggaccagugccgcuacauccgggacaucgcgaccgagaccgucgggaccggcaucaugggcaagauggggaacaagggcgggguggccgugcgcuucgucuuccacaacacgaccuucugcaucgugaacucccaccucgccgcccacguggaggacuucgagcggcgcaaccaggacuacaaggacaucugcgcccggaugagcuucgucgugcccaaccagacccugccccagcugaacaucaugaagcacgaggucgugaucuggcucggcgaccugaacuaccgccugugcaugcccgacgcgaacgaggugaagucccucaucaacaagaaggaccugcagcgccugcucaaguucgaccagcugaacauccagcggacccagaagaaggccuucgucgacuucaacgagggggagaucaaguucauccccacguacaaguacgacagcaagaccgaccgcugggacuccagcggcaagugccgggugcccgccuggugcgaccgcauccuguggcggggcaccaacgugaaccagcucaacuaccgcucccacauggagcugaagaccagcgaccacaagccggucuccgcccuguuccacaucggggugaagguggucgacgagcggcgcuaccggaagguguucgaggacagcgugcgcaucauggaccggauggagaacgacuuccuccccucccuggagcugagccgccgggaguucgucuucgagaacgugaaguuccgccagcuccagaaggagaaguuccagaucuccaacaacggccaggugcccugccacuucagcuucaucccgaagcugaacgacucccaguacugcaagcccuggcugcgggccgagcccuucgagggguaccuggagcccaacgagacggucgacaucagccucgacguguacguguccaaggacagcgucaccauccugaacuccggcgaggacaagaucgaggacauccuggugcuccaccuggaccgcgggaaggacuacuuccugaccaucagcggcaacuaccucccgagcugcuucggcaccucccuggaggcgcugugccggaugaagcgccccauccgggaggugcccgucacgaagcucaucgaccuggaggaggacagcuuccuggagaaggagaagucccuccugcagauggugccccuggacgagggggccagcgagcgcccgcuccaggugcccaaggagaucuggcugcuggucgaccaccucuucaaguacgccugccaccaggaggaccuguuccagacccccggcaugcaggaggagcugcagcagaucaucgacugccucgacaccuccauccccgagaccaucccggggagcaaccacuccguggccgaggcccugcugaucuuccucgaggcgcugcccgagcccgugaucugcuacgagcuguaccagcgcugccucgacagcgccuacgacccccggaucugccgccaggucaucucccagcugccgcggugccaccgcaacguguuccgguaccugauggccuuccuccgcgagcugcugaaguucagcgaguacaacuccgugaacgccaacaugaucgcgacccucuucacgagccugcugcuccggcccccgcccaaccugauggcccgccagacccccuccgaccggcagcgcgccauccaguuccugcucggcuuccugcuggggagcgaggaggacuga

SEQ ID NO: 33944 - RNA, 840 nt, Artificial Sequence
  derived and/or modified sequence opt1 from ODAM__Homo_sapiens__NP_060325
augaagaucaucauccugcucggcuuccugggggccacccugagcgcgccccucaucccgcagcgccugauguccgccagcaacuccaacgagcugcuccugaaccugaacaacggccagcuccugccccugcagcuccaggggccccugaacagcuggaucccgcccuucuccggcauccugcagcagcagcagcaggcccagauccccgggcucagccaguucucccugagcgcccuggaccaguucgccggccuccugcccaaccagaucccccugaccggcgaggccuccuucgcgcagggggcccaggccggccagguggacccgcuccagcugcagacgccgccccagacccagcccgggcccagccacgucaugcccuacguguucuccuucaagaugccccaggagcagggccagauguuccaguacuaccccguguacaugguccugccgugggagcagccccagcagaccgugccccggagcccccagcagacccgccagcagcaguacgaggagcagaucccguucuacgcccaguucggguacaucccccagcucgcggagcccgccaucuccggcggccagcagcagcuggccuucgacccccagcuggggacggccccggagaucgccgugaugagcaccggcgaggagauccccuaccuccagaaggaggcgaucaacuuccggcacgacuccgccggggucuucaugcccagcaccucccccaagccgagcaccacgaacguguucaccuccgccguggaccagaccaucacccccgagcugcccgaggagaaggacaagacggacagccugcgcgagccguga

SEQ ID NO: 33945 - RNA, 999 nt, Artificial Sequence
  derived and/or modified sequence opt1 from ODC1__Homo_sapiens__NP_001274117
augaugaccuucgacagcgagguggagcugaugaaggucgcccgcgcccaccccaaggcgaagcucgugcugcggaucgccaccgacgacuccaaggccgugugccgccugagcgucaaguucggcgccacgcuccggaccucccgccugcugcucgagcgggccaaggagcugaacaucgacguggugggggucagcuuccacgugggcuccgggugcaccgaccccgagaccuucgugcaggcgaucagcgacgcccgcugcgucuucgacaugggcgccgaggugggguucuccauguaccugcucgacaucggcggcggguuccccggcagcgaggacgugaagcugaaguucgaggagaucacgggggucaucaaccccgcccuggacaaguacuuccccuccgacagcggcgugcggaucaucgcggagccggggcgcuacuacguggccuccgccuucacccucgccgucaacaucaucgccaagaagaucgugcugaaggagcagaccggcagcgacgacgaggacgaguccagcgagcagaccuucauguacuacgugaacgacggcgucuacggguccuucaacugcauccuguacgaccacgcgcacgugaagccccuccugcagaagcggcccaagcccgacgagaaguacuacagcuccagcaucuggggcccgacgugcgacgggcuggaccgcaucguggagcggugcgaccuccccgagaugcacgucggcgacuggaugcuguucgagaacaugggcgccuacaccguggccgccgccuccaccuucaacggguuccagcgccccaccaucuacuacgugaugagcggccccgcguggcagcugaugcagcaguuccagaacccggacuucccgcccgaggucgaggagcaggacgccagcacgcuccccguguccugcgccugggagagcgggaugaagcggcaccgcgccgccugcgcguccgccagcaucaacgucuga

SEQ ID NO: 33946 - RNA, 753 nt, Artificial Sequence
  derived and/or modified sequence opt1 from ODF1__Homo_sapiens__NP_077721
auggccgcccugagcugccuccuggacuccgugcgccgggacaucaagaaggucgaccgcgagcugcggcagcuccgcugcaucgacgaguucagcacccggugccugugcgaccuguacaugcaccccuacugcugcugcgaccuccacccguaccccuacugccugugcuacuccaagcgcagccgguccugcggccugugcgaccucuaccccugcugccugugcgacuacaagcuguacugccuccgccccagccugcggucccuggagcgcaaggcgauccgggccaucgaggacgagaagcgcgagcucgccaagcugcggcgcaccacgaaccggauccuggccagcuccugcugcagcuccaacauccucgggagcgugaacgugugcggcuucgagccggaccaggucaaggugcgcgugaaggacgggaaggucugcguguccgccgagcgggagaaccgcuacgacugccugggcagcaagaaguacuccuacaugaacaucugcaaggaguucagccugccgcccugcguggacgagaaggacgucaccuacuccuacgggcucggcagcugcgugaagaucgagucccccugcuaccccugcaccagccccugcagccccugcucccccugcagcccgugcaaccccugcucccccugcaaccccugcagcccguacgaccccugcaaccccugcuaccccugcggcucccgguucagcugccgcaagaugauccuguga

SEQ ID NO: 33947 - RNA, 762 nt, Artificial Sequence
  derived and/or modified sequence opt1 from ODF3B__Homo_sapiens__NP_001014440
augggcagcgacgccuggguggggcuguggcgcccccaccggccgcgcggccccaucgccgcgcacuacgggggccccgggcccaaguacaagcucccgcccaacaccggcuacgcccugcacgaccccucccggccccgcgccccggccuucaccuucggcgcccgguuccccacgcagcagacgaccugcgggcccggccccgggcaccuggucccggcgcgcaugaccgugcggggcaccgacggggcccccgccuacagcaucuacggccgcccccggcgcuccgcccccuuccucaccccgggccccgggcgguacuuccccgagcgcgcgggcaacgccaccuaccccagcgccccgcggcacaccaucgcgccccgcaacuggggcgugcaggccgagcagcagucccccgggcccgccgccuacacggucccgagccugcugggcccccgggugaucgggaagguguccgccccgaccugcagcaucuacggccgccgggccgccggguccuucuucgaggaccucagcaagacccccggccccugcgcguaccaggucgugucccccgggguguacaagagccgcgcgccccaguucaccauccuggcccggacgucccugccgcaggacaacacccgcaagcccggccccgccgccuacaacgucgaccagcaccggaagccccgcggcuggagcuucgggauccgccacuccgacuaccucgccccgcuggugaccgacgccgacaacuga

SEQ ID NO: 33948 - RNA, 774 nt, Artificial Sequence
  derived and/or modified sequence opt1 from ODF4__Homo_sapiens__NP_694552
auggacgccgaguacuccggcaacgaguucccccgcuccgagggggagcgggaccagcaccagcgcccgggcaaggagcggaaguccggggaggccggcugggggaccggcgagcugggccaggacgggcgccuccuguccagcacccugucccucagcuccaaccggagccugggccagcgccagaacagcccccugcccuuccaguggcggaucacgcacagcuuccgcuggauggcccaggugcucgcguccgagcugagccuggucgccuucauccuccugcuggugguggccuucuccaagaaguggcucgaccugagccggucccuguucuaccagcgcuggcccgucgacgugagcaaccggauccacaccuccgcccacgugaugagcauggggcuccugcacuucuacaagucccgcagcugcagcgaccuggagaacggcaaggucaccuucaucuucuccacccucaugcuguucccgaucaacaucuggaucuucgagcuggagcggaacgugagcauccccaucgggugguccuacuucaucggcuggcucgugcugauccuguacuucacgugcgcgauccucugcuacuucaaccacaagagcuucuggucccugauccugagccaccccuccggcgccgucagcugcuccagcuccuucgggagcguggaggagagcccccgcgcccagaccaucaccgacaccccgaucacgcaggagggcgugcucgaccccgagcagaaggacacccacgucuga

SEQ ID NO: 33949 - RNA, 855 nt, Artificial Sequence
  derived and/or modified sequence opt1 from OFCC1__Homo_sapiens__XP_011513347
auggccaagggcgagaaggccgagagcgggguggacaacaccgcgggccuguccgagaaggagacccagaagaacccccgcgccccgauggacgaggccgacgucaagagcgccgcccacuccagccagggguccauccccaagaagaucggccccugcagcauggacuacgaccccaaccuccuggaggaggacgacgagcugcacucccagggggacagccucacggaccacuccgugaagggcaagagcaccguguggcggaucggcgaggcggaggacuacucccaggacaucagcuaccuggaggagcuggaggagcaccgcuucuccgucugcugcagcuccguggccgacagccgguacggggacuucuucaagcaccuccacuucgugcuggucuccgccagcuccgagcugcagcucagccaguggcagagccagggcuucugguacaucauccugcugauguucuuccucugguuccugcgccuguaccuccacuaccuggggcaguggcuguuccuccaggccaucuccaccccggugaccaaguuccacuucagccugcacaucguggagcugugcuaccccacguccagccuccacaucggcgaggagcugcccgucguggugauggggccccugaugcucaacgcgauccugcugcuccugguccugauccgguggggcugccagcuccuguucgccuccugcccggacgugcugagcaagcucaucaucaccaugggccuguggaccauccuggacccccucgccguguucauccuggacacccugcucggggacaacaaggucacgguggccucccgcaucgacgagcaggagauguga

SEQ ID NO: 33950 - RNA, 3039 nt, Artificial Sequence
  derived and/or modified sequence opt1 from OFD1__Homo_sapiens__NP_003602
augauggcccagagcaacauguucaccguggccgacguccugucccaggacgagcuccgcaagaagcuguaccagaccuucaaggaccggggcauccuggacacgcucaagacccagcugcgcaaccagcugauccacgagcucaugcaccccgugcugagcggggagcugcagccgcgguccaucagcguggagggcuccagccuccugaucggggcguccaacagccuggucgccgaccaccuccagcgcugcggcuacgaguacucccugagcguguucuuccccgaguccgggcuggccaaggagaagguguucaccaugcaggaccuccugcagcugaucaagaucaaccccaccagcucccucuacaagagccuggucuccggcagcgacaaggagaaccagaagggcuuccugaugcacuuccucaaggagcuggccgaguaccaccaggccaaggaguccugcaacauggagacgcagaccagcuccaccuucaaccgggacagccuggcggagaagcuccagcugaucgacgaccaguucgccgacgccuacccccagcgcaucaaguucgagagccuggagaucaagcucaacgaguacaagcgggagaucgaggagcagcugcgcgccgagaugugccagaagcugaaguucuucaaggacaccgagaucgcgaagaucaagauggaggccaagaagaaguacgagaaggagcucacgauguuccagaacgacuucgagaaggccugccaggccaaguccgaggcccuggugcugcgggagaaguccacccucgagcgcauccacaagcaccaggagaucgagaccaaggagaucuacgcgcagcggcagcugcugcucaaggacauggaccugcugcgcgggcgggaggccgagcucaagcagcgcguggaggccuucgagcugaaccagaagcugcaggaggagaagcacaagagcaucaccgaggcccuccggcgccaggagcagaacaucaagagcuucgaggagacguacgaccggaagcugaagaacgagcugcucaaguaccagcuggagcugaaggacgacuacaucauccgcaccaaccggcucaucgaggacgagcgcaagaacaaggagaaggccguccaccuccaggaggagcugaucgcgaucaacuccaagaaggaggagcugaaccagagcgugaaccgggugaaggagcuggagcuggagcuggaguccgucaaggcccagagccucgccaucaccaagcagaaccacaugcugaacgagaaggugaaggagauguccgacuacagccugcucaaggaggagaagcuggagcugcucgcccagaacaagcugcugaagcagcagcucgaggagucccgcaacgagaaccugcgccugcucaaccggcuggcccagccggcgcccgagcuggccguguuccagaaggagcuccgcaaggccgagaaggccaucgucguggagcacgaggaguucgagagcugccggcaggcccugcacaagcagcugcaggacgagaucgagcacuccgcgcagcucaaggcccagauccugggcuacaaggccagcgugaagucccugaccacgcaggucgccgaccucaagcugcagcugaagcagacccagaccgcgcucgagaacgagguguacugcaaccccaagcagagcgugaucgaccgcuccgucaacgggcugaucaacggcaacguggugcccugcaacggggagaucagcggcgacuuccugaacaacccguucaagcaggagaacguccucgcccggaugguggccucccgcaucaccaacuaccccacggccugggucgagggcagcagccccgacuccgaccuggaguucguggccaacaccaaggcgcgggugaaggagcugcagcaggaggccgagcgccucgagaaggccuuccggagcuaccaccgccgggucaucaagaacuccgccaagagcccccuggccgcgaaguccccgcccagccugcaccuccuggaggccuucaagaacaucaccuccagcucccccgagcgccacaucuucggggaggaccggguggugagcgagcagccccaggucggcacccuggaggagcgcaacgacgugguggaggcccucacgggguccgccgccagccggcugcgcggcggcaccuccagccggcgccuguccagcaccccgcuccccaaggcgaagcggucccuggagagcgagauguaccuggaggggcucggccgcagccacaucgccucccccagccccugcccggaccgcaugccccugcccucccccaccgagagccggcacucccugagcaucccgcccgucuccagcccgcccgagcagaagguggggcucuaccgccggcagacggagcugcaggacaaguccgaguucagcgacguggacaagcuggccuucaaggacaacgaggaguucgaguccagcuucgaguccgccggcaacaugccccgccagcucgagaugggcgggcugagccccgcgggcgacaugucccacgucgacgccgccgccgccgcggugccccugagcuaccagcacccguccguggaccagaagcagaucgaggagcagaaggaggaggagaagauccgggagcagcaggucaaggagcgccggcagcgcgaggagcggcgccagagcaaccuccaggaggugcuggagcgggagcgccgggagcuggagaagcucuaccaggagcgcaagaugaucgaggagucccugaagaucaagaucaagaaggagcuggagauggagaacgagcucgagaugagcaaccaggagaucaaggacaagagcgcccacuccgagaacccccuggagaaguacaugaagaucauccagcaggagcaggaccaggagagcgccgacaaguccagcaagaagauggugcaggaggggucccuggucgacacccuccagagcuccgacaagguggagagccugaccggcuucucccacgaggagcuggacgacagcugguga

SEQ ID NO: 33951 - RNA, 1284 nt, Artificial Sequence
  derived and/or modified sequence opt1 from OGDH__Homo_sapiens__NP_001003941
auguuccaccuccggaccugcgccgccaagcugcgcccccugaccgcgagccagacggugaagaccuucucccagaaccgcccggccgccgcccggaccuuccagcagauccgcugcuacagcgcccccgucgcggccgagcccuuccuguccggcaccagcuccaacuacguggaggagauguacugcgccuggcucgagaaccccaagagcgugcacaaguccugggacaucuucuuccggaacacgaacgccggggcgccgcccggcaccgccuaccagagcccccugccccugucccgcgggagccucgccgccgucgcccacgcgcagucccugguggaggcccagccgaacguggacaagcuggucgaggaccaccucgccgugcagagccugauccgggccuaccagauccgcggccaccacguggcccagcuggacccccucgggauccuggacgcggaccuggacuccagcguccccgccgacaucaucuccagcaccgacaagcucggcuucuacggccuggacgaguccgaccuggacaagguguuccaccuccccaccacgaccuucaucgggggccaggagagcgcccugccgcugcgggagaucauccgccggcucgagauggccuacugccagcacaucgggguggaguucauguucaucaacgaccuggagcagugccaguggauccgccagaaguucgagacccccggcaucaugcaguucaccaacgaggagaagcggacgcugcucgcccgccugguccgguccacccgcuucgaggaguuccugcagcggaaguggagcagcgagaagcgcuucgggcucgagggcugcgaggugcugauccccgcgcugaagaccaucaucgacaaguccagcgagaacggcguggacuacgucaucauggggaugccccaccggggccgccucaacgugcuggccaacgugauccggaaggagcuggagcagaucuucugccaguucgacuccaagcucgaggccgccgacgaggggagcggcgacgucaaguaccaccugggcauguaccaccgccgcaucaaccgggugaccgaccgcaacaucacgcugucccucguggccaacccgagccaccuggaggcggccgaccccgucgugauggggaagaccaaggccgagcaguucuacugcggcgacaccgaggggaagaaggugcggccccgcgagcggcgcgcccggcagaucgucaaggcgcccugcuccagcauggaguuccgcuccccgaccuga

SEQ ID NO: 33952 - RNA, 2862 nt, Artificial Sequence
  derived and/or modified sequence opt1 from OGDHL__Homo_sapiens__NP_001137468
augagccagcugcgccuccugcccucccggcugggcgugcaggccgcccgccuccuggcggcccacgacgucccgguguucggguggcggagccgcuccagcgggccgcccgccaccuuccccuccagcaagggcggcgggggcuccagcuacauggaggagauguacuucgccuggcuggagaacccccaguccgugcacaagauccggggccaccacgucgcccagcucgacccccuggggauccuggacgcggaccucgacagcuucgugcccuccgaccugaucaccacgaucgacaagcuggccuucuacgaccuccaggaggccgaccuggacaaggaguuccagcugcccaccaccaccuucaucggcgggagcgagaacacgcucucccugcgcgagaucauccggcgccuggagaacaccuacugccagcacaucggccucgaguucauguucaucaacgacguggagcagugccaguggauccggcagaaguucgagaccccgggggucaugcaguucagcuccgaggagaagcgcacccugcuggcccggcucgugcgcagcaugcgguucgaggacuuccuggcgcgcaagugguccagcgagaagcgguucggccuggagggcugcgaggugaugauccccgcccucaagacgaucaucgacaaguccagcgagauggggaucgagaacgucauccugggcaugccccaccgcgggcggcugaacgugcucgccaacgugauccgcaaggaccuggagcagaucuucugccaguucgaccccaagcuggaggccgccgacgagggcagcggcgacgucaaguaccaccucgggauguaccacgagcggaucaaccgcgugaccaaccggaacaucacccugucccugguggcgaacccgagccaccucgaggccgucgaccccguggugcagggcaagaccaaggccgagcaguucuaccgcggggacgcccagggcaagaaggucauguccauccuggugcacggggacgccgcguucgccggccagggcguggucuacgagacguuccaccugagcgaccuccccuccuacaccaccaacgggaccgugcacguggucgugaacaaccagaucggcuucacgaccgacccccgcauggcccggagcuccccguaccccaccgacgucgcccgcguggugaacgcccccaucuuccacgucaacgcggacgaccccgaggccgugaucuacgugugcagcgucgccgccgaguggcggaacaccuucaacaaggacgugguggucgaccuggugugcuaccgccggcgcgggcacaacgagauggacgagccgauguucacgcagccccugauguacaagcagauccaccgccaggugcccguccucaagaaguacgccgacaagcugaucgcggagggcaccgugacccugcaggaguucgaggaggagaucgccaaguacgaccgcaucugcgaggaggccuacgggcgguccaaggacaagaagauccuccacaucaagcacuggcuggacagccccuggccgggcuucuucaacguggacggcgagcccaaguccaugaccugccccgccacggggauccccgaggacaugcugacccacaucggcagcgucgcguccagcgugccgcucgaggacuucaagauccacaccgggcugucccgcauccugcggggccgcgccgacaugaccaagaaccggacgguggacugggcccucgccgaguacauggccuucgggagccugcugaaggagggcauccacguccgccuguccggccaggacguggagcgggggaccuucagccaccgccaccacgugcuccacgaccaggaggucgaccggcggaccugcgugcccaugaaccaccuguggcccgaccaggcgccguacaccgugugcaacuccagccugagcgaguacggcguccucggguucgagcugggcuacgccauggccucccccaacgcccuggugcucugggaggcccaguucggcgacuuccacaacacggcgcagugcaucaucgaccaguucaucagcaccgggcaggccaagugggugcggcacaacggcaucguccugcugcucccccacgggauggagggcauggggcccgagcacuccagcgcccgcccggagcgcuuccugcagauguccaacgacgacagcgacgccuaccccgccuucaccaaggacuucgaggugucccagcuguacgacugcaacuggaucguggucaacugcagcacccccgcgaacuacuuccacgugcuccggcgccagauccugcugcccuuccggaagccgcucaucaucuucacgcccaagucccugcugcgccaccccgaggccaagagcuccuucgaccagauggugagcggcaccuccuuccagcgggucauccccgaggacggcgccgccgcgcgcgccccggagcagguccagcggcucaucuucugcaccgggaagguguacuacgaccuggugaaggagcgcagcucccaggaccuggaggagaagguggccaucacccggcucgagcagaucagccccuuccccuucgaccugaucaagcaggaggccgagaaguaccccggcgccgagcuggcguggugccaggaggagcacaagaacaugggguacuacgacuacaucuccccgcgcuucaugaccauccuccggcgcgcccggcccaucugguacgugggccgcgaccccgccgccgcccccgcgacggggaaccggaacacccaccuggucagccugaagaaguuccucgacaccgccuucaaccugcaggccuucgagggcaagaccuucuga

SEQ ID NO: 33953 - RNA, 1629 nt, Artificial Sequence
  derived and/or modified sequence opt1 from OGFOD1__Homo_sapiens__NP_060703
augaacggcaagcgccccgccgagccggggcccgcccgggugggcaagaaggggaagaaggaggucauggcggaguucagcgacgccgugaccgaggagacccugaagaagcaggucgccgaggccuggucccgccggacgcccuucagccacgaggugaucgugauggacauggaccccuuccuccacugcgugaucccgaacuucauccagucccaggacuuccuggagggccugcagaaggagcucaugaaccuggacuuccacgagaaguacaacgaccuguacaaguuccagcagagcgacgaccucaagaagcgccgggagccccacaucuccacccugcgcaagauccuguucgaggacuuccggagcuggcucuccgacaucagcaagaucgaccuggaguccaccaucgacaugagcugcgccaaguacgaguucaccgacgcgcugcucugccacgacgacgagcuggaggggcgccggaucgccuucauccuguaccucgucccgcccugggaccgcuccaugggcggcacgcuggaccuguacagcaucgacgagcacuuccagcccaagcagaucgugaagucccucauccccagcuggaacaagcugguguucuucgaggucucccccgugagcuuccaccagguguccgagguccugagcgaggagaagucccggcucagcaucagcgggugguuccacggccccucccugacccgcccgcccaacuacuucgagccgcccaucccccggagcccccacaucccccaggaccacgagauccuguacgacuggaucaaccccaccuaccucgacauggacuaccaggugcagauccaggaggaguucgaggaguccagcgagauccugcugaaggaguuccucaagccggagaaguucaccaaggugugcgaggcccuggagcacgggcacgucgagugguccagccgcggcccgcccaacaagcgguucuacgagaaggccgaggaguccaagcugcccgagauccucaaggagugcaugaagcuguuccgcagcgaggcgcuguuccuccugcuguccaacuucacggggcucaagcugcacuuccuggcccccagcgaggaggacgagaugaacgacaagaaggaggccgagaccaccgacaucaccgaggagggcacgucccacagcccgcccgagcccgagaacaaccagauggccaucuccaacaacagccagcaguccaacgagcagaccgaccccgagcccgaggagaacgagaccaagaaggagagcuccgugcccaugugccagggcgagcuccggcacuggaagaccgggcacuacacgcugauccacgaccacagcaaggccgaguucgcgcuggaccucauccuguacugcggcugcgaggggugggagccggaguacggcggcuucaccuccuacaucgccaagggggaggacgaggagcugcucaccgugaaccccgagagcaacagccuggcccuggucuaccgcgaccgggagacccucaaguucgugaagcacaucaaccaccgcucccuggagcagaagaagacguuccccaaccggaccggcuucugggacuucagcuucaucuacuacgaguga

SEQ ID NO: 33954 - RNA, 2034 nt, Artificial Sequence
  derived and/or modified sequence opt1 from OGFR__Homo_sapiens__NP_031372
auggacgaccccgacugcgacagcaccugggaggaggacgaggaggacgccgaggacgccgaggacgaggacugcgaggacggcgaggcggccggggcccgcgacgccgacgccggcgacgaggacgaggaguccgaggagccgcgggcggcccgccccagcuccuuccagagccggaugaccgggucccgcaacuggcgggccacgcgcgacaugugccgguaccgccacaacuaccccgaccugguggagcgggacugcaacggcgacacccccaaccucagcuucuaccgcaacgagauccgguuccugccgaacgggugcuucaucgaggacauccugcagaacuggaccgacaacuacgaccuccuggaggacaaccacuccuacauccaguggcuguucccccuccgcgagcccggcgucaacuggcacgccaagccccugacccugcgggagguggagguguucaagagcucccaggagauccaggagcgccucguccgggcguacgagcugaugcugggcuucuacgggauccgccucgaggaccggggcacggggaccgugggccgcgcccagaacuaccagaagcgguuccagaaccugaacuggcgcagccacaacaaccugcggaucacccgcauccucaagucccugggggagcugggccucgagcacuuccaggccccgcuggugcgcuucuuccuggaggagacccucguccggcgcgagcugcccggcgugcggcagagcgcccuggacuacuucauguucgccgugcgcugccggcaccagcgccggcagcucguccacuucgcgugggagcacuuccgcccccggugcaaguucgugugggggccccaggacaagcugcgccgguucaagccguccagccugccccacccccucgagggcucccgcaagguggaggaggaggggagccccggcgacccggaccacgaggccuccacgcagggccggaccugcgggcccgagcacagcaagggcgggggccgcgucgacgaggggccccagccccgguccguggagccgcaggacgccggcccccuggagcgcagccagggcgacgaggccgggggccacggggaggaccggcccgagccccugagcccgaaggaguccaagaagcgcaagcucgagcugagccggcgcgagcagccgcccaccgagcccggcccccaguccgccagcgagguggagaagaucgcgcugaaccucgaggggugcgcccugucccagggcagccugcgcaccggcacgcaggaggucgggggccaggaccccggggaggccgugcagcccugccggcagccgcucggcgcccgcguggccgacaagguccggaagcgccggaagguggacgagggggcgggcgacuccgccgccguggccagcggcggggcccagacccuggcgcuggccggcucccccgcccccagcgggcaccccaaggccggccacuccgagaacggcgucgaggaggacaccgaggggcgcaccggcccgaaggaggggacgcccggcagccccuccgagacccccgggccgagccccgcgggccccgccggcgacgagcccgccgaguccccgagcgagacccccgggccccggcccgccggcccggccggggacgagcccgcggagucccccagcgagacccccggcccgcgccccgccgggcccgccggcgacgagcccgccgaguccccgagcgagacgcccggccccagcccggccgggcccacccgggacgagcccgcggagucccccagcgagaccccgggcccccgccccgccgggcccgccggcgacgagccggccgagucccccagcgagacccccgggccccggccggccggccccgcgggcgacgagcccgccgagucccccagcgagacgccggggcccucccccgccggccccacccgcgacgagccggccaaggcgggggaggccgccgagcuccaggacgccgagguggagagcuccgccaagagcggcaagcccuga

SEQ ID NO: 33955 - RNA, 1038 nt, Artificial Sequence
  derived and/or modified sequence opt1 from OGG1__Homo_sapiens__NP_002533
augcccgcccgcgcccugcucccgcggcgcaugggccaccggacccuggcgagcacccccgcccugugggccuccauccccugcccccgcagcgagcuccggcuggaccuggugcucccguccgggcagagcuuccgcuggcgggagcagucccccgcccacuggagcggcguccuggccgaccagguguggacgcugacccagaccgaggagcagcuccacugcaccguguaccgcggggacaagucccaggcgagccggcccacgcccgacgagcuggaggccguccgcaaguacuuccagcuggacgugacccucgcccagcuguaccaccacuggggcuccguggacagccacuuccaggaggucgcccagaaguuccagggggugcggcugcuccgccaggacccgaucgagugccuguucuccuucaucugcagcuccaacaacaacaucgcgcggaucaccggcaugguggagcgccugugccaggccuucggcccccggcucauccagcuggacgacgucaccuaccacggguuccccagccugcaggcccucgccggccccgagguggaggcccaccuccgcaagcuggggcugggcuaccgggcgcgcuacguguccgccagcgcccgggccauccuggaggagcagggcgggcuggccuggcuccagcagcugcgcgaguccagcuacgaggaggcgcacaaggcccugugcauccucccgggcgucgggacgaagguggccgacugcaucugccugauggcccuggacaagccccaggccgugcccgucgacgugcacauguggcacaucgcgcagcgggacuacuccuggcaccccaccaccagccaggccaagggcccgagcccccagaccaacaaggagcucgggaacuucuuccgcucccuguggggccccuacgccggcugggcccaggccgugcuguucagcgcggaccuccgccagucccggcacgcccaggagcccccggccaagcgccggaaggggagcaagggccccgagggguga

SEQ ID NO: 33956 - RNA, 897 nt, Artificial Sequence
  derived and/or modified sequence opt1 from OGN__Homo_sapiens__NP_054776
augaagacccugcagagcacccuccugcugcuccugcuggugccccucaucaagccggccccgcccacgcagcaggacucccgcaucaucuacgacuacggcaccgacaacuucgaggagagcaucuucucccaggacuacgaggacaaguaccuggacgggaagaacaucaaggagaaggagaccgucaucauccccaacgagaagucccugcagcuccagaaggacgaggccaucacgccccugccgcccaagaaggagaacgacgagaugcccacgugccugcucugcgugugccugagcggcagcguguacugcgaggaggucgacaucgacgcggugccgccccugcccaaggaguccgccuaccucuacgcccgguucaacaagaucaagaagcugaccgccaaggacuucgccgacauccccaaccugcgccggcucgacuucaccgggaaccugaucgaggacaucgaggacggcaccuucagcaagcugucccuccuggaggagcugagccucgcggagaaccagcugcugaagcuccccgugcugccgcccaagcugacccucuucaacgccaaguacaacaagaucaagucccgcgggaucaaggccaacgccuucaagaagcugaacaaccugaccuuccucuaccuggaccacaacgcgcuggagagcgucccccucaaccugcccgagucccugcgggugauccaccuccaguucaacaacaucgccagcaucaccgacgacaccuucugcaaggccaacgacacguccuacauccgcgaccggaucgaggagauccgccuggagggcaaccccaucgugcugggcaagcaccccaacagcuucaucugccucaagcggcugcccaucggguccuacuucuga

SEQ ID NO: 33957 - RNA, 3141 nt, Artificial Sequence
  derived and/or modified sequence opt1 from OGT__Homo_sapiens__NP_858058
auggccagcuccgugggcaacgucgccgacagcaccgagcccaccaagcgcaugcuguccuuccaggggcucgcggagcuggcccaccgggaguaccaggccggcgacuucgaggccgccgagcgccacugcaugcagcuguggcggcaggagccggacaacacgggggugcuccugcugcucagcuccauccacuuccagugccgccggcuggaccgcagcgcgcacuucuccacccuggccaucaagcagaacccccuccuggccgaggccuacagcaaccugggcaacguguacaaggagcgggggcagcuccaggaggcgaucgagcacuaccgccacgcccugcggcugaagcccgacuucaucgacggcuacaucaaccucgccgccgcccuggucgcggccggcgacauggagggggccgugcaggccuacguguccgcccugcaguacaaccccgaccucuacugcguccgcagcgaccugggcaaccugcucaaggcgcuggggcggcuggaggaggccaaggccugcuaccucaaggccaucgagacccagccgaacuucgccguggcgugguccaaccugggcugcguguucaacgcccagggggagaucuggcuggccauccaccacuucgagaaggccgucacccucgaccccaacuuccuggacgccuacaucaaccugggcaacgugcucaaggaggcgcgcaucuucgaccgggccguggccgccuaccugcgcgcgcugagccucucccccaaccacgccgucgugcacggcaaccuggccugcguguacuacgagcaggggcugaucgaccucgccaucgacacguaccggcgcgccaucgagcugcagccccacuucccggacgcguacugcaaccuggccaacgcccucaaggagaagggcagcgucgccgaggccgaggacugcuacaacaccgcgcugcggcugugccccacccacgccgacucccucaacaaccuggccaacaucaagcgcgagcaggggaacaucgaggaggccgugcggcuguaccgcaaggcccucgagguguuccccgaguucgcggccgcccacagcaaccuggccuccguccugcagcagcagggcaagcuccaggaggcgcugaugcacuacaaggaggccauccggaucagccccaccuucgccgacgccuacuccaacaugggcaacacgcugaaggagaugcaggacgugcagggggcccugcagugcuacacccgcgcgauccagaucaacccggccuucgccgacgcccacagcaaccucgccagcauccacaaggacuccggcaacauccccgaggcgaucgccagcuaccgcaccgcccugaagcugaagcccgacuuccccgacgccuacugcaaccucgcccacugccugcagaucgugugcgacuggaccgacuacgacgagcggaugaagaagcuggucuccaucguggcggaccagcucgagaagaaccgccugccgagcgugcacccccaccacuccaugcuguacccccucagccacggguuccggaaggccaucgccgagcgccacggcaaccugugccuggacaagaucaacguccuccacaagcccccguacgagcaccccaaggaccugaagcuguccgacgggcggcuccgcgugggcuacgucagcuccgacuucggcaaccaccccacgagccaccugaugcaguccauccccgggaugcacaacccggacaaguucgagguguucugcuacgcccugagccccgacgacggcaccaacuuccgggugaaggucauggcggaggccaaccacuucaucgaccucucccagauccccugcaacgggaaggccgccgaccgcauccaccaggacggcauccacauccuggugaacaugaacggguacaccaagggcgcccggaacgagcuguucgcgcuccgccccgccccgauccaggccauguggcugggcuaccccgggaccagcggcgcccuguucauggacuacaucaucacggaccaggagaccucccccgccgagguggcggagcaguacagcgagaagcucgccuacaugccgcacaccuucuucaucggggaccacgccaacauguucccccaccugaagaagaaggccgucaucgacuucaaguccaacggccacaucuacgacaaccggaucgugcugaacgggaucgaccucaaggccuuccuggacagccugcccgacgugaagaucgucaagaugaagugccccgacggcggcgacaacgcggacuccagcaacaccgcccucaacaugccggugauccccaugaacacgaucgccgaggccgugaucgagaugaucaaccgcgggcagauccagaucaccaucaacggcuucagcaucuccaacgggcuggccaccacccagaucaacaacaaggcggccacgggcgaggaggucccccggaccaucaucgugaccacccgcagccaguacggccugcccgaggacgccaucguguacugcaacuucaaccagcucuacaagaucgacccguccacgcugcagaugugggccaacauccugaagcggguccccaacagcgugcucuggcugcugcgcuuccccgcggugggggagcccaacauccagcaguacgcccagaacaugggccucccgcagaaccggaucaucuucucccccgucgcccccaaggaggagcacgugcgccgggggcagcuggccgacgugugccuggacacgccccucugcaacggccacaccaccgggauggacguccugugggccggcaccccgauggugaccaugcccggcgagacccuggcgagccgcguggccgccucccagcugaccugccucgggugccuggagcucaucgccaagaaccgccaggaguacgaggacaucgccgucaagcugggcacggaccuggaguaccucaagaaggugcgggggaagguguggaagcagcgcaucagcagcccccuguucaacaccaagcaguacaccauggagcuggagcggcucuaccugcagaugugggagcacuacgcggccggcaacaagcccgaccacaugaucaagccggucgaggugaccgaguccgccuga

SEQ ID NO: 33958 - RNA, 690 nt, Artificial Sequence
  derived and/or modified sequence opt1 from OIP5__Homo_sapiens__NP_009211
auggccgcccagccccugcgccaccggagccgcugcgcgaccccgccccggggcgacuucugcgggggcaccgagcgcgccaucgaccaggccuccuucacgaccagcauggagugggacacccagguggucaagggguccagcccccucggccccgccgggcugggcgccgaggagccggcggccggcccccagcugcccuccuggcuccagcccgagcggugcgccguguuccagugcgcccagugccacgcggugcuggccgacagcguccaccuggccugggaccucucccgcagccugggggccgugguguucucccgggucaccaacaacguggugcuggaggccccguuccucgucggcaucgaggggagccugaagggcuccacguacaaccugcuguucugcgggagcugcggcauccccgugggcuuccaccuguacuccacccacgcggcccuggccgcccuccgcgggcacuucugccugagcuccgacaagauggugugcuaccugcucaagaccaaggccaucgucaacgcgagcgagauggacauccagaacgugccccuguccgagaagaucgccgagcugaaggagaagaucgugcucacccacaaccggcucaagagccugaugaagauccucuccgaggucacgcccgaccagagcaagccggagaacuga

SEQ ID NO: 33959 - RNA, 1638 nt, Artificial Sequence
  derived and/or modified sequence opt1 from OIT3__Homo_sapiens__NP_689848
augcccccguuccugcuccugaccugccuguucaucaccggcacgagcgugucccccgucgcccucgaccccugcagcgccuacaucucccugaacgagcccuggcgcaacaccgaccaccagcuggacgagagccaggggccgccccucugcgacaaccacgugaacggcgagugguaccacuucaccgggauggcgggcgacgccaugcccaccuucugcauccccgagaaccacugcgggacgcacgccccgguguggcugaacggcucccacccccuggagggcgacgggaucguccagcggcaggccugcgccagcuucaacggcaacugcugccucuggaacaccaccguggaggugaaggcgugccccgggggcuacuacgucuaccgccugaccaagcccuccgugugcuuccacguguacugcgggcacuucuacgacaucugcgacgaggacugccacggcagcugcuccgacacgagcgagugcacgugcgccccgggcaccguccuggggcccgaccggcagaccugcuucgacgagaacgagugcgagcagaacaacggcgggugcuccgagaucugcgugaaccucaagaacagcuaccgcugcgagugcggcgugggccggguccugcgcuccgacgggaagaccugcgaggacguggagggcugccacaacaacaacgggggcugcagccacuccugccuggggagcgagaagggcuaccagugcgagugcccccggggccucgugcuguccgaggacaaccacacgugccagguccccgugcugugcaagagcaacgccaucgaggugaacaucccgcgcgagcucgucgggggccuggagcuguuccucaccaacaccuccugccgcggggugagcaacggcacccacgugaacauccuguucagccugaagaccugcgggaccgucguggacguggucaacgacaagaucguggccuccaaccucgucaccggccugcccaagcagacgcccggcagcuccggggacuucaucauccggaccagcaagcugcucauccccgugaccugcgaguucccgcggcuguacaccaucuccgagggcuacgugcccaaccugcgcaacagcccccucgagaucaugucccggaaccacgggaucuuccccuucacgcuggagaucuucaaggacaacgaguucgaggagccguaccgcgaggcgcugcccacccucaagcugcgggacagccuguacuucggcaucgagcccgucgugcacguguccgggcucgagagccuggucgaguccugcuucgccacccccaccagcaagaucgacgaggugcugaaguacuaccucauccgcgacggcugcguguccgacgacagcgucaagcaguacacgucccgggaccaccuggccaagcacuuccaggugccgguguucaaguucgucggcaaggaccacaaggagguguuccugcacugccgcgugcucgucugcggggugcuggacgagcggagccgcugcgcccagggcugccaccggcgcaugcgccgcggggccggcggcgaggacuccgcggggcugcagggccagacccucaccgggggccccauccggaucgacugggaggacuga

SEQ ID NO: 33960 - RNA, 717 nt, Artificial Sequence
  derived and/or modified sequence opt1 from OLA1__Homo_sapiens__NP_001011708
augaucggccccaucaucgacaagcuggagaagguggccguccgcgggggcgacaagaagcucaagccggaguacgacaucaugugcaaggucaagagcugggugaucgaccagaagaagcccgugcgguucuaccacgacuggaacgacaaggagaucgaggugcugaacaagcaccuguuccucaccuccaagcccaugguguaccuggucaaccugagcgagaaggacuacauccgcaagaagaacaaguggcucaucaagaucaaggaguggguggacaaguacgaccccggggcccuggugaucccguucuccggcgcgcuggagcucaagcugcaggagcugagcgccgaggagcggcagaaguaccucgaggccaacaugacccaguccgcccugcccaagaucaucaaggccggguucgcggcccugcagcucgaguacuucuucacggccggccccgacgagguccgcgccuggaccauccggaagggcaccaaggcgccccaggccgccgggaagauccacaccgacuucgagaagggcuucaucauggccgaggugaugaaguacgaggacuucaaggaggaggggagcgagaacgccgugaaggcggccggcaaguaccgccagcaggggcggaacuacaucgucgaggacggcgacaucaucuucuucaaguucaacacgccgcagcagcccaagaagaaguga

SEQ ID NO: 33961 - RNA, 1458 nt, Artificial Sequence
  derived and/or modified sequence opt1 from OLFM1__Homo_sapiens__NP_001269540
augagcgugccccugcucaagaucggcgucgugcuguccaccauggccaugaucaccaacuggaugagccagacgcugccgucccucguggggcugaacaccaccaagcugagcgccgcgggcgggggcacccucgaccgcuccacggggguccugcccaccaaccccgaggagagcuggcaggucuacuccagcgcccaggacuccgagggccggugcaucugcaccgugguggcgccccagcagaccaugugcagccgcgacgcccggacgaagcagcugcgccagcuccuggagaaggugcagaacaugucccagagcaucgaggugcuggaccggcgcacccagcgggaccuccaguacgucgagaagauggagaaccagaugaagggccuggaguccaaguucaagcaggucgaggagagccacaagcagcaccuggcccgccaguucaaggccaucaaggccaagauggacgagcuccggccgcugauccccgugcuggaggaguacaaggccgacgccaagcucgugcugcaguucaaggaggaggugcagaaccugaccuccgugcucaacgagcugcaggaggagaucggggcguacgacuacgacgagcugcagagccgcgucuccaaccucgaggagcggcugcgcgccugcaugcagaagcuggccugcggcaagcucaccgggaucagcgaccccgugacggugaagaccuccggcagccgguucgggagcuggaugaccgacccccuggccccggagggcgacaaccgcgucugguacauggacggcuaccacaacaaccgguucgugcgcgaguacaaguccaugguggacuucaugaacaccgacaacuucacgagccaccggcugccccaccccugguccgggaccggccaggucguguacaacgggagcaucuacuucaacaaguuccagucccacaucaucauccgcuucgaccucaagaccgagaccauccugaagacgcggagccuggacuacgccggcuacaacaacauguaccacuacgcguggggcgggcacuccgacaucgaccucaugguggacgagagcggccugugggccgucuacgccaccaaccagaacgccgggaacaucguggucucccgccuggaccccgugagccuccagacccugcagaccuggaacacguccuacccgaagcggagcgccggcgaggcguucaucaucugcgggacccuguacgugaccaacggcuacuccggcgggaccaagguccacuacgccuaccagacgaacgccagcaccuacgaguacaucgacauccccuuccagaacaaguacucccacaucagcaugcucgacuacaaccccaaggaccgcgcccuguacgccuggaacaacggccaccagauccuguacaacgugacccucuuccacgugauccgcuccgacgagcuguga

SEQ ID NO: 33962 - RNA, 1365 nt, Artificial Sequence
  derived and/or modified sequence opt1 from OLFM2__Homo_sapiens__NP_477512
auguggccccugaccgugccgccgccccuccugcugcuccugugcagcggccuggccgggcagacccucuuccagaaccccgaggagggcuggcagcuguacacguccgcccaggcgcccgacgggaagugcaucugcaccgccgucauccccgcccagagcacgugcucccgcgacggccggagccgcgagcugcggcagcucauggagaaggugcagaacgugucccagagcauggagguccuggagcugcgcaccuaccgggaccuccaguacgugcgcgggauggagacgcugaugcggucccuggacgcccgccuccgggccgcggacggcagccuguccgccaagagcuuccaggagcugaaggaccgcaugaccgagcuccugccccuguccagcgugcucgagcaguacaaggccgacacccggaccaucguccgccugcgggaggaggugcgcaaccuguccggcagccucgccgcgauccaggaggagaugggggccuacggcuacgaggaccugcagcagcgggugauggcccuggaggcccgccuccacgccugcgcgcagaagcuggggugcggcaagcugacgggggucuccaaccccaucaccgugcgggccaugggcagccgcuucggcuccuggaugaccgacaccauggccccgagcgccgacucccgggugugguacauggacggguacuacaagggccgccggguccucgaguuccgcacgcugggggacuucaucaagggccagaacuucauccagcaccuccugccccagcccugggccggcaccgggcacgugguguacaacggcagccuguucuacaacaaguaccagagcaacgucguggugaaguaccacuuccgcucccggagcguccuggugcagcgcucccuccccggggcgggcuacaacaacaccuucccguacagcuggggcggguucuccgacauggacuucaugguggacgagagcggccugugggccgucuacaccacgaaccagaacgccgggaacaucguggugucccggcuggacccccacacccucgaggucaugcgcagcugggacaccggcuaccccaagcgguccgccggggaggccuucaugaucugcggcgugcuguacgucaccaacagccaccuggcgggggccaagguguacuucgccuacuucacgaacaccuccagcuacgaguacaccgacgugcccuuccacaaccaguacucccacaucagcaugcucgacuacaacccgcgcgagcgggcccuguacaccuggaacaacggccaccagguccuguacaacgugacccucuuccacgugaucuccaccagcggcgaccccuga

SEQ ID NO: 33963 - RNA, 1533 nt, Artificial Sequence
  derived and/or modified sequence opt1 from OLFM4__Homo_sapiens__NP_006409
augcgccccggccugagcuuccuccuggcccugcuguucuuccuggggcaggccgcgggcgaccugggggacgugggcccgcccauccccucccccggguucagcuccuucccgggcgucgacagcuccagcuccuucagcuccagcucccggagcggcuccagcuccagccgcucccucgggagcggcggguccgugagccagcuguucagcaacuucaccggcuccguggacgaccgggggaccugccagugcagcgucucccugcccgacacgaccuuccccguggaccgcguggagcggcucgaguucaccgcccacguccugagccagaaguucgagaaggagcuguccaaggugcgcgaguacgugcagcucaucagcgucuacgagaagaagcugcugaaccucaccgugcggaucgacaucauggagaaggacacgaucuccuacaccgagcuggacuucgagcugaucaagguggaggucaaggagauggagaagcucgugauccagcugaaggagagcuucggcggcuccagcgagaucguggaccagcuggaggucgagauccgcaacaugacccuccugguggagaagcuggagacccucgacaagaacaacgugcuggccauccggcgcgagaucgucgcccugaagacgaagcucaaggagugcgaggccuccaaggaccagaacacccccguggugcacccgccgcccacccccgggagcugcggccacgggggcgucgugaacaucuccaagcccagcgugguccagcugaacuggcggggcuucuccuaccuguacggggcguggggccgcgacuacagcccccagcaccccaacaaggggcucuacuggguggcgccccugaacaccgacggccggcugcucgaguacuaccgccuguacaacacgcuggacgaccuccugcuguacaucaacgcccgggagcuccgcaucaccuacgggcagggcuccggcaccgccgucuacaacaacaacauguacgugaacauguacaacaccgggaacaucgcccgggugaaccugacgaccaacaccaucgccgucacccagacgcugccgaacgccgccuacaacaaccgcuucagcuacgccaacguggcguggcaggacaucgacuucgccguggacgagaacggccucugggucaucuacuccaccgaggccagcaccgggaacauggugaucagcaagcugaacgacaccacgcuccaggugcucaacaccugguacaccaagcaguacaagcccuccgccagcaacgccuucauggucugcggcgugcuguacgcgacccggacgaugaacacccgcaccgaggagaucuucuacuacuacgacaccaacacggggaaggagggcaagcuggacaucgugaugcacaagaugcaggagaagguccaguccaucaacuacaaccccuucgaccagaagcucuacguguacaacgacggcuaccugcugaacuacgaccugagcgugcuccagaagccccaguga

SEQ ID NO: 33964 - RNA, 2253 nt, Artificial Sequence
  derived and/or modified sequence opt1 from OLFML2B__Homo_sapiens__NP_056256
auggccaagccccgccugcucgugcuguacuucgcccugaucgucgugccggcgugggugagcuccaucguccucaccggcaccagcgagccgcccgacgcccagacgguggcccccgccgaggacgagacccugcagaacgaggccgacaaccaggagaacgugcugucccagcuccugggggacuacgacaaggucaaggcgaugagcgagggcuccgacugccagugcaagugcguggugcggccccuggggcgcgacgccugccagcggaucaacgccggcgccagccgcaaggaggacuucuacaccgucgagaccaucacguccgggagcuccugcaagugcgcgugcguggccccgcccagcgcccucaaccccugcgagggcgacuuccggcugcagaagcugcgcgaggccgacucccaggaccucaagcugagcaccaucaucgacaugcuggagggcgccuucuacgggcucgaccugcugaagcuccacuccgugaccaccaagcuggucggccggguggacaagcuggaggaggaggugagcaagaaccucacgaaggagaacgagcagaucaaggaggacauggaggagauccgcaccgagaugaacaagcgggggaaggagaacugcuccgagaacauccuggacagcaugcccgacauccgcuccgcgcugcagcgggacgccgccgccgccuacgcgcaccccgaguacgaggagcgcuuccuccaggaggagaccgucagccagcagaucaacuccaucgagcugcugcagacccggccccucgcccugcccgagguggugaagucccagcgcccgcugcagcggcagguccaccuccgcggccggcccgccagccagcccacggugauccgcgggaucaccuacuacaaggccaaggugagcgaggaggagaacgacaucgaggagcagcaggacgaguucuucagcggcgacaacggcgucgaccugcugaucgaggaccagcuccugcggcacaacgggcugaugaccuccgugacccgccggcccgccgcgacgcgccagggccacagcaccgccgugaccuccgaccucaacgcccgcaccgccccguggagcuccgcccugccccagcccagcacguccgaccccagcaucgcgaaccacgccuccgucgggccgacccugcagaccaccagcgugucccccgaccccacgcgggagagcguccuccagcccuccccgcagguccccgccaccaccguggcccacaccgcgacgcagcagcccgccgcccccgccccgcccgccgugagcccccgcgaggcgcugauggaggccaugcacaccgugccggugccgcccaccaccguccggacggacucccugggcaaggacgcccccgccggcugggggaccacccccgccagccccacccucucccccgaggaggaggacgacauccgcaacgugaucggccggugcaaggacacgcugagcaccaucaccgggcccaccacccagaacacguacggccgcaacgagggggcguggaugaaggacccgcuggccaaggacgagcggaucuacgugaccaacuacuacuacggcaacacccucgucgaguuccgcaaccuggagaacuucaagcagggccgguggagcaacuccuacaagcugcccuacagcuggaucgggaccggccacgugguguacaacggggccuucuacuacaaccgcgccuucacgcggaacaucaucaaguacgaccucaagcagcgcuacgucgccgcgugggccaugcugcacgacguggccuacgaggaggccacccccuggcgguggcagggccacuccgacguggacuucgcggucgacgagaacgggcuguggcugaucuaccccgcccucgacgacgagggcuucagccaggaggugaucgugcuguccaagcugaacgccgccgaccucagcacccagaaggagaccacguggcgcaccggccugcggcgcaacuucuacgggaacugcuucgucaucugcggcgugcuguacgccguggacuccuacaaccagcggaacgcgaacaucagcuacgccuucgacacccacaccaacacgcagaucgucccgcgccuccuguucgagaacgaguacuccuacaccacccagaucgacuacaaccccaaggaccggcugcucuacgccugggacaacgggcaccaggugaccuaccacgugaucuucgccuacuga

SEQ ID NO: 33965 - RNA, 816 nt, Artificial Sequence
  derived and/or modified sequence opt1 from OLIG1__Homo_sapiens__NP_620450
auguacuacgccgugagccaggcccgcgucaacgcggugcccggcaccaugcugcggccgcagcgccccggggaccuccagcugggcgccucccuguacgagcucgugggguaccggcagccgcccagcuccagcuccagcuccaccagcuccaccagcuccaccagcuccagcuccaccaccgccccgcugcugcccaaggccgcccgcgagaagcccgaggcgcccgccgagccgcccggccccgggcccggcagcggcgcccaccccgggggcuccgcccggcccgacgcgaaggaggagcagcagcagcagcuccgccggaagaucaacagccgcgagcggaagcgcaugcaggaccugaaccuggccauggacgcccuccgggaggucauccugcccuacuccgccgcccacugccagggggcgcccggccgcaagcugagcaagaucgccacgcuccugcuggcccggaacuacauccuccugcuggggagcucccuccaggagcugcgccgggcccugggcgagggcgccgggccggcggcgccccgccuccugcuggccggccucccccugcuggccgccgcccccgggagcgugcuccuggccccgggcgccgugggcccgcccgacgcccugcggcccgccaaguaccucucccuggcgcuggacgagccgcccugcgggcaguucgcccuccccggcgggggcgccgggggccccggccugugcacgugcgccgucugcaaguucccccaccuggugcccgcgagccucgggcuggccgccgugcaggcccaguucuccaaguga

SEQ ID NO: 33966 - RNA, 972 nt, Artificial Sequence
  derived and/or modified sequence opt1 from OLIG2__Homo_sapiens__XP_005260965
auggacagcgacgccucccuggugagcucccgccccagcuccccggagcccgacgaccucuuccugcccgcccggagcaagggcuccagcggguccgcguucaccggcgggaccgucagcuccagcacgcccuccgacugcccgcccgagcugagcgccgagcuccgcggcgccaugggguccgccggcgcccaccccggcgacaagcucgggggcagcggguucaaguccagcuccagcagcaccuccagcuccaccagcuccgcggccgccagcuccaccaagaaggacaagaagcagaugacggagcccgagcugcagcagcugcggcugaagaucaacagccgcgagcggaagcgcaugcacgaccugaacaucgccauggacggccuccgggaggugaugccguacgcgcacgggcccuccgugcgcaagcugagcaagaucgccacccugcuccuggcccggaacuacauccugaugcucaccaacucccuggaggagaugaagcgccuggucagcgagaucuacggcggccaccacgccggguuccaccccuccgccugcggcgggcucgcgcacagcgcgccccugccggccgccaccgcccaccccgccgccgccgcccacgccgcgcaccaccccgccgugcaccaccccauccugccgcccgccgccgccgcggccgccgccgcggccgccgccgccgcgguguccagcgccucccuccccggcagcggccugcccuccgucgggagcauccggccgccccacggccugcucaagagccccuccgccgccgccgcggcgccccucgggggcgggggcggcgggagcggcgccuccgggggcuuccagcacuggggcgggaugccgugccccugcagcaugugccaggugcccccgccccaccaccacguguccgccaugggcgccgggagccugccccgccugacguccgacgccaaguga

SEQ ID NO: 33967 - RNA, 819 nt, Artificial Sequence
  derived and/or modified sequence opt1 from OLIG3__Homo_sapiens__NP_786923
augaacagcgacuccagcuccgugagcucccgcgccagcucccccgacauggacgagauguaccugcgggaccaccaccaccgccaccaccaccaccaggagagccggcucaacuccgucagcuccacccagggcgacaugaugcagaagaugcccggggagagccugucccgcgccggcgcgaaggccgccggggagagcuccaaguacaagaucaagaagcagcugagcgagcaggaccuccagcagcugcggcugaagaucaacggccgcgagcggaagcgcaugcacgaccucaaccuggccauggacgggcugcgggaggugaugcccuacgcccacggccccuccgugcgcaagcucagcaagaucgcgacccugcugcucgcccggaacuacauccugaugcugacguccagccucgaggagaugaagcgccuggucggcgagaucuacgggggccaccacagcgccuuccacugcgggaccgugggccacuccgccgggcaccccgcgcacgccgccaacagcgugcacccgguccaccccauccugggcggcgcccucuccagcgggaacgccuccagcccccuguccgcggccagccugcccgccaucggcaccauccggccgccccacucccuccugaaggcccccagcacgcccccggcccugcagcucggguccggcuuccagcacugggcgggccugcccugccccugcaccaucugccagaugcccccgccgccccaccugagcgcccucuccaccgccaacauggcccgccugagcgccgaguccaaggaccugcucaaguga

SEQ ID NO: 33968 - RNA, 546 nt, Artificial Sequence
  derived and/or modified sequence opt1 from OLR1__Homo_sapiens__NP_001166103
augaccuucgacgaccugaagauccagaccgugaaggaccagcccgacgagaaguccaacggcaagaaggccaaggggcuccaguuccuguacagcccgugguggugccuggccgcggccacgcucggcguccugugccuggggcucguggugaccaucaugguccugggcaugcagcugagccagguguccgaccuccugacccaggagcaggccaaccugacccaccagaagaagaagcucgaggggcagaucagcgcccgccagcaggccgaggaggcgucccaggagagcgagaacgagcugaaggagaugaucgagacgcuggcccggaagcucaacgagaaguccaaggagcagauggagcugcaccaccagaaccugaaccuccaggagacccugaagcgcguggccaacugcagcggccugcaccccgccuccaacuuccucuuccaguucagcauccuggacggcgcggucuccgaggagccccagcugcccauggcccucgggggccgguucagcuucgacgccccgcugaucuga

SEQ ID NO: 33969 - RNA, 1266 nt, Artificial Sequence
  derived and/or modified sequence opt1 from OMD__Homo_sapiens__NP_005005
augggcuuccugagccccaucuacgugaucuucuucuucuucggggucaaggugcacugccaguacgagaccuaccagugggacgaggacuacgaccaggagccggacgacgacuaccagaccggcuuccccuuccgccagaacguggacuacgggguccccuuccaccaguacacgcucggcugcguguccgagugcuucugccccaccaacuucccgagcuccauguacugcgacaaccggaagcugaagaccauccccaacauccccaugcacauccagcagcuguaccuccaguucaacgagaucgaggccgugaccgccaacagcuucaucaacgcgacgcaccugaaggagaucaaccugucccacaacaagaucaagagccagaagaucgacuacggggucuucgccaagcuccccaaccugcugcagcuccaccuggagcacaacaaccuggaggaguucccguucccccuccccaagucccuggagcgccugcuccugggcuacaacgagaucagcaagcugcagaccaacgccauggacggccucgugaaccugaccaugcuggaccucugcuacaacuaccugcacgacucccugcucaaggacaagaucuucgccaagauggagaagcugaugcagcugaaccucugcagcaaccggcuggaguccaugcccccggggcugcccagcucccucauguaccugagccuggagaacaacuccaucagcuccauccccgagaaguacuucgacaagcuccccaagcugcacacccugcgcaugagccacaacaagcuccaggacaucccguacaacaucuucaaccugcccaacaucguggagcuguccgucggccacaacaagcucaagcaggccuucuacaucccccggaaccuggagcaccuguaccuccagaacaacgagaucgagaagaugaaccugacggugaugugccccagcaucgacccgcugcacuaccaccaccucaccuacauccgcguggaccagaacaagcugaaggagcccaucagcuccuacaucuucuucugcuucccccacauccacaccaucuacuacggggagcagcggagcaccaacggccagacgauccagcugaagacccaggucuuccgccgguuccccgacgacgacgacgaguccgaggaccacgacgacccggacaacgcgcacgagagccccgagcaggagggggccgagggccacuucgaccuccacuacuacgagaaccaggaguga

SEQ ID NO: 33970 - RNA, 1323 nt, Artificial Sequence
  derived and/or modified sequence opt1 from OMG__Homo_sapiens__NP_002535
auggaguaccagauccugaagaugagccucugccuguucauccugcuguuccugacccccggcauccugugcaucugcccgcuccagugcaucugcaccgagcgccaccggcacguggacugcuccgggcgcaaccugagcacccugcccuccggccuccaggagaacaucauccaccugaaccugagcuacaaccacuucaccgaccuccacaaccagcugacccaguacaccaaccugcggacgcucgacaucuccaacaaccgccuggagagccugcccgcccaccucccccggucccuguggaacaugagcgccgcgaacaacaacaucaagcugcucgacaaguccgacaccgccuaccaguggaaccugaaguaccuggacgucagcaagaacaugcucgagaagguggugcugaucaagaacacccugcgcucccucgagguccugaaccugagcuccaacaagcucuggaccgugccgacgaacaugcccagcaagcugcacaucguggaccuguccaacaacagccucacccagauccugcccgggacccugaucaaccucaccaaccugacgcaccuguaccuccacaacaacaaguucaccuucauccccgaccaguccuucgaccagcuguuccagcugcaggagaucacccucuacaacaaccgguggagcugcgaccacaagcagaacaucaccuaccugcugaaguggaugauggagacgaaggcccacgucaucggcaccccgugcuccacccagaucagcagccucaaggagcacaacauguaccccacccccuccggguucacgagcucccuguucaccgugagcggcaugcagaccguggacaccaucaacucccugagcgucgugacgcagcccaaggugaccaagaucccgaagcaguaccgcaccaaggagaccacguucggcgccacccucuccaaggacaccaccuucacgagcaccgacaaggccuucguccccuaccccgaggacaccuccaccgagacgaucaacagccacgaggcggccgccgccacccugaccauccaccuccaggacgggauggugaccaacaccucccugacgagcuccaccaagagcucccccaccccgaugacccucagcaucacguccggcaugcccaacaacuucagcgagaugccccagcaguccaccacccugaaccuguggcgggaggagaccacgaccaacgugaagacgccccucccgagcgucgcgaacgccuggaaggugaacgccagcuuccugcugcuccugaacguggucgugaugcuggccguguga

SEQ ID NO: 33971 - RNA, 492 nt, Artificial Sequence
  derived and/or modified sequence opt1 from OMP__Homo_sapiens__NP_006180
auggccgaggaccgcccccagcagccgcagcuggacaugccccucgugcuggaccagggccugacccggcagaugcgccuccgggucgagagccugaagcagcgcggggagaagcggcaggacggcgagaagcugcuccagcccgccgaguccguguaccgccugaacuucacccagcagcagcggcugcaguucgagcgcuggaacgugguccucgacaagcccgggaaggugacgaucaccggcaccagccagaacuggaccccggaccugacgaaccugaugacccggcagcuccuggaccccaccgcgaucuucuggcgcaaggaggacuccgacgccaucgacuggaacgaggccgacgcccuggaguucggggagcggcucagcgaccuggccaagauccgcaaggugauguacuuccuggucaccuucggcgagggcguggagcccgcgaaccucaaggccuccguggucuucaaccagcuguga

SEQ ID NO: 33972 - RNA, 1398 nt, Artificial Sequence
  derived and/or modified sequence opt1 from ONECUT1__Homo_sapiens__NP_004489
augaacgcccagcugaccauggaggccaucggcgagcuccacggggugagccacgagcccgucccggcgcccgccgaccugcugggcgggagcccccacgcccgcuccuccguggcccaccggggcagccaccucccgcccgcccacccccgcuccauggggauggcgagccugcuggacggcggcuccgggggcggggacuaccaccaccaccaccgggcccccgagcacagccucgccggcccccugcacccgaccaugaccauggccugcgagaccccgcccgggauguccaugcccaccaccuacacgacccugacgccccuccagccccugccgcccaucagcaccguguccgacaaguucccccaccaccaccaccaccaccaccaccaccaccacccccaccaccaccagcgccuggcgggcaacgucagcggcuccuucacccucaugcgggacgagcgcgggcuggccagcaugaacaaccuguacacccccuaccacaaggacguggccggcauggggcagucccucagcccccuguccagcuccggccugggcagcauccacaacagccagcaggggcucccgcacuacgcccaccccggcgccgcgaugcccaccgacaagaugcugacccccaacggguucgaggcccaccacccggccaugcugggccggcacggggagcagcaccucacgcccaccuccgccggcauggugcccaucaacggccugcccccgcaccacccccacgcccaccugaacgcgcaggggcacggccagcuccuggggaccgcccgcgagcccaacccgagcgucaccggcgcccagguguccaacgggagcaacuccggccagauggaggagaucaacacgaaggagguggcccagcggaucaccaccgagcugaagcgcuacagcaucccccaggccaucuucgcgcagcggguccucugccgcucccagggcacccugagcgaccugcuccggaaccccaagcccugguccaagcucaagagcgggcgcgagacguuccggcgcauguggaaguggcugcaggagccggaguuccagcggauguccgcccugcgccuggccgccugcaagcggaaggagcaggagcacggcaaggaccgcgggaacacccccaagaagccccggcugguguucaccgacgugcagcgccgcacccuccacgccaucuucaaggagaacaagcggcccagcaaggagcugcagaucacgaucucccagcagcugggccucgagcugagcaccgucuccaacuucuucaugaacgcgcgccggcgcagccuggacaaguggcaggacgagggguccagcaacuccggcaacagcagcuccagcuccagcacgugcaccaaggccuga

SEQ ID NO: 33973 - RNA, 1515 nt, Artificial Sequence
  derived and/or modified sequence opt1 from ONECUT2__Homo_sapiens__NP_004843
augaaggccgccuacaccgcguaccgcugccugaccaaggaccucgagggcugcgccaugaaccccgagcugacgauggagagccuggggacccuccacggcccggccgggggcggguccggcggcgggggcgggggcgggggcggcgggggcgggggcggccccgggcacgagcaggagcugcuggccagccccagcccccaccacgccggccgcggggcggccggcucccuccgggggccgcccccgccgcccaccgcccaccaggagcugggcaccgccgcggccgccgccgccgcggccucccggagcgccauggugacguccauggccagcauccuggacggcggggacuaccgccccgagcucuccaucccccugcaccacgccaugagcauguccugcgacagcagcccgcccggcauggggauguccaacaccuacaccacccugacgccccuccagccccugcccccgaucuccaccgucagcgacaaguuccaccacccccacccccaccaccacccccaccaccaccaccaccaccaccaccagcggcuguccggcaacgugagcggguccuucacccucaugcgcgacgagcggggccugcccgcgaugaacaaccuguacagccccuacaaggagaugcccggcaugagccagucccucagcccccuggccgccaccccgcuggggaacggccucgggggccugcacaacgcccagcagucccugcccaacuacgggccgcccggccacgacaagaugcucagccccaacuucgacgcccaccacacggcgaugcugacccgcggcgagcagcaccugucccgggggcucggcaccccgcccgccgccaugaugagccaccugaacgggcugcaccaccccggccacacccagucccacggccccgugcucgcccccagccgcgagcggcccccguccagcuccagcgggucccaggucgccacgagcggccagcuggaggagaucaacaccaaggagguggcgcagcgcaucaccgccgagcugaagcgguacuccaucccccaggccaucuucgcccagcgcgugcucugccggagccaggggacccuguccgaccugcuccgcaaccccaagcccuggagcaagcugaaguccggccgggagacguuccgccggauguggaaguggcugcaggagccggaguuccagcgcaugagcgcgcuccggcuggccgccugcaagcgcaaggagcaggagcccaacaaggaccgcaacaacagccagaagaagucccggcuggucuucaccgaccuccagcgccggacccuguucgccaucuucaaggagaacaagcgccccagcaaggagaugcagaucaccaucucccagcagcuggggcucgagcugacgaccgugagcaacuucuucaugaacgcccggcgccggucccuggagaaguggcaggacgaccucagcaccggcggcuccagcuccaccagcuccacgugcaccaaggcguga

SEQ ID NO: 33974 - RNA, 2883 nt, Artificial Sequence
  derived and/or modified sequence opt1 from OPA1__Homo_sapiens__NP_056375
auguggcgccugcggcgcgccgccguggcgugcgaggucugccagagccucgugaagcacuccagcggcaucaaggggucccugccccugcagaagcuccaccuggugagccgguccaucuaccacagccaccacccgacccugaagcuccagcgcccccagcugcggaccuccuuccagcaguucagcucccugacgaaccucccccugcgcaagcugaaguucagccccaucaaguacggcuaccagccgcggcgcaacuucuggcccgcccggcucgccacccgccugcugaagcuccgguaccugauccugggguccgccgucggcgggggcuacaccgccaagaagaccuucgaccaguggaaggacaugauccccgaccucagcgaguacaaguggaucgugcccgacaucgugugggagaucgacgaguacaucgacuucgagaagauccgcaaggcgcugccguccagcgaggaccuggucaagcucgcccccgacuucgacaagaucguggagucccugagccugcucaaggacuucuucacguccggcagccccgaggagaccgccuuccgggccaccgaccgcggguccgagagcgacaagcacuuccggaaggugagcgacaaggagaagaucgaccagcugcaggaggagcugcuccacacccagcugaaguaccagcgcauccuggagcggcucgagaaggagaacaaggagcugcgcaagcugguccuccagaaggacgacaagggcauccaccaccggaagcugaagaagucccugaucgacauguacagcgaggugcucgacgugcuguccgacuacgacgcgagcuacaacacgcaggaccaccucccccgcgucgugguggucggggaccaguccgccggcaagaccagcgugcucgagaugaucgcccaggcccggaucuucccgcgcggguccggcgagaugaugacccgcagccccgugaaggucacccuguccgagggcccccaccacguggcccuguucaaggacagcucccgggaguucgaccucacgaaggaggaggaccuggcggcccugcgccacgagaucgagcuccggaugcgcaagaacgugaaggaggggugcaccgucagccccgagaccaucucccugaacgugaagggcccggggcugcagcggauggugcucgucgaccugcccggcgugaucaacaccgucacgagcggcauggcccccgacaccaaggagaccaucuucuccaucagcaaggccuacaugcagaaccccaacgccaucauccugugcauccaggacggguccguggacgcggagcgcagcaucgugaccgaccuggucucccagauggacccgcacggccggcgcacgaucuucgugcucaccaagguggaccuggccgagaagaacgucgccagccccagccggauccagcagaucaucgaggggaagcuguuccccaugaaggcccucggcuacuucgccguggugaccgggaagggcaacuccagcgaguccaucgaggcgauccgcgaguacgaggaggaguucuuccagaacagcaagcugcugaagaccuccaugcucaaggcccaccaggucacgacccggaaccugagccuggccguguccgacugcuucuggaagauggugcgcgagagcgucgagcagcaggccgacuccuucaaggccacccgguucaaccucgagaccgaguggaagaacaacuacccccgccugcgggagcuggaccgcaacgagcuguucgagaaggcgaagaacgagauccuggacgaggugaucagccugucccaggugacgccgaagcacugggaggagauccuccagcagagccugugggagcgggucuccacccacgugaucgagaacaucuaccugcccgccgcccagaccaugaacagcggcaccuucaacacgaccguggacaucaagcucaagcaguggaccgacaagcagcugcccaacaaggccgucgagguggcgugggagacccugcaggaggaguucucccgcuucaugacggagcccaaggggaaggagcacgacgacaucuucgacaagcucaaggaggccgugaaggaggagagcaucaagcggcacaaguggaacgacuucgccgaggacucccugcgcgucauccagcacaacgcccuggaggaccgcagcaucagcgacaagcagcagugggacgccgcgaucuacuucauggaggaggcccuccaggcccggcugaaggacaccgagaacgccaucgagaacauggugggcccggacuggaagaagcgcuggcuguacuggaagaaccggacccaggagcagugcgugcacaacgagaccaagaacgagcucgagaagaugcugaagugcaacgaggagcaccccgccuaccuggcguccgacgagaucaccacgguccgcaagaaccucgagagccgcgggguggagguggaccccucccugaucaaggacaccuggcaccaggucuaccggcggcacuuccugaagaccgcccucaaccacugcaaccugugccgccggggcuucuacuacuaccagcgccacuucguggacagcgagcuggagugcaacgacgugguccucuucuggcggauccagcgcaugcuggccaucaccgccaacacgcugcggcagcagcucaccaacaccgaggugcgccggcuggagaagaacgugaaggagguccuggaggacuucgccgaggacggggagaagaagaucaagcuccugaccggcaagcgcgugcagcuggcggaggaccucaagaaggugcgggagauccaggagaagcuggacgccuucaucgaggcccugcaccaggagaaguga

SEQ ID NO: 33975 - RNA, 543 nt, Artificial Sequence
  derived and/or modified sequence opt1 from OPA3__Homo_sapiens__NP_001017989
augguggucggcgccuuccccauggccaagcugcucuaccuggggauccgccaggugagcaagccgcuggcgaaccggaucaaggaggccgcccgccgguccgaguucuucaagaccuacaucugccucccccccgcccagcuguaccacuggcuggagaugcgcaccaagaugcggaucaugggcuucaacgccgcggccaucaagccccucaacgagggggccgccgcggagcugggcgccgagcugcucggggagggcaucaucuucaucacggccugcagcugccugaugcuggaguacuggcgccaccagcuccagcagcggcgcaaggagaaggagcggcgcguggcccgggaggcccugcgcggcgaggucgggcaccugggccucgcgcuggaggagcugcaggcccaggugcaggccaccuccacccagcucgcccuggaggagcugcgggcccagcuccaggaggugcgcgcgcaccugugccugcgggacccgccccccgcccccccggucgcccccgccagcgagaaguga

SEQ ID NO: 33976 - RNA, 1017 nt, Artificial Sequence
  derived and/or modified sequence opt1 from OPCML__Homo_sapiens__NP_001012393
auguaccaccccgccuacuggguggucuucagcgccaccaccgcgcuccuguucaucccgggcgugcccgugcgcuccggggacgccacguuccccaaggccauggacaacgucaccgugcggcagggcgagagcgccacccugcgcugcaccaucgacgaccgggugacgcgcgucgccuggcugaaccgguccaccauccucuacgcggggaacgacaaguggagcaucgacccccgcgugaucauccuggugaacaccccgacccaguacuccaucaugauccagaacgucgacguguacgacgagggccccuacacgugcagcgugcagaccgacaaccaccccaagaccucccggguccaccugaucguccaggugcccccgcagaucaugaacaucagcuccgacaucaccgugaacgaggggagcuccgugacgcuccugugccuggccaucggccgccccgagcccaccgugaccuggcggcaccucagcgucaaggagggccagggguucguguccgaggacgaguaccuggagaucagcgacaucaagcgcgaccaguccggcgaguacgagugcagcgcccugaacgacguggccgcgcccgacguccggaaggugaagaucaccgugaacuacccgcccuacaucuccaaggccaagaacacgggggucagcgugggccagaaggggauccucuccugcgaggccagcgccguccccauggccgaguuccagugguucaaggaggagacccgccuggcgaccggccuggacggcaugcggaucgagaacaaggggcgcaugagcacccucacguucuucaacguguccgagaaggacuacggcaacuacacgugcguggccaccaacaagcuggggaacaccaacgccagcaucacccuguacggccccggcgccgucaucgacggggugaacuccgccagccgggcgcucgccugccuguggcuguccggcacccuccuggcccacuucuucaucaaguucuga

SEQ ID NO: 33977 - RNA, 2085 nt, Artificial Sequence
  derived and/or modified sequence opt1 from OPHN1__Homo_sapiens__XP_005262327
augggccacccgccccuggaguucagcgacugcuaccucgacucccccgacuuccgcgagcggcugaagugcuacgagcaggagcuggagcgcaccaacaaguucaucaaggacgugaucaaggacgggaacgcccucaucagcgccaugcggaacuacuccagcgcgguccagaaguucucccagacccugcagagcuuccaguucgacuucaucggcgacacgcugaccgacgacgagaucaacaucgccgaguccuucaaggaguucgccgagcuccugaacgagguggagaacgagcgcaugaugauggugcacaacgccagcgaccugcucaucaagccccuggagaacuuccggaaggagcagaucggguucaccaaggagcgcaagaagaaguucgagaaggacggcgagcgguucuacucccugcucgaccgccaccuccaccugagcuccaagaagaaggagagccagcugcaggaggccgaccugcaggucgacaaggagcggcacaacuucuucgaguccagccuggacuacguguaccagauccaggaggugcaggaguccaagaaguucaacaucgucgagcccgugcucgcguuccugcacagccuguucaucuccaacagccucaccguggagcugacgcaggacuuccugccguacaagcagcagcuccagcugucccugcagaacacccgcaaccacuucagcagcacccgggaggagauggaggagcucaagaagcgcaugaaggaggcgccccagaccugcaagcugcccgggcagcccacgaucgagggcuaccuguacacccaggagaagugggcccucggcaucuccugggucaaguacuacugccaguacgagaaggagaccaagacccugacgaugacccccauggagcagaagcccggggccaagcagggcccccuggaccucacccugaaguacugcgugcggcgcaagaccgagagcaucgacaagcgguucugcuucgacaucgagacgaacgagcgccccgggaccaucacccugcaggcccucuccgaggccaaccggcgccuguggauggaggccauggacggcaaggagccgaucuaccacagccccaucaccaagcagcaggagauggagcugaacgaggugggguucaaguucguccggaagugcaucaacaucaucgagacgaagggcaucaagaccgagggccucuaccgcaccgugggguccaacauccaggugcagaagcugcugaacgccuucuucgaccccaagugccccggcgacgucgacuuccacaacagcgacugggacaucaagaccaucacguccagccucaaguucuaccugcggaaccuguccgagccggugaugaccuaccgccuccacaaggagcuggugagcgccgcgaaguccgacaaccuggacuaccgccucggggccauccacagccuggucuacaagcugcccgagaagaaccgggagaugcuggagcuccugauccgccaccuggugaacgugugcgagcacuccaaggagaaccucaugacccccagcaacaugggcgucaucuucggccccacccugaugcgggcccaggaggacacgguggccgccaugaugaacaucaaguuccagaacaucguggucgagauccugaucgagcacuucgggaagaucuaccucggcccgcccgaggaguccgcggccccgcccgugcccccgccccgcgucaccgcccggcgccacaagcccaucaccaucagcaagcggcugcugcgcgagcggaccguguucuacacguccagccucgacgaguccgagggggacgccgacagcuucagcaaggugcgcccgcccggcgagaagcccaccaucauccggccgcccguccgcccgcccgacccgcccugccgggccgcgacgccccagaagcccgagcccaagcccgacaucguggccgggaacgccggcgagaucaccuccagcguggucgccucccgcacccgguucuucgagaccgccagccgcaagaccggcuccagccaggggcggcugcccggcgacgaguccuga

SEQ ID NO: 33978 - RNA, 1095 nt, Artificial Sequence
  derived and/or modified sequence opt1 from OPN1LW__Homo_sapiens__NP_064445
auggcccagcaguggagccugcagcgccucgccggccggcacccccaggacuccuacgaggacagcacccaguccagcaucuucaccuacacgaacuccaacagcacccgcgggccguucgagggccccaacuaccacaucgcgccccgguggguguaccaccugaccuccgucuggaugaucuucguggugaccgccagcgucuucacgaacgggcuggugcucgccgccaccaugaaguucaagaagcugcgccacccccugaacuggauccucgugaaccuggccgucgcggaccuggccgagaccgugaucgccuccaccaucagcaucgugaaccaggucuccggcuacuucgugcucgggcacccgaugugcgugcuggagggcuacacggucagccugugcggcaucaccgggcucuggucccuggccaucaucagcugggagcgguggaugguggugugcaagcccuucggcaacguccgcuucgacgcgaagcuggccaucguggggaucgccuucuccuggaucugggccgccguguggaccgcgccgcccaucuucggcuggagccgguacuggccccacgggcucaagaccuccugcggccccgacgucuucagcggcuccagcuaccccggggugcagagcuacaugaucgugcugauggucacgugcugcaucaucccccuggccaucaucaugcucugcuaccuccagguguggcuggccauccgcgccguggccaagcagcagaaggaguccgagagcacccagaaggcggagaaggaggucacccggaugguggucgugaugaucuucgccuacugcgugugcuggggcccguacaccuucuucgccugcuucgccgccgcgaaccccggguacgccuuccacccccucauggccgcccugcccgccuacuucgcgaaguccgccacgaucuacaacccggucaucuacguguucaugaaccgccaguuccggaacugcauccugcagcuguucggcaagaagguggacgacggcagcgagcuguccagcgccuccaagaccgaggucagcuccgugagcuccgugagccccgccuga

SEQ ID NO: 33979 - RNA, 1095 nt, Artificial Sequence
  derived and/or modified sequence opt1 from OPN1MW2__Homo_sapiens__NP_001041646
auggcccagcaguggagccugcagcgccucgccggccggcacccccaggacuccuacgaggacagcacccaguccagcaucuucaccuacacgaacuccaacagcacccgcgggccguucgagggccccaacuaccacaucgcgccccgguggguguaccaccugaccuccgucuggaugaucuucguggugaucgccagcgucuucaccaacgggcuggugcucgccgccacgaugaaguucaagaagcugcgccacccccugaacuggauccucgugaaccuggccgucgcggaccuggccgagaccgugaucgccuccaccaucagcguggucaaccagguguacggcuacuucgugcucgggcacccgaugugcguccuggagggcuacaccgugucccugugcggcaucacggggcucuggagccuggccaucaucuccugggagcgguggaugguggucugcaagcccuucggcaacgugcgcuucgacgcgaagcuggccaucguggggaucgccuucagcuggaucugggccgccgucuggaccgcgccgcccaucuucggcuggucccgguacuggccccacgggcucaagaccagcugcggccccgacguguucuccggcagcuccuaccccggggugcagagcuacaugaucguccugauggugaccugcugcaucacgccccugagcaucaucgugcucugcuaccugcaggucuggcuggccauccgcgccguggccaagcagcagaaggaguccgagagcacccagaaggccgagaaggaggucacccggauggugguggucauggugcucgcguucugcuucugcuggggcccguacgccuucuucgccugcuucgccgccgcgaaccccggguaccccuuccacccccugauggccgcccugccggccuucuucgccaaguccgcgaccaucuacaaccccgugaucuacgucuucaugaaccgccaguuccggaacugcauccuccagcuguucggcaagaagguggacgacggcagcgagcuguccagcgccuccaagacggaggugagcuccgucagcuccgugagccccgccuga

SEQ ID NO: 33980 - RNA, 1047 nt, Artificial Sequence
  derived and/or modified sequence opt1 from OPN1SW__Homo_sapiens__NP_001699
augcgcaagaugagcgaggaggaguucuaccuguucaagaacaucuccagcgugggccccugggacgggccgcaguaccacaucgcccccgucugggccuucuaccuccaggcggccuucaugggcaccguguuccugaucggguucccccugaacgccauggugcucgucgccacccugcgguacaagaagcugcgccagccccucaacuacauccuggugaacguguccuucggcggguuccugcucugcaucuucagcgucuucccgguguucguggccuccugcaacggcuacuucgucuucggccggcacgugugcgcgcuggagggguuccugggcacgguggccgggcucgucaccggcuggagccuggccuuccuggccuucgagcgcuacaucgugaucugcaagcccuucgggaacuuccgguucuccagcaagcacgcgcucaccgugguccuggccaccuggacgaucggcaucggcguguccaucccgcccuucuucggguggagccgcuucauccccgagggccugcagugcuccugcgggcccgacugguacaccgugggcaccaaguaccggagcgaguccuacaccugguuccucuucaucuucugcuucaucgucccccugagccugaucugcuucuccuacacgcagcuccugcgcgcccugaaggccguggccgcgcagcagcaggagagcgccaccacccagaaggccgagcgggaggugucccgcauggucguggugauggucggcagcuucugcgugugcuacguccccuacgccgccuucgcgauguacauggugaacaaccggaaccacgggcucgaccugcgccuggugaccaucccguccuucuucagcaagagcgccugcaucuacaaccccaucaucuacugcuucaugaacaagcaguuccaggccugcaucaugaagauggucugcggcaaggccaugacggacgaguccgacacgugcagcucccagaagaccgaggugagcaccguguccagcacccaggucgggcccaacuga

SEQ ID NO: 33981 - RNA, 1209 nt, Artificial Sequence
  derived and/or modified sequence opt1 from OPN3__Homo_sapiens__NP_055137
auguacagcggcaaccgcuccgggggccacggguacugggacggcgggggcgccgccggcgcggaggggcccgccccggccggcacccugagccccgcgccccucuucucccccgggaccuacgagcggcuggcccugcuccugggcagcaucgggcugcucggcgugggcaacaaccugcugguccucgugcuguacuacaaguuccagcgccugcggacgccgacccaccuccugcuggugaacaucucccucagcgaccugcuggucucccucuucggggugaccuucaccuucgugagcugccugcgcaacggcugggucugggacacgguggggugcgugugggacggcuucuccggcagccuguucgggaucgucuccaucgccacccucaccgugcuggccuacgagcgguacauccgcgugguccacgcccgggugaucaacuucagcugggccuggcgcgcgaucaccuacaucuggcuguacucccucgccugggccggcgcgccccugcugggguggaaccgguacauccucgacgugcacggccuggggugcacggucgacuggaaguccaaggacgccaacgacagcagcuucgugcuguuccucuuccugggcugccugguggucccccucggcgugaucgcccacugcuacgggcacauccuguacuccauccgcaugcugcggugcguggaggaccuccagaccauccaggucaucaagauccugaaguacgagaagaagcuggccaagaugugcuuccucaugaucuucaccuuccuggugugcuggaugcccuacaucgugaucugcuuccuggucgugaacggccacgggcaccucgucaccccgacgaucagcaucguguccuaccuguucgccaagagcaacaccguguacaaccccgucaucuacguguucaugauccgcaaguuccggcgcagccugcuccagcugcugugccuccggcugcugcgcugccagcggcccgccaaggaccugcccgccgcgggcuccgagaugcagauccgcccgaucgugaugagccagaaggacggggaccggcccaagaagaaggucaccuucaacuccagcuccaucaucuucaucaucaccagcgacgagucccucagcguggacgacuccgacaagacgaacggcagcaagguggacgucauccaggugcgcccccuguga

SEQ ID NO: 33982 - RNA, 1470 nt, Artificial Sequence
  derived and/or modified sequence opt1 from OPN4__Homo_sapiens__NP_001025186
augaacccgcccagcggcccccgcgugccgcccucccccacccaggagcccagcugcauggccacccccgcgcccccguccuggugggacagcucccagagcuccaucagcucccuggggcggcuccccagcaucucccccacggcccccggcaccugggccgccgccugggucccgcugcccaccguggacgugcccgaccacgcccacuacacccuggggacggucauccuccuggugggccugaccgggaugcucggcaaccugaccgugaucuacaccuucugccgcgcgguccugcggggcgugacggugaugaugcagagccgcucccuccggacccccgccaacauguucaucaucaaccuggccgucagcgacuuccugauguccuucacccaggccccgguguucuucaccagcucccucuacaagcaguggcuguucggggagacgggcugcgaguucuacgcguucugcggggcccuguucggcaucagcuccaugaucacccucaccgccaucgcccuggaccgcuaccuggugaucacccggccccucgccacguucggggucgcgagcaagcgccgggccgccuucgugcugcugggcguguggcucuacgcccuggccuggagccugccgcccuucuucggcugguccgcguacguccccgaggggcuccugaccagcugcuccugggacuacaugagcuucacccccgccgugcgcgccuacaccaugcugcucugcugcuucguguucuuccugccccugcucaucaucaucuacugcuacaucuucaucuuccgggccauccgcgagacgggccgggcccugcagaccuucggggcgugcaagggcaacggcgagucccuguggcagcgccagcggcuccagagcgagugcaagauggccaagaucaugcugcuggucauccuccuguucgugcuguccugggcccccuacagcgccguggcccucgucgcguucgccggguacgcccacgugcugaccccguacauguccagcgugcccgccgucaucgcgaaggccuccgccauccacaaccccaucaucuacgccaucacccaccccaaguaccgcguggccaucgcgcagcaccucccgugccugggcguccugcugggggugagccggcgccacucccggcccuaccccagcuaccgcuccacgcaccggagcacccucaccucccacaccagcaaccuguccuggaucagcauccgccgccggcaggagagccugggcuccgagagcgaggugggguggacgcacauggaggccgccgccgucuggggcgccgcgcagcaggccaacggccgcucccucuacgggcagggccuggaggaccuggaggccaaggccccgccccggccccaggggcacgaggccgagacccccggcaagaccaaggggcugaucccgagccaggacccccgcauguga

SEQ ID NO: 33983 - RNA, 1065 nt, Artificial Sequence
  derived and/or modified sequence opt1 from OPN5__Homo_sapiens__NP_859528
auggcccugaaccacaccgcccucccccaggacgagcgccugccgcacuaccugcgggacggcgaccccuucgcgagcaagcucuccugggaggccgaccugguggccggguucuaccugaccaucaucggcauccucagcacguucgggaacggcuacguccuguacauguccagccgccggaagaagaagcugcgccccgccgagaucaugaccaucaaccucgccgugugcgaccuggggaucuccguggucggcaagcccuucaccaucaucagcugcuucugccaccgguggguguucggcuggaucgggugccgcugguacggcugggcgggguucuucuucggcugcgggucccugaucaccaugacggccgugagccucgaccgguaccugaagaucugcuaccuguccuacggcgucuggcucaagcgcaagcacgccuacaucugccuggccgcgaucugggccuacgccagcuucuggaccaccaugccgcuggugggccucggggacuacgugcccgagcccuucggcaccuccugcacgcuggacugguggcuggcccaggccagcgucgggggccagguguucauccucaacauccuguucuucugccugcuccugcccaccgcggugaucgucuucuccuacgugaagaucaucgccaaggucaagagcuccagcaaggagguggcccacuucgacucccggauccacagcucccacgugcuggagaugaagcucaccaagguggccaugcugaucugcgccggcuuccugaucgcguggaucccguacgccgucgugagcguguggagcgccuucgggcgccccgacuccauccccauccagcucagcgucgugcccacccugcuggccaaguccgccgcgauguacaacccgaucaucuaccaggugaucgacuacaaguucgccugcugccagacgggcgggcucaaggccaccaagaagaagucccuggagggcuuccggcugcacaccgucaccacggugcgcaagagcagcgccguccucgagauccacgaggagugggaguga

SEQ ID NO: 33984 - RNA, 1143 nt, Artificial Sequence
  derived and/or modified sequence opt1 from OPRK1__Homo_sapiens__NP_000903
auggacagccccauccagaucuuccgcggcgagccggggcccacgugcgcccccuccgccugccugcccccgaacagcuccgcgugguuccccggcugggccgagcccgacagcaacggguccgccggcagcgaggacgcccagcucgagcccgcccacaucuccccggcgauccccgugaucaucaccgccgucuacagcgugguguucgucguggggcuggugggcaacucccuggucauguucgugaucauccgguacaccaagaugaagaccgccaccaacaucuacaucuucaaccucgcccuggcggacgcccuggugaccacgaccaugcccuuccagagcaccgucuaccucaugaacuccuggcccuucggcgacgugcugugcaagaucgugaucagcaucgacuacuacaacauguucaccuccaucuucacgcugaccaugaugagcgucgaccgcuacaucgccgugugccacccggugaaggcccucgacuuccggacgccccugaaggccaagaucaucaacaucugcaucuggcugcucuccagcuccgucgggaucagcgcgaucgugcugggcgggaccaaggugcgcgaggacgucgacgugaucgagugcucccugcaguuccccgacgacgacuacagcuggugggaccucuucaugaagaucugcguguucaucuucgccuucgucauccccgugcugaucaucaucgugugcuacacccugaugauccuccggcucaagagcguccgccugcuguccggcagccgggagaaggaccgcaaccugcggcgcaucacccggcuggugcucgucgugguggccgucuucguggugugcuggaccccgauccacaucuucauccuggucgaggcccugggguccaccagccacuccacggccgcgcucagcuccuacuacuucugcaucgcccugggcuacaccaacagcucccugaaccccauccucuacgccuuccuggacgagaacuucaagcgcugcuuccgggacuucugcuucccccugaagaugcgcauggagcggcagagcaccucccgcgugcggaacaccgugcaggaccccgccuaccuccgcgacaucgacggcaugaacaagccggucuga

SEQ ID NO: 33985 - RNA, 1113 nt, Artificial Sequence
  derived and/or modified sequence opt1 from OPRL1__Homo_sapiens__NP_001186948
auggagccccuguucccggcccccuucugggaggugaucuacggcagccaccuccaggggaaccugucccugcucagccccaaccacucccugcugcccccgcaccuccugcugaacgccagccacggcgcguuccucccccuggggcugaaggucaccaucgugggccucuaccuggccgugugcgucgggggccugcucggcaacugccuggugauguacgugauccugcgccacaccaagaugaagacggccaccaacaucuacaucuucaaccucgcccuggccgacacccugguccuccugacccugcccuuccaggggacggacauccuccugggcuucuggcccuucgggaacgcgcugugcaagaccgugaucgccaucgacuacuacaacauguucaccuccaccuucacgcucaccgccaugagcguggaccgguacgucgccaucugccacccgauccgcgcgcuggacgugcggaccuccagcaaggcccaggccgugaacgucgccaucugggcccuggcguccguggugggcguccccguggccaucauggggagcgcccagguggaggacgaggagaucgagugccucgucgagauccccacgccccaggacuacuggggcccgguguucgccaucugcaucuuccuguucuccuucaucgugcccguccuggugaucagcgugugcuacucccucaugauccgccggcugcgcggcguccggcugcucagcgggucccgcgagaaggaccggaaccugcgccggaucacccgccuggugcucgucgugguggccgucuucgugggcugcuggacccccgugcaggucuucgugcuggcgcaggggcugggcgugcagcccagcuccgagaccgccgucgccauccuccgguucugcaccgcccugggcuacgugaacagcugccugaacccgauccucuacgccuuccuggacgagaacuucaaggcgugcuuccgcaaguucugcugcgccuccgcccugcggcgcgacgugcaggucagcgaccgggugcgcagcaucgccaaggacguggcccucgcgugcaagacguccgagaccgucccccggcccgccuga

SEQ ID NO: 33986 - RNA, 1203 nt, Artificial Sequence
  derived and/or modified sequence opt1 from OPRM1__Homo_sapiens__NP_000905
auggacagcuccgccgcccccaccaacgcgagcaacugcaccgacgcccuggccuacuccagcugcuccccggcccccagccccggcuccugggugaaccucagccaccuggacgggaaccuguccgaccccugcggcccgaaccgcacggaccucgggggccgggacagccugugcccgcccaccgggucccccagcaugaucaccgccaucaccaucauggcgcuguacuccaucgucugcguggugggccucuucggcaacuuccuggucauguacgugaucgugcgcuacacgaagaugaagaccgccaccaacaucuacaucuucaaccuggcccucgccgacgcgcuggccaccagcacgcugcccuuccaguccgucaacuaccucauggggaccuggcccuucggcaccauccugugcaagaucgugaucagcaucgacuacuacaacauguucaccuccaucuucacgcugugcaccaugagcguggaccgguacaucgccgucugccaccccgugaaggcccucgacuuccgcacgccccggaacgccaagaucaucaacgugugcaacuggauccuguccagcgcgaucgggcugccggucauguucauggccaccaccaaguaccgccagggcagcaucgacugcacccucaccuucucccaccccaccugguacugggagaaccugcugaagaucugcguguucaucuucgccuucaucaugcccgugcucaucaucacggucugcuacgggcugaugauccugcggcucaagagcgugcgcaugcuguccggcagcaaggagaaggaccggaaccugcgccggaucacccgcauggugcucgucgugguggccgucuucaucgugugcuggacccccauccacaucuacgugaucaucaaggcccuggucaccaucccggagacgaccuuccagaccguguccuggcacuucugcaucgcgcugggcuacaccaacagcugccucaaccccguccuguacgccuuccuggacgagaacuucaagcggugcuuccgcgaguucugcauccccacguccagcaacaucgagcagcagaacuccacccggauccgccagaacacccgggaccaccccagcaccgccaacacgguggaccgcaccaaccaccagcucgagaaccuggaggccgagaccgccccgcugcccuga

SEQ ID NO: 33987 - RNA, 999 nt, Artificial Sequence
  derived and/or modified sequence opt1 from OPTC__Homo_sapiens__XP_011507708
augcgccugcucgccuuccugagccugcucgcccuggugcugcaggagaccggcaccgcgucccucccccggaaggagcgcaagcggcgcgaggagcagaugccgcgggagggggacagcuucgagguccugccccugcgcaacgacgugcucaaccccgacaacuacggcgaggugaucgaccuguccaacuacgaggagcugacggacuacggggaccagcuccccgaggucaaggugaccagccuggccccggccaccuccaucagccccgccaaguccaccacggcccccggcacccccagcuccaacccgaccaugacccggcccacgaccgcggggcugcuccugagcucccagcccaaccacggccugcccacgugccucgugugcgucugccugggcagcuccguguacugcgacgacaucgaccuggaggacaucccgccccucccccgccggaccgccuaccuguacgcccgcuucaaccggaucagccgcauccgggccgaggacuucaaggggcugaccaagcucaagcgcaucgaccuguccaacaaccugaucagcuccaucgacaacgacgcguuccggcuccugcacgcccugcaggaccucauccugcccgagaaccagcuggaggcccucccggugcugcccagcggcaucgaguuccuggacguccgccucaaccggcugcaguccagcgggauccagcccgccgccuuccgcgcgauggagaagcugcaguuccucuaccugagcgacaaccugcucgacuccauccccggcccgcugccccugagccuccgguccgugcaccuccagaacaaccugaucgagaccaugcagcgcgacguguucugcgaccccgaggagcacaagcacacccggcgccagcuggaggacauccgccuggacgggaaccccaucaaccugagccuguucccguccgccuacuucugccucccccggcugcccaucggccgcuucaccuga

SEQ ID NO: 33988 - RNA, 1734 nt, Artificial Sequence
  derived and/or modified sequence opt1 from OPTN__Homo_sapiens__NP_001008214
augagccaccagccccuguccugccucaccgagaaggaggacagcccguccgagagcaccggcaacgggccgccccaccuggcccaccccaaccuggacacguucacccccgaggagcuccugcagcagaugaaggagcugcucaccgagaaccaccagcugaaggaggccaugaagcugaacaaccaggcgaugaagggccgcuucgaggagcucuccgccuggaccgagaagcagaaggaggagcggcaguucuucgagauccagagcaaggaggccaaggagcgccugauggcccugucccacgagaacgagaagcucaaggaggagcuggggaagcugaagggcaagagcgagcgguccagcgaggaccccacggacgacucccgccucccccgggccgaggcggagcaggagaaggaccagcugcgcacccaggugguccggcugcaggccgagaaggccgaccuccuggggaucgugagcgagcugcagcucaagcugaacuccagcggcuccagcgaggacuccuucguggagauccgcauggccgagggcgaggcggaggggagcgucaaggagaucaagcacucccccggcccgacccggaccgugagcacggggaccgcccugagcaaguaccgcucccggagcgccgacggcgccaagaacuacuucgagcacgaggagcucaccgugucccagcugcugcucugccugcgcgaggggaaccagaaggucgagcggcuggagguggcccucaaggaggcgaaggagcgcgugagcgacuucgagaagaagaccuccaaccggagcgagaucgagacgcagaccgagggcuccaccgagaaggagaacgacgaggagaagggccccgagaccgucgggagcgagguggaggcccugaaccuccaggugacgucccuguucaaggagcugcaggaggcccacaccaagcugagcgaggccgagcucaugaagaagcgccugcaggagaagugccaggcccuggagcggaagaacuccgcgauccccagcgagcucaacgagaagcaggagcuggucuacaccaacaagaagcuggagcuccagguggaguccaugcugagcgagaucaagauggagcaggccaagaccgaggacgagaaguccaagcugacggugcuccagaugacccacaacaagcugcugcaggagcacaacaacgcccucaagaccaucgaggagcugacccgcaaggagagcgagaaggucgaccgggccgugcugaaggagcuguccgagaagcucgagcuggccgagaaggcgcuggccagcaagcagcuccagauggacgagaugaagcagacgaucgccaagcaggaggaggaccuggagaccaugaccauccugcgcgcccagauggagguguacugcuccgacuuccacgccgagcgggcggcccgcgagaagauccacgaggagaaggagcagcucgcccugcagcuggccguccuccugaaggagaacgacgcguucgaggacggcgggcgccagagccugauggagaugcagagccggcacggcgcccgcaccuccgacagcgaccagcaggccuaccucgugcagcggggcgccgaggaccgcgacuggcggcagcagcgcaacauccccauccacuccugcccgaagugcggggaggugcugcccgacaucgacacgcugcagauccacgucauggacugcaucaucuga

SEQ ID NO: 33989 - RNA, 912 nt, Artificial Sequence
  derived and/or modified sequence opt1 from OR10A2__Homo_sapiens__NP_001004460
augagcuucuccagccugcccaccgagauccagucccuccuguuccugaccuuccucacgaucuaccuggugacccugaugggcaacugccucaucauccuggucacccuggccgacccgaugcuccacagccccauguacuucuuccugcgcaaccuguccuuccucgagaucggguucaaccuggugaucgugcccaagaugcugggcacccuccuggcccaggacacgaccaucagcuuccuggggugcgcgacccagauguacuucuucuucuucuucggcgucgccgagugcuuccuccuggccaccauggccuacgaccgguacguggccaucugcagcccccugcacuacccggugaucaugaaccagcgcacgcgggcgaagcucgccgccgccuccugguuccccggguuccccgucgcgaccgugcagaccaccuggcuguucuccuuccccuucugcggcacgaacaaggugaaccacuucuucugcgacagcccgcccguccugcgccucgugugcgccgacaccgcccuguucgagaucuacgccaucgugggcaccauccuggucgugaugauccccugccuccugauccugugcuccuacacccacaucgccgcggccauccucaagauccccagcgccaaggggaagaacaaggccuucuccacgugcagcucccaccuccugguggucagccuguucuacaucucccugagccugaccuacuuccggccgaaguccaacaacagccccgagggcaagaagcuccugagccuguccuacaccgugaugacccccaugcucaaccccaucaucuacagccugcgcaacaacgaggugaagaacgcccugucccggacggucagcaaggcgcucgcccugcgcaacugcaucccguga

SEQ ID NO: 33990 - RNA, 948 nt, Artificial Sequence
  derived and/or modified sequence opt1 from OR10A4__Homo_sapiens__NP_997069
augaugugggagaacuggaccaucgugagcgaguucguccugguguccuucagcgcccucuccaccgagcugcaggcccugcuguuccugcuguuccucacgaucuaccuggugacccugaugggcaacguccucaucauccuggugaccaucgcggacagcgcccugcagucccccauguacuucuuccuccgcaaccugagcuuccuggagaucggguucaaccucgugaucgucccgaagaugcugggcacccugaucauccaggacacgaccaucuccuuccucgggugcgccacccagauguacuucuucuucuucuucggcgccgccgagugcugccugcuggcgaccauggccuacgaccgguacguggccaucugcgacccccuccacuaccccgugaucauggggcacaucagcugcgcccagcuggcggccgccuccugguucagcggcuucuccgucgccacggugcagaccaccuggaucuucagcuuccccuucugcggcccgaaccgcgugaaccacuucuucugcgacuccccgcccgucaucgcccuggugugcgcggacaccagcguguucgagcucgaggcccugacggccaccguccuguucauccucuuccccuuccugcugauccucggguccuacgugcggauccugagcaccaucuuccgcaugcccuccgccgagggcaagcaccaggccuucagcacgugcuccgcgcaccuccucguggucagccuguucuacagcaccgccauccugaccuacuuccggccccaguccagcgccuccagcgaguccaagaagcuccugagccuguccagcaccguggugacccccaugcucaaccccaucaucuacuccagccgcaacaaggaggucaaggccgcccugaagcggcugauccaccgcacgcucgggucccagaagcuguga

SEQ ID NO: 33991 - RNA, 939 nt, Artificial Sequence
  derived and/or modified sequence opt1 from OR10C1__Homo_sapiens__NP_039229
augagcgccaacaccuccauggugaccgaguuccugcuccugggcuucagccaccuggccgaccuccaggggcugcuguucuccgucuuccucacgaucuaccugcugaccguggcgggcaacuuccucaucgugguccuggugagcaccgacgccgcccugcagucccccauguacuucuuccuccgcacccugagcgcccuggagaucggguacacguccgugaccgucccgcuccugcugcaccaccuccugaccggccggcgccacaucagccgguccgggugcgcccugcagauguucuucuuccucuucuucggcgcgaccgagugcugccugcuggccgccauggccuacgaccgcuacgcggccaucugcgagccccuccgguacccccugcugcucagccaccgcgugugccugcagcuggccggcuccgccugggccugcggggugcucgucggccuggggcacacgcccuucaucuucagccugccguucugcggccccaacaccaucccccaguucuucugcgagauccagcccgugcuccagcuggugugcggggacaccucccugaacgagcuccagaucauccuggcgaccgcccugcucauccugugcccguucggccugauccucggcagcuacgggcggauccuggucacgaucuuccgcauccccuccguggccggccggcgcaaggccuucagcacgugcuccagccaccugaucauggugucccucuucuacgggaccgcccuguucaucuacauccggcccaaggcgagcuacgaccccgccaccgacccgcuggucagccucuucuacgccguggugacccccauccugaaccccaucaucuacucccugcgcaacaccgaggucaaggccgcccugaagcggaccauccagaagaccgugcccauggagaucuga

SEQ ID NO: 33992 - RNA, 963 nt, Artificial Sequence
  derived and/or modified sequence opt1 from OR10J1__Homo_sapiens__NP_036483
augcugcucugcuuccgcuucggcaaccagagcaugaagcgggagaacuucacccugaucaccgacuucguguuccagggguucuccagcuuccacgagcagcagaucacgcuguucggcguguuccucgcccuguacauccugacccucgccgggaacaucaucaucgugaccaucauccgcauggaccugcaccuccacacccccauguacuucuuccuguccaugcugagcacguccgagaccguguacacccuggucauccucccgcggaugcugagcucccuggugggcaugagccagcccaucucccucgcggggugcgccacccagauguucuucuucgugacguucggcaucaccaacugcuuccugcugaccgccaugggcuacgaccgcuacgucgccaucugcaacccccuccgguacauggugaucaugaacaagcgccugcggauccagcuggugcucggggccugcagcaucggccugaucgucgcgaucacccaggugacguccguguuccgccugcccuucugcgcccggaaggucccgcacuucuucugcgacauccgccccgugaugaagcucagcugcaucgacaccaccgugaacgagauccugacccugaucaucuccguccucgugcuggugguccccauggggcugguguucaucagcuacgugcucaucaucuccacgauccugaagaucgccagcgucgagggccggaagaaggccuucgcgaccugcgccucccaccugaccguggugaucguccacuacagcugcgccuccaucgccuaccucaagcccaagagcgagaacacccgcgagcacgaccagcugaucagcgugacguacaccgucaucaccccgcugcucaaccccgugguguacacccugcggaacaaggaggucaaggacgcccugugccgcgcggucgggggcaaguucuccuga

SEQ ID NO: 33993 - RNA, 990 nt, Artificial Sequence
  derived and/or modified sequence opt1 from OR10J3__Homo_sapiens__NP_001004467
augcccaagcugaacagcaccuucgugaccgaguuccucuucgagggcuucuccagcuuccgccggcagcacaagcuggucuucuucgugguguuccugacgcucuaccugcugacccucuccgggaacgucaucaucaugaccaucauccgccuggaccaccaccuccacaccccgauguacuucuuccugugcaugcugagcaucuccgagacgugcuacaccguggccaucaucccccacaugcugagcggccuccugaacccccaccagcccaucgccacccaguccugcgcgacccagcuguucuucuaccucacguucgggaucaacaacugcuuccugcugaccgugaugggcuacgaccgguacgucgccaucugcaacccgcuccgcuacagcgugaucauggggaagcgggccugcauccagcuggccuccggcagccugggcaucgggcucggcauggccaucgugcaggucaccuccguguucgggcugcccuucugcgacgcguucgugaucagccacuucuucugcgacguccgccaccuccugaagcuggccugcaccgacacgaccgugaacgagaucaucaacuucguggucuccgugugcgugcugguccuccccaugggccugguguucaucagcuacgugcugaucaucuccaccauccucaagaucgccagcgccgaggggcagaagaaggcguucgcgaccugcgccucccaccugacggucgugaucauccacuacggcugcgccagcaucaucuaccugaagcccaagucccagagcagccucggccaggaccggcugaucuccgugaccuacacccaccacagcccgaccgagcccugcugcguccagcccgaggagcagggcgggcagcgcugcuccgcccagagccgcggggccaagaacuccgugagccugaugaagcggggcugcgagggcuucuccuucgccuucaucaacauguacuga

SEQ ID NO: 33994 - RNA, 930 nt, Artificial Sequence
  derived and/or modified sequence opt1 from OR10J5__Homo_sapiens__NP_001004469
augaagcgcaagaacuucaccgaggugagcgaguucaucuuccugggcuucuccagcuucgggaagcaccagaucacccucuucgucguguuccugacgguguacauccugacccucgucgccaacaucaucaucgugaccaucaucugcaucgaccaccaccuccacacccccauguacuucuuccuguccaugcuggccagcuccgagacgguguacacccuggucaucgugccgcggaugcugcucagccugaucuuccacaaccagcccaucucccuggcgggcugcgccacccagauguucuucuucgugauccucgccaccaacaacugcuuccugcugacggccaugggguacgaccgcuacgucgccaucugccggccccuccgcuacaccgugaucaugagcaagggccugugcgcgcagcuggugugcggguccuucggcaucggccucaccauggccguccugcacgugaccgccauguucaaccugcccuucugcgggacgguggucgaccacuucuucugcgacaucuacccggugaugaagcucagcugcaucgacaccaccaucaacgagaucaucaacuacggcguguccagcuucgucaucuucgugcccaucgggcugaucuucaucuccuacgugcuggucaucagcuccauccuccagaucgccagcgcggagggccggaagaagaccuucgccacgugcgugucccaccugaccguggucaucgugcacugcgggugcgccagcaucgccuaccugaagcccaaguccgagagcagcaucgagaaggaccucguccuguccgugaccuacaccaucaucacgccccugcucaacccgguggucuacagccugcgcaacaaggaggugaaggacgcccugugccggguggucggccgcaacaucuccuga

SEQ ID NO: 33995 - RNA, 942 nt, Artificial Sequence
  derived and/or modified sequence opt1 from OR10K1__Homo_sapiens__NP_001004473
auggagcaggucaacaagaccguggugcgcgaguucgugguccugggcuucagcucccucgcccggcugcagcagcugcuguucgugaucuuccugcugcucuaccuguucacccuggggacgaacgccaucaucaucagcaccaucgugcucgaccgcgcgcugcacacccccauguacuucuuccuggccauccucuccugcagcgagaucugcuacaccuucgucaucgugccgaagaugcugguggaccugcucucccagaagaagacgaucagcuuccugggcugcgccauccagauguucuccuuccuguucuucgggagcucccacagcuuccuccuggccgccaugggcuacgaccgguacauggcgaucugcaacccccugcgcuacuccguccucauggggcacggcgugugcaugggccugauggccgccgccugcgcgugcggguucaccgugagccuggucaccaccucccucguguuccaccuccccuuccacagcuccaaccagcugcaccacuucuucugcgacaucagccccgugcucaagcuggccucccagcacagcggcuucucccagcuggucaucuucaugcucgggguguucgcccuggugaucccgcugcuccugauccuggucagcuacauccggaucaucagcgccauccucaagauccccuccagcgugggccgcuacaagacguucuccacgugcgccagccaccugaucguggucaccgugcacuacuccugcgcgagcuucaucuaccugcggcccaagaccaacuacaccuccagccaggacacccucaucuccgugagcuacaccauccugacgccccuguucaacccgaugaucuacucccuccgcaacaaggaguucaagagcgcccugcggcgcaccaucgggcagaccuucuacccccuguccuga

SEQ ID NO: 33996 - RNA, 939 nt, Artificial Sequence
  derived and/or modified sequence opt1 from OR10K2__Homo_sapiens__NP_001004476
auggagcgcgugaacgagaccgucgugcgggaggugaucuuccugggcuucagcucccucgcccgccugcagcagcugcuguucgucaucuuccugcugcucuaccuguucacccuggggacgaacgccaucaucaucagcaccaucgugcucgaccgggcgcugcacauccccauguacuucuuccuggccauccucuccugcagcgagaucugcuacaccuucaucaucgugccgaagaugcuggucgaccugcucucccagaagaagaccaucagcuuccugggcugcgccauccagauguucuccuuccuguuccucgggugcagccacuccuuccugcuggccgugaugggcuacgaccgcuacaucgccaucugcaacccccuccgguacagcgugcugauggggcacggcgucugcaugggccugguggcggccgccugcgccugcggguucacgguggcgcagaucaucaccucccucgucuuccaccuccccuucuacagcuccaaccagcugcaccacuucuucugcgacaucgcccccgugcucaagcuggccagccaccacaaccacuucucccagaucgugaucuucaugcugugcacccucguccuggccaucccgcugcuccugauccuggugagcuacgugcacauccucuccgccauccugcaguuccccagcacccugggccgcugcaaggcguucuccacgugcgucagccaccucaucaucgugaccgugcacuacgggugcgccagcuucaucuaccugcggccccaguccaacuacagcuccagccaggacgcccugaucuccgucagcuacaccaucaucacgccccucuucaacccgaugaucuacucccugcgcaacaaggaguucaagagcgcccugugcaagaucgugcggcgcaccaucucccuccuguga

SEQ ID NO: 33997 - RNA, 1008 nt, Artificial Sequence
  derived and/or modified sequence opt1 from OR10R2__Homo_sapiens__NP_001004472
augccccagauccugaucuucaccuaccucaacauguucuacuucuucccgccccugcagauccuggccgagaaccucaccauggugaccgaguuccugcugcucggcuucagcucccugggggagauccagcuggcccucuucgucguguuccuguuccuguaccucgugauccugagcggcaacgucaccaucaucuccgugauccaccuggacaagagccuccacacccccauguacuucuuccuggggauccuguccaccagcgagacguucuacaccuucgugauccuccccaagaugcugaucaaccugcucuccgucgcgcgcaccaucagcuucaacugcugcgcccugcagauguucuucuuccugggcuucgccaucaccaacugccuccugcugggggugaugggcuacgaccgguacgccgccaucugccacccgcuccacuaccccacgcugauguccuggcaggucugcggcaagcuggcggccgccugcgccaucgggggcuuccucgcgagccugaccguggugaaccugguguucucccuccccuucugcagcgccaacaaggucaaccacuacuucugcgacaucuccgccgugauccugcuggccugcaccaacaccgacgugaacgaguucgucaucuucaucugcggggugcucgugcuggucgugcccuuccuguucaucugcgugagcuaccucugcauccugcgcacgauccugaagaucccguccgccgagggccggcgcaaggcguucagcacgugcgccucccaccucagcgucgugaucgugcacuacgggugcgccuccuucaucuaccugcggcccaccgccaacuacgucagcaacaaggaccgccuggugaccgucaccuacaccaucgugacgccccuccugaaccccaugguguacagccugcggaacaaggacguccagcucgccauccgcaaggugcugggcaagaagggcucccugaagcuguacaacuga

SEQ ID NO: 33998 - RNA, 945 nt, Artificial Sequence
  derived and/or modified sequence opt1 from OR10T2__Homo_sapiens__NP_001004475
augcgcggcuucaacaagaccaccguggucacgcaguucauccuggugggguucagcucccucggcgagcugcagcugcuccuguucgugaucuuccugcuccuguaccugaccauccucgucgccaacgugaccaucauggccgugauccgguucagcuggacccugcacacgcccauguacggguuccuguucauccucuccuucagcgaguccugcuacaccuucgucaucaucccgcagcugcuggugcaccuccugagcgacaccaagaccaucuccuucauggcgugcgccacgcagcuguucuucuuccucggcuucgccugcaccaacugccugcugaucgccgugaugggguacgaccgcuacgucgccaucugccacccccuccgguacacccugaucaucaacaagcgccugggccucgagcugaucagccuguccggcgcgaccggguucuucaucgcccucguggccacgaaccugaucugcgacaugcgguucugcggccccaaccgcgugaaccacuacuucugcgacauggcccccgucaucaagcuggcgugcaccgacacccacgugaaggagcucgcccuguucagccuguccauccucgugaucauggucccguuccugcugauccucaucagcuacggguucaucgugaacaccauccugaagauccccuccgccgagggcaagaaggccuucgugacgugcgccagccaccugaccgucguguucgugcacuacgggugcgcguccaucaucuaccuccggcccaagagcaaguccgccagcgacaaggaccagcuggucgccgugaccuacaccguggucacgccccugcucaacccgcugguguacucccugcgcaacaaggaggucaagaccgcccucaagcgggugcugggcaugcccguggccaccaagaugagcuga

SEQ ID NO: 33999 - RNA, 981 nt, Artificial Sequence
  derived and/or modified sequence opt1 from OR10X1__Homo_sapiens__NP_001004477
auggugcugaacgucuacugcugcuucuuccagaucagcgacauccagaccaugaagaucaaccagaccauccucaaggaguucauccuggugggcuucuccguguacccccacguccagacguuccuguucgugguguucuucugccucuaccugcugacccucgccgggaaccugaucaucaugggccugaccugggucgaccgcagccuccacaccccgauguaccuguuccuguccgcccucagcuucuccgagacgugcuacacccugaccaucgugcccaagaugcuggaggaccuccuggcgaaggaccggagcaucuccgugaccgggugcagccugcagaugugcuucuuccucggccucgggggcacgaacugcaucauccugacccugaugggcuacgaccgcuuccuggccaucugcaacccccugcgguacccccuccugaugaccaacaucgucugcgggcagcugguggccuccgccugcaccgccggcuucuucaucagccucacggagaccgcgcugaucuuccgcgacuccuucugccggccgaaccuggugaagcacuucuucugccacaugcucgccgucauccgccugagcugcaucgacuccaaccacaccgaguucaucaucacccugaucagcguguccgggcuccugggcacgcugcuccugaucauccugaccgacguguucaucaucagcaccguccuccggauccccuccgccgaggggaagcagaaggccuucaccacgugcgcgagccaccugaccguggugaucauccacuucggcuucgccuccaucgucuaccugaagcccgaggccagcggcgacgacacccucaucgccgugcccuacaccgugaucacgccguuccugagccccaucaucuucucccugcgcaacaaggacaugaagaacgccuuccggcgcaugauggggaacaccgucgcgcucaagaaguga

SEQ ID NO: 34000 - RNA, 942 nt, Artificial Sequence
  derived and/or modified sequence opt1 from OR10Z1__Homo_sapiens__NP_001004478
augggccagaccaacgugaccagcuggcgcgacuucgucuuccugggguucuccagcuccggcgagcuccagcugcugcuguucgcccuguuccugagccucuaccuggugacgcugaccuccaacguguucaucaucaucgccauccggcucgacagccaccuccacacccccauguaccuguuccucuccuuccugagcuucuccgagaccugcuacacgcuggggaucaucccgcgcaugcucagcggccuggccgggggcgaccaggcgaucuccuacgucggcugcgccgcccagauguucuucagcgccuccugggcgugcaccaacugcuuccugcucgccgccaugggguucgaccgguacguggccaucugcgcgccccugcacuacgccagccacaugaaccccacccugugcgcccagcucgugaucaccuccuuccugacgggcuaccuguucgggcucggcaugacccuggucaucuuccaccugagcuucugcuccagccacgagauccagcacuucuucugcgacacgcccccggugcucucccuggccugcggggacaccggccccagcgagcugcgcaucuucauccucagccugcuggugcuccuggucuccuucuucuucaucaccaucagcuacgccuacauccuggcggccauccuccggauccccuccgccgagggccagaagaaggccuucagcacgugcgccucccaccugaccguggugaucauccacuacgggugcgcgagcuucgucuaccugcgccccaaggccuccuacagccucgagcgggaccagcugaucgccaugaccuacaccguggugaccccgcugcucaaccccaucgucuacucccugcgcaaccgggccauccagaccgcccugcgcaacgcguuccggggccgccuccuggggaagggcuga

SEQ ID NO: 34001 - RNA, 948 nt, Artificial Sequence
  derived and/or modified sequence opt1 from OR11A1__Homo_sapiens__NP_039225
auggagaucgugagcaccggcaacgagaccaucacggaguucguccugcucggguucuacgacauccccgagcugcacuuccuguucuucaucguguucaccgccguguacgucuucaucaucaucggcaacaugcucaucaucguggccguggucuccagccagcgccugcacaagccgauguacaucuuccuggcgaaccucuccuuccuggacauccuguacaccagcgccgugaugcccaagaugcucgagggguuccugcaggaggccaccaucuccguggccggcugccugcuccaguucuucaucuucgggagccuggccacggcggagugccugcuccuggccgucauggccuacgaccgguaccuggccaucugcuacccccuccacuacccccugcugaugggcccgcgccgguacaugggccucguggugaccaccuggcuguccggguucgucguggacggccugguggucgcgcucguggcccagcugcgcuucugcgggcccaaccacaucgaccaguucuacugcgacuucaugcuguucgugggccucgccugcagcgacccccgggucgcccaggugaccacgcugauccuguccguguucugccucaccauccccuucgggcugauccugaccagcuacgcccgcaucgucguggcggugcuccgggucccggccggcgccucccgccggcgcgccuucagcacgugcuccagccaccuggccguggucaccaccuucuacggcacccugaugaucuucuacguggcgcccuccgccgugcacagccagcuccuguccaaggucuucagccugcucuacaccguggugacgccccuguucaaccccgucaucuacaccaugcggaacaaggaggugcaccaggcccugcgcaagauccucugcaucaagcagaccgagacccuggacuga

SEQ ID NO: 34002 - RNA, 924 nt, Artificial Sequence
  derived and/or modified sequence opt1 from OR12D2__Homo_sapiens__NP_039224
augcugaacaccaccagcgugacggaguuccuccugcugggcgucaccgacauccaggagcuccagcccuuccuguucgugguguuccugaccaucuacuucaucuccgucaccgggaacggcgccgugcucaugaucgugaucagcgacccgcgccugcacucccugauguacuucuuccucgggaaccugagcuaccuggacaucugcuacuccacggucacccuccccaagaugcugcagaacuuccugagcacccacaaggccaucuccuuccucggcugcaucagccagcugcacuucuuccacucccuggggagcaccgaguccaugcuguucgcggugauggccuucgaccucagcguggccaucugcaagccccugcgguacacggucaucaugaacccccagcucugcacccagauggccaucaccaucugggugaucggcuucuuccacgcccugcugcacuccgugaugaccagccgccucaacuucugcggcuccaaccggauccaccacuuccugugcgacaucaagccgcugcucaagcuggcgugcgggaacacggagcugaaccaguggcuccugagcaccgucaccggcaccaucgccauggggcccuucuuccugacgcuccuguccuacuucuacaucaucaccuaccuguucuucaagacccgcagcugcuccaugcucugcaaggcccugagcacgugcgccagccacuucaugguggugauccuguucuacgcgcccguccucuucaccuacauccaccccgcccuggaguccuucauggaccaggaccggaucguggccaucauguacaccguggucaccccggugcugaacccccucaucuacacccugcgcaacaaggaggugaagggcgcccuggggcgggucauccgccggcucuga

SEQ ID NO: 34003 - RNA, 951 nt, Artificial Sequence
  derived and/or modified sequence opt1 from OR12D3__Homo_sapiens__NP_112221
auggagaacgugaccaccaugaacgaguuccuccuccugggccugacggggguccaggagcuccagcccuucuucuucggcaucuuccugaucaucuaccugaucaaccucaucgggaacggcagcauccuggugauggugguccuggagccgcagcuccacucccccauguacuucuuccuggggaaccugagcugccucgacaucuccuacagcuccgugacccugcccaagcugcucgugaaccuggucugcagccgccgggccaucuccuuccugggcugcaucacccagcuccacuucuuccacuuccugggcagcaccgaggccauccugcucgcgaucauggccuucgaccgcuucguggccaucugcaacccccugcgguacacggugaucaugaacccgcaggucugcauccugcucgccgccgcggccuggcugaucuccuucuucuacgcccugaugcacagcgugaugaccgcccaccucuccuucugcgggagccagaagcugaaccacuucuucuacgacgugaagccccugcucgagcuggcgugcuccgacacccugcucaaccaguggcugcugagcaucgucaccggcuccaucagcaugggggccuucuuccucacgcugcuguccugcuucuacgugaucggcuuccuccuguucaagaaccgcagcugccggauccugcacaaggcccucuccacgugcgccagccacuucaugguggucugccuguucuacgggcccgugggcuucaccuacauccgccccgccagcgcgaccuccaugauccaggaccggaucauggccaucauguacagcgccgugaccccgguccugaacccccucaucuacacccugcgcaacaaggaggugaugauggcccugaagaagaucuucggccggaagcuguucaaggacuggcagcagcaccacuga

SEQ ID NO: 34004 - RNA, 1044 nt, Artificial Sequence
  derived and/or modified sequence opt1 from OR13C3__Homo_sapiens__NP_001001961
augaucgugcagcugaucugcaccgucugcuuccucgccgugaacaccuuccacgugcgcagcuccuucgacuuccugaaggccgacgacaugggcgagaucaaccagacgcuggucagcgaguuccuccugcuggggcucuccggcuaccccaagaucgagaucguguacuucgcgcugauccuggugauguaccucgucauccugaucgggaacggcgugcugaucaucgccagcaucuucgacucccacuuccacaccccgauguacuucuuccucgggaaccugagcuuccuggacaucugcuacaccuccagcuccgugcccagcacccucgucucccugaucagcaagaagcggaacaucuccuucagcggcugcgccgugcagauguucuucggcuucgccaugggguccacggagugccugcuccugggcaugauggccuucgaccgcuacguggcgaucugcaacccccugcgguaccccaucauccucagcaaggucgccuacgugcugauggccuccgugagcuggcuguccgggggcaucaacagcgccguccagacccuccuggcgaugcgccugccguucugcgggaacaacaucaucaaccacuucgccugcgagauccucgccgugcugaagcuggccugcgccgacaucagccucaacaucaucaccauggugaucuccaacauggcguuccugguccugccccucauggugaucuucuucagcuacauguucauccuguacaccauccugcagaugaacuccgccacgggccggcgcaaggccuucagcacgugcuccgcccaccucaccguggucaucaucuucuacggcaccaucuucuucauguacgccaagcccaagagccaggaccugaucggggaggagaagcugcaggcgcucgacaagcugaucucccuguucuacggcguggugacccccaugcucaacccgauccuguacagccugcggaacaaggacgucaaggccgccgugaaguaccuccugaacaagaagcccauccacuga

SEQ ID NO: 34005 - RNA, 957 nt, Artificial Sequence
  derived and/or modified sequence opt1 from OR13C4__Homo_sapiens__NP_001001919
auggacaagaucaaccagaccuucgugcgcgaguucauccugcucggccugagcggguaccccaagcuggagaucaucuucuucgcccucauccuggucauguacguggugauccugaucggcaacgggguccucaucaucgccuccauccuggacagccggcugcacaugccgauguacuucuuccucggcaaccuguccuuccuggacaucugcuacaccacgagcuccauccccagcacccucgugucccugaucagcaagaagcgcaacaucuccuucagcgggugcgcggugcagauguucuucggcuucgccaugggcuccaccgagugcuuccugcucgggaugauggccuucgaccgguacgucgccaucugcaacccccugcgcuaccccaucaucaugaacaaggugguguacguccugcucaccagcguguccuggcugagcggcgggaucaacuccacggugcagaccagccuggccaugcgguggccguucugcggcaacaacaucaucaaccacuuccucugcgagauccuggcgguccugaagcucgccugcuccgacaucagcgugaacaucgugacccuggccgucuccaacaucgccuuccuggugcucccccugcuggugaucuucuucagcuacauguucauccucuacaccauccugcgcacgaacagcgcgaccgggcggcacaaggccuucuccacgugcagcgcccaccugaccgucgugaucaucuucuacggcaccaucuucuucauguacgccaagcccaagucccaggaccuccugggcaaggacaaccugcaggccaccgaggggcucgugagcauguucuacggcgucgugacccccaugcugaacccgaucaucuacucccugcgcaacaaggacgugaaggcggccaucaaguaccuccugagccggaaggccaucaaccaguga

SEQ ID NO: 34006 - RNA, 960 nt, Artificial Sequence
  derived and/or modified sequence opt1 from OR13F1__Homo_sapiens__NP_001004485
auguuccccgccaacuggaccagcgugaaggucuucuucuuccugggcuucuuccacuacccgaagguccaggugaucaucuucgccgugugccuccugauguaccugaucacccuccuggggaacaucuuccugaucuccaucacgauccucgacagccaccuccacacccccauguaccuguuccuguccaaccugagcuuccuggacaucugguacuccagcuccgcgcucagccccaugcuggccaacuucguguccggccgcaacaccaucagcuucuccgggugcgccacccagauguaccugagccucgccaugggcuccacggagugcgugcugcugcccaugauggccuacgaccgguacgucgcgaucugcaacccgcuccgcuaccccgugaucaugaaccggcggaccugcgugcagaucgccgccgggagcuggaugaccggcugccugaccgccauggucgagaugauguccgugcugccccucagccugugcggcaacuccaucaucaaccacuucacgugcgagauccuggcgauccucaagcuggugugcgucgacaccagccuggugcagcucaucaugcuggugaucuccguccugcuccugcccaugccgaugcugcucaucugcaucagcuacgccuucauccuggccagcauccugcgcaucuccagcguggaggggcgcuccaaggccuucagcacgugcaccgcccaccucaugguggucgugcuguucuacggcaccgcgcuguccaugcaccucaagcccagcgccguggacucccaggagaucgacaaguucauggcccuggucuacgccgggcagacccccaugcugaaccccaucaucuacagccuccggaacaaggaggugaagguggcccugaagaagcugcucauccgcaaccacuucaacaccgcguucaucuccauccugaaguga

SEQ ID NO: 34007 - RNA, 924 nt, Artificial Sequence
  derived and/or modified sequence opt1 from OR13G1__Homo_sapiens__NP_001005487
augaaccacagcguggucaccgaguucaucauccugggccucaccaagaagcccgagcugcaggggaucaucuuccuguucuuccucaucguguaccugguggccuuccugggcaacaugcucaucaucaucgccaagaucuacaacaacacgcugcacaccccgauguacgucuuccugcucacccuggcggugguggacaucaucugcaccacguccaucauccccaagaugcuggggaccaugcucaccagcgagaacaccaucuccuacgccggcugcaugagccagcuguuccuguucacguggucccucggggccgagaugguccuguucaccaccauggccuacgaccgcuacguggccaucugcuucccccugcacuacagcaccaucaugaaccaccacaugugcguggcgcuccuguccauggucauggccaucgccgugacgaacagcugggugcacaccgcccugaucaugcggcucaccuucugcggccccaacaccaucgaccacuucuucugcgagaucccgccccugcuggcgcucuccugcagccccguccgcaucaacgaggugaugguguacgucgccgacaucacgcuggccaucggcgacuucauccugaccugcaucuccuacggguucaucaucguggccauccuccggauccgcaccguggagggcaagcggaaggccuucagcacgugcuccagccaccugaccgucgugacccuguacuacucccccgugaucuacaccuacauccgcccggcgagcuccuacaccuucgagcgggacaaggucguggccgcccucuacacgcuggugacccccacccugaaccccauggucuacagcuuccagaaccgcgagaugcaggccgggauccggaagguguucgccuuccucaagcacuga

SEQ ID NO: 34008 - RNA, 939 nt, Artificial Sequence
  derived and/or modified sequence opt1 from OR13J1__Homo_sapiens__NP_001004487
auggagccccugaaccgcaccgaggugagcgaguucuuccucaagggcuucuccggguacccggcccuggagcaccuccuguucccccugugcagcgccauguaccuggucacccuccugggcaacacggcgaucauggccguguccgugcuggacauccaccuccacacccccgucuacuucuuccuggggaaccugagcacccucgacaucugcuacacccccacguucgugccgcugaugcuggugcaccuccuguccagccggaagaccaucuccuucgccgucugcgccauccagaugugccugagccucuccaccggcagcaccgagugccugcugcucgccaucacggcguacgaccgcuaccuggccaucugccagccccugcgguaccacgugcucaugucccaccgccugugcgugcugcucaugggggccgccuggguccugugccugcucaagagcgugaccgagauggugaucuccaugcggcugcccuucugcggccaccacgucgugagccacuucacgugcaagauccuggcggugcucaagcuggccugcggcaacaccuccgucagcgaggacuuccugcucgccggguccauccugcugcuccccgugccgcuggccuucaucugccugagcuaccuccugauccuggccaccauccuccgcgugcccuccgcggcccggugcugcaaggccuucagcacgugccuggcccaccuggccgucgugcuccuguucuacggcaccaucaucuucauguaccugaagcccaagagcaaggaggcgcacaucuccgacgagguguucaccguccuguacgccauggugaccaccaugcucaaccccaccaucuacagccugcgcaacaaggaggugaaggaggccgcccggaaggucugggggcgcucccgggccagccgcuga

SEQ ID NO: 34009 - RNA, 966 nt, Artificial Sequence
  derived and/or modified sequence opt1 from OR14J1__Homo_sapiens__NP_112208
auggugaaccugaccagcauguccggcuuccuccugaugggguucagcgacgagcgcaagcugcagauccuccacgcccuggucuuccuggugaccuaccuccuggcccugacgggcaaccuccugaucaucaccaucaucaccguggaccggcgccugcacucccccauguacuacuuccucaagcaccugagccugcucgaccugugcuucaucuccgucaccgugccgcagagcaucgcgaacucccugauggggaacggcuacaucagccucgugcagugcauccugcaggucuucuucuucaucgcccuggccuccagcgagguggccauccucacggugauguccuacgaccgguacgccgcgaucugccagccccugcacuacgagaccaucauggacccccgcgccugccggcacgccgucaucgccguguggaucgccgggggccugagcggccucaugcacgcggccaucaacuucuccaucccccugugcgggaagcgcgugauccaccaguucuucugcgacgucccgcagaugcugaagcucgccugcagcuacgaguucaucaacgagaucgcccuggcggccuucaccaccuccgccgccuucaucugccugaucagcaucgugcucuccuacauccggaucuucagcacggugcugcgcauccccuccgccgagggccggaccaaggucuucagcacgugccugccccaccucuucguggcgaccuucuuccugagcgccgccggguucgaguuccugcgccuccccuccgacagcuccagcaccguggaccuggucuucuccguguucuacaccgugaucccgcccacccugaaccccgucaucuacagccuccggaacgacuccaugaaggccgcccugcgcaagaugcugagcaaggaggagcucccccagcggaagaugugccugaaggcgauguucaagcuguga

SEQ ID NO: 34010 - RNA, 930 nt, Artificial Sequence
  derived and/or modified sequence opt1 from OR1A1__Homo_sapiens__NP_055380
augcgcgagaacaaccagagcuccacccuggaguucauccuccugggcgugaccgggcagcaggagcaggaggacuucuucuacauccuguuccucuucaucuaccccaucacgcugaucggcaaccugcucaucguccuggccaucugcagcgacgugcggcugcacaacccgauguacuuccuccuggccaaccugucccucguggacaucuucuucagcuccgucaccauccccaagaugcuggcgaaccaccuccucgggagcaaguccaucagcuucggcgggugccugacccagauguacuucaugaucgcccugggcaacaccgacuccuacauccucgccgccauggccuacgaccgcgcgguggccaucagccggccccugcacuacacgaccaucaugagcccccgcuccugcaucuggcugaucgccggcuccugggugaucgggaacgccaacgcgcucccgcacacccugcugaccgccagccucuccuucugcggcaaccaggaggucgccaacuucuacugcgacaucacgccccugcugaagcucagcugcuccgacauccacuuccacgugaagaugauguaccugggggugggcaucuucagcgucccccugcucugcaucaucguguccuacauccggguguucagcaccgucuuccaggugcccagcaccaagggggugcugaaggccuucuccacgugcggcagccaccugaccgucgugucccucuacuacggcaccgugauggggaccuacuuccgcccgcugaccaacuacagccugaaggacgccgucaucacggugauguacaccgcggugacccccaugcucaaccccuucaucuacucccugcggaaccgcgacaugaaggccgcccugcggaagcuguucaacaagcgcaucagcuccuga

SEQ ID NO: 34011 - RNA, 945 nt, Artificial Sequence
  derived and/or modified sequence opt1 from OR1C1__Homo_sapiens__NP_036485
auggagaagcgcaaccugaccgugguccgggaguucgugcuccugggccugcccagcuccgccgagcagcagcaccuccugagcgugcuguuccucugcauguaccuggccaccacgcuggggaacaugcucaucaucgcgaccaucggcuucgacucccaccuccacagcccgauguacuucuuccuguccaaccucgccuucgucgacaucugcuucaccagcaccacggugccccagaugguggucaacauccugaccgggaccaagaccaucuccuucgccggcugccugacgcagcuguucuucuucgugagcuucgugaacauggacucccugcugcucugcgucauggccuacgaccgcuacguggccaucugccacccccugcacuacaccgcgcggaugaaccugugccucugcgugcagcuggucgccgggcuguggcucgugaccuaccugcacgcccugcuccacaccgugcugaucgcccagcugagcuucugcgcguccaacaucauccaccacuucuucugcgaccucaacccccugcugcagcucagcugcuccgacgucagcuucaacgugaugaucaucuucgccgugggcggccugcuggcccucacgccgcuggucugcauccugguguccuacgggcucaucuucagcaccgugcugaagaucaccuccacccagggcaagcagcgcgccgucagcacgugcuccugccaccugagcguggugguccucuucuacgggaccgccaucgcgguguacuucagccccuccagcccccacaugcccgaguccgacacccugagcaccaucauguacuccauggucgccccgaugcugaaccccuucaucuacacgcuccggaaccgcgacaugaagcggggccugcagaagaugcugcucaagugcaccguguuccagcagcaguga

SEQ ID NO: 34012 - RNA, 939 nt, Artificial Sequence
  derived and/or modified sequence opt1 from OR1D2__Homo_sapiens__NP_002539
auggacggcgggaaccagagcgagggcuccgaguuccugcuccuggggaugagcgagucccccgagcagcagcgcauccuguucuggauguuccucagcauguaccuggugaccgucgugggcaacgugcugaucauccucgccaucuccagcgacucccggcugcacaccccggucuacuucuuccuggccaaccucagcuucacggaccuguucuucgugaccaacaccauccccaagaugcuggugaaccuccagucccacaacaaggcgaucagcuacgccgggugccugacccagcuguacuuccucgucucccugguggcccuggacaaccucauccuggccgugauggccuacgaccgcuacgucgcgaucugcugcccccugcacuacacgaccgccaugagccccaagcucugcauccugcugcucucccugugcugggugcugagcgugcucuacggccugauccacacccugcucaugacccgggucacguucugcggcucccgcaagauccacuacaucuucugcgagauguacgugcugcugcggauggccugcagcaacauccagaucaaccacaccgugcucaucgccaccgggugcuucaucuuccugaucccguucggcuucgucaucaucuccuacgugcugaucauccgcgcgauccuccggauccccagcguguccaagaaguacaaggccuucagcacgugcgccagccaccugggggccgucucccuguucuacggcacccucugcaugguguaccugaagccccugcacaccuacagcgugaaggacuccgucgccaccgugauguacgcgguggucacccccaugaugaacccguucaucuacagccuccgcaacaaggacaugcacggggcccugggccggcugcucgacaagcacuucaagcgccugacguga

SEQ ID NO: 34013 - RNA, 945 nt, Artificial Sequence
  derived and/or modified sequence opt1 from OR1E1__Homo_sapiens__NP_003544
augaugggccagaaccagaccagcaucuccgacuuccugcuccuggggcugcccauccagccggagcagcagaaccucugcuacgcccuguuccuggccauguaccucaccacgcugcugggcaaccuccugaucaucgugcugauccgccucgacagccaccuccacacccccauguaccuguuccuguccaaccugagcuucuccgaccugugcuucagcuccgucaccauccccaagcuccugcagaacaugcagaaccaggaccccagcaucccguacgcggacugccugacccagauguacuucuuccuccuguucggggaccuggaguccuuccuccugguggccauggccuacgaccgguacguggccaucugcuucccccugcacuacacggccaucaugagccccaugcucugccuggcgcuggucgcccucuccugggugcugaccaccuuccacgccaugcugcacacccuccugauggcccgccugugcuucugcgcggacaacgugaucccccacuucuucugcgacaugagcgcccuccugaagcuggccuucuccgacacgcgggucaacgagugggugaucuucaucaugggcgggcucauccuggugaucccguuccugcucauccugggcagcuacgcccgcaucgucuccagcauccugaaggugcccuccagcaagggcaucugcaaggccuucuccacgugcgggagccaccucagcguggucucccuguucuacggcaccgugaucgggcuguaccucugcagcuccgcgaacagcuccacccugaaggacaccgugauggccaugauguacaccgucgugacccccaugcugaaccccuucaucuacagccugcggaaccgcgacaugaagggcgcccucucccgggugauccaccagaagaagaccuucuucagccuguga

SEQ ID NO: 34014 - RNA, 972 nt, Artificial Sequence
  derived and/or modified sequence opt1 from OR1E2__Homo_sapiens__NP_003545
augaugggccagaaccagaccagcaucuccgacuuccugcuccuggggcugcccauccagccggagcagcagaaccucugcuacgcccuguuccuggccauguaccucaccacgcugcugggcaaccuccugaucaucgugcugauccgccucgacagccaccuccacacccccgucuaccuguuccuguccaaccugagcuucuccgaccugugcuucagcuccgugaccaugcccaagcuccugcagaacaugcagaaccaggaccccagcaucccguacgcggacugccugacccagauguacuucuuccucuacuucuccgaccuggagagcuuccugcucguggccauggccuacgaccgguacgucgccaucugcuuccccaugcacuacacggccaucugcuuccugcugcacuacaccgcgaucaugucccccaugcucugccugagcgugguggcccuguccuggguccucaccaccuuccacgccaugcugcacacgcugcucauggcccgccugugcuucugcgcggacaacgugaucccccacuucuucugcgacaugagcgcccugcucaagcuggccugcuccgacacccgggugaacgagugggucaucuucaucaugggcgggcugauccucgugaucccguuccugcugauccucgggagcuacgcccgcaucguguccagcauccugaagguccccuccagcaagggcaucugcaaggccuucagcacgugcggcucccaccugagcguggugucccucuucuacgggaccgucaucggccuguaccugugccccagcgcgaacuccagcacccucaaggacaccgugauggccaugauguacaccguggucacccccaugcugacgccguucaucuacucccugcggaaccgcgacaugaagggggcccuggagcgggugaucugcaagcgcaagaaccccuuccuccuguga

SEQ ID NO: 34015 - RNA, 942 nt, Artificial Sequence
  derived and/or modified sequence opt1 from OR1J2__Homo_sapiens__NP_473448
augagccccgagaaccaguccagcguguccgaguuccugcuccugggccugccgauccgccccgagcagcaggccgucuucuucacccucuuccuggggauguaccugaccacggugcucggcaaccugcugaucaugcuccugauccagcuggacagccaccuccacacccccauguacuucuuccugucccaccuggcccucaccgacaucagcuucuccagcgugaccguccccaagaugcugauggacaugcggacgaaguacaaguccauccuguacgaggagugcaucagccagauguacuucuucaucuucuucaccgaccucgacuccuuccugaucaccagcauggcguacgaccgcuacguggccaucugccacccgcugcacuacaccgugaucaugcgggaggagcucugcgucuuccugguggccguguccuggauccugagcugcgccuccagccucucccacacgcugcugcucacccgccugagcuucugcgccgcgaacaccaucccccacgucuucugcgaccuggccgcccuccugaagcuguccugcagcgacaucuuccucaacgagcuggugauguucaccgugggggucguggugaucacgcugcccuucaugugcauccucgucagcuacggcuacaucggggccaccauccugcgggugcccuccaccaagggcauccacaaggcgcugagcacgugcggcucccaccucagcguggucucccuguacuacgggagcaucuucggccaguaccuguucccgaccguguccagcuccaucgacaaggacgugaucgucgcccucauguacaccguggugacccccaugcugaaccccuucaucuacagccugcgcaaccgggacaugaaggaggcccucgggaagcuguucucccgcgccaccuucuucagcugguga

SEQ ID NO: 34016 - RNA, 951 nt, Artificial Sequence
  derived and/or modified sequence opt1 from OR1K1__Homo_sapiens__NP_543135
auggaggccgccaacgagagcuccgagggcaucagcuucgugcugcucgggcugaccaccucccccggccagcagcgcccgcuguucguccucuuccugcugcucuacguggcgagccugcuggggaacggccucaucguggccgccauccaggccucccccgcccugcacgcgcccauguacuuccugcucgcccaccugagcuucgccgaccugugcuucgccuccgucacggugcccaagaugcucgcgaaccugcuggcccacgaccacagcaucucccucgccgggugccugacccagauguacuucuucuucgcccugggcgugaccgacagcugccuccuggccgcgauggccuacgacugcuacgucgccauccggcacccgcugcccuacgccacccgcaugucccgggccaugugcgcggcccucgugggcauggccuggcuggugagccacguccacucccugcucuacauccugcugauggcccgccucagcuucugcgccucccaccaggugccccacuucuucugcgaccaccagccccugcugcggcucagcugcuccgacacgcaccacauccagcugcugaucuucaccgagggggcggccguggucgugaccccguuccuccugauccuggccagcuacggcgccaucgccgcggccgugcuccagcugcccuccgccagcgggcgccugcgggccgucagcacgugcggcucccaccucgcgguggugagccuguucuacgggaccgucaucgccguguacuuccaggccaccucccgccgggaggccgaguggggccgcguggccaccgucauguacaccguggugacgcccaugcugaaccccaucaucuacagccucuggaaccgggacguccagggcgcgcugcgcgcccugcucaucgggcggcgcaucuccgccagcgacuccuga

SEQ ID NO: 34017 - RNA, 930 nt, Artificial Sequence
  derived and/or modified sequence opt1 from OR1L8__Homo_sapiens__NP_001004454
auggagcgcaucaaccacaccagcuccgugagcgaguucauccugcucggccuguccagccggcccgaggaccagaagacccuguucguccucuuccugaucguguaccuggugacgaucaccgggaaccuccugaucauccuggccauccgcuucaacccgcaccuccagacccccauguacuucuuccuguccuuccugagccucaccgacaucugcuucacgaccuccgucgugcccaagaugcugaugaacuuccugagcgagaagaagaccaucuccuacgccggcugccucacccagauguacuuccuguacgcgcuggggaacagcgacuccugccuccuggccgugauggccuucgaccgguacgucgccgugugcgaccccuuccacuacgugacgaccaugagccaccaccacugcguccugcucguggccuucuccugcagcuucccgcaccuccacucccugcugcacacccugcugcucaaccgccugaccuucugcgacagcaacgugauccaccacuuccugugcgaccucucccccguccugaagcugagcugcuccagcaucuucgugaacgagaucgugcagaugacggaggcgcccaucguccucgugacccgguuccugugcaucgccuucagcuacauccgcauccugaccaccgugcucaagauccccuccacgagcggcaagcggaaggccuucuccacgugcggguucuaccugaccgucgugacccuguucuacggcagcaucuucugcguguaccuccagccgcccuccaccuacgccgucaaggaccacguggcgaccaucguguacaccguccugagcuccaugcugaaccccuucaucuacagccuccgcaacaaggaccugaagcagggccugcggaagcucauguccaagcgcagcuga

SEQ ID NO: 34018 - RNA, 942 nt, Artificial Sequence
  derived and/or modified sequence opt1 from OR1M1__Homo_sapiens__NP_001004456
auggagccccgcaaccagaccagcgccucccaguucauccugcucggccugagcgagaagccggagcaggagacccuccuguucucccuguucuucugcauguaccuggugauggucguggggaaccuccugaucauccuggccaucagcaucgacucccaccuccacacgcccauguacuucuuccuggcgaaccugagccucguggacuucugccuggccaccaacaccauccccaagaugcuggucucccuccagaccggcagcaaggccaucuccuaccccugcugccugauccagauguacuucuuccacuucuucgggaucguggacagcgugaucaucgccaugauggccuacgaccgguucgucgcgaucugccacccgcugcacuacgccaagaucaugucccuccgccugugccggcugcucgugggcgcccugugggccuucagcugcuucaucucccugacgcacauccuccugauggcgcgccugguguucugcgggagccacgaggucccccacuacuucugcgaccucacccccauccugcggcuguccugcaccgacaccagcgugaaccgcaucuucauccucaucguggccggcauggucaucgccacgcccuucgugugcauccuggccuccuacgcccggauccugguggcgaucaugaaggucccgagcgccggcgggcgcaagaaggccuucuccacgugcagcagccaccucuccgugguggcccuguucuacggcaccaccaucggggucuaccugugccccagcuccgugcucaccaccgugaaggagaaggccagcgcggucauguacaccgccgugacccccaugcugaaccccuucaucuacucccugcggaaccgcgaccucaagggcgcccugcggaagcuggugaaccgcaagaucacgagcuccagcuga

SEQ ID NO: 34019 - RNA, 936 nt, Artificial Sequence
  derived and/or modified sequence opt1 from OR1N1__Homo_sapiens__NP_036495
auggagaaccagagcuccaucagcgaguucuuccugcgcggcaucuccgcgcccccggagcagcagcagagccucuucgggaucuuccugugcauguaccuggugacccucaccggcaaccugcugaucauccucgccaucggguccgaccugcaccuccacacgcccauguacuucuuccuggccaaccugagcuucgucgacaugggccugaccuccagcaccgugaccaagaugcucgugaacauccagacgcggcaccacaccaucuccuacaccgggugccugacccagauguacuucuuccugauguucggcgaccucgacagcuucuuccuggccgccauggccuacgaccgcuacgucgccaucugccacccccugugcuacuccacggugaugcggccccaggugugcgcgcucaugcuggcccugugcuggguccucaccaacaucguggcccugacccacaccuuccugauggcccgccucagcuucugcgugacgggcgagaucgcgcacuucuucugcgacaucaccccgguccugaagcuguccugcagcgacacccacaucaacgagaugaugguguucgugcucgggggcaccguccugaucgugcccuuccugugcaucgugacguccuacauccacaucguccccgccauccuccgggugcgcacccgcgggggcguggggaaggccuucagcacgugcuccagccaccugugcgucgugugcguguucuacggcacccuguucuccgccuaccucugcccgcccagcaucgccagcgaggagaaggacaucgcggccgccgccauguacaccaucgucacccccaugcugaaccccuucaucuacucccugcggaacaaggacaugaagggcgcccucaagcggcuguucagccaccgcuccaucgugagcuccuga

SEQ ID NO: 34020 - RNA, 993 nt, Artificial Sequence
  derived and/or modified sequence opt1 from OR1N2__Homo_sapiens__NP_001004457
auggagggcuucuaccugcgccggagccacgagcuccaggggaugggcaagcccgggcgcgugaaccagaccaccgucuccgacuuccugcugcucggccugagcgaguggccggaggagcagccccugcuguucgggaucuuccugggcauguaccuggugacgauggugggcaaccuccugaucauccuggccaucuccagcgacccccaccuccacacccccauguacuucuuccuggccaaccugucccucaccgacgcgugcuucaccagcgccuccaucccgaagaugcuggccaacauccacacgcagagccagaucaucuccuacagcgggugccuggcccagcucuacuuccugcugauguucggcgggcucgacaacugccugcuggccgucauggcguacgaccgguacguggccaucugccagccccuccacuacuccaccagcaugagcccccagcugugcgcccugaugcucggcgugugcuggguccugaccaacugccccgcccugaugcacacccuccugcugacgcgcguggcguucugcgcccagaaggccaucccgcacuucuacugcgaccccuccgcccuccugaagcuggccugcuccgacacccacgugaacgagcucaugaucaucaccauggggcugcuguuccucaccgucccccugcugcucaucguguucagcuacgugcggaucuucugggcggucuucgugaucuccagccccggcggccgcuggaaggccuucuccacgugcgggagccaccugaccgugguccuccucuucuacggcagccugauggggguguaccugcucccgcccuccaccuacagcaccgagcgggagucccgcgccgccgugcuguacauggucaucauccccacgcugaaccccuucaucuacagccugcggaaccgcgacaugaaggaggcccucggcaagcuguucguguccggcaagaccuucuuccuguga

SEQ ID NO: 34021 - RNA, 933 nt, Artificial Sequence
  derived and/or modified sequence opt1 from OR2A25__Homo_sapiens__NP_001004488
augggcgggaaccagaccagcaucaccgaguuccugcuccugggcuuccccaucgggccgcgcauccagaugcugcuguucggccuguucucccuguucuacaucuucauccuccuggggaacggcacgauccugggccucaucagccuggacucccggcugcacacccccauguacuucuuccucagccaccuggccguggucgacaucgccugcgcgugcuccaccgugccccagaugcuggugaaccuccugcaccccgccaagccgaucagcuucgccgggugcaugacccagauguuccuguuccucuccuucgcccacacggagugccugcugcucgucgugaugagcuacgaccgcuacguggccaucugccacccccugcgguacuccaccaucaugaccuggaaggucugcaucacccuggcgcucacgagcuggauccugggcgugcugcucgcccuggugcaccugguccuccugcugccccucuccuucugcgggccccagaagcugaaccacuucuucugcgagaucauggccgugcugaagcucgccugcgcggacacccacaucaacgaggugaugguccuggccggcgccgugagcgugcuggucggggccuucuucuccaccgugaucagcuacgugcacauccucugcgccauccugaagauccaguccggcgagggcugccagaaggcguucagcaucugcuccagccaccugugcgucgugggccucuucuacgggaccgccaucaucauguacguggagccgcaguacgagucccccaaggagcagaagaaguaccugcuccucuuccacagccuguucaaccccaugcugaacccccucaucuacagccugcgcaacaaggagguccaggggacgcugaagcggaugcuggagaagaagcgcaccuccuga

SEQ ID NO: 34022 - RNA, 951 nt, Artificial Sequence
  derived and/or modified sequence opt1 from OR2AG1__Homo_sapiens__NP_001004489
auggagcuguggaacuucacccucggcagcggguucauccuggugggcauccugaacgacuccgggagccccgagcuccugugcgccaccaucacgauccuguaccuccuggcccugaucuccaacggccuccugcugcucgcgaucaccauggaggcccgccugcacaugccgauguaccugcuccuggggcagcugagccucauggaccugcuguucaccuccgucgugacccccaaggcccucgccgacuuccugcggcgcgagaacacgaucagcuucggcggcugcgcccugcagauguuccucgcgcugaccaugggcggggccgaggaccugcuccuggccuucauggccuacgaccgguacguggcgaucugccacccccugaccuacaugacccucauguccagccgcgccugcuggcugauggucgccacguccuggauccuggccagccucuccgcccugaucuacaccguguacaccaugcacuaccccuucugccgggcgcaggagauccgccaccuccugugcgagaucccgcaccuccugaagguggccugcgccgacaccagccgguacgagcugauggucuacgugaugggggugacguuccugauccccucccuggccgccauccucgcgagcuacacccagauccugcugaccguccuccacaugcccuccaacgagggccgcaagaaggcccuggugaccugcagcucccaccugacgguggucgggauguucuacggcgccgccaccuucauguacgugcuccccagcuccuuccacagcacccggcaggacaacaucaucagcguguucuacaccaucgucacgccggcccugaacccccugaucuacucccugcgcaacaaggaggugaugcgggcgcuccgccgggugcugggcaaguacaugcugcccgcccacagcacccucuga

SEQ ID NO: 34023 - RNA, 1008 nt, Artificial Sequence
  derived and/or modified sequence opt1 from OR2AK2__Homo_sapiens__NP_001004491
augaacaucagcgacgugaucuccuucgacauccuggucagcgccaugaagaccggcaaccaguccuucgggaccgacuuccuccuggugggccuguuccaguacggguggaucaacagccuccuguucguggucaucgccacgcuguucaccguggcgcucaccggcaacaucaugcugauccaccugauccgccucaacacccggcugcacacgcccauguacuuccugcucucccagcugagcaucguggaccugauguacaucuccaccaccgucccgaagauggccgugagcuuccucucccagagcaagaccauccgcuuccuggggugcgagauccagacguacguguuccuggcccucggcggcaccgaggcccugcugcucggguucauguccuacgaccgguacgucgccaucugccacccccugcacuaccccaugcugaugagcaagaagaucugcugccucaugguggcgugcgccugggccuccggcagcaucaacgccuucauccacacccuguacguguuccagcugcccuucugccgcucccggcucaucaaccacuucuucugcgaggucccggcgcugcugagccucgugugccaggacaccucccaguacgaguacacggugcugcugagcgggcucaucauccugcugcuccccuuccuggccauccuggccuccuacgcccgcguccucaucgugguguuccagaugagcagcggcaaggggcaggccaaggcggucuccacgugcagcucccaccugaucguggccagccuguucuacgccaccacccucuucaccuacacccggccccacucccugcgcagccccucccgggacaaggccguggccgucuucuacaccaucgugaccccgcugcucaaccccuucaucuacagccugcgcaacaaggaggugacgggcgcgguccggcgccugcucggcuacuggaucugcugccggaaguacgacuuccgcucccuguacuga

SEQ ID NO: 34024 - RNA, 963 nt, Artificial Sequence
  derived and/or modified sequence opt1 from OR2AT4__Homo_sapiens__NP_001005285
auggacgccaccgccugcaacgagagcguggacggcucccccgucuucuaccugcucgggaucccgagccugcccgagaccuucuuccugcccguguucuucaucuuccuccuguucuaccugcucauccugaugggcaacgcgcugauccucguggccgucguggccgagcccucccugcacaagccgauguacuucuuccugaucaaccucagcacgcuggacauccuguucaccaccaccacggugcccaagaugcucucccuguuccugcucggggaccgcuuccugagcuucuccagcugccugcuccagauguaccuguuccaguccuucacgugcagcgaggccuucauccuggucgugauggccuacgaccgguacguggcgaucugccacccccuccacuaccccguccugaugaacccgcagaccaacgccacccuggccgccuccgcguggcucaccgcccugcugcuccccauccccgccguggugcgcaccagccagauggccuacaacuccaucgccuacaucuaccacugcuucugcgaccaccuggcggucgugcaggccagcugcuccgacaccacgccccagacccugaugggcuucugcaucgccaugguggucagcuuccucccgcugcugcucgugcugcuguccuacgugcacauccucgccagcguccugcggaucuccagccuggaggggcgcgccaaggcguucagcacgugcuccagccaccuccugguggugggcaccuacuacuccagcaucgccaucgccuacgucgccuaccgggccgaccugccccucgacuuccacaucaugggcaacgugguguacgcgauccugacccccauccugaacccccucaucuacacccugcgcaaccgggacgucaaggccgccaucaccaagaucaugucccaggacccggggugcgaccgcagcaucuga

SEQ ID NO: 34025 - RNA, 1074 nt, Artificial Sequence
  derived and/or modified sequence opt1 from OR2B2__Homo_sapiens__NP_149046
augaacugggugaacaagagcgucccccaggaguucauccugcucguguucuccgaccagccguggcuggagaucccgcccuucgugauguuccuguucagcuacauccucaccaucuucggcaaccugaccaucauccuggucucccacguggacuucaagcuccacacgcccauguacuucuuccugagcaaccugucccuccuggaccugugcuacaccaccagcaccgugccccagaugcucgucaacaucugcaacacgcgcaaggugaucuccuacgggggcugcguggcccagcuguucaucuuccuggcccucgggagcaccgagugccugcugcucgcggucaugugcuucgaccgguucguggccaucugccgcccccugcacuacuccaucaucaugcaccagcggcugugcuuccagcucgccgccgccagcuggaucuccggcuucagcaacuccgugcugcagagcaccuggacccugaagaugccccucugcgggcacaaggaggucgaccacuucuucugcgaggugcccgcgcugcugaagcucuccugcguggacacgaccgccaacgaggccgagcuguucuucaucagcguccuguuccuccugaucccggugacccugauccucaucuccuacgccuucaucgugcaggcgguccugcgcauccagagcgccgagggccagcggaaggccuucgggaccugcggcucccaccugaucguggugagccucuucuacggcacggccaucagcauguaccugcagccgcccucccccagcuccaaggaccgcgggaagauggucagccuguucugcggcaucaucgcccccaugcucaacccccugaucuacacccugcggaacaaggaggugaaggaggcguucaagcgccucguggccaagucccugcugaaccaggagauccggaacaugcagaugaucagcuucgccaaggacaccguccucaccuaccugacgaacuucuccgccagcugccccaucuucgugaucaccaucgagaacuacugcaaccugccccagcgcaaguucccguga

SEQ ID NO: 34026 - RNA, 942 nt, Artificial Sequence
  derived and/or modified sequence opt1 from OR2B3__Homo_sapiens__NP_001005226
augaacugggagaacgagagcucccccaaggaguucauccugcucggcuucagcgaccgcgccuggcugcagaugccccuguucgugguccuccugaucuccuacaccaucaccaucuucgggaacgugagcaucaugauggugugcauccuggaccccaagcuccacacgcccauguacuucuuccugaccaaccuguccauccucgaccugugcuacaccaccacgaccgucccccacaugcuggugaacaucggcugcaacaagaagaccaucagcuacgccgggugcguggcgcaccucaucaucuuccuggcccugggcgccaccgagugccuccugcuggccgucauguccuucgaccgguacguggccgugugccgcccgcuccacuacgucgugaucaugaacuacugguucugccugcggauggcggccuucagcuggcugaucggguucggcaacuccgugcuccagagcucccugacgcugaacaugccccgcugcggccaccaggaggucgaccacuucuucugcgaggugcccgcccuccugaagcugagcugcgccgacaccaagcccaucgaggcggagcuguucuucuucuccgugcucauccugcucaucccggucacccugauccugaucagcuacggguucaucgcccaggccgugcucaagauccgguccgccgagggccgccagaaggccuucgggaccugcggcagccacaugaucguggucucccuguucuacgggacggcgaucuacauguaccugcagccgcccagcuccaccagcaaggacuggggcaagauggugagccucuucuacggcaucaucaccuccaugcugaacagccugaucuacucccuccggaacaaggacaugaaggaggccuucaagcgccugaugccccggaucuucuucugcaagaaguga

SEQ ID NO: 34027 - RNA, 942 nt, Artificial Sequence
  derived and/or modified sequence opt1 from OR2B6__Homo_sapiens__NP_036499
augaacugggugaacgacagcaucauccaggaguucauccugcucggcuucuccgaccgccccuggcuggaguucccgcugcucgucguguuccugaucagcuacaccgugaccaucuucgggaaccugacgaucauccucgucucccggcuggacaccaagcugcacacccccauguacuucuuccucaccaaccugagccugcucgaccugugcuacacgaccugcaccgugccccagaugcuggugaaccucugcuccauccgcaaggucaucagcuaccggggcugcguggcccagcuguucaucuuccuggcccucggggcgaccgaguaccugcugcucgccgugauguccuucgaccgcuucgucgccaucugccggccccugcacuacagcgugaucaugcaccagcgccugugccuccagcuggccgccgcguccugggugacgggcuucagcaacuccgucuggcugagcacccucacccugcagcugccgcucugcgaccccuacgugaucgaccacuuccugugcgaggugcccgcccugcucaagcuguccugcgucgagaccacggccaacgaggccgagcuguuccucgugagcgagcuguuccaccugaucccccucacccugauccugaucuccuacgcguucaucgugcgggccguccuccgcauccagagcgccgaggggcggcagaaggccuucgggaccugcggcucccaccugaucguggugagccuguucuacuccaccgccgucagcguguaccuccagccgcccagccccuccagcaaggaccagggcaagauggugucccuguucuacggcaucaucgcgcccaugcugaacccgcucaucuacacgcugcgcaacaaggaggucaaggagggguucaagcggcugguggcccgcgucuuccugaucaagaaguga

SEQ ID NO: 34028 - RNA, 939 nt, Artificial Sequence
  derived and/or modified sequence opt1 from OR2C1__Homo_sapiens__NP_036500
auggacggcgugaacgacagcucccugcagggguucguccucaugggcaucagcgaccacccccagcuggagaugaucuucuucaucgccauccuguucuccuaccuccugacccugcucgggaacagcaccaucauccugcugucccgccucgaggcccggcugcacacgccgauguacuucuuccugagcaaccucuccagccuggaccuggcguucgccaccuccagcgugccccagaugcucaucaaccuguggggccccgggaagaccaucuccuacggcggcugcaucacccagcuguacguguuccucuggcugggggccacggagugcauccugcucgucgugauggccuucgaccgcuacguggccgucugccggccccugcgcuacaccgcgaucaugaacccgcagcugugcuggcuccuggccgugaucgccugccugggcgggcucggcaacagcgugauccaguccaccuucacccugcagcugccccucugcgggcaccggcgcgucgagggcuuccugugcgaggugcccgccaugaucaagcuggcgugcggcgacacgagccucaaccaggccgugcugaacggggucugcaccuucuucaccgccgugccccuguccaucaucgugaucagcuacugccucaucgcccaggccguccugaagauccgguccgcggagggccgccggaaggccuucaacacgugccugagccaccuccuggugguguuccuguucuacggguccgccagcuacggcuaccuccugccggccaagaacagcaagcaggaccagggcaaguucaucucccuguucuacagccucgucacccccauggugaacccccugaucuacacccugcgcaacauggaggugaagggggcccuccggcgccugcugggcaaggggcgggaggucggcuga

SEQ ID NO: 34029 - RNA, 954 nt, Artificial Sequence
  derived and/or modified sequence opt1 from OR2F2__Homo_sapiens__NP_001004685
auggagaucgacaaccagaccugggugcgcgaguucauccugcucggccugagcuccgacuggugcacccagaucagccuguucucccucuuccuggucacguaccugaugaccgugcucgggaacugccugaucgugcugcucauccggcuggacagccgccugcacacccccauguacuucuuccucaccaaccugucccuggucgacgugagcuacgccacguccguggucccgcagcuccuggcccacuuccuggcggagcacaaggccauccccuuccagagcugcgccgcccagcuguucuucucccucgcccugggcgggaucgaguucgugcuccuggcggugauggccuacgaccggcacgucgccgugagcgaccgccugcgguacuccgccaucaugcacggcgggcucugcgcgcgccuggccaucaccagcuggguguccggcagcaucaacucccugguccagaccgccaucaccuuccagcuccccaugugcacgaacaaguucaucgaccacaucagcugcgagcugcuggccguggugcggcucgccugcgucgacaccuccagcaacgaggcggccaucaugguguccagcaucgugcugcugaugacccccuucugccucguccugcugagcuacauccgcaucaucuccaccauccucaagauccagagccgggagggccgcaagaaggccuuccacacgugcgccucccaccugaccgugguggcccugugcuacgggaccaccaucuucacguacauccagccgcacagcggccccuccguccuccaggagaagcugaucagcguguucuacgcgaucgugaugccccugcucaaccccgucaucuacucccugcggaacaaggaggugaagggggccuggcacaagcugcucgagaaguucagcggccugaccuccaagcuggggaccuga

SEQ ID NO: 34030 - RNA, 954 nt, Artificial Sequence
  derived and/or modified sequence opt1 from OR2G2__Homo_sapiens__NP_001001915
augggcauggugcgccacaccaacgagagcaaccuggccggguucauccuccugggcuucuccgacuacccccagcugcagaagguccucuucgugcugauccugauccucuaccugcugaccauccucgggaacacgaccaucauccuggugagccggcuggagccgaagcuccacaugcccauguacuucuuccugucccaccugagcuuccucuaccgcugcuucaccuccagcgucaucccccagcugcuggugaaccucugggagcccaugaagaccaucgccuacggcgggugccuggugcaccuguacaacucccacgcgcucggcagcacggagugcguccugccggccgugauguccugcgaccgguacguggccgucugccgcccccugcacuacaccgugcucaugcacauccaccugugcauggcccuggccagcauggcguggcucuccggcaucgccaccacccuggugcagagcacgcugacccuccagcugcccuucugcgggcaccggcaggucgaccacuucaucugcgaggugcccgugcugaucaagcucgccugcgucggcaccaccuucaacgaggccgagcuguucguggcguccauccuguuccucaucgugccggucagcuucauccugguguccagcggguacaucgcccacgccgugcugcgcaucaaguccgccacgcggcgccagaaggccuucgggaccugcuucagccaccucaccgucgugaccaucuucuacggcacgaucaucuucauguaccugcagcccgcgaagucccggagccgcgaccagggcaaguucgugagccuguucuacaccgucgugacccggaugcucaacccccugaucuacacccugcgcaucaaggaggucaagggcgcccucaagaaggugcuggccaaggcccugggggugaacauccucuga

SEQ ID NO: 34031 - RNA, 930 nt, Artificial Sequence
  derived and/or modified sequence opt1 from OR2G3__Homo_sapiens__NP_001001914
augggccuggggaacgagagcucccucauggacuucauccugcugggcuucagcgaccacccccgccucgaggccgugcuguucgucuucgugcuguucuucuaccuccugacccugguggggaacuucaccaucaucaucaucuccuaccucgacccgccccugcacacgcccauguacuucuuccugagcaaccucucccugcuggacaucugcuucaccaccagccucgcgccccagacccuggucaaccugcagcggccgaagaagacgaucaccuacggcgggugcguggcccagcucuacaucucccuggcccugggcagcaccgagugcauccuccuggccgacauggcccuggaccgcuacaucgccgugugcaagccccuccacuacgucgugaucaugaacccccggcugugccagcagcuggcguccaucagcuggcucuccggccuggccagcucccugauccacgccaccuucacgcuccagcugccccugugcgggaaccaccgccucgaccacuucaucugcgaggugccggcccugcugaagcucgcgugcgucgacaccaccgugaacgagcuggugcuguucgucgugagcguccucuucguggugaucccgcccgcccugaucuccaucagcuacggcuucaucacccaggccgugcugcggaucaaguccgucgaggcccgccacaaggccuucagcacgugcuccagccaccucaccguggugaucaucuucuacgggaccaucaucuacgucuaccugcagcccagcgacuccuacgcgcaggaccagggcaaguucaucagccuguucuacaccauggugacgcccacccucaaccccaucaucuacacccugcggaacaaggacaugaaggaggcccugcgcaagcuccuguccgggaagcuguga

SEQ ID NO: 34032 - RNA, 939 nt, Artificial Sequence
  derived and/or modified sequence opt1 from OR2H2__Homo_sapiens__NP_009091
auggugaaccagagcuccacccccggcuuccugcuccugggguucagcgagcacccgggccuggagcgcacccucuucgucguggugcugacguccuaccugcucacccuggucgggaacacccugaucauccuccugagcgcccuggaccccaagcuccacucccccauguacuucuuccugagcaaccuguccuuccucgaccugugcuucaccacgagcugcgugccccagaugcuggugaaccucuggggcccgaagaagaccaucuccuuccuggacugcagcguccagaucuucaucuuccugucccucgggaccaccgagugcauccugcugacggugauggccuucgaccgguacguggcggucugccagccccuccacuacgccaccaucauccacccccgccugugcuggcagcuggccagcguggccugggugaucggccucgucgaguccguggugcagacccccagcacccugcaccucccguucugccccgaccggcaggucgacgacuucgugugcgaggugcccgcccugauccgccuguccugcgaggacacgagcuacaacgagauccaggucgcgguggccuccguguucauccuggucgugccccucagccugauccugguguccuacggcgccaucaccugggccguccuccggaucaacagcgcgaaggggcgccggaaggccuucgggaccugcagcucccaccugaccguggucacgcuguucuacagcuccgugaucgccguguaccuccagccgaagaaccccuacgcccaggagcgcggcaaguucuucggccuguucuacgccgucgggacccccagccugaacccccucaucuacacccugcggaacaaggaggugacccgcgcguuccggcgccugcucggcaaggagaugggccugacgcaguccuga

SEQ ID NO: 34033 - RNA, 939 nt, Artificial Sequence
  derived and/or modified sequence opt1 from OR2J2__Homo_sapiens__NP_112167
augaugaucaagaagaacgccagcuccgaggacuucuucauccugcucggcuucagcaacuggccccagcuggaggugguccuguucguggugauccucaucuucuaccugaugacccugaccgggaaccucuucaucaucauccuguccuacgucgacagccaccuccacacgccgauguacuucuuccuguccaaccugagcuuccuggaccucugcuacaccaccuccagcaucccccagcugcuggugaaccuccgcggccccgagaagaccaucuccuacgccgggugcauggugcagcuguacuucguccuggcgcucggcaucacggagugcgugcugcugguggucaugagcuacgaccgguacguggccgugugccgcccccuccacuacaccguccugaugcacccgcgguucugccaccuccugguggccgccuccugggugaucggguucaccaucagcgcccugcacuccagcuucaccuucugggucccccugugcggccaccgccucguggaccacuucuucugcgaggugcccgcgcugcugcggcucuccugcgucgacacgcacgccaacgagcugacccugauggugaugagcuccaucuucgugcucaucccccugauccugauccucaccaccuacggcgccaucgcccgcgcgguccugagcaugcaguccacgaccgggcugcagaagguguuccggaccugcggcgcccaccucaugguggucagccuguucuucaucccggugaugugcauguaccugcagccgcccagcgagaacucccccgaccaggggaaguucaucgcccucuucuacaccgucgugacgcccagccugaacccccugaucuacacccuccgcaacaagcacgugaagggcgccgccaagcggcugcuggggugggaguggggcaaguga

SEQ ID NO: 34034 - RNA, 936 nt, Artificial Sequence
  derived and/or modified sequence opt1 from OR2J3__Homo_sapiens__NP_001005216
augaacgacgacggcaaggugaacgccagcuccgagggguacuucauccuggucggcuucagcaacuggccccaccucgagguggugaucuucgucguggugcugaucuucuaccugaugacccucaucgggaaccuguucaucaucauccuguccuaccucgacagccaccuccacaccccgauguacuucuuccuguccaaccugagcuuccuggaccugugcuacacgaccuccagcaucccccagcuccuggucaaccuguggggccccgagaagaccaucuccuacgccgggugcaugauccagcucuacuucgugcuggcgcugggcaccacggagugcgugcuccuggucgugaugagcuacgaccgcuacgccgccgugugccggccccugcacuacaccguccucaugcacccgcgcuucugccaccuccuggccguggccuccugggugagcggcuucaccaacuccgcgcugcacagcuccuucaccuucugggucccccugugcgggcaccgccagguggaccacuucuucugcgaggugcccgcccugcuccggcugagcugcgucgacacgcacgugaacgagcugacccucaugaucaccuccagcaucuucgugcugaucccccugauccucauccugaccuccuacggcgccaucguccgggccauccugcgcaugcagagcacgaccgggcuccagaagguguucgggaccugcggcgcgcaccugauggccgugagccuguucuucaucccggccaugugcauguaccuccagccgcccuccggcaacagccaggaccagggcaaguucaucgcccuguucuacaccgucgugacgcccucccugaacccccucaucuacacccugcggaacaaggucgugcgcggggccgugaagcggcugaugggcugggaguga

SEQ ID NO: 34035 - RNA, 939 nt, Artificial Sequence
  derived and/or modified sequence opt1 from OR2L2__Homo_sapiens__NP_001004686
auggagaacuacaaccagaccagcaccgacuucauccugcucggccuguucccccagucccgcaucgggcuguucguguucacgcucaucuuccugaucuuccugauggcccucaucggcaaccugagcaugauccugcucaucuuccuggacauccaccuccacaccccgauguacuuccugcugucccagcugagccucaucgaccugaacuacaucuccaccaucguccccaagaugguguacgacuuccuguacgggaacaagagcaucuccuucaccggcugcgggauccagagcuucuucuuccucacgcuggccguggcggagggccugcuccugaccuccauggccuacgaccgguacgucgccaucugcuucccccugcacuaccccauccgcaucagcaagcgggugugcgugaugaugaucaccggcuccuggaugaucagcuccaucaacagcugcgcccacaccgucuacgcccucugcaucccguacugcaagucccgcgcgaucaaccacuucuucugcgacgugcccgccaugcugacgcuggccugcaccgacaccuggguguacgagagcaccgucuuccucuccagcacgaucuuccuggugcugcccuucaccgggaucgccugcuccuacggccgggugcuccuggcggucuaccgcaugcacagcgccgaggggcggaagaaggccuacagcacgugcuccacccaccugaccguggugagcuucuacuacgcccccuucgccuacaccuacguccgcccgcggucccuccgcagccccaccgaggacaagauccuggcgguguucuacaccauccugacgcccaugcucaaccccaucaucuacucccugcggaacaaggaggugaugggcgcccugacccaggucauccagaagaucuucagcgugaagauguga

SEQ ID NO: 34036 - RNA, 939 nt, Artificial Sequence
  derived and/or modified sequence opt1 from OR2M3__Homo_sapiens__NP_001004689
auggcccgcgagaacagcaccuucaacuccgacuucauccugcucggcaucuucaaccacagccccacccacacguuccuguucuuccuggugcucgccaucuucuccgucgcguucauggggaacagcgugauggugcugcugaucuaccucgacacccagcugcacaccccgauguaccugcuccugucccagcugagccucauggaccugaugcugaucugcaccacgguccccaagauggccuucaacuaccucuccggcagcaaguccaucagcauggccgggugcgccacccagaucuucuucuacaccucccugcugggcagcgagugcuuccuccuggccgugauggcguacgaccgguacaccgccaucugccacccccugcgcuacacgaaccucaugucccccaagaucugcgggcugaugaccgccuucagcuggauccugggcuccaccgacggcaucaucgacguggucgccaccuucagcuucuccuacugcgggagccgggagaucgcgcacuucuucugcgacuucccgucccuccugauccugagcugcagcgacacguccaucuucgagaagauccucuucaucugcugcaucgugaugaucguguuccccgucgccaucaucaucgccagcuacgcccgcgugauccuggccgugauccacaugggcuccggggagggccggcgcaaggcguucacgaccugcagcucccaccuccuggucguggggauguacuacggcgccgcccuguucauguacauccggcccaccagcgaccgcucccccacccaggacaagauggugagcgucuucuacaccauccugaccccgaugcucaacccccugaucuacucccugcggaacaaggaggugacccgcgccuucaugaagauccucggcaagggcaagagcggggaguga

SEQ ID NO: 34037 - RNA, 936 nt, Artificial Sequence
  derived and/or modified sequence opt1 from OR2M4__Homo_sapiens__NP_059974
auggugugggagaaccagaccuucaacagcaucuucauccugcucggcaucuucaaccacucccccacccacacguuccuguucagccugguccucgggaucuucucccuggcccugauggagaacaucagcauggugcuccugaucuacaucgagaagcagcugcacaccccgauguacuuccuccugucccagcugagccucauggaccugaugcugaucugcaccacccuccccaagaugaucuucuccuaccugagcggcaagaaguccaucagccuggccgggugcggcacgcagaucuucuucuacgugucccuccugggggcggagugcuuccugcucgccgucauggccuacgaccgcuacguggccaucugccacccccugcaguacaccauccugaugaaccccaagcucugcguguucaugaccgucgccagcuggacccugggcucccuggacggcaucaucgugcucgcggccgugcugagcuucuccuacugcagcucccuggagauccaccacuucuucugcgacgucgccgcccuccugccgcugagcugcacggagaccuccgcguucgagcggcuccuggugaucugcugcguggucaugcugaucuuccccgugagcgugaucauccucagcuacucccacguccugcgcgccgugauccacauggggagcggcgagucccggcgcaaggccuucacgaccugcagcucccaccugagcguggucgggcucuacuacggcgccgccauguucauguacaugcggcccgcguccaagcacacccccgaccaggacaagauggugagcgccuucuacaccauccugaccccgaugcugaacccccucaucuacucccugcgcaacaaggagguguuccgggcccugcagaagguccucaagaagcgcaagcugaucuga

SEQ ID NO: 34038 - RNA, 939 nt, Artificial Sequence
  derived and/or modified sequence opt1 from OR2M7__Homo_sapiens__NP_001004691
auggccugggagaaccagaccuucaacagcgacuuccugcuccugggcaucuucaaccacucccccacccacacguuccuguucuuccucgugcuggccaucuucagcgucgcguucauggggaacuccaucauggugcugcucaucuaccuggacacccagcugcacaccccgauguacuuccuccugagccagcugucccucauggaccugaugcugaucugcaccacggugcccaagauggccuucaacuaccucagcggcuccaagagcaucuccauggccgggugcgccacccagaucuucuucuacaucagccugcugggcuccgagugcuuccuccuggccgucaugagcuacgaccgcuacaccgcgaucugccacccccugcgguacaccaaccucaugcgccccaagaucugcgggcugaugacggccuucuccuggauccugggcagcaccgacggcaucaucgacgccguggccaccuucuccuucagcuacugcgggucccgggagaucgcgcacuucugcugcgacuucccgagccuccugauccuguccugcaacgacaccagcaucuucgaggaggugaucuucaucugcugcaucgucaugcucguguuccccguggccaucaucaucacgagcuacgcccgcgucauccuggccgugauccacaugggcuccggggagggccggcgcaaggccuucacgaccugcagcucccaccugaugguggucgggauguacuacggcgcgggccucuucaugugcauccagcccaccagccaccacucccccaugcaggacaagauggugagcguguucuacaccaucgucaccccgaugcugaacccccugaucuacucccuccggaacaaggaggugacccgcgcccugaugaagauccuggggaagggcaagagcggggacuga

SEQ ID NO: 34039 - RNA, 960 nt, Artificial Sequence
  derived and/or modified sequence opt1 from OR2S2__Homo_sapiens__NP_063950
auggagaaggccaacgagaccagccccgugaugggcuucguccugcuccgccuguccgcccacccggagcuggagaagaccuucuucgugcucauccugcugauguaccucgugauccugcuggggaacggcguccucauccuggugacgauccuggacagccggcuccacacccccauguacuucuuccuggggaaccuguccuuccucgacaucugcuucaccaccagcuccgugccccugguccuggacagcuuccucacgccccaggagaccaucuccuucagcgcgugcgccgugcagauggcccuguccuucgccauggccggcaccgagugccugcuccugagcaugauggcguucgaccgcuacguggccaucugcaacccgcugcgguacuccgucaucaugagcaaggccgccuacaugcccauggcggccuccagcugggccaucgggggcgccgccuccguggugcacaccagccucgcgauccagcugcccuucugcggcgacaacgucaucaaccacuucacgugcgagauccuggccgugcucaagcuggccugcgccgacaucuccaucaacgugaucagcauggaggucaccaacgugaucuuccugggggugcccguccucuucaucuccuucagcuacguguucaucaucaccaccauccugcgcaucccgagcgccgagggccggaagaagguguucuccacgugcagcgcgcaccugaccgucgugaucguguucuacgggacccucuucuucauguacggcaagcccaaguccaaggacagcaugggggccgacaaggaggaccuguccgacaagcugaucccccucuucuacggcgucgugacccccaugcugaacccgaucaucuacagccugcgcaacaaggacgucaaggccgccgugcggcgccuccugcggcccaagggcuucacgcaguga

SEQ ID NO: 34040 - RNA, 939 nt, Artificial Sequence
  derived and/or modified sequence opt1 from OR2T10__Homo_sapiens__NP_001004693
augcgccuggccaaccagacccucggcggggacuucuuccugcugggcaucuucagccagaucucccaccccgggcggcucugccugcugaucuucagcaucuuccucauggccguguccuggaacaucacccugauccugcucauccacaucgacagcucccugcacacgccgauguacuucuucaucaaccagcugagccucaucgaccugaccuacaucuccgucaccgugcccaagaugcuggugaaccagcucgcgaaggacaagaccaucagcguccugggcugcgggacgcagauguacuucuaccugcagcucggcggcgccgagugcugccugcuggccgccauggccuacgaccgcuacguggcgaucugccacccccuccgguacuccgugcugaugagccaccgcgucugccugcuccuggccuccgggugcugguucgugggcagcguggacggguucaugcugacccccaucgccauguccuucccguucugccggagccacgagauccagcacuucuucugcgagguccccgccgugcucaagcuguccugcagcgacaccucccuguacaagaucuucauguaccucugcugcgugaucaugcugcugauccccgucaccgugaucagcguguccuacuacuacaucauccucacgauccacaagaugaacagcgucgagggccgcaagaaggcguucacgaccugcagcucccacaucaccguggugagccuguucuacggggccgccaucuacaacuacaugcugcccuccagcuaccagaccccggagaaggacaugauguccagcuucuucuacaccauccucacccccguccugaaccccaucaucuacuccuuccggaacaaggacgugacccgcgcccugaagaagaugcucagcgugcagaagcccccguacuga

SEQ ID NO: 34041 - RNA, 963 nt, Artificial Sequence
  derived and/or modified sequence opt1 from OR2T12__Homo_sapiens__NP_001004692
auggagaugcgcaacaccacccccgacuucauccugcucggccuguucaaccacacgcgggcccaccaggugcuguucaugaugcuccuggccaccguccugaccagccucuucuccaacgcgcugaugauccugcucauccacugggaccaccgccugcaccggccgauguacuuccugcucagccagcugucccugauggacaugaugcucgugagcaccacggugcccaagauggccgccgacuaccugaccggcaacaaggccaucucccgcgccggcugcgggguccagaucuucuuccugcccacccucggcgggggcgagugcuuccugcuggcggccauggccuacgaccgguacgccgcggugugccacccccuccgcuacccgacccugaugagcuggcagcugugccuccggaugacgauguccagcuggcugcugggcgccgccgacgggcuccugcaggccguggccacccuguccuuccccuacugcggcgcgcacgagaucgaccacuucuucugcgaggcccccguccucgugcgccuggccugcgccgacaccagcguguucgagaacgccauguacaucugcugcguccugaugcuccuggugcccuucucccugauccucagcuccuacgggcugauccuggcggccgugcuccugaugcggagcaccgaggcccgcaagaaggccuucgccacgugcuccagccacgucgcgguggugggccuguucuacggggccggcaucuucaccuacaugcggccgaagucccaccgcagcaccaaccacgacaaggucguguccgccuucuacaccauguucacgccccuccugaacccccugaucuacagcgugcggaacagcgaggucaaggaggcccucaagcgcuggcuggggaccugcgugaaccugaagcaccagcagaacgaggcccaccggucccgcuga

SEQ ID NO: 34042 - RNA, 1110 nt, Artificial Sequence
  derived and/or modified sequence opt1 from OR2T1__Homo_sapiens__NP_112166
auguggcaggaguacuacuuccugaacguguucuucccccuccugaaggucugcugccugaccaucaacagccacguggugauccuccugccgugggagugcuaccaccugaucuggaagauccuccccuacaucggcaccacggucggguccauggaggaguacaacaccagcuccaccgacuucaccuucaugggccuguucaaccgcaaggagacgagcgggcugaucuucgccaucaucuccaucaucuucuucaccgcccucauggcgaacggcgugaugaucuuccugauccagaccgaccugcggcuccacacccccauguacuuccugcugagccaccucucccugaucgacaugauguacaucagcacgaucgugcccaagaugcuggucaacuaccuccuggaccagcgcaccaucuccuucguggggugcaccgcccagcacuuccuguaccucacccuggugggcgccgaguucuuccugcucggccugauggccuacgaccgguacgucgccaucugcaacccgcugcgcuaccccgugcucaugagccggcgcgugugcuggaugaucaucgcgggguccugguucggcgggagccuggacggcuuccugcucacgcccaucaccauguccuuccccuucugcaacagccgggagaucaaccacuucuucugcgaggccccggccguccugaagcuggccugcgcggacaccgcccucuacgagaccgugauguacgugugcugcguccugaugcugcucauccccuucuccguggugcuggccagcuacgcccgcauccugacgaccguccagugcauguccagcguggaggggcggaagaaggccuucgcgaccugcuccagccacaugaccguggucagccucuucuacggcgccgccauguacacguacaugcugccccacuccuaccacaagcccgcccaggacaaggugcugagcguguucuacaccauccucaccccgaugcugaacccccugaucuacucccuccgcaacaaggacgucaccggcgcccugaagcgggcgcuggggcgcuucaagggcccccagcgggugagcgggggcgucuucuga

SEQ ID NO: 34043 - RNA, 975 nt, Artificial Sequence
  derived and/or modified sequence opt1 from OR2T2__Homo_sapiens__NP_001004136
augggcauggaggggcugcuccagaacagcaccaacuucgugcugaccggccugaucacgcaccccgccuucccggggcuccuguucgccaucgucuucuccaucuucgugguggcgaucaccgccaaccuggucaugauccuccugauccacauggacagccgccugcacacccccauguacuuccuccugucccagcugagcaucauggacaccaucuacaucugcaucacggugcccaagaugcuccaggaccugcuguccaaggacaagaccaucagcuuccucggcugcgccgugcagaucuuccuguaccugacccucaucgggggcgaguucuuccugcugggccucauggccuacgaccgguacgucgccgugugcaacccccugcgcuacccgcugcucaugaaccggcgcgugugccuguucauggucgugggguccugggugggcgggagccuggacggcuucaugcucacccccgucacgauguccuuccccuucugccggagccgcgagaucaaccacuucuucugcgagauccccgcggugcugaagcuguccugcaccgacaccagccucuacgagacccugauguacgccugcugcgugcugaugcuccugaucccgcuguccgucaucagcguguccuacacgcacauccuccugaccgugcaccggaugaacagcgccgaggggcgccggaaggccuucgcgaccugcuccagccacaucauggucguguccguguucuacggcgccgccuucuacaccaacguccugccccacagcuaccacacgcccgagaaggacaagguggugagcgccuucuacaccauccucacccccaugcugaacccgcugaucuacucccuccgcaacaaggacgucgccgcggcccugcggaaggugcugggccgcugcgggagcucccagagcauccgggucgccaccgugauccgcaagggcuga

SEQ ID NO: 34044 - RNA, 963 nt, Artificial Sequence
  derived and/or modified sequence opt1 from OR2T33__Homo_sapiens__NP_001004695
auggagaugcgcaacaccacccccgacuucauccugcucggccuguucaaccacacgcgggcccaccaggugcuguucaugaugguccucagcaucgugcugaccucccuguucgggaacagccucaugauccugcugauccacugggaccaccgccuccacaccccgauguacuuccugcugucccagcucagccugauggacaugaugcugguguccaccacgguccccaagauggccgcggacuaccucaccggcagcaaggccaucucccgggccgggugcggcgugcagaucuucuuccugcccacccucgggggcggcgagugcuuccuccuggccgccauggcguacgaccgcuacgccgccgugugccacccccugcgguacccgacccucaugagcuggcagcugugccugcgcaugacgauguccugcuggcuccugggggccgcggacggccugcuccaggccgucgugacccugagcuuccccuacugcggggcccacgagaucgaccacuucuucugcgagacccccgugcugguccggcucgccugcgccgacaccuccguguucgagaacgcgauguacaucugcugcgugcugaugcugcucguccccuucagccugauccuguccagcuacggccucauccuggccgccgugcugcacaugcgcuccacggaggcccggaagaaggccuucgcgaccugcagcucccacguggccgucguggggcuguucuacggcgccgccaucuucaccuacaugcgccccaagagccaccgguccaccaaccacgacaagguggucagcgccuucuacacgauguucaccccgcugcugaacccccucaucuacagcgugaagaacuccgaggugaagggcgcgcugaagcgcuggcuggggaccugcgucaacaucaagcaccagcagaacgaggcccaccggagccgcuga

SEQ ID NO: 34045 - RNA, 1047 nt, Artificial Sequence
  derived and/or modified sequence opt1 from OR2T4__Homo_sapiens__NP_001004696
auggacaacaucaccuggauggccagccacaccggcugguccgacuucauccugauggggcuguuccgccagagcaagcaccccauggccaacaucacguggauggcgaaccacaccggcugguccgacuucauccugcugggccucuuccggcagagcaagcacccggcccugcugugcguggucaucuucgugguguuccucauggcccuguccgggaacgccguccugauccuccugauccacugcgacgcccaccuccacacccccauguacuucuucaucagccagcucucccugauggacauggcguacaucagcgugaccgugcccaagaugcugcucgaccaggucaugggggugaacaagaucuccgcccccgagugcggcaugcagauguucuucuacgugacgcuggccggcagcgaguucuuccugcucgccaccauggcguacgaccgcuacgucgccaucugccacccgcugcgguaccccgugcugaugaaccaccgcgugugccucuuccuguccagcgggugcugguuccugggcuccgucgacggguucaccuucacccccaucacgaugaccuuccccuuccggggcagccgcgagauccaccacuucuucugcgaggugccggccgugcucaaccuguccugcagcgacaccucccuguacgagaucuucauguaccucugcugcguccugaugcugcucauccccguggugaucaucagcuccagcuaccugcugauccuccugaccauccacgggaugaacagcgccgagggccggaagaaggccuucgcgacgugcuccagccaccugaccgucgugauccucuucuacggcgccgccaucuacaccuacaugcugcccuccagcuaccacacccccgagaaggacaugaugguguccgucuucuacacgauccugaccccgguggugaacccccucaucuacagccugcgcaacaaggacgucaugggggcccugaagaagaugcucaccguggagcccgccuuccagaaggcgauggaguga

SEQ ID NO: 34046 - RNA, 948 nt, Artificial Sequence
  derived and/or modified sequence opt1 from OR2T5__Homo_sapiens__NP_001004697
auggccaacaucacccgcauggccaaccacaccggcaagcuggacuucauccucauggggcuguuccggcgcagcaagcaccccgcgcugcucuccguggucaucuucgugguguuccugaaggcccugagcggcaacgccguccucauccugcugauccacugcgacgcccaccuccacuccccgauguacuucuucaucagccagcugucccugauggacauggccuacaucagcgugacggugcccaagaugcuccuggaccaggucaugggggugaacaagguguccgcgcccgagugcggcaugcagauguuccuguaccucacccuggccgggagcgaguucuuccugcucgccaccauggccuacgaccgguacgucgcgaucugccacccccugcgcuacccggugcugaugaaccaccgggugugccucuuccuggccuccggcugcugguuccugggcagcgucgacggguucaugcucacccccaucacgauguccuuccccuucugccgcagcugggagauccaccacuucuucugcgaggugcccgccgugaccauccuguccugcagcgacaccucccuguacgagacccucauguaccugugcugcguccugaugcuccugaucccggugacgaucaucagcuccagcuaccugcucauccugcugaccgugcaccggaugaacuccgccgagggccgcaagaaggccuucgcgaccugcagcagccaccucaccgucgugauccuguucuacggggccgccguguacacguacaugcugcccuccagcuaccacacccccgagaaggacaugauggucuccguguucuacaccauccucacccccgugcugaacccgcugaucuacagccuccggaacaaggacgucaugggcgcccugaagaagaugcugacggugcgcuucguccucuga

SEQ ID NO: 34047 - RNA, 963 nt, Artificial Sequence
  derived and/or modified sequence opt1 from OR2W1__Homo_sapiens__NP_112165
auggaccagagcaacuacuccagccugcacggcuucauccuccugggguucuccaaccaccccaagauggagaugauccugagcggcguggucgccaucuucuaccucaucacccugguggggaacaccgccaucauccuggcgucccuccuggacagccagcugcacacgccgauguacuucuuccuccgcaaccuguccuuccuggaccucugcuucaccaccagcaucaucccccagaugcuggugaaccuguggggccccgacaagaccaucuccuacgucgggugcaucauccagcucuacguguacauguggcugggcagcguggagugccugcuccuggccgucauguccuacgaccgguucacggccaucugcaagccccugcacuacuucguggugaugaacccgcaccucugccugaagaugaucaucaugaucuggagcaucucccuggccaacagcgucgugcucugcacccugacccugaaccucccgaccugcggcaacaacauccuggaccacuuccugugcgagcuccccgcccuggugaagaucgcgugcgucgacacgaccaccguggagauguccguguucgcccuggggaucaucaucguccucacgccccugauccugauccucaucagcuacggcuacaucgccaaggccgugcugcgcaccaaguccaaggcgagccagcggaaggccaugaacacgugcgggucccaccugaccguggucagcauguucuacggcaccaucaucuacauguaccuccagcccgggaaccgcgccagcaaggaccagggcaaguuccugacccuguucuacaccgugaucacccccucccucaacccccugaucuacacccugcggaacaaggacaugaaggacgcccucaagaagcugaugcgcuuccaccacaagagcacgaagaucaagcggaacugcaaguccuga

SEQ ID NO: 34048 - RNA, 936 nt, Artificial Sequence
  derived and/or modified sequence opt1 from OR2Y1__Homo_sapiens__NP_001001657
augggcagcuucaacaccuccuucgaggacggguucauccuggugggcuucagcgacuggccccagcucgagccgauccuguucgucuucaucuucaucuucuacucccugacccucuucgggaacacgaucaucaucgcccugagcuggcuggaccuccgccugcacacccccauguacuucuuccugucccaccucagccugcuggaccucugcuucaccaccuccacggugccccagcugcugaucaaccucugcggcguggaccggaccaucacccgcgggggcugcgucgcccagcuguucaucuaccuggcgcucggcagcaccgagugcgugcugcugguggucauggccuucgaccgguacgccgccgugugccgcccccuccacuacauggccaucaugcacccgcaccugugccagacgcuggcgaucgccuccuggggcgccggguucgugaacagccucauccagaccgggcuggccauggcgaugccccugugcggccaccggcucaaccacuucuucugcgagaugcccgucuuccugaagcuggccugcgccgacaccgaggggaccgaggccaagauguucguggcccgcgugaucgucguggcggugcccgccgcccucauccugggcuccuacguccacaucgcccacgccgugcugcgggucaagagcacggcgggccgccggaaggccuucgggaccugcggcucccaccuccuggugguguuccuguucuacgggagcgccaucuacaccuaccuccaguccauccacaacuacagcgagcgcgagggcaaguucguggcccuguucuacaccaucaucacgccgauccugaacccccucaucuacacccugcggaacaaggacgucaagggcgcccuguggaaggugcucuggcgcgggcgggacuccggcuga

SEQ ID NO: 34049 - RNA, 945 nt, Artificial Sequence
  derived and/or modified sequence opt1 from OR2Z1__Homo_sapiens__NP_001004699
augggcgacgugaaccagagcgucgccuccgacuucauccuggugggccucuucagccacuccgggagccgccagcugcuguucucccucguggccgucauguucgugaucgggcugcugggcaacaccgugcuccuguuccugauccgggucgacagccgccuccacacccccauguacuuccugcugucccagcucagccuguucgacaucgggugcccgauggugacgauccccaagauggcguccgacuuccugcggggcgagggcgccaccagcuacgggggcggggccgcccagaucuucuuccucacccugaugggcguggccgaggggguccugcucgugcugauguccuacgaccgcuacguggcggucugccagccccugcaguaccccgugcucaugcggcgccaggugugccugcugaugaugggcagcuccugggucgugggcgugcucaacgccagcauccagaccuccaucacgcugcacuucccguacugcgccagccggaucgucgaccacuucuucugcgaggugcccgcccugcucaagcuguccugcgcggacacgugcgccuacgagauggcccugagcaccuccggggugcucauccugaugcugccccucagccugaucgccaccagcuacggccacguccugcaggccgugcucuccaugcgcagcgaggaggcgcggcacaaggccgugacgaccugcuccagccacaucaccgucguggggcuguucuacggcgccgccgucuucauguacauggugcccugcgccuaccacuccccgcagcaggacaacguggucagccuguucuacucccucgugacccccacccugaacccccugaucuacagccuccgcaaccccgagguguggauggcgcuggucaaggugcugucccgggccggccuccgccagaugugcuga

SEQ ID NO: 34050 - RNA, 948 nt, Artificial Sequence
  derived and/or modified sequence opt1 from OR3A1__Homo_sapiens__NP_002541
augcagcccgagagcggcgccaacgggaccgugaucgccgaguucauccugcucggccugcuggaggcgccggggcuccagcccgucguguucgugcuguuccuguucgccuaccucgucaccgugcgcggcaaccuguccauccuggccgccgugcucgucgagcccaagcugcacacgcccauguacuucuuccuggggaaccucagcgugcuggacgugggcugcaucuccgucaccgugccgagcaugcugucccggcuccugagccgcaagcgggccgugcccugcggcgcgugccugacccagcuguucuucuuccaccuguucgucgggguggacugcuuccugcucaccgccauggccuacgaccgcuuccuggccaucugccggccccugacguacuccacccgcaugagccagaccgugcagcggaugcucgucgcggccuccugggccugcgccuucaccaacgcccugacgcacaccguggcgaugagcacccugaacuucugcggccccaacgugaucaaccacuucuacugcgaccucccgcagcuguuccagcuguccugcagcuccacccagcucaacgagcugcuccucuucgccgucggguucaucauggccggcacgcccauggcccugaucgugaucagcuacauccacguggccgcggccguccugcgcauccgguccguggaggggcgcaagaaggccuucagcacgugcggcucccaccucaccguggucgccaucuucuacggcagcgggaucuucaacuacaugcggcugggcuccaccaagcugagcgacaaggacaaggccguggggaucuucaacaccgucaucaaccccaugcucaaccccaucaucuacagcuuccgcaacccggacgugcaguccgcgaucuggcggaugcugaccggccgccggagccuggccuga

SEQ ID NO: 34051 - RNA, 1035 nt, Artificial Sequence
  derived and/or modified sequence opt1 from OR4A15__Homo_sapiens__NP_001005275
auggagcugcucaccaacaaccugaaguucaucaccgaccccuucgugugccgccugcggcaccucagcccgacgcccuccgaggagcacaugaagaacaagaacaacgucaccgaguucauccugcugggccucacccagaaccccgaggggcagaaggugcuguucgugaccuuccugcucaucuacauggucacgaucaugggcaaccugcugaucaucgugaccaucauggccagccagucccucgggagccccauguacuucuuccuggccucccugagcuucaucgacaccguguacuccaccgcguucgccccgaagaugaucgucgaccuccugagcgagaagaagacgaucuccuuccagggcugcauggcccagcuguucauggaccaccucuucgccggggccgaggugauccugcugguggucauggcguacgaccgcuacauggccaucugcaagccccuccacgagcugaucaccaugaaccggcgcgugugcgugcugaugcuccuggccgccuggaucggcggcuuccugcacagccucguccaguuccuguucaucuaccagcugcccuucugcgggcccaacgugaucgacaacuuccucugcgaccuguacccgcugcucaagcuggcgugcaccaacaccuacgugacgggccuguccaugaucgccaacgggggcgccaucugcgccgucaccuucuucaccauccuccugagcuacggggugauccugcacucccucaagacccagagccuggagggcaagcggaaggccuucuacacgugcgcgucccacgugaccgucgugauccuguucuucgugcccugcaucuuccucuacgcccgccccaacagcaccuuccccaucgacaaguccaugaccgucgugcugacguucaucaccccgaugcugaacccccucaucuacacccugaagaacgccgagaugaaguccgccaugcggaagcuguggagcaagaaggugagccucgccggcaaguggcuguaccacagcuga

SEQ ID NO: 34052 - RNA, 930 nt, Artificial Sequence
  derived and/or modified sequence opt1 from OR4C12__Homo_sapiens__NP_001005270
auggagaagaagaagaacgugaccgaguucauccugaucggccucacccagaaccccaucauggagaaggugacguucgugguguuccugguccuguacaugaucacccucagcgggaaccugcugaucguggugaccaucaccacgucccaggcccucagcuccccgauguacuucuuccugacccaccugagccucaucgacaccgucuacuccagcuccagcgcccccaagcugaucguggacuccuuccaggagaagaagaucaucagcuucaacggcugcauggcgcaggccuacgccgagcacaucuucggggccaccgagaucauccugcucacggugauggccugcgacugcuacgucgcgaucugcaagccccugaacuacaccaccaucaugucccacagccugugcauccuccugguggccguggccugggucggcggguuccugcacgccaccauccagauccucuucacgguguggcugcccuucugcggcccgaacgugaucggccacuucaugugcgaccuguacccccuccugaagcuggucugcaucgacacccacacccucgggcuguucguggcggugaacuccggcuucaucugccugcucaacuuccugauccuggucgugagcuacgugaucauccuccgcucccugaagaacaacagccuggaggggcggugcaaggcccucuccacgugcaucagccacaucaucgucguggugcuguucuucguccccugcaucuucguguaccugcgcuccgucaccacccuccccaucgacaaggccguggccguguucuacaccauggucgugccgaugcugaaccccguggucuacacccugcggaacgccgaggucaagagcgcgauccgcaagcucuggcggaagaaggugacgagcgacaacgacuga

SEQ ID NO: 34053 - RNA, 930 nt, Artificial Sequence
  derived and/or modified sequence opt1 from OR4C13__Homo_sapiens__NP_001001955
auggccaaccgcaacaacgugaccgaguucauccugcucggccugaccgagaaccccaagaugcagaagaucaucuucgucguguucagcgugaucuacaucaacgccaugaucgggaacguccugaucguggugacgaucaccgcguccccgagccuccggucccccauguacuucuuccuggccuaccugagcuucaucgacgccugcuacuccagcgucaacacccccaagcucaucaccgacucccuguacgagaacaagacgauccuguucaacggcugcaugacccagguguucggggagcacuucuuccgcggcguggaggucauccuccugaccgugauggccuacgaccacuacguggccaucugcaagccccugcacuacaccacggucaugaagcagcacgugugcagccuccuggugggggucuccugggugggcggcuuccugcacgcgaccauccagauccucuucaucugccagcugccguucugcgggcccaacgugaucgaccacuucaugugcgaccuguacacccucaucaaccuggccugcaccaacacgcacacccugggccucuucaucgccgccaacagcggguucaucugccugcugaacugccuccugcugcucgucuccugcguggugauccuguacagccugaagacccacucccucgaggcgcggcacgaggcccugagcacgugcgucucccacaucaccguggugauccugagcuucauccccugcaucuucgucuacaugcggcccccggccacccuccccaucgacaaggccguggccgucuucuacaccaugaucaccuccaugcugaacccccugaucuacacgcuccgcaacgcgcagaugaagaacgccauccgcaagcugugcagccggaaggccaucuccagcgugaaguga

SEQ ID NO: 34054 - RNA, 930 nt, Artificial Sequence
  derived and/or modified sequence opt1 from OR4C6__Homo_sapiens__NP_001004704
auggagaaccagaacaacgugaccgaguucauccugcucggccugaccgagaaccuggagcucuggaagaucuucagcgccgucuuccuggugauguacguggccacgguccuggagaaccuccugaucguggugaccaucaucaccucccagagccugcgcucccccauguacuucuuccucaccuuccugagccugcucgacgucauguucuccagcgugguggcgccgaaggucaucguggacacgcuguccaagagcaccaccaucucccugaaggggugccucacccagcuguucguggagcacuucuucggcggggucggcaucauccugcucacggugauggccuacgaccgguacguggccaucugcaagccccugcacuacaccaucaucaugagcccccgcgucugcugccugauggucgggggcgccugggugggcggguucaugcacgccaugauccagcuccuguucauguaccagauccccuucugcggcccgaacaucaucgaccacuucaucugcgaccuguuccagcuccugacccuggcgugcaccgacacgcacauccucgggcugcuggugacccucaacuccggcaugaugugcguggccaucuuccugauccugaucgccagcuacaccgugauccucugcucccucaagagcuacuccagcaaggggcggcacaaggcccuguccacgugcagcucccaccugaccgucguggugcuguucuucguccccugcaucuuccuguacaugcgccccguggucacccaccccaucgacaaggcgauggccgugagcgacagcaucaucaccccgaugcucaacccccugaucuacacccugcggaacgccgaggugaaguccgccaugaagaagcucuggaugaagugggaggcccuggcgggcaaguga

SEQ ID NO: 34055 - RNA, 936 nt, Artificial Sequence
  derived and/or modified sequence opt1 from OR4D10__Homo_sapiens__NP_001004705
auggagauggagaacugcacccgcgugaaggaguucaucuuccugggccucacccagaaccgggaggucagccuggugcuguuccucuuccugcugcucguguacgucacgacccugcuggggaaccuccugaucauggugaccgugaccugcgagucccgccugcacacgcccauguacuuccuccugcacaaccugagcaucgccgacaucugcuucuccagcaucaccgucccgaaggugcucguggaccugcuguccgagcggaagaccaucagcuucaaccacugcuucacccagauguuccucuuccaccugaucggcggggucgacguguucucccugagcgugauggcccucgaccgcuacgucgcgaucuccaagccccugcacuacgccacgaucaugagccgggaccacugcaucggccugaccguggccgccuggcucgggggcuucgugcacuccaucguccagaucagccugcugcucccccugcccuucugcggcccgaacgugcuggacaccuucuacugcgacgugcaccgcguccucaagcuggcccacaccgacaucuucauccuggagcuccugaugaucuccaacaacgggcugcucacgacccugugguucuuccugcuccuggugagcuacaucgugauccugucccuccccaagagccaggcgggcgaggggcggcgcaaggccaucuccacgugcaccagccacaucaccgucgugacccugcacuucgugcccugcaucuacgucuacgcccggcccuucaccgcccugccgauggacaaggcgaucuccgugaccuucacggucaucagcccccuccugaacccccugaucuacacccuccgcaaccacgagaugaaguccgccaugcggcgccugaagcggcgccuggugcccagcgaccggaaguga

SEQ ID NO: 34056 - RNA, 915 nt, Artificial Sequence
  derived and/or modified sequence opt1 from OR4K13__Homo_sapiens__NP_001004714
auggagcgcgccaaccacagcguggucuccgaguucauccugcucggccugagcaagucccagaaccugcagauccucuucuuccugggguucagcgugguguucgucggcaucgugcuggggaaccuccugauccuggugaccgucaccuucgacucccuccugcacacgcccauguacuuccugcucagcaaccuguccugcaucgacaugauccuggccagcuucgcgaccccgaagaugaucguggacuuccuccgggagcgcaagaccaucuccugguggggcugcuacagccagauguucuucaugcaccuccucgggggcuccgagaugaugcugcugguggccauggccaucgaccgguacgucgccaucugcaagccccugcacuacaugaccaucaugagcccccgcgugcugacgggccugcugcucuccagcuacgccgugggguucguccacuccagcucccagauggcguucaugcugacccugcccuucugcggcccgaacgugaucgacagcuucuucugcgaccucccccuggugaucaagcuggccugcaaggacaccuacauccuccagcugcuggucaucgccgacuccgggcuccugagccuggugugcuuccuccugcugcucgugagcuacggcgucaucaucuucuccgugcgguaccgcgccgcgagccgguccagcaaggccuucuccacccugagcgcccacaucacgguggucacccuguucuucgcccccugcguguucaucuacguguggcccuucucccgcuacagcgucgacaagauccucuccguguucuacaccaucuucaccccgcugcugaaccccaucaucuacacgcuccggaaccaggaggucaaggccgcgaucaagaagcgccugugcaucuga

SEQ ID NO: 34057 - RNA, 939 nt, Artificial Sequence
  derived and/or modified sequence opt1 from OR4P4__Homo_sapiens__NP_001004124
auggagaaguccaacaacagcacccucuucauccuccugggcuucagccagaacaagaacaucgaggugcugugcuucguccucuuccuguucugcuacaucgccaucuggauggggaaccugcucaucaugaucuccaucacgugcacccagcugauccaccagcccauguacuucuuccugaacuaccucagccuguccgaccugugcuacaccagcaccgugaccccgaagcucaugguggaccugcuggccgagcgcaagacgaucuccuacaacaacugcaugauccagcuguucaccacccacuucuucggcgggaucgagaucuucauccucaccggcauggcguacgaccgguacgucgccaucugcaagccccugcacuacacgaucaucaugagccgccagaagugcaacaccaucaucaucgugugcugcaccgggggcuucauccacuccgccagccaguuccuccugaccaucuucgugcccuucugcggccccaacgagaucgaccacuacuucugcgacgucuacccgcugcucaagcuggccugcuccaacauccacaugaucgggcugcucgugaucgccaacagcggccugaucgcgcuggugacguucgucgugcuccugcuguccuacguguucauccucuacaccauccgggccuacagcgccgagcgccgguccaaggcccuggcgaccugcagcucccacgucaucguggugguccuguucuucgcccccgcccucuucaucuacauccgccccgugaccacguucagcgaggacaagguguucgcccuguucuacaccaucaucgcccccauguucaacccgcugaucuacacccuccggaacaccgagaugaagaacgcgaugcgcaaggucuggugcugccagauccugcugaagcggaaccagcuguucuga

SEQ ID NO: 34058 - RNA, 936 nt, Artificial Sequence
  derived and/or modified sequence opt1 from OR4S2__Homo_sapiens__NP_001004059
auggagaagaucaacaacgugaccgaguucaucuucuggggccugagccagucccccgagaucgagaaggucugcuucgugguguucagcuucuucuacaucaucauccuccuggggaaccugcucaucaugcugaccgucugccuguccaaccucuucaagagcccgauguacuucuuccuguccuuccugagcuucguggacaucugcuacuccagcgugacggcccccaagaugaucgucgaccuccuggccaaggacaagaccaucuccuacgugggcugcaugcugcagcuguucggggugcacuucuucggcugcaccgagaucuucauccucaccgucauggcguacgaccgcuacguggccaucugcaagccccugcacuacaugacgaucaugaaccgggagaccugcaacaagaugcuccuggggaccugggugggcggcuuccugcacagcaucauccaggucgcccucguggugcagcugcccuucugcgggccgaacgagaucgaccacuacuucugcgacguccaccccgugcugaagcucgccugcaccgagacguacaucgugggcgucguggugaccgccaacuccgggaccaucgcgcugggcagcuucgucauccugcucaucuccuacagcaucauccuggugucccugcgcaagcagagcgccgaggggcggcgcaaggcccucuccacgugcggcagccacaucgccaugguggucaucuucuucggccccugcaccuucauguacaugcggcccgacaccaccuucuccgaggacaagaugguggcggucuucuacaccaucaucacgccgaugcugaacccccugaucuacacccuccgcaacgccgaggugaagaacgccaugaagaagcugugggggcggaacguguuccuggaggccaagggcaaguga

SEQ ID NO: 34059 - RNA, 942 nt, Artificial Sequence
  derived and/or modified sequence opt1 from OR51A2__Homo_sapiens__NP_001004748
auguccaucaucaacaccuccuacguggagaucaccacguucuuccuggucggcaugcccgggcucgaguacgcccacaucuggaucagcaucccgaucugcuccauguaccugaucgccauccugggcaacgggaccauccucuucaucaucaagaccgagcccagccugcacggccccauguacuacuuccuguccaugcucgcgaugagcgaccuggggcugucccucagcucccugcccaccgugcugagcaucuuccucuucaacgccccggagacguccagcuccgccugcuucgcccaggaguucuucauccacggcuucagcgugcuggaguccagcguccugcucaucauguccuucgaccgcuuccuggccauccacaacccccugcgguacaccagcauccucaccaccgugcgcguggcgcagaucggcaucgucuucuccuucaagagcaugcugcuggugcuccccuuccccuucacgcugcggagccugcgcuacugcaagaagaaccagcucucccacagcuacugccugcaccaggacgugaugaagcuggccugcuccgacaaccggaucgacgucaucuacggguucuucggcgcccucugccugaugguggacuucauccugaucgccgugagcuacacccucauccugaagaccgucccggggaucgcguccaagaaggaggagcugaaggcccucaacacgugcgugagccacaucugcgccgugaucaucuucuaccugcccaucaucaaccuggccgucgugcaccgcuucgccggccacgugagcccccucaucaacguccugauggcgaacgugcugcuccuggugcccccgcugaugaagcccaucgucuacugcgugaagaccaagcagauccgggugcgcgucguggccaagcucugccaguggaagaucuga

SEQ ID NO: 34060 - RNA, 939 nt, Artificial Sequence
  derived and/or modified sequence opt1 from OR51A7__Homo_sapiens__NP_001004749
augagcgugcugaacaacuccgaggucaagcuguuccuccugaucggcauccccgggcucgagcacgcccacaucugguucagcaucccgaucugccugauguaccugcucgccaucaugggcaacugcaccauccuguucaucaucaagaccgagcccucccugcacgagcccauguacuacuuccucgcgaugcuggccgugagcgacauggggcugucccucagcucccugcccacgaugcugcgcguguuccucuucaacgccaugggcaucagcccgaacgccugcuucgcccaggaguucuucauccacggguucaccgucauggaguccagcgugcugcugaucaugucccucgaccgguuccuggcgauccacaacccccugcgcuacagcuccauccucaccagcaaccggguggccaagaugggccugauccuggccauccgcuccauccuccuggucauccccuuccccuucacccugcggcgccucaaguacugccagaagaaccugcugagccacuccuacugccuccaccaggacacgaugaagcuggccugcagcgacaacaagaccaacgugaucuacggcuucuucaucgcgcugugcaccaugcucgaccuggcccugaucgugcucuccuacguccugauccugaagaccauccucagcaucgccagccuggccgagcggcugaaggcccucaacacgugcgugucccacaucugcgcggugcugaccuucuacgucccgaucaucacccuggccgccaugcaccacuucgccaagcacaagagcccccucguggugauccugaucgccgacauguuccugcucgucccgccccugaugaaccccaucguguacugcgugaagacccgccagaucugggagaagauccuggggaagcugcucaacgucugcggccgguga

SEQ ID NO: 34061 - RNA, 957 nt, Artificial Sequence
  derived and/or modified sequence opt1 from OR51E1__Homo_sapiens__NP_689643
augaugguggaccccaacggcaacgagagcuccgccaccuacuucauccugaucgggcucccgggccuggaggaggcccaguucuggcuggcguucccccucugcagccuguaccugaucgccguccucgggaaccugaccaucaucuacaucgugcgcacggagcacucccugcacgagcccauguacaucuuccucugcaugcugagcggcaucgacauccugaucuccaccagcuccaugcccaagaugcucgccaucuucugguucaacagcaccaccauccaguucgacgccugccugcugcagauguucgccauccacucccucagcgggauggaguccacggugcugcuggcgauggccuucgaccgguacgucgccaucugccacccgcuccgccacgccaccgugcugacccugccccgggugaccaagaucggcgucgcggccguggugcgcggcgccgcccucauggcgccccugcccgucuucaucaagcagcugccguucugccggagcaacauccucucccacagcuacugccugcaccaggacgugaugaagcuggccugcgacgacauccgcgugaacgucguguacgggcucaucgugaucaucuccgccaucggccuggacagccugcucaucuccuucagcuaccugcugauccucaagacgguccuggggcugacccgggaggcccaggccaaggccuucgggaccugcgugucccacgugugcgcggucuucaucuucuacgugcccuucaucggccucagcauggugcaccgcuucagcaagcggcgcgacagcccccugcccgucauccuggccaacaucuaccuccuggugccgcccgugcugaaccccaucgucuacggcgugaagaccaaggagauccggcagcgcauccuccggcuguuccacgucgccacgcacgccuccgagcccuga

SEQ ID NO: 34062 - RNA, 963 nt, Artificial Sequence
  derived and/or modified sequence opt1 from OR51E2__Homo_sapiens__NP_110401
augagcuccugcaacuucacccacgccaccuucgugcugaucggcauccccgggcucgagaaggcccacuucugggucggcuucccgcugcugagcauguacgugguggcgauguucgggaacugcaucgucguguucaucgugcgcacggagcggucccuccacgcccccauguaccuguuccugugcaugcucgccgccaucgaccuggcccugagcaccuccaccaugcccaagauccucgcgcuguucugguucgacagccgcgagaucuccuucgaggccugccugacccagauguucuucauccacgcccucagcgccaucgaguccacgauccugcuggcgauggccuucgaccgguacgucgccaucugccacccccuccgccacgccgccgugcugaacaacaccgugaccgcgcagaucggcaucgucgccguggugcgggggagccuguucuucuucccgcucccccugcugaucaagcgccucgccuucugccacuccaacguccugagccacuccuacugcgugcaccaggacgugaugaagcuggccuacgccgacacccuccccaacgucguguacggccugacggcgauccugcucgugaugggcgucgacgugauguucaucagccuguccuacuuccugaucauccggaccgugcuccagcugcccagcaaguccgagcgcgccaaggccuucgggaccugcgucagccacaucggcguggugcuggccuucuacgucccgcucaucgggcuguccgugguccaccgguucggcaacagccugcaccccaucgugcgcguggucaugggggacaucuaccuccugcugccgcccgugaucaaccccaucaucuacggcgccaagaccaagcagauccggacgcgcgugcucgcgauguucaagaucagcugcgacaaggaccugcaggccgucggcgggaaguga

SEQ ID NO: 34063 - RNA, 1029 nt, Artificial Sequence
  derived and/or modified sequence opt1 from OR51F2__Homo_sapiens__NP_001004753
augaccgagaccagccuguccagccagugcuuccccauguccgugcucaacaacaccaucgccgagccgcugaucuuccugcucaugggcauccccgggcugaaggccacccaguacuggaucagcauccccuucugccugcucuacgucguggcgguguccggcaacagcaugauccuguucgucgugcugugcgagcgcucccuccacaagcccauguacuacuuccugagcaugcuguccgccaccgaccucagccugucccugugcacccucagcacgacccuggggguguucugguucgaggcccgggagaucaaccugaacgccugcaucgcccagauguucuuccuccacggcuucaccuucauggaguccgggguccugcuggcgauggccuucgaccgcuucguggccaucugcuacccgcuccgguacaccacgauccugaccaacgcccgcaucgcgaagaucggcaugagcaugcugauccggaacguggccgucaugcuccccgugaugcuguucgugaagcgccuguccuucugcagcuccaugguccucagccacuccuacugcuaccacguggaccugauccagcugagcugcaccgacaaccggaucaacagcauccucggccuguucgcccugcucuccaccacgggguucgacugccccugcauccugcugagcuacauccucaucauccgcuccgugcugagcaucgccuccagcgaggagcggcgcaaggccuucaacacgugcaccucccacaucagcgcggucuccaucuucuaccugccccucaucagccugucccuggugcaccgguacggccacagcgccccgcccuucgugcacaucaucauggccaacgucuuccuccugaucccgcccgugcugaaccccaucaucuacuccgugaagaucaagcagauccagaaggccaucaucaagguccucauccagaagcacagcaaguccaaccaccagcuguuccugauccgcgacaaggccaucuacgaguga

SEQ ID NO: 34064 - RNA, 966 nt, Artificial Sequence
  derived and/or modified sequence opt1 from OR51V1__Homo_sapiens__NP_001004760
auguuccugagcucccgcaugaucaccagcgugucccccagcaccuccacgaacagcuccuuccuccugaccggcuucagcgggauggagcagcaguaccccuggcuguccauccccuucagcuccaucuacgccaugguccuccugggcaacugcauggugcugcacgugaucuggaccgagcccagccuccaccagcccauguucuacuuccuguccaugcuggcccucaccgaccugugcauggggcugagcacggucuacaccgugcucggcauccugugggggaucauccgggagaucucccuggacagcugcaucgcgcaguccuacuucauccacggccucagcuucauggaguccagcgugcugcugaccauggccuucgaccgcuacaucgccaucugcaacccgcuccgguacagcuccauccugaccaacagccgcaucaucaagaucggccugacgaucaucgggcgguccuucuucuucaucaccccgcccaucaucugccucaaguucuucaacuacugccacuuccacauccugagccacuccuucugccugcaccaggaccuccugcgccuggccugcagcgacauccgguucaacuccuacuacgcccucaugcuggucaucugcauccugcuccuggacgcgauccugauccucuucagcuacauccugauccugaaguccgugcucgccguggccagccaggaggagcgccacaagcuguuccagaccugcaucucccacaucugcgccguccugguguucuacauccccaucaucagccucaccauggugcaccgguucggcaagcaccugucccccgucgcgcacgugcugaucgggaacaucuacauccucuucccgccccugaugaaccccaucaucuacagcgugaagacgcagcagauccacacccgcaugcugcgccucuucucccugaagcgguacuga

SEQ ID NO: 34065 - RNA, 972 nt, Artificial Sequence
  derived and/or modified sequence opt1 from OR52B2__Homo_sapiens__NP_001004052
augagccacaccaacgugaccaucuuccaccccgccgucuucgugcugccgggcauccccgggcucgaggccuaccacaucuggcuguccaucccccugugccucaucuacaucacggcggugcugggcaacagcauccugaucgucgugaucgugauggagcgcaaccuccacguccccauguacuucuuccuguccaugcuggccgugauggacauccuccugagcaccaccaccgugccgaaggcccuggccaucuucuggcuccaggcccacaacaucgcguucgacgccugcgucacgcagggguucuucgugcacaugauguucgugggcgaguccgccauccugcuggccauggcguucgaccgguucgucgccaucugcgcgccccuccgcuacaccaccgugcugaccuggcccguggucgggcggaucgcccuggccgugaucacgcgcagcuucugcaucaucuuccccgugaucuuccuccugaagcggcugccguucugccucaccaacaucgucccccacuccuacugcgagcacaucggcguggcccgccuggccugcgccgacaucaccgugaacaucugguacggcuucagcguccccaucgugauggugauccuggacgucauccucaucgccguguccuacagccugauccugcgggccgucuuccgccuccccucccaggacgcgcggcacaaggcccugagcacgugcgggucccaccugugcgugauccucauguucuacgugccgagcuucuucacccugcugacccaccacuucggccgcaacaucccccagcacguccacauccuccuggccaaccuguacguggccgugccgcccaugcucaaccccaucgucuacggggugaagaccaagcagauccgggagggcguggcccaccgcuucuucgacaucaagaccuggugcugcacgagcccccugggguccuga

SEQ ID NO: 34066 - RNA, 945 nt, Artificial Sequence
  derived and/or modified sequence opt1 from OR52B4__Homo_sapiens__NP_001005161
augcccaccgugaaccacagcggcaccucccacacgguguuccaccuccuggggauccccggccugcaggaccagcacauguggaucagcauccccuucuucaucuccuacgugaccgcccugcucgggaacagccugcugaucuucaucauccucaccaagcgcucccugcacgagcccauguaccuguuccucugcaugcuggccggcgcggacaucgugcugagcacgugcaccaucccccaggcccucgccaucuucugguuccgggccggggacaucucccuggaccgcugcaucacccagcuguucuucauccacagcaccuucaucuccgagagcggcauccuccuggucauggccuucgaccacuacaucgcgaucugcuacccgcugcgguacaccacgauccucaccaacgcccugaucaagaagaucugcgugaccgugucccugcgcagcuacggcaccaucuuccccaucaucuuccuccugaagcggcugacguucugccagaacaacaucaucccccacaccuucugcgagcacaucgggcucgccaaguacgccugcaacgacauccgcaucaacaucugguacggcuucuccauccugaugagcaccgucgugcuggacgugguccucaucuucaucuccuacaugcugauccugcacgcgguguuccacaugcccagcccggacgccugccacaaggcccucaacaccuucgggucccacgugugcaucaucauccuguucuacggcagcgggaucuucacgauccugacccagcgguucggccgccacaucccgcccugcauccacaucccccucgccaacgucugcauccuggccccgcccaugcugaaccccaucaucuacggcaucaagaccaagcagauccaggagcaggucgugcaguuccucuucaucaagcagaaguga

SEQ ID NO: 34067 - RNA, 957 nt, Artificial Sequence
  derived and/or modified sequence opt1 from OR52D1__Homo_sapiens__NP_001005163
augagcgacuccaaccugagcgacaaccaccuccccgacaccuucuuccugaccggcaucccggggcuggaggccgcccacuucuggaucgcgauccccuucugcgccauguaccucguggcccuggucggcaacgccgcccugauccucgugaucgcgauggacaacgcccugcacgcccccauguaccuguuccucugccugcugucccucacggaccuggcccugagcuccaccaccgugcccaagaugcucgcgauccuguggcugcacgccggggagaucagcuucggcgggugccucgcccagauguucugcguccacuccaucuacgcccuggagagcuccauccugcucgccauggcguucgaccgcuacguggccaucugcaacccgcugcgguacaccacgauccugaaccacgccgugaucggccgcaucggcuucgucgggcuguuccggagcguggccaucgugucccccuucaucuuccugcugcgccggcuccccuacugcggccaccgcgucaugacccacaccuacugcgagcacauggggaucgcccggcuggcgugcgccaacaucaccgugaacaucguguacggccugacggucgcccuccuggccauggggcuggacagcauccucaucgccaucuccuacggcuucauccugcacgcgguguuccaccuccccagccacgacgcccagcacaaggcccucuccacgugcggcagccacaucgggaucauccugguguucuacaucccggccuucuucuccuuccugacccaccgcuucggccaccacgagguccccaagcacgugcacaucuuccucgccaaccuguacgugcuggucccgcccgugcucaaccccauccuguacggggcgcggaccaaggagauccgcagccggcugcucaagcugcugcaccucggcaagaccuccaucuga

SEQ ID NO: 34068 - RNA, 942 nt, Artificial Sequence
  derived and/or modified sequence opt1 from OR52E6__Homo_sapiens__NP_001005167
augcccaucgccaacgacacccaguuccacaccagcuccuuccugcuccugggcaucccggggcuggaggacgugcacaucuggaucggcuuccccuucuucagcgucuaccucaucgcccugcuggggaacgcggccaucuucuucgugauccagacggagcagucccuccacgagcccauguacuacugccuggccaugcuggacagcaucgaccucucccugagcaccgccaccauccccaagaugcugggcaucuucugguucaacaucaaggagaucuccuucgggggcuaccucagccagauguucuucauccacuucuucaccgugauggaguccaucguccugguggccauggcguucgaccgcuacaucgccaucugcaagccgcugugguacacgaugauccucaccagcaagaucaucucccugaucgccggcaucgccgugcugcggagccucuacauggucaucccccugguguuccugcuccugcgccugcccuucugcgggcaccggaucaucccccacaccuacugcgagcacaugggcaucgcgcgccucgccugcgccuccaucaaggugaacaucauguucgggcugggcagcaucucccugcuccugcuggacguccuccugaucauccugagccacauccggauccucuacgccguguucugccugccguccugggaggcccgccugaaggcgcucaacacgugcgggagccacaucggcgugauccuggccuucuccacccccgccuucuucagcuucuucacccacugcuucggccacgacaucccccaguacauccacaucuuccuggccaaccucuacgucguggugcccccgacccugaaccccgucaucuacggggugcggaccaagcacauccgcgagacggugcugcggaucuucuucaagaccgaccacuga

SEQ ID NO: 34069 - RNA, 975 nt, Artificial Sequence
  derived and/or modified sequence opt1 from OR52I1__Homo_sapiens__NP_001005169
augcugggccccgccuacaaccacaccauggagaccccggccagcuuccuccugguggggauccccggccugcaguccagccaccucuggcuggcgaucucccugagcgccauguacaucacggcccuccuggggaacacccugaucgucaccgccaucuggauggacuccacccgccacgagcccauguacugcuuccucugcgugcuggccgcgguggacaucgucauggccagcuccguggugcccaagauggucagcaucuucugcuccggcgacagcuccaucagcuucuccgccugcuucacgcagauguucuucgugcaccuggccaccgcgguggagaccgggcuccugcugaccauggccuucgaccgguacgucgccaucugcaagccgcuccacuacaagcgcauccugacgccccaggugaugcugggcaugagcauggccgugaccauccgggccgucaccuucaugacgccccucuccuggaugaugaaccaccuccccuucugcggcagcaacguggugguccacuccuacugcaagcacaucgcgcuggcccgccuggccugcgccgacccggugcccagcucccuguacagccugaucgggagcucccucauggugggcagcgacgucgccuucaucgcggccuccuacauccugauccugcgggccguguucgaccucagcuccaagaccgcccagcugaaggcccugagcacgugcgggucccacgugggcgucauggcgcucuacuaccugcccgggauggccagcaucuacgccgccuggcugggccaggacaucgugccccuccacacccaggugcugcuggccgaccucuacgucaucaucccggcgacccugaaccccaucaucuacggcaugcgcaccaagcagcugcucgaggggaucugguccuaccugaugcacuuccuguucgaccacagcaaccucggcuccuga

SEQ ID NO: 34070 - RNA, 1053 nt, Artificial Sequence
  derived and/or modified sequence opt1 from OR52I2__Homo_sapiens__NP_001005170
augugccagcagauccugcgcgacugcauccuccugauccaccaccugugcaucaaccggaagaaggugagccucgucaugcugggccccgccuacaaccacaccauggagaccccggccuccuuccugcucguggggauccccggccugcagagcucccaccuguggcucgcgaucagccuguccgccauguacaucaucgcccugcucgggaacaccaucaucgugaccgccaucuggauggacagcacccgccacgagcccauguacugcuuccugugcguccuggccgcgguggacaucgugauggccuccagcgucgugcccaagaugguguccaucuucugcagcggcgacuccagcaucuccuucagcgccugcuucacccagauguucuucguccaccucgccaccgcgguggagaccgggcugcugcucaccauggccuucgaccgguacguggccaucugcaagccgcugcacuacaagcgcauccugacgccccaggucaugcucggcauguccauggccaucacgauccgggccaucaucgcgaucacgccccugagcuggauggugucccaccuccccuucugcggcagcaacguggucgugcacuccuacugcgagcacaucgcccuggcccgccuggccugcgccgacccggugcccagcagccuguacucccucaucgggagcucccugauggucggcagcgacguggcguucaucgccgccuccuacauccugauccucaaggccguguucgggcugagcuccaagaccgcccagcugaaggcgcucagcacgugcggcucccacgucggggugauggcccuguacuaccugcccggcauggccagcaucuacgccgccuggcucggccaggacguggucccccugcacacccaggugcugcucgcggaccuguacgucaucaucccggccacccugaaccccaucaucuacgggaugcggaccaagcagcuccgcgagcggaucugguccuaccugaugcacgugcuguucgaccacagcaaccucggcuccuga

SEQ ID NO: 34071 - RNA, 945 nt, Artificial Sequence
  derived and/or modified sequence opt1 from OR52K1__Homo_sapiens__NP_001005171
augcugcccagcaacaucaccuccacccacccggccguguuccuccuggucggcauccccgggcuggagcaccuccacgccuggaucagcauccccuucugcuucgcguacacgcuggcccugcucggcaacugcacccugcuguucaucauccaggccgacgccgcccuccacgagcccauguaccuguuccuggcgaugcucgccaccaucgaccuggugcuguccagcaccacgcucccgaagaugcuggccaucuucugguuccgcgaccaggagaucaacuucuucgccugccuggugcagauguucuuccuccacuccuucagcaucauggaguccgcgguccugcuggccauggccuucgaccgguacguggccaucugcaagccccuccacuacaccaccgugcugaccgggagccugaucacgaagaucggcauggccgcggucgcccgcgccgugacccucaugacgccccugcccuuccugcuccggcgcuuccacuacugccgggggccggugaucgcccacugcuacugcgagcacauggccgucgugcgccuggcgugcggcgacaccuccuucaacaacaucuacggcaucgccguggccauguucaucgucgugcuggaccuccuguucgugauccugagcuacgucuucauccuccaggccgugcugcagcuggccucccaggaggcgcgguacaaggccuucgggaccugcgugagccacaucggcgccauccucuccaccuacacccccgucgugaucagcuccgugaugcaccgcgucgcccggcacgccgcgccccgcgugcacauccugcuggccaucuucuaccuccuguucccgcccauggugaaccccaucaucuacggggucaagaccaagcagauccgggaguacgugcugagccucuuccagcgcaagaacauguga

SEQ ID NO: 34072 - RNA, 945 nt, Artificial Sequence
  derived and/or modified sequence opt1 from OR52K2__Homo_sapiens__NP_001005172
augagcgccuccaacaucacccugacccaccccacggccuuccuccuggugggcaucccggggcuggagcaccuccacaucuggaucagcauccccuucugccuggcguacacccuggcccuccugggcaacugcacccugcuccugaucauccaggccgacgccgcccugcacgagcccauguaccucuuccuggcgaugcuggccgccaucgaccucguccuguccagcuccgcccugcccaagaugcucgcgaucuucugguuccgcgaccgggagaucaacuucuucgccugccuggcccagauguucuuccugcacagcuucuccaucauggagagcgccgugcuccuggccauggcguucgaccgcuacguggccaucugcaagccgcugcacuacaccaagguccucacggggucccugaucaccaagaucggcauggccgccguggcccgggcggugacccugaugacgccccuccccuuccugcugcgcugcuuccacuacugccgggggcccgucaucgcccacugcuacugcgagcacauggccguggugcgccucgccugcggcgacaccagcuucaacaacaucuacggcaucgccgucgcgauguucaucguggugcuggaccugcuccuggucauccuguccuacaucuucauccuccaggccgugcugcugcucgccagccaggaggcccgguacaaggccuucgggaccugcgugucccacaucggcgcgauccuggccuucuacaccaccgucgugaucagcuccgugaugcaccgcgucgcccggcacgccgcgccgcacgugcacauccugcucgccaacuucuaccugcuguucccgcccauggugaaccccaucaucuacggggucaagacgaagcagauccgcgagagcauccucggcguguucccccggaaggacauguga

SEQ ID NO: 34073 - RNA, 954 nt, Artificial Sequence
  derived and/or modified sequence opt1 from OR52M1__Homo_sapiens__NP_001004137
augcugaccuuccacaacgugugcagcguccccuccagcuucuggcucaccggcaucccggggcuggagucccugcacguguggcucagcauccccuucggcuccauguaccugguggccgucguggggaacgugacgauccuggccgucgugaagaucgagcgcagccuccaccagcccauguacuucuuccugugcaugcuggcggccaucgaccucgugcuguccaccagcaccauccccaagcugcucggcaucuucugguucggggccugcgacaucggccuggacgccugccugggccagauguuccucauccacugcuucgccaccgucgaguccgggaucuuccuggcgauggccuucgaccgguacguggccaucugcaacccgcugcgccacagcauggugcucacguacaccgucgugggccggcuggggcuggugucccuccugcgcggcguccuguacaucgggccccucccccugaugauccggcugcgccucccccuguacaagacccacgugaucagccacuccuacugcgagcacauggccguggucgcgcugaccugcggcgacagccgggugaacaacguguacggccucuccaucggguuccugguccugauccucgacagcguggccaucgccgccuccuacgugaugaucuuccgcgccgucaugggccuggcgacgccggaggcccggcugaagacccucgggaccugcgccagccaccugugcgccauccugaucuucuacgugcccaucgccgucuccagccucauccaccgcuucggccagugcgugcccccgcccgugcacacccugcuggcgaacuucuaccuccugaucccgcccauccugaaccccaucgucuacgccgugcggacgaagcagauccgcgagagccuccugcagaucccccggaucgagaugaagauccgcuga

SEQ ID NO: 34074 - RNA, 942 nt, Artificial Sequence
  derived and/or modified sequence opt1 from OR5D18__Homo_sapiens__NP_001001952
augcugcucaccgaccgcaacaccagcggcacgaccuucacccugcugggguucuccgacuaccccgagcuccaggugccgcuguuccuggucuuccucgccaucuacaacgugaccgugcugggcaacaucgggcugaucgucaucaucaagaucaaccccaagcuccacacgcccauguacuucuuccugagccagcuguccuucguggacuucugcuacagcuccaucaucgcccccaagaugcucgugaaccuggucgugaaggaccggaccaucagcuuccugggcugcgugguccaguucuucuucuucugcaccuucguggugaccgaguccuuccuccuggcggucauggccuacgaccgcuucguggccaucugcaacccgcugcucuacacggugaacaugagccagaagcugugcguccugcucguggugggguccuacgccuggggcgucagcugcucccuggagcugaccugcagcgcccucaagcugugcuuccacggcuucaacaccaucaaccacuucuucugcgaguucuccagccugcucucccugagcugcuccgacaccuacaucaaccaguggcuccuguucuuccuggcgacguucaacgagaucagcacccugcucaucgugcugaccuccuacgccuucaucguggucaccauccugaagaugcggagcgugagcgggcgccggaaggccuucuccacgugcgccagccaccucaccgcgaucaccaucuuccacggcaccauccuguuccuguacugcgugcccaacuccaagaacagccgccacacggucaagguggccuccgucuucuacaccguggugauccccaugcucaacccccugaucuacagccugcggaacaaggacgucaaggacaccgugaccgagauccucgacacgaagguguucuccuacuga

SEQ ID NO: 34075 - RNA, 945 nt, Artificial Sequence
  derived and/or modified sequence opt1 from OR5H2__Homo_sapiens__NP_001005482
augagcaacgaggacauggagcaggacaacaccacccugcucacggaguucgugcugaccggccugaccuaccagcccgaguggaagaugccccucuuccuggucuuccuggugaucuaccucaucaccaucguguggaaccuggggcugaucgcccucaucuggaacgacccccagcugcacauccccauguacuucuuccugggcucccucgccuucgucgacgcguggaucagcuccacggugacccccaagaugcuggugaacuuccuggccaagaaccgcaugaucagccucuccgagugcaugauccaguucuucagcuucgccuucgggggcaccaccgagugcuuccugcuggccacgauggccuacgaccgguacgucgcgaucugcaagccgcuccuguaccccgugaucaugaacaacucccugugcauccgccuccuggccuucagcuuccucgggggcuuccugcacgcccugauccacgaggugcugaucuuccggcucaccuucugcaacuccaacaucauccaccacuucuacugcgacaucaucccccuguucaugaucagcugcaccgaccccuccaucaacuuccugauggucuucauccucagcggcuccauccagguguucaccaucgugacgguccugaacagcuacaccuucgcccuguucaccauccucaagaagaaguccgugcgcggggugcggaaggcguucagcacgugcggcgcccaccuccuguccgucagccuguacuacgggccgcugaucuucauguaccugcgccccgccuccccgcaggccgacgaccaggacaugaucgacagcguguucuacaccaucaucaucccccuccugaacccgaucaucuacagccugcggaacaagcaggucaucgacuccuucaccaagauggugaagcgcaacguguga

SEQ ID NO: 34076 - RNA, 978 nt, Artificial Sequence
  derived and/or modified sequence opt1 from OR5H6__Homo_sapiens__NP_001005479
auguuccuguaccucugcuucaucuuccagcggaccugcagcgaggagauggaggaggagaacgccacccugcugacggaguucgugcucaccggcuuccugcaccagcccgacugcaagaucccgcuguuccucgccuuccuggucaucuaccugaucaccaucauggggaaccucggccugaucgugcugaucuggaaggacccccaccuccacauccccauguaccuguuccuggggucccucgcguucguggacgccagccuguccagcaccgucacgcccaagaugcugaucaacuuccucgccaaguccaagaugaucagccuguccgagugcauggugcaguucuucagccuggugaccaccgucaccacggagugcuuccuccuggccaccauggccuacgaccgcuacguggcgaucugcaaggcccugcucuacccggugaucaugaccaacgagcugugcauccagcugcucguccuguccuucaucggcgggcugcuccacgcccugauccacgaggccuucagcuuccgccugaccuucugcaacuccaacaucauccagcacuucuacugcgacaucaucccccuccugaagaucagcugcacggacuccagcaucaacuuccugaugguguucaucuucgcgggcuccgugcaggucuucaccaucggcaccauccucaucagcuacaccaucauccuguucacgauccuggagaagaaguccaucaaggggauccggaaggccgugagcacgugcggcgcccaccuccuguccgugagccuguacuacgggccccucaccuucaaguaccugggcagcgccagcccccaggccgacgaccaggacaugauggagucccuguucuacaccgucaucgugccgcuccugaaccccaugaucuacucccugcgcaacaagcaggucaucgcgagcuucaccaagauguucaaguccaacguguga

SEQ ID NO: 34077 - RNA, 927 nt, Artificial Sequence
  derived and/or modified sequence opt1 from OR5K1__Homo_sapiens__NP_001004736
auggccgaggagaaccacaccaugaagaacgaguucauccugaccggcuucacggaccaccccgagcucaagacccugcuguucguggucuucuucgccaucuaccucaucaccgugguggggaacaucagccuggucgcgcugaucuucacccaccgccggcuccacacgccgauguacaucuuccugggcaaccuggcccucguggacuccugcugcgccugcgccaucacccccaagaugcuggagaacuucuucagcgagaacaagcgcaucucccuguacgagugcgccgugcaguucuacuuccucugcaccgucgagaccgcggacugcuuccugcuggccgccauggccuacgaccgguacguggcgaucugcaacccccuccaguaccacaucaugaugagcaagaagcugugcauccagaugacgaccggggccuucaucgccggcaaccugcacuccaugauccacguggggcucgucuuccgccugguguucugcggcagcaaccacaucaaccacuucuacugcgacauccugccccucuaccggcuguccugcguggacccguacaucaacgagcugguccucuucaucuucagcggcuccguccagguguucaccaucgggagcgugcugaucuccuaccuguacauccuccugaccaucuucaagaugaaguccaaggagggccgcgccaaggccuucagcacgugcgcgagccacuuccuguccgugagccucuucuacgggucccuguucuucauguacgugcggcccaaccugcucgaggagggcgacaaggacauccccgccgccauccuguucaccaucgucgugccccugcucaacccguucaucuacagccugcgcaaccgggaggugaucuccguccugcgcaagauccucaugaagaaguga

SEQ ID NO: 34078 - RNA, 951 nt, Artificial Sequence
  derived and/or modified sequence opt1 from OR5K2__Homo_sapiens__NP_001004737
augguggaggagaaccacaccaugaagaacgaguucauccugaccggcuucaccgaccaccccgagcucaagacccugcuguucgucguguucuucgccaucuaccucaucaccguggucgggaacaucagccugguggcccugaucuucacccacugccgccuccacacgccgauguacaucuuccugggcaaccuggcgcucguggacuccugcugcgccugcgccaucacccccaagaugcuggagaacuucuucagcgaggggaagcggaucucccuguacgagugcgccguccaguucuacuuccucugcaccguggagaccgccgacugcuuccugcuggcggccguggccuacgaccgcuacgucgccaucugcaacccccuccaguaccacaucaugaugagcaagaagcugugcauccagaugacgaccggcgcguucaucgccgggaaccugcacuccaugauccacgugggccucguguuccggcuggucuucugcggccugaaccacaucaaccacuucuacugcgacacccucccccuguaccgccugagcugcguggacccguucaucaacgagcucgugcuguucaucuucuccgggagcguccagguguucaccaucggcuccgugcugaucagcuaccucuacauccugcugacgaucuuccggaugaaguccaaggaggggcgcgccaaggccuucagcacgugcgccucccacuucagcuccgucagccucuucuacggcuccaucuucuuccuguacauccggcccaaccugcucgaggagggcgggaacgacauccccgcggccauccuguucaccaucguggugccccugcucaacccguucaucuacagccugcgcaacaaggaggucaucuccgugcugcggaagauccuccugaagaucaagagccagggcagcgugaacaaguga

SEQ ID NO: 34079 - RNA, 966 nt, Artificial Sequence
  derived and/or modified sequence opt1 from OR5V1__Homo_sapiens__NP_110503
auggagcgcaagaaccagaccgccaucaccgaguucaucauccugggcuucagcaaccucaacgagcugcaguuccugcuguucacgaucuucuuccugaccuacuucugcacccucgggggcaacauccucaucauccugaccacggugaccgacccccaccuccacacccccauguacuacuuccuggggaaccuggccuucaucgacaucugcuacaccacguccaacgucccccagaugauggugcaccuccugagcaagaagaaguccaucagcuacgugggcugcgucgugcagcuguucgcguucguguucuucgucggguccgagugccugcuccuggccgccauggccuacgaccgguacaucgccaucugcaacccccugcgcuacagcgugauccucuccaaggugcugugcaaccagcuggcggccagcugcugggccgccggcuuccucaacuccgucgugcacaccgugcugaccuucugccugcccuucugcggcaacaaccagaucaacuacuucuucugcgacaucccgccccuccugauccugagcugcgggaacaccuccgucaacgagcucgcgcugcugagcacgggcguguucaucggguggacccccuuccucugcaucgugcuguccuacaucugcaucaucagcaccauccugcggauccaguccagcgagggccgccggaaggccuucuccacgugcgccagccaccucgccaucgucuuccuguucuacggguccgccaucuucaccuacgugcgccccaucagcaccuacagccugaagaaggaccggcucguguccguccuguacagcguggugaccccgaugcugaaccccaucaucuacacccuccgcaacaaggacaucaaggaggcggucaagacgaucggcuccaaguggcagccgcccaucagcucccuggacagcaagcugaccuacuga

SEQ ID NO: 34080 - RNA, 936 nt, Artificial Sequence
  derived and/or modified sequence opt1 from OR6B1__Homo_sapiens__NP_001005281
auggagcuggagaaccagacccgcgugaccaaguucauccucgucggcuuccccgggagccuguccaugcgggccgccauguuccugaucuuccucguggcguacauccugacgguggccgagaacgucaucaucauccugcucgugcugcagaaccgcccgcugcacaagcccauguacuucuuccucgccaaccugagcuuccuggagaccugguacaucuccgugaccguccccaagcuccuguucagcuucugguccgugaacaacagcaucuccuucacccugugcaugauccagcucuacuucuucaucgcccugaugugcacggagugcgugcugcucgccgcgauggccuacgaccgguacgucgccaucugccgcccccugcacuacccgaccaucaugagccacggccugugcuuccggcucgcccugggguccugggcgaucggcuucgggaucagccuggccaagaucuacuucaucuccugccucagcuucugcggccccaacgugaucaaccacuucuucugcgacaucucccccgugcugaaccugagcugcaccgacauguccaucaccgagcucgucgacuucauccuggcccuggugaucuuccucuucccccuguucaucacggugcugagcuacggcugcauccucgccaccauccugugcaugccgaccgggaagcagaaggccuucuccacgugcgcgagccaccuggucguggugaccaucuucuacuccgccaucaucuucauguacgcccgcccccgggucauccacgccuucaacaugaacaagaucaucagcaucuucuacgccaucgugacccccagccucaaccccuucaucuacugccugcgcaaccgggaggugaaggaggcgcugaagaagcucgccuacugccaggccucccgcagcgacuga

SEQ ID NO: 34081 - RNA, 939 nt, Artificial Sequence
  derived and/or modified sequence opt1 from OR6B2__Homo_sapiens__NP_001005853
augagcggcgagaacgugaccaaggucuccaccuucauccugguggggcuccccacggccccgggccugcaguaccuccuguuccugcuguuccuccugaccuaccuguucgugcucgucgagaaccuggccaucauccugaucguguggagcuccaccagccuccaccgccccauguacuacuuccuguccagcauguccuuccuggagaucugguacgugagcgacaucacccccaagaugcucgagggguuccugcugcagcagaagcggaucuccuucgucggcugcaugacgcagcucuacuucuucagcucccuggugugcaccgagugcgugcugcucgcgagcauggccuacgaccgcuacgucgccaucugccacccccugcgguaccacgugcuggugaccccggggcucugccugcagcuggucggcuucuccuucgugagcggcuucaccaucuccaugaucaaggugugcuucaucagcuccgucacguucugcgggagcaacgugcucaaccacuucuucugcgacaucucccccauccugaagcuggccugcaccgacuucagcaccgccgagcucguggacuucauccuggcguucaucauccuggucuucccccuccuggccaccauccugagcuacuggcacaucacgcucgccgugcugcgcauccccuccgccaccggcugcuggcgggcguucagcacgugcgccucccaccugaccguggucaccguguucuacaccgcccuccuguucauguacgugcgcccgcaggccaucgacagccaguccagcaacaagcugaucuccgccgucuacaccguggucacccccaucaucaacccccucaucuacugccugcggaacaaggaguucaaggacgcgcugaagaaggcccucgggcugggccagacgagccacuga

SEQ ID NO: 34082 - RNA, 939 nt, Artificial Sequence
  derived and/or modified sequence opt1 from OR6C1__Homo_sapiens__NP_001005182
augcgcaaccacaccgagaucaccgaguucauccugcucggccugacggacgaccccaacuuccagguggugaucuucguguuccugcucaucaccuacaugcugagcaucaccgggaaccugacccucaucacgaucacccugcuggacucccaccuccagaccccgauguacuucuuccugcggaacuucagcauccuggagaucuccuucaccacggugagcauccccaaguuccucggcaacaucaucuccggggacaagaccaucagcuucaacaacugcaucguccagcuguucuucuucauccugcucggcgugaccgaguucuaccugcuggccgccauguccuacgaccgcuacguggcgaucugcaagccccuccacugccugagcaucaugaaccggcgcgucugcacccugcucguguucacguccuggcuggugagcuuccugaucaucuuccccgcccucaugcugcugcucaagcugcacuacugccgguccaacaucaucgaccacuucacgugcgacuacuucccgcugcuccagcuggccugcagcgacaccaaguuccuggaggucaugggguucuccugcgccgccuucacccucauguucacccuggcgcugaucuuccucagcuacaucuacaucauccgcaccauccugcggauccccuccaccagccagcgcaccaaggccuucuccacgugcagcucccacauggugguggucagcaucagcuacggcuccugcaucuucauguacaucaagcccagcgccaaggaccgggugucccugagcaagggcguggccauccucaacaccuccgucgcgcccaugaugaacccguucaucuacagccugcgcaaccagcaggucaagcaggccuucaucaacauggcccggaagaccguguucuucaccuccacguga

SEQ ID NO: 34083 - RNA, 927 nt, Artificial Sequence
  derived and/or modified sequence opt1 from OR6F1__Homo_sapiens__NP_001005286
auggacaccggcaacaagacccugccccaggacuuccuccugcugggguucccgggcagccagacgcuccagcugucccuguucaugcuguuccucgugauguacauccugaccgucagcgggaacguggccauccucaugcugguguccaccagccaccagcugcacacccccauguacuucuuccucuccaaccugagcuuccuggagaucugguacacgaccgccgcgguccccaaggcccucgccauccugcugggccgcucccagaccaucagcuucaccuccugccuccugcagauguacuucguguucagccuggggugcacggaguacuuccuccuggccgccauggcguacgaccggugccuggccaucugcuacccccuccacuacggcgccaucauguccagccugcuguccgcccagcucgcgcugggcagcugggugugcggguucgucgccaucgccgugccgaccgcccugaucuccggccucagcuucugcgggccccgcgccaucaaccacuucuucugcgacaucgcgcccuggaucgcccuggccugcaccaacacccaggccguggagcuggucgccuucgugaucgcgguggucgugauccucuccagcugccugaucacguucguguccuacgucuacaucaucagcaccauccugcggauccccagcgccuccggccgcagcaaggccuucuccacgugcagcucccaccucaccguggugcugaucugguacgggagcaccgucuuccugcacgugcggaccuccaucaaggacgcccucgaccugaucaaggccgugcacguccugaacaccguggugaccccgguccucaaccccuucaucuacacgcugcgcaacaaggaggugcgggagacccugcucaagaaguggaagggcaaguga

SEQ ID NO: 34084 - RNA, 975 nt, Artificial Sequence
  derived and/or modified sequence opt1 from OR6K2__Homo_sapiens__NP_001005279
auggagagccccaaccgcaccaccauccaggaguucaucuucuccgccuucccguacagcugggugaaguccgucgugugcuucgugccccuccuguucaucuacgccuucaucgucgugggcaaccuggugaucaucacggucgugcagcugaacacccaccuccacacccccauguacaccuucaucagcgcgcuguccuuccuggagaucugguacacgaccgccaccauccccaagaugcucagcucccugcugagcgagcgguccaucagcuucaacgggugccuccugcagauguacuucuuccacuccaccggcaucugcgaggugugccugcucacggucauggccuucgaccacuaccuggccaucugcagcccgcugcacuaccccuccaucaugacccccaagcucugcacccagcugacccugagcugcugcgugugcggguucaucacgccccucccggagaucgccuggaucuccacccugcccuucugcggcagcaaccaccuggagcacaucuucugcgacuuccuccccgugcugcgccuggcgugcaccgacacccgggccaucgucaugauccaggugguggacgucauccacgccguggagaucaucacggccgugaugcucaucuucauguccuacgacgggaucgucgcggugauccugcgcauccacagcgccggcggccggcgcaccgccuucuccacgugcgugagccacuucaucgucuucagccuguucuucggguccgugacccucauguaccugcgguucagcgccaccuacucccuguucugggacaucgccaucgcgcucgccuucgccgugcugagccccuucuucaacccgaucaucuacucccugcgcaacaaggagaucaaggaggccaucaagaagcacaucggccaggccaagaucuucuucagcguccggcccgggaccuccagcaagaucuucuga

SEQ ID NO: 34085 - RNA, 948 nt, Artificial Sequence
  derived and/or modified sequence opt1 from OR6K3__Homo_sapiens__NP_001005327
auggagagcggcaaccaguccaccgugaccgaguucaucuucacgggguucccccagcugcaggacggcagccuccuguacuucuucccgcugcuguucaucuacaccuucaucaucaucgacaaccugcugaucuucuccgccguccgccucgacacccaccuccacaaccccauguacaacuucaucagcaucuucuccuuccuggagaucugguacaccacggccaccauccccaagaugcucagcaaccugaucuccgagaagaaggcgaucagcaugaccgggugcauccugcagauguacuucuuccacucccucgagaacagcgagggcauccugcugaccacgauggccaucgaccgguacguggccaucugcaacccccuccgcuaccagaugaucaugaccccgcggcugugcgcccagcuguccgccgggagcugccucuucggcuuccugauccugcuccccgagaucgugaugaucuccacccugcccuucugcggccccaaccagauccaccagaucuucugcgaccuggucccggugcucagccuggcgugcaccgacacguccaugauccugaucgaggacgugauccacgccgucaccaucaucaucaccuuccucaucaucgcccugagcuacgugcgcaucgugaccgucauccugcggauccccuccagcgaggggcgccagaaggccuucuccacgugcgcgggccaccucaugguguuccccaucuucuucgggagcgugagccugauguaccugcgguucuccgacaccuacccgcccguccucgacaccgccaucgcccugauguucaccgugcuggcccccuucuucaaccccaucaucuacagccuccgcaacaaggacaugaacaacgccaucaagaagcuguucugccugcagaaggugcucaacaagcccggcggguga

SEQ ID NO: 34086 - RNA, 1032 nt, Artificial Sequence
  derived and/or modified sequence opt1 from OR6K6__Homo_sapiens__NP_001005184
augaagcaguacagcgugggcaaccagcacuccaacuaccgcagccugcuguuccccuuccugugcucccagaugacccagcugaccgccagcgggaaccagacgauggucaccgaguuccucuucuccauguucccgcacgcccaccggggcgggcugcuguucuucaucccccuccugcugaucuacggcuucauccucaccgggaaccugaucauguucaucgugauccaggugggcauggcgcugcacacgccccucuacuucuucaucagcguccuguccuuccuggagaucugcuacaccaccaccaccauccccaagaugcucagcugccugaucuccgagcagaaguccaucagcguggccggcugccugcuccagauguacuucuuccacagccuggggaucacggaguccugcgugcugaccgccauggccaucgaccgcuacaucgccaucugcaacccgcuccgguaccccaccaucaugauccccaagcugugcauccagcugaccgucggcagcugcuucugcggguuccuccuggugcugcccgagaucgcguggaucuccacgcucccguucugcggcagcaaccagauccaccagaucuucugcgacuucacccccgugcugucccuggccugcaccgacaccuuccucgucgugaucguggacgccauccacgccgcggagaucgucgccagcuuccuggugaucgcccuguccuacauccgcaucaucaucgugauccucgggaugcacagcgccgagggccaccacaaggccuucagcacgugcgcggcccaccuggccgucuuccuccucuucuucggcuccguggccgugauguaccugcgguucagcgccaccuacuccgucuucugggacaccgcgaucgccgugaccuucgugauccuggcccccuucuucaaccccaucaucuacagccucaagaacaaggacaugaaggaggccaucgggcgccuguuccacuaccagaagcgggccggcugggcggggaaguga

SEQ ID NO: 34087 - RNA, 939 nt, Artificial Sequence
  derived and/or modified sequence opt1 from OR6N1__Homo_sapiens__NP_001005185
auggacaccggcaacuggagccagguggccgaguucaucauccugggguucccccaccuccagggcguccagaucuaccuguuccugcuccugcugcucaucuaccugaugaccgugcuggggaaccuccugaucuuccugguggucugccucgacucccgccugcacaccccgauguaccacuucgugagcauccuguccuucagcgagcucggcuacaccgccgcgaccauccccaagaugcuggccaaccugcucuccgagaagaagaccaucagcuucuccgggugccugcugcagaucuacuucuuccacagccucggcgccacggagugcuaccugcugaccgccauggccuacgaccgguaccucgcgaucugccgcccccugcacuaccccacccugaugaccccgacgcucugcgccgagaucgccaucggcugcuggcucgggggccuggccgggcccguggucgagaucucccugaucagccggcugcccuucugcggccccaaccgcauccagcacguguucugcgacuucccgcccgugcugucccucgcgugcaccgacaccagcaucaacguccugguggacuucgugaucaacuccugcaagauccuggccaccuuccuccugauccugugcagcuacguccagaucaucugcacggugcuccggauccccuccgccgccgggaagcgcaaggccaucagcacgugcgcgucccacuucaccgugguccugaucuucuacggcagcauccuguccauguacgugcagcucaagaaguccuacagccuggacuacgaccaggcccuggccguggucuacagcgugcucacccccuuccugaacccguucaucuacagccugcggaacaaggagaucaaggaggccgugcgccggcagcucaagcgcaucggcauccuggccuga

SEQ ID NO: 34088 - RNA, 954 nt, Artificial Sequence
  derived and/or modified sequence opt1 from OR6N2__Homo_sapiens__NP_001005278
auggaccaguacaaccacagcucccuggccgaguucguguuccucggcuucgccagcgucggguacgugcgcggcuggcuguucgugcugcuccugcuggcguaccucuucaccaucugcgggaacaugcugaucuucuccgucauccggcuggacgccgcccuccacacccccauguaccacuucgugagcgugcuguccuuccuggagcucugguacacggccaccaccaucccgaagaugcugagcaacauccuguccgagaagaagaccaucagcuucgccggcugccuccugcagacguacuucuuccacucccugggggcgagcgagugcuaccuccugaccgccauggccuacgaccgcuaccuggccaucugccggccccuccacuaccccaucaucaugaccaccacgcugugcgcgaagauggccgccgccugcuggaccugcggcuuccugugccccaucuccgaggucauccucgccagccagcugccguucugcgcguacaacgagauccagcacaucuucugcgacuucccgccccugcucucccuggccugcaaggacaccagcgccaacauccugguggacuucgccaucaacgccuucaucauccucaucaccuucuucuucaucaugaucuccuacgcgcgcaucaucggcgccgugcugaagaucaagacggccagcgggcggaagaaggccuucuccacgugcgccagccaccuggcggucgugcucaucuucuucggcuccaucaucuucauguacgugcgccugaagaaguccuacagccugacccucgaccggacccuggccaucgucuacagcgugcugacccccauggugaaccccaucaucuacagccuccgcaacaaggagaucaucaaggccaucaagcggaccaucuuccagaagggggacaaggccucccuggcccaccuguga

SEQ ID NO: 34089 - RNA, 939 nt, Artificial Sequence
  derived and/or modified sequence opt1 from OR6X1__Homo_sapiens__NP_001005188
augcgcaacggcaccgugaucaccgaguucauccugcucggguuccccgucauccagggccugcagacgccgcuguucaucgccaucuuccucaccuacauccugacccuggccgggaacggccucaucaucgcgaccgugugggccgagccccggcugcagauccccauguacuucuuccugugcaaccucagcuuccuggagaucugguacacgaccaccgugauccccaagcugcucgggaccuucgucguggcccgcacggugaucugcauguccugcugccugcugcaggccuucuuccacuucuucgucggcaccaccgaguuccucauccugaccaucaugagcuucgaccgguaccugacgaucugcaacccgcuccaccaccccaccaucaugaccuccaagcugugccugcagcucgcccugagcuccuggguggugggcuucaccaucgucuucugccagacgaugcugcucauccagcugcccuucugcgggaacaacgugaucagccacuucuacugcgacgugggccccucccugaaggcggccugcaucgacaccagcauccucgagcugcugggggucaucgccaccauccucgugaucccgggcucccugcuguucaacaugaucagcuacaucuacauccucuccgccauccugcgcauccccagcgcgaccgggcaccagaagacguucuccacgugcgccagccaccugaccguggucucccuccuguacggcgccgugcuguucauguaccuccggcccaccgcccacagcuccuucaagaucaacaagguggucagcgugcugaacaccauccugacgccccuccugaacccguucaucuacaccauccgcaacaaggaggugaagggcgcccugcggaaggcgaugaccugccccaagaccgggcacgccaaguga

SEQ ID NO: 34090 - RNA, 978 nt, Artificial Sequence
  derived and/or modified sequence opt1 from OR6Y1__Homo_sapiens__NP_001005189
augaccaccaucauccuggagguggacaaccacacggucaccacccgcuucauccuccugggcuuccccacccggccggccuuccagcuccuguucuucagcaucuuccuggccacguaccugcucacccugcuggagaaccuccugaucauccuggcgauccacuccgacgggcagcuccacaagcccauguacuucuuccugagccaccuguccuuccucgagaugugguacgugaccgugaucagccccaagaugcuggucgacuuccugucccacgacaagagcaucuccuucaacggcugcaugacccagcucuacuucuucgugacguucgugugcaccgaguacauccugcuggccaucauggccuucgaccgcuacgucgccaucugcaacccccuccgguacccggugaucaugaccaaccagcugugcgggacccuggccggcgggugcugguucugcggccucaugacggcgaugaucaagaugguguucaucgcccagcugcacuacugcggcaugccccagaucaaccacuacuucugcgacaucagcccccugcucaacgucuccugcgaggacgccagccaggccgagaugguggacuucuuccuggcgcugauggugaucgccaucccccucugcgucgugguggccuccuacgccgccauccuggcgaccauccugcgcaucccgagcgcccaggggcggcagaaggccuucuccacgugcgccagccaccucaccgucgugauccuguucuacuccaugacccuguucaccuacgcccgccccaagcucauguacgcguacaacagcaacaagguggucuccgugcuguacaccgugaucgucccccugcucaaccccaucaucuacugccugcggaaccacgaggugaaggccgcccugcgcaagaccauccacugccggggcagcgggccgcagggcaacggggccuucuccagcuga

SEQ ID NO: 34091 - RNA, 963 nt, Artificial Sequence
  derived and/or modified sequence opt1 from OR7C1__Homo_sapiens__NP_945182
auggagaccggcaaccagacccacgcccaggaguuccugcuccugggguucagcgccacguccgagauccaguucauccuguucggccucuuccugagcauguaccuggugaccuucaccgggaaccuccugaucauccuggcgaucugcuccgacagccaccuccacacccccauguacuucuuccuguccaaccugagcuucgccgaccucugcuucacguccaccaccgucccgaagaugcugcugaacauccucacccagaacaaguucaucacguacgccggcugccugagccagaucuucuucuucaccuccuucgggugccuggacaaccuccugcugaccgugauggccuacgaccgcuucguggccgucugccacccccuccacuacaccgugaucaugaacccccagcugugcggccugcucgugcugggcagcuggugcaucuccgucauggggagccugcucgagacgcugaccgugcugcggcucuccuucugcaccgagauggagaucccccacuucuucugcgaccugcuggaggugcucaagcuggcgugcagcgacaccuucaucaacaacgucgugaucuacuucgccacgggcgugcugggggucaucuccuucaccggcaucuucuucagcuacuacaagaucguguucuccauccuccgcaucagcuccgccgggcggaagcacaaggccuucagcacgugcggcagccaccuguccguggucacccuguucuacggcaccggguucggcguguaccucagcuccgcggccaccccgagcucccgcaccagccugguggccuccgucauguacaccauggugacgcccaugcugaaccccuucaucuacagccuccggaacaccgacaugaagcgcgcccuggggcggcugcucucccgcgccaccuucuucaacggcgacaucaccgcgggccugagcuga

SEQ ID NO: 34092 - RNA, 939 nt, Artificial Sequence
  derived and/or modified sequence opt1 from OR7D2__Homo_sapiens__NP_787079
auggaggccggcaaccagaccggguuccuggaguucauccuccugggccugagcgaggaccccgagcuccagccguucaucuucgggcuguuccuguccauguaccucgugaccguccugggcaaccugcucaucauccuggccaucagcuccgacagccaccuccacacgcccauguacuucuuccuguccaaccugagcuggguggacaucugcuucuccacgugcaucgugcccaagaugcuggucaacauccagaccgagaacaaggcgaucagcuacauggacugccucacccagguguacuucuccauguucuuccccauccuggacacccugcuccugaccgugauggccuacgaccgcuucgucgccgugugccacccgcugcacuacaugaucaucaugaacccccaccucugcgggcugcugguguucgucaccuggcucaucggcgugaugaccagccugcugcacaucucccucaugaugcaccugaucuucugcaaggacuucgagaucccccacuucuucugcgagcugacguacauccuccagcuggccugcagcgacaccuuccugaacuccacccucaucuacuucaugaccggcgugcugggggucuucccccugcucggcaucaucuucagcuacucccggaucgccagcuccauccgcaagaugagcuccagcgggggcaagcagaaggcgcugagcacgugcgggucccaccugagcguggugucccucuucuacggcaccggcaucgggguccacuucaccagcgccgugacccacuccagccagaagaucuccguggccagcgucauguacacgguggugaccccgaugcugaaccccuucaucuacucccugcggaacaaggacgucaagggcgcccucgggagccugcugucccgcgcggccagcugccucuga

SEQ ID NO: 34093 - RNA, 1020 nt, Artificial Sequence
  derived and/or modified sequence opt1 from OR7E24__Homo_sapiens__NP_001073404
augagcuacuuccccauccuguucuucuucuuccucaagcgcugcccguccuacaccgagccccagaaccugaccggcgugagcgaguuccugcuccuggggcuguccgaggaccccgagcuccagcccguccuggccggccuguuccucagcauguaccuggugacggugcuggggaaccuccugaucauccuggccgucuccagcgacucccaccuccacaccccgauguacuucuuccugagcaaccugucccucgcggacaucggcuucaccagcaccacggugcccaagaugaucguggacaugcagacccacucccgggucaucagcuacgaggggugccugacccagauguccuucuucgugcuguucgccugcauggacgacaugcuccugagcgugauggccuacgaccgcuucgucgccaucugccacccccugcacuaccggaucaucaugaacccccgccucugcggcuuccugauccugcucuccuucuucaucagccugcuggacucccagcuccacaaccugaucaugcugcagcugaccugcuucaaggacguggacaucagcaacuucuucugcgacccgucccagcugcugcaccuccggugcagcgacacguucaucaacgagauggugaucuacuucaugggcgccaucuucgggugccugcccaucagcggcauccuguucuccuacuacaagaucgucagccccauccuccgcgugcccaccuccgacgggaaguacaaggcguucagcacgugcggcucccaccuggccguggucugccuguucuacgggaccggccucgugggcuaccugagcuccgccgugcugccgagcccccggaaguccauggucgccagcgugauguacaccguggucacccccaugcucaaccccuucaucuacucccugcgcaacaaggacauccagagcgcgcugugccggcuccacgggcgcaucaucaagucccaccaccuccacccguucugcuacaugggcuga

SEQ ID NO: 34094 - RNA, 1080 nt, Artificial Sequence
  derived and/or modified sequence opt1 from OR8S1__Homo_sapiens__NP_001005203
auggcccugggcaaccacagcaccaucaccgaguuccuccugcuggggcucuccgccgaccccaacauccgcgcgcugcuguucgugcuguuccugggcaucuaccugcucaccaucauggagaaccugaugcugcuccugaugauccgggccgacagcugccugcacaagccgauguacuucuuccucucccaccugagcuucgucgaccugugcuucuccagcgugaucgugcccaagaugcucgagaaccugcugucccagcgcaagaccaucagcgucgaggggugccucgcccagguguucuucguguucgucaccgccggcaccgaggccugccugcuguccgggauggcguacgaccggcacgccgccaucugccgcccccuccuguacggccagaucaugggcaagcagcuguacaugcaccucgugugggggagcuggggccugggguuccuggacgcccucaucaacgugcugcuggcggucaacaugguguucugcgaggccaagaucauccaccacuacuccuacgagaugcccagccuccugccgcuguccugcagcgacaucucccggagccucaucgcccugcugugcuccacgcuccugcacggccuggggaacuuccuccugguguuccugagcuacacccgcaucaucuccaccauccucagcaucagcuccaccagcggccgguccaaggccuucagcacgugcuccgcccaccugaccgcggucacccuguacuacggcagcgggcuccugcgccaccugaugcccaacuccggcagccccaucgagcugaucuucuccgugcaguacaccguggucacgcccaugcucaacagccugaucuacucccugaagaacaaggaggugaagggggagcggagccuccgcgacuccagccaccucccgcagcugcacaagggccaggcccgguggaagcgccccgccuucaccgagggccggcgcgagcccgggcaccccgagcucuccaucccggugacgccccagccccagggcgccugcgccugcagcgcgcugcgggccgcccccaccgcccugccguga

SEQ ID NO: 34095 - RNA, 1008 nt, Artificial Sequence
  derived and/or modified sequence opt1 from OR9K2__Homo_sapiens__NP_001005243
augcugggcagcaagccccgcgugcaccucuacauccugccgugcgccucccagcaggucagcaccaugggggaccggggcaccuccaaccacagcgagaugaccgacuucauccuggccggguuccgcgugcggcccgagcuccacauccugcuguuccuccuguuccuguucguguacgcgaugauccuccugggcaacgucgggaugaugaccaucaucaugaccgacccccgccugaacacccccauguacuucuuccucggcaaccuguccuucaucgaccuguucuacagcuccgugaucgagccgaaggccaugaucaacuucuggagcgagaacaaguccaucagcuucgccggcugcguggcccagcuguuccucuucgcccugcucaucgucacggagggguuccugcuggcggccauggccuacgaccgguucaucgccaucugcaacccccuccuguacuccgugcagaugagcacccgccugugcacccagcucguggcgggcuccuacuucugcgggugcaucagcuccgucauccagaccagcaugacguucacccuguccuucugcgccagccgggccguggaccacuucuacugcgacucccgcccccugcagcggcucagcugcagcgaccuguucauccaccgcaugaucuccuucagccuguccugcaucaucauccuccccaccaucaucgugaucaucgucagcuacauguacaucguguccaccgugcugaagauccacagcacggagggccacaagaaggccuucuccacgugcagcucccaccugggggucgugagcgugcucuacggcgccgucuucuucauguaccugaccccggaccgguuccccgagcuguccaagguggcgagccucugcuacucccuggugacccccaugcugaacccccucaucuacagccugcgcaacaaggacguccaggaggcccugaagaaguuccucgagaagaagaacaucauccuguga

SEQ ID NO: 34096 - RNA, 945 nt, Artificial Sequence
  derived and/or modified sequence opt1 from OR9Q2__Homo_sapiens__NP_001005283
auggccgagcgcaacuacaccguggucaccgaguucuuccugacggccuucaccgagcaccuccaguggcgggugccccuguuccugaucuuccucagcuucuaccuggcgaccaugcugggcaacaccgggaugauccuccugauccgcggcgaccggcgccugcacacgccgauguacuucuuccucucccaccugagccugguggacaucugcuacuccagcgccaucaucccccagaugcucgccguccugugggagcacgggaccaccaucucccaggcccggugcgccgcgcaguucuuccuguucaccuucuucgccagcaucgacugcuaccuccuggccaucauggccuacgaccgcuacacggcggugugccagccccugcucuacgugaccaucaucaccgagaaggcccgguggggccuggucaccggggccuacguggccggcuucuucuccgccuucgugcgcacggucaccgcguucacccugagcuucugcggcaacaacgagaucaacuucaucuucugcgaccugcccccgcuccugaagcucuccugcggggacagcuacacccaggagguggugaucaucgucuucgcccuguucgugaugcccgccugcauccuggugauccucgucuccuaccuguucaucaucguggccauccugcagauccacagcgccggcgggcgggcgaagacguucuccacgugcgccagccaccucaccgccguggcccuguucuucggcacccugaucuucauguaccuccgcgacaacaccgggcaguccagcgagggcgaccgggucguguccgugcuguacaccgucgugacccccaugcugaacccccucaucuacagccugcgcaacaaggaggugaaggaggccacccggaaggcgcuguccaagagcaagccggcccgccggcccuga

SEQ ID NO: 34097 - RNA, 906 nt, Artificial Sequence
  derived and/or modified sequence opt1 from ORAI1__Homo_sapiens__NP_116179
augcaccccgagccggcgcccccgcccagccgguccagccccgagcugccgcccuccggcgggagcaccaccuccggcagccggcgcucccggcgccggagcggggacggcgagccgcccggggcgcccccgcccccgcccuccgccgugacguaccccgacuggaucggccagagcuacuccgaggucaugagccucaacgagcacuccaugcaggcccugagcuggcgcaagcuguaccucucccgggccaagcugaaggccagcucccgcaccagcgcccugcucuccggcuucgccaugguggccaugguggagguccagcuggacgccgaccacgacuacccgcccgggcugcucaucgccuucagcgcgugcaccaccgugcugguggccguccaccuguucgcccucaugaucagcacgugcauccugcccaacaucgaggccguguccaacgugcacaaccugaacagcgucaaggagagcccccacgagcggaugcaccgccacaucgagcucgccugggcguucuccaccgugaucggcacccugcuguuccucgccgaggugguccugcugugcugggugaaguuccucccccugaagaagcagcccgggcagccccggcccaccuccaagccgcccgccagcggcgccgccgcgaacguguccacgagcgggaucacccccggccaggccgccgccaucgccuccaccaccaucaugguccccuucggccugaucuucaucguguucgcggugcacuucuaccgcagccucgucucccacaagacggaccggcaguuccaggagcugaacgagcuggccgaguucgcccgccuccaggaccagcuggaccaccgcggggaccacccccugacccccggcagccacuacgccuga

SEQ ID NO: 34098 - RNA, 888 nt, Artificial Sequence
  derived and/or modified sequence opt1 from ORAI3__Homo_sapiens__NP_689501
augaagggcggggagggcgacgccggggagcaggcgccccugaacccggagggcgagagccccgccggguccgccaccuaccgcgaguucgugcaccggggcuaccucgaccugaugggcgccagccagcacucccugcgcgcccucagcuggcggcgccuguaccugucccgggccaagcucaaggcgagcucccgcaccagcgcccugcuguccggguucgccauggucgccaugguggaggugcagcucgagagcgaccacgaguacccgcccggccugcuggucgcguucuccgccugcacgaccgugcucguggccguccaccuguucgcccugauggugagcacgugccuccugccccacaucgaggccguguccaacauccacaaccugaacagcguccaccagagcccccaccagcggcuccaccgcuacguggagcuggcguggggguucuccaccgcccugggcaccuuccucuuccuggccgaggugguccugguggggugggugaaguucguccccaucggcgcgccccucgacaccccgacccccauggugcccaccucccgggugcccggcacgcuggccccggucgccaccagccugucccccgccagcaaccucccccgcagcuccgccagcgccgcccccucccaggcggagccggccugcccgccccggcaggccugcgggggcgggggcgcccacggccccggguggcaggccgcgauggccagcaccgccaucauggugcccgugggccuggucuucguggccuucgcgcugcacuucuaccgcucccucguggcccacaagaccgaccgguacaagcaggagcuggaggagcugaaccgccuccagggggagcugcaggccgucuga

SEQ ID NO: 34099 - RNA, 414 nt, Artificial Sequence
  derived and/or modified sequence opt1 from ORAOV1__Homo_sapiens__NP_703152
auggccggcagccaggacaucuucgacgccaucgugauggcggacgagcgcuuccacggggagggcuaccgggagggguacgaggagggcuccagccugggggucauggagggccgccagcacggcacccuccacggggccaagaucggcuccgagaucgggugcuaccagggcuucgccuucgccuggaagugccugcugcacagcugcaccacggagaaggacucccggaagaugaaggugcucgagagccugaucgggaugauccagaaguuccccuacgacgacccgaccuacgacaagcugcacgaggaccucgacaagauccgcggcaaguucaagcaguucugcucccugcugaacgugcagcccgacuucaagaucagcgccgagggcuccgggcucagcuucuga

SEQ ID NO: 34100 - RNA, 1734 nt, Artificial Sequence
  derived and/or modified sequence opt1 from ORC2__Homo_sapiens__NP_006181
augagcaagcccgagcugaaggaggacaagaugcucgaggugcacuucgucggcgacgacgacgugcugaaccacauccuggaccgcgagggcggggccaagcucaagaaggagcgggcccagcugcuggugaacccgaagaagaucaucaagaagcccgaguacgaccucgaggaggacgaccaggagguccugaaggaccagaacuacguggagaucauggggcgcgacgugcaggagucccugaagaacggcagcgcgaccgggggcggcaacaaggucuacuccuuccagaaccggaagcacagcgagaagauggccaagcucgccuccgagcuggccaagacgccccagaaguccgugagcuucagccugaagaacgaccccgagaucaccaucaacgugccgcaguccagcaaggggcacuccgccagcgacaagguccagcccaagaacaacgacaaguccgaguuccucagcaccgcgccccgcucccugcggaagcgccugaucgugccccggagccacuccgacagcgaguccgaguacagcgccagcaacuccgaggacgacgagggcguggcccaggagcacgaggaggacaccaacgccgucaucuucagccagaagauccaggcgcagaaccgcgugguguccgccccggucgggaaggagacccccagcaagcggaugaagcgcgacaagacguccgaccucguggaggaguacuucgaggcccacagcuccagcaaggugcugaccuccgaccggacccugcagaagcucaagcgcgccaagcuggaccagcagacccugcggaaccuccugagcaaggucucccccagcuucuccgccgagcugaagcagcucaaccagcaguacgagaagcuguuccacaaguggaugcugcagcuccaccugggcuucaacaucgugcuguacgggcucggcagcaagcgcgaccugcuggagcgguuccgcacgaccaugcuccaggacuccauccacguggucaucaacggcuucuuccccgggaucagcgugaaguccgugcugaacagcaucaccgaggagguccuggaccacaugggcaccuuccgguccauccucgaccagcuggacuggaucgugaacaaguucaaggaggacagcagccuggagcuguuccuccugauccacaaccucgacucccagaugcugcgcggggagaagucccagcagaucaucggccagcugagcagccuccacaacaucuaccugaucgcguccaucgaccaccugaacgccccgcucaugugggaccacgccaagcagagccuguucaacuggcugugguacgagacgaccaccuacucccccuacaccgaggagacgagcuacgagaacucccugcucgucaagcagagcggcucccugccccugagcucccucacccacgugcugcggagccugacccccaacgcccgcgggaucuuccggcuccugaucaaguaccagcuggacaaccaggacaacccguccuacaucggccucagcuuccaggacuucuaccagcagugccgcgaggccuuccuggugaacuccgaccugacccuccgcgcgcagcugacggaguuccgggaccacaagcugauccgcaccaagaaggggaccgacggcgucgaguaccuccugauccccguggacaacgggacccugacggacuuccucgagaaggaggaggaggaggccuga

SEQ ID NO: 34101 - RNA, 1707 nt, Artificial Sequence
  derived and/or modified sequence opt1 from ORC3__Homo_sapiens__NP_001184188
augaagcacuuccugcagaagcucaucagccagcugauggacugcugcguggacaucaaguccaaggaggaggagagcguccacgugacccagcgcaagacccacuacuccauggacagccuguccagcugguacaugacggugacccagaagaccgaccccaagaugcucuccaagaagcggaccacgagcucccaguggcagagcccgcccgucguggugauccugaaggacauggaguccuucgccaccaagguccugcaggacuucaucaucaucagcucccagcaccuccacgaguucccccugauccugaucuucggcaucgccaccagccccaucaucauccaccgccuccugccgcacgcgguguccagccugcucugcaucgagcuguuccagucccugagcugcaaggagcaccucaccacggugcuggacaagcugcuccugaccacccaguuccccuucaagaucaacgagaagguccuccaggugcugaccaacaucuuccuguaccacgacuucuccgugcagaacuucaucaaggggcugcagcucagccugcuggagcacuucuacagccagccccucuccguccugugcugcaaccugcccgaggccaagcggcgcaucaacuuccucagcaacaaccagugcgagaacauccggcgccugccguccuuccggcgcuacguggagaagcaggccagcgagaagcaggucgcccugcucacgaacgagcgguaccugaaggaggagacccagcugcuccuggagaaccugcacguguaccacaugaacuacuuccucgugcugcgcugccugcacaaguucaccuccagccuccccaaguacccccugggccggcagauccgcgagcuguacugcacgugccucgagaagaacaucugggacuccgaggaguacgccagcgugcugcagcugcuccggaugcuggcgaaggacgagcugaugaccauccuggagaagugcuucaaggucuucaaguccuacugcgagaaccaccucgggagcaccgccaagcgcaucgaggaguuccuggcccaguuccagucccuggacgagaccaaggaggaggaggacgccagcggcucccagcccaaggggcuccagaagaccgaccuguaccaccuccagaagucccugcuggagaugaaggagcugcggcgcagcaagaagcagacgaaguucgaggugcuccgggagaacguggucaacuucaucgacugccuggugcgcgaguaccugcucccgcccgagacccagccccugcacgagguggucuacuucagcgcggcccacgcccugcgggagcaccucaacgccgcgccccgcaucgcccugcacaccgcccugaacaacccguacuacuaccucaagaacgaggcccugaaguccgaggagggcugcauccccaacaucgcccccgacaucugcaucgccuacaagcugcaccucgagugcagccggcugaucaaccugguggacugguccgaggcguucgccaccgucgugacggccgccgagaagauggacgccaacagcgcgaccagcgaggagaugaacgagaucauccacgcccgcuucauccgcgccguguccgagcucgagcugcugggcuucaucaagcccaccaagcagaagaccgaccacgucgcccggcucacguggggcgggugcuga

SEQ ID NO: 34102 - RNA, 1059 nt, Artificial Sequence
  derived and/or modified sequence opt1 from ORC4__Homo_sapiens__NP_001177810
auggagaucgaggaggugagcgagaacguccuccaggugcaccucaacggccugcugcagaucaacgacaagaucgcccucaaggagaucacccgccagcugaaccuggagaacguggucggggacaagguguucggcuccuucgccgagaaccucagcuuccugcuggaggcgcucaagaagggggaccggaccuccagcugccccgugaucuucauccuggacgaguucgaccuguucgcccaccacaagaaccagacgcuccuguacaaccuguucgacaucucccagagcgcccagaccccgaucgccgucaucggccugaccugccgccuggacauccuggagcuccuggagaagcgggugaagucccgcuucagccaccggcagauccaccugaugaacuccuucggguucccccaguacgugaagaucuucaaggagcagcucagccugcccgccgaguuccccgacaaggucuucgcggagaaguggaacgagaacgugcaguaccuguccgaggaccgcagcgugcaggagguccuccagaagcacuucaacaucuccaagaaccugcggagccugcacaugcuccugaugcuggcccucaaccgcgugaccgccucccacccguucaugacggccguggaccugauggaggcgagccagcugugcuccauggacagcaaggccaacaucguccacggccucuccgugcuggagaucugccugaucaucgccaugaagcaccucaacgacaucuacgaggaggagcccuucaacuuccagaugguguacaacgaguuccagaaguucguccagcggaaggcccacagcguguacaacuucgagaagcccguggucaugaaggccuucgagcaccuccagcagcuggagcugaucaagcccauggagcgcaccagcggcaacucccagcgggaguaccagcugaugaagcugcuccuggacaacacccagaucaugaacgcgcugcagaaguacccgaacugccccaccgacgugcgccagugggccacgagcucccucagcuggcuguga

SEQ ID NO: 34103 - RNA, 1308 nt, Artificial Sequence
  derived and/or modified sequence opt1 from ORC5__Homo_sapiens__NP_002544
augccccaccuggagaacgugguccucugccgcgagagccagguguccauccugcagagccuguucggcgagcggcaccacuucuccuucccgagcaucuucaucuacgggcacaccgccuccggcaagaccuacgugacgcagacccuccugaagacccuggagcucccccacgucuucgugaacugcguggagugcuucacccugcgccugcuccuggagcagauccugaacaagcucaaccaccugagcuccagcgaggacgggugcuccacggagaucacgugcgagaccuucaacgacuucguccggcuguucaagcaggucaccaccgccgagaaccucaaggaccagaccguguacaucgugcuggacaaggcggaguaccugcgcgacauggaggccaaccuccugcccggcuuccugcggcuccaggagcuggccgaccgcaacgugaccgugcuguuccucagcgagaucgucugggagaaguuccggcccaacaccgggugcuucgagccguucgugcuguacuuccccgacuacuccaucggcaaccugcagaagauccucagccacgaccacccgcccgaguacuccgccgacuucuacgccgcguacaucaacauccugcugggcguguucuacacggucugccgcgaccucaaggagcugcggcaccuggccgugcucaacuuccccaaguacugcgagcccguggucaagggggaggccagcgagcgcgacacccggaagcuguggcgcaacaucgagccccaccugaagaaggccaugcagaccguguaccuccgggagaucuccagcucccagugggagaagcugcagaaggacgacaccgaccccggccagcugaaggggcucagcgcgcacacgcacguggagcugccguacuacuccaaguucauccugaucgccgccuaccucgccagcuacaaccccgcccgcaccgacaagcgguucuuccugaagcaccacggcaagaucaagaagaccaacuuccugaagaagcacgagaagaccagcaaccaccuccuggggcccaagcccuucccgcuggaccgccuccuggcgauccuguacuccaucgucgacagccggguggcccccacggccaacaucuucucccagaucaccagccuggugacccuccagcugcugacccucgucggccacgacgaccagcuggacggccccaaguacaagugcacggugucccuggacuucauccgcgccaucgcccggaccgucaacuucgacaucaucaaguaccucuacgacuuccuguga

SEQ ID NO: 34104 - RNA, 759 nt, Artificial Sequence
  derived and/or modified sequence opt1 from ORC6__Homo_sapiens__NP_055136
augggcagcgagcugaucgggcgccucgcgccccggcugggccuggccgagccggacaugcuccgcaaggccgaggaguaccugcggcugucccgcgugaagugcgucgggcucagcgcccggaccaccgagacguccagcgccgugaugugccuggaccuggccgccuccuggaugaagugcccccucgaccgcgcguaccugaucaagcugagcggccucaacaaggagaccuaccaguccugccucaagagcuucgagugccugcuggggcugaacuccaacaucggcauccgggaccuggccgugcaguucagcugcaucgaggccgucaacauggccuccaagauccucaagagcuacgaguccagccugccccagacccagcaggucgaccuggaccucucccgcccccuguucaccagcgcggcccugcucuccgccugcaagauccugaagcugaagguggacaagaacaagaugguggccacgagcggcgugaagaaggccaucuucgaccggcucugcaagcagcuggagaagaucgggcagcaggucgaccgcgagccgggcgacguggcgaccccgccccggaagcgcaagaagaucgugguggaggcccccgccaaggagauggagaaggucgaggagaugccccacaagccccagaaggacgaggaccugacccaggacuacgaggaguggaagcggaagauccucgagaacgccgccuccgcgcagaaggccaccgccgaguga

SEQ ID NO: 34105 - RNA, 606 nt, Artificial Sequence
  derived and/or modified sequence opt1 from ORM1__Homo_sapiens__NP_000598
auggcccugagcugggugcucaccguccugucccugcucccccugcuggaggcccagaucccgcucugcgcgaaccuggugcccgugcccaucaccaacgccacgcuggaccgcaucaccggcaagugguucuacaucgccagcgccuuccggaacgaggaguacaacaaguccguccaggagauccaggccaccuucuucuacuucacccccaacaagacggaggacaccaucuuccuccgcgaguaccagacccggcaggaccagugcaucuacaacaccacguaccugaacgugcagcgcgagaacgggaccaucagccgguacgugggcgggcaggagcacuucgcgcaccuccugauccugcgcgacaccaagaccuacaugcuggccuucgacgucaacgacgagaagaacuggggccucuccguguacgccgacaagccggagacgaccaaggagcagcugggggaguucuacgaggcccuggacugccuccggauccccaagagcgacguggucuacaccgacuggaagaaggacaagugcgagccccuggagaagcagcacgagaaggagcgcaagcaggaggagggcgaguccuga

SEQ ID NO: 34106 - RNA, 606 nt, Artificial Sequence
  derived and/or modified sequence opt1 from ORM2__Homo_sapiens__NP_000599
auggcccugagcugggugcucaccguccugucccugcucccccugcuggaggcccagaucccgcucugcgcgaaccuggugcccgugcccaucaccaacgccacgcuggaccgcaucaccggcaagugguucuacaucgccagcgccuuccggaacgaggaguacaacaaguccguccaggagauccaggccaccuucuucuacuucacccccaacaagacggaggacaccaucuuccuccgcgaguaccagacccggcagaaccagugcuucuacaacagcuccuaccugaacgugcagcgcgagaacgggaccgugagccgguacgagggcgggcgcgagcacgucgcgcaccuccuguuccugcgggacacgaagacccugauguucggcuccuaccucgacgacgagaagaacugggggcugagcuucuacgccgacaagccggagaccaccaaggagcagcugggcgaguucuacgaggcccucgacugccugugcaucccccgcuccgacgugauguacacggacuggaagaaggacaagugcgagccccuggagaagcagcacgagaaggagcggaagcaggaggagggcgagagcuga

SEQ ID NO: 34107 - RNA, 462 nt, Artificial Sequence
  derived and/or modified sequence opt1 from ORMDL3__Homo_sapiens__NP_001307731
augaacgugggcaccgcccacagcgaggucaaccccaacacccgcgugaugaacucccgggggaucuggcugagcuacgugcucgccaucggccugcugcacaucguccuccuguccaucccguucgugagcgugcccgucguguggacgcugaccaaccucauccacaacauggggauguacaucuuccugcacaccgugaagggcacccccuucgagacgcccgaccaggggaaggcgcgccugcucacccacugggagcagauggacuacggcguccaguucaccgccucccggaaguuccugaccaucacgccgaucgugcuguacuuccucaccagcuucuacaccaaguacgaccagauccacuucgugcugaacaccgucucccugaugagcgugcucauccccaagcugccccagcugcacggcgugcgcaucuucgggaucaacaaguacuga

SEQ ID NO: 34108 - RNA, 1839 nt, Artificial Sequence
  derived and/or modified sequence opt1 from OS9__Homo_sapiens__NP_001017956
auggccgccgagacccugcucagcucccugcugggccuccugcugcucgggcugcugcuccccgcgagccugaccggcggggugggcucccugaaccucgaggagcugagcgagaugcgcuacgggaucgagauccugccgcuccccgucaugggcggccagucccagagcuccgacguggugaucgucagcuccaaguacaagcagcgguacgagugccgccugcccgccggggccauccacuuccagcgggagcgcgaggaggagacgcccgccuaccagggcccggggauccccgagcugcucagccccaugcgggacgcccccugccugcugaagaccaaggacugguggaccuacgaguucugcuacggccgccacauccagcaguaccacauggaggacuccgagaucaagggggaggugcucuaccugggcuacuaccagagcgcguucgacugggacgacgagaccgccaaggccuccaagcagcaccggcugaagcgcuaccacagccagacguacggcaacggguccaagugcgaccucaacggccggccgcgcgaggccgaggugcgguuccugugcgacgagggggcgggcaucagcggcgacuacaucgaccgcgucgacgagccccuguccugcagcuacgugcucaccauccggacgccccgccugugcccccacccgcugcuccggcccccgcccuccgccgcgccccaggccauccugugccaccccagccugcagcccgaggaguacauggccuacgugcagcgccaggccgacagcaagcaguacggggacaagaucaucgaggagcuccaggaccugggcccccaggucugguccgagaccaagagcgggguggccccgcagaagauggccggcgccucccccaccaaggacgacagcaaggacuccgacuucuggaagaugcugaacgagcccgaggaccaggcccccgggggcgaggaggugccggcggaggagcaggaccccagccccgaggccgccgacuccgccagcggcgcccccaacgacuuccagaacaacguccaggugaaggugauccgguccccggcggaccucauccgcuucaucgaggagcugaagggcgggaccaagaaggggaagcccaacaucggccaggagcagcccgucgacgacgccgccgaggugccgcagcgggagcccgagaaggagcgcggggaccccgagcggcagcgcgagauggaggaggaggaggacgaggacgaggacgaggacgaggacgaggacgagcgccagcugcucggcgaguucgagaaggagcuggagggcauccugcuccccagcgaccgggaccgccugcgguccgaggugaaggccgggauggagcgcgagcuggagaacaucauccaggagaccgagaaggagcucgacccggacggccugaagaaggagagcgagcgggaccgcgccaugcuggcgcucaccuccacgcugaacaagcugaucaagcggcuggaggagaagcagagccccgagcucgucaagaagcacaagaagaagcgcguggugcccaagaagcccccgcccagcccccagcccaccgggaagaucgagaucaagaucguccggccgugggccgagggcaccgaggagggggcccgcuggcugaccgacgaggacacgcggaaccugaaggagaucuucuucaacauccucgugcccggcgccgaggaggcgcagaaggagcgccagcggcagaaggagcuggaguccaacuaccgccggguguggggcucccccgggggcgaggggaccggcgaccuggacgaguucgacuucuga

SEQ ID NO: 34109 - RNA, 2253 nt, Artificial Sequence
  derived and/or modified sequence opt1 from OSBP2__Homo_sapiens__NP_001269667
augcaccgccagcggacccgcaccaugagcucccuggccgccaagcggcucggcaugaaccgccggcccgcggggagcggcgggggcgggggcgaggccgccaccuggggccaccgcuucuggcggccgcaggagcgccccaccgaccggaaccagggggagauggcccacacgugccgcggcaccaucaaccuguccaccgcccacaucgacaccgaggacagcugcgggauccugcucaccuccggcgcgcggagcuaccaccugaaggccuccagcgagguggaccgccagcaguggaucaccgcccuggagcucgccaaggcgaaggccguccgggugaugaacacgcacuccgacgacagcggggacgacgacgaggccaccacccccgccgacaaguccgagcugcaccacacccugaagaaccucagccugaagcuggacgaccucuccacgugcaacgaccugaucgccaagcacggcgcggcccugcagcgcagccucaccgagcuggacggccugaagauccccuccgagagcggggagaagcucaagguggucaacgagcgggccacccuguuccgcaucaccuccaacgccaugaucaacgccugccgggacuuccuggagcucgcggagauccacagccgcaaguggcagcgggcccugcaguacgagcaggagcagcgcgugcaccuggaggagacgaucgagcagcucgccaagcagcacaacucccuggagcgggccuuccacagcgccccgggccgccccgcgaaccccagcaaguccuucaucgaggggagccugcucacccccaagggcgaggacuccgaggaggacgaggacaccgaguacuucgacgccauggaggacagcaccuccuucaucacggugaucaccgaggccaaggaggaccgcaaggccgagggcagcaccgggaccuccagcgucgacugguccagcgccgacaacgugcuggacggcgcgucccuggugccgaaggggagcuccaaggucaagcggcgcgugcggauccccaacaagcccaacuacagccucaaccugugguccaucaugaagaacugcaucggccgcgagcugagccggauccccaugccggugaacuucaacgagccccucuccaugcugcagcgccugacggaggaccucgaguaccaccaccuccuggacaaggccguccacugcaccagcuccguggagcagaugugccugguggccgccuucagcgucagcuccuacagcaccaccgugcaccggaucgcgaagcccuucaaccccaugcugggggagacguucgagcuggaccgccucgacgacaugggccugcggucccugugcgagcaggucagccaccacccgcccuccgccgcccacuacguguucagcaagcacggcuggucccucuggcaggagaucaccaucagcuccaaguuccgcgggaaguacaucagcaucaugccccugggcgccauccaccuggaguuccaggccuccgggaaccacuacguguggcgcaagagcaccuccaccgugcacaacaucaucgucggcaagcucuggaucgaccagagcggggacaucgagaucgugaaccacaagacgaacgaccggugccagcugaaguuccugcccuacuccuacuucagcaaggaggcggcccggaaggugaccggcgucguguccgacagccagggcaaggcccacuacguccugagcggguccugggacgagcagauggagugcagcaaggugaugcacuccagcccguccagccccuccagcgacggcaagcagaagaccguguaccagacccucuccgccaagcugcuguggaagaaguacccccuccccgagaacgccgagaacauguacuacuucagcgagcuggcgcugacgcucaacgagcacgaggagggggucgccccgaccgacucccgccugcggcccgaccagcgccugauggagaagggccggugggacgaggccaacaccgagaagcagcgccucgaggagaagcagcggcugagccgccgccggcgccuggaggccugcgggcccggcuccagcugcuccagcgaggaggagaaggaggccgacgcguacacgccccucugguucgagaagcggcuggacccgcugaccggcgagauggccugcguguacaagggcggguacugggaggccaaggagaagcaggacuggcacaugugccccaacaucuucuga

SEQ ID NO: 34110 - RNA, 2424 nt, Artificial Sequence
  derived and/or modified sequence opt1 from OSBP__Homo_sapiens__NP_002547
auggccgccaccgagcugcgcggcguggucgggcccggcccggcggccaucgccgcccucgggggcgggggcgccggcccgcccguggucgggggcgggggcgggcggggcgacgcgggccccgggagcggcgccgccuccgggaccgugguggccgcggccgccggcggccccgggcccggcgccgggggcguggccgcggccgggcccgcccccgccccgcccacgggcggcagcgggggcuccggggccggcgggagcggcuccgcgcgcgagggcuggcuguucaaguggaccaacuacaucaagggguaccagcggcgcugguucguccugagcaacggccuccuguccuacuaccggagcaaggccgagaugcgccacacgugccgggggaccaucaaccuggccaccgccaacaucaccguggaggacuccugcaacuucaucaucagcaacggcggggcccagaccuaccaccucaaggcguccagcgagguggagcgccagcggugggucaccgcccuggagcuggccaaggccaaggccgugaagaugcucgcggaguccgacgagagcggcgacgaggaguccgugagccagacggacaagaccgagcugcagaacacccugcgcacccucuccagcaaggucgaggaccuguccacgugcaacgaccugaucgccaagcacggcaccgcccuccagcggagccugagcgagcuggagucccucaagcugcccgccgagagcaacgagaagaucaagcaggucaacgagcgcgcgacccuguuccggaucaccuccaacgccaugaucaacgccugccgcgacuuccucaugcuggcccagacgcacagcaagaaguggcagaagucccugcaguacgagcgggaccagcgcauccggcucgaggagacccuggagcagcuggccaagcagcacaaccaccucgagcgcgcguuccgcggggccaccgugcugcccgccaacaccccgggcaacguggggagcggcaaggaccagugcugcuccggcaagggggacaugagcgacgaggacgacgagaacgaguucuucgacgcccccgagaucaucacgaugcccgagaaccugggccacaagcggaccggguccaacaucagcggcgccuccagcgacaucucccucgacgagcaguacaagcaccagcuggaggagaccaagaaggagaagcggacccgcauccccuacaagccgaacuacagccugaaccucugguccaucaugaagaacugcaucgggaaggagcugagcaagauccccaugcccgugaacuucaacgagccccuguccaugcuccagcgccugacggaggaccuggaguaccacgagcuccuggaccgggcggccaagugcgagaacagccuggagcagcucugcuacguggccgccuucaccgucuccagcuacagcaccaccguguuccgcacguccaagccguucaacccccugcugggcgagaccuucgagcucgaccggcuggaggagaacggcuaccgcagccugugcgagcaggucucccaccacccgcccgccgcggcccaccacgccgagagcaagaacggguggacccuccggcaggagaucaagaucaccuccaaguuccgcggcaaguaccugagcaucaugccccuggggacgauccacugcaucuuccacgccaccggccaccacuacaccuggaagaaggugaccacgaccgugcacaacaucaucguggggaagcuguggaucgaccaguccggcgagaucgacaucgucaaccacaagaccggcgacaagugcaaccucaaguucgugcccuacagcuacuucucccgggacgucgcgcgcaaggugaccggggaggugaccgaccccagcggcaagguccacuucgcccugcuggggacgugggacgagaagauggagugcuucaaggugcagcccgugaucggcgagaacgggggcgacgcccggcagcgcggccacgaggccgaggagucccgggucaugcucuggaagcgcaacccgcugcccaagaacgccgagaacauguacuacuucagcgagcuggcgcucacccugaacgccugggaguccgggaccgcccccaccgacagccggcugcgcccggaccagcggcucauggagaacggccgcugggacgaggccaacgccgagaagcagcggcuggaggagaagcagcgccugucccggaagaagcgcgaggcggaggccaugaaggccacggaggacgggacccccuacgaccccuacaaggcccucugguucgagcgcaagaaggaccccgugaccaaggagcugacccacaucuaccggggcgaguacugggagugcaaggagaagcaggacuggagcuccugcccggacaucuucuga

SEQ ID NO: 34111 - RNA, 2103 nt, Artificial Sequence
  derived and/or modified sequence opt1 from OSBPL10__Homo_sapiens__NP_001167531
auggagcgcgccgugcagggcaccgacgggggcgggggcagcaacuccagcucccggagcuccagccgcgccaccuccgcggggagcucccccagcugcucccuggccggccggggcgucagcucccgcagcgccgccgccgggcucggcgggggcgggucccggagcuccccgggcagcguggcggccucccccagcggcgggggcgggcgccggcgcgagcccgcccuggagggcgugcugagcaaguacacgaaccuccugcagggcuggcagaaccgguacuucguccuggacuucgaggccgggauccuccaguacuucgugaacgagcaguccaagcaccagaagccccgcggcgugcugagccuguccggggcgaucgucagccucuccgacgaggccccgcacaugcuggugguguacagcgccaacggcgagauguucaagcugcgggccgccgacgcgaaggagaagcaguucugggucacccagcuccgcgccugcgccaaguaccacauggagaugaacuccaagaugaugaaccagguggaggggcagcagaagaaccuggugcacgccaucgagagccugcccggcuccggcccccucaccgcccuggaccaggaccugcuccugcugaaggcgaccagcgccgccacgcucuccugccugggggagugccugaaccuccugcagcagagcguccaccaggccggccagcccucccagaagccgggggccagcgagaacauccugggcuggcacggguccaagagccacuccaccgagcagcucaagaacggcacccugggcagccugcccuccgcgagcgccaacaucaccugggccauccuccccaacagcgccgaggacgagcagacgucccagcccgagccggagcccaacagcggguccgagcuggugcugagcgaggacgagaaguccgacaacgaggacaaggaggagaccgagcucggcgugauggaggaccagcggagcaucauccugcaccugaucucccagcucaagcuggggauggaccugaccaaggucgugcuccccaccuucauccuggagaagcgcagccugcucgagauguacgccgacuucauggcgcaccccgaccugcugcucgccaucacggccggcgccaccccggaggagcgggugaucugcuucgucgaguacuaccugaccgcguuccacgaggggcgcaagggcgcccuggccaagaagcccuacaaccccaucaucggcgagaccuuccacugcuccugggaggugcccaaggaccgggugaagccgaagcgcacggccagccggucccccgccagcugccacgagcaccccauggcggacgaccccuccaagagcuacaagcuccgcuucgucgccgagcaggucucccaccacccgcccaucagcugcuucuacugcgagugcgaggagaagcggcugugcgugaacacccacguguggaccaaguccaaguucauggggaugagcgugggcgucagcaugaucggggagggcgugcugcgccugcucgagcacggcgaggaguacguguucacccugcccuccgccuacgcccgcagcauccugacgauccccugggucgagcucgggggcaagguguccaucaacugcgccaagaccggguacagcgcgaccgugaucuuccacaccaagccguucuacggcgggaagguccaccgggugacggccgaggugaagcacaaccccaccaacaccaucgucugcaaggcccacggcgaguggaacggcacccuggaguucacguacaacaacggggagaccaaggugaucgacaccaccacgcugcccguguacccgaagaagauccgcccccucgagaagcagggccccauggagucccggaaccuguggcgcgaggucacccgguaccugcgccucggggacaucgacgccgccaccgagcagaagcggcaccuggaggagaagcagcgcguggaggagcggaagcgcgagaaccugcggacccccuggaagccgaaguacuucauccaggagggcgacggguggguguacuucaacccccucuggaaggcgcacuga

SEQ ID NO: 34112 - RNA, 2244 nt, Artificial Sequence
  derived and/or modified sequence opt1 from OSBPL11__Homo_sapiens__NP_073613
augcagggcggggagcccgugagcaccaugaaggucuccgagagcgagggcaagcuggaggggcaggccaccgccgugacgccgaacaagaacuccagcugcggcgggggcaucuccagcuccagcuccagccgcggcggguccgcgaagggcuggcaguacagcgaccacauggagaacguguacggguaccucaugaaguacaccaaccuggucaccggcuggcaguaccgguucuucgugcugaacaacgaggccgggcuccuggaguacuucgugaacgagcagucccgcaaccagaagccccggggcacccugcagcucgccggcgccgucaucagccccuccgacgaggacagccacacguucaccgugaacgccgcguccggggagcaguacaagcugcgcgccaccgacgccaaggagcggcagcacugggugagccgccugcagaucugcacccagcaccacacggaggccaucggcaagaacaacccgccccucaagucccggagcuucagccuggcguccagcuccaacagccccaucucccagcgccggcccagccagaacgccaucuccuucuucaacgucgggcacagcaagcugcagucccucagcaagcgcaccaaccugcccccggaccaccugguggaggugcgggagaugaugucccacgccgagggccagcagcgcgaccucauccggcgcaucgagugccugcccaccagcggccaccuguccagccucgaccaggaccugcugaugcucaaggccaccuccauggccacgaugaacugccugaacgacugcuuccacauccugcagcuccagcacgcgagccaccagaaggggucccugcccagcggcaccaccaucgaguggcuggagcccaagaucucccucagcaaccacuacaagaacggggccgaccagccguucgccaccgaccagagcaagcccgucgccgugcccgaggagcagcccguggccgaguccggccugcuggcgcgggagccggaggagaucaacgccgacgacgagaucgaggacacgugcgaccacaaggaggacgaccucggggccgucgaggagcagcgcagcgugauccugcaccuccugucccagcugaagcugggcauggaccucacccgggugguccugcccaccuucauccuggagaagcgcagccuccuggagauguacgccgacuucaugucccaccccgaccuguucaucgccaucaccaacggcgcgacggccgaggaccggaugauccgcuucguggaguacuaccucaccagcuuccacgaggggcggaagggcgccaucgccaagaagcccuacaacccgaucaucggggagaccuuccacugcuccuggaagaugcccaagagcgagguggccuccagcgucuucuccagcuccagcacccagggcgugacgaaccacgcgccccuguccggggagagccugacccaggugggcuccgacugcuacaccguccgcuucguggccgagcaggucagccaccacccgcccgugagcggcuucuacgccgagugcaccgagcgcaagaugugcgugaacgcccacgucuggacgaaguccaaguuccucgggaugagcaucggcgugaccauggugggggagggcauccugucccugcucgagcacggggaggaguacaccuucagccugcccugcgcguacgcccgguccauccugaccguccccuggguggagcugggcggcaaggugagcgucaacugcgccaagacgggguacuccgccagcaucaccuuccacaccaagcccuucuacggcgggaagcuccaccgcgugaccgccgaggugaagcacaacaucacgaacaccgucgugugccgggugcagggcgaguggaacuccguccuggaguucaccuacagcaacggcgagaccaaguacguggaccugaccaagcucgcggugacgaagaagcgcguccggccgcuggagaagcaggaccccuucgagucccgccggcuguggaagaacgugaccgacagccuccgcgaguccgagaucgacaaggccaccgagcacaagcacacccuggaggagcggcagcgcacggaggagcggcaccgcaccgagaccgggacccccuggaagacgaaguacuucaucaaggagggcgacggguggguguaccacaagccgcuguggaagaucauccccaccacccagcccgccgaguga

SEQ ID NO: 34113 - RNA, 1314 nt, Artificial Sequence
  derived and/or modified sequence opt1 from OSBPL1A__Homo_sapiens__NP_060500
augagcgaggagaaggacugcggcgggggcgacgcccuguccaacgggaucaagaagcaccgcaccagccuccccuccccgauguucagccggaacgacuucuccaucuggagcauccugcgcaagugcaucggcauggagcuguccaagaucaccaugcccgugaucuucaacgagccccucagcuuccugcagcggcugacggaguacauggagcacaccuaccucauccacaaggccuccagccuguccgaccccgucgagcgcaugcagugcguggcggccuucgccgugagcgccgucgccucccagugggagcggaccgggaagccguucaacccccugcucggcgagaccuacgagcuggugcgcgacgaccugggcuuccggcucaucagcgagcaggucucccaccacccgcccaucagcgcguuccacgccgaggggcugaacaacgacuucaucuuccacggcuccaucuaccccaagcugaaguucuggggcaagagcguggaggccgagcccaaggggacgaucacccucgagcugcuggagcacaacgaggccuacaccuggaccaaccccacgugcugcgugcacaacaucaucguggggaagcucuggaucgagcaguacggcaacgucgagaucaucaaccacaagaccggcgacaagugcgugcugaacuucaagcccugcgggcuguucggcaaggagcuccacaagguggagggguacauccaggacaaguccaagaagaagcugugcgcgcuguacggcaaguggaccgagugccucuacagcgucgacccggccaccuucgacgccuacaagaagaacgacaagaagaacacggaggagaagaagaacagcaagcagauguccaccagcgaggagcuggacgagaugcccgugcccgacuccgagagcguguucaucauccccggcuccguccugcucuggcgcaucgccccgcggccgcccaacagcgcccagauguacaacuucaccuccuucgcgauggugcugaacgagguggacaaggacauggagagcgucauccccaagaccgacugccgccugcggcccgacauccgcgccauggagaacggggagaucgaccaggccuccgaggagaagaagcggcucgaggagaagcagcgcgccgcccggaagaaccgcagcaaguccgaggaggacuggaagacgcggugguuccaccagggccccaaccccuacaacggggcgcaggacuggaucuacagcggcuccuacugggaccgcaacuacuucaaccugcccgacaucuacuga

SEQ ID NO: 34114 - RNA, 1113 nt, Artificial Sequence
  derived and/or modified sequence opt1 from OSBPL2__Homo_sapiens__NP_001265578
augcccaucgccuucaacgagccgcugagcuuccuccagcgcaucaccgaguacauggagcacguguaccugauccaccgggccuccugccagccccagccccuggagcgcaugcagagcgucgcggccuucgccguguccgccguggccagccagugggagcggaccggcaagcccuucaacccgcuccugggggagacguacgagcugauccgcgaggaccucggcuuccgguucaucuccgagcaggucagccaccacccgcccaucuccgcguuccacagcgaggggcugaaccacgacuuccuguuccacggcuccaucuaccccaagcucaaguucuggggcaagagcguggaggccgagccccgcggcaccaucacccuggagcugcucaagcacaacgaggccuacaccuggacgaacccgaccugcugcgugcacaacgucaucaucggcaagcuguggaucgagcaguacgggaccguggagauccugaaccaccggaccggccacaagugcgugcuccacuucaagcccugcgggcuguucggcaaggagcugcacaaggucgaggggcacauccaggacaagaacaagaagaagcuguucaugaucuacggcaaguggacggagugccuguggggcaucgaccccguguccuacgagagcuucaagaagcaggagcgccgcggggaccaccuccggaaggccaagcucgacgaggacuccggcaaggcggacagcgacguggccgacgacguccccguggcccaggagaccgugcaggucauccccggguccaagcugcuguggcggaucaacacccgcccgcccaacagcgcccagaucuggcccgcccggcgccgguccggcuggcgccggagccgcgagaagcacggcggguccggcccccggcgccggcagagcgggcgccgcggcgggagcacccaggcgaucacgcccacccucgggcccccgaccggcugcaugcaggggaucacccuguccggcaucagccccacggcccagaucuccaccgaggggcuggagggccccggggcccgggaccgccggcucacccgccuggacuuccuggaguggccccucuga

SEQ ID NO: 34115 - RNA, 2664 nt, Artificial Sequence
  derived and/or modified sequence opt1 from OSBPL3__Homo_sapiens__NP_056365
augaugagcgacgagaagaaccugggcgugucccagaagcucgucagccccucccgcagcaccuccagcugcuccagcaagcaggggucccggcaggacagcugggaggugguggagggccugcgcggggagaugaacuacacccaggagccgcccguccagaagggcuuccugcucaagaagcggaaguggccccugaagggguggcacaagcgcuucuucuaccuggacaagggcauccucaaguacgccaagucccagacggacaucgagcgggagaagcugcacggcugcaucgacguggggcugagcgugauguccgucaagaaguccagcaagugcaucgaccucgacaccgaggagcacaucuaccaccugaaggucaagagcgaggagguguucgacgaguggguguccaagcugcgccaccaccggauguaccgccagaacgagaucgccauguucccccacgaggugaaccacuucuucagcggcuccaccaucaccgacagcagcuccgggguguucgacagcaucuccagccggaagcgcuccagcaucuccaagcagaaccucuuccagacgggcagcaacgucuccuucagcugcgggggcgagacccgggugccgcuguggcugcaguccagcgaggacauggagaagugcuccaaggaccucgcgcacugccacgccuaccugguggagaugagccagcugcuccaguccauggacguccugcaccgcaccuacagcgcccccgccaucaacgccauccagggcggguccuucgagagccccaagaaggagaagcggucccaccgccgguggcgcagccgggcgaucggcaaggacgccaaggggacccuccaggugcccaagccguucagcggccccgugcgccugcacuccagcaaccccaaccuguccacgcuggacuucggcgaggagaagaacuacagcgacggguccgagaccagcuccgaguucagcaagaugcaggaggaccucugccacaucgcccacaaggucuacuucacccugcgguccgccuucaacaucaugagcgcggagcgcgagaagcugaagcagcucauggagcaggacgccuccagcucccccagcgcccaggugaucggccugaagaacgcccuguccagcgcccucgcgcagaacaccgaccugaaggagcggcugcgccgcauccacgccgagucccuccugcuggacagcccggccguggccaagagcggggacaaccucgccgaggagaacucccgggacgagaaccgcgcgcugguccaccagcugagcaacgagucccggcucagcaucacggacucccugagcgaguucuucgacgcccaggaggugcugcucucccccagcuccagcgagaacgagaucuccgacgacgacagcuacguguccgacaucagcgacaaccugucccuggacaaccucagcaacgaccuggacaacgagcgccagacccugggccccguccucgacuccgggcgggaggccaagagccgccggcggaccugccugcccgccccgugccccuccagcagcaacaucucccuguggaacauccugcgcaacaacaucggcaaggaccucagcaagguggccaugcccgucgagcugaacgagccccugaacacccuccagcgccugugcgaggagcuggaguacuccgagcuccuggacaaggcggcccagaucccgagcccccuggagcggaugguguacguggccgccuucgccaucuccgcguacgccagcuccuacuaccgcgccggcagcaagcccuucaaccccguccucggggagacguacgagugcauccgggaggacaagggcuuccaguucuucuccgagcaggucagccaccacccgcccaucuccgccugccacgcggagagccgcaacuucguguucuggcaggacgugcgguggaagaacaaguucugggggaaguccauggagaucgugcccaucggcaccacccacgugacccugcccgucuucggggaccacuucgaguggaacaaggugacgagcugcauccacaacauccuguccggccagcgcuggaucgagcacuacggcgagaucgugaucaagaaccuccacgacgacagcugcuacugcaaggucaacuucaucaaggccaaguacugguccaccaacgcccacgagaucgaggggaccguguucgaccggagcggcaaggccgugcaccgccuguucgggaaguggcacgaguccaucuacugcggcgggggcagcagcuccgccugcgucuggcgggcgaacccgaugcccaagggcuacgagcaguacuacagcuucacccaguucgcccuggagcucaacgagauggaccccuccagcaagucccugcugccgcccacggacacccgcuuccgccccgaccagcgguuccucgaggaggggaaccuggaggaggccgagauccagaagcagcgcaucgagcagcugcagcgggagcgccggcgcgugcucgaggagaaccacguggagcaccagccccgguucuuccgcaagagcgacgacgacuccugggucagcaacggcaccuaccuggagcugcggaaggaccucggguucuccaagcuggaccacccggugcugugguga
